United States Patent 12,624,385 (RIBOREGULATORS AND METHODS OF USE THEREOF) - sequence listing, part 14

SEQ ID NO: 222622 - DNA, 103 bp, Artificial Sequence
  Synthetic Polynucleotide
taatacgactcactatagggccctgctcccccctggctccttcccagcctaacagaggagaaggctgatgaggagccagaacctggcggcagcgcaaaagatg

SEQ ID NO: 222623 - DNA, 103 bp, Artificial Sequence
  Synthetic Polynucleotide
taatacgactcactatagggctggagtgagccctgctcccccctggctccaacagaggagaggagccatgggggagcagaacctggcggcagcgcaaaagatg

SEQ ID NO: 222624 - DNA, 103 bp, Artificial Sequence
  Synthetic Polynucleotide
taatacgactcactatagggcttcaggtggctggagtgagccctgctcccaacagaggagagggagcatggctcactccaacctggcggcagcgcaaaagatg

SEQ ID NO: 222625 - DNA, 103 bp, Artificial Sequence
  Synthetic Polynucleotide
taatacgactcactatagggtcaaatcatccattgcttgggacggcaaggaacagaggagaccttgcatgcccaagcaaaacctggcggcagcgcaaaagatg

SEQ ID NO: 222626 - DNA, 103 bp, Artificial Sequence
  Synthetic Polynucleotide
taatacgactcactatagggcctttttggacttcaggtggctggagtgagaacagaggagactcactatggccacctgaaacctggcggcagcgcaaaagatg

SEQ ID NO: 222627 - DNA, 103 bp, Artificial Sequence
  Synthetic Polynucleotide
taatacgactcactataggggtagactgaccctttttggacttcaggtggaacagaggagaccacctatggtccaaaaaaacctggcggcagcgcaaaagatg

SEQ ID NO: 222628 - DNA, 103 bp, Artificial Sequence
  Synthetic Polynucleotide
taatacgactcactatagggatggcgggaggtagactgaccctttttggaaacagaggagatccaaaatgggtcagtctaacctggcggcagcgcaaaagatg

SEQ ID NO: 222629 - DNA, 103 bp, Artificial Sequence
  Synthetic Polynucleotide
taatacgactcactatagggtgagttttttatggcgggaggtagactgacaacagaggagagtcagtatgcctcccgccaacctggcggcagcgcaaaagatg

SEQ ID NO: 222630 - DNA, 103 bp, Artificial Sequence
  Synthetic Polynucleotide
taatacgactcactataggggtcttgaacatgagttttttatggcgggagaacagaggagactcccgatgtaaaaaactaacctggcggcagcgcaaaagatg

SEQ ID NO: 222631 - DNA, 103 bp, Artificial Sequence
  Synthetic Polynucleotide
taatacgactcactatagggaggcccttctgtcttgaacatgagttttttaacagaggagaaaaaaaatgatgttcaagaacctggcggcagcgcaaaagatg

SEQ ID NO: 222632 - DNA, 103 bp, Artificial Sequence
  Synthetic Polynucleotide
taatacgactcactatagggagtctgagtcaggcccttctgtcttgaacaaacagaggagatgttcaatgcagaagggcaacctggcggcagcgcaaaagatg

SEQ ID NO: 222633 - DNA, 103 bp, Artificial Sequence
  Synthetic Polynucleotide
taatacgactcactatagggggggacagcatcaaatcatccattgcttggaacagaggagaccaagcatgggatgatttaacctggcggcagcgcaaaagatg

SEQ ID NO: 222634 - DNA, 103 bp, Artificial Sequence
  Synthetic Polynucleotide
taatacgactcactatagggaatatcgtccggggacagcatcaaatcatcaacagaggagagatgatatgatgctgtccaacctggcggcagcgcaaaagatg

SEQ ID NO: 222635 - DNA, 103 bp, Artificial Sequence
  Synthetic Polynucleotide
taatacgactcactatagggaccattgttcaatatcgtccggggacagcaaacagaggagatgctgtatgcggacgataaacctggcggcagcgcaaaagatg

SEQ ID NO: 222636 - DNA, 103 bp, Artificial Sequence
  Synthetic Polynucleotide
taatacgactcactatagggtcttcagtgaaccattgttcaatatcgtccaacagaggagaggacgaatgtgaacaatgaacctggcggcagcgcaaaagatg

SEQ ID NO: 222637 - DNA, 103 bp, Artificial Sequence
  Synthetic Polynucleotide
taatacgactcactatagggtggacctgggtcttcagtgaaccattgttcaacagaggagagaacaaatgttcactgaaaacctggcggcagcgcaaaagatg

SEQ ID NO: 222638 - DNA, 103 bp, Artificial Sequence
  Synthetic Polynucleotide
taatacgactcactataggggagcttcatctggacctgggtcttcagtgaaacagaggagatcactgatgacccaggtcaacctggcggcagcgcaaaagatg

SEQ ID NO: 222639 - DNA, 103 bp, Artificial Sequence
  Synthetic Polynucleotide
taatacgactcactatagggggcattctgggagcttcatctggacctgggaacagaggagacccaggatgagatgaagcaacctggcggcagcgcaaaagatg

SEQ ID NO: 222640 - DNA, 103 bp, Artificial Sequence
  Synthetic Polynucleotide
taatacgactcactatagggagcagcctctggcattctgggagcttcatcaacagaggagagatgaaatgcccagaatgaacctggcggcagcgcaaaagatg

SEQ ID NO: 222641 - DNA, 103 bp, Artificial Sequence
  Synthetic Polynucleotide
taatacgactcactataggggagggggctcgacgctaggatctgactgcgaacagaggagacgcagtatgatcctagcgaacctggcggcagcgcaaaagatg

SEQ ID NO: 222642 - DNA, 103 bp, Artificial Sequence
  Synthetic Polynucleotide
taatacgactcactatagggccacggggggagcagcctctggcattctggaacagaggagaccagaaatgcagaggctgaacctggcggcagcgcaaaagatg

SEQ ID NO: 222643 - DNA, 103 bp, Artificial Sequence
  Synthetic Polynucleotide
taatacgactcactatagggggtgcaggggccacggggggagcagcctctaacagaggagaagaggcatgtccccccgtaacctggcggcagcgcaaaagatg

SEQ ID NO: 222644 - DNA, 103 bp, Artificial Sequence
  Synthetic Polynucleotide
taatacgactcactatagggaggagctgctggtgcaggggccacggggggaacagaggagaccccccatggcccctgcaaacctggcggcagcgcaaaagatg

SEQ ID NO: 222645 - DNA, 103 bp, Artificial Sequence
  Synthetic Polynucleotide
taatacgactcactatagggccgccggtgtaggagctgctggtgcaggggaacagaggagacccctgatgcagcagctcaacctggcggcagcgcaaaagatg

SEQ ID NO: 222646 - DNA, 103 bp, Artificial Sequence
  Synthetic Polynucleotide
taatacgactcactatagggggtgcaggggccgccggtgtaggagctgctaacagaggagaagcagcatgtacaccggcaacctggcggcagcgcaaaagatg

SEQ ID NO: 222647 - DNA, 103 bp, Artificial Sequence
  Synthetic Polynucleotide
taatacgactcactatagggggagggggctggtgcaggggccgccggtgtaacagaggagaacaccgatggcccctgcaaacctggcggcagcgcaaaagatg

SEQ ID NO: 222648 - DNA, 103 bp, Artificial Sequence
  Synthetic Polynucleotide
taatacgactcactatagggacaggggccaggagggggctggtgcaggggaacagaggagacccctgatgcagccccctaacctggcggcagcgcaaaagatg

SEQ ID NO: 222649 - DNA, 103 bp, Artificial Sequence
  Synthetic Polynucleotide
taatacgactcactatagggacagaagatgacaggggccaggagggggctaacagaggagaagccccatgctggcccctaacctggcggcagcgcaaaagatg

SEQ ID NO: 222650 - DNA, 103 bp, Artificial Sequence
  Synthetic Polynucleotide
taatacgactcactatagggctgggaagggacagaagatgacaggggccaaacagaggagatggcccatgtcatcttctaacctggcggcagcgcaaaagatg

SEQ ID NO: 222651 - DNA, 103 bp, Artificial Sequence
  Synthetic Polynucleotide
taatacgactcactatagggggtaggttttctgggaagggacagaagatgaacagaggagacatcttatgtcccttcccaacctggcggcagcgcaaaagatg

SEQ ID NO: 222652 - DNA, 103 bp, Artificial Sequence
  Synthetic Polynucleotide
taatacgactcactatagggtcctgactcagagggggctcgacgctaggaaacagaggagatcctagatgcgagcccccaacctggcggcagcgcaaaagatg

SEQ ID NO: 222653 - DNA, 103 bp, Artificial Sequence
  Synthetic Polynucleotide
taatacgactcactatagggtagctgccctggtaggttttctgggaagggaacagaggagacccttcatggaaaacctaaacctggcggcagcgcaaaagatg

SEQ ID NO: 222654 - DNA, 103 bp, Artificial Sequence
  Synthetic Polynucleotide
taatacgactcactatagggacggaaaccgtagctgccctggtaggttttaacagaggagaaaaaccatgcagggcagcaacctggcggcagcgcaaaagatg

SEQ ID NO: 222655 - DNA, 103 bp, Artificial Sequence
  Synthetic Polynucleotide
taatacgactcactatagggagaagcccagacggaaaccgtagctgccctaacagaggagaagggcaatgacggtttccaacctggcggcagcgcaaaagatg

SEQ ID NO: 222656 - DNA, 103 bp, Artificial Sequence
  Synthetic Polynucleotide
taatacgactcactatagggccagaatgcaagaagcccagacggaaaccgaacagaggagacggtttatgtctgggcttaacctggcggcagcgcaaaagatg

SEQ ID NO: 222657 - DNA, 103 bp, Artificial Sequence
  Synthetic Polynucleotide
taatacgactcactatagggcttggctgtcccagaatgcaagaagcccagaacagaggagactgggcatgttgcattctaacctggcggcagcgcaaaagatg

SEQ ID NO: 222658 - DNA, 103 bp, Artificial Sequence
  Synthetic Polynucleotide
taatacgactcactatagggaagtcacagacttggctgtcccagaatgcaaacagaggagatgcattatgggacagccaaacctggcggcagcgcaaaagatg

SEQ ID NO: 222659 - DNA, 103 bp, Artificial Sequence
  Synthetic Polynucleotide
taatacgactcactataggggagtacgtgcaagtcacagacttggctgtcaacagaggagagacagcatggtctgtgacaacctggcggcagcgcaaaagatg

SEQ ID NO: 222660 - DNA, 103 bp, Artificial Sequence
  Synthetic Polynucleotide
taatacgactcactataggggagggcaggggagtacgtgcaagtcacagaaacagaggagatctgtgatgtgcacgtacaacctggcggcagcgcaaaagatg

SEQ ID NO: 222661 - DNA, 103 bp, Artificial Sequence
  Synthetic Polynucleotide
taatacgactcactatagggacatcttgttgagggcaggggagtacgtgcaacagaggagagcacgtatgcccctgcccaacctggcggcagcgcaaaagatg

SEQ ID NO: 222662 - DNA, 103 bp, Artificial Sequence
  Synthetic Polynucleotide
taatacgactcactatagggagttggcaaaacatcttgttgagggcagggaacagaggagaccctgcatgcaacaagataacctggcggcagcgcaaaagatg

SEQ ID NO: 222663 - DNA, 103 bp, Artificial Sequence
  Synthetic Polynucleotide
taatacgactcactatagggtgaaaatgtttcctgactcagagggggctcaacagaggagagagcccatgctgagtcagaacctggcggcagcgcaaaagatg

SEQ ID NO: 222664 - DNA, 103 bp, Artificial Sequence
  Synthetic Polynucleotide
taatacgactcactatagggggtcttggccagttggcaaaacatcttgttaacagaggagaaacaagatgttttgccaaaacctggcggcagcgcaaaagatg

SEQ ID NO: 222665 - DNA, 103 bp, Artificial Sequence
  Synthetic Polynucleotide
taatacgactcactataggggcacagggcaggtcttggccagttggcaaaaacagaggagatttgccatgtggccaagaaacctggcggcagcgcaaaagatg

SEQ ID NO: 222666 - DNA, 103 bp, Artificial Sequence
  Synthetic Polynucleotide
taatacgactcactatagggacccacagctgcacagggcaggtcttggccaacagaggagaggccaaatgctgccctgtaacctggcggcagcgcaaaagatg

SEQ ID NO: 222667 - DNA, 103 bp, Artificial Sequence
  Synthetic Polynucleotide
taatacgactcactatagggtgtggaatcaacccacagctgcacagggcaaacagaggagatgccctatgcagctgtggaacctggcggcagcgcaaaagatg

SEQ ID NO: 222668 - DNA, 103 bp, Artificial Sequence
  Synthetic Polynucleotide
taatacgactcactatagggcgggcgggggtgtggaatcaacccacagctaacagaggagaagctgtatgttgattccaaacctggcggcagcgcaaaagatg

SEQ ID NO: 222669 - DNA, 103 bp, Artificial Sequence
  Synthetic Polynucleotide
taatacgactcactatagggacgcgggtgccgggcgggggtgtggaatcaaacagaggagatgattcatgacccccgccaacctggcggcagcgcaaaagatg

SEQ ID NO: 222670 - DNA, 103 bp, Artificial Sequence
  Synthetic Polynucleotide
taatacgactcactatagggcatggcgcggacgcgggtgccgggcgggggaacagaggagacccccgatgggcacccgcaacctggcggcagcgcaaaagatg

SEQ ID NO: 222671 - DNA, 103 bp, Artificial Sequence
  Synthetic Polynucleotide
taatacgactcactatagggtgtagatggccatggcgcggacgcgggtgcaacagaggagagcacccatgtccgcgccaaacctggcggcagcgcaaaagatg

SEQ ID NO: 222672 - DNA, 103 bp, Artificial Sequence
  Synthetic Polynucleotide
taatacgactcactatagggtgtgactgcttgtagatggccatggcgcggaacagaggagaccgcgcatgggccatctaaacctggcggcagcgcaaaagatg

SEQ ID NO: 222673 - DNA, 103 bp, Artificial Sequence
  Synthetic Polynucleotide
taatacgactcactatagggcgtcatgtgctgtgactgcttgtagatggcaacagaggagagccatcatgaagcagtcaaacctggcggcagcgcaaaagatg

SEQ ID NO: 222674 - DNA, 103 bp, Artificial Sequence
  Synthetic Polynucleotide
taatacgactcactatagggtccataggtctgaaaatgtttcctgactcaaacagaggagatgagtcatgaaacattttaacctggcggcagcgcaaaagatg

SEQ ID NO: 222675 - DNA, 103 bp, Artificial Sequence
  Synthetic Polynucleotide
taatacgactcactatagggtcacaacctccgtcatgtgctgtgactgctaacagaggagaagcagtatgagcacatgaaacctggcggcagcgcaaaagatg

SEQ ID NO: 222676 - DNA, 103 bp, Artificial Sequence
  Synthetic Polynucleotide
taatacgactcactataggggggcagcgcctcacaacctccgtcatgtgcaacagaggagagcacatatgggaggttgtaacctggcggcagcgcaaaagatg

SEQ ID NO: 222677 - DNA, 103 bp, Artificial Sequence
  Synthetic Polynucleotide
taatacgactcactatagggctcatggtgggggcagcgcctcacaacctcaacagaggagagaggttatgaggcgctgcaacctggcggcagcgcaaaagatg

SEQ ID NO: 222678 - DNA, 103 bp, Artificial Sequence
  Synthetic Polynucleotide
taatacgactcactatagggctgagcagcgctcatggtgggggcagcgccaacagaggagaggcgctatgcccaccatgaacctggcggcagcgcaaaagatg

SEQ ID NO: 222679 - DNA, 103 bp, Artificial Sequence
  Synthetic Polynucleotide
taatacgactcactatagggccatcgctatctgagcagcgctcatggtggaacagaggagaccaccaatggcgctgctcaacctggcggcagcgcaaaagatg

SEQ ID NO: 222680 - DNA, 103 bp, Artificial Sequence
  Synthetic Polynucleotide
taatacgactcactatagggaggggccagaccatcgctatctgagcagcgaacagaggagacgctgcatggatagcgataacctggcggcagcgcaaaagatg

SEQ ID NO: 222681 - DNA, 103 bp, Artificial Sequence
  Synthetic Polynucleotide
taatacgactcactataggggatgctgaggaggggccagaccatcgctataacagaggagaatagcgatggtctggcccaacctggcggcagcgcaaaagatg

SEQ ID NO: 222682 - DNA, 103 bp, Artificial Sequence
  Synthetic Polynucleotide
taatacgactcactatagggactcggataagatgctgaggaggggccagaaacagaggagatctggcatgtcctcagcaaacctggcggcagcgcaaaagatg

SEQ ID NO: 222683 - DNA, 103 bp, Artificial Sequence
  Synthetic Polynucleotide
taatacgactcactatagggatttccttccactcggataagatgctgaggaacagaggagacctcagatgcttatccgaaacctggcggcagcgcaaaagatg

SEQ ID NO: 222684 - DNA, 103 bp, Artificial Sequence
  Synthetic Polynucleotide
taatacgactcactatagggccacacgcaaatttccttccactcggataaaacagaggagattatccatgtggaaggaaaacctggcggcagcgcaaaagatg

SEQ ID NO: 222685 - DNA, 103 bp, Artificial Sequence
  Synthetic Polynucleotide
taatacgactcactatagggggaagtagtttccataggtctgaaaatgttaacagaggagaaacattatgagacctatgaacctggcggcagcgcaaaagatg

SEQ ID NO: 222686 - DNA, 103 bp, Artificial Sequence
  Synthetic Polynucleotide
taatacgactcactatagggtccaaatactccacacgcaaatttccttccaacagaggagaggaaggatgtttgcgtgtaacctggcggcagcgcaaaagatg

SEQ ID NO: 222687 - DNA, 103 bp, Artificial Sequence
  Synthetic Polynucleotide
taatacgactcactataggggtttctgtcatccaaatactccacacgcaaaacagaggagattgcgtatggagtatttgaacctggcggcagcgcaaaagatg

SEQ ID NO: 222688 - DNA, 103 bp, Artificial Sequence
  Synthetic Polynucleotide
taatacgactcactataggggtcgaaaagtgtttctgtcatccaaatactaacagaggagaagtattatgatgacagaaaacctggcggcagcgcaaaagatg

SEQ ID NO: 222689 - DNA, 103 bp, Artificial Sequence
  Synthetic Polynucleotide
taatacgactcactatagggaccacactatgtcgaaaagtgtttctgtcaaacagaggagatgacagatgcacttttcgaacctggcggcagcgcaaaagatg

SEQ ID NO: 222690 - DNA, 103 bp, Artificial Sequence
  Synthetic Polynucleotide
taatacgactcactatagggatagggcaccaccacactatgtcgaaaagtaacagaggagaacttttatgcatagtgtgaacctggcggcagcgcaaaagatg

SEQ ID NO: 222691 - DNA, 103 bp, Artificial Sequence
  Synthetic Polynucleotide
taatacgactcactatagggcaggcggctcatagggcaccaccacactataacagaggagaatagtgatgtggtgccctaacctggcggcagcgcaaaagatg

SEQ ID NO: 222692 - DNA, 103 bp, Artificial Sequence
  Synthetic Polynucleotide
taatacgactcactataggggagccaacctcaggcggctcatagggcaccaacagaggagaggtgccatgtgagccgccaacctggcggcagcgcaaaagatg

SEQ ID NO: 222693 - DNA, 103 bp, Artificial Sequence
  Synthetic Polynucleotide
taatacgactcactatagggggtacagtcagagccaacctcaggcggctcaacagaggagagagccgatggaggttggcaacctggcggcagcgcaaaagatg

SEQ ID NO: 222694 - DNA, 103 bp, Artificial Sequence
  Synthetic Polynucleotide
taatacgactcactatagggagtggatggtggtacagtcagagccaacctaacagaggagaaggttgatgctgactgtaaacctggcggcagcgcaaaagatg

SEQ ID NO: 222695 - DNA, 103 bp, Artificial Sequence
  Synthetic Polynucleotide
taatacgactcactatagggatgtagttgtagtggatggtggtacagtcaaacagaggagatgactgatgcaccatccaaacctggcggcagcgcaaaagatg

SEQ ID NO: 222696 - DNA, 103 bp, Artificial Sequence
  Synthetic Polynucleotide
taatacgactcactataggggttgttttcaggaagtagtttccataggtcaacagaggagagacctaatgaaactacttaacctggcggcagcgcaaaagatg

SEQ ID NO: 222697 - DNA, 103 bp, Artificial Sequence
  Synthetic Polynucleotide
taatacgactcactatagggactgttacacatgtagttgtagtggatggtaacagaggagaaccatcatgtacaactacaacctggcggcagcgcaaaagatg

SEQ ID NO: 222698 - DNA, 103 bp, Artificial Sequence
  Synthetic Polynucleotide
taatacgactcactatagggccatgcaggaactgttacacatgtagttgtaacagaggagaacaactatgtgtgtaacaaacctggcggcagcgcaaaagatg

SEQ ID NO: 222699 - DNA, 103 bp, Artificial Sequence
  Synthetic Polynucleotide
taatacgactcactatagggttcatgccgcccatgcaggaactgttacacaacagaggagagtgtaaatgttcctgcataacctggcggcagcgcaaaagatg

SEQ ID NO: 222700 - DNA, 103 bp, Artificial Sequence
  Synthetic Polynucleotide
taatacgactcactataggggggcctccggttcatgccgcccatgcaggaaacagaggagatcctgcatgggcggcatgaacctggcggcagcgcaaaagatg

SEQ ID NO: 222701 - DNA, 103 bp, Artificial Sequence
  Synthetic Polynucleotide
taatacgactcactatagggtggtgaggatgggcctccggttcatgccgcaacagaggagagcggcaatgaccggaggcaacctggcggcagcgcaaaagatg

SEQ ID NO: 222702 - DNA, 103 bp, Artificial Sequence
  Synthetic Polynucleotide
taatacgactcactatagggagtgtgatgatggtgaggatgggcctccggaacagaggagaccggagatgcatcctcacaacctggcggcagcgcaaaagatg

SEQ ID NO: 222703 - DNA, 103 bp, Artificial Sequence
  Synthetic Polynucleotide
taatacgactcactatagggggagtcttccagtgtgatgatggtgaggataacagaggagaatcctcatgatcatcacaaacctggcggcagcgcaaaagatg

SEQ ID NO: 222704 - DNA, 103 bp, Artificial Sequence
  Synthetic Polynucleotide
taatacgactcactataggggattaccactggagtcttccagtgtgatgaaacagaggagatcatcaatgtggaagactaacctggcggcagcgcaaaagatg

SEQ ID NO: 222705 - DNA, 103 bp, Artificial Sequence
  Synthetic Polynucleotide
taatacgactcactatagggcgtcccagtagattaccactggagtcttccaacagaggagaggaagaatgcagtggtaaaacctggcggcagcgcaaaagatg

SEQ ID NO: 222706 - DNA, 103 bp, Artificial Sequence
  Synthetic Polynucleotide
taatacgactcactatagggaaagctgttccgtcccagtagattaccactaacagaggagaagtggtatgctactgggaaacctggcggcagcgcaaaagatg

SEQ ID NO: 222707 - DNA, 103 bp, Artificial Sequence
  Synthetic Polynucleotide
taatacgactcactataggggggacagaacgttgttttcaggaagtagttaacagaggagaaactacatgctgaaaacaaacctggcggcagcgcaaaagatg

SEQ ID NO: 222708 - DNA, 103 bp, Artificial Sequence
  Synthetic Polynucleotide
taatacgactcactatagggcacgcacctcaaagctgttccgtcccagtaaacagaggagatactggatgggaacagctaacctggcggcagcgcaaaagatg

SEQ ID NO: 222709 - DNA, 103 bp, Artificial Sequence
  Synthetic Polynucleotide
taatacgactcactatagggcaggcacaaacacgcacctcaaagctgttcaacagaggagagaacagatgtgaggtgcgaacctggcggcagcgcaaaagatg

SEQ ID NO: 222710 - DNA, 103 bp, Artificial Sequence
  Synthetic Polynucleotide
taatacgactcactatagggtctcccaggacaggcacaaacacgcacctcaacagaggagagaggtgatggtttgtgccaacctggcggcagcgcaaaagatg

SEQ ID NO: 222711 - DNA, 103 bp, Artificial Sequence
  Synthetic Polynucleotide
taatacgactcactatagggtgcgccggtctctcccaggacaggcacaaaaacagaggagatttgtgatggtcctgggaaacctggcggcagcgcaaaagatg

SEQ ID NO: 222712 - DNA, 103 bp, Artificial Sequence
  Synthetic Polynucleotide
taatacgactcactatagggtcttcctctgtgcgccggtctctcccaggaaacagaggagatcctggatgagaccggcgaacctggcggcagcgcaaaagatg

SEQ ID NO: 222713 - DNA, 103 bp, Artificial Sequence
  Synthetic Polynucleotide
taatacgactcactataggggcggagattctcttcctctgtgcgccggtcaacagaggagagaccggatgacagaggaaaacctggcggcagcgcaaaagatg

SEQ ID NO: 222714 - DNA, 103 bp, Artificial Sequence
  Synthetic Polynucleotide
taatacgactcactatagggcccctttcttgcggagattctcttcctctgaacagaggagacagaggatgagaatctccaacctggcggcagcgcaaaagatg

SEQ ID NO: 222715 - DNA, 103 bp, Artificial Sequence
  Synthetic Polynucleotide
taatacgactcactatagggtggtgaggctcccctttcttgcggagattcaacagaggagagaatctatgcaagaaaggaacctggcggcagcgcaaaagatg

SEQ ID NO: 222716 - DNA, 103 bp, Artificial Sequence
  Synthetic Polynucleotide
taatacgactcactataggggggcagctcgtggtgaggctcccctttcttaacagaggagaaagaaaatggagcctcacaacctggcggcagcgcaaaagatg

SEQ ID NO: 222717 - DNA, 103 bp, Artificial Sequence
  Synthetic Polynucleotide
taatacgactcactatagggtgctccctgggggcagctcgtggtgaggctaacagaggagaagcctcatgacgagctgcaacctggcggcagcgcaaaagatg

SEQ ID NO: 222718 - DNA, 103 bp, Artificial Sequence
  Synthetic Polynucleotide
taatacgactcactataggggacggcaagggggacagaacgttgttttcaaacagaggagatgaaaaatgcgttctgtcaacctggcggcagcgcaaaagatg

SEQ ID NO: 222719 - DNA, 103 bp, Artificial Sequence
  Synthetic Polynucleotide
taatacgactcactataggggctcgcttagtgctccctgggggcagctcgaacagaggagacgagctatgcccagggagaacctggcggcagcgcaaaagatg

SEQ ID NO: 222720 - DNA, 103 bp, Artificial Sequence
  Synthetic Polynucleotide
taatacgactcactataggggttgggcagtgctcgcttagtgctccctggaacagaggagaccagggatgactaagcgaaacctggcggcagcgcaaaagatg

SEQ ID NO: 222721 - DNA, 103 bp, Artificial Sequence
  Synthetic Polynucleotide
taatacgactcactatagggagctggtgttgttgggcagtgctcgcttagaacagaggagactaagcatgcactgcccaaacctggcggcagcgcaaaagatg

SEQ ID NO: 222722 - DNA, 103 bp, Artificial Sequence
  Synthetic Polynucleotide
taatacgactcactatagggtggggagaggagctggtgttgttgggcagtaacagaggagaactgccatgcaacaccagaacctggcggcagcgcaaaagatg

SEQ ID NO: 222723 - DNA, 103 bp, Artificial Sequence
  Synthetic Polynucleotide
taatacgactcactatagggcttctttggctggggagaggagctggtgttaacagaggagaaacaccatgtcctctcccaacctggcggcagcgcaaaagatg

SEQ ID NO: 222724 - DNA, 103 bp, Artificial Sequence
  Synthetic Polynucleotide
taatacgactcactatagggccagtggtttcttctttggctggggagaggaacagaggagacctctcatgagccaaagaaacctggcggcagcgcaaaagatg

SEQ ID NO: 222725 - DNA, 103 bp, Artificial Sequence
  Synthetic Polynucleotide
taatacgactcactatagggtattctccatccagtggtttcttctttggcaacagaggagagccaaaatggaaaccactaacctggcggcagcgcaaaagatg

SEQ ID NO: 222726 - DNA, 103 bp, Artificial Sequence
  Synthetic Polynucleotide
taatacgactcactatagggaagggtgaaatattctccatccagtggtttaacagaggagaaaaccaatggatggagaaaacctggcggcagcgcaaaagatg

SEQ ID NO: 222727 - DNA, 103 bp, Artificial Sequence
  Synthetic Polynucleotide
taatacgactcactatagggcacggatctgaagggtgaaatattctccataacagaggagaatggagatgatttcacccaacctggcggcagcgcaaaagatg

SEQ ID NO: 222728 - DNA, 103 bp, Artificial Sequence
  Synthetic Polynucleotide
taatacgactcactatagggcgctcacgcccacggatctgaagggtgaaaaacagaggagatttcacatgtcagatccgaacctggcggcagcgcaaaagatg

SEQ ID NO: 222729 - DNA, 103 bp, Artificial Sequence
  Synthetic Polynucleotide
taatacgactcactatagggggtggcacaccgtgaagtttcaaaattcataacagaggagaatgaatatggaaacttcaaacctggcggcagcgcaaaagatg

SEQ ID NO: 222730 - DNA, 103 bp, Artificial Sequence
  Synthetic Polynucleotide
taatacgactcactatagggcatggtggatcggtaataactttctttccaaacagaggagatggaaaatgagttattacaacctggcggcagcgcaaaagatg

SEQ ID NO: 222731 - DNA, 103 bp, Artificial Sequence
  Synthetic Polynucleotide
taatacgactcactatagggaaagcagcgtcggcccaggacttgcccatcaacagaggagagatgggatggtcctgggcaacctggcggcagcgcaaaagatg

SEQ ID NO: 222732 - DNA, 103 bp, Artificial Sequence
  Synthetic Polynucleotide
taatacgactcactatagggtccgggcctcaaagcagcgtcggcccaggaaacagaggagatcctggatggacgctgctaacctggcggcagcgcaaaagatg

SEQ ID NO: 222733 - DNA, 103 bp, Artificial Sequence
  Synthetic Polynucleotide
taatacgactcactatagggcaagcacagatccgggcctcaaagcagcgtaacagaggagaacgctgatgtgaggcccgaacctggcggcagcgcaaaagatg

SEQ ID NO: 222734 - DNA, 103 bp, Artificial Sequence
  Synthetic Polynucleotide
taatacgactcactatagggtcttcctgggcaagcacagatccgggcctcaacagaggagagaggccatgatctgtgctaacctggcggcagcgcaaaagatg

SEQ ID NO: 222735 - DNA, 103 bp, Artificial Sequence
  Synthetic Polynucleotide
taatacgactcactatagggccttcctgtctcttcctgggcaagcacagaaacagaggagatctgtgatggcccaggaaaacctggcggcagcgcaaaagatg

SEQ ID NO: 222736 - DNA, 103 bp, Artificial Sequence
  Synthetic Polynucleotide
taatacgactcactatagggtcttcatccgccttcctgtctcttcctgggaacagaggagacccaggatgagacaggaaaacctggcggcagcgcaaaagatg

SEQ ID NO: 222737 - DNA, 103 bp, Artificial Sequence
  Synthetic Polynucleotide
taatacgactcactatagggtctgatgctatcttcatccgccttcctgtcaacagaggagagacaggatggcggatgaaaacctggcggcagcgcaaaagatg

SEQ ID NO: 222738 - DNA, 103 bp, Artificial Sequence
  Synthetic Polynucleotide
taatacgactcactatagggcttgctgctttctgatgctatcttcatccgaacagaggagacggatgatgatagcatcaaacctggcggcagcgcaaaagatg

SEQ ID NO: 222739 - DNA, 103 bp, Artificial Sequence
  Synthetic Polynucleotide
taatacgactcactatagggctgtccgaaacttgctgctttctgatgctaaacagaggagatagcatatgaaagcagcaaacctggcggcagcgcaaaagatg

SEQ ID NO: 222740 - DNA, 103 bp, Artificial Sequence
  Synthetic Polynucleotide
taatacgactcactataggggttctttgtactgtccgaaacttgctgcttaacagaggagaaagcagatggtttcggacaacctggcggcagcgcaaaagatg

SEQ ID NO: 222741 - DNA, 103 bp, Artificial Sequence
  Synthetic Polynucleotide
taatacgactcactatagggtgctctgggacatggtggatcggtaataacaacagaggagagttattatggatccaccaaacctggcggcagcgcaaaagatg

SEQ ID NO: 222742 - DNA, 103 bp, Artificial Sequence
  Synthetic Polynucleotide
taatacgactcactatagggtaccatcaccgttctttgtactgtccgaaaaacagaggagatttcggatggtacaaagaaacctggcggcagcgcaaaagatg

SEQ ID NO: 222743 - DNA, 103 bp, Artificial Sequence
  Synthetic Polynucleotide
taatacgactcactataggggggcgcttcgtaccatcaccgttctttgtaaacagaggagatacaaaatgcggtgatggaacctggcggcagcgcaaaagatg

SEQ ID NO: 222744 - DNA, 103 bp, Artificial Sequence
  Synthetic Polynucleotide
taatacgactcactatagggctgacgaaacgggcgcttcgtaccatcaccaacagaggagaggtgatatgacgaagcgcaacctggcggcagcgcaaaagatg

SEQ ID NO: 222745 - DNA, 103 bp, Artificial Sequence
  Synthetic Polynucleotide
taatacgactcactatagggcatgtgtgttctgacgaaacgggcgcttcgaacagaggagacgaagcatgcgtttcgtcaacctggcggcagcgcaaaagatg

SEQ ID NO: 222746 - DNA, 103 bp, Artificial Sequence
  Synthetic Polynucleotide
taatacgactcactatagggatctggataccatgtgtgttctgacgaaacaacagaggagagtttcgatggaacacacaaacctggcggcagcgcaaaagatg

SEQ ID NO: 222747 - DNA, 103 bp, Artificial Sequence
  Synthetic Polynucleotide
taatacgactcactataggggatggatgtcatctggataccatgtgtgttaacagaggagaaacacaatgggtatccagaacctggcggcagcgcaaaagatg

SEQ ID NO: 222748 - DNA, 103 bp, Artificial Sequence
  Synthetic Polynucleotide
taatacgactcactatagggttcgtttcttgatggatgtcatctggatacaacagaggagagtatccatgtgacatccaaacctggcggcagcgcaaaagatg

SEQ ID NO: 222749 - DNA, 103 bp, Artificial Sequence
  Synthetic Polynucleotide
taatacgactcactatagggtctggggatcttcgtttcttgatggatgtcaacagaggagagacatcatgcaagaaacgaacctggcggcagcgcaaaagatg

SEQ ID NO: 222750 - DNA, 103 bp, Artificial Sequence
  Synthetic Polynucleotide
taatacgactcactatagggcagttcatcatctggggatcttcgtttcttaacagaggagaaagaaaatgagatccccaaacctggcggcagcgcaaaagatg

SEQ ID NO: 222751 - DNA, 103 bp, Artificial Sequence
  Synthetic Polynucleotide
taatacgactcactataggggtaagtataacagttcatcatctggggatcaacagaggagagatcccatgatgatgaacaacctggcggcagcgcaaaagatg

SEQ ID NO: 222752 - DNA, 103 bp, Artificial Sequence
  Synthetic Polynucleotide
taatacgactcactatagggtttgtctgtgtgctctgggacatggtggataacagaggagaatccacatggtcccagagaacctggcggcagcgcaaaagatg

SEQ ID NO: 222753 - DNA, 103 bp, Artificial Sequence
  Synthetic Polynucleotide
taatacgactcactatagggcccctcactggtaagtataacagttcatcaaacagaggagatgatgaatggttatacttaacctggcggcagcgcaaaagatg

SEQ ID NO: 222754 - DNA, 103 bp, Artificial Sequence
  Synthetic Polynucleotide
taatacgactcactatagggagtctcacggcccctcactggtaagtataaaacagaggagattatacatgccagtgaggaacctggcggcagcgcaaaagatg

SEQ ID NO: 222755 - DNA, 103 bp, Artificial Sequence
  Synthetic Polynucleotide
taatacgactcactataggggcatttcataagtctcacggcccctcactgaacagaggagacagtgaatggccgtgagaaacctggcggcagcgcaaaagatg

SEQ ID NO: 222756 - DNA, 103 bp, Artificial Sequence
  Synthetic Polynucleotide
taatacgactcactatagggatcttcaacagcatttcataagtctcacggaacagaggagaccgtgaatgttatgaaataacctggcggcagcgcaaaagatg

SEQ ID NO: 222757 - DNA, 103 bp, Artificial Sequence
  Synthetic Polynucleotide
taatacgactcactatagggggactctttgatcttcaacagcatttcataaacagaggagatatgaaatgctgttgaagaacctggcggcagcgcaaaagatg

SEQ ID NO: 222758 - DNA, 103 bp, Artificial Sequence
  Synthetic Polynucleotide
taatacgactcactatagggtgagttccagggactctttgatcttcaacaaacagaggagatgttgaatgtcaaagagtaacctggcggcagcgcaaaagatg

SEQ ID NO: 222759 - DNA, 103 bp, Artificial Sequence
  Synthetic Polynucleotide
taatacgactcactatagggaggtactgcatgagttccagggactctttgaacagaggagacaaagaatgcctggaactaacctggcggcagcgcaaaagatg

SEQ ID NO: 222760 - DNA, 103 bp, Artificial Sequence
  Synthetic Polynucleotide
taatacgactcactataggggtgctgaggaaggtactgcatgagttccagaacagaggagactggaaatgatgcagtacaacctggcggcagcgcaaaagatg

SEQ ID NO: 222761 - DNA, 103 bp, Artificial Sequence
  Synthetic Polynucleotide
taatacgactcactatagggtttcaattgtgtgctgaggaaggtactgcaaacagaggagatgcagtatgttcctcagcaacctggcggcagcgcaaaagatg

SEQ ID NO: 222762 - DNA, 103 bp, Artificial Sequence
  Synthetic Polynucleotide
taatacgactcactatagggtgcctgtacgtttcaattgtgtgctgaggaaacagaggagatcctcaatgcacaattgaaacctggcggcagcgcaaaagatg

SEQ ID NO: 222763 - DNA, 103 bp, Artificial Sequence
  Synthetic Polynucleotide
taatacgactcactataggggaggaattcatttgtctgtgtgctctgggaaacagaggagatcccagatgacacagacaaacctggcggcagcgcaaaagatg

SEQ ID NO: 222764 - DNA, 103 bp, Artificial Sequence
  Synthetic Polynucleotide
taatacgactcactatagggctgttgctgttgcctgtacgtttcaattgtaacagaggagaacaattatgacgtacaggaacctggcggcagcgcaaaagatg

SEQ ID NO: 222765 - DNA, 103 bp, Artificial Sequence
  Synthetic Polynucleotide
taatacgactcactatagggggtgctgctgctgttgctgttgcctgtacgaacagaggagacgtacaatgaacagcaacaacctggcggcagcgcaaaagatg

SEQ ID NO: 222766 - DNA, 103 bp, Artificial Sequence
  Synthetic Polynucleotide
taatacgactcactatagggagtaagtgctggtgctgctgctgttgctgtaacagaggagaacagcaatggcagcagcaaacctggcggcagcgcaaaagatg

SEQ ID NO: 222767 - DNA, 103 bp, Artificial Sequence
  Synthetic Polynucleotide
taatacgactcactatagggctgtttctgaagtaagtgctggtgctgctgaacagaggagacagcagatgcagcacttaaacctggcggcagcgcaaaagatg

SEQ ID NO: 222768 - DNA, 103 bp, Artificial Sequence
  Synthetic Polynucleotide
taatacgactcactataggggtattgaggtctgtttctgaagtaagtgctaacagaggagaagcactatgttcagaaacaacctggcggcagcgcaaaagatg

SEQ ID NO: 222769 - DNA, 103 bp, Artificial Sequence
  Synthetic Polynucleotide
taatacgactcactataggggatggagactgtattgaggtctgtttctgaaacagaggagatcagaaatggacctcaataacctggcggcagcgcaaaagatg

SEQ ID NO: 222770 - DNA, 103 bp, Artificial Sequence
  Synthetic Polynucleotide
taatacgactcactatagggaccatatgaagatggagactgtattgaggtaacagaggagaacctcaatgcagtctccaaacctggcggcagcgcaaaagatg

SEQ ID NO: 222771 - DNA, 103 bp, Artificial Sequence
  Synthetic Polynucleotide
taatacgactcactataggggggagctgttaccatatgaagatggagactaacagaggagaagtctcatgcttcatatgaacctggcggcagcgcaaaagatg

SEQ ID NO: 222772 - DNA, 103 bp, Artificial Sequence
  Synthetic Polynucleotide
taatacgactcactatagggttcagaggtggggagctgttaccatatgaaaacagaggagattcataatgtaacagctcaacctggcggcagcgcaaaagatg

SEQ ID NO: 222773 - DNA, 103 bp, Artificial Sequence
  Synthetic Polynucleotide
taatacgactcactataggggttcattttgttcagaggtggggagctgttaacagaggagaaacagcatgccacctctgaacctggcggcagcgcaaaagatg

SEQ ID NO: 222774 - DNA, 103 bp, Artificial Sequence
  Synthetic Polynucleotide
taatacgactcactatagggcctctggactgaggaattcatttgtctgtgaacagaggagacacagaatgatgaattccaacctggcggcagcgcaaaagatg

SEQ ID NO: 222775 - DNA, 103 bp, Artificial Sequence
  Synthetic Polynucleotide
taatacgactcactatagggtgttcatgctgttcattttgttcagaggtgaacagaggagacacctcatgacaaaatgaaacctggcggcagcgcaaaagatg

SEQ ID NO: 222776 - DNA, 103 bp, Artificial Sequence
  Synthetic Polynucleotide
taatacgactcactataggggaaggcagcttgttcatgctgttcattttgaacagaggagacaaaatatgcagcatgaaaacctggcggcagcgcaaaagatg

SEQ ID NO: 222777 - DNA, 103 bp, Artificial Sequence
  Synthetic Polynucleotide
taatacgactcactatagggctggctcacagaaggcagcttgttcatgctaacagaggagaagcatgatgaagctgcctaacctggcggcagcgcaaaagatg

SEQ ID NO: 222778 - DNA, 103 bp, Artificial Sequence
  Synthetic Polynucleotide
taatacgactcactatagggggttgataagctggctcacagaaggcagctaacagaggagaagctgcatgctgtgagccaacctggcggcagcgcaaaagatg

SEQ ID NO: 222779 - DNA, 103 bp, Artificial Sequence
  Synthetic Polynucleotide
taatacgactcactatagggcgctgctgagggttgataagctggctcacaaacagaggagatgtgagatggcttatcaaaacctggcggcagcgcaaaagatg

SEQ ID NO: 222780 - DNA, 103 bp, Artificial Sequence
  Synthetic Polynucleotide
taatacgactcactataggggagggcgttgcgctgctgagggttgataagaacagaggagacttatcatgcctcagcagaacctggcggcagcgcaaaagatg

SEQ ID NO: 222781 - DNA, 103 bp, Artificial Sequence
  Synthetic Polynucleotide
taatacgactcactatagggttgtaggagtgagggcgttgcgctgctgagaacagaggagactcagcatggcaacgcccaacctggcggcagcgcaaaagatg

SEQ ID NO: 222782 - DNA, 103 bp, Artificial Sequence
  Synthetic Polynucleotide
taatacgactcactatagggtcaggaatggttgtaggagtgagggcgttgaacagaggagacaacgcatgcactcctacaacctggcggcagcgcaaaagatg

SEQ ID NO: 222783 - DNA, 103 bp, Artificial Sequence
  Synthetic Polynucleotide
taatacgactcactatagggtcccatgccatcaggaatggttgtaggagtaacagaggagaactcctatgaccattcctaacctggcggcagcgcaaaagatg

SEQ ID NO: 222784 - DNA, 103 bp, Artificial Sequence
  Synthetic Polynucleotide
taatacgactcactataggggaatgttggctcccatgccatcaggaatggaacagaggagaccattcatgatggcatggaacctggcggcagcgcaaaagatg

SEQ ID NO: 222785 - DNA, 103 bp, Artificial Sequence
  Synthetic Polynucleotide
taatacgactcactatagggtgctggaaaacctctggactgaggaattcaaacagaggagatgaattatgcagtccagaaacctggcggcagcgcaaaagatg

SEQ ID NO: 222786 - DNA, 103 bp, Artificial Sequence
  Synthetic Polynucleotide
taatacgactcactatagggcccatcatgggaatgttggctcccatgccaaacagaggagatggcatatgagccaacataacctggcggcagcgcaaaagatg

SEQ ID NO: 222787 - DNA, 103 bp, Artificial Sequence
  Synthetic Polynucleotide
taatacgactcactatagggcatgtgggtgcccatcatgggaatgttggcaacagaggagagccaacatgcccatgatgaacctggcggcagcgcaaaagatg

SEQ ID NO: 222788 - DNA, 103 bp, Artificial Sequence
  Synthetic Polynucleotide
taatacgactcactatagggcagccattggcatgtgggtgcccatcatggaacagaggagaccatgaatggcacccacaaacctggcggcagcgcaaaagatg

SEQ ID NO: 222789 - DNA, 103 bp, Artificial Sequence
  Synthetic Polynucleotide
taatacgactcactatagggttcatgtctccagccattggcatgtgggtgaacagaggagacacccaatggccaatggcaacctggcggcagcgcaaaagatg

SEQ ID NO: 222790 - DNA, 103 bp, Artificial Sequence
  Synthetic Polynucleotide
taatacgactcactataggggctgagtccattcatgtctccagccattggaacagaggagaccaatgatgggagacatgaacctggcggcagcgcaaaagatg

SEQ ID NO: 222791 - DNA, 103 bp, Artificial Sequence
  Synthetic Polynucleotide
taatacgactcactatagggcctgggtggggctgagtccattcatgtctcaacagaggagagagacaatgatggactcaaacctggcggcagcgcaaaagatg

SEQ ID NO: 222792 - DNA, 103 bp, Artificial Sequence
  Synthetic Polynucleotide
taatacgactcactatagggggagggagtgcctgggtggggctgagtccaaacagaggagatggactatgccccacccaaacctggcggcagcgcaaaagatg

SEQ ID NO: 222793 - DNA, 103 bp, Artificial Sequence
  Synthetic Polynucleotide
taatacgactcactatagggggagagtgggggagggagtgcctgggtgggaacagaggagacccaccatggcactccctaacctggcggcagcgcaaaagatg

SEQ ID NO: 222794 - DNA, 103 bp, Artificial Sequence
  Synthetic Polynucleotide
taatacgactcactatagggtggatggcatggagagtgggggagggagtgaacagaggagacactccatgccccactctaacctggcggcagcgcaaaagatg

SEQ ID NO: 222795 - DNA, 103 bp, Artificial Sequence
  Synthetic Polynucleotide
taatacgactcactatagggcagtgggaggtggatggcatggagagtgggaacagaggagacccactatgcatgccatcaacctggcggcagcgcaaaagatg

SEQ ID NO: 222796 - DNA, 103 bp, Artificial Sequence
  Synthetic Polynucleotide
taatacgactcactatagggatcccagatatgctggaaaacctctggactaacagaggagaagtccaatggttttccagaacctggcggcagcgcaaaagatg

SEQ ID NO: 222797 - DNA, 103 bp, Artificial Sequence
  Synthetic Polynucleotide
taatacgactcactatagggtgggggtgtgcagtgggaggtggatggcataacagaggagaatgccaatgacctcccacaacctggcggcagcgcaaaagatg

SEQ ID NO: 222798 - DNA, 103 bp, Artificial Sequence
  Synthetic Polynucleotide
taatacgactcactataggggatacggaggtgggggtgtgcagtgggaggaacagaggagacctcccatggcacaccccaacctggcggcagcgcaaaagatg

SEQ ID NO: 222799 - DNA, 103 bp, Artificial Sequence
  Synthetic Polynucleotide
taatacgactcactatagggcaatctgtgggatacggaggtgggggtgtgaacagaggagacacaccatgacctccgtaaacctggcggcagcgcaaaagatg

SEQ ID NO: 222800 - DNA, 103 bp, Artificial Sequence
  Synthetic Polynucleotide
taatacgactcactataggggacaatgctgcaatctgtgggatacggaggaacagaggagacctccgatgcccacagataacctggcggcagcgcaaaagatg

SEQ ID NO: 222801 - DNA, 103 bp, Artificial Sequence
  Synthetic Polynucleotide
taatacgactcactatagggctaagaaactgacaatgctgcaatctgtggaacagaggagaccacagatggcagcattgaacctggcggcagcgcaaaagatg

SEQ ID NO: 222802 - DNA, 103 bp, Artificial Sequence
  Synthetic Polynucleotide
taatacgactcactatagggcccaacctcgctaagaaactgacaatgctgaacagaggagacagcatatgcagtttcttaacctggcggcagcgcaaaagatg

SEQ ID NO: 222803 - DNA, 103 bp, Artificial Sequence
  Synthetic Polynucleotide
taatacgactcactatagggtgatgaacagcccaacctcgctaagaaactaacagaggagaagtttcatggcgaggttgaacctggcggcagcgcaaaagatg

SEQ ID NO: 222804 - DNA, 103 bp, Artificial Sequence
  Synthetic Polynucleotide
taatacgactcactatagggagtccagacatgatgaacagcccaacctcgaacagaggagacgaggtatggctgttcataacctggcggcagcgcaaaagatg

SEQ ID NO: 222805 - DNA, 103 bp, Artificial Sequence
  Synthetic Polynucleotide
taatacgactcactataggggtcgtgaaatagtccagacatgatgaacagaacagaggagactgttcatgatgtctggaaacctggcggcagcgcaaaagatg

SEQ ID NO: 222806 - DNA, 103 bp, Artificial Sequence
  Synthetic Polynucleotide
taatacgactcactatagggcagcccctgggtcgtgaaatagtccagacaaacagaggagatgtctgatgtatttcacgaacctggcggcagcgcaaaagatg

SEQ ID NO: 222807 - DNA, 103 bp, Artificial Sequence
  Synthetic Polynucleotide
taatacgactcactataggggttccagaaaatcccagatatgctggaaaaaacagaggagattttccatgatatctgggaacctggcggcagcgcaaaagatg

SEQ ID NO: 222808 - DNA, 103 bp, Artificial Sequence
  Synthetic Polynucleotide
taatacgactcactatagggagatggtggtcagcccctgggtcgtgaaataacagaggagaatttcaatgcccaggggcaacctggcggcagcgcaaaagatg

SEQ ID NO: 222809 - DNA, 103 bp, Artificial Sequence
  Synthetic Polynucleotide
taatacgactcactatagggtcaatctgatagatggtggtcagcccctggaacagaggagaccagggatggaccaccataacctggcggcagcgcaaaagatg

SEQ ID NO: 222810 - DNA, 103 bp, Artificial Sequence
  Synthetic Polynucleotide
taatacgactcactatagggggagtaatgctcaatctgatagatggtggtaacagaggagaaccaccatgtatcagattaacctggcggcagcgcaaaagatg

SEQ ID NO: 222811 - DNA, 103 bp, Artificial Sequence
  Synthetic Polynucleotide
taatacgactcactataggggatcatccatggagtaatgctcaatctgataacagaggagaatcagaatgagcattactaacctggcggcagcgcaaaagatg

SEQ ID NO: 222812 - DNA, 103 bp, Artificial Sequence
  Synthetic Polynucleotide
taatacgactcactatagggagacttgccagatcatccatggagtaatgcaacagaggagagcattaatgcatggatgaaacctggcggcagcgcaaaagatg

SEQ ID NO: 222813 - DNA, 103 bp, Artificial Sequence
  Synthetic Polynucleotide
taatacgactcactatagggagggattttcagacttgccagatcatccataacagaggagaatggatatgctggcaagtaacctggcggcagcgcaaaagatg

SEQ ID NO: 222814 - DNA, 103 bp, Artificial Sequence
  Synthetic Polynucleotide
taatacgactcactataggggaaattgctcagggattttcagacttgccaaacagaggagatggcaaatgtgaaaatccaacctggcggcagcgcaaaagatg

SEQ ID NO: 222815 - DNA, 103 bp, Artificial Sequence
  Synthetic Polynucleotide
taatacgactcactatagggatcgcatgtcgaaattgctcagggattttcaacagaggagagaaaatatgtgagcaattaacctggcggcagcgcaaaagatg

SEQ ID NO: 222816 - DNA, 103 bp, Artificial Sequence
  Synthetic Polynucleotide
taatacgactcactataggggcccttccagatcgcatgtcgaaattgctcaacagaggagagagcaaatgcgacatgcgaacctggcggcagcgcaaaagatg

SEQ ID NO: 222817 - DNA, 103 bp, Artificial Sequence
  Synthetic Polynucleotide
taatacgactcactatagggggtccaggatgcccttccagatcgcatgtcaacagaggagagacatgatgtctggaaggaacctggcggcagcgcaaaagatg

SEQ ID NO: 222818 - DNA, 103 bp, Artificial Sequence
  Synthetic Polynucleotide
taatacgactcactatagggcatataggctgttccagaaaatcccagataaacagaggagatatctgatgttttctggaaacctggcggcagcgcaaaagatg

SEQ ID NO: 222819 - DNA, 103 bp, Artificial Sequence
  Synthetic Polynucleotide
taatacgactcactatagggagctgccggtggtccaggatgcccttccagaacagaggagactggaaatgcatcctggaaacctggcggcagcgcaaaagatg

SEQ ID NO: 222820 - DNA, 103 bp, Artificial Sequence
  Synthetic Polynucleotide
taatacgactcactataggggaattcgtggagctgccggtggtccaggataacagaggagaatcctgatgcaccggcagaacctggcggcagcgcaaaagatg

SEQ ID NO: 222821 - DNA, 103 bp, Artificial Sequence
  Synthetic Polynucleotide
taatacgactcactatagggaaggggaggagaattcgtggagctgccggtaacagaggagaaccggcatgtccacgaataacctggcggcagcgcaaaagatg

SEQ ID NO: 222822 - DNA, 103 bp, Artificial Sequence
  Synthetic Polynucleotide
taatacgactcactatagggaggagatgagaaggggaggagaattcgtggaacagaggagaccacgaatgctcctccccaacctggcggcagcgcaaaagatg

SEQ ID NO: 222823 - DNA, 103 bp, Artificial Sequence
  Synthetic Polynucleotide
taatacgactcactatagggtggggtccgcaggagatgagaaggggaggaaacagaggagatcctccatgtctcatctcaacctggcggcagcgcaaaagatg

SEQ ID NO: 222824 - DNA, 103 bp, Artificial Sequence
  Synthetic Polynucleotide
taatacgactcactatagggaggcactgcttggggtccgcaggagatgagaacagaggagactcatcatgtgcggacccaacctggcggcagcgcaaaagatg

SEQ ID NO: 222825 - DNA, 103 bp, Artificial Sequence
  Synthetic Polynucleotide
taatacgactcactatagggctgactgtagaggcactgcttggggtccgcaacagaggagagcggacatgaagcagtgcaacctggcggcagcgcaaaagatg

SEQ ID NO: 222826 - DNA, 103 bp, Artificial Sequence
  Synthetic Polynucleotide
taatacgactcactatagggggagcccacactgactgtagaggcactgctaacagaggagaagcagtatgtctacagtcaacctggcggcagcgcaaaagatg

SEQ ID NO: 222827 - DNA, 103 bp, Artificial Sequence
  Synthetic Polynucleotide
taatacgactcactataggggggtctcactggagcccacactgactgtagaacagaggagactacagatggtgtgggctaacctggcggcagcgcaaaagatg

SEQ ID NO: 222828 - DNA, 103 bp, Artificial Sequence
  Synthetic Polynucleotide
taatacgactcactatagggcgctcaccccgggtctcactggagcccacaaacagaggagatgtgggatgcagtgagacaacctggcggcagcgcaaaagatg

SEQ ID NO: 222829 - DNA, 103 bp, Artificial Sequence
  Synthetic Polynucleotide
taatacgactcactatagggctgaactgaacatataggctgttccagaaaaacagaggagatttctgatgcagcctataaacctggcggcagcgcaaaagatg

SEQ ID NO: 222830 - DNA, 103 bp, Artificial Sequence
  Synthetic Polynucleotide
taatacgactcactatagggatcaataacacgctcaccccgggtctcactaacagaggagaagtgagatgcggggtgagaacctggcggcagcgcaaaagatg

SEQ ID NO: 222831 - DNA, 103 bp, Artificial Sequence
  Synthetic Polynucleotide
taatacgactcactatagggatcgcacagcatcaataacacgctcaccccaacagaggagaggggtgatggtgttattgaacctggcggcagcgcaaaagatg

SEQ ID NO: 222832 - DNA, 103 bp, Artificial Sequence
  Synthetic Polynucleotide
taatacgactcactatagggcggagggtgaatcgcacagcatcaataacaaacagaggagatgttatatgtgctgtgcgaacctggcggcagcgcaaaagatg

SEQ ID NO: 222833 - DNA, 103 bp, Artificial Sequence
  Synthetic Polynucleotide
taatacgactcactataggggatggtctggcggagggtgaatcgcacagcaacagaggagagctgtgatgttcaccctcaacctggcggcagcgcaaaagatg

SEQ ID NO: 222834 - DNA, 103 bp, Artificial Sequence
  Synthetic Polynucleotide
taatacgactcactataggggtgggaaagagatggtctggcggagggtgaaacagaggagatcacccatggccagaccaaacctggcggcagcgcaaaagatg

SEQ ID NO: 222835 - DNA, 103 bp, Artificial Sequence
  Synthetic Polynucleotide
taatacgactcactatagggtcatctcggggtgggaaagagatggtctggaacagaggagaccagacatgctctttcccaacctggcggcagcgcaaaagatg

SEQ ID NO: 222836 - DNA, 103 bp, Artificial Sequence
  Synthetic Polynucleotide
taatacgactcactataggggtcattccactcatctcggggtgggaaagaaacagaggagatctttcatgccccgagataacctggcggcagcgcaaaagatg

SEQ ID NO: 222837 - DNA, 103 bp, Artificial Sequence
  Synthetic Polynucleotide
taatacgactcactatagggcaaagttgaagtcattccactcatctcgggaacagaggagacccgagatgagtggaatgaacctggcggcagcgcaaaagatg

SEQ ID NO: 222838 - DNA, 103 bp, Artificial Sequence
  Synthetic Polynucleotide
taatacgactcactataggggcatccatgtcaaagttgaagtcattccacaacagaggagagtggaaatgcttcaacttaacctggcggcagcgcaaaagatg

SEQ ID NO: 222839 - DNA, 103 bp, Artificial Sequence
  Synthetic Polynucleotide
taatacgactcactatagggattgcggcgagcatccatgtcaaagttgaaaacagaggagattcaacatggacatggataacctggcggcagcgcaaaagatg

SEQ ID NO: 222840 - DNA, 103 bp, Artificial Sequence
  Synthetic Polynucleotide
taatacgactcactatagggagtactgtagggtggcacaccgtgaagtttaacagaggagaaaacttatgggtgtgccaaacctggcggcagcgcaaaagatg

SEQ ID NO: 222841 - DNA, 103 bp, Artificial Sequence
  Synthetic Polynucleotide
taatacgactcactatagggagtcaatgggctgaactgaacatataggctaacagaggagaagcctaatggttcagttcaacctggcggcagcgcaaaagatg

SEQ ID NO: 222842 - DNA, 103 bp, Artificial Sequence
  Synthetic Polynucleotide
taatacgactcactataggggctgttgcttattgcggcgagcatccatgtaacagaggagaacatggatgctcgccgcaaacctggcggcagcgcaaaagatg

SEQ ID NO: 222843 - DNA, 103 bp, Artificial Sequence
  Synthetic Polynucleotide
taatacgactcactatagggtctttgatgcgctgttgcttattgcggcgaaacagaggagatcgccgatgtaagcaacaaacctggcggcagcgcaaaagatg

SEQ ID NO: 222844 - DNA, 103 bp, Artificial Sequence
  Synthetic Polynucleotide
taatacgactcactatagggctccccctcctctttgatgcgctgttgcttaacagaggagaaagcaaatgcgcatcaaaaacctggcggcagcgcaaaagatg

SEQ ID NO: 222845 - DNA, 103 bp, Artificial Sequence
  Synthetic Polynucleotide
taatacgactcactatagggacaaagttcaagtcaatgggctgaactgaaaacagaggagattcagtatggcccattgaaacctggcggcagcgcaaaagatg

SEQ ID NO: 222846 - DNA, 103 bp, Artificial Sequence
  Synthetic Polynucleotide
taatacgactcactatagggtggttcatccacaaagttcaagtcaatgggaacagaggagacccattatgttgaactttaacctggcggcagcgcaaaagatg

SEQ ID NO: 222847 - DNA, 103 bp, Artificial Sequence
  Synthetic Polynucleotide
taatacgactcactatagggcatcttctgatggttcatccacaaagttcaaacagaggagatgaactatgtggatgaacaacctggcggcagcgcaaaagatg

SEQ ID NO: 222848 - DNA, 103 bp, Artificial Sequence
  Synthetic Polynucleotide
taatacgactcactatagggtttgtcgcaccatcttctgatggttcatccaacagaggagaggatgaatgatcagaagaaacctggcggcagcgcaaaagatg

SEQ ID NO: 222849 - DNA, 103 bp, Artificial Sequence
  Synthetic Polynucleotide
taatacgactcactatagggctcaatcttgtttgtcgcaccatcttctgaaacagaggagatcagaaatgggtgcgacaaacctggcggcagcgcaaaagatg

SEQ ID NO: 222850 - DNA, 103 bp, Artificial Sequence
  Synthetic Polynucleotide
taatacgactcactatagggccatgctaatctcaatcttgtttgtcgcacaacagaggagagtgcgaatgacaagattgaacctggcggcagcgcaaaagatg

SEQ ID NO: 222851 - DNA, 103 bp, Artificial Sequence
  Synthetic Polynucleotide
taatacgactcactatagggcggatacagtccatgctaatctcaatcttgaacagaggagacaagatatggattagcataacctggcggcagcgcaaaagatg

SEQ ID NO: 222852 - DNA, 103 bp, Artificial Sequence
  Synthetic Polynucleotide
taatacgactcactataggggtcctgcatgcggatacagtccatgctaataacagaggagaattagcatggactgtatcaacctggcggcagcgcaaaagatg

SEQ ID NO: 222853 - DNA, 103 bp, Artificial Sequence
  Synthetic Polynucleotide
taatacgactcactatagggtcaggtccgagtcctgcatgcggatacagtaacagaggagaactgtaatggcatgcaggaacctggcggcagcgcaaaagatg

SEQ ID NO: 222854 - DNA, 103 bp, Artificial Sequence
  Synthetic Polynucleotide
taatacgactcactataggggggtcagggcagtactgtagggtggcacacaacagaggagagtgtgcatgcctacagtaaacctggcggcagcgcaaaagatg

SEQ ID NO: 222855 - DNA, 103 bp, Artificial Sequence
  Synthetic Polynucleotide
taatacgactcactatagggatggggtcactcaggtccgagtcctgcatgaacagaggagacatgcaatgctcggacctaacctggcggcagcgcaaaagatg

SEQ ID NO: 222856 - DNA, 103 bp, Artificial Sequence
  Synthetic Polynucleotide
taatacgactcactatagggctgtggccacatggggtcactcaggtccgaaacagaggagatcggacatgagtgaccccaacctggcggcagcgcaaaagatg

SEQ ID NO: 222857 - DNA, 103 bp, Artificial Sequence
  Synthetic Polynucleotide
taatacgactcactatagggggttcgtgtactgtggccacatggggtcacaacagaggagagtgaccatgtgtggccacaacctggcggcagcgcaaaagatg

SEQ ID NO: 222858 - DNA, 103 bp, Artificial Sequence
  Synthetic Polynucleotide
taatacgactcactatagggaggagccccaggttcgtgtactgtggccacaacagaggagagtggccatggtacacgaaaacctggcggcagcgcaaaagatg

SEQ ID NO: 222859 - DNA, 103 bp, Artificial Sequence
  Synthetic Polynucleotide
taatacgactcactatagggcatgctgttcaggagccccaggttcgtgtaaacagaggagatacacgatgctggggctcaacctggcggcagcgcaaaagatg

SEQ ID NO: 222860 - DNA, 103 bp, Artificial Sequence
  Synthetic Polynucleotide
taatacgactcactatagggtctgctggtccatgctgttcaggagccccaaacagaggagatggggcatgtgaacagcaaacctggcggcagcgcaaaagatg

SEQ ID NO: 222861 - DNA, 103 bp, Artificial Sequence
  Synthetic Polynucleotide
taatacgactcactatagggccgttctgaatctgctggtccatgctgttcaacagaggagagaacagatgggaccagcaaacctggcggcagcgcaaaagatg

SEQ ID NO: 222862 - DNA, 103 bp, Artificial Sequence
  Synthetic Polynucleotide
taatacgactcactatagggggacgaggagccgttctgaatctgctggtcaacagaggagagaccagatgattcagaacaacctggcggcagcgcaaaagatg

SEQ ID NO: 222863 - DNA, 103 bp, Artificial Sequence
  Synthetic Polynucleotide
taatacgactcactatagggagggactggtggacgaggagccgttctgaaaacagaggagattcagaatggctcctcgtaacctggcggcagcgcaaaagatg

SEQ ID NO: 222864 - DNA, 103 bp, Artificial Sequence
  Synthetic Polynucleotide
taatacgactcactatagggtctgtgttatagggactggtggacgaggagaacagaggagactcctcatgcaccagtccaacctggcggcagcgcaaaagatg

SEQ ID NO: 222865 - DNA, 103 bp, Artificial Sequence
  Synthetic Polynucleotide
taatacgactcactatagggctggatgtaagggtcagggcagtactgtagaacagaggagactacagatgtgccctgacaacctggcggcagcgcaaaagatg

SEQ ID NO: 222866 - DNA, 103 bp, Artificial Sequence
  Synthetic Polynucleotide
taatacgactcactatagggctgcgcgtggtctgtgttatagggactggtaacagaggagaaccagtatgtataacacaaacctggcggcagcgcaaaagatg

SEQ ID NO: 222867 - DNA, 103 bp, Artificial Sequence
  Synthetic Polynucleotide
taatacgactcactatagggtgacgctgttctgcgcgtggtctgtgttataacagaggagaataacaatgaccacgcgcaacctggcggcagcgcaaaagatg

SEQ ID NO: 222868 - DNA, 103 bp, Artificial Sequence
  Synthetic Polynucleotide
taatacgactcactataggggagggcgccgtgacgctgttctgcgcgtggaacagaggagaccacgcatggaacagcgtaacctggcggcagcgcaaaagatg

SEQ ID NO: 222869 - DNA, 103 bp, Artificial Sequence
  Synthetic Polynucleotide
taatacgactcactatagggtgcgtagggcgagggcgccgtgacgctgttaacagaggagaaacagcatgacggcgcccaacctggcggcagcgcaaaagatg

SEQ ID NO: 222870 - DNA, 103 bp, Artificial Sequence
  Synthetic Polynucleotide
taatacgactcactatagggagctgggctgtgcgtagggcgagggcgccgaacagaggagacggcgcatgcgccctacgaacctggcggcagcgcaaaagatg

SEQ ID NO: 222871 - DNA, 103 bp, Artificial Sequence
  Synthetic Polynucleotide
taatacgactcactatagggtcgaaggtggagctgggctgtgcgtagggcaacagaggagagccctaatgacagcccagaacctggcggcagcgcaaaagatg

SEQ ID NO: 222872 - DNA, 103 bp, Artificial Sequence
  Synthetic Polynucleotide
taatacgactcactatagggagagagagcatcgaaggtggagctgggctgaacagaggagacagcccatgtccaccttcaacctggcggcagcgcaaaagatg

SEQ ID NO: 222873 - DNA, 103 bp, Artificial Sequence
  Synthetic Polynucleotide
taatacgactcactatagggcgggtgatggagagagagcatcgaaggtggaacagaggagaccacctatgatgctctctaacctggcggcagcgcaaaagatg

SEQ ID NO: 222874 - DNA, 103 bp, Artificial Sequence
  Synthetic Polynucleotide
taatacgactcactataggggaggggatggcgggtgatggagagagagcaaacagaggagatgctctatgtccatcaccaacctggcggcagcgcaaaagatg

SEQ ID NO: 222875 - DNA, 103 bp, Artificial Sequence
  Synthetic Polynucleotide
taatacgactcactataggggtcggtgttggaggggatggcgggtgatggaacagaggagaccatcaatggccatccccaacctggcggcagcgcaaaagatg

SEQ ID NO: 222876 - DNA, 103 bp, Artificial Sequence
  Synthetic Polynucleotide
taatacgactcactatagggctacgaaacgctggatgtaagggtcagggcaacagaggagagccctgatgcttacatccaacctggcggcagcgcaaaagatg

SEQ ID NO: 222877 - DNA, 103 bp, Artificial Sequence
  Synthetic Polynucleotide
taatacgactcactatagggggcctgggtagtcggtgttggaggggatggaacagaggagaccatccatgccaacaccgaacctggcggcagcgcaaaagatg

SEQ ID NO: 222878 - DNA, 103 bp, Artificial Sequence
  Synthetic Polynucleotide
taatacgactcactatagggaaactgtgcgggcctgggtagtcggtgttgaacagaggagacaacacatgctacccaggaacctggcggcagcgcaaaagatg

SEQ ID NO: 222879 - DNA, 103 bp, Artificial Sequence
  Synthetic Polynucleotide
taatacgactcactatagggggacacgtcgaaactgtgcgggcctgggtaaacagaggagatacccaatgccgcacagtaacctggcggcagcgcaaaagatg

SEQ ID NO: 222880 - DNA, 103 bp, Artificial Sequence
  Synthetic Polynucleotide
taatacgactcactatagggactgctggaaggacacgtcgaaactgtgcgaacagaggagacgcacaatgtcgacgtgtaacctggcggcagcgcaaaagatg

SEQ ID NO: 222881 - DNA, 103 bp, Artificial Sequence
  Synthetic Polynucleotide
taatacgactcactataggggcggtgctcgactgctggaaggacacgtcgaacagaggagacgacgtatgcttccagcaaacctggcggcagcgcaaaagatg

SEQ ID NO: 222882 - DNA, 103 bp, Artificial Sequence
  Synthetic Polynucleotide
taatacgactcactatagggggccgacttggcggtgctcgactgctggaaaacagaggagattccagatgtcgagcaccaacctggcggcagcgcaaaagatg

SEQ ID NO: 222883 - DNA, 103 bp, Artificial Sequence
  Synthetic Polynucleotide
taatacgactcactatagggacgtccaggtggccgacttggcggtgctcgaacagaggagacgagcaatgccaagtcggaacctggcggcagcgcaaaagatg

SEQ ID NO: 222884 - DNA, 103 bp, Artificial Sequence
  Synthetic Polynucleotide
taatacgactcactatagggtcagtggaatacgtccaggtggccgacttgaacagaggagacaagtcatgcacctggacaacctggcggcagcgcaaaagatg

SEQ ID NO: 222885 - DNA, 103 bp, Artificial Sequence
  Synthetic Polynucleotide
taatacgactcactatagggtttcttcagttcagtggaatacgtccaggtaacagaggagaacctggatgtattccactaacctggcggcagcgcaaaagatg

SEQ ID NO: 222886 - DNA, 103 bp, Artificial Sequence
  Synthetic Polynucleotide
taatacgactcactatagggggcagtagagtttcttcagttcagtggaataacagaggagaattccaatgaactgaagaaacctggcggcagcgcaaaagatg

SEQ ID NO: 222887 - DNA, 103 bp, Artificial Sequence
  Synthetic Polynucleotide
taatacgactcactataggggctggggtttctacgaaacgctggatgtaaaacagaggagattacatatggcgtttcgtaacctggcggcagcgcaaaagatg

SEQ ID NO: 222888 - DNA, 103 bp, Artificial Sequence
  Synthetic Polynucleotide
taatacgactcactatagggtttgcaatttggcagtagagtttcttcagtaacagaggagaactgaaatgactctactgaacctggcggcagcgcaaaagatg

SEQ ID NO: 222889 - DNA, 103 bp, Artificial Sequence
  Synthetic Polynucleotide
taatacgactcactatagggggggcatgtctttgcaatttggcagtagagaacagaggagactctacatgcaaattgcaaacctggcggcagcgcaaaagatg

SEQ ID NO: 222890 - DNA, 103 bp, Artificial Sequence
  Synthetic Polynucleotide
taatacgactcactatagggtgatctggatggggcatgtctttgcaatttaacagaggagaaaattgatgagacatgccaacctggcggcagcgcaaaagatg

SEQ ID NO: 222891 - DNA, 103 bp, Artificial Sequence
  Synthetic Polynucleotide
taatacgactcactataggggtcatcaccttgatctggatggggcatgtcaacagaggagagacatgatgcatccagataacctggcggcagcgcaaaagatg

SEQ ID NO: 222892 - DNA, 103 bp, Artificial Sequence
  Synthetic Polynucleotide
taatacgactcactatagggaggaggtggggtcatcaccttgatctggataacagaggagaatccagatgaaggtgatgaacctggcggcagcgcaaaagatg

SEQ ID NO: 222893 - DNA, 103 bp, Artificial Sequence
  Synthetic Polynucleotide
taatacgactcactatagggcagctccctgaggaggtggggtcatcacctaacagaggagaaggtgaatgccccacctcaacctggcggcagcgcaaaagatg

SEQ ID NO: 222894 - DNA, 103 bp, Artificial Sequence
  Synthetic Polynucleotide
taatacgactcactataggggcgcggataacagctccctgaggaggtgggaacagaggagacccaccatgtcagggagcaacctggcggcagcgcaaaagatg

SEQ ID NO: 222895 - DNA, 103 bp, Artificial Sequence
  Synthetic Polynucleotide
taatacgactcactataggggacaggcatggcgcggataacagctccctgaacagaggagacagggaatggttatccgcaacctggcggcagcgcaaaagatg

SEQ ID NO: 222896 - DNA, 103 bp, Artificial Sequence
  Synthetic Polynucleotide
taatacgactcactatagggcttttttgtagacaggcatggcgcggataaaacagaggagattatccatgccatgcctgaacctggcggcagcgcaaaagatg

SEQ ID NO: 222897 - DNA, 103 bp, Artificial Sequence
  Synthetic Polynucleotide
taatacgactcactatagggacgtgctcagcttttttgtagacaggcatgaacagaggagacatgccatgctacaaaaaaacctggcggcagcgcaaaagatg

SEQ ID NO: 222898 - DNA, 103 bp, Artificial Sequence
  Synthetic Polynucleotide
taatacgactcactatagggagagaaatgagctggggtttctacgaaacgaacagaggagacgtttcatggaaaccccaaacctggcggcagcgcaaaagatg

SEQ ID NO: 222899 - DNA, 103 bp, Artificial Sequence
  Synthetic Polynucleotide
taatacgactcactatagggcacctccgtgacgtgctcagcttttttgtaaacagaggagatacaaaatggctgagcacaacctggcggcagcgcaaaagatg

SEQ ID NO: 222900 - DNA, 103 bp, Artificial Sequence
  Synthetic Polynucleotide
taatacgactcactatagggaccgcttcaccacctccgtgacgtgctcagaacagaggagactgagcatgtcacggaggaacctggcggcagcgcaaaagatg

SEQ ID NO: 222901 - DNA, 103 bp, Artificial Sequence
  Synthetic Polynucleotide
taatacgactcactatagggtggttggggcaccgcttcaccacctccgtgaacagaggagacacggaatgggtgaagcgaacctggcggcagcgcaaaagatg

SEQ ID NO: 222902 - DNA, 103 bp, Artificial Sequence
  Synthetic Polynucleotide
taatacgactcactataggggctcagctcatggttggggcaccgcttcacaacagaggagagtgaagatgtgccccaacaacctggcggcagcgcaaaagatg

SEQ ID NO: 222903 - DNA, 103 bp, Artificial Sequence
  Synthetic Polynucleotide
taatacgactcactatagggtgaattcacggctcagctcatggttggggcaacagaggagagccccaatgatgagctgaaacctggcggcagcgcaaaagatg

SEQ ID NO: 222904 - DNA, 103 bp, Artificial Sequence
  Synthetic Polynucleotide
taatacgactcactatagggtgtccctcgttgaattcacggctcagctcaaacagaggagatgagctatgccgtgaattaacctggcggcagcgcaaaagatg

SEQ ID NO: 222905 - DNA, 103 bp, Artificial Sequence
  Synthetic Polynucleotide
taatacgactcactatagggaggggcaatctgtccctcgttgaattcacgaacagaggagacgtgaaatgaacgagggaaacctggcggcagcgcaaaagatg

SEQ ID NO: 222906 - DNA, 103 bp, Artificial Sequence
  Synthetic Polynucleotide
taatacgactcactatagggaatgactaggaggggcaatctgtccctcgtaacagaggagaacgaggatgagattgcccaacctggcggcagcgcaaaagatg

SEQ ID NO: 222907 - DNA, 103 bp, Artificial Sequence
  Synthetic Polynucleotide
taatacgactcactatagggactcgaatcaaatgactaggaggggcaatcaacagaggagagattgcatgtcctagtcaaacctggcggcagcgcaaaagatg

SEQ ID NO: 222908 - DNA, 103 bp, Artificial Sequence
  Synthetic Polynucleotide
taatacgactcactataggggttcccctctactcgaatcaaatgactaggaacagaggagacctagtatgttgattcgaaacctggcggcagcgcaaaagatg

SEQ ID NO: 222909 - DNA, 103 bp, Artificial Sequence
  Synthetic Polynucleotide
taatacgactcactatagggtttctttccaagagaaatgagctggggtttaacagaggagaaaacccatgctcatttctaacctggcggcagcgcaaaagatg

SEQ ID NO: 222910 - DNA, 103 bp, Artificial Sequence
  Synthetic Polynucleotide
taatacgactcactataggggggcatggctgttcccctctactcgaatcaaacagaggagatgattcatgtagaggggaaacctggcggcagcgcaaaagatg

SEQ ID NO: 222911 - DNA, 103 bp, Artificial Sequence
  Synthetic Polynucleotide
taatacgactcactatagggtctacatactgggcatggctgttcccctctaacagaggagaagagggatgcagccatgcaacctggcggcagcgcaaaagatg

SEQ ID NO: 222912 - DNA, 103 bp, Artificial Sequence
  Synthetic Polynucleotide
taatacgactcactataggggatgggatcttctacatactgggcatggctaacagaggagaagccatatgcagtatgtaaacctggcggcagcgcaaaagatg

SEQ ID NO: 222913 - DNA, 103 bp, Artificial Sequence
  Synthetic Polynucleotide
taatacgactcactataggggtcttcctgtgatgggatcttctacatactaacagaggagaagtatgatgaagatcccaaacctggcggcagcgcaaaagatg

SEQ ID NO: 222914 - DNA, 103 bp, Artificial Sequence
  Synthetic Polynucleotide
taatacgactcactatagggagcacactctgtcttcctgtgatgggatctaacagaggagaagatccatgcacaggaagaacctggcggcagcgcaaaagatg

SEQ ID NO: 222915 - DNA, 103 bp, Artificial Sequence
  Synthetic Polynucleotide
taatacgactcactatagggataaggtaccagcacactctgtcttcctgtaacagaggagaacaggaatgcagagtgtgaacctggcggcagcgcaaaagatg

SEQ ID NO: 222916 - DNA, 103 bp, Artificial Sequence
  Synthetic Polynucleotide
taatacgactcactatagggggggtggctcataaggtaccagcacactctaacagaggagaagagtgatgtggtaccttaacctggcggcagcgcaaaagatg

SEQ ID NO: 222917 - DNA, 103 bp, Artificial Sequence
  Synthetic Polynucleotide
taatacgactcactataggggtgccaacctggggtggctcataaggtaccaacagaggagaggtaccatgtgagccaccaacctggcggcagcgcaaaagatg

SEQ ID NO: 222918 - DNA, 103 bp, Artificial Sequence
  Synthetic Polynucleotide
taatacgactcactatagggcgtgaattcagtgccaacctggggtggctcaacagaggagagagccaatgcaggttggcaacctggcggcagcgcaaaagatg

SEQ ID NO: 222919 - DNA, 103 bp, Artificial Sequence
  Synthetic Polynucleotide
taatacgactcactatagggacaagactgtcgtgaattcagtgccaacctaacagaggagaaggttgatgctgaattcaaacctggcggcagcgcaaaagatg

SEQ ID NO: 222920 - DNA, 103 bp, Artificial Sequence
  Synthetic Polynucleotide
taatacgactcactatagggcggtaataactttctttccaagagaaatgaaacagaggagatcatttatgttggaaagaaacctggcggcagcgcaaaagatg

SEQ ID NO: 222921 - DNA, 103 bp, Artificial Sequence
  Synthetic Polynucleotide
taatacgactcactatagggatgaaattgtacaagactgtcgtgaattcaaacagaggagatgaattatggacagtcttaacctggcggcagcgcaaaagatg

SEQ ID NO: 222922 - DNA, 103 bp, Artificial Sequence
  Synthetic Polynucleotide
taatacgactcactataggggctgttacacatgaaattgtacaagactgtaacagaggagaacagtcatgtacaatttcaacctggcggcagcgcaaaagatg

SEQ ID NO: 222923 - DNA, 103 bp, Artificial Sequence
  Synthetic Polynucleotide
taatacgactcactatagggcaacacaactgctgttacacatgaaattgtaacagaggagaacaattatgtgtgtaacaaacctggcggcagcgcaaaagatg

SEQ ID NO: 222924 - DNA, 103 bp, Artificial Sequence
  Synthetic Polynucleotide
taatacgactcactatagggttcatccctccaacacaactgctgttacacaacagaggagagtgtaaatgcagttgtgtaacctggcggcagcgcaaaagatg

SEQ ID NO: 222925 - DNA, 103 bp, Artificial Sequence
  Synthetic Polynucleotide
taatacgactcactatagggtggacggcggttcatccctccaacacaactaacagaggagaagttgtatgggagggatgaacctggcggcagcgcaaaagatg

SEQ ID NO: 222926 - DNA, 103 bp, Artificial Sequence
  Synthetic Polynucleotide
taatacgactcactatagggtgattaaaattggacggcggttcatccctcaacagaggagagagggaatgaccgccgtcaacctggcggcagcgcaaaagatg

SEQ ID NO: 222927 - DNA, 103 bp, Artificial Sequence
  Synthetic Polynucleotide
taatacgactcactatagggagagtaacaatgattaaaattggacggcggaacagaggagaccgccgatgaattttaataacctggcggcagcgcaaaagatg

SEQ ID NO: 222928 - DNA, 103 bp, Artificial Sequence
  Synthetic Polynucleotide
taatacgactcactatagggtctggtttccagagtaacaatgattaaaataacagaggagaattttaatgattgttactaacctggcggcagcgcaaaagatg

SEQ ID NO: 222929 - DNA, 103 bp, Artificial Sequence
  Synthetic Polynucleotide
taatacgactcactatagggcttgcccatctctggtttccagagtaacaaaacagaggagattgttaatgtggaaaccaaacctggcggcagcgcaaaagatg

SEQ ID NO: 222930 - DNA, 103 bp, Artificial Sequence
  Synthetic Polynucleotide
taatacgactcactatagggcggcccaggacttgcccatctctggtttccaacagaggagaggaaacatgagatgggcaaacctggcggcagcgcaaaagatg

SEQ ID NO: 222931 - DNA, 103 bp, Artificial Sequence
  Synthetic Polynucleotide
taatacgactcactatagggatcaggggaggtggcggtggactgggccataacagaggagaatggccatgtccaccgccaacctggcggcagcgcaaaagatg

SEQ ID NO: 222932 - DNA, 103 bp, Artificial Sequence
  Synthetic Polynucleotide
taatacgactcactatagggctcattattcccccggcttgactggggaagaacagaggagacttcccatgtcaagccggaacctggcggcagcgcaaaagatg

SEQ ID NO: 222933 - DNA, 103 bp, Artificial Sequence
  Synthetic Polynucleotide
taatacgactcactatagggaagggcggggacggcaggggggctctgcttaacagaggagaaagcagatgccccctgccaacctggcggcagcgcaaaagatg

SEQ ID NO: 222934 - DNA, 103 bp, Artificial Sequence
  Synthetic Polynucleotide
taatacgactcactatagggcaccggcaccaagggcggggacggcaggggaacagaggagacccctgatgtccccgcccaacctggcggcagcgcaaaagatg

SEQ ID NO: 222935 - DNA, 103 bp, Artificial Sequence
  Synthetic Polynucleotide
taatacgactcactatagggcgcttcttcacaccggcaccaagggcggggaacagaggagaccccgcatgtggtgccggaacctggcggcagcgcaaaagatg

SEQ ID NO: 222936 - DNA, 103 bp, Artificial Sequence
  Synthetic Polynucleotide
taatacgactcactatagggtccatgccgccgcttcttcacaccggcaccaacagaggagaggtgccatggtgaagaagaacctggcggcagcgcaaaagatg

SEQ ID NO: 222937 - DNA, 103 bp, Artificial Sequence
  Synthetic Polynucleotide
taatacgactcactatagggtgtcctcgtctccatgccgccgcttcttcaaacagaggagatgaagaatgggcggcatgaacctggcggcagcgcaaaagatg

SEQ ID NO: 222938 - DNA, 103 bp, Artificial Sequence
  Synthetic Polynucleotide
taatacgactcactatagggaggtagtacgtgtcctcgtctccatgccgcaacagaggagagcggcaatgagacgaggaaacctggcggcagcgcaaaagatg

SEQ ID NO: 222939 - DNA, 103 bp, Artificial Sequence
  Synthetic Polynucleotide
taatacgactcactatagggtcgcacctgaaggtagtacgtgtcctcgtcaacagaggagagacgagatgacgtactacaacctggcggcagcgcaaaagatg

SEQ ID NO: 222940 - DNA, 103 bp, Artificial Sequence
  Synthetic Polynucleotide
taatacgactcactatagggtctcccggcctcgcacctgaaggtagtacgaacagaggagacgtactatgttcaggtgcaacctggcggcagcgcaaaagatg

SEQ ID NO: 222941 - DNA, 103 bp, Artificial Sequence
  Synthetic Polynucleotide
taatacgactcactatagggatctcaaagttctcccggcctcgcacctgaaacagaggagatcaggtatgaggccgggaaacctggcggcagcgcaaaagatg

SEQ ID NO: 222942 - DNA, 103 bp, Artificial Sequence
  Synthetic Polynucleotide
taatacgactcactatagggcttcatcaggatctcaaagttctcccggccaacagaggagaggccggatgaactttgagaacctggcggcagcgcaaaagatg

SEQ ID NO: 222943 - DNA, 103 bp, Artificial Sequence
  Synthetic Polynucleotide
taatacgactcactatagggcgcccaccacctcattattcccccggcttgaacagaggagacaagccatgggaataatgaacctggcggcagcgcaaaagatg

SEQ ID NO: 222944 - DNA, 103 bp, Artificial Sequence
  Synthetic Polynucleotide
taatacgactcactatagggtctctttcagcttcatcaggatctcaaagtaacagaggagaactttgatgtcctgatgaaacctggcggcagcgcaaaagatg

SEQ ID NO: 222945 - DNA, 103 bp, Artificial Sequence
  Synthetic Polynucleotide
taatacgactcactatagggagctccaggctctctttcagcttcatcaggaacagaggagacctgatatggctgaaagaaacctggcggcagcgcaaaagatg

SEQ ID NO: 222946 - DNA, 103 bp, Artificial Sequence
  Synthetic Polynucleotide
taatacgactcactatagggcaactccatcagctccaggctctctttcagaacagaggagactgaaaatgagcctggagaacctggcggcagcgcaaaagatg

SEQ ID NO: 222947 - DNA, 103 bp, Artificial Sequence
  Synthetic Polynucleotide
taatacgactcactataggggctgcggcaccaactccatcagctccaggcaacagaggagagcctggatgtgatggagtaacctggcggcagcgcaaaagatg

SEQ ID NO: 222948 - DNA, 103 bp, Artificial Sequence
  Synthetic Polynucleotide
taatacgactcactatagggtccaccagtggctgcggcaccaactccatcaacagaggagagatggaatgggtgccgcaaacctggcggcagcgcaaaagatg

SEQ ID NO: 222949 - DNA, 103 bp, Artificial Sequence
  Synthetic Polynucleotide
taatacgactcactatagggccgataggagtccaccagtggctgcggcacaacagaggagagtgccgatgccactggtgaacctggcggcagcgcaaaagatg

SEQ ID NO: 222950 - DNA, 103 bp, Artificial Sequence
  Synthetic Polynucleotide
taatacgactcactataggggctgctgctgccgataggagtccaccagtgaacagaggagacactggatgactcctatcaacctggcggcagcgcaaaagatg

SEQ ID NO: 222951 - DNA, 103 bp, Artificial Sequence
  Synthetic Polynucleotide
taatacgactcactatagggtgtaggagctgctgctgctgccgataggagaacagaggagactcctaatggcagcagcaaacctggcggcagcgcaaaagatg

SEQ ID NO: 222952 - DNA, 103 bp, Artificial Sequence
  Synthetic Polynucleotide
taatacgactcactatagggactcggcctctgtaggagctgctgctgctgaacagaggagacagcagatgcagctcctaaacctggcggcagcgcaaaagatg

SEQ ID NO: 222953 - DNA, 103 bp, Artificial Sequence
  Synthetic Polynucleotide
taatacgactcactataggggctgtaggtgactcggcctctgtaggagctaacagaggagaagctccatgagaggccgaaacctggcggcagcgcaaaagatg

SEQ ID NO: 222954 - DNA, 103 bp, Artificial Sequence
  Synthetic Polynucleotide
taatacgactcactataggggaatccgttccgcccaccacctcattattcaacagaggagagaataaatgggtggtgggaacctggcggcagcgcaaaagatg

SEQ ID NO: 222955 - DNA, 103 bp, Artificial Sequence
  Synthetic Polynucleotide
taatacgactcactatagggtaggacgggggctgtaggtgactcggcctcaacagaggagagaggccatgtcacctacaaacctggcggcagcgcaaaagatg

SEQ ID NO: 222956 - DNA, 103 bp, Artificial Sequence
  Synthetic Polynucleotide
taatacgactcactataggggaccggcccgtaggacgggggctgtaggtgaacagaggagacacctaatgcccccgtccaacctggcggcagcgcaaaagatg

SEQ ID NO: 222957 - DNA, 103 bp, Artificial Sequence
  Synthetic Polynucleotide
taatacgactcactatagggtgggcgagaggaccggcccgtaggacggggaacagaggagaccccgtatgacgggccggaacctggcggcagcgcaaaagatg

SEQ ID NO: 222958 - DNA, 103 bp, Artificial Sequence
  Synthetic Polynucleotide
taatacgactcactatagggaccttgttcatgggcgagaggaccggcccgaacagaggagacgggccatgcctctcgccaacctggcggcagcgcaaaagatg

SEQ ID NO: 222959 - DNA, 103 bp, Artificial Sequence
  Synthetic Polynucleotide
taatacgactcactataggggcccccgtgcaccttgttcatgggcgagagaacagaggagactctcgatgatgaacaagaacctggcggcagcgcaaaagatg

SEQ ID NO: 222960 - DNA, 103 bp, Artificial Sequence
  Synthetic Polynucleotide
taatacgactcactataggggcttgttcatgcccccgtgcaccttgttcaaacagaggagatgaacaatgtgcacggggaacctggcggcagcgcaaaagatg

SEQ ID NO: 222961 - DNA, 103 bp, Artificial Sequence
  Synthetic Polynucleotide
taatacgactcactatagggacggagggcagcttgttcatgcccccgtgcaacagaggagagcacggatgcatgaacaaaacctggcggcagcgcaaaagatg

SEQ ID NO: 222962 - DNA, 103 bp, Artificial Sequence
  Synthetic Polynucleotide
taatacgactcactatagggcagctggttgacggagggcagcttgttcataacagaggagaatgaacatgctgccctccaacctggcggcagcgcaaaagatg

SEQ ID NO: 222963 - DNA, 103 bp, Artificial Sequence
  Synthetic Polynucleotide
taatacgactcactataggggctggcccaccagctggttgacggagggcaaacagaggagatgccctatgtcaaccagcaacctggcggcagcgcaaaagatg

SEQ ID NO: 222964 - DNA, 103 bp, Artificial Sequence
  Synthetic Polynucleotide
taatacgactcactatagggtgcgggggaggctggcccaccagctggttgaacagaggagacaaccaatgggtgggccaaacctggcggcagcgcaaaagatg

SEQ ID NO: 222965 - DNA, 103 bp, Artificial Sequence
  Synthetic Polynucleotide
taatacgactcactataggggtccatgctggaatccgttccgcccaccacaacagaggagagtggtgatgggaacggataacctggcggcagcgcaaaagatg

SEQ ID NO: 222966 - DNA, 103 bp, Artificial Sequence
  Synthetic Polynucleotide
taatacgactcactatagggtgccgaactgtgcgggggaggctggcccacaacagaggagagtgggcatgcctcccccgaacctggcggcagcgcaaaagatg

SEQ ID NO: 222967 - DNA, 103 bp, Artificial Sequence
  Synthetic Polynucleotide
taatacgactcactatagggtgggtgtagctgccgaactgtgcgggggagaacagaggagactccccatgacagttcggaacctggcggcagcgcaaaagatg

SEQ ID NO: 222968 - DNA, 103 bp, Artificial Sequence
  Synthetic Polynucleotide
taatacgactcactatagggggccccaggttgggtgtagctgccgaactgaacagaggagacagttcatgagctacaccaacctggcggcagcgcaaaagatg

SEQ ID NO: 222969 - DNA, 103 bp, Artificial Sequence
  Synthetic Polynucleotide
taatacgactcactatagggggggcccacgggccccaggttgggtgtagcaacagaggagagctacaatgaacctggggaacctggcggcagcgcaaaagatg

SEQ ID NO: 222970 - DNA, 103 bp, Artificial Sequence
  Synthetic Polynucleotide
taatacgactcactatagggtgagcatcccggggcccacgggccccaggtaacagaggagaacctggatgccgtgggccaacctggcggcagcgcaaaagatg

SEQ ID NO: 222971 - DNA, 103 bp, Artificial Sequence
  Synthetic Polynucleotide
taatacgactcactatagggccatggttgttgagcatcccggggcccacgaacagaggagacgtgggatgcgggatgctaacctggcggcagcgcaaaagatg

SEQ ID NO: 222972 - DNA, 103 bp, Artificial Sequence
  Synthetic Polynucleotide
taatacgactcactatagggcactgcgtggccatggttgttgagcatcccaacagaggagagggatgatgaacaaccataacctggcggcagcgcaaaagatg

SEQ ID NO: 222973 - DNA, 103 bp, Artificial Sequence
  Synthetic Polynucleotide
taatacgactcactatagggcgttggctggcactgcgtggccatggttgtaacagaggagaacaaccatggccacgcagaacctggcggcagcgcaaaagatg

SEQ ID NO: 222974 - DNA, 103 bp, Artificial Sequence
  Synthetic Polynucleotide
taatacgactcactatagggctcatctcgccgttggctggcactgcgtggaacagaggagaccacgcatggccagccaaaacctggcggcagcgcaaaagatg

SEQ ID NO: 222975 - DNA, 103 bp, Artificial Sequence
  Synthetic Polynucleotide
taatacgactcactataggggtggctgctgctcatctcgccgttggctggaacagaggagaccagccatgggcgagatgaacctggcggcagcgcaaaagatg

SEQ ID NO: 222976 - DNA, 103 bp, Artificial Sequence
  Synthetic Polynucleotide
taatacgactcactatagggggtggaagacgtccatgctggaatccgttcaacagaggagagaacggatgccagcatggaacctggcggcagcgcaaaagatg

SEQ ID NO: 222977 - DNA, 103 bp, Artificial Sequence
  Synthetic Polynucleotide
taatacgactcactatagggactgggcgctgtggctgctgctcatctcgcaacagaggagagcgagaatggcagcagccaacctggcggcagcgcaaaagatg

SEQ ID NO: 222978 - DNA, 103 bp, Artificial Sequence
  Synthetic Polynucleotide
taatacgactcactataggggagaccatggactgggcgctgtggctgctgaacagaggagacagcagatgcagcgcccaaacctggcggcagcgcaaaagatg

SEQ ID NO: 222979 - DNA, 103 bp, Artificial Sequence
  Synthetic Polynucleotide
taatacgactcactataggggtgggaccccgagaccatggactgggcgctaacagaggagaagcgccatgtccatggtcaacctggcggcagcgcaaaagatg

SEQ ID NO: 222980 - DNA, 103 bp, Artificial Sequence
  Synthetic Polynucleotide
taatacgactcactataggggcggagtgcagtgggaccccgagaccatggaacagaggagaccatggatgcggggtcccaacctggcggcagcgcaaaagatg

SEQ ID NO: 222981 - DNA, 103 bp, Artificial Sequence
  Synthetic Polynucleotide
taatacgactcactatagggtaggggggtggcggagtgcagtgggaccccaacagaggagaggggtcatgctgcactccaacctggcggcagcgcaaaagatg

SEQ ID NO: 222982 - DNA, 103 bp, Artificial Sequence
  Synthetic Polynucleotide
taatacgactcactataggggtcggcgtggtaggggggtggcggagtgcaaacagaggagatgcactatgccaccccccaacctggcggcagcgcaaaagatg

SEQ ID NO: 222983 - DNA, 103 bp, Artificial Sequence
  Synthetic Polynucleotide
taatacgactcactatagggcgaggctggggtcggcgtggtaggggggtgaacagaggagacaccccatgaccacgccgaacctggcggcagcgcaaaagatg

SEQ ID NO: 222984 - DNA, 103 bp, Artificial Sequence
  Synthetic Polynucleotide
taatacgactcactatagggcaggtcctgacgaggctggggtcggcgtggaacagaggagaccacgcatgccccagcctaacctggcggcagcgcaaaagatg

SEQ ID NO: 222985 - DNA, 103 bp, Artificial Sequence
  Synthetic Polynucleotide
taatacgactcactatagggtcagggcccccaggtcctgacgaggctgggaacagaggagacccagcatggtcaggaccaacctggcggcagcgcaaaagatg

SEQ ID NO: 222986 - DNA, 103 bp, Artificial Sequence
  Synthetic Polynucleotide
taatacgactcactatagggatgccctccaggtggaagacgtccatgctgaacagaggagacagcatatgcgtcttccaaacctggcggcagcgcaaaagatg

SEQ ID NO: 222987 - DNA, 103 bp, Artificial Sequence
  Synthetic Polynucleotide
taatacgactcactatagggagatgtagtcatgccctccaggtggaagacaacagaggagagtcttcatgctggagggcaacctggcggcagcgcaaaagatg

SEQ ID NO: 222988 - DNA, 103 bp, Artificial Sequence
  Synthetic Polynucleotide
taatacgactcactataggggggccatgacagatgtagtcatgccctccaaacagaggagatggaggatgtgactacataacctggcggcagcgcaaaagatg

SEQ ID NO: 222989 - DNA, 103 bp, Artificial Sequence
  Synthetic Polynucleotide
taatacgactcactatagggagattgaactgggccatgacagatgtagtcaacagaggagagactacatgtgtcatggcaacctggcggcagcgcaaaagatg

SEQ ID NO: 222990 - DNA, 103 bp, Artificial Sequence
  Synthetic Polynucleotide
taatacgactcactataggggctgctcagcagattgaactgggccatgacaacagaggagagtcatgatgcagttcaataacctggcggcagcgcaaaagatg

SEQ ID NO: 222991 - DNA, 103 bp, Artificial Sequence
  Synthetic Polynucleotide
taatacgactcactatagggtggtgcccccatcaggggaggtggcggtggaacagaggagaccaccgatgcctcccctgaacctggcggcagcgcaaaagatg

SEQ ID NO: 222992 - DNA, 103 bp, Artificial Sequence
  Synthetic Polynucleotide
taatacgactcactatagggggtccatggtgctgctcagcagattgaactaacagaggagaagttcaatgtgctgagcaaacctggcggcagcgcaaaagatg

SEQ ID NO: 222993 - DNA, 103 bp, Artificial Sequence
  Synthetic Polynucleotide
taatacgactcactatagggctgctcatctggtccatggtgctgctcagcaacagaggagagctgagatgcaccatggaaacctggcggcagcgcaaaagatg

SEQ ID NO: 222994 - DNA, 103 bp, Artificial Sequence
  Synthetic Polynucleotide
taatacgactcactatagggggccgcgcggctgctcatctggtccatggtaacagaggagaaccatgatgcagatgagcaacctggcggcagcgcaaaagatg

SEQ ID NO: 222995 - DNA, 103 bp, Artificial Sequence
  Synthetic Polynucleotide
taatacgactcactatagggggctggccgaggccgcgcggctgctcatctaacagaggagaagatgaatggccgcgcggaacctggcggcagcgcaaaagatg

SEQ ID NO: 222996 - DNA, 103 bp, Artificial Sequence
  Synthetic Polynucleotide
taatacgactcactatagggggggtgtaggggctggccgaggccgcgcggaacagaggagaccgcgcatgctcggccagaacctggcggcagcgcaaaagatg

SEQ ID NO: 222997 - DNA, 103 bp, Artificial Sequence
  Synthetic Polynucleotide
taatacgactcactatagggggcgtgctctggggtgtaggggctggccgaaacagaggagatcggccatgccctacaccaacctggcggcagcgcaaaagatg

SEQ ID NO: 222998 - DNA, 103 bp, Artificial Sequence
  Synthetic Polynucleotide
taatacgactcactataggggcacgctggcggcgtgctctggggtgtaggaacagaggagacctacaatgcagagcacgaacctggcggcagcgcaaaagatg

SEQ ID NO: 222999 - DNA, 103 bp, Artificial Sequence
  Synthetic Polynucleotide
taatacgactcactataggggagtgggtgggcacgctggcggcgtgctctaacagaggagaagagcaatgcgccagcgtaacctggcggcagcgcaaaagatg

SEQ ID NO: 223000 - DNA, 103 bp, Artificial Sequence
  Synthetic Polynucleotide
taatacgactcactatagggtgcgtagggcgagtgggtgggcacgctggcaacagaggagagccagcatgcccacccacaacctggcggcagcgcaaaagatg

SEQ ID NO: 223001 - DNA, 103 bp, Artificial Sequence
  Synthetic Polynucleotide
taatacgactcactatagggagctgggttgtgcgtagggcgagtgggtggaacagaggagaccacccatgcgccctacgaacctggcggcagcgcaaaagatg

SEQ ID NO: 223002 - DNA, 103 bp, Artificial Sequence
  Synthetic Polynucleotide
taatacgactcactatagggtgctcaaacgtggtgcccccatcaggggagaacagaggagactccccatgtgggggcacaacctggcggcagcgcaaaagatg

SEQ ID NO: 223003 - DNA, 103 bp, Artificial Sequence
  Synthetic Polynucleotide
taatacgactcactatagggtcgaaggtggagctgggttgtgcgtagggcaacagaggagagccctaatgacaacccagaacctggcggcagcgcaaaagatg

SEQ ID NO: 223004 - DNA, 103 bp, Artificial Sequence
  Synthetic Polynucleotide
taatacgactcactatagggcgacatggtgtcgaaggtggagctgggttgaacagaggagacaacccatgtccaccttcaacctggcggcagcgcaaaagatg

SEQ ID NO: 223005 - DNA, 103 bp, Artificial Sequence
  Synthetic Polynucleotide
taatacgactcactatagggcaggcgccggcgacatggtgtcgaaggtggaacagaggagaccacctatgacaccatgtaacctggcggcagcgcaaaagatg

SEQ ID NO: 223006 - DNA, 103 bp, Artificial Sequence
  Synthetic Polynucleotide
taatacgactcactataggggaggggatgacaggcgccggcgacatggtgaacagaggagacaccatatggccggcgccaacctggcggcagcgcaaaagatg

SEQ ID NO: 223007 - DNA, 103 bp, Artificial Sequence
  Synthetic Polynucleotide
taatacgactcactataggggtcggtgttggaggggatgacaggcgccggaacagaggagaccggcgatggtcatccccaacctggcggcagcgcaaaagatg

SEQ ID NO: 223008 - DNA, 103 bp, Artificial Sequence
  Synthetic Polynucleotide
taatacgactcactataggggtccggggtagtcggtgttggaggggatgaaacagaggagatcatccatgccaacaccgaacctggcggcagcgcaaaagatg

SEQ ID NO: 223009 - DNA, 103 bp, Artificial Sequence
  Synthetic Polynucleotide
taatacgactcactatagggaagtggtggggtccggggtagtcggtgttgaacagaggagacaacacatgctaccccggaacctggcggcagcgcaaaagatg

SEQ ID NO: 223010 - DNA, 103 bp, Artificial Sequence
  Synthetic Polynucleotide
taatacgactcactatagggagtgacctcaaagtggtggggtccggggtaaacagaggagataccccatgccccaccacaacctggcggcagcgcaaaagatg

SEQ ID NO: 223011 - DNA, 103 bp, Artificial Sequence
  Synthetic Polynucleotide
taatacgactcactatagggactgctggaaagtgacctcaaagtggtgggaacagaggagacccaccatgttgaggtcaaacctggcggcagcgcaaaagatg

SEQ ID NO: 223012 - DNA, 103 bp, Artificial Sequence
  Synthetic Polynucleotide
taatacgactcactataggggccgtgctggactgctggaaagtgacctcaaacagaggagatgaggtatgtttccagcaaacctggcggcagcgcaaaagatg

SEQ ID NO: 223013 - DNA, 103 bp, Artificial Sequence
  Synthetic Polynucleotide
taatacgactcactataggggctccagaggtgctcaaacgtggtgcccccaacagaggagagggggcatgacgtttgagaacctggcggcagcgcaaaagatg

SEQ ID NO: 223014 - DNA, 103 bp, Artificial Sequence
  Synthetic Polynucleotide
taatacgactcactatagggggctgacttggccgtgctggactgctggaaaacagaggagattccagatgtccagcacgaacctggcggcagcgcaaaagatg

SEQ ID NO: 223015 - DNA, 103 bp, Artificial Sequence
  Synthetic Polynucleotide
taatacgactcactatagggacgtccaggtggctgacttggccgtgctggaacagaggagaccagcaatgccaagtcagaacctggcggcagcgcaaaagatg

SEQ ID NO: 223016 - DNA, 103 bp, Artificial Sequence
  Synthetic Polynucleotide
taatacgactcactatagggagcggggagtacgtccaggtggctgacttgaacagaggagacaagtcatgcacctggacaacctggcggcagcgcaaaagatg

SEQ ID NO: 223017 - DNA, 103 bp, Artificial Sequence
  Synthetic Polynucleotide
taatacgactcactatagggtttcttcaagagcggggagtacgtccaggtaacagaggagaacctggatgtactccccgaacctggcggcagcgcaaaagatg

SEQ ID NO: 223018 - DNA, 103 bp, Artificial Sequence
  Synthetic Polynucleotide
taatacgactcactatagggggcagtagagtttcttcaagagcggggagtaacagaggagaactcccatgtcttgaagaaacctggcggcagcgcaaaagatg

SEQ ID NO: 223019 - DNA, 103 bp, Artificial Sequence
  Synthetic Polynucleotide
taatacgactcactatagggttggcgatctggcagtagagtttcttcaagaacagaggagacttgaaatgactctactgaacctggcggcagcgcaaaagatg

SEQ ID NO: 223020 - DNA, 103 bp, Artificial Sequence
  Synthetic Polynucleotide
taatacgactcactatagggggggcatgtcttggcgatctggcagtagagaacagaggagactctacatgcagatcgccaacctggcggcagcgcaaaagatg

SEQ ID NO: 223021 - DNA, 103 bp, Artificial Sequence
  Synthetic Polynucleotide
taatacgactcactatagggtgatctggatggggcatgtcttggcgatctaacagaggagaagatcgatgagacatgccaacctggcggcagcgcaaaagatg

SEQ ID NO: 223022 - DNA, 103 bp, Artificial Sequence
  Synthetic Polynucleotide
taatacgactcactataggggtggacaccttgatctggatggggcatgtcaacagaggagagacatgatgcatccagataacctggcggcagcgcaaaagatg

SEQ ID NO: 223023 - DNA, 103 bp, Artificial Sequence
  Synthetic Polynucleotide
taatacgactcactataggggggtggcggggtggacaccttgatctggataacagaggagaatccagatgaaggtgtccaacctggcggcagcgcaaaagatg

SEQ ID NO: 223024 - DNA, 103 bp, Artificial Sequence
  Synthetic Polynucleotide
taatacgactcactataggggttccagagagctccagaggtgctcaaacgaacagaggagacgtttgatgacctctggaaacctggcggcagcgcaaaagatg

SEQ ID NO: 223025 - DNA, 103 bp, Artificial Sequence
  Synthetic Polynucleotide
taatacgactcactatagggcggtgcctgggggtggcggggtggacacctaacagaggagaaggtgtatgccccgccacaacctggcggcagcgcaaaagatg

SEQ ID NO: 223026 - DNA, 103 bp, Artificial Sequence
  Synthetic Polynucleotide
taatacgactcactataggggcccggatggcggtgcctgggggtggcgggaacagaggagacccgccatgcccaggcacaacctggcggcagcgcaaaagatg

SEQ ID NO: 223027 - DNA, 103 bp, Artificial Sequence
  Synthetic Polynucleotide
taatacgactcactatagggaacaggcatggcccggatggcggtgcctggaacagaggagaccaggcatggccatccggaacctggcggcagcgcaaaagatg

SEQ ID NO: 223028 - DNA, 103 bp, Artificial Sequence
  Synthetic Polynucleotide
taatacgactcactatagggctttcttgtaaacaggcatggcccggatggaacagaggagaccatccatgccatgcctgaacctggcggcagcgcaaaagatg

SEQ ID NO: 223029 - DNA, 103 bp, Artificial Sequence
  Synthetic Polynucleotide
taatacgactcactatagggacgtgctccgctttcttgtaaacaggcatgaacagaggagacatgccatgttacaagaaaacctggcggcagcgcaaaagatg

SEQ ID NO: 223030 - DNA, 103 bp, Artificial Sequence
  Synthetic Polynucleotide
taatacgactcactataggggacgtcggtcacgtgctccgctttcttgtaaacagaggagatacaagatggcggagcacaacctggcggcagcgcaaaagatg

SEQ ID NO: 223031 - DNA, 103 bp, Artificial Sequence
  Synthetic Polynucleotide
taatacgactcactatagggagcgtttcacgacgtcggtcacgtgctccgaacagaggagacggagcatgtgaccgacgaacctggcggcagcgcaaaagatg

SEQ ID NO: 223032 - DNA, 103 bp, Artificial Sequence
  Synthetic Polynucleotide
taatacgactcactatagggtggttggggcagcgtttcacgacgtcggtcaacagaggagagaccgaatgcgtgaaacgaacctggcggcagcgcaaaagatg

SEQ ID NO: 223033 - DNA, 103 bp, Artificial Sequence
  Synthetic Polynucleotide
taatacgactcactatagggcccgagctcgtggttggggcagcgtttcacaacagaggagagtgaaaatgtgccccaacaacctggcggcagcgcaaaagatg

SEQ ID NO: 223034 - DNA, 103 bp, Artificial Sequence
  Synthetic Polynucleotide
taatacgactcactatagggtgaagtccctcccgagctcgtggttggggcaacagaggagagccccaatgacgagctcgaacctggcggcagcgcaaaagatg

SEQ ID NO: 223035 - DNA, 103 bp, Artificial Sequence
  Synthetic Polynucleotide
taatacgactcactataggggtgctgtctggttccagagagctccagaggaacagaggagacctctgatgctctctggaaacctggcggcagcgcaaaagatg

SEQ ID NO: 223036 - DNA, 103 bp, Artificial Sequence
  Synthetic Polynucleotide
taatacgactcactatagggtgtccttcgttgaagtccctcccgagctcgaacagaggagacgagctatggagggacttaacctggcggcagcgcaaaagatg

SEQ ID NO: 223037 - DNA, 103 bp, Artificial Sequence
  Synthetic Polynucleotide
taatacgactcactatagggtggagcagactgtccttcgttgaagtccctaacagaggagaagggacatgaacgaaggaaacctggcggcagcgcaaaagatg

SEQ ID NO: 223038 - DNA, 103 bp, Artificial Sequence
  Synthetic Polynucleotide
taatacgactcactatagggggtggctggctggagcagactgtccttcgtaacagaggagaacgaagatgagtctgctcaacctggcggcagcgcaaaagatg

SEQ ID NO: 223039 - DNA, 103 bp, Artificial Sequence
  Synthetic Polynucleotide
taatacgactcactatagggacgcggatgaggtggctggctggagcagacaacagaggagagtctgcatgagccagccaaacctggcggcagcgcaaaagatg

SEQ ID NO: 223040 - DNA, 103 bp, Artificial Sequence
  Synthetic Polynucleotide
taatacgactcactatagggattgccttccacgcggatgaggtggctggcaacagaggagagccagcatgctcatccgcaacctggcggcagcgcaaaagatg

SEQ ID NO: 223041 - DNA, 103 bp, Artificial Sequence
  Synthetic Polynucleotide
taatacgactcactataggggcgagagattattgccttccacgcggatgaaacagaggagatcatccatgtggaaggcaaacctggcggcagcgcaaaagatg

SEQ ID NO: 223042 - DNA, 103 bp, Artificial Sequence
  Synthetic Polynucleotide
taatacgactcactatagggtccacatactgcgagagattattgccttccaacagaggagaggaaggatgtaatctctcaacctggcggcagcgcaaaagatg

SEQ ID NO: 223043 - DNA, 103 bp, Artificial Sequence
  Synthetic Polynucleotide
taatacgactcactataggggacagggtcatccacatactgcgagagattaacagaggagaaatctcatgcagtatgtgaacctggcggcagcgcaaaagatg

SEQ ID NO: 223044 - DNA, 103 bp, Artificial Sequence
  Synthetic Polynucleotide
taatacgactcactataggggcctgccggtgacagggtcatccacatactaacagaggagaagtatgatgatgaccctgaacctggcggcagcgcaaaagatg

SEQ ID NO: 223045 - DNA, 103 bp, Artificial Sequence
  Synthetic Polynucleotide
taatacgactcactatagggacgacgctctgcctgccggtgacagggtcaaacagaggagatgacccatgcaccggcagaacctggcggcagcgcaaaagatg

SEQ ID NO: 223046 - DNA, 103 bp, Artificial Sequence
  Synthetic Polynucleotide
taatacgactcactataggggtcgaagtaggtgctgtctggttccagagaaacagaggagatctctgatgccagacagcaacctggcggcagcgcaaaagatg

SEQ ID NO: 223047 - DNA, 103 bp, Artificial Sequence
  Synthetic Polynucleotide
taatacgactcactatagggatagggcaccacgacgctctgcctgccggtaacagaggagaaccggcatgcagagcgtcaacctggcggcagcgcaaaagatg

SEQ ID NO: 223048 - DNA, 103 bp, Artificial Sequence
  Synthetic Polynucleotide
taatacgactcactataggggtggtggctcatagggcaccacgacgctctaacagaggagaagagcgatgtggtgccctaacctggcggcagcgcaaaagatg

SEQ ID NO: 223049 - DNA, 103 bp, Artificial Sequence
  Synthetic Polynucleotide
taatacgactcactataggggtccccacctgtggtggctcatagggcaccaacagaggagaggtgccatgtgagccaccaacctggcggcagcgcaaaagatg

SEQ ID NO: 223050 - DNA, 103 bp, Artificial Sequence
  Synthetic Polynucleotide
taatacgactcactatagggggtgaattccgtccccacctgtggtggctcaacagaggagagagccaatgcaggtggggaacctggcggcagcgcaaaagatg

SEQ ID NO: 223051 - DNA, 103 bp, Artificial Sequence
  Synthetic Polynucleotide
taatacgactcactatagggacaggatggtggtgaattccgtccccacctaacagaggagaaggtggatgcggaattcaaacctggcggcagcgcaaaagatg

SEQ ID NO: 223052 - DNA, 103 bp, Artificial Sequence
  Synthetic Polynucleotide
taatacgactcactatagggatgaagttgtacaggatggtggtgaattccaacagaggagaggaattatgcaccatcctaacctggcggcagcgcaaaagatg

SEQ ID NO: 223053 - DNA, 103 bp, Artificial Sequence
  Synthetic Polynucleotide
taatacgactcactataggggctgttacacatgaagttgtacaggatggtaacagaggagaaccatcatgtacaacttcaacctggcggcagcgcaaaagatg

SEQ ID NO: 223054 - DNA, 103 bp, Artificial Sequence
  Synthetic Polynucleotide
taatacgactcactatagggctacacagctgctgttacacatgaagttgtaacagaggagaacaactatgtgtgtaacaaacctggcggcagcgcaaaagatg

SEQ ID NO: 223055 - DNA, 103 bp, Artificial Sequence
  Synthetic Polynucleotide
taatacgactcactatagggttcatgccccctacacagctgctgttacacaacagaggagagtgtaaatgcagctgtgtaacctggcggcagcgcaaaagatg

SEQ ID NO: 223056 - DNA, 103 bp, Artificial Sequence
  Synthetic Polynucleotide
taatacgactcactataggggggccgccggttcatgccccctacacagctaacagaggagaagctgtatggggggcatgaacctggcggcagcgcaaaagatg

SEQ ID NO: 223057 - DNA, 103 bp, Artificial Sequence
  Synthetic Polynucleotide
taatacgactcactatagggactggggaaggtcgaagtaggtgctgtctgaacagaggagacagacaatgcctacttcgaacctggcggcagcgcaaaagatg

SEQ ID NO: 223058 - DNA, 103 bp, Artificial Sequence
  Synthetic Polynucleotide
taatacgactcactatagggtgatgaggatgggccgccggttcatgccccaacagaggagaggggcaatgaccggcggcaacctggcggcagcgcaaaagatg

SEQ ID NO: 223059 - DNA, 103 bp, Artificial Sequence
  Synthetic Polynucleotide
taatacgactcactatagggagggtgatgatgatgaggatgggccgccggaacagaggagaccggcgatgcatcctcataacctggcggcagcgcaaaagatg

SEQ ID NO: 223060 - DNA, 103 bp, Artificial Sequence
  Synthetic Polynucleotide
taatacgactcactatagggccgcatctccagggtgatgatgatgaggataacagaggagaatcctcatgatcatcaccaacctggcggcagcgcaaaagatg

SEQ ID NO: 223061 - DNA, 103 bp, Artificial Sequence
  Synthetic Polynucleotide
taatacgactcactatagggcctgcccatcccgcatctccagggtgatgaaacagaggagatcatcaatgtggagatgcaacctggcggcagcgcaaaagatg

SEQ ID NO: 223062 - DNA, 103 bp, Artificial Sequence
  Synthetic Polynucleotide
taatacgactcactatagggcggcccagcacctgcccatcccgcatctccaacagaggagaggagatatgggatgggcaaacctggcggcagcgcaaaagatg

SEQ ID NO: 223063 - DNA, 103 bp, Artificial Sequence
  Synthetic Polynucleotide
taatacgactcactatagggaaaggaccggcggcccagcacctgcccatcaacagaggagagatgggatggtgctgggcaacctggcggcagcgcaaaagatg

SEQ ID NO: 223064 - DNA, 103 bp, Artificial Sequence
  Synthetic Polynucleotide
taatacgactcactatagggtgcggccctcaaaggaccggcggcccagcaaacagaggagatgctggatggccggtcctaacctggcggcagcgcaaaagatg

SEQ ID NO: 223065 - DNA, 103 bp, Artificial Sequence
  Synthetic Polynucleotide
taatacgactcactatagggcaggcgcagatgcggccctcaaaggaccggaacagaggagaccggtcatgtgagggccgaacctggcggcagcgcaaaagatg

SEQ ID NO: 223066 - DNA, 103 bp, Artificial Sequence
  Synthetic Polynucleotide
taatacgactcactataggggcggccaggacaggcgcagatgcggccctcaacagaggagagagggcatgatctgcgccaacctggcggcagcgcaaaagatg

SEQ ID NO: 223067 - DNA, 103 bp, Artificial Sequence
  Synthetic Polynucleotide
taatacgactcactatagggcttttcggtcgcggccaggacaggcgcagaaacagaggagatctgcgatggtcctggccaacctggcggcagcgcaaaagatg

SEQ ID NO: 223068 - DNA, 103 bp, Artificial Sequence
  Synthetic Polynucleotide
taatacgactcactatagggccccggcttgactggggaaggtcgaagtagaacagaggagactacttatgccttccccaaacctggcggcagcgcaaaagatg

SEQ ID NO: 223069 - DNA, 103 bp, Artificial Sequence
  Synthetic Polynucleotide
taatacgactcactatagggtcctcatcagcttttcggtcgcggccaggaaacagaggagatcctggatgcgaccgaaaaacctggcggcagcgcaaaagatg

SEQ ID NO: 223070 - DNA, 103 bp, Artificial Sequence
  Synthetic Polynucleotide
taatacgactcactatagggccggtagtggtcctcatcagcttttcggtcaacagaggagagaccgaatggctgatgagaacctggcggcagcgcaaaagatg

SEQ ID NO: 223071 - DNA, 103 bp, Artificial Sequence
  Synthetic Polynucleotide
taatacgactcactatagggcctgctgctcccggtagtggtcctcatcagaacagaggagactgatgatgaccactaccaacctggcggcagcgcaaaagatg

SEQ ID NO: 223072 - DNA, 103 bp, Artificial Sequence
  Synthetic Polynucleotide
taatacgactcactatagggtcgttcagggcctgctgctcccggtagtggaacagaggagaccactaatgggagcagcaaacctggcggcagcgcaaaagatg

SEQ ID NO: 223073 - DNA, 103 bp, Artificial Sequence
  Synthetic Polynucleotide
taatacgactcactatagggggcggagctctcgttcagggcctgctgctcaacagaggagagagcagatggccctgaacaacctggcggcagcgcaaaagatg

SEQ ID NO: 223074 - DNA, 103 bp, Artificial Sequence
  Synthetic Polynucleotide
taatacgactcactatagggccccgttcttggcggagctctcgttcagggaacagaggagaccctgaatgagagctccgaacctggcggcagcgcaaaagatg

SEQ ID NO: 223075 - DNA, 103 bp, Artificial Sequence
  Synthetic Polynucleotide
taatacgactcactatagggttgctggcggccccgttcttggcggagctcaacagaggagagagctcatgcaagaacggaacctggcggcagcgcaaaagatg

SEQ ID NO: 223076 - DNA, 103 bp, Artificial Sequence
  Synthetic Polynucleotide
taatacgactcactataggggaaggcacgcttgctggcggccccgttcttaacagaggagaaagaacatggccgccagcaacctggcggcagcgcaaaagatg

SEQ ID NO: 223077 - DNA, 103 bp, Artificial Sequence
  Synthetic Polynucleotide
taatacgactcactatagggggctctgcttgaaggcacgcttgctggcggaacagaggagaccgccaatgagcgtgcctaacctggcggcagcgcaaaagatg

SEQ ID NO: 223078 - DNA, 103 bp, Artificial Sequence
  Synthetic Polynucleotide
taatacgactcactatagggacggcaggggggctctgcttgaaggcacgcaacagaggagagcgtgcatgcaagcagagaacctggcggcagcgcaaaagatg

SEQ ID NO: 223079 - DNA, 103 bp, Artificial Sequence
  Synthetic Polynucleotide
taatacgactcactataggggttggtcttgtacagttgctggtcacccataacagaggagaatgggtatgcagcaactgaacctggcggcagcgcaaaagatg

SEQ ID NO: 223080 - DNA, 103 bp, Artificial Sequence
  Synthetic Polynucleotide
taatacgactcactatagggaactgcattcccatagttgtggttcagcccaacagaggagagggctgatgcacaactataacctggcggcagcgcaaaagatg

SEQ ID NO: 223081 - DNA, 103 bp, Artificial Sequence
  Synthetic Polynucleotide
taatacgactcactatagggctgctgctcttgcaagtgctgcatcatgggaacagaggagacccatgatgcagcacttgaacctggcggcagcgcaaaagatg

SEQ ID NO: 223082 - DNA, 103 bp, Artificial Sequence
  Synthetic Polynucleotide
taatacgactcactatagggtctgttgctgctgctgctcttgcaagtgctaacagaggagaagcactatgaagagcagcaacctggcggcagcgcaaaagatg

SEQ ID NO: 223083 - DNA, 103 bp, Artificial Sequence
  Synthetic Polynucleotide
taatacgactcactatagggtgcaggtgcatctgttgctgctgctgctctaacagaggagaagagcaatggcagcaacaaacctggcggcagcgcaaaagatg

SEQ ID NO: 223084 - DNA, 103 bp, Artificial Sequence
  Synthetic Polynucleotide
taatacgactcactatagggagaaggaggctgcaggtgcatctgttgctgaacagaggagacagcaaatgatgcacctgaacctggcggcagcgcaaaagatg

SEQ ID NO: 223085 - DNA, 103 bp, Artificial Sequence
  Synthetic Polynucleotide
taatacgactcactatagggccctgtgataagaaggaggctgcaggtgcaaacagaggagatgcaccatgagcctccttaacctggcggcagcgcaaaagatg

SEQ ID NO: 223086 - DNA, 103 bp, Artificial Sequence
  Synthetic Polynucleotide
taatacgactcactatagggtggtgagggtccctgtgataagaaggaggcaacagaggagagcctccatgttatcacagaacctggcggcagcgcaaaagatg

SEQ ID NO: 223087 - DNA, 103 bp, Artificial Sequence
  Synthetic Polynucleotide
taatacgactcactatagggtggggtatactggtgagggtccctgtgataaacagaggagatatcacatggaccctcacaacctggcggcagcgcaaaagatg

SEQ ID NO: 223088 - DNA, 103 bp, Artificial Sequence
  Synthetic Polynucleotide
taatacgactcactataggggtgcctgctctggggtatactggtgagggtaacagaggagaaccctcatgagtatacccaacctggcggcagcgcaaaagatg

SEQ ID NO: 223089 - DNA, 103 bp, Artificial Sequence
  Synthetic Polynucleotide
taatacgactcactatagggtggacagtgtgtgcctgctctggggtatacaacagaggagagtatacatgagagcaggcaacctggcggcagcgcaaaagatg

SEQ ID NO: 223090 - DNA, 103 bp, Artificial Sequence
  Synthetic Polynucleotide
taatacgactcactataggggggaatcagctggacagtgtgtgcctgctcaacagaggagagagcagatgcacactgtcaacctggcggcagcgcaaaagatg

SEQ ID NO: 223091 - DNA, 103 bp, Artificial Sequence
  Synthetic Polynucleotide
taatacgactcactatagggcgccccctgtaactgcattcccatagttgtaacagaggagaacaactatgggaatgcagaacctggcggcagcgcaaaagatg

SEQ ID NO: 223092 - DNA, 103 bp, Artificial Sequence
  Synthetic Polynucleotide
taatacgactcactatagggtggagcccaggggaatcagctggacagtgtaacagaggagaacactgatgagctgattcaacctggcggcagcgcaaaagatg

SEQ ID NO: 223093 - DNA, 103 bp, Artificial Sequence
  Synthetic Polynucleotide
taatacgactcactatagggtactgggacatggagcccaggggaatcagcaacagaggagagctgatatgcctgggctcaacctggcggcagcgcaaaagatg

SEQ ID NO: 223094 - DNA, 103 bp, Artificial Sequence
  Synthetic Polynucleotide
taatacgactcactatagggctggtagtagtactgggacatggagcccagaacagaggagactgggcatgatgtcccagaacctggcggcagcgcaaaagatg

SEQ ID NO: 223095 - DNA, 103 bp, Artificial Sequence
  Synthetic Polynucleotide
taatacgactcactataggggctggggctcctggtagtagtactgggacaaacagaggagatgtcccatgactactaccaacctggcggcagcgcaaaagatg

SEQ ID NO: 223096 - DNA, 103 bp, Artificial Sequence
  Synthetic Polynucleotide
taatacgactcactatagggctgtagggctgctggggctcctggtagtagaacagaggagactactaatgggagccccaaacctggcggcagcgcaaaagatg

SEQ ID NO: 223097 - DNA, 103 bp, Artificial Sequence
  Synthetic Polynucleotide
taatacgactcactataggggagggggtggctgtagggctgctggggctcaacagaggagagagcccatgcagccctacaacctggcggcagcgcaaaagatg

SEQ ID NO: 223098 - DNA, 103 bp, Artificial Sequence
  Synthetic Polynucleotide
taatacgactcactatagggtctgctggtagagggggtggctgtagggctaacagaggagaagccctatggccacccccaacctggcggcagcgcaaaagatg

SEQ ID NO: 223099 - DNA, 103 bp, Artificial Sequence
  Synthetic Polynucleotide
taatacgactcactataggggacaggtggctctgctggtagagggggtggaacagaggagaccacccatgctaccagcaaacctggcggcagcgcaaaagatg

SEQ ID NO: 223100 - DNA, 103 bp, Artificial Sequence
  Synthetic Polynucleotide
taatacgactcactatagggctggtgctgggacaggtggctctgctggtaaacagaggagataccagatgagccacctgaacctggcggcagcgcaaaagatg

SEQ ID NO: 223101 - DNA, 103 bp, Artificial Sequence
  Synthetic Polynucleotide
taatacgactcactatagggcctcacgctgctggtgctgggacaggtggcaacagaggagagccaccatgcccagcaccaacctggcggcagcgcaaaagatg

SEQ ID NO: 223102 - DNA, 103 bp, Artificial Sequence
  Synthetic Polynucleotide
taatacgactcactataggggcatccattccgccccctgtaactgcattcaacagaggagagaatgcatgtacagggggaacctggcggcagcgcaaaagatg

SEQ ID NO: 223103 - DNA, 103 bp, Artificial Sequence
  Synthetic Polynucleotide
taatacgactcactatagggagctgactgtcctcacgctgctggtgctggaacagaggagaccagcaatggcagcgtgaaacctggcggcagcgcaaaagatg

SEQ ID NO: 223104 - DNA, 103 bp, Artificial Sequence
  Synthetic Polynucleotide
taatacgactcactataggggtaggtcttcagctgactgtcctcacgctgaacagaggagacagcgtatggacagtcagaacctggcggcagcgcaaaagatg

SEQ ID NO: 223105 - DNA, 103 bp, Artificial Sequence
  Synthetic Polynucleotide
taatacgactcactatagggtgtcactagagtaggtcttcagctgactgtaacagaggagaacagtcatgtgaagacctaacctggcggcagcgcaaaagatg

SEQ ID NO: 223106 - DNA, 103 bp, Artificial Sequence
  Synthetic Polynucleotide
taatacgactcactatagggtgggcctgtctgtcactagagtaggtcttcaacagaggagagaagacatgctctagtgaaacctggcggcagcgcaaaagatg

SEQ ID NO: 223107 - DNA, 103 bp, Artificial Sequence
  Synthetic Polynucleotide
taatacgactcactatagggcagcatggcctgggcctgtctgtcactagaaacagaggagatctagtatgagacaggccaacctggcggcagcgcaaaagatg

SEQ ID NO: 223108 - DNA, 103 bp, Artificial Sequence
  Synthetic Polynucleotide
taatacgactcactatagggcatgggagctcagcatggcctgggcctgtcaacagaggagagacaggatgaggccatgcaacctggcggcagcgcaaaagatg

SEQ ID NO: 223109 - DNA, 103 bp, Artificial Sequence
  Synthetic Polynucleotide
taatacgactcactatagggcccaggtccccatgggagctcagcatggccaacagaggagaggccatatggagctcccaaacctggcggcagcgcaaaagatg

SEQ ID NO: 223110 - DNA, 103 bp, Artificial Sequence
  Synthetic Polynucleotide
taatacgactcactataggggtcaggaggccccaggtccccatgggagctaacagaggagaagctccatgggggacctgaacctggcggcagcgcaaaagatg

SEQ ID NO: 223111 - DNA, 103 bp, Artificial Sequence
  Synthetic Polynucleotide
taatacgactcactatagggccattcctgtgtcaggaggccccaggtcccaacagaggagagggaccatgggcctcctgaacctggcggcagcgcaaaagatg

SEQ ID NO: 223112 - DNA, 103 bp, Artificial Sequence
  Synthetic Polynucleotide
taatacgactcactataggggctgggtctcccattcctgtgtcaggaggcaacagaggagagcctccatgcacaggaataacctggcggcagcgcaaaagatg

SEQ ID NO: 223113 - DNA, 103 bp, Artificial Sequence
  Synthetic Polynucleotide
taatacgactcactatagggggcctgaggggcatccattccgccccctgtaacagaggagaacagggatgggaatggataacctggcggcagcgcaaaagatg

SEQ ID NO: 223114 - DNA, 103 bp, Artificial Sequence
  Synthetic Polynucleotide
taatacgactcactatagggatctgagctcgctgggtctcccattcctgtaacagaggagaacaggaatgggagacccaaacctggcggcagcgcaaaagatg

SEQ ID NO: 223115 - DNA, 103 bp, Artificial Sequence
  Synthetic Polynucleotide
taatacgactcactatagggcccgggtcagatctgagctcgctgggtctcaacagaggagagagaccatgcgagctcagaacctggcggcagcgcaaaagatg

SEQ ID NO: 223116 - DNA, 103 bp, Artificial Sequence
  Synthetic Polynucleotide
taatacgactcactataggggtgctgctgacccgggtcagatctgagctcaacagaggagagagctcatgtctgacccgaacctggcggcagcgcaaaagatg

SEQ ID NO: 223117 - DNA, 103 bp, Artificial Sequence
  Synthetic Polynucleotide
taatacgactcactatagggatgggggagggtgctgctgacccgggtcagaacagaggagactgaccatggtcagcagcaacctggcggcagcgcaaaagatg

SEQ ID NO: 223118 - DNA, 103 bp, Artificial Sequence
  Synthetic Polynucleotide
taatacgactcactatagggggagggggcgatgggggagggtgctgctgaaacagaggagatcagcaatgccctcccccaacctggcggcagcgcaaaagatg

SEQ ID NO: 223119 - DNA, 103 bp, Artificial Sequence
  Synthetic Polynucleotide
taatacgactcactatagggctgggggataggagggggcgatgggggaggaacagaggagacctcccatgtcgccccctaacctggcggcagcgcaaaagatg

SEQ ID NO: 223120 - DNA, 103 bp, Artificial Sequence
  Synthetic Polynucleotide
taatacgactcactataggggtggatcccactgggggataggagggggcgaacagaggagacgccccatgctatcccccaacctggcggcagcgcaaaagatg

SEQ ID NO: 223121 - DNA, 103 bp, Artificial Sequence
  Synthetic Polynucleotide
taatacgactcactatagggtgttgttgaggtggatcccactgggggataaacagaggagatatcccatggtgggatccaacctggcggcagcgcaaaagatg

SEQ ID NO: 223122 - DNA, 103 bp, Artificial Sequence
  Synthetic Polynucleotide
taatacgactcactatagggtgaggccccatgttgttgaggtggatcccaaacagaggagatgggatatgcctcaacaaaacctggcggcagcgcaaaagatg

SEQ ID NO: 223123 - DNA, 103 bp, Artificial Sequence
  Synthetic Polynucleotide
taatacgactcactatagggctgctgatgctgaggccccatgttgttgagaacagaggagactcaacatgatggggcctaacctggcggcagcgcaaaagatg

SEQ ID NO: 223124 - DNA, 103 bp, Artificial Sequence
  Synthetic Polynucleotide
taatacgactcactatagggagattggcgaggcctgaggggcatccattcaacagaggagagaatggatgcccctcaggaacctggcggcagcgcaaaagatg

SEQ ID NO: 223125 - DNA, 103 bp, Artificial Sequence
  Synthetic Polynucleotide
taatacgactcactatagggtgggagacagctgctgatgctgaggccccaaacagaggagatggggcatgagcatcagcaacctggcggcagcgcaaaagatg

SEQ ID NO: 223126 - DNA, 103 bp, Artificial Sequence
  Synthetic Polynucleotide
taatacgactcactatagggcacatggcactgggagacagctgctgatgcaacagaggagagcatcaatggctgtctccaacctggcggcagcgcaaaagatg

SEQ ID NO: 223127 - DNA, 103 bp, Artificial Sequence
  Synthetic Polynucleotide
taatacgactcactatagggcatctggggccacatggcactgggagacagaacagaggagactgtctatgagtgccatgaacctggcggcagcgcaaaagatg

SEQ ID NO: 223128 - DNA, 103 bp, Artificial Sequence
  Synthetic Polynucleotide
taatacgactcactatagggcaggtaggtgcatctggggccacatggcacaacagaggagagtgccaatgggccccagaaacctggcggcagcgcaaaagatg

SEQ ID NO: 223129 - DNA, 103 bp, Artificial Sequence
  Synthetic Polynucleotide
taatacgactcactataggggctctcccatcaggtaggtgcatctggggcaacagaggagagccccaatggcacctaccaacctggcggcagcgcaaaagatg

SEQ ID NO: 223130 - DNA, 103 bp, Artificial Sequence
  Synthetic Polynucleotide
taatacgactcactatagggccctggctgggctctcccatcaggtaggtgaacagaggagacacctaatggatgggagaaacctggcggcagcgcaaaagatg

SEQ ID NO: 223131 - DNA, 103 bp, Artificial Sequence
  Synthetic Polynucleotide
taatacgactcactatagggactcaggggaccctggctgggctctcccataacagaggagaatgggaatgcccagccagaacctggcggcagcgcaaaagatg

SEQ ID NO: 223132 - DNA, 103 bp, Artificial Sequence
  Synthetic Polynucleotide
taatacgactcactatagggtggccacttgactcaggggaccctggctggaacagaggagaccagccatggtcccctgaaacctggcggcagcgcaaaagatg

SEQ ID NO: 223133 - DNA, 103 bp, Artificial Sequence
  Synthetic Polynucleotide
taatacgactcactatagggtcctttgggttggccacttgactcaggggaaacagaggagatcccctatgtcaagtggcaacctggcggcagcgcaaaagatg

SEQ ID NO: 223134 - DNA, 103 bp, Artificial Sequence
  Synthetic Polynucleotide
taatacgactcactatagggccccaaacgctcctttgggttggccacttgaacagaggagacaagtgatgaacccaaagaacctggcggcagcgcaaaagatg

SEQ ID NO: 223135 - DNA, 103 bp, Artificial Sequence
  Synthetic Polynucleotide
taatacgactcactatagggaagtggggggagattggcgaggcctgagggaacagaggagaccctcaatgctcgccaataacctggcggcagcgcaaaagatg

SEQ ID NO: 223136 - DNA, 103 bp, Artificial Sequence
  Synthetic Polynucleotide
taatacgactcactatagggtcaaactgctccccaaacgctcctttgggtaacagaggagaacccaaatgagcgtttggaacctggcggcagcgcaaaagatg

SEQ ID NO: 223137 - DNA, 103 bp, Artificial Sequence
  Synthetic Polynucleotide
taatacgactcactataggggttcttggcatcaaactgctccccaaacgcaacagaggagagcgtttatggagcagtttaacctggcggcagcgcaaaagatg

SEQ ID NO: 223138 - DNA, 103 bp, Artificial Sequence
  Synthetic Polynucleotide
taatacgactcactatagggatgtcagcttgttcttggcatcaaactgctaacagaggagaagcagtatgatgccaagaaacctggcggcagcgcaaaagatg

SEQ ID NO: 223139 - DNA, 103 bp, Artificial Sequence
  Synthetic Polynucleotide
taatacgactcactatagggcagatggagcatgtcagcttgttcttggcaaacagaggagatgccaaatgcaagctgacaacctggcggcagcgcaaaagatg

SEQ ID NO: 223140 - DNA, 103 bp, Artificial Sequence
  Synthetic Polynucleotide
taatacgactcactatagggctccttcaggcagatggagcatgtcagcttaacagaggagaaagctgatgtgctccatcaacctggcggcagcgcaaaagatg

SEQ ID NO: 223141 - DNA, 103 bp, Artificial Sequence
  Synthetic Polynucleotide
taatacgactcactatagggggttcttgaactccttcaggcagatggagcaacagaggagagctccaatggcctgaaggaacctggcggcagcgcaaaagatg

SEQ ID NO: 223142 - DNA, 103 bp, Artificial Sequence
  Synthetic Polynucleotide
taatacgactcactatagggagggcaggcaggttcttgaactccttcaggaacagaggagacctgaaatggttcaagaaaacctggcggcagcgcaaaagatg

SEQ ID NO: 223143 - DNA, 103 bp, Artificial Sequence
  Synthetic Polynucleotide
taatacgactcactataggggtggccattcagggcaggcaggttcttgaaaacagaggagattcaagatgctgcctgccaacctggcggcagcgcaaaagatg

SEQ ID NO: 223144 - DNA, 103 bp, Artificial Sequence
  Synthetic Polynucleotide
taatacgactcactataggggggaccgcatgtggccattcagggcaggcaaacagaggagatgcctgatgtgaatggccaacctggcggcagcgcaaaagatg

SEQ ID NO: 223145 - DNA, 103 bp, Artificial Sequence
  Synthetic Polynucleotide
taatacgactcactatagggattcccccgtgggaccgcatgtggccattcaacagaggagagaatggatgcatgcggtcaacctggcggcagcgcaaaagatg

SEQ ID NO: 223146 - DNA, 103 bp, Artificial Sequence
  Synthetic Polynucleotide
taatacgactcactatagggatcttgagggaagtggggggagattggcgaaacagaggagatcgccaatgtccccccacaacctggcggcagcgcaaaagatg

SEQ ID NO: 223147 - DNA, 103 bp, Artificial Sequence
  Synthetic Polynucleotide
taatacgactcactatagggggaggccctcattcccccgtgggaccgcataacagaggagaatgcggatgcacgggggaaacctggcggcagcgcaaaagatg

SEQ ID NO: 223148 - DNA, 103 bp, Artificial Sequence
  Synthetic Polynucleotide
taatacgactcactatagggtgaggttgggggaggccctcattcccccgtaacagaggagaacggggatgtgagggcctaacctggcggcagcgcaaaagatg

SEQ ID NO: 223149 - DNA, 103 bp, Artificial Sequence
  Synthetic Polynucleotide
taatacgactcactatagggatttcctgtttgaggttgggggaggccctcaacagaggagagagggcatgccccaacctaacctggcggcagcgcaaaagatg

SEQ ID NO: 223150 - DNA, 103 bp, Artificial Sequence
  Synthetic Polynucleotide
taatacgactcactatagggcttcctggggatttcctgtttgaggttgggaacagaggagacccaacatgaaacaggaaaacctggcggcagcgcaaaagatg

SEQ ID NO: 223151 - DNA, 103 bp, Artificial Sequence
  Synthetic Polynucleotide
taatacgactcactatagggtcggctgatgcttcctggggatttcctgttaacagaggagaaacaggatgtccccaggaaacctggcggcagcgcaaaagatg

SEQ ID NO: 223152 - DNA, 103 bp, Artificial Sequence
  Synthetic Polynucleotide
taatacgactcactatagggttgggcacactcggctgatgcttcctggggaacagaggagaccccagatggcatcagccaacctggcggcagcgcaaaagatg

SEQ ID NO: 223153 - DNA, 103 bp, Artificial Sequence
  Synthetic Polynucleotide
taatacgactcactatagggctcctcggctttgggcacactcggctgatgaacagaggagacatcagatgagtgtgcccaacctggcggcagcgcaaaagatg

SEQ ID NO: 223154 - DNA, 103 bp, Artificial Sequence
  Synthetic Polynucleotide
taatacgactcactatagggtcttgaggggctcctcggctttgggcacacaacagaggagagtgtgcatgaagccgaggaacctggcggcagcgcaaaagatg

SEQ ID NO: 223155 - DNA, 103 bp, Artificial Sequence
  Synthetic Polynucleotide
taatacgactcactatagggtcctgcacggtcttgaggggctcctcggctaacagaggagaagccgaatggcccctcaaaacctggcggcagcgcaaaagatg

SEQ ID NO: 223156 - DNA, 103 bp, Artificial Sequence
  Synthetic Polynucleotide
taatacgactcactatagggctttttcttctcctgcacggtcttgaggggaacagaggagacccctcatgaccgtgcagaacctggcggcagcgcaaaagatg

SEQ ID NO: 223157 - DNA, 103 bp, Artificial Sequence
  Synthetic Polynucleotide
taatacgactcactatagggcatcccgtgtatcttgagggaagtggggggaacagaggagaccccccatgtccctcaagaacctggcggcagcgcaaaagatg

SEQ ID NO: 223158 - DNA, 103 bp, Artificial Sequence
  Synthetic Polynucleotide
taatacgactcactatagggggtgccggaactttttcttctcctgcacggaacagaggagaccgtgcatgagaagaaaaaacctggcggcagcgcaaaagatg

SEQ ID NO: 223159 - DNA, 103 bp, Artificial Sequence
  Synthetic Polynucleotide
taatacgactcactatagggggttccggccggtgccggaactttttcttcaacagaggagagaagaaatggttccggcaaacctggcggcagcgcaaaagatg

SEQ ID NO: 223160 - DNA, 103 bp, Artificial Sequence
  Synthetic Polynucleotide
taatacgactcactataggggatgaagagaggttccggccggtgccggaaaacagaggagattccggatgcggccggaaaacctggcggcagcgcaaaagatg

SEQ ID NO: 223161 - DNA, 103 bp, Artificial Sequence
  Synthetic Polynucleotide
taatacgactcactataggggcggcggcgggatgaagagaggttccggccaacagaggagaggccggatgctctcttcaaacctggcggcagcgcaaaagatg

SEQ ID NO: 223162 - DNA, 103 bp, Artificial Sequence
  Synthetic Polynucleotide
taatacgactcactatagggttgtaggagggcggcggcgggatgaagagaaacagaggagatctcttatgcccgccgccaacctggcggcagcgcaaaagatg

SEQ ID NO: 223163 - DNA, 103 bp, Artificial Sequence
  Synthetic Polynucleotide
taatacgactcactatagggggggttcgggttgtaggagggcggcggcggaacagaggagaccgccgatgccctcctacaacctggcggcagcgcaaaagatg

SEQ ID NO: 223164 - DNA, 103 bp, Artificial Sequence
  Synthetic Polynucleotide
taatacgactcactatagggaggaggcagcggggttcgggttgtaggaggaacagaggagacctcctatgacccgaaccaacctggcggcagcgcaaaagatg

SEQ ID NO: 223165 - DNA, 103 bp, Artificial Sequence
  Synthetic Polynucleotide
taatacgactcactataggggcgcccgagtaggaggcagcggggttcgggaacagaggagacccgaaatgcgctgcctcaacctggcggcagcgcaaaagatg

SEQ ID NO: 223166 - DNA, 103 bp, Artificial Sequence
  Synthetic Polynucleotide
taatacgactcactataggggtacagggtggcgcccgagtaggaggcagcaacagaggagagctgccatgtactcgggcaacctggcggcagcgcaaaagatg

SEQ ID NO: 223167 - DNA, 103 bp, Artificial Sequence
  Synthetic Polynucleotide
taatacgactcactataggggctggctctggtacagggtggcgcccgagtaacagaggagaactcggatgccaccctgtaacctggcggcagcgcaaaagatg

SEQ ID NO: 223168 - DNA, 103 bp, Artificial Sequence
  Synthetic Polynucleotide
taatacgactcactatagggaagcccagaccatcccgtgtatcttgagggaacagaggagaccctcaatgtacacgggaaacctggcggcagcgcaaaagatg

SEQ ID NO: 223169 - DNA, 103 bp, Artificial Sequence
  Synthetic Polynucleotide
taatacgactcactatagggggggagcgcagctggctctggtacagggtgaacagaggagacaccctatgccagagccaaacctggcggcagcgcaaaagatg

SEQ ID NO: 223170 - DNA, 103 bp, Artificial Sequence
  Synthetic Polynucleotide
taatacgactcactataggggaggacgcgcggggagcgcagctggctctgaacagaggagacagagcatgctgcgctccaacctggcggcagcgcaaaagatg

SEQ ID NO: 223171 - DNA, 103 bp, Artificial Sequence
  Synthetic Polynucleotide
taatacgactcactatagggggtggtccccgaggacgcgcggggagcgcaaacagaggagatgcgctatgcgcgcgtccaacctggcggcagcgcaaaagatg

SEQ ID NO: 223172 - DNA, 103 bp, Artificial Sequence
  Synthetic Polynucleotide
taatacgactcactatagggtccaggagcaggtggtccccgaggacgcgcaacagaggagagcgcgtatgcggggaccaaacctggcggcagcgcaaaagatg

SEQ ID NO: 223173 - DNA, 103 bp, Artificial Sequence
  Synthetic Polynucleotide
taatacgactcactataggggtgggtggggtccaggagcaggtggtccccaacagaggagaggggacatgctgctcctgaacctggcggcagcgcaaaagatg

SEQ ID NO: 223174 - DNA, 103 bp, Artificial Sequence
  Synthetic Polynucleotide
taatacgactcactatagggggggcagctcgtgggtggggtccaggagcaaacagaggagatgctccatgaccccacccaacctggcggcagcgcaaaagatg

SEQ ID NO: 223175 - DNA, 103 bp, Artificial Sequence
  Synthetic Polynucleotide
taatacgactcactatagggggcgtgtaagggggcagctcgtgggtggggaacagaggagaccccacatgcgagctgccaacctggcggcagcgcaaaagatg

SEQ ID NO: 223176 - DNA, 103 bp, Artificial Sequence
  Synthetic Polynucleotide
taatacgactcactatagggcatgggtgggggcgtgtaagggggcagctcaacagaggagagagctgatgccttacacgaacctggcggcagcgcaaaagatg

SEQ ID NO: 223177 - DNA, 103 bp, Artificial Sequence
  Synthetic Polynucleotide
taatacgactcactatagggccgggctcagcatgggtgggggcgtgtaagaacagaggagacttacaatgccccacccaaacctggcggcagcgcaaaagatg

SEQ ID NO: 223178 - DNA, 103 bp, Artificial Sequence
  Synthetic Polynucleotide
taatacgactcactatagggccctggcgcaccgggctcagcatgggtgggaacagaggagacccaccatggctgagcccaacctggcggcagcgcaaaagatg

SEQ ID NO: 223179 - DNA, 103 bp, Artificial Sequence
  Synthetic Polynucleotide
taatacgactcactataggggccaacaggcaagcccagaccatcccgtgtaacagaggagaacacggatgggtctgggcaacctggcggcagcgcaaaagatg

SEQ ID NO: 223180 - DNA, 103 bp, Artificial Sequence
  Synthetic Polynucleotide
taatacgactcactataggggagccccgagccctggcgcaccgggctcagaacagaggagactgagcatggtgcgccagaacctggcggcagcgcaaaagatg

SEQ ID NO: 223181 - DNA, 103 bp, Artificial Sequence
  Synthetic Polynucleotide
taatacgactcactatagggcattgctgaagagccccgagccctggcgcaaacagaggagatgcgccatggctcggggcaacctggcggcagcgcaaaagatg

SEQ ID NO: 223182 - DNA, 103 bp, Artificial Sequence
  Synthetic Polynucleotide
taatacgactcactataggggagatgaggacattgctgaagagccccgagaacagaggagactcgggatgcttcagcaaaacctggcggcagcgcaaaagatg

SEQ ID NO: 223183 - DNA, 103 bp, Artificial Sequence
  Synthetic Polynucleotide
taatacgactcactataggggccgtggccggagatgaggacattgctgaaaacagaggagattcagcatggtcctcatcaacctggcggcagcgcaaaagatg

SEQ ID NO: 223184 - DNA, 103 bp, Artificial Sequence
  Synthetic Polynucleotide
taatacgactcactataggggggcgccagggccgtggccggagatgaggaaacagaggagatcctcaatgccggccacgaacctggcggcagcgcaaaagatg

SEQ ID NO: 223185 - DNA, 103 bp, Artificial Sequence
  Synthetic Polynucleotide
taatacgactcactatagggagctgcgggtgggcgccagggccgtggccgaacagaggagacggccaatgccctggcgcaacctggcggcagcgcaaaagatg

SEQ ID NO: 223186 - DNA, 103 bp, Artificial Sequence
  Synthetic Polynucleotide
taatacgactcactatagggcgtcaggggcagctgcgggtgggcgccaggaacagaggagacctggcatgcacccgcagaacctggcggcagcgcaaaagatg

SEQ ID NO: 223187 - DNA, 103 bp, Artificial Sequence
  Synthetic Polynucleotide
taatacgactcactataggggcgtcaggggcgtcaggggcagctgcgggtaacagaggagaacccgcatgtgcccctgaaacctggcggcagcgcaaaagatg

SEQ ID NO: 223188 - DNA, 103 bp, Artificial Sequence
  Synthetic Polynucleotide
taatacgactcactatagggcgtggtgtgggcgtcaggggcgtcaggggcaacagaggagagcccctatggcccctgacaacctggcggcagcgcaaaagatg

SEQ ID NO: 223189 - DNA, 103 bp, Artificial Sequence
  Synthetic Polynucleotide
taatacgactcactatagggcagcagcacccgtggtgtgggcgtcaggggaacagaggagacccctgatgcccacaccaaacctggcggcagcgcaaaagatg

SEQ ID NO: 223190 - DNA, 103 bp, Artificial Sequence
  Synthetic Polynucleotide
taatacgactcactataggggggccacatggttggtcttgtacagttgctaacagaggagaagcaacatgacaagaccaaacctggcggcagcgcaaaagatg

SEQ ID NO: 223191 - DNA, 103 bp, Artificial Sequence
  Synthetic Polynucleotide
taatacgactcactatagggggtttttggagccaacaggcaagcccagacaacagaggagagtctggatgtgcctgttgaacctggcggcagcgcaaaagatg

SEQ ID NO: 223192 - DNA, 103 bp, Artificial Sequence
  Synthetic Polynucleotide
taatacgactcactatagggtggagcgacacagcagcacccgtggtgtggaacagaggagaccacacatggggtgctgcaacctggcggcagcgcaaaagatg

SEQ ID NO: 223193 - DNA, 103 bp, Artificial Sequence
  Synthetic Polynucleotide
taatacgactcactatagggtcgatgctgttggagcgacacagcagcaccaacagaggagaggtgctatggtgtcgctcaacctggcggcagcgcaaaagatg

SEQ ID NO: 223194 - DNA, 103 bp, Artificial Sequence
  Synthetic Polynucleotide
taatacgactcactataggggttgctgccatcgatgctgttggagcgacaaacagaggagatgtcgcatgaacagcatcaacctggcggcagcgcaaaagatg

SEQ ID NO: 223195 - DNA, 103 bp, Artificial Sequence
  Synthetic Polynucleotide
taatacgactcactatagggtgaccgtcacgttgctgccatcgatgctgtaacagaggagaacagcaatgatggcagcaaacctggcggcagcgcaaaagatg

SEQ ID NO: 223196 - DNA, 103 bp, Artificial Sequence
  Synthetic Polynucleotide
taatacgactcactatagggggccctggggtgaccgtcacgttgctgccaaacagaggagatggcagatgcgtgacggtaacctggcggcagcgcaaaagatg

SEQ ID NO: 223197 - DNA, 103 bp, Artificial Sequence
  Synthetic Polynucleotide
taatacgactcactatagggctgctctccaggccctggggtgaccgtcacaacagaggagagtgacgatgaccccagggaacctggcggcagcgcaaaagatg

SEQ ID NO: 223198 - DNA, 103 bp, Artificial Sequence
  Synthetic Polynucleotide
taatacgactcactatagggcatctacagtctgctctccaggccctggggaacagaggagaccccagatgctggagagcaacctggcggcagcgcaaaagatg

SEQ ID NO: 223199 - DNA, 103 bp, Artificial Sequence
  Synthetic Polynucleotide
taatacgactcactatagggcgtggttcaacatctacagtctgctctccaaacagaggagatggagaatggactgtagaaacctggcggcagcgcaaaagatg

SEQ ID NO: 223200 - DNA, 103 bp, Artificial Sequence
  Synthetic Polynucleotide
taatacgactcactatagggaatgttgatgcgtggttcaacatctacagtaacagaggagaactgtaatggttgaaccaaacctggcggcagcgcaaaagatg

SEQ ID NO: 223201 - DNA, 103 bp, Artificial Sequence
  Synthetic Polynucleotide
taatacgactcactatagggatctcaagccaatgttgatgcgtggttcaaaacagaggagattgaacatggcatcaacaaacctggcggcagcgcaaaagatg

SEQ ID NO: 223202 - DNA, 103 bp, Artificial Sequence
  Synthetic Polynucleotide
taatacgactcactatagggatttggccaaggtttttggagccaacaggcaacagaggagagcctgtatgctccaaaaaaacctggcggcagcgcaaaagatg

SEQ ID NO: 223203 - DNA, 103 bp, Artificial Sequence
  Synthetic Polynucleotide
taatacgactcactatagggtctgcttggaatctcaagccaatgttgatgaacagaggagacatcaaatgtggcttgagaacctggcggcagcgcaaaagatg

SEQ ID NO: 223204 - DNA, 103 bp, Artificial Sequence
  Synthetic Polynucleotide
taatacgactcactatagggttcagggatttctgcttggaatctcaagccaacagaggagaggcttgatgttccaagcaaacctggcggcagcgcaaaagatg

SEQ ID NO: 223205 - DNA, 103 bp, Artificial Sequence
  Synthetic Polynucleotide
taatacgactcactatagggtatcttggagttcagggatttctgcttggaaacagaggagatccaagatgaaatccctgaacctggcggcagcgcaaaagatg

SEQ ID NO: 223206 - DNA, 103 bp, Artificial Sequence
  Synthetic Polynucleotide
taatacgactcactatagggagggcagagatatcttggagttcagggattaacagaggagaaatcccatgactccaagaaacctggcggcagcgcaaaagatg

SEQ ID NO: 223207 - DNA, 103 bp, Artificial Sequence
  Synthetic Polynucleotide
taatacgactcactataggggtcctgggccagggcagagatatcttggagaacagaggagactccaaatgatctctgccaacctggcggcagcgcaaaagatg

SEQ ID NO: 223208 - DNA, 103 bp, Artificial Sequence
  Synthetic Polynucleotide
taatacgactcactatagggccttgtgtgtgtcctgggccagggcagagaaacagaggagatctctgatgtggcccaggaacctggcggcagcgcaaaagatg

SEQ ID NO: 223209 - DNA, 103 bp, Artificial Sequence
  Synthetic Polynucleotide
taatacgactcactatagggaccagtgtggccttgtgtgtgtcctgggccaacagaggagaggcccaatgcacacacaaaacctggcggcagcgcaaaagatg

SEQ ID NO: 223210 - DNA, 103 bp, Artificial Sequence
  Synthetic Polynucleotide
taatacgactcactataggggggcttccataccagtgtggccttgtgtgtaacagaggagaacacacatggccacactgaacctggcggcagcgcaaaagatg

SEQ ID NO: 223211 - DNA, 103 bp, Artificial Sequence
  Synthetic Polynucleotide
taatacgactcactataggggttctggccagggcttccataccagtgtggaacagaggagaccacacatgtatggaagcaacctggcggcagcgcaaaagatg

SEQ ID NO: 223212 - DNA, 103 bp, Artificial Sequence
  Synthetic Polynucleotide
taatacgactcactatagggtggttttctagttctggccagggcttccataacagaggagaatggaaatgctggccagaaacctggcggcagcgcaaaagatg

SEQ ID NO: 223213 - DNA, 103 bp, Artificial Sequence
  Synthetic Polynucleotide
taatacgactcactatagggcgaggtatccatttggccaaggtttttggaaacagaggagatccaaaatgcttggccaaaacctggcggcagcgcaaaagatg

SEQ ID NO: 223214 - DNA, 103 bp, Artificial Sequence
  Synthetic Polynucleotide
taatacgactcactatagggctggaggtcatggttttctagttctggccaaacagaggagatggccaatgctagaaaacaacctggcggcagcgcaaaagatg

SEQ ID NO: 223215 - DNA, 103 bp, Artificial Sequence
  Synthetic Polynucleotide
taatacgactcactatagggccactctttgctggaggtcatggttttctaaacagaggagatagaaaatgatgacctccaacctggcggcagcgcaaaagatg

SEQ ID NO: 223216 - DNA, 103 bp, Artificial Sequence
  Synthetic Polynucleotide
taatacgactcactatagggagaagattctccactctttgctggaggtcaaacagaggagatgacctatggcaaagagtaacctggcggcagcgcaaaagatg

SEQ ID NO: 223217 - DNA, 103 bp, Artificial Sequence
  Synthetic Polynucleotide
taatacgactcactataggggcacaaattcagaagattctccactctttgaacagaggagacaaagaatggagaatcttaacctggcggcagcgcaaaagatg

SEQ ID NO: 223218 - DNA, 103 bp, Artificial Sequence
  Synthetic Polynucleotide
taatacgactcactatagggcactggaacagcacaaattcagaagattctaacagaggagaagaatcatgtgaatttgtaacctggcggcagcgcaaaagatg

SEQ ID NO: 223219 - DNA, 103 bp, Artificial Sequence
  Synthetic Polynucleotide
taatacgactcactatagggcctggcaatgcactggaacagcacaaattcaacagaggagagaatttatgctgttccagaacctggcggcagcgcaaaagatg

SEQ ID NO: 223220 - DNA, 103 bp, Artificial Sequence
  Synthetic Polynucleotide
taatacgactcactatagggggtccctccacctggcaatgcactggaacaaacagaggagatgttccatggcattgccaaacctggcggcagcgcaaaagatg

SEQ ID NO: 223221 - DNA, 103 bp, Artificial Sequence
  Synthetic Polynucleotide
taatacgactcactatagggattcagaattggtccctccacctggcaatgaacagaggagacattgcatggtggagggaaacctggcggcagcgcaaaagatg

SEQ ID NO: 223222 - DNA, 103 bp, Artificial Sequence
  Synthetic Polynucleotide
taatacgactcactatagggtgcaaagcaaattcagaattggtccctccaaacagaggagatggaggatgcaattctgaaacctggcggcagcgcaaaagatg

SEQ ID NO: 223223 - DNA, 103 bp, Artificial Sequence
  Synthetic Polynucleotide
taatacgactcactatagggaaacagagagtgcaaagcaaattcagaattaacagaggagaaattctatgtttgctttgaacctggcggcagcgcaaaagatg

SEQ ID NO: 223224 - DNA, 103 bp, Artificial Sequence
  Synthetic Polynucleotide
taatacgactcactatagggctccctgcctcgaggtatccatttggccaaaacagaggagattggccatgtggatacctaacctggcggcagcgcaaaagatg

SEQ ID NO: 223225 - DNA, 103 bp, Artificial Sequence
  Synthetic Polynucleotide
taatacgactcactatagggctttggcctcaaacagagagtgcaaagcaaaacagaggagattgcttatgactctctgtaacctggcggcagcgcaaaagatg

SEQ ID NO: 223226 - DNA, 103 bp, Artificial Sequence
  Synthetic Polynucleotide
taatacgactcactatagggatcacatcacctttggcctcaaacagagagaacagaggagactctctatgtgaggccaaaacctggcggcagcgcaaaagatg

SEQ ID NO: 223227 - DNA, 103 bp, Artificial Sequence
  Synthetic Polynucleotide
taatacgactcactatagggcagagcaaccatcacatcacctttggcctcaacagaggagagaggccatgggtgatgtgaacctggcggcagcgcaaaagatg

SEQ ID NO: 223228 - DNA, 103 bp, Artificial Sequence
  Synthetic Polynucleotide
taatacgactcactataggggcagcatttccagagcaaccatcacatcacaacagaggagagtgatgatgtggttgctcaacctggcggcagcgcaaaagatg

SEQ ID NO: 223229 - DNA, 103 bp, Artificial Sequence
  Synthetic Polynucleotide
taatacgactcactatagggttccgcagtagcagcatttccagagcaaccaacagaggagaggttgcatgggaaatgctaacctggcggcagcgcaaaagatg

SEQ ID NO: 223230 - DNA, 103 bp, Artificial Sequence
  Synthetic Polynucleotide
taatacgactcactatagggcctgacaggcttccgcagtagcagcatttcaacagaggagagaaatgatgctactgcggaacctggcggcagcgcaaaagatg

SEQ ID NO: 223231 - DNA, 103 bp, Artificial Sequence
  Synthetic Polynucleotide
taatacgactcactataggggacattttaacctgacaggcttccgcagtaaacagaggagatactgcatgagcctgtcaaacctggcggcagcgcaaaagatg

SEQ ID NO: 223232 - DNA, 103 bp, Artificial Sequence
  Synthetic Polynucleotide
taatacgactcactataggggctaaaggatgacattttaacctgacaggcaacagaggagagcctgtatggttaaaatgaacctggcggcagcgcaaaagatg

SEQ ID NO: 223233 - DNA, 103 bp, Artificial Sequence
  Synthetic Polynucleotide
taatacgactcactataggggtggtaatttgctaaaggatgacattttaaaacagaggagattaaaaatgcatcctttaaacctggcggcagcgcaaaagatg

SEQ ID NO: 223234 - DNA, 103 bp, Artificial Sequence
  Synthetic Polynucleotide
taatacgactcactatagggaaccggcatagtggtaatttgctaaaggataacagaggagaatccttatgcaaattaccaacctggcggcagcgcaaaagatg

SEQ ID NO: 223235 - DNA, 103 bp, Artificial Sequence
  Synthetic Polynucleotide
taatacgactcactatagggcttccccaccctccctgcctcgaggtatccaacagaggagaggatacatggaggcagggaacctggcggcagcgcaaaagatg

SEQ ID NO: 223236 - DNA, 103 bp, Artificial Sequence
  Synthetic Polynucleotide
taatacgactcactatagggcacttgtccgaaccggcatagtggtaatttaacagaggagaaaattaatgctatgccggaacctggcggcagcgcaaaagatg

SEQ ID NO: 223237 - DNA, 103 bp, Artificial Sequence
  Synthetic Polynucleotide
taatacgactcactatagggtagggaggtccacttgtccgaaccggcataaacagaggagatatgccatgtcggacaagaacctggcggcagcgcaaaagatg

SEQ ID NO: 223238 - DNA, 103 bp, Artificial Sequence
  Synthetic Polynucleotide
taatacgactcactataggggttttctttctagggaggtccacttgtccgaacagaggagacggacaatgggacctcccaacctggcggcagcgcaaaagatg

SEQ ID NO: 223239 - DNA, 103 bp, Artificial Sequence
  Synthetic Polynucleotide
taatacgactcactatagggttgttaaacagttttctttctagggaggtcaacagaggagagacctcatgagaaagaaaaacctggcggcagcgcaaaagatg

SEQ ID NO: 223240 - DNA, 103 bp, Artificial Sequence
  Synthetic Polynucleotide
taatacgactcactatagggggctagtgctttgttaaacagttttctttcaacagaggagagaaagaatgctgtttaacaacctggcggcagcgcaaaagatg

SEQ ID NO: 223241 - DNA, 103 bp, Artificial Sequence
  Synthetic Polynucleotide
taatacgactcactatagggtgctgtaagtggctagtgctttgttaaacaaacagaggagatgtttaatgaagcactagaacctggcggcagcgcaaaagatg

SEQ ID NO: 223242 - DNA, 103 bp, Artificial Sequence
  Synthetic Polynucleotide
taatacgactcactatagggataaagtctttgctgtaagtggctagtgctaacagaggagaagcactatgcacttacagaacctggcggcagcgcaaaagatg

SEQ ID NO: 223243 - DNA, 103 bp, Artificial Sequence
  Synthetic Polynucleotide
taatacgactcactatagggctgtacaaaaataaagtctttgctgtaagtaacagaggagaacttacatgaaagactttaacctggcggcagcgcaaaagatg

SEQ ID NO: 223244 - DNA, 103 bp, Artificial Sequence
  Synthetic Polynucleotide
taatacgactcactatagggtcaccatcttctgtacaaaaataaagtcttaacagaggagaaagactatgtttttgtacaacctggcggcagcgcaaaagatg

SEQ ID NO: 223245 - DNA, 103 bp, Artificial Sequence
  Synthetic Polynucleotide
taatacgactcactataggggtcttggacttcaccatcttctgtacaaaaaacagaggagattttgtatggaagatggtaacctggcggcagcgcaaaagatg

SEQ ID NO: 223246 - DNA, 103 bp, Artificial Sequence
  Synthetic Polynucleotide
taatacgactcactatagggccctgcatgacttccccaccctccctgcctaacagaggagaaggcagatggggtggggaaacctggcggcagcgcaaaagatg

SEQ ID NO: 223247 - DNA, 103 bp, Artificial Sequence
  Synthetic Polynucleotide
taatacgactcactatagggctgagccaccgtcttggacttcaccatcttaacagaggagaaagatgatgaagtccaagaacctggcggcagcgcaaaagatg

SEQ ID NO: 223248 - DNA, 103 bp, Artificial Sequence
  Synthetic Polynucleotide
taatacgactcactatagggactccacgcactgagccaccgtcttggactaacagaggagaagtccaatgcggtggctcaacctggcggcagcgcaaaagatg

SEQ ID NO: 223249 - DNA, 103 bp, Artificial Sequence
  Synthetic Polynucleotide
taatacgactcactataggggtgtagtagtactccacgcactgagccaccaacagaggagaggtggcatggtgcgtggaaacctggcggcagcgcaaaagatg

SEQ ID NO: 223250 - DNA, 103 bp, Artificial Sequence
  Synthetic Polynucleotide
taatacgactcactatagggctttttccacgtgtagtagtactccacgcaaacagaggagatgcgtgatgtactactacaacctggcggcagcgcaaaagatg

SEQ ID NO: 223251 - DNA, 103 bp, Artificial Sequence
  Synthetic Polynucleotide
taatacgactcactataggggccgcatgatctttttccacgtgtagtagtaacagaggagaactactatgcgtggaaaaaacctggcggcagcgcaaaagatg

SEQ ID NO: 223252 - DNA, 103 bp, Artificial Sequence
  Synthetic Polynucleotide
taatacgactcactatagggttccgccccagccgcatgatctttttccacaacagaggagagtggaaatggatcatgcgaacctggcggcagcgcaaaagatg

SEQ ID NO: 223253 - DNA, 103 bp, Artificial Sequence
  Synthetic Polynucleotide
taatacgactcactatagggtgtccggtgtttccgccccagccgcatgataacagaggagaatcatgatgctggggcggaacctggcggcagcgcaaaagatg

SEQ ID NO: 223254 - DNA, 103 bp, Artificial Sequence
  Synthetic Polynucleotide
taatacgactcactatagggctgccaggcgtgtccggtgtttccgccccaaacagaggagatggggcatgaacaccggaaacctggcggcagcgcaaaagatg

SEQ ID NO: 223255 - DNA, 103 bp, Artificial Sequence
  Synthetic Polynucleotide
taatacgactcactatagggtcgatgatttctgccaggcgtgtccggtgtaacagaggagaacaccgatgacgcctggcaacctggcggcagcgcaaaagatg

SEQ ID NO: 223256 - DNA, 103 bp, Artificial Sequence
  Synthetic Polynucleotide
taatacgactcactatagggcacacaatcgtcgatgatttctgccaggcgaacagaggagacgcctgatggaaatcatcaacctggcggcagcgcaaaagatg

SEQ ID NO: 223257 - DNA, 103 bp, Artificial Sequence
  Synthetic Polynucleotide
taatacgactcactatagggggtttccaggccctgcatgacttccccaccaacagaggagaggtgggatggtcatgcagaacctggcggcagcgcaaaagatg

SEQ ID NO: 223258 - DNA, 103 bp, Artificial Sequence
  Synthetic Polynucleotide
taatacgactcactatagggcttcacttgtcacacaatcgtcgatgatttaacagaggagaaaatcaatgacgattgtgaacctggcggcagcgcaaaagatg

SEQ ID NO: 223259 - DNA, 103 bp, Artificial Sequence
  Synthetic Polynucleotide
taatacgactcactatagggtcttcttcttcttcacttgtcacacaatcgaacagaggagacgattgatggacaagtgaaacctggcggcagcgcaaaagatg

SEQ ID NO: 223260 - DNA, 103 bp, Artificial Sequence
  Synthetic Polynucleotide
taatacgactcactatagggctcctctaactcttcttcttcttcacttgtaacagaggagaacaagtatggaagaagaaaacctggcggcagcgcaaaagatg

SEQ ID NO: 223261 - DNA, 103 bp, Artificial Sequence
  Synthetic Polynucleotide
taatacgactcactatagggcctcctcctcctcctctaactcttcttcttaacagaggagaaagaagatgagttagaggaacctggcggcagcgcaaaagatg

SEQ ID NO: 223262 - DNA, 103 bp, Artificial Sequence
  Synthetic Polynucleotide
taatacgactcactatagggtccgggtcctcctcctcctcctcctctaacaacagaggagagttagaatgggaggaggaaacctggcggcagcgcaaaagatg

SEQ ID NO: 223263 - DNA, 103 bp, Artificial Sequence
  Synthetic Polynucleotide
taatacgactcactatagggcctatcttcttccgggtcctcctcctcctcaacagaggagagaggagatggaggacccgaacctggcggcagcgcaaaagatg

SEQ ID NO: 223264 - DNA, 103 bp, Artificial Sequence
  Synthetic Polynucleotide
taatacgactcactatagggttgtggatttcctatcttcttccgggtcctaacagaggagaaggaccatgaagaagataaacctggcggcagcgcaaaagatg

SEQ ID NO: 223265 - DNA, 103 bp, Artificial Sequence
  Synthetic Polynucleotide
taatacgactcactatagggtcttcttcttttgtggatttcctatcttctaacagaggagaagaagaatggaaatccacaacctggcggcagcgcaaaagatg

SEQ ID NO: 223266 - DNA, 103 bp, Artificial Sequence
  Synthetic Polynucleotide
taatacgactcactatagggcacctcactctcttcttcttttgtggatttaacagaggagaaaatccatgaaagaagaaaacctggcggcagcgcaaaagatg

SEQ ID NO: 223267 - DNA, 103 bp, Artificial Sequence
  Synthetic Polynucleotide
taatacgactcactataggggggacttcggcacctcactctcttcttcttaacagaggagaaagaagatgagagtgaggaacctggcggcagcgcaaaagatg

SEQ ID NO: 223268 - DNA, 103 bp, Artificial Sequence
  Synthetic Polynucleotide
taatacgactcactatagggagctggacatggtttccaggccctgcatgaaacagaggagatcatgcatggcctggaaaaacctggcggcagcgcaaaagatg

SEQ ID NO: 223269 - DNA, 103 bp, Artificial Sequence
  Synthetic Polynucleotide
taatacgactcactatagggggtggctccggggacttcggcacctcactcaacagaggagagagtgaatggccgaagtcaacctggcggcagcgcaaaagatg

SEQ ID NO: 223270 - DNA, 103 bp, Artificial Sequence
  Synthetic Polynucleotide
taatacgactcactatagggggggacgggtggtggctccggggacttcggaacagaggagaccgaagatgccggagccaaacctggcggcagcgcaaaagatg

SEQ ID NO: 223271 - DNA, 103 bp, Artificial Sequence
  Synthetic Polynucleotide
taatacgactcactataggggagccaggacggggacgggtggtggctccgaacagaggagacggagcatgcacccgtccaacctggcggcagcgcaaaagatg

SEQ ID NO: 223272 - DNA, 103 bp, Artificial Sequence
  Synthetic Polynucleotide
taatacgactcactatagggccctccgtgggagccaggacggggacgggtaacagaggagaacccgtatgcgtcctggcaacctggcggcagcgcaaaagatg

SEQ ID NO: 223273 - DNA, 103 bp, Artificial Sequence
  Synthetic Polynucleotide
taatacgactcactatagggcaggggcggcccctccgtgggagccaggacaacagaggagagtcctgatgcccacggagaacctggcggcagcgcaaaagatg

SEQ ID NO: 223274 - DNA, 103 bp, Artificial Sequence
  Synthetic Polynucleotide
taatacgactcactatagggccagggcctgcaggggcggcccctccgtggaacagaggagaccacggatgggccgccccaacctggcggcagcgcaaaagatg

SEQ ID NO: 223275 - DNA, 103 bp, Artificial Sequence
  Synthetic Polynucleotide
taatacgactcactataggggagggctggcccagggcctgcaggggcggcaacagaggagagccgccatggcaggccctaacctggcggcagcgcaaaagatg

SEQ ID NO: 223276 - DNA, 103 bp, Artificial Sequence
  Synthetic Polynucleotide
taatacgactcactataggggaaggagcctgagggctggcccagggcctgaacagaggagacaggccatgggccagcccaacctggcggcagcgcaaaagatg

SEQ ID NO: 223277 - DNA, 103 bp, Artificial Sequence
  Synthetic Polynucleotide
taatacgactcactatagggtttcacagatgaaggagcctgagggctggcaacagaggagagccagcatgcaggctcctaacctggcggcagcgcaaaagatg

SEQ ID NO: 223278 - DNA, 103 bp, Artificial Sequence
  Synthetic Polynucleotide
taatacgactcactatagggcagttgggcatttcacagatgaaggagcctaacagaggagaaggctcatgcatctgtgaaacctggcggcagcgcaaaagatg

SEQ ID NO: 223279 - DNA, 103 bp, Artificial Sequence
  Synthetic Polynucleotide
taatacgactcactataggggtttccacgtagctggacatggtttccaggaacagaggagacctggaatgcatgtccagaacctggcggcagcgcaaaagatg

SEQ ID NO: 223280 - DNA, 103 bp, Artificial Sequence
  Synthetic Polynucleotide
taatacgactcactataggggtcagccccacagttgggcatttcacagataacagaggagaatctgtatgatgcccaacaacctggcggcagcgcaaaagatg

SEQ ID NO: 223281 - DNA, 103 bp, Artificial Sequence
  Synthetic Polynucleotide
taatacgactcactataggggacatctacagtcagccccacagttgggcaaacagaggagatgcccaatggtggggctgaacctggcggcagcgcaaaagatg

SEQ ID NO: 223282 - DNA, 103 bp, Artificial Sequence
  Synthetic Polynucleotide
taatacgactcactatagggggagtgacatgacatctacagtcagccccaaacagaggagatggggcatgctgtagatgaacctggcggcagcgcaaaagatg

SEQ ID NO: 223283 - DNA, 103 bp, Artificial Sequence
  Synthetic Polynucleotide
taatacgactcactataggggggaagaaagggagtgacatgacatctacaaacagaggagatgtagaatgcatgtcactaacctggcggcagcgcaaaagatg

SEQ ID NO: 223284 - DNA, 103 bp, Artificial Sequence
  Synthetic Polynucleotide
taatacgactcactatagggtgaacacctggggaagaaagggagtgacataacagaggagaatgtcaatgcctttcttcaacctggcggcagcgcaaaagatg

SEQ ID NO: 223285 - DNA, 103 bp, Artificial Sequence
  Synthetic Polynucleotide
taatacgactcactatagggtgtcgggagctgaacacctggggaagaaagaacagaggagactttctatgccaggtgttaacctggcggcagcgcaaaagatg

SEQ ID NO: 223286 - DNA, 103 bp, Artificial Sequence
  Synthetic Polynucleotide
taatacgactcactatagggattcagtgcctgtcgggagctgaacacctgaacagaggagacaggtgatgagctcccgaaacctggcggcagcgcaaaagatg

SEQ ID NO: 223287 - DNA, 103 bp, Artificial Sequence
  Synthetic Polynucleotide
taatacgactcactataggggggcatggccattcagtgcctgtcgggagcaacagaggagagctcccatgaggcactgaaacctggcggcagcgcaaaagatg

SEQ ID NO: 223288 - DNA, 103 bp, Artificial Sequence
  Synthetic Polynucleotide
taatacgactcactatagggccgtggatgcgggcatggccattcagtgccaacagaggagaggcactatgtggccatgcaacctggcggcagcgcaaaagatg

SEQ ID NO: 223289 - DNA, 103 bp, Artificial Sequence
  Synthetic Polynucleotide
taatacgactcactataggggttggtgcccccgtggatgcgggcatggccaacagaggagaggccatatgcgcatccacaacctggcggcagcgcaaaagatg

SEQ ID NO: 223290 - DNA, 103 bp, Artificial Sequence
  Synthetic Polynucleotide
taatacgactcactatagggagttggccaggtttccacgtagctggacataacagaggagaatgtccatgtacgtggaaaacctggcggcagcgcaaaagatg

SEQ ID NO: 223291 - DNA, 103 bp, Artificial Sequence
  Synthetic Polynucleotide
taatacgactcactatagggtggtcacctggttggtgcccccgtggatgcaacagaggagagcatccatgggggcaccaaacctggcggcagcgcaaaagatg

SEQ ID NO: 223292 - DNA, 103 bp, Artificial Sequence
  Synthetic Polynucleotide
taatacgactcactatagggcctcgggccttggtcacctggttggtgcccaacagaggagagggcacatgccaggtgacaacctggcggcagcgcaaaagatg

SEQ ID NO: 223293 - DNA, 103 bp, Artificial Sequence
  Synthetic Polynucleotide
taatacgactcactatagggggggatggcacctcgggccttggtcacctgaacagaggagacaggtgatgaaggcccgaaacctggcggcagcgcaaaagatg

SEQ ID NO: 223294 - DNA, 103 bp, Artificial Sequence
  Synthetic Polynucleotide
taatacgactcactataggggcttcccagaggggatggcacctcgggcctaacagaggagaaggcccatggtgccatccaacctggcggcagcgcaaaagatg

SEQ ID NO: 223295 - DNA, 103 bp, Artificial Sequence
  Synthetic Polynucleotide
taatacgactcactatagggccaggcttctgcttcccagaggggatggcaaacagaggagatgccatatgctctgggaaaacctggcggcagcgcaaaagatg

SEQ ID NO: 223296 - DNA, 103 bp, Artificial Sequence
  Synthetic Polynucleotide
taatacgactcactatagggctgggtgccaccaggcttctgcttcccagaaacagaggagatctgggatgcagaagcctaacctggcggcagcgcaaaagatg

SEQ ID NO: 223297 - DNA, 103 bp, Artificial Sequence
  Synthetic Polynucleotide
taatacgactcactatagggagtacccactctgggtgccaccaggcttctaacagaggagaagaagcatggtggcacccaacctggcggcagcgcaaaagatg

SEQ ID NO: 223298 - DNA, 103 bp, Artificial Sequence
  Synthetic Polynucleotide
taatacgactcactatagggtttaccgaacagtacccactctgggtgccaaacagaggagatggcacatggagtgggtaaacctggcggcagcgcaaaagatg

SEQ ID NO: 223299 - DNA, 103 bp, Artificial Sequence
  Synthetic Polynucleotide
taatacgactcactataggggggtgagctctttaccgaacagtacccactaacagaggagaagtgggatgtgttcggtaaacctggcggcagcgcaaaagatg

SEQ ID NO: 223300 - DNA, 103 bp, Artificial Sequence
  Synthetic Polynucleotide
taatacgactcactatagggtgctgtgagagggtgagctctttaccgaacaacagaggagagttcggatgagagctcacaacctggcggcagcgcaaaagatg

SEQ ID NO: 223301 - DNA, 103 bp, Artificial Sequence
  Synthetic Polynucleotide
taatacgactcactatagggtcactaccatgggccacatggttggtcttgaacagaggagacaagacatgccatgtggcaacctggcggcagcgcaaaagatg

SEQ ID NO: 223302 - DNA, 103 bp, Artificial Sequence
  Synthetic Polynucleotide
taatacgactcactatagggatcatgtttgagttggccaggtttccacgtaacagaggagaacgtggatgcctggccaaaacctggcggcagcgcaaaagatg

SEQ ID NO: 223303 - DNA, 103 bp, Artificial Sequence
  Synthetic Polynucleotide
taatacgactcactatagggccgctggtggtgctgtgagagggtgagctcaacagaggagagagctcatgctctcacagaacctggcggcagcgcaaaagatg

SEQ ID NO: 223304 - DNA, 103 bp, Artificial Sequence
  Synthetic Polynucleotide
taatacgactcactataggggtctgtctcgccgctggtggtgctgtgagaaacagaggagatctcacatgaccaccagcaacctggcggcagcgcaaaagatg

SEQ ID NO: 223305 - DNA, 103 bp, Artificial Sequence
  Synthetic Polynucleotide
taatacgactcactatagggtggtggtggggtctgtctcgccgctggtggaacagaggagaccaccaatggcgagacagaacctggcggcagcgcaaaagatg

SEQ ID NO: 223306 - DNA, 103 bp, Artificial Sequence
  Synthetic Polynucleotide
taatacgactcactatagggcaggggaagatggtggtggggtctgtctcgaacagaggagacgagacatgccccaccacaacctggcggcagcgcaaaagatg

SEQ ID NO: 223307 - DNA, 103 bp, Artificial Sequence
  Synthetic Polynucleotide
taatacgactcactatagggacactccttgcaggggaagatggtggtgggaacagaggagacccaccatgatcttccccaacctggcggcagcgcaaaagatg

SEQ ID NO: 223308 - DNA, 103 bp, Artificial Sequence
  Synthetic Polynucleotide
taatacgactcactatagggagactttgccacactccttgcaggggaagaaacagaggagatcttccatggcaaggagtaacctggcggcagcgcaaaagatg

SEQ ID NO: 223309 - DNA, 103 bp, Artificial Sequence
  Synthetic Polynucleotide
taatacgactcactatagggatcttgaagaagactttgccacactccttgaacagaggagacaaggaatgtggcaaagtaacctggcggcagcgcaaaagatg

SEQ ID NO: 223310 - DNA, 103 bp, Artificial Sequence
  Synthetic Polynucleotide
taatacgactcactatagggtcggcttttgatcttgaagaagactttgccaacagaggagaggcaaaatgttcttcaagaacctggcggcagcgcaaaagatg

SEQ ID NO: 223311 - DNA, 103 bp, Artificial Sequence
  Synthetic Polynucleotide
taatacgactcactatagggtgtgtgcatttcggcttttgatcttgaagaaacagaggagatcttcaatgtcaaaagccaacctggcggcagcgcaaaagatg

SEQ ID NO: 223312 - DNA, 103 bp, Artificial Sequence
  Synthetic Polynucleotide
taatacgactcactatagggtgagttttcatgtgtgcatttcggcttttgaacagaggagacaaaagatgaaatgcacaaacctggcggcagcgcaaaagatg

SEQ ID NO: 223313 - DNA, 103 bp, Artificial Sequence
  Synthetic Polynucleotide
taatacgactcactatagggtgccccccacatcatgtttgagttggccagaacagaggagactggccatgtcaaacatgaacctggcggcagcgcaaaagatg

SEQ ID NO: 223314 - DNA, 103 bp, Artificial Sequence
  Synthetic Polynucleotide
taatacgactcactatagggctgctgcctgtgagttttcatgtgtgcattaacagaggagaaatgcaatgatgaaaactaacctggcggcagcgcaaaagatg

SEQ ID NO: 223315 - DNA, 103 bp, Artificial Sequence
  Synthetic Polynucleotide
taatacgactcactataggggttgttcctcctgctgcctgtgagttttcaaacagaggagatgaaaaatgacaggcagcaacctggcggcagcgcaaaagatg

SEQ ID NO: 223316 - DNA, 103 bp, Artificial Sequence
  Synthetic Polynucleotide
taatacgactcactatagggttttgcctctgttgttcctcctgctgcctgaacagaggagacaggcaatgggaggaacaaacctggcggcagcgcaaaagatg

SEQ ID NO: 223317 - DNA, 103 bp, Artificial Sequence
  Synthetic Polynucleotide
taatacgactcactatagggcttctgagccttttgcctctgttgttcctcaacagaggagagaggaaatgcagaggcaaaacctggcggcagcgcaaaagatg

SEQ ID NO: 223318 - DNA, 103 bp, Artificial Sequence
  Synthetic Polynucleotide
taatacgactcactatagggcaaaagccgccttctgagccttttgcctctaacagaggagaagaggcatgaggctcagaaacctggcggcagcgcaaaagatg

SEQ ID NO: 223319 - DNA, 103 bp, Artificial Sequence
  Synthetic Polynucleotide
taatacgactcactatagggatctcagctgcaaaagccgccttctgagccaacagaggagaggctcaatgggcggctttaacctggcggcagcgcaaaagatg

SEQ ID NO: 223320 - DNA, 103 bp, Artificial Sequence
  Synthetic Polynucleotide
taatacgactcactatagggcgtggctgccatctcagctgcaaaagccgcaacagaggagagcggctatggcagctgagaacctggcggcagcgcaaaagatg

SEQ ID NO: 223321 - DNA, 103 bp, Artificial Sequence
  Synthetic Polynucleotide
taatacgactcactatagggtcctctcaatcgtggctgccatctcagctgaacagaggagacagctgatgtggcagccaaacctggcggcagcgcaaaagatg

SEQ ID NO: 223322 - DNA, 103 bp, Artificial Sequence
  Synthetic Polynucleotide
taatacgactcactatagggggccccgtagtcctctcaatcgtggctgccaacagaggagaggcagcatggattgagagaacctggcggcagcgcaaaagatg

SEQ ID NO: 223323 - DNA, 103 bp, Artificial Sequence
  Synthetic Polynucleotide
taatacgactcactatagggcgcccccacgggccccgtagtcctctcaataacagaggagaattgagatgactacggggaacctggcggcagcgcaaaagatg

SEQ ID NO: 223324 - DNA, 103 bp, Artificial Sequence
  Synthetic Polynucleotide
taatacgactcactatagggcctgggctggtgccccccacatcatgtttgaacagaggagacaaacaatgtgtggggggaacctggcggcagcgcaaaagatg

SEQ ID NO: 223325 - DNA, 103 bp, Artificial Sequence
  Synthetic Polynucleotide
taatacgactcactataggggcagccccggcgcccccacgggccccgtagaacagaggagactacggatgccgtgggggaacctggcggcagcgcaaaagatg

SEQ ID NO: 223326 - DNA, 103 bp, Artificial Sequence
  Synthetic Polynucleotide
taatacgactcactatagggtccaggggcagcagccccggcgcccccacgaacagaggagacgtgggatggccggggctaacctggcggcagcgcaaaagatg

SEQ ID NO: 223327 - DNA, 103 bp, Artificial Sequence
  Synthetic Polynucleotide
taatacgactcactatagggactcagctggtccaggggcagcagccccggaacagaggagaccggggatgctgcccctgaacctggcggcagcgcaaaagatg

SEQ ID NO: 223328 - DNA, 103 bp, Artificial Sequence
  Synthetic Polynucleotide
taatacgactcactataggggtttgatcagactcagctggtccaggggcaaacagaggagatgccccatgaccagctgaaacctggcggcagcgcaaaagatg

SEQ ID NO: 223329 - DNA, 103 bp, Artificial Sequence
  Synthetic Polynucleotide
taatacgactcactatagggtccttgatgggtttgatcagactcagctggaacagaggagaccagctatgtctgatcaaaacctggcggcagcgcaaaagatg

SEQ ID NO: 223330 - DNA, 103 bp, Artificial Sequence
  Synthetic Polynucleotide
taatacgactcactataggggatgtccacatccttgatgggtttgatcagaacagaggagactgatcatgcccatcaagaacctggcggcagcgcaaaagatg

SEQ ID NO: 223331 - DNA, 103 bp, Artificial Sequence
  Synthetic Polynucleotide
taatacgactcactatagggcgtcgtcgaggatgtccacatccttgatggaacagaggagaccatcaatgatgtggacaaacctggcggcagcgcaaaagatg

SEQ ID NO: 223332 - DNA, 103 bp, Artificial Sequence
  Synthetic Polynucleotide
taatacgactcactatagggtggacgacgtcgtcgtcgaggatgtccacaaacagaggagatgtggaatgcctcgacgaaacctggcggcagcgcaaaagatg

SEQ ID NO: 223333 - DNA, 103 bp, Artificial Sequence
  Synthetic Polynucleotide
taatacgactcactatagggtcccaactgctggacgacgtcgtcgtcgagaacagaggagactcgacatggacgtcgtcaacctggcggcagcgcaaaagatg

SEQ ID NO: 223334 - DNA, 103 bp, Artificial Sequence
  Synthetic Polynucleotide
taatacgactcactatagggccatgacacctcccaactgctggacgacgtaacagaggagaacgtcgatgagcagttggaacctggcggcagcgcaaaagatg

SEQ ID NO: 223335 - DNA, 103 bp, Artificial Sequence
  Synthetic Polynucleotide
taatacgactcactataggggtgggctcagcctgggctggtgccccccacaacagaggagagtggggatgaccagcccaaacctggcggcagcgcaaaagatg

SEQ ID NO: 223336 - DNA, 103 bp, Artificial Sequence
  Synthetic Polynucleotide
taatacgactcactatagggtcagcctcttccatgacacctcccaactgcaacagaggagagcagttatgaggtgtcataacctggcggcagcgcaaaagatg

SEQ ID NO: 223337 - DNA, 103 bp, Artificial Sequence
  Synthetic Polynucleotide
taatacgactcactataggggtccacaacttcagcctcttccatgacaccaacagaggagaggtgtcatggaagaggctaacctggcggcagcgcaaaagatg

SEQ ID NO: 223338 - DNA, 103 bp, Artificial Sequence
  Synthetic Polynucleotide
taatacgactcactataggggaagatcggtgtccacaacttcagcctcttaacagaggagaaagaggatgaagttgtggaacctggcggcagcgcaaaagatg

SEQ ID NO: 223339 - DNA, 103 bp, Artificial Sequence
  Synthetic Polynucleotide
taatacgactcactatagggtcatccaagagaagatcggtgtccacaactaacagaggagaagttgtatgcaccgatctaacctggcggcagcgcaaaagatg

SEQ ID NO: 223340 - DNA, 103 bp, Artificial Sequence
  Synthetic Polynucleotide
taatacgactcactatagggtgaatcttgatcatccaagagaagatcggtaacagaggagaaccgatatgctcttggataacctggcggcagcgcaaaagatg

SEQ ID NO: 223341 - DNA, 103 bp, Artificial Sequence
  Synthetic Polynucleotide
taatacgactcactataggggaagcaagactgaatcttgatcatccaagaaacagaggagatcttggatgatcaagattaacctggcggcagcgcaaaagatg

SEQ ID NO: 223342 - DNA, 103 bp, Artificial Sequence
  Synthetic Polynucleotide
taatacgactcactataggggcgtcaccctgaagcaagactgaatcttgaaacagaggagatcaagaatgagtcttgctaacctggcggcagcgcaaaagatg

SEQ ID NO: 223343 - DNA, 103 bp, Artificial Sequence
  Synthetic Polynucleotide
taatacgactcactatagggttatagttctgcgtcaccctgaagcaagacaacagaggagagtcttgatgcagggtgacaacctggcggcagcgcaaaagatg

SEQ ID NO: 223344 - DNA, 103 bp, Artificial Sequence
  Synthetic Polynucleotide
taatacgactcactataggggtagccatcagtgggctcagcctgggctggaacagaggagaccagccatggctgagcccaacctggcggcagcgcaaaagatg

SEQ ID NO: 223345 - DNA, 103 bp, Artificial Sequence
  Synthetic Polynucleotide
taatacgactcactatagggaggtgtattggtagccatcagtgggctcagaacagaggagactgagcatgctgatggctaacctggcggcagcgcaaaagatg

SEQ ID NO: 223346 - DNA, 103 bp, Artificial Sequence
  Synthetic Polynucleotide
taatacgactcactataggggcctgggagtaggtgtattggtagccatcaaacagaggagatgatggatgccaatacacaacctggcggcagcgcaaaagatg

SEQ ID NO: 223347 - DNA, 103 bp, Artificial Sequence
  Synthetic Polynucleotide
taatacgactcactataggggatctcgctggcctgggagtaggtgtattgaacagaggagacaatacatgtactcccagaacctggcggcagcgcaaaagatg

SEQ ID NO: 223348 - DNA, 103 bp, Artificial Sequence
  Synthetic Polynucleotide
taatacgactcactatagggtctgggtccggatctcgctggcctgggagtaacagaggagaactcccatgccagcgagaaacctggcggcagcgcaaaagatg

SEQ ID NO: 223349 - DNA, 103 bp, Artificial Sequence
  Synthetic Polynucleotide
taatacgactcactatagggctggtaagcttctgggtccggatctcgctgaacagaggagacagcgaatgccggacccaaacctggcggcagcgcaaaagatg

SEQ ID NO: 223350 - DNA, 103 bp, Artificial Sequence
  Synthetic Polynucleotide
taatacgactcactataggggaaaaggttctcactaccatgggccacatgaacagaggagacatgtgatgcatggtagtaacctggcggcagcgcaaaagatg

SEQ ID NO: 223351 - DNA, 103 bp, Artificial Sequence
  Synthetic Polynucleotide
taatacgactcactatagggtaagacaccgctggtaagcttctgggtccgaacagaggagacggaccatgaagcttaccaacctggcggcagcgcaaaagatg

SEQ ID NO: 223352 - DNA, 103 bp, Artificial Sequence
  Synthetic Polynucleotide
taatacgactcactatagggccagcttgtgtaagacaccgctggtaagctaacagaggagaagcttaatggcggtgtctaacctggcggcagcgcaaaagatg

SEQ ID NO: 223353 - DNA, 103 bp, Artificial Sequence
  Synthetic Polynucleotide
taatacgactcactataggggtgaaagagtccagcttgtgtaagacaccgaacagaggagacggtgtatgacacaagctaacctggcggcagcgcaaaagatg

SEQ ID NO: 223354 - DNA, 103 bp, Artificial Sequence
  Synthetic Polynucleotide
taatacgactcactatagggaaacacctgggtgaaagagtccagcttgtgaacagaggagacacaagatggactctttcaacctggcggcagcgcaaaagatg

SEQ ID NO: 223355 - DNA, 103 bp, Artificial Sequence
  Synthetic Polynucleotide
taatacgactcactatagggtttggttggcaaacacctgggtgaaagagtaacagaggagaactcttatgcccaggtgtaacctggcggcagcgcaaaagatg

SEQ ID NO: 223356 - DNA, 103 bp, Artificial Sequence
  Synthetic Polynucleotide
taatacgactcactatagggattcgcaggttttggttggcaaacacctggaacagaggagaccaggtatgtgccaaccaaacctggcggcagcgcaaaagatg

SEQ ID NO: 223357 - DNA, 103 bp, Artificial Sequence
  Synthetic Polynucleotide
taatacgactcactataggggttgacctgaattcgcaggttttggttggcaacagaggagagccaacatgaacctgcgaaacctggcggcagcgcaaaagatg

SEQ ID NO: 223358 - DNA, 103 bp, Artificial Sequence
  Synthetic Polynucleotide
taatacgactcactataggggggccatattgttgacctgaattcgcaggtaacagaggagaacctgcatgttcaggtcaaacctggcggcagcgcaaaagatg

SEQ ID NO: 223359 - DNA, 103 bp, Artificial Sequence
  Synthetic Polynucleotide
taatacgactcactatagggtgcagcacctgggccatattgttgacctgaaacagaggagatcaggtatgcaatatggcaacctggcggcagcgcaaaagatg

SEQ ID NO: 223360 - DNA, 103 bp, Artificial Sequence
  Synthetic Polynucleotide
taatacgactcactatagggtgactgagtgtgcagcacctgggccatattaacagaggagaaatatgatgcaggtgctgaacctggcggcagcgcaaaagatg

SEQ ID NO: 223361 - DNA, 103 bp, Artificial Sequence
  Synthetic Polynucleotide
taatacgactcactataggggctgttggtagaaaaggttctcactaccataacagaggagaatggtaatgagaacctttaacctggcggcagcgcaaaagatg

SEQ ID NO: 223362 - DNA, 103 bp, Artificial Sequence
  Synthetic Polynucleotide
taatacgactcactatagggccatcactgctgactgagtgtgcagcacctaacagaggagaaggtgcatgacactcagtaacctggcggcagcgcaaaagatg

SEQ ID NO: 223363 - DNA, 103 bp, Artificial Sequence
  Synthetic Polynucleotide
taatacgactcactatagggggggctccatccatcactgctgactgagtgaacagaggagacactcaatgagcagtgataacctggcggcagcgcaaaagatg

SEQ ID NO: 223364 - DNA, 103 bp, Artificial Sequence
  Synthetic Polynucleotide
taatacgactcactatagggagcactgtcaggggctccatccatcactgcaacagaggagagcagtgatggatggagccaacctggcggcagcgcaaaagatg

SEQ ID NO: 223365 - DNA, 103 bp, Artificial Sequence
  Synthetic Polynucleotide
taatacgactcactataggggctggcggagagcactgtcaggggctccataacagaggagaatggagatgctgacagtgaacctggcggcagcgcaaaagatg

SEQ ID NO: 223366 - DNA, 103 bp, Artificial Sequence
  Synthetic Polynucleotide
taatacgactcactatagggtgagacagcagctggcggagagcactgtcaaacagaggagatgacagatgtctccgccaaacctggcggcagcgcaaaagatg

SEQ ID NO: 223367 - DNA, 103 bp, Artificial Sequence
  Synthetic Polynucleotide
taatacgactcactatagggcatgggcttctgagacagcagctggcggagaacagaggagactccgcatgctgctgtctaacctggcggcagcgcaaaagatg

SEQ ID NO: 223368 - DNA, 103 bp, Artificial Sequence
  Synthetic Polynucleotide
taatacgactcactatagggctgggggctccatgggcttctgagacagcaaacagaggagatgctgtatgagaagcccaaacctggcggcagcgcaaaagatg

SEQ ID NO: 223369 - DNA, 103 bp, Artificial Sequence
  Synthetic Polynucleotide
taatacgactcactatagggatagccggtgctgggggctccatgggcttcaacagaggagagaagccatgggagcccccaacctggcggcagcgcaaaagatg

SEQ ID NO: 223370 - DNA, 103 bp, Artificial Sequence
  Synthetic Polynucleotide
taatacgactcactataggggcgggaagggatagccggtgctgggggctcaacagaggagagagcccatggcaccggctaacctggcggcagcgcaaaagatg

SEQ ID NO: 223371 - DNA, 103 bp, Artificial Sequence
  Synthetic Polynucleotide
taatacgactcactatagggcctgctggtagcgggaagggatagccggtgaacagaggagacaccggatgtcccttcccaacctggcggcagcgcaaaagatg

SEQ ID NO: 223372 - DNA, 103 bp, Artificial Sequence
  Synthetic Polynucleotide
taatacgactcactatagggccaagtggtggctgttggtagaaaaggttcaacagaggagagaacctatgctaccaacaaacctggcggcagcgcaaaagatg

SEQ ID NO: 223373 - DNA, 103 bp, Artificial Sequence
  Synthetic Polynucleotide
taatacgactcactatagggtgctggggcacctgctggtagcgggaagggaacagaggagacccttcatgctaccagcaaacctggcggcagcgcaaaagatg

SEQ ID NO: 223374 - DNA, 103 bp, Artificial Sequence
  Synthetic Polynucleotide
taatacgactcactatagggagggtgaggctgctggggcacctgctggtaaacagaggagataccagatggtgccccagaacctggcggcagcgcaaaagatg

SEQ ID NO: 223375 - DNA, 103 bp, Artificial Sequence
  Synthetic Polynucleotide
taatacgactcactatagggcagtgaaaccagggtgaggctgctggggcaaacagaggagatgccccatgagcctcaccaacctggcggcagcgcaaaagatg

SEQ ID NO: 223376 - DNA, 103 bp, Artificial Sequence
  Synthetic Polynucleotide
taatacgactcactataggggacagcccaccagtgaaaccagggtgaggcaacagaggagagcctcaatgtggtttcacaacctggcggcagcgcaaaagatg

SEQ ID NO: 223377 - DNA, 103 bp, Artificial Sequence
  Synthetic Polynucleotide
taatacgactcactatagggagctggtttggacagcccaccagtgaaaccaacagaggagaggtttcatgggtgggctgaacctggcggcagcgcaaaagatg

SEQ ID NO: 223378 - DNA, 103 bp, Artificial Sequence
  Synthetic Polynucleotide
taatacgactcactatagggcgacctgaagagctggtttggacagcccacaacagaggagagtgggcatgccaaaccagaacctggcggcagcgcaaaagatg

SEQ ID NO: 223379 - DNA, 103 bp, Artificial Sequence
  Synthetic Polynucleotide
taatacgactcactataggggggtgctgcccgacctgaagagctggtttgaacagaggagacaaaccatgtcttcaggtaacctggcggcagcgcaaaagatg

SEQ ID NO: 223380 - DNA, 103 bp, Artificial Sequence
  Synthetic Polynucleotide
taatacgactcactatagggcccttgggtagggtgctgcccgacctgaagaacagaggagacttcagatggggcagcacaacctggcggcagcgcaaaagatg

SEQ ID NO: 223381 - DNA, 103 bp, Artificial Sequence
  Synthetic Polynucleotide
taatacgactcactatagggaatacaggtgcccttgggtagggtgctgccaacagaggagaggcagcatgctacccaagaacctggcggcagcgcaaaagatg

SEQ ID NO: 223382 - DNA, 103 bp, Artificial Sequence
  Synthetic Polynucleotide
taatacgactcactatagggtggtagtcataatacaggtgcccttgggtaaacagaggagatacccaatggcacctgtaaacctggcggcagcgcaaaagatg

SEQ ID NO: 223383 - DNA, 103 bp, Artificial Sequence
  Synthetic Polynucleotide
taatacgactcactataggggctgtggacgccaagtggtggctgttggtaaacagaggagataccaaatgccaccacttaacctggcggcagcgcaaaagatg

SEQ ID NO: 223384 - DNA, 103 bp, Artificial Sequence
  Synthetic Polynucleotide
taatacgactcactatagggcagaggctgctggtagtcataatacaggtgaacagaggagacacctgatgtatgactacaacctggcggcagcgcaaaagatg

SEQ ID NO: 223385 - DNA, 103 bp, Artificial Sequence
  Synthetic Polynucleotide
taatacgactcactataggggcacctgagccagaggctgctggtagtcataacagaggagaatgactatgagcagcctcaacctggcggcagcgcaaaagatg

SEQ ID NO: 223386 - DNA, 103 bp, Artificial Sequence
  Synthetic Polynucleotide
taatacgactcactatagggccctgcactggcacctgagccagaggctgcaacagaggagagcagccatgggctcaggtaacctggcggcagcgcaaaagatg

SEQ ID NO: 223387 - DNA, 103 bp, Artificial Sequence
  Synthetic Polynucleotide
taatacgactcactatagggtggctgtcctccctgcactggcacctgagcaacagaggagagctcagatgccagtgcagaacctggcggcagcgcaaaagatg

SEQ ID NO: 223388 - DNA, 103 bp, Artificial Sequence
  Synthetic Polynucleotide
taatacgactcactataggggggcctgcagtggctgtcctccctgcactgaacagaggagacagtgcatggaggacagcaacctggcggcagcgcaaaagatg

SEQ ID NO: 223389 - DNA, 103 bp, Artificial Sequence
  Synthetic Polynucleotide
taatacgactcactatagggagcatctgtggggcctgcagtggctgtcctaacagaggagaaggacaatgactgcaggcaacctggcggcagcgcaaaagatg

SEQ ID NO: 223390 - DNA, 103 bp, Artificial Sequence
  Synthetic Polynucleotide
taatacgactcactataggggtgctgtgacagcatctgtggggcctgcagaacagaggagactgcagatgccacagatgaacctggcggcagcgcaaaagatg

SEQ ID NO: 223391 - DNA, 103 bp, Artificial Sequence
  Synthetic Polynucleotide
taatacgactcactatagggtctgttgcatgtgctgtgacagcatctgtgaacagaggagacacagaatgtgtcacagcaacctggcggcagcgcaaaagatg

SEQ ID NO: 223392 - DNA, 103 bp, Artificial Sequence
  Synthetic Polynucleotide
taatacgactcactatagggtgctgctgcatctgttgcatgtgctgtgacaacagaggagagtcacaatgcatgcaacaaacctggcggcagcgcaaaagatg

SEQ ID NO: 223393 - DNA, 103 bp, Artificial Sequence
  Synthetic Polynucleotide
taatacgactcactataggggtaatactggtgctgctgcatctgttgcataacagaggagaatgcaaatgatgcagcagaacctggcggcagcgcaaaagatg

SEQ ID NO: 223394 - DNA, 103 bp, Artificial Sequence
  Synthetic Polynucleotide
taatacgactcactatagggggttcagcccgctgtggacgccaagtggtgaacagaggagacaccacatggcgtccacaaacctggcggcagcgcaaaagatg

SEQ ID NO: 223395 - DNA, 103 bp, Artificial Sequence
  Synthetic Polynucleotide
taatacgactcactataggggctgcggtgggtaatactggtgctgctgcaaacagaggagatgcagcatgaccagtattaacctggcggcagcgcaaaagatg

SEQ ID NO: 223396 - DNA, 103 bp, Artificial Sequence
  Synthetic Polynucleotide
taatacgactcactatagggtgctgctgttgctgcggtgggtaatactggaacagaggagaccagtaatgcccaccgcaaacctggcggcagcgcaaaagatg

SEQ ID NO: 223397 - DNA, 103 bp, Artificial Sequence
  Synthetic Polynucleotide
taatacgactcactatagggttgcccggcttgctgctgttgctgcggtggaacagaggagaccaccgatgcaacagcagaacctggcggcagcgcaaaagatg

SEQ ID NO: 223398 - DNA, 103 bp, Artificial Sequence
  Synthetic Polynucleotide
taatacgactcactatagggagatacgctgttgcccggcttgctgctgttaacagaggagaaacagcatgaagccgggcaacctggcggcagcgcaaaagatg

SEQ ID NO: 223399 - DNA, 103 bp, Artificial Sequence
  Synthetic Polynucleotide
taatacgactcactatagggtcttgcatggagatacgctgttgcccggctaacagaggagaagccggatgacagcgtataacctggcggcagcgcaaaagatg

SEQ ID NO: 223400 - DNA, 103 bp, Artificial Sequence
  Synthetic Polynucleotide
taatacgactcactatagggcgtctgtatttcttgcatggagatacgctgaacagaggagacagcgtatgtccatgcaaaacctggcggcagcgcaaaagatg

SEQ ID NO: 223401 - DNA, 103 bp, Artificial Sequence
  Synthetic Polynucleotide
taatacgactcactataggggttgcggctgcgtctgtatttcttgcatggaacagaggagaccatgcatgaaatacagaaacctggcggcagcgcaaaagatg

SEQ ID NO: 223402 - DNA, 103 bp, Artificial Sequence
  Synthetic Polynucleotide
taatacgactcactataggggggcgaatttgttgcggctgcgtctgtattaacagaggagaaatacaatggcagccgcaaacctggcggcagcgcaaaagatg

SEQ ID NO: 223403 - DNA, 103 bp, Artificial Sequence
  Synthetic Polynucleotide
taatacgactcactatagggtggctgtgatgggcgaatttgttgcggctgaacagaggagacagccgatgcaaattcgcaacctggcggcagcgcaaaagatg

SEQ ID NO: 223404 - DNA, 103 bp, Artificial Sequence
  Synthetic Polynucleotide
taatacgactcactataggggcggcggctgtggctgtgatgggcgaatttaacagaggagaaaattcatgcatcacagcaacctggcggcagcgcaaaagatg

SEQ ID NO: 223405 - DNA, 103 bp, Artificial Sequence
  Synthetic Polynucleotide
taatacgactcactatagggccatagttgtggttcagcccgctgtggacgaacagaggagacgtccaatgcgggctgaaaacctggcggcagcgcaaaagatg

SEQ ID NO: 223406 - DNA, 103 bp, Artificial Sequence
  Synthetic Polynucleotide
taatacgactcactatagggtgctgctgtggcggcggctgtggctgtgataacagaggagaatcacaatgacagccgccaacctggcggcagcgcaaaagatg

SEQ ID NO: 223407 - DNA, 103 bp, Artificial Sequence
  Synthetic Polynucleotide
taatacgactcactatagggctgcggctgctgctgctgtggcggcggctgaacagaggagacagccgatgccacagcagaacctggcggcagcgcaaaagatg

SEQ ID NO: 223408 - DNA, 103 bp, Artificial Sequence
  Synthetic Polynucleotide
taatacgactcactataggggctgtagctgctgcggctgctgctgctgtgaacagaggagacacagcatgagcagccgcaacctggcggcagcgcaaaagatg

SEQ ID NO: 223409 - DNA, 103 bp, Artificial Sequence
  Synthetic Polynucleotide
taatacgactcactatagggcgctgctgcagctgtagctgctgcggctgcaacagaggagagcagccatggcagctacaaacctggcggcagcgcaaaagatg

SEQ ID NO: 223410 - DNA, 103 bp, Artificial Sequence
  Synthetic Polynucleotide
taatacgactcactatagggtgaaccctgccgctgctgcagctgtagctgaacagaggagacagctaatgctgcagcagaacctggcggcagcgcaaaagatg

SEQ ID NO: 223411 - DNA, 103 bp, Artificial Sequence
  Synthetic Polynucleotide
taatacgactcactataggggtatctgcattgaaccctgccgctgctgcaaacagaggagatgcagcatgggcagggttaacctggcggcagcgcaaaagatg

SEQ ID NO: 223412 - DNA, 103 bp, Artificial Sequence
  Synthetic Polynucleotide
taatacgactcactatagggtaatactgaggtatctgcattgaaccctgcaacagaggagagcagggatgaatgcagataacctggcggcagcgcaaaagatg

SEQ ID NO: 223413 - DNA, 103 bp, Artificial Sequence
  Synthetic Polynucleotide
taatacgactcactatagggttggggctgataatactgaggtatctgcataacagaggagaatgcagatgcctcagtataacctggcggcagcgcaaaagatg

SEQ ID NO: 223414 - DNA, 103 bp, Artificial Sequence
  Synthetic Polynucleotide
taatacgactcactataggggcatcatgggttggggctgataatactgagaacagaggagactcagtatgatcagccccaacctggcggcagcgcaaaagatg

SEQ ID NO: 223415 - DNA, 103 bp, Artificial Sequence
  Synthetic Polynucleotide
taatacgactcactatagggtgcaagtgctgcatcatgggttggggctgaaacagaggagatcagccatgacccatgataacctggcggcagcgcaaaagatg

SEQ ID NO: 223416 - DNA, 103 bp, Artificial Sequence
  Synthetic Polynucleotide
taatacgactcactatagggcgccaccgccttctccaccgccacctccataacagaggagaatggagatggcggtggagaacctggcggcagcgcaaaagatg

SEQ ID NO: 223417 - DNA, 103 bp, Artificial Sequence
  Synthetic Polynucleotide
taatacgactcactataggggtccgggccctgccgactctcggcctcgttaacagaggagaaacgagatggagagtcggaacctggcggcagcgcaaaagatg

SEQ ID NO: 223418 - DNA, 103 bp, Artificial Sequence
  Synthetic Polynucleotide
taatacgactcactatagggcatgcgatggtcctttgcaaggctctctaaaacagaggagattagagatgcttgcaaagaacctggcggcagcgcaaaagatg

SEQ ID NO: 223419 - DNA, 103 bp, Artificial Sequence
  Synthetic Polynucleotide
taatacgactcactataggggcataagtttcatgcgatggtcctttgcaaaacagaggagattgcaaatgaccatcgcaaacctggcggcagcgcaaaagatg

SEQ ID NO: 223420 - DNA, 103 bp, Artificial Sequence
  Synthetic Polynucleotide
taatacgactcactatagggtgttgttgttgcataagtttcatgcgatggaacagaggagaccatcgatggaaacttataacctggcggcagcgcaaaagatg

SEQ ID NO: 223421 - DNA, 103 bp, Artificial Sequence
  Synthetic Polynucleotide
taatacgactcactatagggagccacttcctgttgttgttgcataagtttaacagaggagaaaacttatgcaacaacaaaacctggcggcagcgcaaaagatg

SEQ ID NO: 223422 - DNA, 103 bp, Artificial Sequence
  Synthetic Polynucleotide
taatacgactcactatagggtagagagtccagccacttcctgttgttgttaacagaggagaaacaacatgaggaagtggaacctggcggcagcgcaaaagatg

SEQ ID NO: 223423 - DNA, 103 bp, Artificial Sequence
  Synthetic Polynucleotide
taatacgactcactatagggtccaattgtttagagagtccagccacttccaacagaggagaggaagtatgtggactctcaacctggcggcagcgcaaaagatg

SEQ ID NO: 223424 - DNA, 103 bp, Artificial Sequence
  Synthetic Polynucleotide
taatacgactcactatagggcatgacatgctccaattgtttagagagtccaacagaggagaggactcatgaaacaattgaacctggcggcagcgcaaaagatg

SEQ ID NO: 223425 - DNA, 103 bp, Artificial Sequence
  Synthetic Polynucleotide
taatacgactcactatagggtagaaaaatgcatgacatgctccaattgttaacagaggagaaacaatatgagcatgtcaaacctggcggcagcgcaaaagatg

SEQ ID NO: 223426 - DNA, 103 bp, Artificial Sequence
  Synthetic Polynucleotide
taatacgactcactatagggactgcccatttagaaaaatgcatgacatgcaacagaggagagcatgtatggcatttttcaacctggcggcagcgcaaaagatg

SEQ ID NO: 223427 - DNA, 103 bp, Artificial Sequence
  Synthetic Polynucleotide
taatacgactcactataggggccactggaaactgcccatttagaaaaatgaacagaggagacattttatgaaatgggcaaacctggcggcagcgcaaaagatg

SEQ ID NO: 223428 - DNA, 103 bp, Artificial Sequence
  Synthetic Polynucleotide
taatacgactcactatagggcgcgctccgagtccgggccctgccgactctaacagaggagaagagtcatgagggcccggaacctggcggcagcgcaaaagatg

SEQ ID NO: 223429 - DNA, 103 bp, Artificial Sequence
  Synthetic Polynucleotide
taatacgactcactatagggctgtactgctgccactggaaactgcccattaacagaggagaaatgggatgtttccagtgaacctggcggcagcgcaaaagatg

SEQ ID NO: 223430 - DNA, 103 bp, Artificial Sequence
  Synthetic Polynucleotide
taatacgactcactatagggtaaagtaatgctgtactgctgccactggaaaacagaggagattccagatgcagcagtacaacctggcggcagcgcaaaagatg

SEQ ID NO: 223431 - DNA, 103 bp, Artificial Sequence
  Synthetic Polynucleotide
taatacgactcactatagggtcgtttgctataaagtaatgctgtactgctaacagaggagaagcagtatggcattacttaacctggcggcagcgcaaaagatg

SEQ ID NO: 223432 - DNA, 103 bp, Artificial Sequence
  Synthetic Polynucleotide
taatacgactcactatagggatgtaatcagtcgtttgctataaagtaatgaacagaggagacattacatgatagcaaacaacctggcggcagcgcaaaagatg

SEQ ID NO: 223433 - DNA, 103 bp, Artificial Sequence
  Synthetic Polynucleotide
taatacgactcactatagggcgtaaccggtatgtaatcagtcgtttgctaaacagaggagatagcaaatgactgattacaacctggcggcagcgcaaaagatg

SEQ ID NO: 223434 - DNA, 103 bp, Artificial Sequence
  Synthetic Polynucleotide
taatacgactcactatagggaaggaggtgccgtaaccggtatgtaatcagaacagaggagactgattatgtaccggttaaacctggcggcagcgcaaaagatg

SEQ ID NO: 223435 - DNA, 103 bp, Artificial Sequence
  Synthetic Polynucleotide
taatacgactcactatagggaccttgcacgaaggaggtgccgtaaccggtaacagaggagaaccggtatgggcacctccaacctggcggcagcgcaaaagatg

SEQ ID NO: 223436 - DNA, 103 bp, Artificial Sequence
  Synthetic Polynucleotide
taatacgactcactataggggatgcatcacaccttgcacgaaggaggtgcaacagaggagagcacctatgtcgtgcaagaacctggcggcagcgcaaaagatg

SEQ ID NO: 223437 - DNA, 103 bp, Artificial Sequence
  Synthetic Polynucleotide
taatacgactcactatagggggtcactggggatgcatcacaccttgcacgaacagaggagacgtgcaatgtgtgatgcaaacctggcggcagcgcaaaagatg

SEQ ID NO: 223438 - DNA, 103 bp, Artificial Sequence
  Synthetic Polynucleotide
taatacgactcactatagggtggtgttgttggtcactggggatgcatcacaacagaggagagtgatgatgccccagtgaaacctggcggcagcgcaaaagatg

SEQ ID NO: 223439 - DNA, 103 bp, Artificial Sequence
  Synthetic Polynucleotide
taatacgactcactataggggcctcgccgccgcgctccgagtccgggcccaacagaggagagggcccatgctcggagcgaacctggcggcagcgcaaaagatg

SEQ ID NO: 223440 - DNA, 103 bp, Artificial Sequence
  Synthetic Polynucleotide
taatacgactcactatagggtgaaattggatggtgttgttggtcactgggaacagaggagacccagtatgcaacaacacaacctggcggcagcgcaaaagatg

SEQ ID NO: 223441 - DNA, 103 bp, Artificial Sequence
  Synthetic Polynucleotide
taatacgactcactatagggaggatcacagtgaaattggatggtgttgttaacagaggagaaacaacatgatccaatttaacctggcggcagcgcaaaagatg

SEQ ID NO: 223442 - DNA, 103 bp, Artificial Sequence
  Synthetic Polynucleotide
taatacgactcactatagggcccagaaactaggatcacagtgaaattggaaacagaggagatccaatatgactgtgatcaacctggcggcagcgcaaaagatg

SEQ ID NO: 223443 - DNA, 103 bp, Artificial Sequence
  Synthetic Polynucleotide
taatacgactcactatagggatattttgagcccagaaactaggatcacagaacagaggagactgtgaatgtagtttctgaacctggcggcagcgcaaaagatg

SEQ ID NO: 223444 - DNA, 103 bp, Artificial Sequence
  Synthetic Polynucleotide
taatacgactcactatagggtaagttgatgatattttgagcccagaaactaacagaggagaagtttcatggctcaaaataacctggcggcagcgcaaaagatg

SEQ ID NO: 223445 - DNA, 103 bp, Artificial Sequence
  Synthetic Polynucleotide
taatacgactcactatagggctaaagaacctaagttgatgatattttgagaacagaggagactcaaaatgtcatcaactaacctggcggcagcgcaaaagatg

SEQ ID NO: 223446 - DNA, 103 bp, Artificial Sequence
  Synthetic Polynucleotide
taatacgactcactatagggtcctcgattactaaagaacctaagttgatgaacagaggagacatcaaatgaggttctttaacctggcggcagcgcaaaagatg

SEQ ID NO: 223447 - DNA, 103 bp, Artificial Sequence
  Synthetic Polynucleotide
taatacgactcactataggggctctctttatcctcgattactaaagaaccaacagaggagaggttctatggtaatcgagaacctggcggcagcgcaaaagatg

SEQ ID NO: 223448 - DNA, 103 bp, Artificial Sequence
  Synthetic Polynucleotide
taatacgactcactatagggtttgtggctggctctctttatcctcgattaaacagaggagataatcgatgataaagagaaacctggcggcagcgcaaaagatg

SEQ ID NO: 223449 - DNA, 103 bp, Artificial Sequence
  Synthetic Polynucleotide
taatacgactcactatagggtgcttaggcatttgtggctggctctctttaaacagaggagataaagaatgccagccacaaacctggcggcagcgcaaaagatg

SEQ ID NO: 223450 - DNA, 103 bp, Artificial Sequence
  Synthetic Polynucleotide
taatacgactcactataggggagccgggccgcctcgccgccgcgctccgaaacagaggagatcggagatgggcggcgagaacctggcggcagcgcaaaagatg

SEQ ID NO: 223451 - DNA, 103 bp, Artificial Sequence
  Synthetic Polynucleotide
taatacgactcactataggggacaggattctgcttaggcatttgtggctgaacagaggagacagccaatgatgcctaagaacctggcggcagcgcaaaagatg

SEQ ID NO: 223452 - DNA, 103 bp, Artificial Sequence
  Synthetic Polynucleotide
taatacgactcactatagggtctgttccacgacaggattctgcttaggcaaacagaggagatgcctaatgagaatcctgaacctggcggcagcgcaaaagatg

SEQ ID NO: 223453 - DNA, 103 bp, Artificial Sequence
  Synthetic Polynucleotide
taatacgactcactatagggggctgtgaattctgttccacgacaggattcaacagaggagagaatccatgcgtggaacaaacctggcggcagcgcaaaagatg

SEQ ID NO: 223454 - DNA, 103 bp, Artificial Sequence
  Synthetic Polynucleotide
taatacgactcactatagggaccacttggtggctgtgaattctgttccacaacagaggagagtggaaatgaattcacagaacctggcggcagcgcaaaagatg

SEQ ID NO: 223455 - DNA, 103 bp, Artificial Sequence
  Synthetic Polynucleotide
taatacgactcactatagggttgatgataaaccacttggtggctgtgaataacagaggagaattcacatgcaccaagtgaacctggcggcagcgcaaaagatg

SEQ ID NO: 223456 - DNA, 103 bp, Artificial Sequence
  Synthetic Polynucleotide
taatacgactcactataggggataactggtttgatgataaaccacttggtaacagaggagaaccaagatgtttatcatcaacctggcggcagcgcaaaagatg

SEQ ID NO: 223457 - DNA, 103 bp, Artificial Sequence
  Synthetic Polynucleotide
taatacgactcactatagggtgggaacttggataactggtttgatgataaaacagaggagattatcaatgaaccagttaaacctggcggcagcgcaaaagatg

SEQ ID NO: 223458 - DNA, 103 bp, Artificial Sequence
  Synthetic Polynucleotide
taatacgactcactatagggtgatctgtgttgggaacttggataactggtaacagaggagaaccagtatgccaagttccaacctggcggcagcgcaaaagatg

SEQ ID NO: 223459 - DNA, 103 bp, Artificial Sequence
  Synthetic Polynucleotide
taatacgactcactatagggtgagctaggctgatctgtgttgggaacttgaacagaggagacaagttatgaacacagataacctggcggcagcgcaaaagatg

SEQ ID NO: 223460 - DNA, 103 bp, Artificial Sequence
  Synthetic Polynucleotide
taatacgactcactataggggagccgtaattgagctaggctgatctgtgtaacagaggagaacacagatgagcctagctaacctggcggcagcgcaaaagatg

SEQ ID NO: 223461 - DNA, 103 bp, Artificial Sequence
  Synthetic Polynucleotide
taatacgactcactatagggccaacaggttgagccgggccgcctcgccgcaacagaggagagcggcgatgcggcccggcaacctggcggcagcgcaaaagatg

SEQ ID NO: 223462 - DNA, 103 bp, Artificial Sequence
  Synthetic Polynucleotide
taatacgactcactataggggcatatgctggagccgtaattgagctaggcaacagaggagagcctagatgaattacggcaacctggcggcagcgcaaaagatg

SEQ ID NO: 223463 - DNA, 103 bp, Artificial Sequence
  Synthetic Polynucleotide
taatacgactcactatagggacctgttgctgcatatgctggagccgtaataacagaggagaattacgatgccagcatataacctggcggcagcgcaaaagatg

SEQ ID NO: 223464 - DNA, 103 bp, Artificial Sequence
  Synthetic Polynucleotide
taatacgactcactatagggctgagccattacctgttgctgcatatgctgaacagaggagacagcatatgcagcaacagaacctggcggcagcgcaaaagatg

SEQ ID NO: 223465 - DNA, 103 bp, Artificial Sequence
  Synthetic Polynucleotide
taatacgactcactatagggcctgttgcctctgagccattacctgttgctaacagaggagaagcaacatgtaatggctcaacctggcggcagcgcaaaagatg

SEQ ID NO: 223466 - DNA, 103 bp, Artificial Sequence
  Synthetic Polynucleotide
taatacgactcactatagggctccgttgcacctgttgcctctgagccattaacagaggagaaatggcatggaggcaacaaacctggcggcagcgcaaaagatg

SEQ ID NO: 223467 - DNA, 103 bp, Artificial Sequence
  Synthetic Polynucleotide
taatacgactcactatagggaggtgctggcctccgttgcacctgttgcctaacagaggagaaggcaaatggtgcaacggaacctggcggcagcgcaaaagatg

SEQ ID NO: 223468 - DNA, 103 bp, Artificial Sequence
  Synthetic Polynucleotide
taatacgactcactataggggtaaacccacaggtgctggcctccgttgcaaacagaggagatgcaacatgggccagcacaacctggcggcagcgcaaaagatg

SEQ ID NO: 223469 - DNA, 103 bp, Artificial Sequence
  Synthetic Polynucleotide
taatacgactcactatagggctagggtttggtaaacccacaggtgctggcaacagaggagagccagcatgtgtgggtttaacctggcggcagcgcaaaagatg

SEQ ID NO: 223470 - DNA, 103 bp, Artificial Sequence
  Synthetic Polynucleotide
taatacgactcactatagggcccctgcattctagggtttggtaaacccacaacagaggagagtgggtatgccaaaccctaacctggcggcagcgcaaaagatg

SEQ ID NO: 223471 - DNA, 103 bp, Artificial Sequence
  Synthetic Polynucleotide
taatacgactcactataggggctggatgggcccctgcattctagggtttgaacagaggagacaaaccatggaatgcaggaacctggcggcagcgcaaaagatg

SEQ ID NO: 223472 - DNA, 103 bp, Artificial Sequence
  Synthetic Polynucleotide
taatacgactcactataggggcgcaagtgtccaacaggttgagccgggccaacagaggagaggcccgatgcaacctgttaacctggcggcagcgcaaaagatg

SEQ ID NO: 223473 - DNA, 103 bp, Artificial Sequence
  Synthetic Polynucleotide
taatacgactcactatagggatggaaggttgctggatgggcccctgcattaacagaggagaaatgcaatggcccatccaaacctggcggcagcgcaaaagatg

SEQ ID NO: 223474 - DNA, 103 bp, Artificial Sequence
  Synthetic Polynucleotide
taatacgactcactatagggctgatgagagatggaaggttgctggatgggaacagaggagacccatcatgcaaccttccaacctggcggcagcgcaaaagatg

SEQ ID NO: 223475 - DNA, 103 bp, Artificial Sequence
  Synthetic Polynucleotide
taatacgactcactataggggaggcggttgctgatgagagatggaaggttaacagaggagaaaccttatgtctctcatcaacctggcggcagcgcaaaagatg

SEQ ID NO: 223476 - DNA, 103 bp, Artificial Sequence
  Synthetic Polynucleotide
taatacgactcactatagggatcaaacgtggaggcggttgctgatgagagaacagaggagactctcaatggcaaccgccaacctggcggcagcgcaaaagatg

SEQ ID NO: 223477 - DNA, 103 bp, Artificial Sequence
  Synthetic Polynucleotide
taatacgactcactatagggctgaaagtttatcaaacgtggaggcggttgaacagaggagacaaccgatgccacgtttgaacctggcggcagcgcaaaagatg

SEQ ID NO: 223478 - DNA, 103 bp, Artificial Sequence
  Synthetic Polynucleotide
taatacgactcactatagggggctgtgattctgaaagtttatcaaacgtgaacagaggagacacgttatgtaaactttcaacctggcggcagcgcaaaagatg

SEQ ID NO: 223479 - DNA, 103 bp, Artificial Sequence
  Synthetic Polynucleotide
taatacgactcactatagggttgggtttggggctgtgattctgaaagtttaacagaggagaaaacttatggaatcacagaacctggcggcagcgcaaaagatg

SEQ ID NO: 223480 - DNA, 103 bp, Artificial Sequence
  Synthetic Polynucleotide
taatacgactcactatagggaactggtccattgggtttggggctgtgattaacagaggagaaatcacatgcccaaacccaacctggcggcagcgcaaaagatg

SEQ ID NO: 223481 - DNA, 103 bp, Artificial Sequence
  Synthetic Polynucleotide
taatacgactcactataggggaggaggaagaactggtccattgggtttggaacagaggagaccaaacatgatggaccagaacctggcggcagcgcaaaagatg

SEQ ID NO: 223482 - DNA, 103 bp, Artificial Sequence
  Synthetic Polynucleotide
taatacgactcactatagggtgttgaggatgaggaggaagaactggtccaaacagaggagatggaccatgtcttcctccaacctggcggcagcgcaaaagatg

SEQ ID NO: 223483 - DNA, 103 bp, Artificial Sequence
  Synthetic Polynucleotide
taatacgactcactataggggtggcacacggcgcaagtgtccaacaggttaacagaggagaaacctgatggacacttgcaacctggcggcagcgcaaaagatg

SEQ ID NO: 223484 - DNA, 103 bp, Artificial Sequence
  Synthetic Polynucleotide
taatacgactcactatagggatatctcagttgttgaggatgaggaggaagaacagaggagacttcctatgcatcctcaaaacctggcggcagcgcaaaagatg

SEQ ID NO: 223485 - DNA, 103 bp, Artificial Sequence
  Synthetic Polynucleotide
taatacgactcactatagggggtttggtggatatctcagttgttgaggataacagaggagaatcctcatgaactgagataacctggcggcagcgcaaaagatg

SEQ ID NO: 223486 - DNA, 103 bp, Artificial Sequence
  Synthetic Polynucleotide
taatacgactcactatagggggtatgttctggtttggtggatatctcagtaacagaggagaactgagatgtccaccaaaaacctggcggcagcgcaaaagatg

SEQ ID NO: 223487 - DNA, 103 bp, Artificial Sequence
  Synthetic Polynucleotide
taatacgactcactatagggtgcttgtcgtggtatgttctggtttggtggaacagaggagaccaccaatgcagaacataaacctggcggcagcgcaaaagatg

SEQ ID NO: 223488 - DNA, 103 bp, Artificial Sequence
  Synthetic Polynucleotide
taatacgactcactatagggttggctttattgcttgtcgtggtatgttctaacagaggagaagaacaatgcacgacaagaacctggcggcagcgcaaaagatg

SEQ ID NO: 223489 - DNA, 103 bp, Artificial Sequence
  Synthetic Polynucleotide
taatacgactcactatagggtgtagggggtttggctttattgcttgtcgtaacagaggagaacgacaatgaataaagccaacctggcggcagcgcaaaagatg

SEQ ID NO: 223490 - DNA, 103 bp, Artificial Sequence
  Synthetic Polynucleotide
taatacgactcactataggggaaagccatctgtagggggtttggctttataacagaggagaataaagatgaaccccctaaacctggcggcagcgcaaaagatg

SEQ ID NO: 223491 - DNA, 103 bp, Artificial Sequence
  Synthetic Polynucleotide
taatacgactcactataggggttgagccaagaaagccatctgtagggggtaacagaggagaacccccatgagatggcttaacctggcggcagcgcaaaagatg

SEQ ID NO: 223492 - DNA, 103 bp, Artificial Sequence
  Synthetic Polynucleotide
taatacgactcactatagggtttatggcttgttgagccaagaaagccatcaacagaggagagatggcatgcttggctcaaacctggcggcagcgcaaaagatg

SEQ ID NO: 223493 - DNA, 103 bp, Artificial Sequence
  Synthetic Polynucleotide
taatacgactcactatagggctgccactgttttatggcttgttgagccaaaacagaggagattggctatgcaagccataaacctggcggcagcgcaaaagatg

SEQ ID NO: 223494 - DNA, 103 bp, Artificial Sequence
  Synthetic Polynucleotide
taatacgactcactatagggggatgttctggtggcacacggcgcaagtgtaacagaggagaacacttatgccgtgtgccaacctggcggcagcgcaaaagatg

SEQ ID NO: 223495 - DNA, 103 bp, Artificial Sequence
  Synthetic Polynucleotide
taatacgactcactatagggcactgctgatctgccactgttttatggcttaacagaggagaaagccaatgaacagtggcaacctggcggcagcgcaaaagatg

SEQ ID NO: 223496 - DNA, 103 bp, Artificial Sequence
  Synthetic Polynucleotide
taatacgactcactataggggttccctgtccactgctgatctgccactgtaacagaggagaacagtgatggatcagcagaacctggcggcagcgcaaaagatg

SEQ ID NO: 223497 - DNA, 103 bp, Artificial Sequence
  Synthetic Polynucleotide
taatacgactcactatagggagttgatggggttccctgtccactgctgataacagaggagaatcagcatgggacagggaaacctggcggcagcgcaaaagatg

SEQ ID NO: 223498 - DNA, 103 bp, Artificial Sequence
  Synthetic Polynucleotide
taatacgactcactatagggtgctgttggtagttgatggggttccctgtcaacagaggagagacaggatgccccatcaaaacctggcggcagcgcaaaagatg

SEQ ID NO: 223499 - DNA, 103 bp, Artificial Sequence
  Synthetic Polynucleotide
taatacgactcactataggggtagaggatgtgctgttggtagttgatgggaacagaggagacccatcatgtaccaacagaacctggcggcagcgcaaaagatg

SEQ ID NO: 223500 - DNA, 103 bp, Artificial Sequence
  Synthetic Polynucleotide
taatacgactcactataggggctggaaggagtagaggatgtgctgttggtaacagaggagaaccaacatgacatcctctaacctggcggcagcgcaaaagatg

SEQ ID NO: 223501 - DNA, 103 bp, Artificial Sequence
  Synthetic Polynucleotide
taatacgactcactatagggtaatcgtggggctggaaggagtagaggatgaacagaggagacatcctatgctccttccaaacctggcggcagcgcaaaagatg

SEQ ID NO: 223502 - DNA, 103 bp, Artificial Sequence
  Synthetic Polynucleotide
taatacgactcactataggggctgcactagtaatcgtggggctggaaggaaacagaggagatccttcatgccccacgataacctggcggcagcgcaaaagatg

SEQ ID NO: 223503 - DNA, 103 bp, Artificial Sequence
  Synthetic Polynucleotide
taatacgactcactatagggatcatatcctgctgcactagtaatcgtgggaacagaggagacccacgatgactagtgcaaacctggcggcagcgcaaaagatg

SEQ ID NO: 223504 - DNA, 103 bp, Artificial Sequence
  Synthetic Polynucleotide
taatacgactcactatagggaagcctttccatcatatcctgctgcactagaacagaggagactagtgatgcaggatatgaacctggcggcagcgcaaaagatg

SEQ ID NO: 223505 - DNA, 103 bp, Artificial Sequence
  Synthetic Polynucleotide
taatacgactcactataggggcccggctctggatgttctggtggcacacgaacagaggagacgtgtgatgccagaacataacctggcggcagcgcaaaagatg

SEQ ID NO: 223506 - DNA, 103 bp, Artificial Sequence
  Synthetic Polynucleotide
taatacgactcactatagggggtgaaccaaaagcctttccatcatatcctaacagaggagaaggataatgtggaaaggcaacctggcggcagcgcaaaagatg

SEQ ID NO: 223507 - DNA, 103 bp, Artificial Sequence
  Synthetic Polynucleotide
taatacgactcactatagggatcgatcataggtgaaccaaaagcctttccaacagaggagaggaaagatgtttggttcaaacctggcggcagcgcaaaagatg

SEQ ID NO: 223508 - DNA, 103 bp, Artificial Sequence
  Synthetic Polynucleotide
taatacgactcactataggggtgagctcaaatcgatcataggtgaaccaaaacagaggagattggttatgctatgatcgaacctggcggcagcgcaaaagatg

SEQ ID NO: 223509 - DNA, 103 bp, Artificial Sequence
  Synthetic Polynucleotide
taatacgactcactatagggcctcccactggtgagctcaaatcgatcataaacagaggagatatgatatgtttgagctcaacctggcggcagcgcaaaagatg

SEQ ID NO: 223510 - DNA, 103 bp, Artificial Sequence
  Synthetic Polynucleotide
taatacgactcactatagggattataagaccctcccactggtgagctcaaaacagaggagattgagcatgccagtgggaaacctggcggcagcgcaaaagatg

SEQ ID NO: 223511 - DNA, 103 bp, Artificial Sequence
  Synthetic Polynucleotide
taatacgactcactataggggagagggaagattataagaccctcccactgaacagaggagacagtggatgggtcttataaacctggcggcagcgcaaaagatg

SEQ ID NO: 223512 - DNA, 103 bp, Artificial Sequence
  Synthetic Polynucleotide
taatacgactcactatagggatatccggaagagagggaagattataagacaacagaggagagtcttaatgtcttccctcaacctggcggcagcgcaaaagatg

SEQ ID NO: 223513 - DNA, 103 bp, Artificial Sequence
  Synthetic Polynucleotide
taatacgactcactatagggtgaacagtcaatatccggaagagagggaagaacagaggagacttcccatgcttccggataacctggcggcagcgcaaaagatg

SEQ ID NO: 223514 - DNA, 103 bp, Artificial Sequence
  Synthetic Polynucleotide
taatacgactcactatagggtaatagtacttgaacagtcaatatccggaaaacagaggagattccggatgttgactgttaacctggcggcagcgcaaaagatg

SEQ ID NO: 223515 - DNA, 103 bp, Artificial Sequence
  Synthetic Polynucleotide
taatacgactcactatagggttgtccagcataatagtacttgaacagtcaaacagaggagatgactgatgaagtactataacctggcggcagcgcaaaagatg

SEQ ID NO: 223516 - DNA, 103 bp, Artificial Sequence
  Synthetic Polynucleotide
taatacgactcactatagggcagcttgggcgcccggctctggatgttctgaacagaggagacagaacatgcagagccggaacctggcggcagcgcaaaagatg

SEQ ID NO: 223517 - DNA, 103 bp, Artificial Sequence
  Synthetic Polynucleotide
taatacgactcactatagggcctcacaatattgtccagcataatagtactaacagaggagaagtactatgatgctggacaacctggcggcagcgcaaaagatg

SEQ ID NO: 223518 - DNA, 103 bp, Artificial Sequence
  Synthetic Polynucleotide
taatacgactcactatagggtagtatctttcctcacaatattgtccagcaaacagaggagatgctggatgatattgtgaaacctggcggcagcgcaaaagatg

SEQ ID NO: 223519 - DNA, 103 bp, Artificial Sequence
  Synthetic Polynucleotide
taatacgactcactatagggtgatctatattagtatctttcctcacaataaacagaggagatattgtatggaaagatacaacctggcggcagcgcaaaagatg

SEQ ID NO: 223520 - DNA, 103 bp, Artificial Sequence
  Synthetic Polynucleotide
taatacgactcactatagggtggctggccatgatctatattagtatctttaacagaggagaaaagatatgaatatagataacctggcggcagcgcaaaagatg

SEQ ID NO: 223521 - DNA, 103 bp, Artificial Sequence
  Synthetic Polynucleotide
taatacgactcactatagggagggtggtcttggctggccatgatctatataacagaggagaatatagatgatggccagcaacctggcggcagcgcaaaagatg

SEQ ID NO: 223522 - DNA, 103 bp, Artificial Sequence
  Synthetic Polynucleotide
taatacgactcactataggggttctgtttgagggtggtcttggctggccaaacagaggagatggccaatgaagaccaccaacctggcggcagcgcaaaagatg

SEQ ID NO: 223523 - DNA, 103 bp, Artificial Sequence
  Synthetic Polynucleotide
taatacgactcactatagggtgactggaccgttctgtttgagggtggtctaacagaggagaagaccaatgtcaaacagaaacctggcggcagcgcaaaagatg

SEQ ID NO: 223524 - DNA, 103 bp, Artificial Sequence
  Synthetic Polynucleotide
taatacgactcactatagggatgaatttggtgactggaccgttctgtttgaacagaggagacaaacaatgcggtccagtaacctggcggcagcgcaaaagatg

SEQ ID NO: 223525 - DNA, 103 bp, Artificial Sequence
  Synthetic Polynucleotide
taatacgactcactataggggatggcactgatgaatttggtgactggaccaacagaggagaggtccaatgaccaaattcaacctggcggcagcgcaaaagatg

SEQ ID NO: 223526 - DNA, 103 bp, Artificial Sequence
  Synthetic Polynucleotide
taatacgactcactatagggaaggcctggagatggcactgatgaatttggaacagaggagaccaaatatgtcagtgccaaacctggcggcagcgcaaaagatg

SEQ ID NO: 223527 - DNA, 103 bp, Artificial Sequence
  Synthetic Polynucleotide
taatacgactcactatagggctgccgccgccgccaccgccttctccaccgaacagaggagacggtggatgaggcggtggaacctggcggcagcgcaaaagatg

SEQ ID NO: 223528 - DNA, 103 bp, Artificial Sequence
  Synthetic Polynucleotide
taatacgactcactatagggggcagggcagcagcttgggcgcccggctctaacagaggagaagagccatgcgcccaagcaacctggcggcagcgcaaaagatg

SEQ ID NO: 223529 - DNA, 103 bp, Artificial Sequence
  Synthetic Polynucleotide
taatacgactcactatagggcaggtcctgcaaggcctggagatggcactgaacagaggagacagtgcatgctccaggccaacctggcggcagcgcaaaagatg

SEQ ID NO: 223530 - DNA, 103 bp, Artificial Sequence
  Synthetic Polynucleotide
taatacgactcactataggggtcatagtaacaggtcctgcaaggcctggaaacagaggagatccaggatgtgcaggaccaacctggcggcagcgcaaaagatg

SEQ ID NO: 223531 - DNA, 103 bp, Artificial Sequence
  Synthetic Polynucleotide
taatacgactcactataggggtgtacactagtcatagtaacaggtcctgcaacagaggagagcaggaatggttactatgaacctggcggcagcgcaaaagatg

SEQ ID NO: 223532 - DNA, 103 bp, Artificial Sequence
  Synthetic Polynucleotide
taatacgactcactataggggtattggggggtgtacactagtcatagtaaaacagaggagattactaatgctagtgtacaacctggcggcagcgcaaaagatg

SEQ ID NO: 223533 - DNA, 103 bp, Artificial Sequence
  Synthetic Polynucleotide
taatacgactcactatagggctaggtgaacgtattggggggtgtacactaaacagaggagatagtgtatgccccccaataacctggcggcagcgcaaaagatg

SEQ ID NO: 223534 - DNA, 103 bp, Artificial Sequence
  Synthetic Polynucleotide
taatacgactcactataggggctggaggcactaggtgaacgtattgggggaacagaggagacccccaatgcgttcacctaacctggcggcagcgcaaaagatg

SEQ ID NO: 223535 - DNA, 103 bp, Artificial Sequence
  Synthetic Polynucleotide
taatacgactcactatagggggcttccaacgctggaggcactaggtgaacaacagaggagagttcacatggtgcctccaaacctggcggcagcgcaaaagatg

SEQ ID NO: 223536 - DNA, 103 bp, Artificial Sequence
  Synthetic Polynucleotide
taatacgactcactataggggagcttcctcggcttccaacgctggaggcaaacagaggagatgcctcatgcgttggaagaacctggcggcagcgcaaaagatg

SEQ ID NO: 223537 - DNA, 103 bp, Artificial Sequence
  Synthetic Polynucleotide
taatacgactcactatagggggaagagccagagcttcctcggcttccaacaacagaggagagttggaatgcgaggaagcaacctggcggcagcgcaaaagatg

SEQ ID NO: 223538 - DNA, 103 bp, Artificial Sequence
  Synthetic Polynucleotide
taatacgactcactatagggctggtttgctggaagagccagagcttcctcaacagaggagagaggaaatgctggctcttaacctggcggcagcgcaaaagatg

SEQ ID NO: 223539 - DNA, 103 bp, Artificial Sequence
  Synthetic Polynucleotide
taatacgactcactatagggaaagagtgcaggcagggcagcagcttgggcaacagaggagagcccaaatggctgccctgaacctggcggcagcgcaaaagatg

SEQ ID NO: 223540 - DNA, 103 bp, Artificial Sequence
  Synthetic Polynucleotide
taatacgactcactatagggtcagctcctgctggtttgctggaagagccaaacagaggagatggctcatgcagcaaaccaacctggcggcagcgcaaaagatg

SEQ ID NO: 223541 - DNA, 103 bp, Artificial Sequence
  Synthetic Polynucleotide
taatacgactcactataggggtgtgtagagtcagctcctgctggtttgctaacagaggagaagcaaaatggcaggagctaacctggcggcagcgcaaaagatg

SEQ ID NO: 223542 - DNA, 103 bp, Artificial Sequence
  Synthetic Polynucleotide
taatacgactcactatagggctgggactttgtgtgtagagtcagctcctgaacagaggagacaggagatgactctacacaacctggcggcagcgcaaaagatg

SEQ ID NO: 223543 - DNA, 103 bp, Artificial Sequence
  Synthetic Polynucleotide
taatacgactcactatagggagcatgaccactgggactttgtgtgtagagaacagaggagactctacatgcaaagtcccaacctggcggcagcgcaaaagatg

SEQ ID NO: 223544 - DNA, 103 bp, Artificial Sequence
  Synthetic Polynucleotide
taatacgactcactatagggaattggctccagcatgaccactgggactttaacagaggagaaaagtcatggtggtcatgaacctggcggcagcgcaaaagatg

SEQ ID NO: 223545 - DNA, 103 bp, Artificial Sequence
  Synthetic Polynucleotide
taatacgactcactataggggttttattcgaattggctccagcatgaccaaacagaggagatggtcaatgtggagccaaaacctggcggcagcgcaaaagatg

SEQ ID NO: 223546 - DNA, 103 bp, Artificial Sequence
  Synthetic Polynucleotide
taatacgactcactatagggctgttttcttgttttattcgaattggctccaacagaggagaggagccatgtcgaataaaaacctggcggcagcgcaaaagatg

SEQ ID NO: 223547 - DNA, 103 bp, Artificial Sequence
  Synthetic Polynucleotide
taatacgactcactatagggcggtggtccactgttttcttgttttattcgaacagaggagacgaataatgcaagaaaacaacctggcggcagcgcaaaagatg

SEQ ID NO: 223548 - DNA, 103 bp, Artificial Sequence
  Synthetic Polynucleotide
taatacgactcactatagggcataattttccggtggtccactgttttcttaacagaggagaaagaaaatggtggaccacaacctggcggcagcgcaaaagatg

SEQ ID NO: 223549 - DNA, 103 bp, Artificial Sequence
  Synthetic Polynucleotide
taatacgactcactatagggacagggaaatcataattttccggtggtccaaacagaggagatggaccatgggaaaattaaacctggcggcagcgcaaaagatg

SEQ ID NO: 223550 - DNA, 103 bp, Artificial Sequence
  Synthetic Polynucleotide
taatacgactcactataggggcgctggcagaaagagtgcaggcagggcagaacagaggagactgcccatgctgcactctaacctggcggcagcgcaaaagatg

SEQ ID NO: 223551 - DNA, 103 bp, Artificial Sequence
  Synthetic Polynucleotide
taatacgactcactatagggcactataacaacagggaaatcataattttcaacagaggagagaaaatatggatttccctaacctggcggcagcgcaaaagatg

SEQ ID NO: 223552 - DNA, 103 bp, Artificial Sequence
  Synthetic Polynucleotide
taatacgactcactatagggattcttgcttcactataacaacagggaaataacagaggagaatttccatgttgttatagaacctggcggcagcgcaaaagatg

SEQ ID NO: 223553 - DNA, 103 bp, Artificial Sequence
  Synthetic Polynucleotide
taatacgactcactatagggtcttcatctgattcttgcttcactataacaaacagaggagatgttatatggaagcaagaaacctggcggcagcgcaaaagatg

SEQ ID NO: 223554 - DNA, 103 bp, Artificial Sequence
  Synthetic Polynucleotide
taatacgactcactatagggaggcctagattcttcatctgattcttgcttaacagaggagaaagcaaatgtcagatgaaaacctggcggcagcgcaaaagatg

SEQ ID NO: 223555 - DNA, 103 bp, Artificial Sequence
  Synthetic Polynucleotide
taatacgactcactatagggtggcattttgaggcctagattcttcatctgaacagaggagacagatgatgaatctaggcaacctggcggcagcgcaaaagatg

SEQ ID NO: 223556 - DNA, 103 bp, Artificial Sequence
  Synthetic Polynucleotide
taatacgactcactatagggcttggataattggcattttgaggcctagataacagaggagaatctagatgtcaaaatgcaacctggcggcagcgcaaaagatg

SEQ ID NO: 223557 - DNA, 103 bp, Artificial Sequence
  Synthetic Polynucleotide
taatacgactcactataggggagtatgcttcttggataattggcattttgaacagaggagacaaaatatgaattatccaaacctggcggcagcgcaaaagatg

SEQ ID NO: 223558 - DNA, 103 bp, Artificial Sequence
  Synthetic Polynucleotide
taatacgactcactataggggcagggaggtgagtatgcttcttggataataacagaggagaattatcatggaagcatacaacctggcggcagcgcaaaagatg

SEQ ID NO: 223559 - DNA, 103 bp, Artificial Sequence
  Synthetic Polynucleotide
taatacgactcactatagggctatttaagagcagggaggtgagtatgcttaacagaggagaaagcatatgcacctccctaacctggcggcagcgcaaaagatg

SEQ ID NO: 223560 - DNA, 103 bp, Artificial Sequence
  Synthetic Polynucleotide
taatacgactcactataggggctctgactgctatttaagagcagggaggtaacagaggagaacctccatgctcttaaataacctggcggcagcgcaaaagatg

SEQ ID NO: 223561 - DNA, 103 bp, Artificial Sequence
  Synthetic Polynucleotide
taatacgactcactatagggcgggcaggcagcgctggcagaaagagtgcaaacagaggagatgcactatgtctgccagcaacctggcggcagcgcaaaagatg

SEQ ID NO: 223562 - DNA, 103 bp, Artificial Sequence
  Synthetic Polynucleotide
taatacgactcactatagggcagaagtagagctctgactgctatttaagaaacagaggagatcttaaatggcagtcagaaacctggcggcagcgcaaaagatg

SEQ ID NO: 223563 - DNA, 103 bp, Artificial Sequence
  Synthetic Polynucleotide
taatacgactcactatagggacagtctcctcagaagtagagctctgactgaacagaggagacagtcaatgctctacttcaacctggcggcagcgcaaaagatg

SEQ ID NO: 223564 - DNA, 103 bp, Artificial Sequence
  Synthetic Polynucleotide
taatacgactcactatagggtgatcttagcacagtctcctcagaagtagaaacagaggagatctactatggaggagactaacctggcggcagcgcaaaagatg

SEQ ID NO: 223565 - DNA, 103 bp, Artificial Sequence
  Synthetic Polynucleotide
taatacgactcactatagggcaggggcatctgatcttagcacagtctcctaacagaggagaaggagaatgtgctaagataacctggcggcagcgcaaaagatg

SEQ ID NO: 223566 - DNA, 103 bp, Artificial Sequence
  Synthetic Polynucleotide
taatacgactcactatagggcctgtactatcaggggcatctgatcttagcaacagaggagagctaagatgagatgccccaacctggcggcagcgcaaaagatg

SEQ ID NO: 223567 - DNA, 103 bp, Artificial Sequence
  Synthetic Polynucleotide
taatacgactcactatagggaggttgatctcctgtactatcaggggcatcaacagaggagagatgccatggatagtacaaacctggcggcagcgcaaaagatg

SEQ ID NO: 223568 - DNA, 103 bp, Artificial Sequence
  Synthetic Polynucleotide
taatacgactcactatagggggtgaagtccaggttgatctcctgtactataacagaggagaatagtaatggagatcaacaacctggcggcagcgcaaaagatg

SEQ ID NO: 223569 - DNA, 103 bp, Artificial Sequence
  Synthetic Polynucleotide
taatacgactcactataggggaattgtcctggtgaagtccaggttgatctaacagaggagaagatcaatgtggacttcaaacctggcggcagcgcaaaagatg

SEQ ID NO: 223570 - DNA, 103 bp, Artificial Sequence
  Synthetic Polynucleotide
taatacgactcactatagggtccatttgaggaattgtcctggtgaagtccaacagaggagaggacttatgcaggacaataacctggcggcagcgcaaaagatg

SEQ ID NO: 223571 - DNA, 103 bp, Artificial Sequence
  Synthetic Polynucleotide
taatacgactcactatagggattcagactttccatttgaggaattgtcctaacagaggagaaggacaatgcctcaaatgaacctggcggcagcgcaaaagatg

SEQ ID NO: 223572 - DNA, 103 bp, Artificial Sequence
  Synthetic Polynucleotide
taatacgactcactatagggcgctggggcgcgggcaggcagcgctggcagaacagaggagactgccaatgctgcctgccaacctggcggcagcgcaaaagatg

SEQ ID NO: 223573 - DNA, 103 bp, Artificial Sequence
  Synthetic Polynucleotide
taatacgactcactatagggggatccaaccattcagactttccatttgagaacagaggagactcaaaatgaaagtctgaaacctggcggcagcgcaaaagatg

SEQ ID NO: 223574 - DNA, 103 bp, Artificial Sequence
  Synthetic Polynucleotide
taatacgactcactatagggcttctgggaaggatccaaccattcagacttaacagaggagaaagtctatgtggttggataacctggcggcagcgcaaaagatg

SEQ ID NO: 223575 - DNA, 103 bp, Artificial Sequence
  Synthetic Polynucleotide
taatacgactcactataggggaagaggtgacttctgggaaggatccaaccaacagaggagaggttggatgcttcccagaaacctggcggcagcgcaaaagatg

SEQ ID NO: 223576 - DNA, 103 bp, Artificial Sequence
  Synthetic Polynucleotide
taatacgactcactatagggtctccaacatgaagaggtgacttctgggaaaacagaggagattcccaatggtcacctctaacctggcggcagcgcaaaagatg

SEQ ID NO: 223577 - DNA, 103 bp, Artificial Sequence
  Synthetic Polynucleotide
taatacgactcactatagggtttccttgtctctccaacatgaagaggtgaaacagaggagatcacctatgcatgttggaaacctggcggcagcgcaaaagatg

SEQ ID NO: 223578 - DNA, 103 bp, Artificial Sequence
  Synthetic Polynucleotide
taatacgactcactatagggggtcatcctctttccttgtctctccaacataacagaggagaatgttgatgagacaaggaaacctggcggcagcgcaaaagatg

SEQ ID NO: 223579 - DNA, 103 bp, Artificial Sequence
  Synthetic Polynucleotide
taatacgactcactatagggtcctcattggggtcatcctctttccttgtcaacagaggagagacaagatgagaggatgaaacctggcggcagcgcaaaagatg

SEQ ID NO: 223580 - DNA, 103 bp, Artificial Sequence
  Synthetic Polynucleotide
taatacgactcactatagggtgcacaccagtcctcattggggtcatcctcaacagaggagagaggatatgcccaatgagaacctggcggcagcgcaaaagatg

SEQ ID NO: 223581 - DNA, 103 bp, Artificial Sequence
  Synthetic Polynucleotide
taatacgactcactatagggtttgacaaactgcacaccagtcctcattggaacagaggagaccaatgatgactggtgtgaacctggcggcagcgcaaaagatg

SEQ ID NO: 223582 - DNA, 103 bp, Artificial Sequence
  Synthetic Polynucleotide
taatacgactcactatagggtcccctccgttttgacaaactgcacaccagaacagaggagactggtgatgagtttgtcaaacctggcggcagcgcaaaagatg

SEQ ID NO: 223583 - DNA, 103 bp, Artificial Sequence
  Synthetic Polynucleotide
taatacgactcactatagggcatgaggtagcgctggggcgcgggcaggcaaacagaggagatgcctgatggcgccccagaacctggcggcagcgcaaaagatg

SEQ ID NO: 223584 - DNA, 103 bp, Artificial Sequence
  Synthetic Polynucleotide
taatacgactcactataggggcagaggagttcccctccgttttgacaaacaacagaggagagtttgtatgaacggagggaacctggcggcagcgcaaaagatg

SEQ ID NO: 223585 - DNA, 103 bp, Artificial Sequence
  Synthetic Polynucleotide
taatacgactcactatagggacttttcacagcagaggagttcccctccgtaacagaggagaacggagatgaactcctctaacctggcggcagcgcaaaagatg

SEQ ID NO: 223586 - DNA, 103 bp, Artificial Sequence
  Synthetic Polynucleotide
taatacgactcactatagggactttggggcacttttcacagcagaggagtaacagaggagaactcctatgctgtgaaaaaacctggcggcagcgcaaaagatg

SEQ ID NO: 223587 - DNA, 103 bp, Artificial Sequence
  Synthetic Polynucleotide
taatacgactcactatagggaagatggaatactttggggcacttttcacaaacagaggagatgtgaaatgtgccccaaaaacctggcggcagcgcaaaagatg

SEQ ID NO: 223588 - DNA, 103 bp, Artificial Sequence
  Synthetic Polynucleotide
taatacgactcactatagggcatgacaagaaagatggaatactttggggcaacagaggagagccccaatgtattccatcaacctggcggcagcgcaaaagatg

SEQ ID NO: 223589 - DNA, 103 bp, Artificial Sequence
  Synthetic Polynucleotide
taatacgactcactatagggaatgtgggcacatgacaagaaagatggaataacagaggagaattccaatgttcttgtcaaacctggcggcagcgcaaaagatg

SEQ ID NO: 223590 - DNA, 103 bp, Artificial Sequence
  Synthetic Polynucleotide
taatacgactcactatagggaaaatttgtcaatgtgggcacatgacaagaaacagaggagatcttgtatggtgcccacaaacctggcggcagcgcaaaagatg

SEQ ID NO: 223591 - DNA, 103 bp, Artificial Sequence
  Synthetic Polynucleotide
taatacgactcactatagggctccacttggaaaatttgtcaatgtgggcaaacagaggagatgcccaatgtgacaaattaacctggcggcagcgcaaaagatg

SEQ ID NO: 223592 - DNA, 103 bp, Artificial Sequence
  Synthetic Polynucleotide
taatacgactcactatagggcaaatccactctccacttggaaaatttgtcaacagaggagagacaaaatgtccaagtggaacctggcggcagcgcaaaagatg

SEQ ID NO: 223593 - DNA, 103 bp, Artificial Sequence
  Synthetic Polynucleotide
taatacgactcactataggggcagaaagtgcaaatccactctccacttggaacagaggagaccaagtatggagtggattaacctggcggcagcgcaaaagatg

SEQ ID NO: 223594 - DNA, 103 bp, Artificial Sequence
  Synthetic Polynucleotide
taatacgactcactataggggcgcgggcagcatgaggtagcgctggggcgaacagaggagacgccccatggctacctcaaacctggcggcagcgcaaaagatg

SEQ ID NO: 223595 - DNA, 103 bp, Artificial Sequence
  Synthetic Polynucleotide
taatacgactcactatagggataagtctcggcagaaagtgcaaatccactaacagaggagaagtggaatggcactttctaacctggcggcagcgcaaaagatg

SEQ ID NO: 223596 - DNA, 103 bp, Artificial Sequence
  Synthetic Polynucleotide
taatacgactcactatagggtctggtttagataagtctcggcagaaagtgaacagaggagacactttatgccgagacttaacctggcggcagcgcaaaagatg

SEQ ID NO: 223597 - DNA, 103 bp, Artificial Sequence
  Synthetic Polynucleotide
taatacgactcactatagggatattcaacttctggtttagataagtctcgaacagaggagacgagacatgtctaaaccaaacctggcggcagcgcaaaagatg

SEQ ID NO: 223598 - DNA, 103 bp, Artificial Sequence
  Synthetic Polynucleotide
taatacgactcactatagggcatcacaatcatattcaacttctggtttagaacagaggagactaaacatgaagttgaataacctggcggcagcgcaaaagatg

SEQ ID NO: 223599 - DNA, 103 bp, Artificial Sequence
  Synthetic Polynucleotide
taatacgactcactatagggtgactgggagcatcacaatcatattcaactaacagaggagaagttgaatgtgattgtgaaacctggcggcagcgcaaaagatg

SEQ ID NO: 223600 - DNA, 103 bp, Artificial Sequence
  Synthetic Polynucleotide
taatacgactcactatagggttctgagttgtgactgggagcatcacaatcaacagaggagagattgtatggctcccagtaacctggcggcagcgcaaaagatg

SEQ ID NO: 223601 - DNA, 103 bp, Artificial Sequence
  Synthetic Polynucleotide
taatacgactcactatagggttttctttttttctgagttgtgactgggagaacagaggagactcccaatgacaactcagaacctggcggcagcgcaaaagatg

SEQ ID NO: 223602 - DNA, 103 bp, Artificial Sequence
  Synthetic Polynucleotide
taatacgactcactatagggaggccttcagttttctttttttctgagttgaacagaggagacaactcatgaaaaaagaaaacctggcggcagcgcaaaagatg

SEQ ID NO: 223603 - DNA, 103 bp, Artificial Sequence
  Synthetic Polynucleotide
taatacgactcactatagggtaacttaacaaggccttcagttttctttttaacagaggagaaaaaagatgactgaaggcaacctggcggcagcgcaaaagatg

SEQ ID NO: 223604 - DNA, 103 bp, Artificial Sequence
  Synthetic Polynucleotide
taatacgactcactatagggctataggtgttaacttaacaaggccttcagaacagaggagactgaagatgttgttaagtaacctggcggcagcgcaaaagatg

SEQ ID NO: 223605 - DNA, 103 bp, Artificial Sequence
  Synthetic Polynucleotide
taatacgactcactatagggcccagcatgggcgcgggcagcatgaggtagaacagaggagactacctatggctgcccgcaacctggcggcagcgcaaaagatg

SEQ ID NO: 223606 - DNA, 103 bp, Artificial Sequence
  Synthetic Polynucleotide
taatacgactcactatagggttccttttatctataggtgttaacttaacaaacagaggagatgttaaatgaacacctataacctggcggcagcgcaaaagatg

SEQ ID NO: 223607 - DNA, 103 bp, Artificial Sequence
  Synthetic Polynucleotide
taatacgactcactataggggcgctcacacttccttttatctataggtgtaacagaggagaacacctatggataaaaggaacctggcggcagcgcaaaagatg

SEQ ID NO: 223608 - DNA, 103 bp, Artificial Sequence
  Synthetic Polynucleotide
taatacgactcactatagggataaaagtaggcgctcacacttccttttataacagaggagaataaaaatgagtgtgagcaacctggcggcagcgcaaaagatg

SEQ ID NO: 223609 - DNA, 103 bp, Artificial Sequence
  Synthetic Polynucleotide
taatacgactcactatagggcagtaaagaaataaaagtaggcgctcacacaacagaggagagtgtgaatgcctacttttaacctggcggcagcgcaaaagatg

SEQ ID NO: 223610 - DNA, 103 bp, Artificial Sequence
  Synthetic Polynucleotide
taatacgactcactatagggcatttcatggcagtaaagaaataaaagtagaacagaggagactacttatgtttctttacaacctggcggcagcgcaaaagatg

SEQ ID NO: 223611 - DNA, 103 bp, Artificial Sequence
  Synthetic Polynucleotide
taatacgactcactatagggaagccaggctcatttcatggcagtaaagaaaacagaggagattctttatggccatgaaaaacctggcggcagcgcaaaagatg

SEQ ID NO: 223612 - DNA, 103 bp, Artificial Sequence
  Synthetic Polynucleotide
taatacgactcactataggggggtcttgaaaagccaggctcatttcatggaacagaggagaccatgaatggagcctggcaacctggcggcagcgcaaaagatg

SEQ ID NO: 223613 - DNA, 103 bp, Artificial Sequence
  Synthetic Polynucleotide
taatacgactcactatagggtagaggaacagggtcttgaaaagccaggctaacagaggagaagcctgatgtttcaagacaacctggcggcagcgcaaaagatg

SEQ ID NO: 223614 - DNA, 103 bp, Artificial Sequence
  Synthetic Polynucleotide
taatacgactcactatagggcaggcacagttagaggaacagggtcttgaaaacagaggagattcaagatgctgttcctcaacctggcggcagcgcaaaagatg

SEQ ID NO: 223615 - DNA, 103 bp, Artificial Sequence
  Synthetic Polynucleotide
taatacgactcactatagggttgtaataatcaggcacagttagaggaacaaacagaggagatgttccatgaactgtgccaacctggcggcagcgcaaaagatg

SEQ ID NO: 223616 - DNA, 103 bp, Artificial Sequence
  Synthetic Polynucleotide
taatacgactcactatagggctcggccgagcccagcatgggcgcgggcagaacagaggagactgcccatgcccatgctgaacctggcggcagcgcaaaagatg

SEQ ID NO: 223617 - DNA, 103 bp, Artificial Sequence
  Synthetic Polynucleotide
taatacgactcactatagggtttaattattttgtaataatcaggcacagtaacagaggagaactgtgatggattattacaacctggcggcagcgcaaaagatg

SEQ ID NO: 223618 - DNA, 103 bp, Artificial Sequence
  Synthetic Polynucleotide
taatacgactcactatagggccattggatttttaattattttgtaataataacagaggagaattattatgaaataattaaacctggcggcagcgcaaaagatg

SEQ ID NO: 223619 - DNA, 103 bp, Artificial Sequence
  Synthetic Polynucleotide
taatacgactcactataggggttgacaaatccattggatttttaattattaacagaggagaaataatatgaaatccaataacctggcggcagcgcaaaagatg

SEQ ID NO: 223620 - DNA, 103 bp, Artificial Sequence
  Synthetic Polynucleotide
taatacgactcactatagggtttcttgatggttgacaaatccattggattaacagaggagaaatccaatggatttgtcaaacctggcggcagcgcaaaagatg

SEQ ID NO: 223621 - DNA, 103 bp, Artificial Sequence
  Synthetic Polynucleotide
taatacgactcactatagggcttgtagtcttttcttgatggttgacaaataacagaggagaatttgtatgccatcaagaaacctggcggcagcgcaaaagatg

SEQ ID NO: 223622 - DNA, 103 bp, Artificial Sequence
  Synthetic Polynucleotide
taatacgactcactataggggaataatcttcttgtagtcttttcttgatgaacagaggagacatcaaatgaagactacaaacctggcggcagcgcaaaagatg

SEQ ID NO: 223623 - DNA, 103 bp, Artificial Sequence
  Synthetic Polynucleotide
taatacgactcactatagggtgagtacatggaataatcttcttgtagtctaacagaggagaagactaatggaagattataacctggcggcagcgcaaaagatg

SEQ ID NO: 223624 - DNA, 103 bp, Artificial Sequence
  Synthetic Polynucleotide
taatacgactcactatagggcttcaggttttgagtacatggaataatcttaacagaggagaaagattatgccatgtactaacctggcggcagcgcaaaagatg

SEQ ID NO: 223625 - DNA, 103 bp, Artificial Sequence
  Synthetic Polynucleotide
taatacgactcactataggggctacaaaatcttcaggttttgagtacatgaacagaggagacatgtaatgaaaacctgaaacctggcggcagcgcaaaagatg

SEQ ID NO: 223626 - DNA, 103 bp, Artificial Sequence
  Synthetic Polynucleotide
taatacgactcactatagggtctaaaatcagctacaaaatcttcaggtttaacagaggagaaaacctatggattttgtaaacctggcggcagcgcaaaagatg

SEQ ID NO: 223627 - DNA, 103 bp, Artificial Sequence
  Synthetic Polynucleotide
taatacgactcactataggggtggcggggtctcggccgagcccagcatggaacagaggagaccatgcatggctcggccgaacctggcggcagcgcaaaagatg

SEQ ID NO: 223628 - DNA, 103 bp, Artificial Sequence
  Synthetic Polynucleotide
taatacgactcactataggggaaagatcaatctaaaatcagctacaaaataacagaggagaattttgatgctgattttaaacctggcggcagcgcaaaagatg

SEQ ID NO: 223629 - DNA, 103 bp, Artificial Sequence
  Synthetic Polynucleotide
taatacgactcactataggggcacagttttgaaagatcaatctaaaatcaaacagaggagatgatttatgattgatcttaacctggcggcagcgcaaaagatg

SEQ ID NO: 223630 - DNA, 103 bp, Artificial Sequence
  Synthetic Polynucleotide
taatacgactcactatagggattgaattcagcacagttttgaaagatcaaaacagaggagattgatcatgcaaaactgtaacctggcggcagcgcaaaagatg

SEQ ID NO: 223631 - DNA, 103 bp, Artificial Sequence
  Synthetic Polynucleotide
taatacgactcactatagggaatcaggctcattgaattcagcacagttttaacagaggagaaaaactatgctgaattcaaacctggcggcagcgcaaaagatg

SEQ ID NO: 223632 - DNA, 103 bp, Artificial Sequence
  Synthetic Polynucleotide
taatacgactcactataggggctacttctgaatcaggctcattgaattcaaacagaggagatgaattatgtgagcctgaaacctggcggcagcgcaaaagatg

SEQ ID NO: 223633 - DNA, 103 bp, Artificial Sequence
  Synthetic Polynucleotide
taatacgactcactatagggaccagcattggctacttctgaatcaggctcaacagaggagagagcctatgtcagaagtaaacctggcggcagcgcaaaagatg

SEQ ID NO: 223634 - DNA, 103 bp, Artificial Sequence
  Synthetic Polynucleotide
taatacgactcactatagggcaagttttataccagcattggctacttctgaacagaggagacagaagatgccaatgctgaacctggcggcagcgcaaaagatg

SEQ ID NO: 223635 - DNA, 103 bp, Artificial Sequence
  Synthetic Polynucleotide
taatacgactcactatagggaaataattttcaagttttataccagcattgaacagaggagacaatgcatgtataaaactaacctggcggcagcgcaaaagatg

SEQ ID NO: 223636 - DNA, 103 bp, Artificial Sequence
  Synthetic Polynucleotide
taatacgactcactatagggaagttcttcaaaataattttcaagttttataacagaggagaataaaaatggaaaattataacctggcggcagcgcaaaagatg

SEQ ID NO: 223637 - DNA, 103 bp, Artificial Sequence
  Synthetic Polynucleotide
taatacgactcactatagggggttctttagaagttcttcaaaataattttaacagaggagaaaaattatgttgaagaacaacctggcggcagcgcaaaagatg

SEQ ID NO: 223638 - DNA, 103 bp, Artificial Sequence
  Synthetic Polynucleotide
taatacgactcactataggggccgaggccgctgccgccgccgccaccgccaacagaggagaggcggtatgggcggcggcaacctggcggcagcgcaaaagatg

SEQ ID NO: 223639 - DNA, 103 bp, Artificial Sequence
  Synthetic Polynucleotide
taatacgactcactataggggcagggacgggtggcggggtctcggccgagaacagaggagactcggcatggaccccgccaacctggcggcagcgcaaaagatg

SEQ ID NO: 223640 - DNA, 103 bp, Artificial Sequence
  Synthetic Polynucleotide
taatacgactcactatagggtctggatagaggttctttagaagttcttcaaacagaggagatgaagaatgtctaaagaaaacctggcggcagcgcaaaagatg

SEQ ID NO: 223641 - DNA, 103 bp, Artificial Sequence
  Synthetic Polynucleotide
taatacgactcactatagggaaaccttttttctggatagaggttctttagaacagaggagactaaagatgctctatccaaacctggcggcagcgcaaaagatg

SEQ ID NO: 223642 - DNA, 103 bp, Artificial Sequence
  Synthetic Polynucleotide
taatacgactcactatagggctggtttgggaaaccttttttctggatagaaacagaggagatctatcatgaaaaaaggtaacctggcggcagcgcaaaagatg

SEQ ID NO: 223643 - DNA, 103 bp, Artificial Sequence
  Synthetic Polynucleotide
taatacgactcactatagggttcctgaattctggtttgggaaacctttttaacagaggagaaaaaagatgtcccaaaccaacctggcggcagcgcaaaagatg

SEQ ID NO: 223644 - DNA, 103 bp, Artificial Sequence
  Synthetic Polynucleotide
taatacgactcactatagggttctgattcattcctgaattctggtttgggaacagaggagacccaaaatggaattcaggaacctggcggcagcgcaaaagatg

SEQ ID NO: 223645 - DNA, 103 bp, Artificial Sequence
  Synthetic Polynucleotide
taatacgactcactatagggatttattatcttctgattcattcctgaattaacagaggagaaattcaatgatgaatcagaacctggcggcagcgcaaaagatg

SEQ ID NO: 223646 - DNA, 103 bp, Artificial Sequence
  Synthetic Polynucleotide
taatacgactcactatagggtcatcactaaatttattatcttctgattcaaacagaggagatgaatcatgagataataaaacctggcggcagcgcaaaagatg

SEQ ID NO: 223647 - DNA, 103 bp, Artificial Sequence
  Synthetic Polynucleotide
taatacgactcactatagggatcatctgaatcatcactaaatttattatcaacagaggagagataatatgtttagtgataacctggcggcagcgcaaaagatg

SEQ ID NO: 223648 - DNA, 103 bp, Artificial Sequence
  Synthetic Polynucleotide
taatacgactcactataggggtacaaagtcatcatctgaatcatcactaaaacagaggagattagtgatgattcagatgaacctggcggcagcgcaaaagatg

SEQ ID NO: 223649 - DNA, 103 bp, Artificial Sequence
  Synthetic Polynucleotide
taatacgactcactatagggttccggggctgtacaaagtcatcatctgaaaacagaggagattcagaatgtgactttgtaacctggcggcagcgcaaaagatg

SEQ ID NO: 223650 - DNA, 103 bp, Artificial Sequence
  Synthetic Polynucleotide
taatacgactcactatagggcgagccgggggcagggacgggtggcggggtaacagaggagaaccccgatgcccgtccctaacctggcggcagcgcaaaagatg

SEQ ID NO: 223651 - DNA, 103 bp, Artificial Sequence
  Synthetic Polynucleotide
taatacgactcactataggggaggcgtttcttccggggctgtacaaagtcaacagaggagagactttatgcagccccggaacctggcggcagcgcaaaagatg

SEQ ID NO: 223652 - DNA, 103 bp, Artificial Sequence
  Synthetic Polynucleotide
taatacgactcactatagggcaatgcttttgaggcgtttcttccggggctaacagaggagaagccccatgagaaacgccaacctggcggcagcgcaaaagatg

SEQ ID NO: 223653 - DNA, 103 bp, Artificial Sequence
  Synthetic Polynucleotide
taatacgactcactatagggtggcgttcttcaatgcttttgaggcgtttcaacagaggagagaaacgatgcaaaagcataacctggcggcagcgcaaaagatg

SEQ ID NO: 223654 - DNA, 103 bp, Artificial Sequence
  Synthetic Polynucleotide
taatacgactcactatagggtttaagcaactggcgttcttcaatgcttttaacagaggagaaaaagcatggaagaacgcaacctggcggcagcgcaaaagatg

SEQ ID NO: 223655 - DNA, 103 bp, Artificial Sequence
  Synthetic Polynucleotide
taatacgactcactatagggcgctgaccggcgagccgggggcagggacggaacagaggagaccgtccatgcccccggctaacctggcggcagcgcaaaagatg

SEQ ID NO: 223656 - DNA, 103 bp, Artificial Sequence
  Synthetic Polynucleotide
taatacgactcactatagggggcgacgagccgctgaccggcgagccggggaacagaggagaccccggatggccggtcagaacctggcggcagcgcaaaagatg

SEQ ID NO: 223657 - DNA, 103 bp, Artificial Sequence
  Synthetic Polynucleotide
taatacgactcactatagggggtggcgaacggcgacgagccgctgaccggaacagaggagaccggtcatgggctcgtcgaacctggcggcagcgcaaaagatg

SEQ ID NO: 223658 - DNA, 103 bp, Artificial Sequence
  Synthetic Polynucleotide
taatacgactcactatagggctccaacttgggtggcgaacggcgacgagcaacagaggagagctcgtatgcgttcgccaaacctggcggcagcgcaaaagatg

SEQ ID NO: 223659 - DNA, 103 bp, Artificial Sequence
  Synthetic Polynucleotide
taatacgactcactatagggcaacgaatgactccaacttgggtggcgaacaacagaggagagttcgcatgccaagttggaacctggcggcagcgcaaaagatg

SEQ ID NO: 223660 - DNA, 103 bp, Artificial Sequence
  Synthetic Polynucleotide
taatacgactcactataggggcaaactgggcaacgaatgactccaacttgaacagaggagacaagttatggtcattcgtaacctggcggcagcgcaaaagatg

SEQ ID NO: 223661 - DNA, 103 bp, Artificial Sequence
  Synthetic Polynucleotide
taatacgactcactatagggattcttggctgcaaactgggcaacgaatgaaacagaggagatcattcatggcccagtttaacctggcggcagcgcaaaagatg

SEQ ID NO: 223662 - DNA, 103 bp, Artificial Sequence
  Synthetic Polynucleotide
taatacgactcactatagggctctctgcacattcttggctgcaaactgggaacagaggagacccagtatgcagccaagaaacctggcggcagcgcaaaagatg

SEQ ID NO: 223663 - DNA, 103 bp, Artificial Sequence
  Synthetic Polynucleotide
taatacgactcactatagggggaggccgcagccgaggccgctgccgccgcaacagaggagagcggcgatggcggcctcgaacctggcggcagcgcaaaagatg

SEQ ID NO: 223664 - DNA, 103 bp, Artificial Sequence
  Synthetic Polynucleotide
taatacgactcactatagggtatgatgtgtctctctgcacattcttggctaacagaggagaagccaaatgtgtgcagagaacctggcggcagcgcaaaagatg

SEQ ID NO: 223665 - DNA, 103 bp, Artificial Sequence
  Synthetic Polynucleotide
taatacgactcactatagggaaaagttatctatgatgtgtctctctgcacaacagaggagagtgcagatggacacatcaaacctggcggcagcgcaaaagatg

SEQ ID NO: 223666 - DNA, 103 bp, Artificial Sequence
  Synthetic Polynucleotide
taatacgactcactatagggtccttcacaaaaaagttatctatgatgtgtaacagaggagaacacatatgagataacttaacctggcggcagcgcaaaagatg

SEQ ID NO: 223667 - DNA, 103 bp, Artificial Sequence
  Synthetic Polynucleotide
taatacgactcactatagggctcagtagtgtccttcacaaaaaagttatcaacagaggagagataacatgtttgtgaagaacctggcggcagcgcaaaagatg

SEQ ID NO: 223668 - DNA, 103 bp, Artificial Sequence
  Synthetic Polynucleotide
taatacgactcactatagggtgctgggaacctcagtagtgtccttcacaaaacagaggagattgtgaatgacactactgaacctggcggcagcgcaaaagatg

SEQ ID NO: 223669 - DNA, 103 bp, Artificial Sequence
  Synthetic Polynucleotide
taatacgactcactatagggtctactgtactgctgggaacctcagtagtgaacagaggagacactacatgggttcccagaacctggcggcagcgcaaaagatg

SEQ ID NO: 223670 - DNA, 103 bp, Artificial Sequence
  Synthetic Polynucleotide
taatacgactcactatagggatttgacttttctactgtactgctgggaacaacagaggagagttcccatgagtacagtaaacctggcggcagcgcaaaagatg

SEQ ID NO: 223671 - DNA, 103 bp, Artificial Sequence
  Synthetic Polynucleotide
taatacgactcactatagggtacatacctgatttgacttttctactgtacaacagaggagagtacagatgaaaagtcaaaacctggcggcagcgcaaaagatg

SEQ ID NO: 223672 - DNA, 103 bp, Artificial Sequence
  Synthetic Polynucleotide
taatacgactcactatagggtcacagcttgtacatacctgatttgactttaacagaggagaaaagtcatgtcaggtatgaacctggcggcagcgcaaaagatg

SEQ ID NO: 223673 - DNA, 103 bp, Artificial Sequence
  Synthetic Polynucleotide
taatacgactcactatagggtgcgttgtcctcacagcttgtacatacctgaacagaggagacaggtaatgacaagctgtaacctggcggcagcgcaaaagatg

SEQ ID NO: 223674 - DNA, 103 bp, Artificial Sequence
  Synthetic Polynucleotide
taatacgactcactatagggagggccccccggaggccgcagccgaggccgaacagaggagacggcctatgctgcggcctaacctggcggcagcgcaaaagatg

SEQ ID NO: 223675 - DNA, 103 bp, Artificial Sequence
  Synthetic Polynucleotide
taatacgactcactatagggcattggcttctgcgttgtcctcacagcttgaacagaggagacaagctatgaggacaacgaacctggcggcagcgcaaaagatg

SEQ ID NO: 223676 - DNA, 103 bp, Artificial Sequence
  Synthetic Polynucleotide
taatacgactcactatagggacacaaaacccattggcttctgcgttgtccaacagaggagaggacaaatgagaagccaaaacctggcggcagcgcaaaagatg

SEQ ID NO: 223677 - DNA, 103 bp, Artificial Sequence
  Synthetic Polynucleotide
taatacgactcactatagggaacacactctacacaaaacccattggcttcaacagaggagagaagccatggggttttgtaacctggcggcagcgcaaaagatg

SEQ ID NO: 223678 - DNA, 103 bp, Artificial Sequence
  Synthetic Polynucleotide
taatacgactcactatagggagagccattcaacacactctacacaaaaccaacagaggagaggttttatgtagagtgtgaacctggcggcagcgcaaaagatg

SEQ ID NO: 223679 - DNA, 103 bp, Artificial Sequence
  Synthetic Polynucleotide
taatacgactcactatagggcacgtcttgcagagccattcaacacactctaacagaggagaagagtgatgtgaatggctaacctggcggcagcgcaaaagatg

SEQ ID NO: 223680 - DNA, 103 bp, Artificial Sequence
  Synthetic Polynucleotide
taatacgactcactatagggagctctgatacacgtcttgcagagccattcaacagaggagagaatggatgtgcaagacgaacctggcggcagcgcaaaagatg

SEQ ID NO: 223681 - DNA, 103 bp, Artificial Sequence
  Synthetic Polynucleotide
taatacgactcactatagggccctctgatgagctctgatacacgtcttgcaacagaggagagcaagaatggtatcagagaacctggcggcagcgcaaaagatg

SEQ ID NO: 223682 - DNA, 103 bp, Artificial Sequence
  Synthetic Polynucleotide
taatacgactcactataggggtgaactttaccctctgatgagctctgataaacagaggagatatcagatgtcatcagagaacctggcggcagcgcaaaagatg

SEQ ID NO: 223683 - DNA, 103 bp, Artificial Sequence
  Synthetic Polynucleotide
taatacgactcactataggggtggtcttttgtgaactttaccctctgatgaacagaggagacatcagatggtaaagttcaacctggcggcagcgcaaaagatg

SEQ ID NO: 223684 - DNA, 103 bp, Artificial Sequence
  Synthetic Polynucleotide
taatacgactcactataggggtctgacagtgtggtcttttgtgaactttaaacagaggagataaagtatgcaaaagaccaacctggcggcagcgcaaaagatg

SEQ ID NO: 223685 - DNA, 103 bp, Artificial Sequence
  Synthetic Polynucleotide
taatacgactcactatagggggcgccgccgagggccccccggaggccgcaaacagaggagatgcggcatgcggggggccaacctggcggcagcgcaaaagatg

SEQ ID NO: 223686 - DNA, 103 bp, Artificial Sequence
  Synthetic Polynucleotide
taatacgactcactatagggtcctctttctgtctgacagtgtggtcttttaacagaggagaaaaagaatgcactgtcagaacctggcggcagcgcaaaagatg

SEQ ID NO: 223687 - DNA, 103 bp, Artificial Sequence
  Synthetic Polynucleotide
taatacgactcactatagggtggagatacttcctctttctgtctgacagtaacagaggagaactgtcatgcagaaagagaacctggcggcagcgcaaaagatg

SEQ ID NO: 223688 - DNA, 103 bp, Artificial Sequence
  Synthetic Polynucleotide
taatacgactcactatagggcaactgcctctggagatacttcctctttctaacagaggagaagaaagatgaagtatctcaacctggcggcagcgcaaaagatg

SEQ ID NO: 223689 - DNA, 103 bp, Artificial Sequence
  Synthetic Polynucleotide
taatacgactcactatagggctggtgacaccaactgcctctggagatactaacagaggagaagtatcatgagaggcagtaacctggcggcagcgcaaaagatg

SEQ ID NO: 223690 - DNA, 103 bp, Artificial Sequence
  Synthetic Polynucleotide
taatacgactcactatagggtggtcgctggctggtgacaccaactgcctcaacagaggagagaggcaatgggtgtcaccaacctggcggcagcgcaaaagatg

SEQ ID NO: 223691 - DNA, 103 bp, Artificial Sequence
  Synthetic Polynucleotide
taatacgactcactataggggacaaaacactggtcgctggctggtgacacaacagaggagagtgtcaatggccagcgacaacctggcggcagcgcaaaagatg

SEQ ID NO: 223692 - DNA, 103 bp, Artificial Sequence
  Synthetic Polynucleotide
taatacgactcactatagggttatgaaaaggacaaaacactggtcgctggaacagaggagaccagcgatgagtgttttgaacctggcggcagcgcaaaagatg

SEQ ID NO: 223693 - DNA, 103 bp, Artificial Sequence
  Synthetic Polynucleotide
taatacgactcactatagggctgctcctttttatgaaaaggacaaaacacaacagaggagagtgtttatgccttttcataacctggcggcagcgcaaaagatg

SEQ ID NO: 223694 - DNA, 103 bp, Artificial Sequence
  Synthetic Polynucleotide
taatacgactcactatagggacagcttcagctgctcctttttatgaaaagaacagaggagacttttcatgaaaaggagcaacctggcggcagcgcaaaagatg

SEQ ID NO: 223695 - DNA, 103 bp, Artificial Sequence
  Synthetic Polynucleotide
taatacgactcactataggggtctcacagtacagcttcagctgctcctttaacagaggagaaaaggaatggctgaagctaacctggcggcagcgcaaaagatg

SEQ ID NO: 223696 - DNA, 103 bp, Artificial Sequence
  Synthetic Polynucleotide
taatacgactcactatagggctccccgctcggcgccgccgagggccccccaacagaggagaggggggatgtcggcggcgaacctggcggcagcgcaaaagatg

SEQ ID NO: 223697 - DNA, 103 bp, Artificial Sequence
  Synthetic Polynucleotide
taatacgactcactatagggtttgtcacatgtctcacagtacagcttcagaacagaggagactgaagatgtactgtgagaacctggcggcagcgcaaaagatg

SEQ ID NO: 223698 - DNA, 103 bp, Artificial Sequence
  Synthetic Polynucleotide
taatacgactcactataggggacatgtcagtttgtcacatgtctcacagtaacagaggagaactgtgatgcatgtgacaaacctggcggcagcgcaaaagatg

SEQ ID NO: 223699 - DNA, 103 bp, Artificial Sequence
  Synthetic Polynucleotide
taatacgactcactatagggtgacagtctcgacatgtcagtttgtcacataacagaggagaatgtgaatgactgacatgaacctggcggcagcgcaaaagatg

SEQ ID NO: 223700 - DNA, 103 bp, Artificial Sequence
  Synthetic Polynucleotide
taatacgactcactatagggttctaacaactgacagtctcgacatgtcagaacagaggagactgacaatgcgagactgtaacctggcggcagcgcaaaagatg

SEQ ID NO: 223701 - DNA, 103 bp, Artificial Sequence
  Synthetic Polynucleotide
taatacgactcactataggggctctttatgttctaacaactgacagtctcaacagaggagagagactatgagttgttagaacctggcggcagcgcaaaagatg

SEQ ID NO: 223702 - DNA, 103 bp, Artificial Sequence
  Synthetic Polynucleotide
taatacgactcactatagggtggtatctatgctctttatgttctaacaacaacagaggagagttgttatgacataaagaaacctggcggcagcgcaaaagatg

SEQ ID NO: 223703 - DNA, 103 bp, Artificial Sequence
  Synthetic Polynucleotide
taatacgactcactatagggttctataaattggtatctatgctctttatgaacagaggagacataaaatgcatagatacaacctggcggcagcgcaaaagatg

SEQ ID NO: 223704 - DNA, 103 bp, Artificial Sequence
  Synthetic Polynucleotide
taatacgactcactataggggaaaagcttcttctataaattggtatctataacagaggagaatagatatgaatttatagaacctggcggcagcgcaaaagatg

SEQ ID NO: 223705 - DNA, 103 bp, Artificial Sequence
  Synthetic Polynucleotide
taatacgactcactatagggttctgattctgaaaagcttcttctataaataacagaggagaatttatatgagaagctttaacctggcggcagcgcaaaagatg

SEQ ID NO: 223706 - DNA, 103 bp, Artificial Sequence
  Synthetic Polynucleotide
taatacgactcactatagggtatgatcactttctgattctgaaaagcttcaacagaggagagaagctatgcagaatcagaacctggcggcagcgcaaaagatg

SEQ ID NO: 223707 - DNA, 103 bp, Artificial Sequence
  Synthetic Polynucleotide
taatacgactcactatagggcggcctcgttctccccgctcggcgccgccgaacagaggagacggcggatgcgagcggggaacctggcggcagcgcaaaagatg

SEQ ID NO: 223708 - DNA, 103 bp, Artificial Sequence
  Synthetic Polynucleotide
taatacgactcactatagggttagtgtatctatgatcactttctgattctaacagaggagaagaatcatgaagtgatcaaacctggcggcagcgcaaaagatg

SEQ ID NO: 223709 - DNA, 103 bp, Artificial Sequence
  Synthetic Polynucleotide
taatacgactcactatagggagtttggtgattagtgtatctatgatcactaacagaggagaagtgatatgagatacactaacctggcggcagcgcaaaagatg

SEQ ID NO: 223710 - DNA, 103 bp, Artificial Sequence
  Synthetic Polynucleotide
taatacgactcactatagggtttttccatcagtttggtgattagtgtatcaacagaggagagatacaatgatcaccaaaaacctggcggcagcgcaaaagatg

SEQ ID NO: 223711 - DNA, 103 bp, Artificial Sequence
  Synthetic Polynucleotide
taatacgactcactatagggtgtattttgttttttccatcagtttggtgaaacagaggagatcaccaatgtgatggaaaaacctggcggcagcgcaaaagatg

SEQ ID NO: 223712 - DNA, 103 bp, Artificial Sequence
  Synthetic Polynucleotide
taatacgactcactataggggtgaattttatgtattttgttttttccatcaacagaggagagatggaatgaacaaaataaacctggcggcagcgcaaaagatg

SEQ ID NO: 223713 - DNA, 103 bp, Artificial Sequence
  Synthetic Polynucleotide
taatacgactcactatagggctgatttcctgtgaattttatgtattttgtaacagaggagaacaaaaatgataaaattcaacctggcggcagcgcaaaagatg

SEQ ID NO: 223714 - DNA, 103 bp, Artificial Sequence
  Synthetic Polynucleotide
taatacgactcactatagggtgttttggatctgatttcctgtgaattttaaacagaggagataaaatatgcaggaaatcaacctggcggcagcgcaaaagatg

SEQ ID NO: 223715 - DNA, 103 bp, Artificial Sequence
  Synthetic Polynucleotide
taatacgactcactatagggtcaataattctgttttggatctgatttcctaacagaggagaaggaaaatggatccaaaaaacctggcggcagcgcaaaagatg

SEQ ID NO: 223716 - DNA, 103 bp, Artificial Sequence
  Synthetic Polynucleotide
taatacgactcactatagggttgatttacttcaataattctgttttggataacagaggagaatccaaatgagaattattaacctggcggcagcgcaaaagatg

SEQ ID NO: 223717 - DNA, 103 bp, Artificial Sequence
  Synthetic Polynucleotide
taatacgactcactataggggcttttgattttgatttacttcaataattcaacagaggagagaattaatgaagtaaatcaacctggcggcagcgcaaaagatg

SEQ ID NO: 223718 - DNA, 103 bp, Artificial Sequence
  Synthetic Polynucleotide
taatacgactcactatagggtgccgactctcggcctcgttctccccgctcaacagaggagagagcggatggaacgaggcaacctggcggcagcgcaaaagatg

SEQ ID NO: 223719 - DNA, 103 bp, Artificial Sequence
  Synthetic Polynucleotide
taatacgactcactatagggtgttccacctgcttttgattttgatttactaacagaggagaagtaaaatgaaatcaaaaaacctggcggcagcgcaaaagatg

SEQ ID NO: 223720 - DNA, 103 bp, Artificial Sequence
  Synthetic Polynucleotide
taatacgactcactatagggtttaatatcctgttccacctgcttttgattaacagaggagaaatcaaatgcaggtggaaaacctggcggcagcgcaaaagatg

SEQ ID NO: 223721 - DNA, 103 bp, Artificial Sequence
  Synthetic Polynucleotide
taatacgactcactatagggatatagcaactttaatatcctgttccacctaacagaggagaaggtggatgaggatattaaacctggcggcagcgcaaaagatg

SEQ ID NO: 223722 - DNA, 103 bp, Artificial Sequence
  Synthetic Polynucleotide
taatacgactcactatagggatcagtgtaaatatagcaactttaatatccaacagaggagaggatatatgagttgctataacctggcggcagcgcaaaagatg

SEQ ID NO: 223723 - DNA, 103 bp, Artificial Sequence
  Synthetic Polynucleotide
taatacgactcactatagggtatttctaccatcagtgtaaatatagcaacaacagaggagagttgctatgtttacactgaacctggcggcagcgcaaaagatg

SEQ ID NO: 223724 - DNA, 103 bp, Artificial Sequence
  Synthetic Polynucleotide
taatacgactcactatagggcttttttatttatttctaccatcagtgtaaaacagaggagattacacatgtggtagaaaaacctggcggcagcgcaaaagatg

SEQ ID NO: 223725 - DNA, 103 bp, Artificial Sequence
  Synthetic Polynucleotide
taatacgactcactatagggagagcttttccttttttatttatttctaccaacagaggagaggtagaatgaaataaaaaaacctggcggcagcgcaaaagatg

SEQ ID NO: 223726 - DNA, 103 bp, Artificial Sequence
  Synthetic Polynucleotide
taatacgactcactatagggctgatgcagtagagcttttccttttttattaacagaggagaaataaaatgggaaaagctaacctggcggcagcgcaaaagatg

SEQ ID NO: 223727 - DNA, 103 bp, Artificial Sequence
  Synthetic Polynucleotide
taatacgactcactatagggggctctctaactgatgcagtagagcttttcaacagaggagagaaaagatgtactgcatcaacctggcggcagcgcaaaagatg

SEQ ID NO: 223728 - DNA, 103 bp, Artificial Sequence
  Synthetic Polynucleotide
taatacgactcactatagggtcctttgcaaggctctctaactgatgcagtaacagaggagaactgcaatggttagagagaacctggcggcagcgcaaaagatg

SEQ ID NO: 223729 - DNA, 103 bp, Artificial Sequence
  Synthetic Polynucleotide
taatacgactcactatagggtctcagaggggggttctttttccggaccataacagaggagaatggtcatgaaaaagaacaacctggcggcagcgcaaaagatg

SEQ ID NO: 223730 - DNA, 103 bp, Artificial Sequence
  Synthetic Polynucleotide
taatacgactcactatagggatctgcagaaaattctttgttctttccagaaacagaggagatctggaatgaacaaagaaaacctggcggcagcgcaaaagatg

SEQ ID NO: 223731 - DNA, 103 bp, Artificial Sequence
  Synthetic Polynucleotide
taatacgactcactataggggaaattgcagaatttacagcggaaatacttaacagaggagaaagtatatgcgctgtaaaaacctggcggcagcgcaaaagatg

SEQ ID NO: 223732 - DNA, 103 bp, Artificial Sequence
  Synthetic Polynucleotide
taatacgactcactatagggccatataagtgaaattgcagaatttacagcaacagaggagagctgtaatgtctgcaattaacctggcggcagcgcaaaagatg

SEQ ID NO: 223733 - DNA, 103 bp, Artificial Sequence
  Synthetic Polynucleotide
taatacgactcactataggggatgagttgcccatataagtgaaattgcagaacagaggagactgcaaatgcacttatataacctggcggcagcgcaaaagatg

SEQ ID NO: 223734 - DNA, 103 bp, Artificial Sequence
  Synthetic Polynucleotide
taatacgactcactatagggtaattcggtggatgagttgcccatataagtaacagaggagaacttatatgggcaactcaaacctggcggcagcgcaaaagatg

SEQ ID NO: 223735 - DNA, 103 bp, Artificial Sequence
  Synthetic Polynucleotide
taatacgactcactatagggaatgttgttctaattcggtggatgagttgcaacagaggagagcaactatgccaccgaataacctggcggcagcgcaaaagatg

SEQ ID NO: 223736 - DNA, 103 bp, Artificial Sequence
  Synthetic Polynucleotide
taatacgactcactataggggtctgaagaaaatgttgttctaattcggtgaacagaggagacaccgaatgagaacaacaaacctggcggcagcgcaaaagatg

SEQ ID NO: 223737 - DNA, 103 bp, Artificial Sequence
  Synthetic Polynucleotide
taatacgactcactataggggtttgggtgagtctgaagaaaatgttgttcaacagaggagagaacaaatgtttcttcagaacctggcggcagcgcaaaagatg

SEQ ID NO: 223738 - DNA, 103 bp, Artificial Sequence
  Synthetic Polynucleotide
taatacgactcactatagggcttttattttgtttgggtgagtctgaagaaaacagaggagattcttcatgctcacccaaaacctggcggcagcgcaaaagatg

SEQ ID NO: 223739 - DNA, 103 bp, Artificial Sequence
  Synthetic Polynucleotide
taatacgactcactataggggggagagaagcttttattttgtttgggtgaaacagaggagatcacccatgcaaaataaaaacctggcggcagcgcaaaagatg

SEQ ID NO: 223740 - DNA, 103 bp, Artificial Sequence
  Synthetic Polynucleotide
taatacgactcactatagggctcagaggaggggagagaagcttttattttaacagaggagaaaaataatggcttctctcaacctggcggcagcgcaaaagatg

SEQ ID NO: 223741 - DNA, 103 bp, Artificial Sequence
  Synthetic Polynucleotide
taatacgactcactatagggctgacatctgatctgcagaaaattctttgtaacagaggagaacaaagatgtttctgcagaacctggcggcagcgcaaaagatg

SEQ ID NO: 223742 - DNA, 103 bp, Artificial Sequence
  Synthetic Polynucleotide
taatacgactcactataggggttttgcaacctcagaggaggggagagaagaacagaggagacttctcatgcctcctctgaacctggcggcagcgcaaaagatg

SEQ ID NO: 223743 - DNA, 103 bp, Artificial Sequence
  Synthetic Polynucleotide
taatacgactcactatagggttctctgaaggttttgcaacctcagaggagaacagaggagactcctcatgggttgcaaaaacctggcggcagcgcaaaagatg

SEQ ID NO: 223744 - DNA, 103 bp, Artificial Sequence
  Synthetic Polynucleotide
taatacgactcactataggggttagagtttttctctgaaggttttgcaacaacagaggagagttgcaatgccttcagagaacctggcggcagcgcaaaagatg

SEQ ID NO: 223745 - DNA, 103 bp, Artificial Sequence
  Synthetic Polynucleotide
taatacgactcactatagggggatggacttgttagagtttttctctgaagaacagaggagacttcagatgaaaactctaaacctggcggcagcgcaaaagatg

SEQ ID NO: 223746 - DNA, 103 bp, Artificial Sequence
  Synthetic Polynucleotide
taatacgactcactatagggtgaagtgcagggatggacttgttagagtttaacagaggagaaaactcatgcaagtccataacctggcggcagcgcaaaagatg

SEQ ID NO: 223747 - DNA, 103 bp, Artificial Sequence
  Synthetic Polynucleotide
taatacgactcactatagggatcactggattgaagtgcagggatggacttaacagaggagaaagtccatgcctgcacttaacctggcggcagcgcaaaagatg

SEQ ID NO: 223748 - DNA, 103 bp, Artificial Sequence
  Synthetic Polynucleotide
taatacgactcactatagggagtctccagaatcactggattgaagtgcagaacagaggagactgcacatgaatccagtgaacctggcggcagcgcaaaagatg

SEQ ID NO: 223749 - DNA, 103 bp, Artificial Sequence
  Synthetic Polynucleotide
taatacgactcactatagggcattttcccaagtctccagaatcactggataacagaggagaatccagatgttctggagaaacctggcggcagcgcaaaagatg

SEQ ID NO: 223750 - DNA, 103 bp, Artificial Sequence
  Synthetic Polynucleotide
taatacgactcactatagggcttgtcctgccattttcccaagtctccagaaacagaggagatctggaatgttgggaaaaaacctggcggcagcgcaaaagatg

SEQ ID NO: 223751 - DNA, 103 bp, Artificial Sequence
  Synthetic Polynucleotide
taatacgactcactatagggtgactgttatcttgtcctgccattttcccaaacagaggagatgggaaatgggcaggacaaacctggcggcagcgcaaaagatg

SEQ ID NO: 223752 - DNA, 103 bp, Artificial Sequence
  Synthetic Polynucleotide
taatacgactcactatagggtccgtattttctgacatctgatctgcagaaaacagaggagattctgcatgtcagatgtcaacctggcggcagcgcaaaagatg

SEQ ID NO: 223753 - DNA, 103 bp, Artificial Sequence
  Synthetic Polynucleotide
taatacgactcactatagggtctcctgctttgactgttatcttgtcctgcaacagaggagagcaggaatggataacagtaacctggcggcagcgcaaaagatg

SEQ ID NO: 223754 - DNA, 103 bp, Artificial Sequence
  Synthetic Polynucleotide
taatacgactcactatagggaggagtgtcatctcctgctttgactgttataacagaggagaataacaatgaaagcaggaaacctggcggcagcgcaaaagatg

SEQ ID NO: 223755 - DNA, 103 bp, Artificial Sequence
  Synthetic Polynucleotide
taatacgactcactatagggagtacccaacaggagtgtcatctcctgcttaacagaggagaaagcagatgatgacactcaacctggcggcagcgcaaaagatg

SEQ ID NO: 223756 - DNA, 103 bp, Artificial Sequence
  Synthetic Polynucleotide
taatacgactcactatagggatgggcactgagtacccaacaggagtgtcaaacagaggagatgacacatgtgttgggtaaacctggcggcagcgcaaaagatg

SEQ ID NO: 223757 - DNA, 103 bp, Artificial Sequence
  Synthetic Polynucleotide
taatacgactcactataggggaggggctttatgggcactgagtacccaacaacagaggagagttgggatgtcagtgcccaacctggcggcagcgcaaaagatg

SEQ ID NO: 223758 - DNA, 103 bp, Artificial Sequence
  Synthetic Polynucleotide
taatacgactcactatagggtagaggaatcgaggggctttatgggcactgaacagaggagacagtgcatgtaaagccccaacctggcggcagcgcaaaagatg

SEQ ID NO: 223759 - DNA, 103 bp, Artificial Sequence
  Synthetic Polynucleotide
taatacgactcactatagggccattttgtctagaggaatcgaggggctttaacagaggagaaaagccatgcgattcctcaacctggcggcagcgcaaaagatg

SEQ ID NO: 223760 - DNA, 103 bp, Artificial Sequence
  Synthetic Polynucleotide
taatacgactcactatagggggcctctgtaccattttgtctagaggaatcaacagaggagagattccatgagacaaaataacctggcggcagcgcaaaagatg

SEQ ID NO: 223761 - DNA, 103 bp, Artificial Sequence
  Synthetic Polynucleotide
taatacgactcactatagggagtaactggtggcctctgtaccattttgtcaacagaggagagacaaaatggtacagaggaacctggcggcagcgcaaaagatg

SEQ ID NO: 223762 - DNA, 103 bp, Artificial Sequence
  Synthetic Polynucleotide
taatacgactcactatagggttacaccagtagtaactggtggcctctgtaaacagaggagatacagaatgcaccagttaaacctggcggcagcgcaaaagatg

SEQ ID NO: 223763 - DNA, 103 bp, Artificial Sequence
  Synthetic Polynucleotide
taatacgactcactatagggatcactctgatccgtattttctgacatctgaacagaggagacagatgatggaaaatacgaacctggcggcagcgcaaaagatg

SEQ ID NO: 223764 - DNA, 103 bp, Artificial Sequence
  Synthetic Polynucleotide
taatacgactcactatagggactacaaaatttacaccagtagtaactggtaacagaggagaaccagtatgtactggtgtaacctggcggcagcgcaaaagatg

SEQ ID NO: 223765 - DNA, 103 bp, Artificial Sequence
  Synthetic Polynucleotide
taatacgactcactatagggcacagctgaaactacaaaatttacaccagtaacagaggagaactggtatgaattttgtaaacctggcggcagcgcaaaagatg

SEQ ID NO: 223766 - DNA, 103 bp, Artificial Sequence
  Synthetic Polynucleotide
taatacgactcactatagggctagatgactcacagctgaaactacaaaataacagaggagaattttgatgtttcagctgaacctggcggcagcgcaaaagatg

SEQ ID NO: 223767 - DNA, 103 bp, Artificial Sequence
  Synthetic Polynucleotide
taatacgactcactatagggtttaagtgagctagatgactcacagctgaaaacagaggagattcagcatggagtcatctaacctggcggcagcgcaaaagatg

SEQ ID NO: 223768 - DNA, 103 bp, Artificial Sequence
  Synthetic Polynucleotide
taatacgactcactataggggttctagcagtttaagtgagctagatgactaacagaggagaagtcatatggctcacttaaacctggcggcagcgcaaaagatg

SEQ ID NO: 223769 - DNA, 103 bp, Artificial Sequence
  Synthetic Polynucleotide
taatacgactcactatagggttgccataatgttctagcagtttaagtgagaacagaggagactcactatgactgctagaaacctggcggcagcgcaaaagatg

SEQ ID NO: 223770 - DNA, 103 bp, Artificial Sequence
  Synthetic Polynucleotide
taatacgactcactatagggtccgtgctgcttgccataatgttctagcagaacagaggagactgctaatgcattatggcaacctggcggcagcgcaaaagatg

SEQ ID NO: 223771 - DNA, 103 bp, Artificial Sequence
  Synthetic Polynucleotide
taatacgactcactatagggactgcactgctccgtgctgcttgccataataacagaggagaattatgatgagcagcacgaacctggcggcagcgcaaaagatg

SEQ ID NO: 223772 - DNA, 103 bp, Artificial Sequence
  Synthetic Polynucleotide
taatacgactcactatagggaggccgcctgactgcactgctccgtgctgcaacagaggagagcagcaatgagcagtgcaaacctggcggcagcgcaaaagatg

SEQ ID NO: 223773 - DNA, 103 bp, Artificial Sequence
  Synthetic Polynucleotide
taatacgactcactatagggctctggattaaggccgcctgactgcactgcaacagaggagagcagtgatgtcaggcggcaacctggcggcagcgcaaaagatg

SEQ ID NO: 223774 - DNA, 103 bp, Artificial Sequence
  Synthetic Polynucleotide
taatacgactcactataggggttctgcagcatcactctgatccgtattttaacagaggagaaaaataatgatcagagtgaacctggcggcagcgcaaaagatg

SEQ ID NO: 223775 - DNA, 103 bp, Artificial Sequence
  Synthetic Polynucleotide
taatacgactcactatagggtatcatttaactctggattaaggccgcctgaacagaggagacaggcgatgttaatccagaacctggcggcagcgcaaaagatg

SEQ ID NO: 223776 - DNA, 103 bp, Artificial Sequence
  Synthetic Polynucleotide
taatacgactcactatagggctggaaagcttatcatttaactctggattaaacagaggagataatccatggttaaatgaaacctggcggcagcgcaaaagatg

SEQ ID NO: 223777 - DNA, 103 bp, Artificial Sequence
  Synthetic Polynucleotide
taatacgactcactataggggacagagcccctggaaagcttatcatttaaaacagaggagattaaatatgaagctttccaacctggcggcagcgcaaaagatg

SEQ ID NO: 223778 - DNA, 103 bp, Artificial Sequence
  Synthetic Polynucleotide
taatacgactcactatagggtctgattaatgacagagcccctggaaagctaacagaggagaagctttatgggggctctgaacctggcggcagcgcaaaagatg

SEQ ID NO: 223779 - DNA, 103 bp, Artificial Sequence
  Synthetic Polynucleotide
taatacgactcactataggggctagatcattctgattaatgacagagcccaacagaggagagggctcatgcattaatcaaacctggcggcagcgcaaaagatg

SEQ ID NO: 223780 - DNA, 103 bp, Artificial Sequence
  Synthetic Polynucleotide
taatacgactcactatagggtgaacttttggctagatcattctgattaataacagaggagaattaatatgaatgatctaaacctggcggcagcgcaaaagatg

SEQ ID NO: 223781 - DNA, 103 bp, Artificial Sequence
  Synthetic Polynucleotide
taatacgactcactatagggtctctccttctgaacttttggctagatcataacagaggagaatgatcatgccaaaagttaacctggcggcagcgcaaaagatg

SEQ ID NO: 223782 - DNA, 103 bp, Artificial Sequence
  Synthetic Polynucleotide
taatacgactcactatagggttggtcattgtctctccttctgaacttttgaacagaggagacaaaagatgagaaggagaaacctggcggcagcgcaaaagatg

SEQ ID NO: 223783 - DNA, 103 bp, Artificial Sequence
  Synthetic Polynucleotide
taatacgactcactatagggcttgtctgtcttggtcattgtctctccttcaacagaggagagaaggaatgacaatgaccaacctggcggcagcgcaaaagatg

SEQ ID NO: 223784 - DNA, 103 bp, Artificial Sequence
  Synthetic Polynucleotide
taatacgactcactatagggcactcgagctcttgtctgtcttggtcattgaacagaggagacaatgaatgagacagacaaacctggcggcagcgcaaaagatg

SEQ ID NO: 223785 - DNA, 103 bp, Artificial Sequence
  Synthetic Polynucleotide
taatacgactcactatagggttatgatttagttctgcagcatcactctgaaacagaggagatcagagatgtgctgcagaaacctggcggcagcgcaaaagatg

SEQ ID NO: 223786 - DNA, 103 bp, Artificial Sequence
  Synthetic Polynucleotide
taatacgactcactatagggtttttagccccactcgagctcttgtctgtcaacagaggagagacagaatggagctcgagaacctggcggcagcgcaaaagatg

SEQ ID NO: 223787 - DNA, 103 bp, Artificial Sequence
  Synthetic Polynucleotide
taatacgactcactataggggaagtccttctttttagccccactcgagctaacagaggagaagctcgatgggggctaaaaacctggcggcagcgcaaaagatg

SEQ ID NO: 223788 - DNA, 103 bp, Artificial Sequence
  Synthetic Polynucleotide
taatacgactcactatagggccttgctggagaagtccttctttttagcccaacagaggagagggctaatgagaaggactaacctggcggcagcgcaaaagatg

SEQ ID NO: 223789 - DNA, 103 bp, Artificial Sequence
  Synthetic Polynucleotide
taatacgactcactatagggtcctcggctcccttgctggagaagtccttcaacagaggagagaaggaatgctccagcaaaacctggcggcagcgcaaaagatg

SEQ ID NO: 223790 - DNA, 103 bp, Artificial Sequence
  Synthetic Polynucleotide
taatacgactcactatagggtaccatattatcctcggctcccttgctggaaacagaggagatccagcatgggagccgagaacctggcggcagcgcaaaagatg

SEQ ID NO: 223791 - DNA, 103 bp, Artificial Sequence
  Synthetic Polynucleotide
taatacgactcactatagggtatagctcgttaccatattatcctcggctcaacagaggagagagccgatgataatatggaacctggcggcagcgcaaaagatg

SEQ ID NO: 223792 - DNA, 103 bp, Artificial Sequence
  Synthetic Polynucleotide
taatacgactcactatagggaactgacaattatagctcgttaccatattaaacagaggagataatatatgaacgagctaaacctggcggcagcgcaaaagatg

SEQ ID NO: 223793 - DNA, 103 bp, Artificial Sequence
  Synthetic Polynucleotide
taatacgactcactataggggaagtcacagaactgacaattatagctcgtaacagaggagaacgagcatgaattgtcagaacctggcggcagcgcaaaagatg

SEQ ID NO: 223794 - DNA, 103 bp, Artificial Sequence
  Synthetic Polynucleotide
taatacgactcactatagggtggaatatcggaagtcacagaactgacaataacagaggagaattgtcatgtctgtgactaacctggcggcagcgcaaaagatg

SEQ ID NO: 223795 - DNA, 103 bp, Artificial Sequence
  Synthetic Polynucleotide
taatacgactcactatagggccatggcttttggaatatcggaagtcacagaacagaggagactgtgaatgccgatattcaacctggcggcagcgcaaaagatg

SEQ ID NO: 223796 - DNA, 103 bp, Artificial Sequence
  Synthetic Polynucleotide
taatacgactcactatagggatgttcctccttatgatttagttctgcagcaacagaggagagctgcaatgctaaatcataacctggcggcagcgcaaaagatg

SEQ ID NO: 223797 - DNA, 103 bp, Artificial Sequence
  Synthetic Polynucleotide
taatacgactcactatagggtacatcagggccatggcttttggaatatcgaacagaggagacgatatatgaaaagccataacctggcggcagcgcaaaagatg

SEQ ID NO: 223798 - DNA, 103 bp, Artificial Sequence
  Synthetic Polynucleotide
taatacgactcactatagggccactacaattacatcagggccatggctttaacagaggagaaaagccatggccctgatgaacctggcggcagcgcaaaagatg

SEQ ID NO: 223799 - DNA, 103 bp, Artificial Sequence
  Synthetic Polynucleotide
taatacgactcactatagggagaagtggccccactacaattacatcagggaacagaggagaccctgaatgaattgtagtaacctggcggcagcgcaaaagatg

SEQ ID NO: 223800 - DNA, 103 bp, Artificial Sequence
  Synthetic Polynucleotide
taatacgactcactatagggataatgacggagaagtggccccactacaataacagaggagaattgtaatggggccacttaacctggcggcagcgcaaaagatg

SEQ ID NO: 223801 - DNA, 103 bp, Artificial Sequence
  Synthetic Polynucleotide
taatacgactcactatagggggagctgttgataatgacggagaagtggccaacagaggagaggccacatgtccgtcattaacctggcggcagcgcaaaagatg

SEQ ID NO: 223802 - DNA, 103 bp, Artificial Sequence
  Synthetic Polynucleotide
taatacgactcactatagggtgaatgttatggagctgttgataatgacggaacagaggagaccgtcaatgtcaacagctaacctggcggcagcgcaaaagatg

SEQ ID NO: 223803 - DNA, 103 bp, Artificial Sequence
  Synthetic Polynucleotide
taatacgactcactatagggggtacacttgtgaatgttatggagctgttgaacagaggagacaacagatgcataacattaacctggcggcagcgcaaaagatg

SEQ ID NO: 223804 - DNA, 103 bp, Artificial Sequence
  Synthetic Polynucleotide
taatacgactcactatagggagtgtttaatggtacacttgtgaatgttataacagaggagaataacaatgacaagtgtaaacctggcggcagcgcaaaagatg

SEQ ID NO: 223805 - DNA, 103 bp, Artificial Sequence
  Synthetic Polynucleotide
taatacgactcactatagggcagaatggacagtgtttaatggtacacttgaacagaggagacaagtgatgcattaaacaaacctggcggcagcgcaaaagatg

SEQ ID NO: 223806 - DNA, 103 bp, Artificial Sequence
  Synthetic Polynucleotide
taatacgactcactatagggtcctctgggacagaatggacagtgtttaataacagaggagaattaaaatgtgtccattcaacctggcggcagcgcaaaagatg

SEQ ID NO: 223807 - DNA, 103 bp, Artificial Sequence
  Synthetic Polynucleotide
taatacgactcactatagggcatgcaagctatgttcctccttatgatttaaacagaggagataaatcatgaggaggaacaacctggcggcagcgcaaaagatg

SEQ ID NO: 223808 - DNA, 103 bp, Artificial Sequence
  Synthetic Polynucleotide
taatacgactcactatagggggctgcaaagtcctctgggacagaatggacaacagaggagagtccatatggtcccagagaacctggcggcagcgcaaaagatg

SEQ ID NO: 223809 - DNA, 103 bp, Artificial Sequence
  Synthetic Polynucleotide
taatacgactcactatagggtgcttttctgggctgcaaagtcctctgggaaacagaggagatcccagatgactttgcagaacctggcggcagcgcaaaagatg

SEQ ID NO: 223810 - DNA, 103 bp, Artificial Sequence
  Synthetic Polynucleotide
taatacgactcactatagggttctccaaggtgcttttctgggctgcaaagaacagaggagactttgcatgccagaaaagaacctggcggcagcgcaaaagatg

SEQ ID NO: 223811 - DNA, 103 bp, Artificial Sequence
  Synthetic Polynucleotide
taatacgactcactataggggataagtaatttctccaaggtgcttttctgaacagaggagacagaaaatgaccttggagaacctggcggcagcgcaaaagatg

SEQ ID NO: 223812 - DNA, 103 bp, Artificial Sequence
  Synthetic Polynucleotide
taatacgactcactatagggcaagcaaacggataagtaatttctccaaggaacagaggagaccttggatgaattacttaaacctggcggcagcgcaaaagatg

SEQ ID NO: 223813 - DNA, 103 bp, Artificial Sequence
  Synthetic Polynucleotide
taatacgactcactatagggactttttctacaagcaaacggataagtaataacagaggagaattactatgccgtttgctaacctggcggcagcgcaaaagatg

SEQ ID NO: 223814 - DNA, 103 bp, Artificial Sequence
  Synthetic Polynucleotide
taatacgactcactataggggggaacaattactttttctacaagcaaacgaacagaggagacgtttgatggtagaaaaaaacctggcggcagcgcaaaagatg

SEQ ID NO: 223815 - DNA, 103 bp, Artificial Sequence
  Synthetic Polynucleotide
taatacgactcactatagggagtgcacagtgggaacaattactttttctaaacagaggagatagaaaatgtaattgttcaacctggcggcagcgcaaaagatg

SEQ ID NO: 223816 - DNA, 103 bp, Artificial Sequence
  Synthetic Polynucleotide
taatacgactcactatagggcagaagcaagagtgcacagtgggaacaattaacagaggagaaattgtatgcactgtgcaaacctggcggcagcgcaaaagatg

SEQ ID NO: 223817 - DNA, 103 bp, Artificial Sequence
  Synthetic Polynucleotide
taatacgactcactataggggagacaagtgcagaagcaagagtgcacagtaacagaggagaactgtgatgtcttgcttcaacctggcggcagcgcaaaagatg

SEQ ID NO: 223818 - DNA, 103 bp, Artificial Sequence
  Synthetic Polynucleotide
taatacgactcactatagggggatcttgaacatgcaagctatgttcctccaacagaggagaggaggaatgtagcttgcaaacctggcggcagcgcaaaagatg

SEQ ID NO: 223819 - DNA, 103 bp, Artificial Sequence
  Synthetic Polynucleotide
taatacgactcactataggggccgccccaggagacaagtgcagaagcaagaacagaggagacttgctatggcacttgtcaacctggcggcagcgcaaaagatg

SEQ ID NO: 223820 - DNA, 103 bp, Artificial Sequence
  Synthetic Polynucleotide
taatacgactcactatagggcgagcttccagccgccccaggagacaagtgaacagaggagacacttgatgcctggggcgaacctggcggcagcgcaaaagatg

SEQ ID NO: 223821 - DNA, 103 bp, Artificial Sequence
  Synthetic Polynucleotide
taatacgactcactataggggtttgactcgcgagcttccagccgccccagaacagaggagactggggatgctggaagctaacctggcggcagcgcaaaagatg

SEQ ID NO: 223822 - DNA, 103 bp, Artificial Sequence
  Synthetic Polynucleotide
taatacgactcactatagggtggcactgatgtttgactcgcgagcttccaaacagaggagatggaagatggcgagtcaaaacctggcggcagcgcaaaagatg

SEQ ID NO: 223823 - DNA, 103 bp, Artificial Sequence
  Synthetic Polynucleotide
taatacgactcactatagggtgaacactgatggcactgatgtttgactcgaacagaggagacgagtcatgcatcagtgcaacctggcggcagcgcaaaagatg

SEQ ID NO: 223824 - DNA, 103 bp, Artificial Sequence
  Synthetic Polynucleotide
taatacgactcactataggggggtggtgaatgaacactgatggcactgataacagaggagaatcagtatgatcagtgttaacctggcggcagcgcaaaagatg

SEQ ID NO: 223825 - DNA, 103 bp, Artificial Sequence
  Synthetic Polynucleotide
taatacgactcactatagggtctacgtcaggggtggtgaatgaacactgaaacagaggagatcagtgatgattcaccacaacctggcggcagcgcaaaagatg

SEQ ID NO: 223826 - DNA, 103 bp, Artificial Sequence
  Synthetic Polynucleotide
taatacgactcactataggggaggagtacatctacgtcaggggtggtgaaaacagaggagattcaccatgcctgacgtaaacctggcggcagcgcaaaagatg

SEQ ID NO: 223827 - DNA, 103 bp, Artificial Sequence
  Synthetic Polynucleotide
taatacgactcactatagggcatagtgaaagaggagtacatctacgtcagaacagaggagactgacgatgatgtactccaacctggcggcagcgcaaaagatg

SEQ ID NO: 223828 - DNA, 103 bp, Artificial Sequence
  Synthetic Polynucleotide
taatacgactcactatagggtgcacactttcatagtgaaagaggagtacaaacagaggagatgtactatgctttcactaaacctggcggcagcgcaaaagatg

SEQ ID NO: 223829 - DNA, 103 bp, Artificial Sequence
  Synthetic Polynucleotide
taatacgactcactataggggctagaagatggatcttgaacatgcaagctaacagaggagaagcttgatggttcaagataacctggcggcagcgcaaaagatg

SEQ ID NO: 223830 - DNA, 103 bp, Artificial Sequence
  Synthetic Polynucleotide
taatacgactcactatagggttgggactcatgcacactttcatagtgaaaaacagaggagatttcacatggaaagtgtgaacctggcggcagcgcaaaagatg

SEQ ID NO: 223831 - DNA, 103 bp, Artificial Sequence
  Synthetic Polynucleotide
taatacgactcactatagggcatccgatgcttgggactcatgcacactttaacagaggagaaaagtgatgatgagtcccaacctggcggcagcgcaaaagatg

SEQ ID NO: 223832 - DNA, 103 bp, Artificial Sequence
  Synthetic Polynucleotide
taatacgactcactatagggtcttgtttgacatccgatgcttgggactcaaacagaggagatgagtcatgagcatcggaaacctggcggcagcgcaaaagatg

SEQ ID NO: 223833 - DNA, 103 bp, Artificial Sequence
  Synthetic Polynucleotide
taatacgactcactataggggtgatttgcttcttgtttgacatccgatgcaacagaggagagcatcgatggtcaaacaaaacctggcggcagcgcaaaagatg

SEQ ID NO: 223834 - DNA, 103 bp, Artificial Sequence
  Synthetic Polynucleotide
taatacgactcactatagggatccttgcaggtgatttgcttcttgtttgaaacagaggagatcaaacatgaagcaaatcaacctggcggcagcgcaaaagatg

SEQ ID NO: 223835 - DNA, 103 bp, Artificial Sequence
  Synthetic Polynucleotide
taatacgactcactatagggtgcccatccgatccttgcaggtgatttgctaacagaggagaagcaaaatgcctgcaaggaacctggcggcagcgcaaaagatg

SEQ ID NO: 223836 - DNA, 103 bp, Artificial Sequence
  Synthetic Polynucleotide
taatacgactcactataggggacagactgctgcccatccgatccttgcagaacagaggagactgcaaatgtcggatgggaacctggcggcagcgcaaaagatg

SEQ ID NO: 223837 - DNA, 103 bp, Artificial Sequence
  Synthetic Polynucleotide
taatacgactcactatagggtgctttccttgacagactgctgcccatccgaacagaggagacggatgatgagcagtctgaacctggcggcagcgcaaaagatg

SEQ ID NO: 223838 - DNA, 103 bp, Artificial Sequence
  Synthetic Polynucleotide
taatacgactcactataggggagtgttctttgctttccttgacagactgcaacagaggagagcagtcatgcaaggaaagaacctggcggcagcgcaaaagatg

SEQ ID NO: 223839 - DNA, 103 bp, Artificial Sequence
  Synthetic Polynucleotide
taatacgactcactatagggtttggtacatgagtgttctttgctttccttaacagaggagaaaggaaatgaaagaacacaacctggcggcagcgcaaaagatg

SEQ ID NO: 223840 - DNA, 103 bp, Artificial Sequence
  Synthetic Polynucleotide
taatacgactcactatagggttgcaacgtttctcagaggggggttcttttaacagaggagaaaaagaatgcccctctgaaacctggcggcagcgcaaaagatg

SEQ ID NO: 223841 - DNA, 103 bp, Artificial Sequence
  Synthetic Polynucleotide
taatacgactcactatagggccttcttactgctagaagatggatcttgaaaacagaggagattcaagatgcatcttctaaacctggcggcagcgcaaaagatg

SEQ ID NO: 223842 - DNA, 103 bp, Artificial Sequence
  Synthetic Polynucleotide
taatacgactcactatagggtaaaatcacatttggtacatgagtgttcttaacagaggagaaagaacatgcatgtaccaaacctggcggcagcgcaaaagatg

SEQ ID NO: 223843 - DNA, 103 bp, Artificial Sequence
  Synthetic Polynucleotide
taatacgactcactatagggacttgggtaataaaatcacatttggtacataacagaggagaatgtacatgatgtgatttaacctggcggcagcgcaaaagatg

SEQ ID NO: 223844 - DNA, 103 bp, Artificial Sequence
  Synthetic Polynucleotide
taatacgactcactatagggctcttcttccacttgggtaataaaatcacaaacagaggagatgtgatatgattacccaaaacctggcggcagcgcaaaagatg

SEQ ID NO: 223845 - DNA, 103 bp, Artificial Sequence
  Synthetic Polynucleotide
taatacgactcactataggggtcgggaaatctcttcttccacttgggtaaaacagaggagattacccatgtggaagaagaacctggcggcagcgcaaaagatg

SEQ ID NO: 223846 - DNA, 103 bp, Artificial Sequence
  Synthetic Polynucleotide
taatacgactcactatagggctcctgtagtgtcgggaaatctcttcttccaacagaggagaggaagaatggatttcccgaacctggcggcagcgcaaaagatg

SEQ ID NO: 223847 - DNA, 103 bp, Artificial Sequence
  Synthetic Polynucleotide
taatacgactcactataggggctgtgtgctctcctgtagtgtcgggaaataacagaggagaatttccatgcactacaggaacctggcggcagcgcaaaagatg

SEQ ID NO: 223848 - DNA, 103 bp, Artificial Sequence
  Synthetic Polynucleotide
taatacgactcactatagggatttgtagcagctgtgtgctctcctgtagtaacagaggagaactacaatggagcacacaaacctggcggcagcgcaaaagatg

SEQ ID NO: 223849 - DNA, 103 bp, Artificial Sequence
  Synthetic Polynucleotide
taatacgactcactatagggcactgacggcatttgtagcagctgtgtgctaacagaggagaagcacaatgctgctacaaaacctggcggcagcgcaaaagatg

SEQ ID NO: 223850 - DNA, 103 bp, Artificial Sequence
  Synthetic Polynucleotide
taatacgactcactatagggtgtaaaactgcactgacggcatttgtagcaaacagaggagatgctacatgtgccgtcagaacctggcggcagcgcaaaagatg

SEQ ID NO: 223851 - DNA, 103 bp, Artificial Sequence
  Synthetic Polynucleotide
taatacgactcactatagggtatcggcagctgtaaaactgcactgacggcaacagaggagagccgtcatggcagttttaaacctggcggcagcgcaaaagatg

SEQ ID NO: 223852 - DNA, 103 bp, Artificial Sequence
  Synthetic Polynucleotide
taatacgactcactatagggcttttcaagtccttcttactgctagaagataacagaggagaatcttcatgcagtaagaaaacctggcggcagcgcaaaagatg

SEQ ID NO: 223853 - DNA, 103 bp, Artificial Sequence
  Synthetic Polynucleotide
taatacgactcactatagggagtgactgagtatcggcagctgtaaaactgaacagaggagacagtttatgagctgccgaaacctggcggcagcgcaaaagatg

SEQ ID NO: 223854 - DNA, 103 bp, Artificial Sequence
  Synthetic Polynucleotide
taatacgactcactataggggtgctccagtagtgactgagtatcggcagcaacagaggagagctgccatgactcagtcaaacctggcggcagcgcaaaagatg

SEQ ID NO: 223855 - DNA, 103 bp, Artificial Sequence
  Synthetic Polynucleotide
taatacgactcactatagggcagtgttgaagtgctccagtagtgactgagaacagaggagactcagtatgtactggagcaacctggcggcagcgcaaaagatg

SEQ ID NO: 223856 - DNA, 103 bp, Artificial Sequence
  Synthetic Polynucleotide
taatacgactcactatagggtggcagtgaacagtgttgaagtgctccagtaacagaggagaactggaatgcttcaacacaacctggcggcagcgcaaaagatg

SEQ ID NO: 223857 - DNA, 103 bp, Artificial Sequence
  Synthetic Polynucleotide
taatacgactcactataggggtcctgttcctggcagtgaacagtgttgaaaacagaggagattcaacatggttcactgcaacctggcggcagcgcaaaagatg

SEQ ID NO: 223858 - DNA, 103 bp, Artificial Sequence
  Synthetic Polynucleotide
taatacgactcactatagggctgtagtgatgtcctgttcctggcagtgaaaacagaggagattcactatgaggaacaggaacctggcggcagcgcaaaagatg

SEQ ID NO: 223859 - DNA, 103 bp, Artificial Sequence
  Synthetic Polynucleotide
taatacgactcactatagggtcgccgttggctgtagtgatgtcctgttccaacagaggagaggaacaatgcatcactacaacctggcggcagcgcaaaagatg

SEQ ID NO: 223860 - DNA, 103 bp, Artificial Sequence
  Synthetic Polynucleotide
taatacgactcactatagggaccgtcctcttcgccgttggctgtagtgataacagaggagaatcactatggccaacggcaacctggcggcagcgcaaaagatg

SEQ ID NO: 223861 - DNA, 103 bp, Artificial Sequence
  Synthetic Polynucleotide
taatacgactcactatagggatatggcatgaccgtcctcttcgccgttggaacagaggagaccaacgatgaagaggacgaacctggcggcagcgcaaaagatg

SEQ ID NO: 223862 - DNA, 103 bp, Artificial Sequence
  Synthetic Polynucleotide
taatacgactcactatagggttgatggtggatatggcatgaccgtcctctaacagaggagaagaggaatgtcatgccataacctggcggcagcgcaaaagatg

SEQ ID NO: 223863 - DNA, 103 bp, Artificial Sequence
  Synthetic Polynucleotide
taatacgactcactatagggcagaactgcgcttttcaagtccttcttactaacagaggagaagtaagatggacttgaaaaacctggcggcagcgcaaaagatg

SEQ ID NO: 223864 - DNA, 103 bp, Artificial Sequence
  Synthetic Polynucleotide
taatacgactcactataggggggctcctctttgatggtggatatggcatgaacagaggagacatgccatgtccaccatcaacctggcggcagcgcaaaagatg

SEQ ID NO: 223865 - DNA, 103 bp, Artificial Sequence
  Synthetic Polynucleotide
taatacgactcactatagggagtcaattttgggctcctctttgatggtggaacagaggagaccaccaatgaagaggagcaacctggcggcagcgcaaaagatg

SEQ ID NO: 223866 - DNA, 103 bp, Artificial Sequence
  Synthetic Polynucleotide
taatacgactcactatagggtagaccctgaagtcaattttgggctcctctaacagaggagaagaggaatgcaaaattgaaacctggcggcagcgcaaaagatg

SEQ ID NO: 223867 - DNA, 103 bp, Artificial Sequence
  Synthetic Polynucleotide
taatacgactcactatagggtagcagattgtagaccctgaagtcaattttaacagaggagaaaaattatgttcagggtcaacctggcggcagcgcaaaagatg

SEQ ID NO: 223868 - DNA, 103 bp, Artificial Sequence
  Synthetic Polynucleotide
taatacgactcactatagggagtctggagttagcagattgtagaccctgaaacagaggagatcagggatgacaatctgcaacctggcggcagcgcaaaagatg

SEQ ID NO: 223869 - DNA, 103 bp, Artificial Sequence
  Synthetic Polynucleotide
taatacgactcactatagggcccattttagagtctggagttagcagattgaacagaggagacaatctatgaactccagaaacctggcggcagcgcaaaagatg

SEQ ID NO: 223870 - DNA, 103 bp, Artificial Sequence
  Synthetic Polynucleotide
taatacgactcactatagggaactggctctcccattttagagtctggagtaacagaggagaactccaatgtctaaaatgaacctggcggcagcgcaaaagatg

SEQ ID NO: 223871 - DNA, 103 bp, Artificial Sequence
  Synthetic Polynucleotide
taatacgactcactatagggcactctcagaaactggctctcccattttagaacagaggagactaaaaatggagagccagaacctggcggcagcgcaaaagatg

SEQ ID NO: 223872 - DNA, 103 bp, Artificial Sequence
  Synthetic Polynucleotide
taatacgactcactatagggctcttcaccacactctcagaaactggctctaacagaggagaagagccatgttctgagagaacctggcggcagcgcaaaagatg

SEQ ID NO: 223873 - DNA, 103 bp, Artificial Sequence
  Synthetic Polynucleotide
taatacgactcactatagggcagcttctctctcttcaccacactctcagaaacagaggagatctgagatggtggtgaagaacctggcggcagcgcaaaagatg

SEQ ID NO: 223874 - DNA, 103 bp, Artificial Sequence
  Synthetic Polynucleotide
taatacgactcactatagggccttctcactcagaactgcgcttttcaagtaacagaggagaacttgaatggcgcagttcaacctggcggcagcgcaaaagatg

SEQ ID NO: 223875 - DNA, 103 bp, Artificial Sequence
  Synthetic Polynucleotide
taatacgactcactatagggccttctcttccagcttctctctcttcaccaaacagaggagatggtgaatggagagaagcaacctggcggcagcgcaaaagatg

SEQ ID NO: 223876 - DNA, 103 bp, Artificial Sequence
  Synthetic Polynucleotide
taatacgactcactatagggttgagcccgtccttctcttccagcttctctaacagaggagaagagaaatgggaagagaaaacctggcggcagcgcaaaagatg

SEQ ID NO: 223877 - DNA, 103 bp, Artificial Sequence
  Synthetic Polynucleotide
taatacgactcactatagggaactttctctttgagcccgtccttctcttcaacagaggagagaagagatggacgggctcaacctggcggcagcgcaaaagatg

SEQ ID NO: 223878 - DNA, 103 bp, Artificial Sequence
  Synthetic Polynucleotide
taatacgactcactatagggtctcggtccaaactttctctttgagcccgtaacagaggagaacgggcatgaagagaaagaacctggcggcagcgcaaaagatg

SEQ ID NO: 223879 - DNA, 103 bp, Artificial Sequence
  Synthetic Polynucleotide
taatacgactcactatagggtcactggaactctcggtccaaactttctctaacagaggagaagagaaatgttggaccgaaacctggcggcagcgcaaaagatg

SEQ ID NO: 223880 - DNA, 103 bp, Artificial Sequence
  Synthetic Polynucleotide
taatacgactcactataggggcgaaggtcatcactggaactctcggtccaaacagaggagatggaccatgagttccagtaacctggcggcagcgcaaaagatg

SEQ ID NO: 223881 - DNA, 103 bp, Artificial Sequence
  Synthetic Polynucleotide
taatacgactcactatagggaagtcacattgcgaaggtcatcactggaacaacagaggagagttccaatgatgaccttcaacctggcggcagcgcaaaagatg

SEQ ID NO: 223882 - DNA, 103 bp, Artificial Sequence
  Synthetic Polynucleotide
taatacgactcactataggggcccctctccaagtcacattgcgaaggtcaaacagaggagatgacctatgcaatgtgacaacctggcggcagcgcaaaagatg

SEQ ID NO: 223883 - DNA, 103 bp, Artificial Sequence
  Synthetic Polynucleotide
taatacgactcactatagggcaggatgtctgcccctctccaagtcacattaacagaggagaaatgtgatgtggagagggaacctggcggcagcgcaaaagatg

SEQ ID NO: 223884 - DNA, 103 bp, Artificial Sequence
  Synthetic Polynucleotide
taatacgactcactataggggactcccccgcaggatgtctgcccctctccaacagaggagaggagagatgcagacatccaacctggcggcagcgcaaaagatg

SEQ ID NO: 223885 - DNA, 103 bp, Artificial Sequence
  Synthetic Polynucleotide
taatacgactcactatagggttgaagccagccttctcactcagaactgcgaacagaggagacgcagtatggagtgagaaaacctggcggcagcgcaaaagatg

SEQ ID NO: 223886 - DNA, 103 bp, Artificial Sequence
  Synthetic Polynucleotide
taatacgactcactataggggtgtatgacggactcccccgcaggatgtctaacagaggagaagacatatggcgggggagaacctggcggcagcgcaaaagatg

SEQ ID NO: 223887 - DNA, 103 bp, Artificial Sequence
  Synthetic Polynucleotide
taatacgactcactataggggcttgcttgggtgtatgacggactcccccgaacagaggagacgggggatgccgtcatacaacctggcggcagcgcaaaagatg

SEQ ID NO: 223888 - DNA, 103 bp, Artificial Sequence
  Synthetic Polynucleotide
taatacgactcactataggggcagccccaggcttgcttgggtgtatgacgaacagaggagacgtcatatgcccaagcaaaacctggcggcagcgcaaaagatg

SEQ ID NO: 223889 - DNA, 103 bp, Artificial Sequence
  Synthetic Polynucleotide
taatacgactcactatagggacaggcgtcagcagccccaggcttgcttggaacagaggagaccaagcatgcctggggctaacctggcggcagcgcaaaagatg

SEQ ID NO: 223890 - DNA, 103 bp, Artificial Sequence
  Synthetic Polynucleotide
taatacgactcactatagggggtgccagacacaggcgtcagcagccccagaacagaggagactggggatgctgacgcctaacctggcggcagcgcaaaagatg

SEQ ID NO: 223891 - DNA, 103 bp, Artificial Sequence
  Synthetic Polynucleotide
taatacgactcactatagggtctgctcttgggtgccagacacaggcgtcaaacagaggagatgacgcatgtgtctggcaaacctggcggcagcgcaaaagatg

SEQ ID NO: 223892 - DNA, 103 bp, Artificial Sequence
  Synthetic Polynucleotide
taatacgactcactatagggagagtctttgtctgctcttgggtgccagacaacagaggagagtctggatgccaagagcaaacctggcggcagcgcaaaagatg

SEQ ID NO: 223893 - DNA, 103 bp, Artificial Sequence
  Synthetic Polynucleotide
taatacgactcactatagggactatcccttagagtctttgtctgctcttgaacagaggagacaagagatgacaaagactaacctggcggcagcgcaaaagatg

SEQ ID NO: 223894 - DNA, 103 bp, Artificial Sequence
  Synthetic Polynucleotide
taatacgactcactatagggccacattgggactatcccttagagtctttgaacagaggagacaaagaatgtaagggataaacctggcggcagcgcaaaagatg

SEQ ID NO: 223895 - DNA, 103 bp, Artificial Sequence
  Synthetic Polynucleotide
taatacgactcactatagggtgggcggcctccacattgggactatcccttaacagaggagaaagggaatgtcccaatgtaacctggcggcagcgcaaaagatg

SEQ ID NO: 223896 - DNA, 103 bp, Artificial Sequence
  Synthetic Polynucleotide
taatacgactcactataggggctttcataattgaagccagccttctcactaacagaggagaagtgagatggctggcttcaacctggcggcagcgcaaaagatg

SEQ ID NO: 223897 - DNA, 103 bp, Artificial Sequence
  Synthetic Polynucleotide
taatacgactcactatagggtcgcgccagatgggcggcctccacattgggaacagaggagacccaatatggaggccgccaacctggcggcagcgcaaaagatg

SEQ ID NO: 223898 - DNA, 103 bp, Artificial Sequence
  Synthetic Polynucleotide
taatacgactcactatagggcataaataggtcgcgccagatgggcggcctaacagaggagaaggccgatgatctggcgcaacctggcggcagcgcaaaagatg

SEQ ID NO: 223899 - DNA, 103 bp, Artificial Sequence
  Synthetic Polynucleotide
taatacgactcactatagggacagccaagccataaataggtcgcgccagaaacagaggagatctggcatgacctatttaaacctggcggcagcgcaaaagatg

SEQ ID NO: 223900 - DNA, 103 bp, Artificial Sequence
  Synthetic Polynucleotide
taatacgactcactatagggcttggtttccacagccaagccataaataggaacagaggagacctattatgggcttggctaacctggcggcagcgcaaaagatg

SEQ ID NO: 223901 - DNA, 103 bp, Artificial Sequence
  Synthetic Polynucleotide
taatacgactcactataggggcaggaatcccttggtttccacagccaagcaacagaggagagcttggatgtggaaaccaaacctggcggcagcgcaaaagatg

SEQ ID NO: 223902 - DNA, 103 bp, Artificial Sequence
  Synthetic Polynucleotide
taatacgactcactatagggggcgccccctgcaggaatcccttggtttccaacagaggagaggaaacatggggattcctaacctggcggcagcgcaaaagatg

SEQ ID NO: 223903 - DNA, 103 bp, Artificial Sequence
  Synthetic Polynucleotide
taatacgactcactatagggtccgccagctggcgccccctgcaggaatccaacagaggagaggattcatgcagggggcgaacctggcggcagcgcaaaagatg

SEQ ID NO: 223904 - DNA, 103 bp, Artificial Sequence
  Synthetic Polynucleotide
taatacgactcactatagggcagacttctctccgccagctggcgccccctaacagaggagaagggggatgcagctggcgaacctggcggcagcgcaaaagatg

SEQ ID NO: 223905 - DNA, 103 bp, Artificial Sequence
  Synthetic Polynucleotide
taatacgactcactataggggggagggccccagacttctctccgccagctaacagaggagaagctggatgagagaagtcaacctggcggcagcgcaaaagatg

SEQ ID NO: 223906 - DNA, 103 bp, Artificial Sequence
  Synthetic Polynucleotide
taatacgactcactatagggatactgctgggggagggccccagacttctcaacagaggagagagaagatgggggccctcaacctggcggcagcgcaaaagatg

SEQ ID NO: 223907 - DNA, 103 bp, Artificial Sequence
  Synthetic Polynucleotide
taatacgactcactatagggccttactggggctttcataattgaagccagaacagaggagactggctatgattatgaaaaacctggcggcagcgcaaaagatg

SEQ ID NO: 223908 - DNA, 103 bp, Artificial Sequence
  Synthetic Polynucleotide
taatacgactcactatagggccgatgcaggatactgctgggggagggcccaacagaggagagggcccatgcccagcagtaacctggcggcagcgcaaaagatg

SEQ ID NO: 223909 - DNA, 103 bp, Artificial Sequence
  Synthetic Polynucleotide
taatacgactcactatagggttgttttctcccgatgcaggatactgctggaacagaggagaccagcaatgtcctgcatcaacctggcggcagcgcaaaagatg

SEQ ID NO: 223910 - DNA, 103 bp, Artificial Sequence
  Synthetic Polynucleotide
taatacgactcactatagggatccttggacttgttttctcccgatgcaggaacagaggagacctgcaatgggagaaaacaacctggcggcagcgcaaaagatg

SEQ ID NO: 223911 - DNA, 103 bp, Artificial Sequence
  Synthetic Polynucleotide
taatacgactcactatagggactgggattcatccttggacttgttttctcaacagaggagagagaaaatgagtccaaggaacctggcggcagcgcaaaagatg

SEQ ID NO: 223912 - DNA, 103 bp, Artificial Sequence
  Synthetic Polynucleotide
taatacgactcactatagggcgtaacagggactgggattcatccttggacaacagaggagagtccaaatgtgaatcccaaacctggcggcagcgcaaaagatg

SEQ ID NO: 223913 - DNA, 103 bp, Artificial Sequence
  Synthetic Polynucleotide
taatacgactcactatagggtctacgcctccgtaacagggactgggattcaacagaggagagaatccatgtccctgttaaacctggcggcagcgcaaaagatg

SEQ ID NO: 223914 - DNA, 103 bp, Artificial Sequence
  Synthetic Polynucleotide
taatacgactcactatagggcaccggagcctctacgcctccgtaacagggaacagaggagaccctgtatgggaggcgtaaacctggcggcagcgcaaaagatg

SEQ ID NO: 223915 - DNA, 103 bp, Artificial Sequence
  Synthetic Polynucleotide
taatacgactcactataggggcacaaaaaacaccggagcctctacgcctcaacagaggagagaggcgatgaggctccggaacctggcggcagcgcaaaagatg

SEQ ID NO: 223916 - DNA, 103 bp, Artificial Sequence
  Synthetic Polynucleotide
taatacgactcactatagggcaggcaattggcacaaaaaacaccggagccaacagaggagaggctccatggttttttgtaacctggcggcagcgcaaaagatg

SEQ ID NO: 223917 - DNA, 103 bp, Artificial Sequence
  Synthetic Polynucleotide
taatacgactcactatagggtctttgtggtcaggcaattggcacaaaaaaaacagaggagattttttatgccaattgccaacctggcggcagcgcaaaagatg

SEQ ID NO: 223918 - DNA, 103 bp, Artificial Sequence
  Synthetic Polynucleotide
taatacgactcactatagggaagtttcctcccttactggggctttcataaaacagaggagattatgaatgccccagtaaaacctggcggcagcgcaaaagatg

SEQ ID NO: 223919 - DNA, 103 bp, Artificial Sequence
  Synthetic Polynucleotide
taatacgactcactatagggcagagagaggtctttgtggtcaggcaattgaacagaggagacaattgatggaccacaaaaacctggcggcagcgcaaaagatg

SEQ ID NO: 223920 - DNA, 103 bp, Artificial Sequence
  Synthetic Polynucleotide
taatacgactcactatagggattctttcgccagagagaggtctttgtggtaacagaggagaaccacaatgacctctctcaacctggcggcagcgcaaaagatg

SEQ ID NO: 223921 - DNA, 103 bp, Artificial Sequence
  Synthetic Polynucleotide
taatacgactcactatagggcgccatttgcattctttcgccagagagaggaacagaggagacctctcatgggcgaaagaaacctggcggcagcgcaaaagatg

SEQ ID NO: 223922 - DNA, 103 bp, Artificial Sequence
  Synthetic Polynucleotide
taatacgactcactatagggcatacatatccgccatttgcattctttcgcaacagaggagagcgaaaatgtgcaaatggaacctggcggcagcgcaaaagatg

SEQ ID NO: 223923 - DNA, 103 bp, Artificial Sequence
  Synthetic Polynucleotide
taatacgactcactatagggacacgcgttgcatacatatccgccatttgcaacagaggagagcaaatatgggatatgtaaacctggcggcagcgcaaaagatg

SEQ ID NO: 223924 - DNA, 103 bp, Artificial Sequence
  Synthetic Polynucleotide
taatacgactcactatagggggtagaggccacacgcgttgcatacatatcaacagaggagagatatgatggcaacgcgtaacctggcggcagcgcaaaagatg

SEQ ID NO: 223925 - DNA, 103 bp, Artificial Sequence
  Synthetic Polynucleotide
taatacgactcactatagggtgaagcttctggtagaggccacacgcgttgaacagaggagacaacgcatgtggcctctaaacctggcggcagcgcaaaagatg

SEQ ID NO: 223926 - DNA, 103 bp, Artificial Sequence
  Synthetic Polynucleotide
taatacgactcactataggggggagtcgagtgaagcttctggtagaggccaacagaggagaggcctcatgcagaagcttaacctggcggcagcgcaaaagatg

SEQ ID NO: 223927 - DNA, 103 bp, Artificial Sequence
  Synthetic Polynucleotide
taatacgactcactatagggttaaaggcctgggagtcgagtgaagcttctaacagaggagaagaagcatgactcgactcaacctggcggcagcgcaaaagatg

SEQ ID NO: 223928 - DNA, 103 bp, Artificial Sequence
  Synthetic Polynucleotide
taatacgactcactatagggttaatgatgtttaaaggcctgggagtcgagaacagaggagactcgacatgcaggcctttaacctggcggcagcgcaaaagatg

SEQ ID NO: 223929 - DNA, 103 bp, Artificial Sequence
  Synthetic Polynucleotide
taatacgactcactatagggaaaggagggaaagtttcctcccttactgggaacagaggagacccagtatgggaggaaacaacctggcggcagcgcaaaagatg

SEQ ID NO: 223930 - DNA, 103 bp, Artificial Sequence
  Synthetic Polynucleotide
taatacgactcactataggggttgttttgtttaatgatgtttaaaggcctaacagaggagaaggcctatgaacatcattaacctggcggcagcgcaaaagatg

SEQ ID NO: 223931 - DNA, 103 bp, Artificial Sequence
  Synthetic Polynucleotide
taatacgactcactatagggtctgctcaccgttgttttgtttaatgatgtaacagaggagaacatcaatgaacaaaacaaacctggcggcagcgcaaaagatg

SEQ ID NO: 223932 - DNA, 103 bp, Artificial Sequence
  Synthetic Polynucleotide
taatacgactcactatagggctcctaataatctgctcaccgttgttttgtaacagaggagaacaaaaatgcggtgagcaaacctggcggcagcgcaaaagatg

SEQ ID NO: 223933 - DNA, 103 bp, Artificial Sequence
  Synthetic Polynucleotide
taatacgactcactatagggtcttgttctcctcctaataatctgctcaccaacagaggagaggtgagatgattattaggaacctggcggcagcgcaaaagatg

SEQ ID NO: 223934 - DNA, 103 bp, Artificial Sequence
  Synthetic Polynucleotide
taatacgactcactatagggtaaggcgctttcttgttctcctcctaataaaacagaggagattattaatgggagaacaaaacctggcggcagcgcaaaagatg

SEQ ID NO: 223935 - DNA, 103 bp, Artificial Sequence
  Synthetic Polynucleotide
taatacgactcactataggggcctctgggttaaggcgctttcttgttctcaacagaggagagagaacatgaaagcgcctaacctggcggcagcgcaaaagatg

SEQ ID NO: 223936 - DNA, 103 bp, Artificial Sequence
  Synthetic Polynucleotide
taatacgactcactatagggagcctgaagtgcctctgggttaaggcgcttaacagaggagaaagcgcatgaacccagagaacctggcggcagcgcaaaagatg

SEQ ID NO: 223937 - DNA, 103 bp, Artificial Sequence
  Synthetic Polynucleotide
taatacgactcactatagggtgagctgctcagcctgaagtgcctctgggtaacagaggagaacccagatgcacttcaggaacctggcggcagcgcaaaagatg

SEQ ID NO: 223938 - DNA, 103 bp, Artificial Sequence
  Synthetic Polynucleotide
taatacgactcactatagggtgctgtttgttgagctgctcagcctgaagtaacagaggagaacttcaatgtgagcagctaacctggcggcagcgcaaaagatg

SEQ ID NO: 223939 - DNA, 103 bp, Artificial Sequence
  Synthetic Polynucleotide
taatacgactcactataggggctgcccctctgctgtttgttgagctgctcaacagaggagagagcagatgaacaaacagaacctggcggcagcgcaaaagatg

SEQ ID NO: 223940 - DNA, 103 bp, Artificial Sequence
  Synthetic Polynucleotide
taatacgactcactatagggcatcatgcggaaaggagggaaagtttcctcaacagaggagagaggaaatgttccctcctaacctggcggcagcgcaaaagatg

SEQ ID NO: 223941 - DNA, 103 bp, Artificial Sequence
  Synthetic Polynucleotide
taatacgactcactataggggctcctcattgctgcccctctgctgtttgtaacagaggagaacaaacatgagaggggcaaacctggcggcagcgcaaaagatg

SEQ ID NO: 223942 - DNA, 103 bp, Artificial Sequence
  Synthetic Polynucleotide
taatacgactcactatagggccattgacttgctcctcattgctgcccctcaacagaggagagaggggatgcaatgaggaaacctggcggcagcgcaaaagatg

SEQ ID NO: 223943 - DNA, 103 bp, Artificial Sequence
  Synthetic Polynucleotide
taatacgactcactatagggtaacgggcttccattgacttgctcctcattaacagaggagaaatgagatgcaagtcaataacctggcggcagcgcaaaagatg

SEQ ID NO: 223944 - DNA, 103 bp, Artificial Sequence
  Synthetic Polynucleotide
taatacgactcactatagggacctcctctctaacgggcttccattgacttaacagaggagaaagtcaatggaagcccgtaacctggcggcagcgcaaaagatg

SEQ ID NO: 223945 - DNA, 103 bp, Artificial Sequence
  Synthetic Polynucleotide
taatacgactcactatagggtgatcttctgacctcctctctaacgggcttaacagaggagaaagcccatgagagaggagaacctggcggcagcgcaaaagatg

SEQ ID NO: 223946 - DNA, 103 bp, Artificial Sequence
  Synthetic Polynucleotide
taatacgactcactatagggttcagttagatgatcttctgacctcctctcaacagaggagagagaggatgtcagaagataacctggcggcagcgcaaaagatg

SEQ ID NO: 223947 - DNA, 103 bp, Artificial Sequence
  Synthetic Polynucleotide
taatacgactcactatagggtctggtgactttcagttagatgatcttctgaacagaggagacagaagatgatctaactgaacctggcggcagcgcaaaagatg

SEQ ID NO: 223948 - DNA, 103 bp, Artificial Sequence
  Synthetic Polynucleotide
taatacgactcactatagggggaatttctctctggtgactttcagttagaaacagaggagatctaacatgaagtcaccaaacctggcggcagcgcaaaagatg

SEQ ID NO: 223949 - DNA, 103 bp, Artificial Sequence
  Synthetic Polynucleotide
taatacgactcactataggggctggggagtggaatttctctctggtgactaacagaggagaagtcacatgagagaaattaacctggcggcagcgcaaaagatg

SEQ ID NO: 223950 - DNA, 103 bp, Artificial Sequence
  Synthetic Polynucleotide
taatacgactcactatagggatttacttaggctggggagtggaatttctcaacagaggagagagaaaatgcactccccaaacctggcggcagcgcaaaagatg

SEQ ID NO: 223951 - DNA, 103 bp, Artificial Sequence
  Synthetic Polynucleotide
taatacgactcactatagggtcgccttcacttgcaacgtttctcagagggaacagaggagaccctctatgaaacgttgcaacctggcggcagcgcaaaagatg

SEQ ID NO: 223952 - DNA, 103 bp, Artificial Sequence
  Synthetic Polynucleotide
taatacgactcactatagggtctgtcacctcatcatgcggaaaggagggaaacagaggagatccctcatgtccgcatgaaacctggcggcagcgcaaaagatg

SEQ ID NO: 223953 - DNA, 103 bp, Artificial Sequence
  Synthetic Polynucleotide
taatacgactcactatagggtgggcttcgtatttacttaggctggggagtaacagaggagaactcccatgcctaagtaaaacctggcggcagcgcaaaagatg

SEQ ID NO: 223954 - DNA, 103 bp, Artificial Sequence
  Synthetic Polynucleotide
taatacgactcactatagggcaatgaaccctgggcttcgtatttacttagaacagaggagactaagtatgtacgaagccaacctggcggcagcgcaaaagatg

SEQ ID NO: 223955 - DNA, 103 bp, Artificial Sequence
  Synthetic Polynucleotide
taatacgactcactatagggggcttttagtcaatgaaccctgggcttcgtaacagaggagaacgaagatgagggttcataacctggcggcagcgcaaaagatg

SEQ ID NO: 223956 - DNA, 103 bp, Artificial Sequence
  Synthetic Polynucleotide
taatacgactcactatagggtgagcagaatggcttttagtcaatgaacccaacagaggagagggttcatggactaaaagaacctggcggcagcgcaaaagatg

SEQ ID NO: 223957 - DNA, 103 bp, Artificial Sequence
  Synthetic Polynucleotide
taatacgactcactataggggactggctgctgagcagaatggcttttagtaacagaggagaactaaaatgcattctgctaacctggcggcagcgcaaaagatg

SEQ ID NO: 223958 - DNA, 103 bp, Artificial Sequence
  Synthetic Polynucleotide
taatacgactcactatagggggctgaccaggactggctgctgagcagaataacagaggagaattctgatgagcagccagaacctggcggcagcgcaaaagatg

SEQ ID NO: 223959 - DNA, 103 bp, Artificial Sequence
  Synthetic Polynucleotide
taatacgactcactatagggtccagagtttggctgaccaggactggctgcaacagaggagagcagccatgcctggtcagaacctggcggcagcgcaaaagatg

SEQ ID NO: 223960 - DNA, 103 bp, Artificial Sequence
  Synthetic Polynucleotide
taatacgactcactatagggtttgtgaatatccagagtttggctgaccagaacagaggagactggtcatgcaaactctgaacctggcggcagcgcaaaagatg

SEQ ID NO: 223961 - DNA, 103 bp, Artificial Sequence
  Synthetic Polynucleotide
taatacgactcactataggggttgcatccttttgtgaatatccagagtttaacagaggagaaaactcatgatattcacaaacctggcggcagcgcaaaagatg

SEQ ID NO: 223962 - DNA, 103 bp, Artificial Sequence
  Synthetic Polynucleotide
taatacgactcactatagggatgtgcaaaggttgcatccttttgtgaataaacagaggagatattcaatgaaggatgcaaacctggcggcagcgcaaaagatg

SEQ ID NO: 223963 - DNA, 103 bp, Artificial Sequence
  Synthetic Polynucleotide
taatacgactcactatagggcatatttctgtctgtcacctcatcatgcggaacagaggagaccgcatatggaggtgacaaacctggcggcagcgcaaaagatg

SEQ ID NO: 223964 - DNA, 103 bp, Artificial Sequence
  Synthetic Polynucleotide
taatacgactcactatagggttttatctgaatgtgcaaaggttgcatcctaacagaggagaaggatgatgcctttgcacaacctggcggcagcgcaaaagatg

SEQ ID NO: 223965 - DNA, 103 bp, Artificial Sequence
  Synthetic Polynucleotide
taatacgactcactatagggcctgaggactttttatctgaatgtgcaaagaacagaggagactttgcatgttcagataaaacctggcggcagcgcaaaagatg

SEQ ID NO: 223966 - DNA, 103 bp, Artificial Sequence
  Synthetic Polynucleotide
taatacgactcactatagggccagtactttcctgaggactttttatctgaaacagaggagatcagatatgaagtcctcaaacctggcggcagcgcaaaagatg

SEQ ID NO: 223967 - DNA, 103 bp, Artificial Sequence
  Synthetic Polynucleotide
taatacgactcactatagggtcctggatctccagtactttcctgaggactaacagaggagaagtcctatggaaagtactaacctggcggcagcgcaaaagatg

SEQ ID NO: 223968 - DNA, 103 bp, Artificial Sequence
  Synthetic Polynucleotide
taatacgactcactatagggatgaactatttcctggatctccagtactttaacagaggagaaaagtaatggagatccagaacctggcggcagcgcaaaagatg

SEQ ID NO: 223969 - DNA, 103 bp, Artificial Sequence
  Synthetic Polynucleotide
taatacgactcactatagggtcagatacggatgaactatttcctggatctaacagaggagaagatccatgaaatagttcaacctggcggcagcgcaaaagatg

SEQ ID NO: 223970 - DNA, 103 bp, Artificial Sequence
  Synthetic Polynucleotide
taatacgactcactatagggtcctttcccttcagatacggatgaactattaacagaggagaaatagtatgtccgtatctaacctggcggcagcgcaaaagatg

SEQ ID NO: 223971 - DNA, 103 bp, Artificial Sequence
  Synthetic Polynucleotide
taatacgactcactatagggtctcagaacttcctttcccttcagatacggaacagaggagaccgtatatgaagggaaagaacctggcggcagcgcaaaagatg

SEQ ID NO: 223972 - DNA, 103 bp, Artificial Sequence
  Synthetic Polynucleotide
taatacgactcactatagggggactgcctctctcagaacttcctttccctaacagaggagaagggaaatgaagttctgaaacctggcggcagcgcaaaagatg

SEQ ID NO: 223973 - DNA, 103 bp, Artificial Sequence
  Synthetic Polynucleotide
taatacgactcactatagggcttttctataggactgcctctctcagaactaacagaggagaagttctatgagaggcagtaacctggcggcagcgcaaaagatg

SEQ ID NO: 223974 - DNA, 103 bp, Artificial Sequence
  Synthetic Polynucleotide
taatacgactcactatagggagaaagccaacatatttctgtctgtcacctaacagaggagaaggtgaatgacagaaataaacctggcggcagcgcaaaagatg

SEQ ID NO: 223975 - DNA, 103 bp, Artificial Sequence
  Synthetic Polynucleotide
taatacgactcactataggggtctcatgtacttttctataggactgcctcaacagaggagagaggcaatgctatagaaaaacctggcggcagcgcaaaagatg

SEQ ID NO: 223976 - DNA, 103 bp, Artificial Sequence
  Synthetic Polynucleotide
taatacgactcactatagggtgtttcgcaggtctcatgtacttttctataaacagaggagatatagaatggtacatgagaacctggcggcagcgcaaaagatg

SEQ ID NO: 223977 - DNA, 103 bp, Artificial Sequence
  Synthetic Polynucleotide
taatacgactcactatagggataatttgggtgtttcgcaggtctcatgtaaacagaggagatacatgatgcctgcgaaaaacctggcggcagcgcaaaagatg

SEQ ID NO: 223978 - DNA, 103 bp, Artificial Sequence
  Synthetic Polynucleotide
taatacgactcactatagggctggtggtgaataatttgggtgtttcgcagaacagaggagactgcgaatgacccaaattaacctggcggcagcgcaaaagatg

SEQ ID NO: 223979 - DNA, 103 bp, Artificial Sequence
  Synthetic Polynucleotide
taatacgactcactatagggatagggctgcctggtggtgaataatttgggaacagaggagacccaaaatgttcaccaccaacctggcggcagcgcaaaagatg

SEQ ID NO: 223980 - DNA, 103 bp, Artificial Sequence
  Synthetic Polynucleotide
taatacgactcactataggggtacttttcaatagggctgcctggtggtgaaacagaggagatcaccaatgggcagccctaacctggcggcagcgcaaaagatg

SEQ ID NO: 223981 - DNA, 103 bp, Artificial Sequence
  Synthetic Polynucleotide
taatacgactcactataggggtgggtactggtacttttcaatagggctgcaacagaggagagcagccatgttgaaaagtaacctggcggcagcgcaaaagatg

SEQ ID NO: 223982 - DNA, 103 bp, Artificial Sequence
  Synthetic Polynucleotide
taatacgactcactatagggagtccaaaaagtgggtactggtacttttcaaacagaggagatgaaaaatgccagtacccaacctggcggcagcgcaaaagatg

SEQ ID NO: 223983 - DNA, 103 bp, Artificial Sequence
  Synthetic Polynucleotide
taatacgactcactatagggtacaaagggaagtccaaaaagtgggtactgaacagaggagacagtacatgctttttggaaacctggcggcagcgcaaaagatg

SEQ ID NO: 223984 - DNA, 103 bp, Artificial Sequence
  Synthetic Polynucleotide
taatacgactcactatagggagtcattatgtacaaagggaagtccaaaaaaacagaggagatttttgatgttccctttgaacctggcggcagcgcaaaagatg

SEQ ID NO: 223985 - DNA, 103 bp, Artificial Sequence
  Synthetic Polynucleotide
taatacgactcactataggggctggagatgagaaagccaacatatttctgaacagaggagacagaaaatggttggctttaacctggcggcagcgcaaaagatg

SEQ ID NO: 223986 - DNA, 103 bp, Artificial Sequence
  Synthetic Polynucleotide
taatacgactcactatagggtcactctggaagtcattatgtacaaagggaaacagaggagatcccttatgacataatgaaacctggcggcagcgcaaaagatg

SEQ ID NO: 223987 - DNA, 103 bp, Artificial Sequence
  Synthetic Polynucleotide
taatacgactcactatagggccaatcagcttcactctggaagtcattatgaacagaggagacataatatgttccagagtaacctggcggcagcgcaaaagatg

SEQ ID NO: 223988 - DNA, 103 bp, Artificial Sequence
  Synthetic Polynucleotide
taatacgactcactatagggagaaccgcagccaatcagcttcactctggaaacagaggagatccagaatgaagctgattaacctggcggcagcgcaaaagatg

SEQ ID NO: 223989 - DNA, 103 bp, Artificial Sequence
  Synthetic Polynucleotide
taatacgactcactatagggtatttactccagaaccgcagccaatcagctaacagaggagaagctgaatggctgcggttaacctggcggcagcgcaaaagatg

SEQ ID NO: 223990 - DNA, 103 bp, Artificial Sequence
  Synthetic Polynucleotide
taatacgactcactatagggggagagcttatatttactccagaaccgcagaacagaggagactgcggatgtggagtaaaaacctggcggcagcgcaaaagatg

SEQ ID NO: 223991 - DNA, 103 bp, Artificial Sequence
  Synthetic Polynucleotide
taatacgactcactatagggtcccaggaacggagagcttatatttactccaacagaggagaggagtaatgataagctctaacctggcggcagcgcaaaagatg

SEQ ID NO: 223992 - DNA, 103 bp, Artificial Sequence
  Synthetic Polynucleotide
taatacgactcactatagggtagtgcggattcccaggaacggagagcttaaacagaggagataagctatgcgttcctggaacctggcggcagcgcaaaagatg

SEQ ID NO: 223993 - DNA, 103 bp, Artificial Sequence
  Synthetic Polynucleotide
taatacgactcactataggggtgactcaagtagtgcggattcccaggaacaacagaggagagttcctatgaatccgcacaacctggcggcagcgcaaaagatg

SEQ ID NO: 223994 - DNA, 103 bp, Artificial Sequence
  Synthetic Polynucleotide
taatacgactcactatagggggccaggcacgtgactcaagtagtgcggataacagaggagaatccgcatgacttgagtcaacctggcggcagcgcaaaagatg

SEQ ID NO: 223995 - DNA, 103 bp, Artificial Sequence
  Synthetic Polynucleotide
taatacgactcactatagggggatttggtaggccaggcacgtgactcaagaacagaggagacttgagatgcgtgcctggaacctggcggcagcgcaaaagatg

SEQ ID NO: 223996 - DNA, 103 bp, Artificial Sequence
  Synthetic Polynucleotide
taatacgactcactatagggtcccccagcagctggagatgagaaagccaaaacagaggagattggctatgtcatctccaaacctggcggcagcgcaaaagatg

SEQ ID NO: 223997 - DNA, 103 bp, Artificial Sequence
  Synthetic Polynucleotide
taatacgactcactataggggttttggcaaggatttggtaggccaggcacaacagaggagagtgcctatgctaccaaataacctggcggcagcgcaaaagatg

SEQ ID NO: 223998 - DNA, 103 bp, Artificial Sequence
  Synthetic Polynucleotide
taatacgactcactatagggaaggcacatagttttggcaaggatttggtaaacagaggagataccaaatgcttgccaaaaacctggcggcagcgcaaaagatg

SEQ ID NO: 223999 - DNA, 103 bp, Artificial Sequence
  Synthetic Polynucleotide
taatacgactcactatagggaaggtgggataaggcacatagttttggcaaaacagaggagattgccaatgctatgtgccaacctggcggcagcgcaaaagatg

SEQ ID NO: 224000 - DNA, 103 bp, Artificial Sequence
  Synthetic Polynucleotide
taatacgactcactatagggaggcagattgaaggtgggataaggcacataaacagaggagatatgtgatgtatcccaccaacctggcggcagcgcaaaagatg

SEQ ID NO: 224001 - DNA, 103 bp, Artificial Sequence
  Synthetic Polynucleotide
taatacgactcactatagggaaaaatgaggaggcagattgaaggtgggataacagaggagaatcccaatgtcaatctgcaacctggcggcagcgcaaaagatg

SEQ ID NO: 224002 - DNA, 103 bp, Artificial Sequence
  Synthetic Polynucleotide
taatacgactcactatagggccaacagctgaaaaatgaggaggcagattgaacagaggagacaatctatgtcctcatttaacctggcggcagcgcaaaagatg

SEQ ID NO: 224003 - DNA, 103 bp, Artificial Sequence
  Synthetic Polynucleotide
taatacgactcactatagggattgtctgatccaacagctgaaaaatgaggaacagaggagacctcatatgtcagctgttaacctggcggcagcgcaaaagatg

SEQ ID NO: 224004 - DNA, 103 bp, Artificial Sequence
  Synthetic Polynucleotide
taatacgactcactataggggaggaatgtcattgtctgatccaacagctgaacagaggagacagctgatggatcagacaaacctggcggcagcgcaaaagatg

SEQ ID NO: 224005 - DNA, 103 bp, Artificial Sequence
  Synthetic Polynucleotide
taatacgactcactataggggccaaatctagaggaatgtcattgtctgataacagaggagaatcagaatgtgacattccaacctggcggcagcgcaaaagatg

SEQ ID NO: 224006 - DNA, 103 bp, Artificial Sequence
  Synthetic Polynucleotide
taatacgactcactatagggatgcttgatcgccaaatctagaggaatgtcaacagaggagagacattatgctagatttgaacctggcggcagcgcaaaagatg

SEQ ID NO: 224007 - DNA, 103 bp, Artificial Sequence
  Synthetic Polynucleotide
taatacgactcactataggggctcacagactcccccagcagctggagatgaacagaggagacatctcatgctgctggggaacctggcggcagcgcaaaagatg

SEQ ID NO: 224008 - DNA, 103 bp, Artificial Sequence
  Synthetic Polynucleotide
taatacgactcactatagggcaggtctggaatgcttgatcgccaaatctaaacagaggagatagattatgcgatcaagcaacctggcggcagcgcaaaagatg

SEQ ID NO: 224009 - DNA, 103 bp, Artificial Sequence
  Synthetic Polynucleotide
taatacgactcactataggggcagttggcccaggtctggaatgcttgatcaacagaggagagatcaaatgttccagaccaacctggcggcagcgcaaaagatg

SEQ ID NO: 224010 - DNA, 103 bp, Artificial Sequence
  Synthetic Polynucleotide
taatacgactcactatagggggcaccgtttgcagttggcccaggtctggaaacagaggagatccagaatggggccaactaacctggcggcagcgcaaaagatg

SEQ ID NO: 224011 - DNA, 103 bp, Artificial Sequence
  Synthetic Polynucleotide
taatacgactcactatagggtctccttggaggcaccgtttgcagttggccaacagaggagaggccaaatgcaaacggtgaacctggcggcagcgcaaaagatg

SEQ ID NO: 224012 - DNA, 103 bp, Artificial Sequence
  Synthetic Polynucleotide
taatacgactcactataggggccttcgttttctccttggaggcaccgtttaacagaggagaaaacggatgctccaaggaaacctggcggcagcgcaaaagatg

SEQ ID NO: 224013 - DNA, 103 bp, Artificial Sequence
  Synthetic Polynucleotide
taatacgactcactatagggatttggtggtgccttcgttttctccttggaaacagaggagatccaagatgaaaacgaagaacctggcggcagcgcaaaagatg

SEQ ID NO: 224014 - DNA, 103 bp, Artificial Sequence
  Synthetic Polynucleotide
taatacgactcactatagggcattttttacatttggtggtgccttcgtttaacagaggagaaaacgaatgcaccaccaaaacctggcggcagcgcaaaagatg

SEQ ID NO: 224015 - DNA, 103 bp, Artificial Sequence
  Synthetic Polynucleotide
taatacgactcactatagggaagggaccttcattttttacatttggtggtaacagaggagaaccaccatgtgtaaaaaaaacctggcggcagcgcaaaagatg

SEQ ID NO: 224016 - DNA, 103 bp, Artificial Sequence
  Synthetic Polynucleotide
taatacgactcactatagggtactacattcaagggaccttcattttttacaacagaggagagtaaaaatggaaggtcccaacctggcggcagcgcaaaagatg

SEQ ID NO: 224017 - DNA, 103 bp, Artificial Sequence
  Synthetic Polynucleotide
taatacgactcactatagggtctctgtttttactacattcaagggaccttaacagaggagaaaggtcatgtgaatgtagaacctggcggcagcgcaaaagatg

SEQ ID NO: 224018 - DNA, 103 bp, Artificial Sequence
  Synthetic Polynucleotide
taatacgactcactataggggacttcaagggctcacagactcccccagcaaacagaggagatgctggatgagtctgtgaaacctggcggcagcgcaaaagatg

SEQ ID NO: 224019 - DNA, 103 bp, Artificial Sequence
  Synthetic Polynucleotide
taatacgactcactatagggctatcaactttctctgtttttactacattcaacagaggagagaatgtatgaaaaacagaaacctggcggcagcgcaaaagatg

SEQ ID NO: 224020 - DNA, 103 bp, Artificial Sequence
  Synthetic Polynucleotide
taatacgactcactatagggttgagtacttctatcaactttctctgttttaacagaggagaaaaacaatgaaagttgataacctggcggcagcgcaaaagatg

SEQ ID NO: 224021 - DNA, 103 bp, Artificial Sequence
  Synthetic Polynucleotide
taatacgactcactatagggaaagttcatcttgagtacttctatcaacttaacagaggagaaagttgatggaagtactcaacctggcggcagcgcaaaagatg

SEQ ID NO: 224022 - DNA, 103 bp, Artificial Sequence
  Synthetic Polynucleotide
taatacgactcactatagggcattttgttgaaagttcatcttgagtacttaacagaggagaaagtacatgagatgaactaacctggcggcagcgcaaaagatg

SEQ ID NO: 224023 - DNA, 103 bp, Artificial Sequence
  Synthetic Polynucleotide
taatacgactcactatagggacagtgcacacattttgttgaaagttcatcaacagaggagagatgaaatgtcaacaaaaaacctggcggcagcgcaaaagatg

SEQ ID NO: 224024 - DNA, 103 bp, Artificial Sequence
  Synthetic Polynucleotide
taatacgactcactatagggagacaatgccacagtgcacacattttgttgaacagaggagacaacaaatggtgtgcactaacctggcggcagcgcaaaagatg

SEQ ID NO: 224025 - DNA, 103 bp, Artificial Sequence
  Synthetic Polynucleotide
taatacgactcactatagggtcatccagaaagacaatgccacagtgcacaaacagaggagatgtgcaatgtggcattgtaacctggcggcagcgcaaaagatg

SEQ ID NO: 224026 - DNA, 103 bp, Artificial Sequence
  Synthetic Polynucleotide
taatacgactcactatagggatacatcacttcatccagaaagacaatgccaacagaggagaggcattatgtttctggataacctggcggcagcgcaaaagatg

SEQ ID NO: 224027 - DNA, 103 bp, Artificial Sequence
  Synthetic Polynucleotide
taatacgactcactatagggtatgcaaagcatacatcacttcatccagaaaacagaggagattctggatgaagtgatgtaacctggcggcagcgcaaaagatg

SEQ ID NO: 224028 - DNA, 103 bp, Artificial Sequence
  Synthetic Polynucleotide
taatacgactcactatagggtggcaactcatatgcaaagcatacatcactaacagaggagaagtgatatgtgctttgcaaacctggcggcagcgcaaaagatg

SEQ ID NO: 224029 - DNA, 103 bp, Artificial Sequence
  Synthetic Polynucleotide
taatacgactcactatagggtctttgcggagacttcaagggctcacagacaacagaggagagtctgtatgcccttgaagaacctggcggcagcgcaaaagatg

SEQ ID NO: 224030 - DNA, 103 bp, Artificial Sequence
  Synthetic Polynucleotide
taatacgactcactatagggactgtcaccatggcaactcatatgcaaagcaacagaggagagctttgatgatgagttgcaacctggcggcagcgcaaaagatg

SEQ ID NO: 224031 - DNA, 103 bp, Artificial Sequence
  Synthetic Polynucleotide
taatacgactcactatagggggaaaggtccactgtcaccatggcaactcaaacagaggagatgagttatgatggtgacaaacctggcggcagcgcaaaagatg

SEQ ID NO: 224032 - DNA, 103 bp, Artificial Sequence
  Synthetic Polynucleotide
taatacgactcactatagggatgctgcactggaaaggtccactgtcaccaaacagaggagatggtgaatgtggacctttaacctggcggcagcgcaaaagatg

SEQ ID NO: 224033 - DNA, 103 bp, Artificial Sequence
  Synthetic Polynucleotide
taatacgactcactatagggatgctggcatatgctgcactggaaaggtccaacagaggagaggacctatgcagtgcagcaacctggcggcagcgcaaaagatg

SEQ ID NO: 224034 - DNA, 103 bp, Artificial Sequence
  Synthetic Polynucleotide
taatacgactcactatagggccgtgcaaagatgctggcatatgctgcactaacagaggagaagtgcaatgtatgccagcaacctggcggcagcgcaaaagatg

SEQ ID NO: 224035 - DNA, 103 bp, Artificial Sequence
  Synthetic Polynucleotide
taatacgactcactatagggtcatatttgtccgtgcaaagatgctggcataacagaggagaatgccaatgtctttgcacaacctggcggcagcgcaaaagatg

SEQ ID NO: 224036 - DNA, 103 bp, Artificial Sequence
  Synthetic Polynucleotide
taatacgactcactatagggtgttgtgaagtcatatttgtccgtgcaaagaacagaggagactttgcatggacaaatataacctggcggcagcgcaaaagatg

SEQ ID NO: 224037 - DNA, 103 bp, Artificial Sequence
  Synthetic Polynucleotide
taatacgactcactatagggtctggatatgtgttgtgaagtcatatttgtaacagaggagaacaaatatgacttcacaaaacctggcggcagcgcaaaagatg

SEQ ID NO: 224038 - DNA, 103 bp, Artificial Sequence
  Synthetic Polynucleotide
taatacgactcactatagggtgcaggcccctctggatatgtgttgtgaagaacagaggagacttcacatgacatatccaaacctggcggcagcgcaaaagatg

SEQ ID NO: 224039 - DNA, 103 bp, Artificial Sequence
  Synthetic Polynucleotide
taatacgactcactatagggattgttcctatgcaggcccctctggatatgaacagaggagacatatcatgaggggcctgaacctggcggcagcgcaaaagatg

SEQ ID NO: 224040 - DNA, 103 bp, Artificial Sequence
  Synthetic Polynucleotide
taatacgactcactatagggctgcctctgctctttgcggagacttcaaggaacagaggagaccttgaatgctccgcaaaaacctggcggcagcgcaaaagatg

SEQ ID NO: 224041 - DNA, 103 bp, Artificial Sequence
  Synthetic Polynucleotide
taatacgactcactatagggccacttgtgcattgttcctatgcaggccccaacagaggagaggggccatgataggaacaaacctggcggcagcgcaaaagatg

SEQ ID NO: 224042 - DNA, 103 bp, Artificial Sequence
  Synthetic Polynucleotide
taatacgactcactatagggccatttttttccacttgtgcattgttcctaaacagaggagataggaaatgtgcacaagtaacctggcggcagcgcaaaagatg

SEQ ID NO: 224043 - DNA, 103 bp, Artificial Sequence
  Synthetic Polynucleotide
taatacgactcactatagggtttaggttttccatttttttccacttgtgcaacagaggagagcacaaatggaaaaaaataacctggcggcagcgcaaaagatg

SEQ ID NO: 224044 - DNA, 103 bp, Artificial Sequence
  Synthetic Polynucleotide
taatacgactcactatagggtgagggtcatctgcctctgctctttgcggaaacagaggagatccgcaatgagcagaggcaacctggcggcagcgcaaaagatg

SEQ ID NO: 224045 - DNA, 103 bp, Artificial Sequence
  Synthetic Polynucleotide
taatacgactcactataggggatctggccctcgccttcacttgcaacgttaacagaggagaaacgttatgagtgaaggcaacctggcggcagcgcaaaagatg

SEQ ID NO: 224046 - DNA, 103 bp, Artificial Sequence
  Synthetic Polynucleotide
taatacgactcactatagggggccatatcttgagggtcatctgcctctgcaacagaggagagcagagatggatgaccctaacctggcggcagcgcaaaagatg

SEQ ID NO: 224047 - DNA, 103 bp, Artificial Sequence
  Synthetic Polynucleotide
taatacgactcactatagggagggggtgcaggccatatcttgagggtcataacagaggagaatgaccatgaagatatggaacctggcggcagcgcaaaagatg

SEQ ID NO: 224048 - DNA, 103 bp, Artificial Sequence
  Synthetic Polynucleotide
taatacgactcactataggggagtcccctgagggggtgcaggccatatctaacagaggagaagatatatgctgcaccccaacctggcggcagcgcaaaagatg

SEQ ID NO: 224049 - DNA, 103 bp, Artificial Sequence
  Synthetic Polynucleotide
taatacgactcactatagggtgtctccagtgagtcccctgagggggtgcaaacagaggagatgcaccatgtcaggggacaacctggcggcagcgcaaaagatg

SEQ ID NO: 224050 - DNA, 103 bp, Artificial Sequence
  Synthetic Polynucleotide
taatacgactcactataggggatcttcctttgtctccagtgagtcccctgaacagaggagacaggggatgcactggagaaacctggcggcagcgcaaaagatg

SEQ ID NO: 224051 - DNA, 103 bp, Artificial Sequence
  Synthetic Polynucleotide
taatacgactcactataggggacatcttctgatcttcctttgtctccagtaacagaggagaactggaatgaaaggaagaaacctggcggcagcgcaaaagatg

SEQ ID NO: 224052 - DNA, 103 bp, Artificial Sequence
  Synthetic Polynucleotide
taatacgactcactatagggagcctttggtgacatcttctgatcttccttaacagaggagaaaggaaatgcagaagatgaacctggcggcagcgcaaaagatg

SEQ ID NO: 224053 - DNA, 103 bp, Artificial Sequence
  Synthetic Polynucleotide
taatacgactcactatagggtttcctctgtagcctttggtgacatcttctaacagaggagaagaagaatgcaccaaaggaacctggcggcagcgcaaaagatg

SEQ ID NO: 224054 - DNA, 103 bp, Artificial Sequence
  Synthetic Polynucleotide
taatacgactcactataggggcttgccctgtttcctctgtagcctttggtaacagaggagaaccaaaatgtacagaggaaacctggcggcagcgcaaaagatg

SEQ ID NO: 224055 - DNA, 103 bp, Artificial Sequence
  Synthetic Polynucleotide
taatacgactcactatagggaccactctgtgcttgccctgtttcctctgtaacagaggagaacagagatgacagggcaaaacctggcggcagcgcaaaagatg

SEQ ID NO: 224056 - DNA, 103 bp, Artificial Sequence
  Synthetic Polynucleotide
taatacgactcactatagggtaggctccaggatctggccctcgccttcacaacagaggagagtgaagatgagggccagaaacctggcggcagcgcaaaagatg

SEQ ID NO: 224057 - DNA, 103 bp, Artificial Sequence
  Synthetic Polynucleotide
taatacgactcactatagggaattggcttgaccactctgtgcttgccctgaacagaggagacagggcatgcacagagtgaacctggcggcagcgcaaaagatg

SEQ ID NO: 224058 - DNA, 103 bp, Artificial Sequence
  Synthetic Polynucleotide
taatacgactcactatagggaaaccttgacaattggcttgaccactctgtaacagaggagaacagagatgtcaagccaaaacctggcggcagcgcaaaagatg

SEQ ID NO: 224059 - DNA, 103 bp, Artificial Sequence
  Synthetic Polynucleotide
taatacgactcactatagggaactgggctcaaaccttgacaattggcttgaacagaggagacaagccatgtgtcaaggtaacctggcggcagcgcaaaagatg

SEQ ID NO: 224060 - DNA, 103 bp, Artificial Sequence
  Synthetic Polynucleotide
taatacgactcactatagggaggccactgaaactgggctcaaaccttgacaacagaggagagtcaagatgtgagcccagaacctggcggcagcgcaaaagatg

SEQ ID NO: 224061 - DNA, 103 bp, Artificial Sequence
  Synthetic Polynucleotide
taatacgactcactataggggggttttttgaggccactgaaactgggctcaacagaggagagagcccatgttcagtggcaacctggcggcagcgcaaaagatg

SEQ ID NO: 224062 - DNA, 103 bp, Artificial Sequence
  Synthetic Polynucleotide
taatacgactcactatagggaggcacttgtgggttttttgaggccactgaaacagaggagatcagtgatgtcaaaaaacaacctggcggcagcgcaaaagatg

SEQ ID NO: 224063 - DNA, 103 bp, Artificial Sequence
  Synthetic Polynucleotide
taatacgactcactatagggccccatctgaaggcacttgtgggttttttgaacagaggagacaaaaaatgcacaagtgcaacctggcggcagcgcaaaagatg

SEQ ID NO: 224064 - DNA, 103 bp, Artificial Sequence
  Synthetic Polynucleotide
taatacgactcactatagggagtcttacacccccatctgaaggcacttgtaacagaggagaacaagtatgttcagatggaacctggcggcagcgcaaaagatg

SEQ ID NO: 224065 - DNA, 103 bp, Artificial Sequence
  Synthetic Polynucleotide
taatacgactcactatagggggatttattcagtcttacacccccatctgaaacagaggagatcagatatgggtgtaagaaacctggcggcagcgcaaaagatg

SEQ ID NO: 224066 - DNA, 103 bp, Artificial Sequence
  Synthetic Polynucleotide
taatacgactcactatagggagtcagttttggatttattcagtcttacacaacagaggagagtgtaaatgtgaataaataacctggcggcagcgcaaaagatg

SEQ ID NO: 224067 - DNA, 103 bp, Artificial Sequence
  Synthetic Polynucleotide
taatacgactcactatagggtctgtacctataggctccaggatctggcccaacagaggagagggccaatgcctggagccaacctggcggcagcgcaaaagatg

SEQ ID NO: 224068 - DNA, 103 bp, Artificial Sequence
  Synthetic Polynucleotide
taatacgactcactatagggttcaccagtaagtcagttttggatttattcaacagaggagagaataaatgcaaaactgaaacctggcggcagcgcaaaagatg

SEQ ID NO: 224069 - DNA, 103 bp, Artificial Sequence
  Synthetic Polynucleotide
taatacgactcactatagggtgggttgtcattcaccagtaagtcagttttaacagaggagaaaaactatgttactggtgaacctggcggcagcgcaaaagatg

SEQ ID NO: 224070 - DNA, 103 bp, Artificial Sequence
  Synthetic Polynucleotide
taatacgactcactataggggtgccgggtctgggttgtcattcaccagtaaacagaggagatactggatgatgacaaccaacctggcggcagcgcaaaagatg

SEQ ID NO: 224071 - DNA, 103 bp, Artificial Sequence
  Synthetic Polynucleotide
taatacgactcactatagggggagacagaggtgccgggtctgggttgtcaaacagaggagatgacaaatgagacccggcaacctggcggcagcgcaaaagatg

SEQ ID NO: 224072 - DNA, 103 bp, Artificial Sequence
  Synthetic Polynucleotide
taatacgactcactatagggctgaagctctggagacagaggtgccgggtcaacagaggagagacccgatgcctctgtctaacctggcggcagcgcaaaagatg

SEQ ID NO: 224073 - DNA, 103 bp, Artificial Sequence
  Synthetic Polynucleotide
taatacgactcactatagggatttaaagtcctgaagctctggagacagagaacagaggagactctgtatgcagagcttcaacctggcggcagcgcaaaagatg

SEQ ID NO: 224074 - DNA, 103 bp, Artificial Sequence
  Synthetic Polynucleotide
taatacgactcactatagggcagatattgcatttaaagtcctgaagctctaacagaggagaagagctatgggactttaaaacctggcggcagcgcaaaagatg

SEQ ID NO: 224075 - DNA, 103 bp, Artificial Sequence
  Synthetic Polynucleotide
taatacgactcactatagggaccatatccacagatattgcatttaaagtcaacagaggagagactttatgtgcaatatcaacctggcggcagcgcaaaagatg

SEQ ID NO: 224076 - DNA, 103 bp, Artificial Sequence
  Synthetic Polynucleotide
taatacgactcactatagggtgccgtagtaaccatatccacagatattgcaacagaggagagcaataatggtggatatgaacctggcggcagcgcaaaagatg

SEQ ID NO: 224077 - DNA, 103 bp, Artificial Sequence
  Synthetic Polynucleotide
taatacgactcactataggggtggggtcgttgccgtagtaaccatatccaaacagaggagatggataatgttactacggaacctggcggcagcgcaaaagatg

SEQ ID NO: 224078 - DNA, 103 bp, Artificial Sequence
  Synthetic Polynucleotide
taatacgactcactatagggtaccttgctttctgtacctataggctccagaacagaggagactggagatgataggtacaaacctggcggcagcgcaaaagatg

SEQ ID NO: 224079 - DNA, 103 bp, Artificial Sequence
  Synthetic Polynucleotide
taatacgactcactatagggaatcagatctgtggggtcgttgccgtagtaaacagaggagatactacatgaacgaccccaacctggcggcagcgcaaaagatg

SEQ ID NO: 224080 - DNA, 103 bp, Artificial Sequence
  Synthetic Polynucleotide
taatacgactcactatagggggaagtgcttaatcagatctgtggggtcgtaacagaggagaacgaccatgcagatctgaaacctggcggcagcgcaaaagatg

SEQ ID NO: 224081 - DNA, 103 bp, Artificial Sequence
  Synthetic Polynucleotide
taatacgactcactatagggtgatactttcggaagtgcttaatcagatctaacagaggagaagatctatgtaagcacttaacctggcggcagcgcaaaagatg

SEQ ID NO: 224082 - DNA, 103 bp, Artificial Sequence
  Synthetic Polynucleotide
taatacgactcactatagggcagtcctaagtgatactttcggaagtgcttaacagaggagaaagcacatgcgaaagtataacctggcggcagcgcaaaagatg

SEQ ID NO: 224083 - DNA, 103 bp, Artificial Sequence
  Synthetic Polynucleotide
taatacgactcactatagggtgcggttatgcagtcctaagtgatactttcaacagaggagagaaagtatgacttaggacaacctggcggcagcgcaaaagatg

SEQ ID NO: 224084 - DNA, 103 bp, Artificial Sequence
  Synthetic Polynucleotide
taatacgactcactatagggtcttgcctggtgcggttatgcagtcctaagaacagaggagacttaggatggcataaccgaacctggcggcagcgcaaaagatg

SEQ ID NO: 224085 - DNA, 103 bp, Artificial Sequence
  Synthetic Polynucleotide
taatacgactcactatagggcagctcagcatcttgcctggtgcggttatgaacagaggagacataacatgaccaggcaaaacctggcggcagcgcaaaagatg

SEQ ID NO: 224086 - DNA, 103 bp, Artificial Sequence
  Synthetic Polynucleotide
taatacgactcactatagggttttgctgtccagctcagcatcttgcctggaacagaggagaccaggcatgatgctgagcaacctggcggcagcgcaaaagatg

SEQ ID NO: 224087 - DNA, 103 bp, Artificial Sequence
  Synthetic Polynucleotide
taatacgactcactatagggagggccaagattttgctgtccagctcagcaaacagaggagatgctgaatgggacagcaaaacctggcggcagcgcaaaagatg

SEQ ID NO: 224088 - DNA, 103 bp, Artificial Sequence
  Synthetic Polynucleotide
taatacgactcactatagggcatgttatgaagggccaagattttgctgtcaacagaggagagacagcatgatcttggccaacctggcggcagcgcaaaagatg

SEQ ID NO: 224089 - DNA, 103 bp, Artificial Sequence
  Synthetic Polynucleotide
taatacgactcactatagggtctttccagataccttgctttctgtacctaaacagaggagataggtaatgaaagcaaggaacctggcggcagcgcaaaagatg

SEQ ID NO: 224090 - DNA, 103 bp, Artificial Sequence
  Synthetic Polynucleotide
taatacgactcactatagggtgaactgcaccatgttatgaagggccaagaaacagaggagatcttggatgttcataacaaacctggcggcagcgcaaaagatg

SEQ ID NO: 224091 - DNA, 103 bp, Artificial Sequence
  Synthetic Polynucleotide
taatacgactcactatagggttggaatggctgaactgcaccatgttatgaaacagaggagatcataaatgggtgcagttaacctggcggcagcgcaaaagatg

SEQ ID NO: 224092 - DNA, 103 bp, Artificial Sequence
  Synthetic Polynucleotide
taatacgactcactatagggctggaagtctttggaatggctgaactgcacaacagaggagagtgcagatgagccattccaacctggcggcagcgcaaaagatg

SEQ ID NO: 224093 - DNA, 103 bp, Artificial Sequence
  Synthetic Polynucleotide
taatacgactcactatagggggttgaccttctggaagtctttggaatggcaacagaggagagccattatgaagacttccaacctggcggcagcgcaaaagatg

SEQ ID NO: 224094 - DNA, 103 bp, Artificial Sequence
  Synthetic Polynucleotide
taatacgactcactatagggaacacagaacggttgaccttctggaagtctaacagaggagaagacttatggaaggtcaaaacctggcggcagcgcaaaagatg

SEQ ID NO: 224095 - DNA, 103 bp, Artificial Sequence
  Synthetic Polynucleotide
taatacgactcactatagggcacaccagaaaacacagaacggttgaccttaacagaggagaaaggtcatgcgttctgtgaacctggcggcagcgcaaaagatg

SEQ ID NO: 224096 - DNA, 103 bp, Artificial Sequence
  Synthetic Polynucleotide
taatacgactcactatagggtgtcctgcagcacaccagaaaacacagaacaacagaggagagttctgatgtttctggtgaacctggcggcagcgcaaaagatg

SEQ ID NO: 224097 - DNA, 103 bp, Artificial Sequence
  Synthetic Polynucleotide
taatacgactcactataggggaagaattgatgtcctgcagcacaccagaaaacagaggagattctggatggctgcaggaaacctggcggcagcgcaaaagatg

SEQ ID NO: 224098 - DNA, 103 bp, Artificial Sequence
  Synthetic Polynucleotide
taatacgactcactatagggaacaggccttgaagaattgatgtcctgcagaacagaggagactgcagatgatcaattctaacctggcggcagcgcaaaagatg

SEQ ID NO: 224099 - DNA, 103 bp, Artificial Sequence
  Synthetic Polynucleotide
taatacgactcactatagggcatttagtaaaacaggccttgaagaattgaaacagaggagatcaattatgcaaggcctgaacctggcggcagcgcaaaagatg

SEQ ID NO: 224100 - DNA, 103 bp, Artificial Sequence
  Synthetic Polynucleotide
taatacgactcactatagggaattctttgttctttccagataccttgcttaacagaggagaaagcaaatgatctggaaaaacctggcggcagcgcaaaagatg

SEQ ID NO: 224101 - DNA, 103 bp, Artificial Sequence
  Synthetic Polynucleotide
taatacgactcactatagggtcataggtcccatttagtaaaacaggccttaacagaggagaaaggccatgtttactaaaaacctggcggcagcgcaaaagatg

SEQ ID NO: 224102 - DNA, 103 bp, Artificial Sequence
  Synthetic Polynucleotide
taatacgactcactatagggcacctgcacatcataggtcccatttagtaaaacagaggagattactaatggggacctataacctggcggcagcgcaaaagatg

SEQ ID NO: 224103 - DNA, 103 bp, Artificial Sequence
  Synthetic Polynucleotide
taatacgactcactatagggcacctgaagtcacctgcacatcataggtccaacagaggagaggacctatgatgtgcaggaacctggcggcagcgcaaaagatg

SEQ ID NO: 224104 - DNA, 103 bp, Artificial Sequence
  Synthetic Polynucleotide
taatacgactcactatagggatgaatgttccacctgaagtcacctgcacaaacagaggagatgtgcaatggacttcaggaacctggcggcagcgcaaaagatg

SEQ ID NO: 224105 - DNA, 103 bp, Artificial Sequence
  Synthetic Polynucleotide
taatacgactcactatagggtccaatgccaatgaatgttccacctgaagtaacagaggagaacttcaatgggaacattcaacctggcggcagcgcaaaagatg

SEQ ID NO: 224106 - DNA, 103 bp, Artificial Sequence
  Synthetic Polynucleotide
taatacgactcactataggggtgttttccgtccaatgccaatgaatgttcaacagaggagagaacatatgttggcattgaacctggcggcagcgcaaaagatg

SEQ ID NO: 224107 - DNA, 103 bp, Artificial Sequence
  Synthetic Polynucleotide
taatacgactcactatagggtggcaatctggtgttttccgtccaatgccaaacagaggagatggcatatgacggaaaacaacctggcggcagcgcaaaagatg

SEQ ID NO: 224108 - DNA, 103 bp, Artificial Sequence
  Synthetic Polynucleotide
taatacgactcactatagggggtgttcccttggcaatctggtgttttccgaacagaggagacggaaaatgccagattgcaacctggcggcagcgcaaaagatg

SEQ ID NO: 224109 - DNA, 103 bp, Artificial Sequence
  Synthetic Polynucleotide
taatacgactcactatagggggaaatacttggtgttcccttggcaatctgaacagaggagacagattatgaagggaacaaacctggcggcagcgcaaaagatg

SEQ ID NO: 224110 - DNA, 103 bp, Artificial Sequence
  Synthetic Polynucleotide
taatacgactcactatagggaatttacagcggaaatacttggtgttccctaacagaggagaagggaaatgcaagtatttaacctggcggcagcgcaaaagatg

SEQ ID NO: 224111 - DNA, 103 bp, Artificial Sequence
  Synthetic Polynucleotide
taatacgactcactataggggactggcgagctggacacgtcctgcatcataacagaggagaatgatgatggacgtgtccaacctggcggcagcgcaaaagatg

SEQ ID NO: 224112 - DNA, 103 bp, Artificial Sequence
  Synthetic Polynucleotide
taatacgactcactataggggcgccgcttgcgtcccccgcgcttgccgctaacagaggagaagcggcatgcgcgggggaaacctggcggcagcgcaaaagatg

SEQ ID NO: 224113 - DNA, 103 bp, Artificial Sequence
  Synthetic Polynucleotide
taatacgactcactataggggcctgctgctgcgccgcttgcgtcccccgcaacagaggagagcggggatggcaagcggcaacctggcggcagcgcaaaagatg

SEQ ID NO: 224114 - DNA, 103 bp, Artificial Sequence
  Synthetic Polynucleotide
taatacgactcactatagggcccgcgctgcgcctgctgctgcgccgcttgaacagaggagacaagcgatgcagcagcagaacctggcggcagcgcaaaagatg

SEQ ID NO: 224115 - DNA, 103 bp, Artificial Sequence
  Synthetic Polynucleotide
taatacgactcactatagggcgcgccgccgcccgcgctgcgcctgctgctaacagaggagaagcagcatgcgcagcgcgaacctggcggcagcgcaaaagatg

SEQ ID NO: 224116 - DNA, 103 bp, Artificial Sequence
  Synthetic Polynucleotide
taatacgactcactatagggcgccgggccccgcgccgccgcccgcgctgcaacagaggagagcagcgatggcggcggcgaacctggcggcagcgcaaaagatg

SEQ ID NO: 224117 - DNA, 103 bp, Artificial Sequence
  Synthetic Polynucleotide
taatacgactcactatagggcccgcggctccgccgggccccgcgccgccgaacagaggagacggcggatgggggcccggaacctggcggcagcgcaaaagatg

SEQ ID NO: 224118 - DNA, 103 bp, Artificial Sequence
  Synthetic Polynucleotide
taatacgactcactataggggacgcccccacccgcggctccgccgggcccaacagaggagagggcccatgggagccgcgaacctggcggcagcgcaaaagatg

SEQ ID NO: 224119 - DNA, 103 bp, Artificial Sequence
  Synthetic Polynucleotide
taatacgactcactatagggcgccgcctccgacgcccccacccgcggctcaacagaggagagagccgatggtgggggcgaacctggcggcagcgcaaaagatg

SEQ ID NO: 224120 - DNA, 103 bp, Artificial Sequence
  Synthetic Polynucleotide
taatacgactcactatagggcccggctcgtcgccgcctccgacgcccccaaacagaggagatgggggatgcggaggcggaacctggcggcagcgcaaaagatg

SEQ ID NO: 224121 - DNA, 103 bp, Artificial Sequence
  Synthetic Polynucleotide
taatacgactcactatagggggccgggctgcccggctcgtcgccgcctccaacagaggagaggaggcatggacgagccgaacctggcggcagcgcaaaagatg

SEQ ID NO: 224122 - DNA, 103 bp, Artificial Sequence
  Synthetic Polynucleotide
taatacgactcactatagggcggccggcgagactggcgagctggacacgtaacagaggagaacgtgtatggctcgccagaacctggcggcagcgcaaaagatg

SEQ ID NO: 224123 - DNA, 103 bp, Artificial Sequence
  Synthetic Polynucleotide
taatacgactcactataggggcttgccctgggccgggctgcccggctcgtaacagaggagaacgagcatggcagcccggaacctggcggcagcgcaaaagatg

SEQ ID NO: 224124 - DNA, 103 bp, Artificial Sequence
  Synthetic Polynucleotide
taatacgactcactatagggttcttgccgcgcttgccctgggccgggctgaacagaggagacagcccatgccagggcaaaacctggcggcagcgcaaaagatg

SEQ ID NO: 224125 - DNA, 103 bp, Artificial Sequence
  Synthetic Polynucleotide
taatacgactcactataggggcccgcagacttcttgccgcgcttgccctgaacagaggagacagggcatgcgcggcaagaacctggcggcagcgcaaaagatg

SEQ ID NO: 224126 - DNA, 103 bp, Artificial Sequence
  Synthetic Polynucleotide
taatacgactcactatagggcgccgccacagcccgcagacttcttgccgcaacagaggagagcggcaatgagtctgcggaacctggcggcagcgcaaaagatg

SEQ ID NO: 224127 - DNA, 103 bp, Artificial Sequence
  Synthetic Polynucleotide
taatacgactcactataggggcgccgccgccgccgccacagcccgcagacaacagaggagagtctgcatgctgtggcggaacctggcggcagcgcaaaagatg

SEQ ID NO: 224128 - DNA, 103 bp, Artificial Sequence
  Synthetic Polynucleotide
taatacgactcactataggggccgccgcccgcgccgccgccgccgccacaaacagaggagatgtggcatgggcggcggcaacctggcggcagcgcaaaagatg

SEQ ID NO: 224129 - DNA, 103 bp, Artificial Sequence
  Synthetic Polynucleotide
taatacgactcactatagggtgctgccgccgccgccgcccgcgccgccgcaacagaggagagcggcgatgcgggcggcgaacctggcggcagcgcaaaagatg

SEQ ID NO: 224130 - DNA, 103 bp, Artificial Sequence
  Synthetic Polynucleotide
taatacgactcactatagggccgccgctgctgctgccgccgccgccgcccaacagaggagagggcggatgcggcggcagaacctggcggcagcgcaaaagatg

SEQ ID NO: 224131 - DNA, 103 bp, Artificial Sequence
  Synthetic Polynucleotide
taatacgactcactatagggcggactcccgccgccgctgctgctgccgccaacagaggagaggcggcatgagcagcggcaacctggcggcagcgcaaaagatg

SEQ ID NO: 224132 - DNA, 103 bp, Artificial Sequence
  Synthetic Polynucleotide
taatacgactcactatagggcgtaagactgcggactcccgccgccgctgcaacagaggagagcagcgatggcgggagtcaacctggcggcagcgcaaaagatg

SEQ ID NO: 224133 - DNA, 103 bp, Artificial Sequence
  Synthetic Polynucleotide
taatacgactcactatagggaggctgtcgtcggccggcgagactggcgagaacagaggagactcgccatgctcgccggcaacctggcggcagcgcaaaagatg

SEQ ID NO: 224134 - DNA, 103 bp, Artificial Sequence
  Synthetic Polynucleotide
taatacgactcactatagggtgcagctcctcgtaagactgcggactcccgaacagaggagacgggagatggcagtcttaaacctggcggcagcgcaaaagatg

SEQ ID NO: 224135 - DNA, 103 bp, Artificial Sequence
  Synthetic Polynucleotide
taatacgactcactatagggccgctgcgtctgcagctcctcgtaagactgaacagaggagacagtctatggaggagctgaacctggcggcagcgcaaaagatg

SEQ ID NO: 224136 - DNA, 103 bp, Artificial Sequence
  Synthetic Polynucleotide
taatacgactcactatagggtggccatgacccgctgcgtctgcagctcctaacagaggagaaggagcatgagacgcagcaacctggcggcagcgcaaaagatg

SEQ ID NO: 224137 - DNA, 103 bp, Artificial Sequence
  Synthetic Polynucleotide
taatacgactcactatagggtcccgcacgttggccatgacccgctgcgtcaacagaggagagacgcaatgggtcatggcaacctggcggcagcgcaaaagatg

SEQ ID NO: 224138 - DNA, 103 bp, Artificial Sequence
  Synthetic Polynucleotide
taatacgactcactataggggcgctggcgctcccgcacgttggccatgacaacagaggagagtcatgatgaacgtgcggaacctggcggcagcgcaaaagatg

SEQ ID NO: 224139 - DNA, 103 bp, Artificial Sequence
  Synthetic Polynucleotide
taatacgactcactataggggcgactgggtgcgctggcgctcccgcacgtaacagaggagaacgtgcatgagcgccagcaacctggcggcagcgcaaaagatg

SEQ ID NO: 224140 - DNA, 103 bp, Artificial Sequence
  Synthetic Polynucleotide
taatacgactcactataggggcctcgttcagcgactgggtgcgctggcgcaacagaggagagcgccaatgcacccagtcaacctggcggcagcgcaaaagatg

SEQ ID NO: 224141 - DNA, 103 bp, Artificial Sequence
  Synthetic Polynucleotide
taatacgactcactatagggcgcggcgaacgcctcgttcagcgactgggtaacagaggagaacccagatgctgaacgagaacctggcggcagcgcaaaagatg

SEQ ID NO: 224142 - DNA, 103 bp, Artificial Sequence
  Synthetic Polynucleotide
taatacgactcactatagggtcttccgcagcgcggcgaacgcctcgttcaaacagaggagatgaacgatgcgttcgccgaacctggcggcagcgcaaaagatg

SEQ ID NO: 224143 - DNA, 103 bp, Artificial Sequence
  Synthetic Polynucleotide
taatacgactcactataggggtggggatgatcttccgcagcgcggcgaacaacagaggagagttcgcatggctgcggaaaacctggcggcagcgcaaaagatg

SEQ ID NO: 224144 - DNA, 103 bp, Artificial Sequence
  Synthetic Polynucleotide
taatacgactcactataggggctgttgctcaggctgtcgtcggccggcgaaacagaggagatcgccgatggacgacagcaacctggcggcagcgcaaaagatg

SEQ ID NO: 224145 - DNA, 103 bp, Artificial Sequence
  Synthetic Polynucleotide
taatacgactcactatagggcgagggcagcgtggggatgatcttccgcagaacagaggagactgcggatgatcatccccaacctggcggcagcgcaaaagatg

SEQ ID NO: 224146 - DNA, 103 bp, Artificial Sequence
  Synthetic Polynucleotide
taatacgactcactatagggtcagcttgtccgagggcagcgtggggatgaaacagaggagatcatccatgcgctgccctaacctggcggcagcgcaaaagatg

SEQ ID NO: 224147 - DNA, 103 bp, Artificial Sequence
  Synthetic Polynucleotide
taatacgactcactatagggtgaatcttgctcagcttgtccgagggcagcaacagaggagagctgccatgggacaagctaacctggcggcagcgcaaaagatg

SEQ ID NO: 224148 - DNA, 103 bp, Artificial Sequence
  Synthetic Polynucleotide
taatacgactcactatagggcttgagggtctgaatcttgctcagcttgtcaacagaggagagacaagatgagcaagattaacctggcggcagcgcaaaagatg

SEQ ID NO: 224149 - DNA, 103 bp, Artificial Sequence
  Synthetic Polynucleotide
taatacgactcactatagggtggccgccagcttgagggtctgaatcttgcaacagaggagagcaagaatgagaccctcaaacctggcggcagcgcaaaagatg

SEQ ID NO: 224150 - DNA, 103 bp, Artificial Sequence
  Synthetic Polynucleotide
taatacgactcactatagggtcgatgtacctggccgccagcttgagggtcaacagaggagagaccctatggctggcggcaacctggcggcagcgcaaaagatg

SEQ ID NO: 224151 - DNA, 103 bp, Artificial Sequence
  Synthetic Polynucleotide
taatacgactcactataggggtagaggaagtcgatgtacctggccgccagaacagaggagactggcgatgaggtacatcaacctggcggcagcgcaaaagatg

SEQ ID NO: 224152 - DNA, 103 bp, Artificial Sequence
  Synthetic Polynucleotide
taatacgactcactatagggggaggacctggtagaggaagtcgatgtaccaacagaggagaggtacaatgacttcctctaacctggcggcagcgcaaaagatg

SEQ ID NO: 224153 - DNA, 103 bp, Artificial Sequence
  Synthetic Polynucleotide
taatacgactcactatagggtcgtcgctctggaggacctggtagaggaagaacagaggagacttcctatgccaggtcctaacctggcggcagcgcaaaagatg

SEQ ID NO: 224154 - DNA, 103 bp, Artificial Sequence
  Synthetic Polynucleotide
taatacgactcactatagggggagtccagctcgtcgctctggaggacctgaacagaggagacaggtcatgcagagcgacaacctggcggcagcgcaaaagatg

SEQ ID NO: 224155 - DNA, 103 bp, Artificial Sequence
  Synthetic Polynucleotide
taatacgactcactataggggctcttcctcgctgttgctcaggctgtcgtaacagaggagaacgacaatgtgagcaacaaacctggcggcagcgcaaaagatg

SEQ ID NO: 224156 - DNA, 103 bp, Artificial Sequence
  Synthetic Polynucleotide
taatacgactcactatagggttgccatcttggagtccagctcgtcgctctaacagaggagaagagcgatgagctggactaacctggcggcagcgcaaaagatg

SEQ ID NO: 224157 - DNA, 103 bp, Artificial Sequence
  Synthetic Polynucleotide
taatacgactcactatagggtagctgcagcttgccatcttggagtccagcaacagaggagagctggaatgcaagatggcaacctggcggcagcgcaaaagatg

SEQ ID NO: 224158 - DNA, 103 bp, Artificial Sequence
  Synthetic Polynucleotide
taatacgactcactataggggtgagccacatagctgcagcttgccatcttaacagaggagaaagatgatgagctgcagcaacctggcggcagcgcaaaagatg

SEQ ID NO: 224159 - DNA, 103 bp, Artificial Sequence
  Synthetic Polynucleotide
taatacgactcactatagggtgagccgctcgtgagccacatagctgcagcaacagaggagagctgcaatgatgtggctcaacctggcggcagcgcaaaagatg

SEQ ID NO: 224160 - DNA, 103 bp, Artificial Sequence
  Synthetic Polynucleotide
taatacgactcactatagggaaggcgtagctgagccgctcgtgagccacaaacagaggagatgtggcatgcgagcggctaacctggcggcagcgcaaaagatg

SEQ ID NO: 224161 - DNA, 103 bp, Artificial Sequence
  Synthetic Polynucleotide
taatacgactcactatagggccagaccgagaaggcgtagctgagccgctcaacagaggagagagcggatgagctacgccaacctggcggcagcgcaaaagatg

SEQ ID NO: 224162 - DNA, 103 bp, Artificial Sequence
  Synthetic Polynucleotide
taatacgactcactatagggcctccatcctccagaccgagaaggcgtagcaacagaggagagctacgatgtctcggtctaacctggcggcagcgcaaaagatg

SEQ ID NO: 224163 - DNA, 103 bp, Artificial Sequence
  Synthetic Polynucleotide
taatacgactcactataggggaccaggccccctccatcctccagaccgagaacagaggagactcggtatggaggatggaaacctggcggcagcgcaaaagatg

SEQ ID NO: 224164 - DNA, 103 bp, Artificial Sequence
  Synthetic Polynucleotide
taatacgactcactatagggcgcggacatggaccaggccccctccatcctaacagaggagaaggatgatgggggcctggaacctggcggcagcgcaaaagatg

SEQ ID NO: 224165 - DNA, 103 bp, Artificial Sequence
  Synthetic Polynucleotide
taatacgactcactatagggtgccggtctggctcttcctcgctgttgctcaacagaggagagagcaaatgcgaggaagaaacctggcggcagcgcaaaagatg

SEQ ID NO: 224166 - DNA, 103 bp, Artificial Sequence
  Synthetic Polynucleotide
taatacgactcactatagggcggcggctgctgccggtctggctcttcctcaacagaggagagaggaaatgccagaccggaacctggcggcagcgcaaaagatg

SEQ ID NO: 224167 - DNA, 103 bp, Artificial Sequence
  Synthetic Polynucleotide
taatacgactcactataggggcttgccgctcggcggctgctgccggtctgaacagaggagacagaccatgagcagccgcaacctggcggcagcgcaaaagatg

SEQ ID NO: 224168 - DNA, 103 bp, Artificial Sequence
  Synthetic Polynucleotide
taatacgactcactatagggcgtcccccgcgcttgccgctcggcggctgcaacagaggagagcagccatggagcggcaaaacctggcggcagcgcaaaagatg

SEQ ID NO: 224169 - DNA, 103 bp, Artificial Sequence
  Synthetic Polynucleotide
taatacgactcactatagggctggatggtgttataggaggaaaggatcataacagaggagaatgatcatgtcctcctataacctggcggcagcgcaaaagatg

SEQ ID NO: 224170 - DNA, 103 bp, Artificial Sequence
  Synthetic Polynucleotide
taatacgactcactatagggttctggaagctcttcatctgtgctcaggctaacagaggagaagcctgatgacagatgaaaacctggcggcagcgcaaaagatg

SEQ ID NO: 224171 - DNA, 103 bp, Artificial Sequence
  Synthetic Polynucleotide
taatacgactcactataggggtaaaggggcttccgctgtatacagactccaacagaggagaggagtcatgatacagcggaacctggcggcagcgcaaaagatg

SEQ ID NO: 224172 - DNA, 103 bp, Artificial Sequence
  Synthetic Polynucleotide
taatacgactcactatagggctgtcacaatgtaaaggggcttccgctgtaaacagaggagatacagcatgagcccctttaacctggcggcagcgcaaaagatg

SEQ ID NO: 224173 - DNA, 103 bp, Artificial Sequence
  Synthetic Polynucleotide
taatacgactcactatagggtccatgaactctgtcacaatgtaaaggggcaacagaggagagcccctatgcattgtgacaacctggcggcagcgcaaaagatg

SEQ ID NO: 224174 - DNA, 103 bp, Artificial Sequence
  Synthetic Polynucleotide
taatacgactcactataggggcagccattttccatgaactctgtcacaataacagaggagaattgtgatggagttcatgaacctggcggcagcgcaaaagatg

SEQ ID NO: 224175 - DNA, 103 bp, Artificial Sequence
  Synthetic Polynucleotide
taatacgactcactatagggagttaagcaggcagccattttccatgaactaacagaggagaagttcaatgaaaatggctaacctggcggcagcgcaaaagatg

SEQ ID NO: 224176 - DNA, 103 bp, Artificial Sequence
  Synthetic Polynucleotide
taatacgactcactatagggtccctgagatagttaagcaggcagccatttaacagaggagaaaatggatgcctgcttaaaacctggcggcagcgcaaaagatg

SEQ ID NO: 224177 - DNA, 103 bp, Artificial Sequence
  Synthetic Polynucleotide
taatacgactcactatagggtcctttattctccctgagatagttaagcagaacagaggagactgcttatgtatctcaggaacctggcggcagcgcaaaagatg

SEQ ID NO: 224178 - DNA, 103 bp, Artificial Sequence
  Synthetic Polynucleotide
taatacgactcactatagggtcctaagctttcctttattctccctgagataacagaggagaatctcaatgagaataaagaacctggcggcagcgcaaaagatg

SEQ ID NO: 224179 - DNA, 103 bp, Artificial Sequence
  Synthetic Polynucleotide
taatacgactcactatagggagcatttccttcctaagctttcctttattcaacagaggagagaataaatgaaagcttagaacctggcggcagcgcaaaagatg

SEQ ID NO: 224180 - DNA, 103 bp, Artificial Sequence
  Synthetic Polynucleotide
taatacgactcactatagggtacactcagtagcatttccttcctaagcttaacagaggagaaagcttatgaaggaaatgaacctggcggcagcgcaaaagatg

SEQ ID NO: 224181 - DNA, 103 bp, Artificial Sequence
  Synthetic Polynucleotide
taatacgactcactataggggggtgtatttttctggaagctcttcatctgaacagaggagacagatgatgagcttccagaacctggcggcagcgcaaaagatg

SEQ ID NO: 224182 - DNA, 103 bp, Artificial Sequence
  Synthetic Polynucleotide
taatacgactcactatagggtatcctggcatacactcagtagcatttcctaacagaggagaaggaaaatgtactgagtgaacctggcggcagcgcaaaagatg

SEQ ID NO: 224183 - DNA, 103 bp, Artificial Sequence
  Synthetic Polynucleotide
taatacgactcactatagggccttcacatatatcctggcatacactcagtaacagaggagaactgagatgatgccaggaaacctggcggcagcgcaaaagatg

SEQ ID NO: 224184 - DNA, 103 bp, Artificial Sequence
  Synthetic Polynucleotide
taatacgactcactatagggatattccattccttcacatatatcctggcaaacagaggagatgccagatgatatgtgaaaacctggcggcagcgcaaaagatg

SEQ ID NO: 224185 - DNA, 103 bp, Artificial Sequence
  Synthetic Polynucleotide
taatacgactcactatagggtcctctccagatattccattccttcacataaacagaggagatatgtgatggaatggaataacctggcggcagcgcaaaagatg

SEQ ID NO: 224186 - DNA, 103 bp, Artificial Sequence
  Synthetic Polynucleotide
taatacgactcactatagggatatagccattcctctccagatattccattaacagaggagaaatggaatgtctggagagaacctggcggcagcgcaaaagatg

SEQ ID NO: 224187 - DNA, 103 bp, Artificial Sequence
  Synthetic Polynucleotide
taatacgactcactatagggatccctatgaatatagccattcctctccagaacagaggagactggagatgaatggctataacctggcggcagcgcaaaagatg

SEQ ID NO: 224188 - DNA, 103 bp, Artificial Sequence
  Synthetic Polynucleotide
taatacgactcactatagggttgccgccaaatccctatgaatatagccataacagaggagaatggctatgttcatagggaacctggcggcagcgcaaaagatg

SEQ ID NO: 224189 - DNA, 103 bp, Artificial Sequence
  Synthetic Polynucleotide
taatacgactcactatagggaaacaattccttgccgccaaatccctatgaaacagaggagatcatagatgtttggcggcaacctggcggcagcgcaaaagatg

SEQ ID NO: 224190 - DNA, 103 bp, Artificial Sequence
  Synthetic Polynucleotide
taatacgactcactatagggtgaactgaccaaacaattccttgccgccaaaacagaggagattggcgatgaggaattgtaacctggcggcagcgcaaaagatg

SEQ ID NO: 224191 - DNA, 103 bp, Artificial Sequence
  Synthetic Polynucleotide
taatacgactcactatagggctatgcatgttgaactgaccaaacaattccaacagaggagaggaattatgtggtcagttaacctggcggcagcgcaaaagatg

SEQ ID NO: 224192 - DNA, 103 bp, Artificial Sequence
  Synthetic Polynucleotide
taatacgactcactatagggctgcgacgctgggtgtatttttctggaagcaacagaggagagcttccatgaaaatacacaacctggcggcagcgcaaaagatg

SEQ ID NO: 224193 - DNA, 103 bp, Artificial Sequence
  Synthetic Polynucleotide
taatacgactcactataggggaaatttttactatgcatgttgaactgaccaacagaggagaggtcagatgaacatgcataacctggcggcagcgcaaaagatg

SEQ ID NO: 224194 - DNA, 103 bp, Artificial Sequence
  Synthetic Polynucleotide
taatacgactcactatagggtccaaagtctgaaatttttactatgcatgtaacagaggagaacatgcatggtaaaaattaacctggcggcagcgcaaaagatg

SEQ ID NO: 224195 - DNA, 103 bp, Artificial Sequence
  Synthetic Polynucleotide
taatacgactcactatagggaccttgtcattccaaagtctgaaatttttaaacagaggagataaaaaatgcagactttgaacctggcggcagcgcaaaagatg

SEQ ID NO: 224196 - DNA, 103 bp, Artificial Sequence
  Synthetic Polynucleotide
taatacgactcactatagggtccaaaacgtaccttgtcattccaaagtctaacagaggagaagacttatgaatgacaagaacctggcggcagcgcaaaagatg

SEQ ID NO: 224197 - DNA, 103 bp, Artificial Sequence
  Synthetic Polynucleotide
taatacgactcactatagggatactcatcatccaaaacgtaccttgtcataacagaggagaatgacaatgtacgttttgaacctggcggcagcgcaaaagatg

SEQ ID NO: 224198 - DNA, 103 bp, Artificial Sequence
  Synthetic Polynucleotide
taatacgactcactatagggaagaactgacatactcatcatccaaaacgtaacagaggagaacgtttatgatgatgagtaacctggcggcagcgcaaaagatg

SEQ ID NO: 224199 - DNA, 103 bp, Artificial Sequence
  Synthetic Polynucleotide
taatacgactcactatagggttggctccaaaagaactgacatactcatcaaacagaggagatgatgaatgtgtcagttcaacctggcggcagcgcaaaagatg

SEQ ID NO: 224200 - DNA, 103 bp, Artificial Sequence
  Synthetic Polynucleotide
taatacgactcactataggggattgggaacttggctccaaaagaactgacaacagaggagagtcagtatgtttggagccaacctggcggcagcgcaaaagatg

SEQ ID NO: 224201 - DNA, 103 bp, Artificial Sequence
  Synthetic Polynucleotide
taatacgactcactataggggggaccacttgattgggaacttggctccaaaacagaggagattggagatgagttcccaaaacctggcggcagcgcaaaagatg

SEQ ID NO: 224202 - DNA, 103 bp, Artificial Sequence
  Synthetic Polynucleotide
taatacgactcactatagggacttcaggaggggaccacttgattgggaacaacagaggagagttcccatgcaagtggtcaacctggcggcagcgcaaaagatg

SEQ ID NO: 224203 - DNA, 103 bp, Artificial Sequence
  Synthetic Polynucleotide
taatacgactcactataggggagccacggcctgcgacgctgggtgtatttaacagaggagaaaatacatgcagcgtcgcaacctggcggcagcgcaaaagatg

SEQ ID NO: 224204 - DNA, 103 bp, Artificial Sequence
  Synthetic Polynucleotide
taatacgactcactataggggaaaagaaaaacttcaggaggggaccacttaacagaggagaaagtggatgcctcctgaaaacctggcggcagcgcaaaagatg

SEQ ID NO: 224205 - DNA, 103 bp, Artificial Sequence
  Synthetic Polynucleotide
taatacgactcactatagggtgtacttattgaaaagaaaaacttcaggagaacagaggagactcctgatgtttttctttaacctggcggcagcgcaaaagatg

SEQ ID NO: 224206 - DNA, 103 bp, Artificial Sequence
  Synthetic Polynucleotide
taatacgactcactataggggatttactgctgtacttattgaaaagaaaaaacagaggagattttctatgcaataagtaaacctggcggcagcgcaaaagatg

SEQ ID NO: 224207 - DNA, 103 bp, Artificial Sequence
  Synthetic Polynucleotide
taatacgactcactatagggccagacatcagatttactgctgtacttattaacagaggagaaataagatgagcagtaaaaacctggcggcagcgcaaaagatg

SEQ ID NO: 224208 - DNA, 103 bp, Artificial Sequence
  Synthetic Polynucleotide
taatacgactcactatagggctccaaatgaccagacatcagatttactgcaacagaggagagcagtaatgctgatgtctaacctggcggcagcgcaaaagatg

SEQ ID NO: 224209 - DNA, 103 bp, Artificial Sequence
  Synthetic Polynucleotide
taatacgactcactatagggcacattaaaactccaaatgaccagacatcaaacagaggagatgatgtatggtcatttggaacctggcggcagcgcaaaagatg

SEQ ID NO: 224210 - DNA, 103 bp, Artificial Sequence
  Synthetic Polynucleotide
taatacgactcactatagggaaaaacttcccacattaaaactccaaatgaaacagaggagatcatttatggttttaatgaacctggcggcagcgcaaaagatg

SEQ ID NO: 224211 - DNA, 103 bp, Artificial Sequence
  Synthetic Polynucleotide
taatacgactcactatagggttccttctgtaaaaacttcccacattaaaaaacagaggagattttaaatggggaagtttaacctggcggcagcgcaaaagatg

SEQ ID NO: 224212 - DNA, 103 bp, Artificial Sequence
  Synthetic Polynucleotide
taatacgactcactatagggaaaggcatttttccttctgtaaaaacttccaacagaggagaggaagtatgtacagaaggaacctggcggcagcgcaaaagatg

SEQ ID NO: 224213 - DNA, 103 bp, Artificial Sequence
  Synthetic Polynucleotide
taatacgactcactatagggcttattttcaaaaggcatttttccttctgtaacagaggagaacagaaatgaaaatgcctaacctggcggcagcgcaaaagatg

SEQ ID NO: 224214 - DNA, 103 bp, Artificial Sequence
  Synthetic Polynucleotide
taatacgactcactatagggacaattggctgagccacggcctgcgacgctaacagaggagaagcgtcatgggccgtggcaacctggcggcagcgcaaaagatg

SEQ ID NO: 224215 - DNA, 103 bp, Artificial Sequence
  Synthetic Polynucleotide
taatacgactcactataggggcaaatttgacttattttcaaaaggcatttaacagaggagaaaatgcatgttgaaaataaacctggcggcagcgcaaaagatg

SEQ ID NO: 224216 - DNA, 103 bp, Artificial Sequence
  Synthetic Polynucleotide
taatacgactcactatagggtccacgacttgcaaatttgacttattttcaaacagaggagatgaaaaatggtcaaatttaacctggcggcagcgcaaaagatg

SEQ ID NO: 224217 - DNA, 103 bp, Artificial Sequence
  Synthetic Polynucleotide
taatacgactcactatagggagaaatagcttccacgacttgcaaatttgaaacagaggagatcaaatatgcaagtcgtgaacctggcggcagcgcaaaagatg

SEQ ID NO: 224218 - DNA, 103 bp, Artificial Sequence
  Synthetic Polynucleotide
taatacgactcactatagggtgaagccttcagaaatagcttccacgacttaacagaggagaaagtcgatgaagctatttaacctggcggcagcgcaaaagatg

SEQ ID NO: 224219 - DNA, 103 bp, Artificial Sequence
  Synthetic Polynucleotide
taatacgactcactatagggcgatatagcctgaagccttcagaaatagctaacagaggagaagctatatgtgaaggcttaacctggcggcagcgcaaaagatg

SEQ ID NO: 224220 - DNA, 103 bp, Artificial Sequence
  Synthetic Polynucleotide
taatacgactcactatagggcaggtgagggcgatatagcctgaagccttcaacagaggagagaaggcatgaggctatataacctggcggcagcgcaaaagatg

SEQ ID NO: 224221 - DNA, 103 bp, Artificial Sequence
  Synthetic Polynucleotide
taatacgactcactatagggacattggtgccaggtgagggcgatatagccaacagaggagaggctatatggccctcaccaacctggcggcagcgcaaaagatg

SEQ ID NO: 224222 - DNA, 103 bp, Artificial Sequence
  Synthetic Polynucleotide
taatacgactcactatagggtcatatatggacattggtgccaggtgagggaacagaggagaccctcaatgggcaccaataacctggcggcagcgcaaaagatg

SEQ ID NO: 224223 - DNA, 103 bp, Artificial Sequence
  Synthetic Polynucleotide
taatacgactcactataggggtacatgacttcatatatggacattggtgcaacagaggagagcaccaatgtccatatataacctggcggcagcgcaaaagatg

SEQ ID NO: 224224 - DNA, 103 bp, Artificial Sequence
  Synthetic Polynucleotide
taatacgactcactataggggccagcagctgtacatgacttcatatatggaacagaggagaccatatatgaagtcatgtaacctggcggcagcgcaaaagatg

SEQ ID NO: 224225 - DNA, 103 bp, Artificial Sequence
  Synthetic Polynucleotide
taatacgactcactatagggttcttatttgacaattggctgagccacggcaacagaggagagccgtgatgcagccaattaacctggcggcagcgcaaaagatg

SEQ ID NO: 224226 - DNA, 103 bp, Artificial Sequence
  Synthetic Polynucleotide
taatacgactcactatagggggtttctcatgccagcagctgtacatgactaacagaggagaagtcatatgcagctgctgaacctggcggcagcgcaaaagatg

SEQ ID NO: 224227 - DNA, 103 bp, Artificial Sequence
  Synthetic Polynucleotide
taatacgactcactataggggcggccttcaggtttctcatgccagcagctaacagaggagaagctgcatgcatgagaaaaacctggcggcagcgcaaaagatg

SEQ ID NO: 224228 - DNA, 103 bp, Artificial Sequence
  Synthetic Polynucleotide
taatacgactcactatagggcaaatgtagggcggccttcaggtttctcataacagaggagaatgagaatgctgaaggccaacctggcggcagcgcaaaagatg

SEQ ID NO: 224229 - DNA, 103 bp, Artificial Sequence
  Synthetic Polynucleotide
taatacgactcactatagggagcagctcggcaaatgtagggcggccttcaaacagaggagatgaaggatgccctacattaacctggcggcagcgcaaaagatg

SEQ ID NO: 224230 - DNA, 103 bp, Artificial Sequence
  Synthetic Polynucleotide
taatacgactcactataggggacagcccgcagcagctcggcaaatgtaggaacagaggagacctacaatggccgagctgaacctggcggcagcgcaaaagatg

SEQ ID NO: 224231 - DNA, 103 bp, Artificial Sequence
  Synthetic Polynucleotide
taatacgactcactatagggcaatctctgtgacagcccgcagcagctcggaacagaggagaccgagcatgtgcgggctgaacctggcggcagcgcaaaagatg

SEQ ID NO: 224232 - DNA, 103 bp, Artificial Sequence
  Synthetic Polynucleotide
taatacgactcactatagggcaggtttccgcaatctctgtgacagcccgcaacagaggagagcgggcatgcacagagataacctggcggcagcgcaaaagatg

SEQ ID NO: 224233 - DNA, 103 bp, Artificial Sequence
  Synthetic Polynucleotide
taatacgactcactataggggttggattgcttcttatttgacaattggctaacagaggagaagccaaatgtcaaataagaacctggcggcagcgcaaaagatg

SEQ ID NO: 224234 - DNA, 103 bp, Artificial Sequence
  Synthetic Polynucleotide
taatacgactcactatagggcacggcccgtgttggattgcttcttatttgaacagaggagacaaataatgagcaatccaaacctggcggcagcgcaaaagatg

SEQ ID NO: 224235 - DNA, 103 bp, Artificial Sequence
  Synthetic Polynucleotide
taatacgactcactataggggacggctgcacacggcccgtgttggattgcaacagaggagagcaatcatgcacgggccgaacctggcggcagcgcaaaagatg

SEQ ID NO: 224236 - DNA, 103 bp, Artificial Sequence
  Synthetic Polynucleotide
taatacgactcactatagggctttcgttttgacggctgcacacggcccgtaacagaggagaacgggcatggtgcagccgaacctggcggcagcgcaaaagatg

SEQ ID NO: 224237 - DNA, 103 bp, Artificial Sequence
  Synthetic Polynucleotide
taatacgactcactatagggagaaaaccgactggatggtgttataggaggaacagaggagacctcctatgacaccatccaacctggcggcagcgcaaaagatg

SEQ ID NO: 224238 - DNA, 103 bp, Artificial Sequence
  Synthetic Polynucleotide
taatacgactcactataggggaggcagtggctttcgttttgacggctgcaaacagaggagatgcagcatgcaaaacgaaaacctggcggcagcgcaaaagatg

SEQ ID NO: 224239 - DNA, 103 bp, Artificial Sequence
  Synthetic Polynucleotide
taatacgactcactatagggggtgggaggggaggcagtggctttcgttttaacagaggagaaaaacgatggccactgccaacctggcggcagcgcaaaagatg

SEQ ID NO: 224240 - DNA, 103 bp, Artificial Sequence
  Synthetic Polynucleotide
taatacgactcactatagggaacctcagagggtgggaggggaggcagtggaacagaggagaccactgatgcccctcccaaacctggcggcagcgcaaaagatg

SEQ ID NO: 224241 - DNA, 103 bp, Artificial Sequence
  Synthetic Polynucleotide
taatacgactcactatagggtctcttcagcaacctcagagggtgggagggaacagaggagaccctccatgcctctgaggaacctggcggcagcgcaaaagatg

SEQ ID NO: 224242 - DNA, 103 bp, Artificial Sequence
  Synthetic Polynucleotide
taatacgactcactatagggacttggatcttctcttcagcaacctcagagaacagaggagactctgaatgtgctgaagaaacctggcggcagcgcaaaagatg

SEQ ID NO: 224243 - DNA, 103 bp, Artificial Sequence
  Synthetic Polynucleotide
taatacgactcactatagggaagtgccttgacttggatcttctcttcagcaacagaggagagctgaaatgaagatccaaaacctggcggcagcgcaaaagatg

SEQ ID NO: 224244 - DNA, 103 bp, Artificial Sequence
  Synthetic Polynucleotide
taatacgactcactataggggaaaatcataaagtgccttgacttggatctaacagaggagaagatccatgtcaaggcacaacctggcggcagcgcaaaagatg

SEQ ID NO: 224245 - DNA, 103 bp, Artificial Sequence
  Synthetic Polynucleotide
taatacgactcactatagggtctctgggcagaaaatcataaagtgccttgaacagaggagacaaggcatgttatgatttaacctggcggcagcgcaaaagatg

SEQ ID NO: 224246 - DNA, 103 bp, Artificial Sequence
  Synthetic Polynucleotide
taatacgactcactatagggattacagggttctctgggcagaaaatcataaacagaggagatatgatatgctgcccagaaacctggcggcagcgcaaaagatg

SEQ ID NO: 224247 - DNA, 103 bp, Artificial Sequence
  Synthetic Polynucleotide
taatacgactcactatagggttaaggctaaattacagggttctctgggcaaacagaggagatgcccaatgaaccctgtaaacctggcggcagcgcaaaagatg

SEQ ID NO: 224248 - DNA, 103 bp, Artificial Sequence
  Synthetic Polynucleotide
taatacgactcactatagggcagcagcaacagaaaaccgactggatggtgaacagaggagacaccatatggtcggttttaacctggcggcagcgcaaaagatg

SEQ ID NO: 224249 - DNA, 103 bp, Artificial Sequence
  Synthetic Polynucleotide
taatacgactcactatagggtctgctctccttaaggctaaattacagggtaacagaggagaaccctgatgtttagccttaacctggcggcagcgcaaaagatg

SEQ ID NO: 224250 - DNA, 103 bp, Artificial Sequence
  Synthetic Polynucleotide
taatacgactcactatagggcaggtattcttctgctctccttaaggctaaaacagaggagattagccatgaggagagcaaacctggcggcagcgcaaaagatg

SEQ ID NO: 224251 - DNA, 103 bp, Artificial Sequence
  Synthetic Polynucleotide
taatacgactcactatagggtctccagtatcaggtattcttctgctctccaacagaggagaggagagatgaagaataccaacctggcggcagcgcaaaagatg

SEQ ID NO: 224252 - DNA, 103 bp, Artificial Sequence
  Synthetic Polynucleotide
taatacgactcactatagggggattgtatttctccagtatcaggtattctaacagaggagaagaataatggatactggaaacctggcggcagcgcaaaagatg

SEQ ID NO: 224253 - DNA, 103 bp, Artificial Sequence
  Synthetic Polynucleotide
taatacgactcactatagggccaccagtgaggattgtatttctccagtataacagaggagaatactgatgaaatacaataacctggcggcagcgcaaaagatg

SEQ ID NO: 224254 - DNA, 103 bp, Artificial Sequence
  Synthetic Polynucleotide
taatacgactcactatagggctcttgccttccaccagtgaggattgtattaacagaggagaaatacaatgctcactggtaacctggcggcagcgcaaaagatg

SEQ ID NO: 224255 - DNA, 103 bp, Artificial Sequence
  Synthetic Polynucleotide
taatacgactcactatagggcccaaacggtctcttgccttccaccagtgaaacagaggagatcactgatggaaggcaagaacctggcggcagcgcaaaagatg

SEQ ID NO: 224256 - DNA, 103 bp, Artificial Sequence
  Synthetic Polynucleotide
taatacgactcactataggggccttcattccccaaacggtctcttgccttaacagaggagaaaggcaatggaccgtttgaacctggcggcagcgcaaaagatg

SEQ ID NO: 224257 - DNA, 103 bp, Artificial Sequence
  Synthetic Polynucleotide
taatacgactcactatagggttgggattaagccttcattccccaaacggtaacagaggagaaccgttatgggaatgaagaacctggcggcagcgcaaaagatg

SEQ ID NO: 224258 - DNA, 103 bp, Artificial Sequence
  Synthetic Polynucleotide
taatacgactcactatagggacatagttgcttgggattaagccttcattcaacagaggagagaatgaatgcttaatcccaacctggcggcagcgcaaaagatg

SEQ ID NO: 224259 - DNA, 103 bp, Artificial Sequence
  Synthetic Polynucleotide
taatacgactcactatagggtgaacagcaacagcagcaacagaaaaccgaaacagaggagatcggttatgtgttgctgcaacctggcggcagcgcaaaagatg

SEQ ID NO: 224260 - DNA, 103 bp, Artificial Sequence
  Synthetic Polynucleotide
taatacgactcactataggggttttcagtcacatagttgcttgggattaaaacagaggagattaatcatgagcaactataacctggcggcagcgcaaaagatg

SEQ ID NO: 224261 - DNA, 103 bp, Artificial Sequence
  Synthetic Polynucleotide
taatacgactcactatagggtagttattttgttttcagtcacatagttgcaacagaggagagcaactatgtgactgaaaaacctggcggcagcgcaaaagatg

SEQ ID NO: 224262 - DNA, 103 bp, Artificial Sequence
  Synthetic Polynucleotide
taatacgactcactatagggatttctaaattagttattttgttttcagtcaacagaggagagactgaatgcaaaataacaacctggcggcagcgcaaaagatg

SEQ ID NO: 224263 - DNA, 103 bp, Artificial Sequence
  Synthetic Polynucleotide
taatacgactcactatagggccactcatatatttctaaattagttattttaacagaggagaaaaataatgaatttagaaaacctggcggcagcgcaaaagatg

SEQ ID NO: 224264 - DNA, 103 bp, Artificial Sequence
  Synthetic Polynucleotide
taatacgactcactatagggttctatggtaccactcatatatttctaaataacagaggagaatttagatgtatatgagtaacctggcggcagcgcaaaagatg

SEQ ID NO: 224265 - DNA, 103 bp, Artificial Sequence
  Synthetic Polynucleotide
taatacgactcactatagggctggtaatgtttctatggtaccactcatataacagaggagaatatgaatggtaccatagaacctggcggcagcgcaaaagatg

SEQ ID NO: 224266 - DNA, 103 bp, Artificial Sequence
  Synthetic Polynucleotide
taatacgactcactatagggtgcctgatttctggtaatgtttctatggtaaacagaggagataccatatgaacattaccaacctggcggcagcgcaaaagatg

SEQ ID NO: 224267 - DNA, 103 bp, Artificial Sequence
  Synthetic Polynucleotide
taatacgactcactatagggatagatgttctgcctgatttctggtaatgtaacagaggagaacattaatggaaatcaggaacctggcggcagcgcaaaagatg

SEQ ID NO: 224268 - DNA, 103 bp, Artificial Sequence
  Synthetic Polynucleotide
taatacgactcactatagggtcttgtctcaatagatgttctgcctgatttaacagaggagaaaatcaatgagaacatctaacctggcggcagcgcaaaagatg

SEQ ID NO: 224269 - DNA, 103 bp, Artificial Sequence
  Synthetic Polynucleotide
taatacgactcactatagggttctttagactcttgtctcaatagatgttcaacagaggagagaacatatgttgagacaaaacctggcggcagcgcaaaagatg

SEQ ID NO: 224270 - DNA, 103 bp, Artificial Sequence
  Synthetic Polynucleotide
taatacgactcactataggggcttctgcactgaacagcaacagcagcaacaacagaggagagttgctatggttgctgttaacctggcggcagcgcaaaagatg

SEQ ID NO: 224271 - DNA, 103 bp, Artificial Sequence
  Synthetic Polynucleotide
taatacgactcactatagggtaaatgcaccttctttagactcttgtctcaaacagaggagatgagacatgagtctaaagaacctggcggcagcgcaaaagatg

SEQ ID NO: 224272 - DNA, 103 bp, Artificial Sequence
  Synthetic Polynucleotide
taatacgactcactatagggtctctgacaataaatgcaccttctttagacaacagaggagagtctaaatgaggtgcattaacctggcggcagcgcaaaagatg

SEQ ID NO: 224273 - DNA, 103 bp, Artificial Sequence
  Synthetic Polynucleotide
taatacgactcactatagggatgtcttgaatctctgacaataaatgcaccaacagaggagaggtgcaatgattgtcagaaacctggcggcagcgcaaaagatg

SEQ ID NO: 224274 - DNA, 103 bp, Artificial Sequence
  Synthetic Polynucleotide
taatacgactcactatagggaggatcctaaatgtcttgaatctctgacaaaacagaggagattgtcaatgattcaagacaacctggcggcagcgcaaaagatg

SEQ ID NO: 224275 - DNA, 103 bp, Artificial Sequence
  Synthetic Polynucleotide
taatacgactcactataggggaaattgtgtaggatcctaaatgtcttgaaaacagaggagattcaagatgtttaggatcaacctggcggcagcgcaaaagatg

SEQ ID NO: 224276 - DNA, 103 bp, Artificial Sequence
  Synthetic Polynucleotide
taatacgactcactatagggcataaatacggaaattgtgtaggatcctaaaacagaggagattaggaatgtacacaattaacctggcggcagcgcaaaagatg

SEQ ID NO: 224277 - DNA, 103 bp, Artificial Sequence
  Synthetic Polynucleotide
taatacgactcactatagggttctagctcccataaatacggaaattgtgtaacagaggagaacacaaatgccgtatttaaacctggcggcagcgcaaaagatg

SEQ ID NO: 224278 - DNA, 103 bp, Artificial Sequence
  Synthetic Polynucleotide
taatacgactcactatagggtccgtacttcttctagctcccataaatacgaacagaggagacgtattatggggagctagaacctggcggcagcgcaaaagatg

SEQ ID NO: 224279 - DNA, 103 bp, Artificial Sequence
  Synthetic Polynucleotide
taatacgactcactatagggtatggcagcctccgtacttcttctagctccaacagaggagaggagctatgagaagtacgaacctggcggcagcgcaaaagatg

SEQ ID NO: 224280 - DNA, 103 bp, Artificial Sequence
  Synthetic Polynucleotide
taatacgactcactataggggataatgttttatggcagcctccgtacttcaacagaggagagaagtaatgaggctgccaaacctggcggcagcgcaaaagatg

SEQ ID NO: 224281 - DNA, 103 bp, Artificial Sequence
  Synthetic Polynucleotide
taatacgactcactatagggctcatttgtcgcttctgcactgaacagcaaaacagaggagattgctgatgagtgcagaaaacctggcggcagcgcaaaagatg

SEQ ID NO: 224282 - DNA, 103 bp, Artificial Sequence
  Synthetic Polynucleotide
taatacgactcactatagggttttttatctgataatgttttatggcagccaacagaggagaggctgcatgaaaacattaaacctggcggcagcgcaaaagatg

SEQ ID NO: 224283 - DNA, 103 bp, Artificial Sequence
  Synthetic Polynucleotide
taatacgactcactatagggtgagtcattcttttttatctgataatgtttaacagaggagaaaacatatgcagataaaaaacctggcggcagcgcaaaagatg

SEQ ID NO: 224284 - DNA, 103 bp, Artificial Sequence
  Synthetic Polynucleotide
taatacgactcactatagggaccactgtcctgagtcattcttttttatctaacagaggagaagataaatgagaatgactaacctggcggcagcgcaaaagatg

SEQ ID NO: 224285 - DNA, 103 bp, Artificial Sequence
  Synthetic Polynucleotide
taatacgactcactatagggtcagccacataccactgtcctgagtcattcaacagaggagagaatgaatgaggacagtgaacctggcggcagcgcaaaagatg

SEQ ID NO: 224286 - DNA, 103 bp, Artificial Sequence
  Synthetic Polynucleotide
taatacgactcactatagggggcgtgtctttcagccacataccactgtccaacagaggagaggacagatgtatgtggctaacctggcggcagcgcaaaagatg

SEQ ID NO: 224287 - DNA, 103 bp, Artificial Sequence
  Synthetic Polynucleotide
taatacgactcactatagggttgattgaaaggcgtgtctttcagccacataacagaggagaatgtggatgaaagacacgaacctggcggcagcgcaaaagatg

SEQ ID NO: 224288 - DNA, 103 bp, Artificial Sequence
  Synthetic Polynucleotide
taatacgactcactatagggaactcagggattgattgaaaggcgtgtcttaacagaggagaaagacaatgctttcaatcaacctggcggcagcgcaaaagatg

SEQ ID NO: 224289 - DNA, 103 bp, Artificial Sequence
  Synthetic Polynucleotide
taatacgactcactatagggataccagattaactcagggattgattgaaaaacagaggagatttcaaatgatccctgagaacctggcggcagcgcaaaagatg

SEQ ID NO: 224290 - DNA, 103 bp, Artificial Sequence
  Synthetic Polynucleotide
taatacgactcactatagggtgtgctggtgataccagattaactcagggaaacagaggagatccctgatgtaatctggtaacctggcggcagcgcaaaagatg

SEQ ID NO: 224291 - DNA, 103 bp, Artificial Sequence
  Synthetic Polynucleotide
taatacgactcactatagggccggctgcattgtgctggtgataccagattaacagaggagaaatctgatgtcaccagcaaacctggcggcagcgcaaaagatg

SEQ ID NO: 224292 - DNA, 103 bp, Artificial Sequence
  Synthetic Polynucleotide
taatacgactcactatagggtatctgtgttctcatttgtcgcttctgcacaacagaggagagtgcagatgcgacaaatgaacctggcggcagcgcaaaagatg

SEQ ID NO: 224293 - DNA, 103 bp, Artificial Sequence
  Synthetic Polynucleotide
taatacgactcactatagggagtcatgagaccggctgcattgtgctggtgaacagaggagacaccagatgaatgcagccaacctggcggcagcgcaaaagatg

SEQ ID NO: 224294 - DNA, 103 bp, Artificial Sequence
  Synthetic Polynucleotide
taatacgactcactatagggatcggagacgagtcatgagaccggctgcataacagaggagaatgcagatggtctcatgaaacctggcggcagcgcaaaagatg

SEQ ID NO: 224295 - DNA, 103 bp, Artificial Sequence
  Synthetic Polynucleotide
taatacgactcactatagggccaactggatatcggagacgagtcatgagaaacagaggagatctcatatgtcgtctccgaacctggcggcagcgcaaaagatg

SEQ ID NO: 224296 - DNA, 103 bp, Artificial Sequence
  Synthetic Polynucleotide
taatacgactcactataggggcccatcagcccaactggatatcggagacgaacagaggagacgtctcatgtatccagttaacctggcggcagcgcaaaagatg

SEQ ID NO: 224297 - DNA, 103 bp, Artificial Sequence
  Synthetic Polynucleotide
taatacgactcactataggggtaaacaactgcccatcagcccaactggataacagaggagaatccagatgggctgatggaacctggcggcagcgcaaaagatg

SEQ ID NO: 224298 - DNA, 103 bp, Artificial Sequence
  Synthetic Polynucleotide
taatacgactcactataggggctgtggctggtaaacaactgcccatcagcaacagaggagagctgatatgcagttgtttaacctggcggcagcgcaaaagatg

SEQ ID NO: 224299 - DNA, 103 bp, Artificial Sequence
  Synthetic Polynucleotide
taatacgactcactataggggctaaacccagctgtggctggtaaacaactaacagaggagaagttgtatgccagccacaaacctggcggcagcgcaaaagatg

SEQ ID NO: 224300 - DNA, 103 bp, Artificial Sequence
  Synthetic Polynucleotide
taatacgactcactatagggacttttcgtagctaaacccagctgtggctgaacagaggagacagccaatgctgggtttaaacctggcggcagcgcaaaagatg

SEQ ID NO: 224301 - DNA, 103 bp, Artificial Sequence
  Synthetic Polynucleotide
taatacgactcactatagggtctatctcccacttttcgtagctaaacccaaacagaggagatgggttatgctacgaaaaaacctggcggcagcgcaaaagatg

SEQ ID NO: 224302 - DNA, 103 bp, Artificial Sequence
  Synthetic Polynucleotide
taatacgactcactatagggctcagatggatctatctcccacttttcgtaaacagaggagatacgaaatgtgggagataaacctggcggcagcgcaaaagatg

SEQ ID NO: 224303 - DNA, 103 bp, Artificial Sequence
  Synthetic Polynucleotide
taatacgactcactatagggtgctcaggcttatctgtgttctcatttgtcaacagaggagagacaaaatggaacacagaaacctggcggcagcgcaaaagatg

SEQ ID NO: 224304 - DNA, 103 bp, Artificial Sequence
  Synthetic Polynucleotide
taatacgactcactatagggtaaaagccaactcagatggatctatctcccaacagaggagagggagaatgatccatctgaacctggcggcagcgcaaaagatg

SEQ ID NO: 224305 - DNA, 103 bp, Artificial Sequence
  Synthetic Polynucleotide
taatacgactcactatagggatctcctttataaaagccaactcagatggaaacagaggagatccatcatggttggctttaacctggcggcagcgcaaaagatg

SEQ ID NO: 224306 - DNA, 103 bp, Artificial Sequence
  Synthetic Polynucleotide
taatacgactcactatagggaccgcttccaatctcctttataaaagccaaaacagaggagattggctatgataaaggagaacctggcggcagcgcaaaagatg

SEQ ID NO: 224307 - DNA, 103 bp, Artificial Sequence
  Synthetic Polynucleotide
taatacgactcactatagggctccaaactgaccgcttccaatctcctttaaacagaggagataaaggatgttggaagcgaacctggcggcagcgcaaaagatg

SEQ ID NO: 224308 - DNA, 103 bp, Artificial Sequence
  Synthetic Polynucleotide
taatacgactcactatagggaaatggaccactccaaactgaccgcttccaaacagaggagatggaagatgtcagtttggaacctggcggcagcgcaaaagatg

SEQ ID NO: 224309 - DNA, 103 bp, Artificial Sequence
  Synthetic Polynucleotide
taatacgactcactatagggccattcacctaaatggaccactccaaactgaacagaggagacagtttatggtggtccataacctggcggcagcgcaaaagatg

SEQ ID NO: 224310 - DNA, 103 bp, Artificial Sequence
  Synthetic Polynucleotide
taatacgactcactatagggtatgtgaccgccattcacctaaatggaccaaacagaggagatggtccatgtaggtgaataacctggcggcagcgcaaaagatg

SEQ ID NO: 224311 - DNA, 103 bp, Artificial Sequence
  Synthetic Polynucleotide
taatacgactcactataggggctacctggatatgtgaccgccattcacctaacagaggagaaggtgaatggcggtcacaaacctggcggcagcgcaaaagatg

SEQ ID NO: 224312 - DNA, 103 bp, Artificial Sequence
  Synthetic Polynucleotide
taatacgactcactatagggggccttgatagctacctggatatgtgaccgaacagaggagacggtcaatgatccaggtaaacctggcggcagcgcaaaagatg

SEQ ID NO: 224313 - DNA, 103 bp, Artificial Sequence
  Synthetic Polynucleotide
taatacgactcactatagggcttcattgatggccttgatagctacctggaaacagaggagatccaggatgctatcaaggaacctggcggcagcgcaaaagatg

SEQ ID NO: 224314 - DNA, 103 bp, Artificial Sequence
  Synthetic Polynucleotide
taatacgactcactatagggtcttcatctgtgctcaggcttatctgtgttaacagaggagaaacacaatgaagcctgagaacctggcggcagcgcaaaagatg

SEQ ID NO: 224315 - DNA, 103 bp, Artificial Sequence
  Synthetic Polynucleotide
taatacgactcactataggggacatggagccttcattgatggccttgataaacagaggagatatcaaatgcatcaatgaaacctggcggcagcgcaaaagatg

SEQ ID NO: 224316 - DNA, 103 bp, Artificial Sequence
  Synthetic Polynucleotide
taatacgactcactatagggatcctcttcagacatggagccttcattgataacagaggagaatcaatatgggctccatgaacctggcggcagcgcaaaagatg

SEQ ID NO: 224317 - DNA, 103 bp, Artificial Sequence
  Synthetic Polynucleotide
taatacgactcactatagggcttcaatgaaatcctcttcagacatggagcaacagaggagagctccaatgctgaagaggaacctggcggcagcgcaaaagatg

SEQ ID NO: 224318 - DNA, 103 bp, Artificial Sequence
  Synthetic Polynucleotide
taatacgactcactatagggactttggcctcttcaatgaaatcctcttcaaacagaggagatgaagaatgtttcattgaaacctggcggcagcgcaaaagatg

SEQ ID NO: 224319 - DNA, 103 bp, Artificial Sequence
  Synthetic Polynucleotide
taatacgactcactatagggtttcatcatcactttggcctcttcaatgaaaacagaggagattcattatggaggccaaaaacctggcggcagcgcaaaagatg

SEQ ID NO: 224320 - DNA, 103 bp, Artificial Sequence
  Synthetic Polynucleotide
taatacgactcactatagggaatgagataatttcatcatcactttggcctaacagaggagaaggccaatgtgatgatgaaacctggcggcagcgcaaaagatg

SEQ ID NO: 224321 - DNA, 103 bp, Artificial Sequence
  Synthetic Polynucleotide
taatacgactcactatagggactagctttgaatgagataatttcatcatcaacagaggagagatgatatgattatctcaaacctggcggcagcgcaaaagatg

SEQ ID NO: 224322 - DNA, 103 bp, Artificial Sequence
  Synthetic Polynucleotide
taatacgactcactatagggataaagttgcactagctttgaatgagataaaacagaggagattatctatgtcaaagctaaacctggcggcagcgcaaaagatg

SEQ ID NO: 224323 - DNA, 103 bp, Artificial Sequence
  Synthetic Polynucleotide
taatacgactcactatagggtacagactccataaagttgcactagctttgaacagaggagacaaagcatgtgcaactttaacctggcggcagcgcaaaagatg

SEQ ID NO: 224324 - DNA, 103 bp, Artificial Sequence
  Synthetic Polynucleotide
taatacgactcactatagggttccgctgtatacagactccataaagttgcaacagaggagagcaactatgtggagtctgaacctggcggcagcgcaaaagatg

SEQ ID NO: 224325 - DNA, 103 bp, Artificial Sequence
  Synthetic Polynucleotide
taatacgactcactataggggtctgtggggcagtcggcttctccgttcataacagaggagaatgaacatggaagccgacaacctggcggcagcgcaaaagatg

SEQ ID NO: 224326 - DNA, 103 bp, Artificial Sequence
  Synthetic Polynucleotide
taatacgactcactatagggggatggaaggttgttcttcatgcattccagaacagaggagactggaaatgatgaagaacaacctggcggcagcgcaaaagatg

SEQ ID NO: 224327 - DNA, 103 bp, Artificial Sequence
  Synthetic Polynucleotide
taatacgactcactatagggcttctccttctgggacagcagcttccactgaacagaggagacagtggatgctgctgtccaacctggcggcagcgcaaaagatg

SEQ ID NO: 224328 - DNA, 103 bp, Artificial Sequence
  Synthetic Polynucleotide
taatacgactcactataggggataggcgtccttctccttctgggacagcaaacagaggagatgctgtatgagaaggagaaacctggcggcagcgcaaaagatg

SEQ ID NO: 224329 - DNA, 103 bp, Artificial Sequence
  Synthetic Polynucleotide
taatacgactcactatagggcacttcttgtgataggcgtccttctccttcaacagaggagagaaggaatgggacgcctaaacctggcggcagcgcaaaagatg

SEQ ID NO: 224330 - DNA, 103 bp, Artificial Sequence
  Synthetic Polynucleotide
taatacgactcactatagggtttctgatcacacttcttgtgataggcgtcaacagaggagagacgccatgcacaagaagaacctggcggcagcgcaaaagatg

SEQ ID NO: 224331 - DNA, 103 bp, Artificial Sequence
  Synthetic Polynucleotide
taatacgactcactatagggaatctttctttttctgatcacacttcttgtaacagaggagaacaagaatggtgatcagaaacctggcggcagcgcaaaagatg

SEQ ID NO: 224332 - DNA, 103 bp, Artificial Sequence
  Synthetic Polynucleotide
taatacgactcactatagggtccacctcgtaatctttctttttctgatcaaacagaggagatgatcaatgaaagaaagaaacctggcggcagcgcaaaagatg

SEQ ID NO: 224333 - DNA, 103 bp, Artificial Sequence
  Synthetic Polynucleotide
taatacgactcactatagggacggagcagctccacctcgtaatctttcttaacagaggagaaagaaaatgtacgaggtgaacctggcggcagcgcaaaagatg

SEQ ID NO: 224334 - DNA, 103 bp, Artificial Sequence
  Synthetic Polynucleotide
taatacgactcactatagggtctcgaggaaacggagcagctccacctcgtaacagaggagaacgaggatgagctgctccaacctggcggcagcgcaaaagatg

SEQ ID NO: 224335 - DNA, 103 bp, Artificial Sequence
  Synthetic Polynucleotide
taatacgactcactatagggtcaggcaggctctcgaggaaacggagcagcaacagaggagagctgctatgtttcctcgaaacctggcggcagcgcaaaagatg

SEQ ID NO: 224336 - DNA, 103 bp, Artificial Sequence
  Synthetic Polynucleotide
taatacgactcactatagggctgctcctcctcaggcaggctctcgaggaaaacagaggagattcctcatgagcctgcctaacctggcggcagcgcaaaagatg

SEQ ID NO: 224337 - DNA, 103 bp, Artificial Sequence
  Synthetic Polynucleotide
taatacgactcactatagggagctgtcattggatggaaggttgttcttcaaacagaggagatgaagaatgaccttccataacctggcggcagcgcaaaagatg

SEQ ID NO: 224338 - DNA, 103 bp, Artificial Sequence
  Synthetic Polynucleotide
taatacgactcactatagggagacccgctgctgctcctcctcaggcaggcaacagaggagagcctgcatgaggaggagcaacctggcggcagcgcaaaagatg

SEQ ID NO: 224339 - DNA, 103 bp, Artificial Sequence
  Synthetic Polynucleotide
taatacgactcactatagggtcttcccccaagacccgctgctgctcctccaacagaggagaggaggaatggcagcgggtaacctggcggcagcgcaaaagatg

SEQ ID NO: 224340 - DNA, 103 bp, Artificial Sequence
  Synthetic Polynucleotide
taatacgactcactatagggcagcatcttctcttcccccaagacccgctgaacagaggagacagcggatgttgggggaaaacctggcggcagcgcaaaagatg

SEQ ID NO: 224341 - DNA, 103 bp, Artificial Sequence
  Synthetic Polynucleotide
taatacgactcactatagggtgttgatgttcagcatcttctcttcccccaaacagaggagatgggggatgagaagatgcaacctggcggcagcgcaaaagatg

SEQ ID NO: 224342 - DNA, 103 bp, Artificial Sequence
  Synthetic Polynucleotide
taatacgactcactataggggcctgcttcttgttgatgttcagcatcttcaacagaggagagaagatatggaacatcaaaacctggcggcagcgcaaaagatg

SEQ ID NO: 224343 - DNA, 103 bp, Artificial Sequence
  Synthetic Polynucleotide
taatacgactcactatagggggggctggtggcctgcttcttgttgatgttaacagaggagaaacatcatgaagaagcagaacctggcggcagcgcaaaagatg

SEQ ID NO: 224344 - DNA, 103 bp, Artificial Sequence
  Synthetic Polynucleotide
taatacgactcactatagggtcttggaggcggggctggtggcctgcttctaacagaggagaagaagcatgccaccagccaacctggcggcagcgcaaaagatg

SEQ ID NO: 224345 - DNA, 103 bp, Artificial Sequence
  Synthetic Polynucleotide
taatacgactcactatagggtgggctggcttcttggaggcggggctggtgaacagaggagacaccagatgcgcctccaaaacctggcggcagcgcaaaagatg

SEQ ID NO: 224346 - DNA, 103 bp, Artificial Sequence
  Synthetic Polynucleotide
taatacgactcactataggggcccccttcctgggctggcttcttggaggcaacagaggagagcctccatgaagccagccaacctggcggcagcgcaaaagatg

SEQ ID NO: 224347 - DNA, 103 bp, Artificial Sequence
  Synthetic Polynucleotide
taatacgactcactatagggagccgcccttgcccccttcctgggctggctaacagaggagaagccagatgaggaaggggaacctggcggcagcgcaaaagatg

SEQ ID NO: 224348 - DNA, 103 bp, Artificial Sequence
  Synthetic Polynucleotide
taatacgactcactatagggttgaacttggagctgtcattggatggaaggaacagaggagaccttccatgcaatgacagaacctggcggcagcgcaaaagatg

SEQ ID NO: 224349 - DNA, 103 bp, Artificial Sequence
  Synthetic Polynucleotide
taatacgactcactatagggggcttctcggagccgcccttgcccccttccaacagaggagaggaaggatgcaagggcggaacctggcggcagcgcaaaagatg

SEQ ID NO: 224350 - DNA, 103 bp, Artificial Sequence
  Synthetic Polynucleotide
taatacgactcactataggggggccgcttgggcttctcggagccgcccttaacagaggagaaagggcatgtccgagaagaacctggcggcagcgcaaaagatg

SEQ ID NO: 224351 - DNA, 103 bp, Artificial Sequence
  Synthetic Polynucleotide
taatacgactcactatagggtggccgacacgggccgcttgggcttctcggaacagaggagaccgagaatgccaagcggcaacctggcggcagcgcaaaagatg

SEQ ID NO: 224352 - DNA, 103 bp, Artificial Sequence
  Synthetic Polynucleotide
taatacgactcactatagggaagatgaacatggccgacacgggccgcttgaacagaggagacaagcgatgcgtgtcggcaacctggcggcagcgcaaaagatg

SEQ ID NO: 224353 - DNA, 103 bp, Artificial Sequence
  Synthetic Polynucleotide
taatacgactcactatagggctcctccgagaagatgaacatggccgacacaacagaggagagtgtcgatgatgttcatcaacctggcggcagcgcaaaagatg

SEQ ID NO: 224354 - DNA, 103 bp, Artificial Sequence
  Synthetic Polynucleotide
taatacgactcactataggggccgccgtttctcctccgagaagatgaacaaacagaggagatgttcaatgtctcggaggaacctggcggcagcgcaaaagatg

SEQ ID NO: 224355 - DNA, 103 bp, Artificial Sequence
  Synthetic Polynucleotide
taatacgactcactatagggtcctgcagctgccgccgtttctcctccgagaacagaggagactcggaatggaaacggcgaacctggcggcagcgcaaaagatg

SEQ ID NO: 224356 - DNA, 103 bp, Artificial Sequence
  Synthetic Polynucleotide
taatacgactcactatagggaggccgctcctcctgcagctgccgccgtttaacagaggagaaaacggatgcagctgcagaacctggcggcagcgcaaaagatg

SEQ ID NO: 224357 - DNA, 103 bp, Artificial Sequence
  Synthetic Polynucleotide
taatacgactcactatagggcggagagctcaggccgctcctcctgcagctaacagaggagaagctgcatgaggagcggcaacctggcggcagcgcaaaagatg

SEQ ID NO: 224358 - DNA, 103 bp, Artificial Sequence
  Synthetic Polynucleotide
taatacgactcactatagggagctcgctctcggagagctcaggccgctccaacagaggagaggagcgatgtgagctctcaacctggcggcagcgcaaaagatg

SEQ ID NO: 224359 - DNA, 103 bp, Artificial Sequence
  Synthetic Polynucleotide
taatacgactcactatagggttcggtggttttgaacttggagctgtcattaacagaggagaaatgacatgtccaagttcaacctggcggcagcgcaaaagatg

SEQ ID NO: 224360 - DNA, 103 bp, Artificial Sequence
  Synthetic Polynucleotide
taatacgactcactatagggcaggcgggtcagctcgctctcggagagctcaacagaggagagagctcatggagagcgagaacctggcggcagcgcaaaagatg

SEQ ID NO: 224361 - DNA, 103 bp, Artificial Sequence
  Synthetic Polynucleotide
taatacgactcactatagggttcgggccagcaggcgggtcagctcgctctaacagaggagaagagcgatgtgacccgccaacctggcggcagcgcaaaagatg

SEQ ID NO: 224362 - DNA, 103 bp, Artificial Sequence
  Synthetic Polynucleotide
taatacgactcactatagggtcgttccacattcgggccagcaggcgggtcaacagaggagagacccgatggctggcccgaacctggcggcagcgcaaaagatg

SEQ ID NO: 224363 - DNA, 103 bp, Artificial Sequence
  Synthetic Polynucleotide
taatacgactcactatagggctcagacaggtcgttccacattcgggccagaacagaggagactggccatgatgtggaacaacctggcggcagcgcaaaagatg

SEQ ID NO: 224364 - DNA, 103 bp, Artificial Sequence
  Synthetic Polynucleotide
taatacgactcactatagggccttcttcttctcagacaggtcgttccacaaacagaggagatgtggaatgacctgtctgaacctggcggcagcgcaaaagatg

SEQ ID NO: 224365 - DNA, 103 bp, Artificial Sequence
  Synthetic Polynucleotide
taatacgactcactatagggttgtacttggccttcttcttctcagacaggaacagaggagacctgtcatggaagaagaaaacctggcggcagcgcaaaagatg

SEQ ID NO: 224366 - DNA, 103 bp, Artificial Sequence
  Synthetic Polynucleotide
taatacgactcactatagggctctcgggccttgtacttggccttcttcttaacagaggagaaagaagatggccaagtacaacctggcggcagcgcaaaagatg

SEQ ID NO: 224367 - DNA, 103 bp, Artificial Sequence
  Synthetic Polynucleotide
taatacgactcactatagggtgagcgccgcctctcgggccttgtacttggaacagaggagaccaagtatgaggcccgagaacctggcggcagcgcaaaagatg

SEQ ID NO: 224368 - DNA, 103 bp, Artificial Sequence
  Synthetic Polynucleotide
taatacgactcactataggggactgagccttgagcgccgcctctcgggccaacagaggagaggcccgatgggcggcgctaacctggcggcagcgcaaaagatg

SEQ ID NO: 224369 - DNA, 103 bp, Artificial Sequence
  Synthetic Polynucleotide
taatacgactcactatagggcttcctctccgactgagccttgagcgccgcaacagaggagagcggcgatgaaggctcagaacctggcggcagcgcaaaagatg

SEQ ID NO: 224370 - DNA, 103 bp, Artificial Sequence
  Synthetic Polynucleotide
taatacgactcactatagggccatgtgtgattcggtggttttgaacttggaacagaggagaccaagtatgaaaccaccgaacctggcggcagcgcaaaagatg

SEQ ID NO: 224371 - DNA, 103 bp, Artificial Sequence
  Synthetic Polynucleotide
taatacgactcactatagggccccgccgggcttcctctccgactgagcctaacagaggagaaggctcatgcggagaggaaacctggcggcagcgcaaaagatg

SEQ ID NO: 224372 - DNA, 103 bp, Artificial Sequence
  Synthetic Polynucleotide
taatacgactcactatagggtcctcgcgctccccgccgggcttcctctccaacagaggagaggagagatggcccggcggaacctggcggcagcgcaaaagatg

SEQ ID NO: 224373 - DNA, 103 bp, Artificial Sequence
  Synthetic Polynucleotide
taatacgactcactatagggcttgccccgttcctcgcgctccccgccgggaacagaggagacccggcatggagcgcgagaacctggcggcagcgcaaaagatg

SEQ ID NO: 224374 - DNA, 103 bp, Artificial Sequence
  Synthetic Polynucleotide
taatacgactcactatagggactcgggcagcttgccccgttcctcgcgctaacagaggagaagcgcgatgaacggggcaaacctggcggcagcgcaaaagatg

SEQ ID NO: 224375 - DNA, 103 bp, Artificial Sequence
  Synthetic Polynucleotide
taatacgactcactatagggcttttgggggactcgggcagcttgccccgtaacagaggagaacggggatggctgcccgaaacctggcggcagcgcaaaagatg

SEQ ID NO: 224376 - DNA, 103 bp, Artificial Sequence
  Synthetic Polynucleotide
taatacgactcactatagggctcctcagctcttttgggggactcgggcagaacagaggagactgcccatgtcccccaaaaacctggcggcagcgcaaaagatg

SEQ ID NO: 224377 - DNA, 103 bp, Artificial Sequence
  Synthetic Polynucleotide
taatacgactcactataggggttgccagatctcctcagctcttttgggggaacagaggagacccccaatggagctgaggaacctggcggcagcgcaaaagatg

SEQ ID NO: 224378 - DNA, 103 bp, Artificial Sequence
  Synthetic Polynucleotide
taatacgactcactatagggataacgctctgttgccagatctcctcagctaacagaggagaagctgaatggatctggcaaacctggcggcagcgcaaaagatg

SEQ ID NO: 224379 - DNA, 103 bp, Artificial Sequence
  Synthetic Polynucleotide
taatacgactcactataggggtagtcgccgataacgctctgttgccagataacagaggagaatctggatgcagagcgttaacctggcggcagcgcaaaagatg

SEQ ID NO: 224380 - DNA, 103 bp, Artificial Sequence
  Synthetic Polynucleotide
taatacgactcactatagggagcgggccaggtagtcgccgataacgctctaacagaggagaagagcgatgtcggcgactaacctggcggcagcgcaaaagatg

SEQ ID NO: 224381 - DNA, 103 bp, Artificial Sequence
  Synthetic Polynucleotide
taatacgactcactatagggttttcccagtccatgtgtgattcggtggttaacagaggagaaaccacatgatcacacataacctggcggcagcgcaaaagatg

SEQ ID NO: 224382 - DNA, 103 bp, Artificial Sequence
  Synthetic Polynucleotide
taatacgactcactatagggtcattcttgaagcgggccaggtagtcgccgaacagaggagacggcgaatgcctggcccgaacctggcggcagcgcaaaagatg

SEQ ID NO: 224383 - DNA, 103 bp, Artificial Sequence
  Synthetic Polynucleotide
taatacgactcactatagggcttcacccggtcattcttgaagcgggccagaacagaggagactggccatgttcaagaataacctggcggcagcgcaaaagatg

SEQ ID NO: 224384 - DNA, 103 bp, Artificial Sequence
  Synthetic Polynucleotide
taatacgactcactatagggctttcaaggccttcacccggtcattcttgaaacagaggagatcaagaatgaccgggtgaaacctggcggcagcgcaaaagatg

SEQ ID NO: 224385 - DNA, 103 bp, Artificial Sequence
  Synthetic Polynucleotide
taatacgactcactatagggatttccatggctttcaaggccttcacccggaacagaggagaccgggtatgggccttgaaaacctggcggcagcgcaaaagatg

SEQ ID NO: 224386 - DNA, 103 bp, Artificial Sequence
  Synthetic Polynucleotide
taatacgactcactatagggattccaggtcatttccatggctttcaaggcaacagaggagagccttgatggccatggaaaacctggcggcagcgcaaaagatg

SEQ ID NO: 224387 - DNA, 103 bp, Artificial Sequence
  Synthetic Polynucleotide
taatacgactcactatagggtttccatgttattccaggtcatttccatggaacagaggagaccatggatgtgacctggaaacctggcggcagcgcaaaagatg

SEQ ID NO: 224388 - DNA, 103 bp, Artificial Sequence
  Synthetic Polynucleotide
taatacgactcactatagggttctccttcttttccatgttattccaggtcaacagaggagagacctgatgtaacatggaaacctggcggcagcgcaaaagatg

SEQ ID NO: 224389 - DNA, 103 bp, Artificial Sequence
  Synthetic Polynucleotide
taatacgactcactatagggccacatcagtttctccttcttttccatgttaacagaggagaaacatgatgaagaaggagaacctggcggcagcgcaaaagatg

SEQ ID NO: 224390 - DNA, 103 bp, Artificial Sequence
  Synthetic Polynucleotide
taatacgactcactatagggccttcttaatccacatcagtttctccttctaacagaggagaagaaggatgaactgatgtaacctggcggcagcgcaaaagatg

SEQ ID NO: 224391 - DNA, 103 bp, Artificial Sequence
  Synthetic Polynucleotide
taatacgactcactatagggtcttcggctgccttcttaatccacatcagtaacagaggagaactgatatggattaagaaaacctggcggcagcgcaaaagatg

SEQ ID NO: 224392 - DNA, 103 bp, Artificial Sequence
  Synthetic Polynucleotide
taatacgactcactatagggaaatgctactttttcccagtccatgtgtgaaacagaggagatcacacatggactgggaaaacctggcggcagcgcaaaagatg

SEQ ID NO: 224393 - DNA, 103 bp, Artificial Sequence
  Synthetic Polynucleotide
taatacgactcactatagggtcgcttttggtcttcggctgccttcttaataacagaggagaattaagatggcagccgaaaacctggcggcagcgcaaaagatg

SEQ ID NO: 224394 - DNA, 103 bp, Artificial Sequence
  Synthetic Polynucleotide
taatacgactcactatagggctctctcatatcgcttttggtcttcggctgaacagaggagacagccgatgaccaaaagcaacctggcggcagcgcaaaagatg

SEQ ID NO: 224395 - DNA, 103 bp, Artificial Sequence
  Synthetic Polynucleotide
taatacgactcactatagggtcactcagctctctctcatatcgcttttggaacagaggagaccaaaaatgatatgagagaacctggcggcagcgcaaaagatg

SEQ ID NO: 224396 - DNA, 103 bp, Artificial Sequence
  Synthetic Polynucleotide
taatacgactcactatagggtgcccgcatctcactcagctctctctcataaacagaggagatatgagatggagctgagtaacctggcggcagcgcaaaagatg

SEQ ID NO: 224397 - DNA, 103 bp, Artificial Sequence
  Synthetic Polynucleotide
taatacgactcactatagggcagctggaggtgcccgcatctcactcagctaacagaggagaagctgaatgagatgcgggaacctggcggcagcgcaaaagatg

SEQ ID NO: 224398 - DNA, 103 bp, Artificial Sequence
  Synthetic Polynucleotide
taatacgactcactataggggaatttgtagcagctggaggtgcccgcatcaacagaggagagatgcgatgacctccagcaacctggcggcagcgcaaaagatg

SEQ ID NO: 224399 - DNA, 103 bp, Artificial Sequence
  Synthetic Polynucleotide
taatacgactcactatagggcttcttggaagaatttgtagcagctggaggaacagaggagacctccaatggctacaaataacctggcggcagcgcaaaagatg

SEQ ID NO: 224400 - DNA, 103 bp, Artificial Sequence
  Synthetic Polynucleotide
taatacgactcactatagggggaatttcatcttcttggaagaatttgtagaacagaggagactacaaatgcttccaagaaacctggcggcagcgcaaaagatg

SEQ ID NO: 224401 - DNA, 103 bp, Artificial Sequence
  Synthetic Polynucleotide
taatacgactcactatagggggttctccctggaatttcatcttcttggaaaacagaggagattccaaatggatgaaattaacctggcggcagcgcaaaagatg

SEQ ID NO: 224402 - DNA, 103 bp, Artificial Sequence
  Synthetic Polynucleotide
taatacgactcactatagggaggcttcttgggttctccctggaatttcataacagaggagaatgaaaatgcagggagaaaacctggcggcagcgcaaaagatg

SEQ ID NO: 224403 - DNA, 103 bp, Artificial Sequence
  Synthetic Polynucleotide
taatacgactcactatagggaaaagtctttaaatgctactttttcccagtaacagaggagaactgggatgaagtagcataacctggcggcagcgcaaaagatg

SEQ ID NO: 224404 - DNA, 103 bp, Artificial Sequence
  Synthetic Polynucleotide
taatacgactcactatagggcgttcatgggaggcttcttgggttctccctaacagaggagaagggagatgccaagaagcaacctggcggcagcgcaaaagatg

SEQ ID NO: 224405 - DNA, 103 bp, Artificial Sequence
  Synthetic Polynucleotide
taatacgactcactatagggttctggtaaccgttcatgggaggcttcttgaacagaggagacaagaaatgtcccatgaaaacctggcggcagcgcaaaagatg

SEQ ID NO: 224406 - DNA, 103 bp, Artificial Sequence
  Synthetic Polynucleotide
taatacgactcactatagggctgggagaacttctggtaaccgttcatgggaacagaggagacccatgatgggttaccagaacctggcggcagcgcaaaagatg

SEQ ID NO: 224407 - DNA, 103 bp, Artificial Sequence
  Synthetic Polynucleotide
taatacgactcactatagggacagcagctcctgggagaacttctggtaacaacagaggagagttaccatgagttctcccaacctggcggcagcgcaaaagatg

SEQ ID NO: 224408 - DNA, 103 bp, Artificial Sequence
  Synthetic Polynucleotide
taatacgactcactatagggtccccattggacagcagctcctgggagaacaacagaggagagttctcatgggagctgctaacctggcggcagcgcaaaagatg

SEQ ID NO: 224409 - DNA, 103 bp, Artificial Sequence
  Synthetic Polynucleotide
taatacgactcactataggggtggttcagctccccattggacagcagctcaacagaggagagagctgatgtccaatgggaacctggcggcagcgcaaaagatg

SEQ ID NO: 224410 - DNA, 103 bp, Artificial Sequence
  Synthetic Polynucleotide
taatacgactcactatagggtcagcggcaggtggttcagctccccattggaacagaggagaccaatgatgagctgaaccaacctggcggcagcgcaaaagatg

SEQ ID NO: 224411 - DNA, 103 bp, Artificial Sequence
  Synthetic Polynucleotide
taatacgactcactatagggatgcgctccttcagcggcaggtggttcagcaacagaggagagctgaaatgcctgccgctaacctggcggcagcgcaaaagatg

SEQ ID NO: 224412 - DNA, 103 bp, Artificial Sequence
  Synthetic Polynucleotide
taatacgactcactataggggatctccaccatgcgctccttcagcggcagaacagaggagactgccgatgaaggagcgcaacctggcggcagcgcaaaagatg

SEQ ID NO: 224413 - DNA, 103 bp, Artificial Sequence
  Synthetic Polynucleotide
taatacgactcactatagggagcgactgccgatctccaccatgcgctcctaacagaggagaaggagcatgtggtggagaaacctggcggcagcgcaaaagatg

SEQ ID NO: 224414 - DNA, 103 bp, Artificial Sequence
  Synthetic Polynucleotide
taatacgactcactatagggatgtctccagaaaagtctttaaatgctactaacagaggagaagtagcatgtaaagacttaacctggcggcagcgcaaaagatg

SEQ ID NO: 224415 - DNA, 103 bp, Artificial Sequence
  Synthetic Polynucleotide
taatacgactcactatagggatgcgctgccagcgactgccgatctccaccaacagaggagaggtggaatgcggcagtcgaacctggcggcagcgcaaaagatg

SEQ ID NO: 224416 - DNA, 103 bp, Artificial Sequence
  Synthetic Polynucleotide
taatacgactcactataggggctctgggagatgcgctgccagcgactgccaacagaggagaggcagtatgtggcagcgcaacctggcggcagcgcaaaagatg

SEQ ID NO: 224417 - DNA, 103 bp, Artificial Sequence
  Synthetic Polynucleotide
taatacgactcactataggggctccttctggctctgggagatgcgctgccaacagaggagaggcagcatgtctcccagaaacctggcggcagcgcaaaagatg

SEQ ID NO: 224418 - DNA, 103 bp, Artificial Sequence
  Synthetic Polynucleotide
taatacgactcactatagggtttttgtagtgctccttctggctctgggagaacagaggagactcccaatgccagaaggaaacctggcggcagcgcaaaagatg

SEQ ID NO: 224419 - DNA, 103 bp, Artificial Sequence
  Synthetic Polynucleotide
taatacgactcactatagggctcggccagctttttgtagtgctccttctgaacagaggagacagaagatgcactacaaaaacctggcggcagcgcaaaagatg

SEQ ID NO: 224420 - DNA, 103 bp, Artificial Sequence
  Synthetic Polynucleotide
taatacgactcactatagggtttgctgctcctcggccagctttttgtagtaacagaggagaactacaatgagctggccgaacctggcggcagcgcaaaagatg

SEQ ID NO: 224421 - DNA, 103 bp, Artificial Sequence
  Synthetic Polynucleotide
taatacgactcactatagggttgtactgcttttgctgctcctcggccagcaacagaggagagctggcatgggagcagcaaacctggcggcagcgcaaaagatg

SEQ ID NO: 224422 - DNA, 103 bp, Artificial Sequence
  Synthetic Polynucleotide
taatacgactcactatagggcaggtgcaccttgtactgcttttgctgctcaacagaggagagagcagatgaagcagtacaacctggcggcagcgcaaaagatg

SEQ ID NO: 224423 - DNA, 103 bp, Artificial Sequence
  Synthetic Polynucleotide
taatacgactcactatagggcccagaggtccaggtgcaccttgtactgctaacagaggagaagcagtatgaggtgcaccaacctggcggcagcgcaaaagatg

SEQ ID NO: 224424 - DNA, 103 bp, Artificial Sequence
  Synthetic Polynucleotide
taatacgactcactatagggaggctcttaacccagaggtccaggtgcaccaacagaggagaggtgcaatgggacctctgaacctggcggcagcgcaaaagatg

SEQ ID NO: 224425 - DNA, 103 bp, Artificial Sequence
  Synthetic Polynucleotide
taatacgactcactataggggagcttgcacatgtctccagaaaagtctttaacagaggagaaaagacatgtctggagacaacctggcggcagcgcaaaagatg

SEQ ID NO: 224426 - DNA, 103 bp, Artificial Sequence
  Synthetic Polynucleotide
taatacgactcactatagggctggggagacaggctcttaacccagaggtcaacagaggagagacctcatggttaagagcaacctggcggcagcgcaaaagatg

SEQ ID NO: 224427 - DNA, 103 bp, Artificial Sequence
  Synthetic Polynucleotide
taatacgactcactatagggctgcacggtcctggggagacaggctcttaaaacagaggagattaagaatgtgtctccccaacctggcggcagcgcaaaagatg

SEQ ID NO: 224428 - DNA, 103 bp, Artificial Sequence
  Synthetic Polynucleotide
taatacgactcactatagggtctttatatgctgcacggtcctggggagacaacagaggagagtctccatgggaccgtgcaacctggcggcagcgcaaaagatg

SEQ ID NO: 224429 - DNA, 103 bp, Artificial Sequence
  Synthetic Polynucleotide
taatacgactcactatagggggagatgtactctttatatgctgcacggtcaacagaggagagaccgtatggcatataaaaacctggcggcagcgcaaaagatg

SEQ ID NO: 224430 - DNA, 103 bp, Artificial Sequence
  Synthetic Polynucleotide
taatacgactcactatagggtacgtttattggagatgtactctttatatgaacagaggagacatataatgagtacatctaacctggcggcagcgcaaaagatg

SEQ ID NO: 224431 - DNA, 103 bp, Artificial Sequence
  Synthetic Polynucleotide
taatacgactcactataggggtcatgctcttacgtttattggagatgtacaacagaggagagtacatatgcaataaacgaacctggcggcagcgcaaaagatg

SEQ ID NO: 224432 - DNA, 103 bp, Artificial Sequence
  Synthetic Polynucleotide
taatacgactcactatagggtcgcagcttggtcatgctcttacgtttattaacagaggagaaataaaatgaagagcatgaacctggcggcagcgcaaaagatg

SEQ ID NO: 224433 - DNA, 103 bp, Artificial Sequence
  Synthetic Polynucleotide
taatacgactcactatagggggtttgggcctcgcagcttggtcatgctctaacagaggagaagagcaatgccaagctgcaacctggcggcagcgcaaaagatg

SEQ ID NO: 224434 - DNA, 103 bp, Artificial Sequence
  Synthetic Polynucleotide
taatacgactcactatagggctggatttggggtttgggcctcgcagcttgaacagaggagacaagctatgaggcccaaaaacctggcggcagcgcaaaagatg

SEQ ID NO: 224435 - DNA, 103 bp, Artificial Sequence
  Synthetic Polynucleotide
taatacgactcactatagggagtagtccggctggatttggggtttgggccaacagaggagaggcccaatgcccaaatccaacctggcggcagcgcaaaagatg

SEQ ID NO: 224436 - DNA, 103 bp, Artificial Sequence
  Synthetic Polynucleotide
taatacgactcactatagggccatttccaggtctgtggggcagtcggcttaacagaggagaaagccgatggccccacagaacctggcggcagcgcaaaagatg

SEQ ID NO: 224437 - DNA, 103 bp, Artificial Sequence
  Synthetic Polynucleotide
taatacgactcactatagggccacccatttgagcttgcacatgtctccagaacagaggagactggagatgtgtgcaagcaacctggcggcagcgcaaaagatg

SEQ ID NO: 224438 - DNA, 103 bp, Artificial Sequence
  Synthetic Polynucleotide
taatacgactcactatagggtggactgcagagtagtccggctggatttggaacagaggagaccaaatatggccggactaaacctggcggcagcgcaaaagatg

SEQ ID NO: 224439 - DNA, 103 bp, Artificial Sequence
  Synthetic Polynucleotide
taatacgactcactataggggactccgacttggactgcagagtagtccggaacagaggagaccggacatgtctgcagtcaacctggcggcagcgcaaaagatg

SEQ ID NO: 224440 - DNA, 103 bp, Artificial Sequence
  Synthetic Polynucleotide
taatacgactcactatagggatcctcctcggactccgacttggactgcagaacagaggagactgcagatgaagtcggagaacctggcggcagcgcaaaagatg

SEQ ID NO: 224441 - DNA, 103 bp, Artificial Sequence
  Synthetic Polynucleotide
taatacgactcactatagggcctcttcatcatcctcctcggactccgactaacagaggagaagtcggatgccgaggaggaacctggcggcagcgcaaaagatg

SEQ ID NO: 224442 - DNA, 103 bp, Artificial Sequence
  Synthetic Polynucleotide
taatacgactcactatagggtcatcctcatcctcttcatcatcctcctcgaacagaggagacgaggaatgtgatgaagaaacctggcggcagcgcaaaagatg

SEQ ID NO: 224443 - DNA, 103 bp, Artificial Sequence
  Synthetic Polynucleotide
taatacgactcactatagggctcgtcctcgtcatcctcatcctcttcatcaacagaggagagatgaaatggatgaggataacctggcggcagcgcaaaagatg

SEQ ID NO: 224444 - DNA, 103 bp, Artificial Sequence
  Synthetic Polynucleotide
taatacgactcactatagggcttcttcatcctcgtcctcgtcatcctcataacagaggagaatgaggatgacgaggacgaacctggcggcagcgcaaaagatg

SEQ ID NO: 224445 - DNA, 103 bp, Artificial Sequence
  Synthetic Polynucleotide
taatacgactcactatagggtcatcttcctcttcttcatcctcgtcctcgaacagaggagacgaggaatgggatgaagaaacctggcggcagcgcaaaagatg

SEQ ID NO: 224446 - DNA, 103 bp, Artificial Sequence
  Synthetic Polynucleotide
taatacgactcactatagggcccattctcatcatcttcctcttcttcatcaacagaggagagatgaaatggaggaagataacctggcggcagcgcaaaagatg

SEQ ID NO: 224447 - DNA, 103 bp, Artificial Sequence
  Synthetic Polynucleotide
taatacgactcactatagggcagaggagtccccattctcatcatcttcctaacagaggagaaggaagatgatgagaatgaacctggcggcagcgcaaaagatg

SEQ ID NO: 224448 - DNA, 103 bp, Artificial Sequence
  Synthetic Polynucleotide
taatacgactcactatagggttagaaatctccacccatttgagcttgcacaacagaggagagtgcaaatgcaaatgggtaacctggcggcagcgcaaaagatg

SEQ ID NO: 224449 - DNA, 103 bp, Artificial Sequence
  Synthetic Polynucleotide
taatacgactcactatagggccgccatcttcagaggagtccccattctcaaacagaggagatgagaaatgggactcctcaacctggcggcagcgcaaaagatg

SEQ ID NO: 224450 - DNA, 103 bp, Artificial Sequence
  Synthetic Polynucleotide
taatacgactcactatagggagaggagtcgccgccatcttcagaggagtcaacagaggagagactccatggaagatggcaacctggcggcagcgcaaaagatg

SEQ ID NO: 224451 - DNA, 103 bp, Artificial Sequence
  Synthetic Polynucleotide
taatacgactcactatagggtgctggactcagaggagtcgccgccatcttaacagaggagaaagatgatggcgactcctaacctggcggcagcgcaaaagatg

SEQ ID NO: 224452 - DNA, 103 bp, Artificial Sequence
  Synthetic Polynucleotide
taatacgactcactatagggtcgtcctcgctgctggactcagaggagtcgaacagaggagacgactcatgtgagtccagaacctggcggcagcgcaaaagatg

SEQ ID NO: 224453 - DNA, 103 bp, Artificial Sequence
  Synthetic Polynucleotide
taatacgactcactatagggatcctcgctctcgtcctcgctgctggactcaacagaggagagagtccatgagcgaggacaacctggcggcagcgcaaaagatg

SEQ ID NO: 224454 - DNA, 103 bp, Artificial Sequence
  Synthetic Polynucleotide
taatacgactcactatagggtctcatccccatcctcgctctcgtcctcgcaacagaggagagcgaggatgagagcgaggaacctggcggcagcgcaaaagatg

SEQ ID NO: 224455 - DNA, 103 bp, Artificial Sequence
  Synthetic Polynucleotide
taatacgactcactatagggtcctcttcattctcatccccatcctcgctcaacagaggagagagcgaatgtggggatgaaacctggcggcagcgcaaaagatg

SEQ ID NO: 224456 - DNA, 103 bp, Artificial Sequence
  Synthetic Polynucleotide
taatacgactcactataggggtcctcgtcatcctcttcattctcatccccaacagaggagaggggatatgaatgaagagaacctggcggcagcgcaaaagatg

SEQ ID NO: 224457 - DNA, 103 bp, Artificial Sequence
  Synthetic Polynucleotide
taatacgactcactatagggcgtcgtcttcgtcctcgtcatcctcttcataacagaggagaatgaagatgatgacgaggaacctggcggcagcgcaaaagatg

SEQ ID NO: 224458 - DNA, 103 bp, Artificial Sequence
  Synthetic Polynucleotide
taatacgactcactatagggtcatcctcgtcgtcgtcttcgtcctcgtcaaacagaggagatgacgaatgcgaagacgaaacctggcggcagcgcaaaagatg

SEQ ID NO: 224459 - DNA, 103 bp, Artificial Sequence
  Synthetic Polynucleotide
taatacgactcactatagggcctcacctcattagaaatctccacccatttaacagaggagaaaatggatggagatttctaacctggcggcagcgcaaaagatg

SEQ ID NO: 224460 - DNA, 103 bp, Artificial Sequence
  Synthetic Polynucleotide
taatacgactcactatagggatcctcatcgtcatcctcgtcgtcgtcttcaacagaggagagaagacatggacgaggataacctggcggcagcgcaaaagatg

SEQ ID NO: 224461 - DNA, 103 bp, Artificial Sequence
  Synthetic Polynucleotide
taatacgactcactatagggcattatcttcatcctcatcgtcatcctcgtaacagaggagaacgaggatgacgatgaggaacctggcggcagcgcaaaagatg

SEQ ID NO: 224462 - DNA, 103 bp, Artificial Sequence
  Synthetic Polynucleotide
taatacgactcactatagggccctcggactcattatcttcatcctcatcgaacagaggagacgatgaatgtgaagataaaacctggcggcagcgcaaaagatg

SEQ ID NO: 224463 - DNA, 103 bp, Artificial Sequence
  Synthetic Polynucleotide
taatacgactcactatagggggagctgctgccctcggactcattatcttcaacagaggagagaagatatggagtccgagaacctggcggcagcgcaaaagatg

SEQ ID NO: 224464 - DNA, 103 bp, Artificial Sequence
  Synthetic Polynucleotide
taatacgactcactatagggaggaggagctggagctgctgccctcggactaacagaggagaagtccgatggcagcagctaacctggcggcagcgcaaaagatg

SEQ ID NO: 224465 - DNA, 103 bp, Artificial Sequence
  Synthetic Polynucleotide
taatacgactcactatagggtcccctgaggaggaggagctggagctgctgaacagaggagacagcagatgcagctcctcaacctggcggcagcgcaaaagatg

SEQ ID NO: 224466 - DNA, 103 bp, Artificial Sequence
  Synthetic Polynucleotide
taatacgactcactataggggtctgaggagtcccctgaggaggaggagctaacagaggagaagctccatgtcctcagggaacctggcggcagcgcaaaagatg

SEQ ID NO: 224467 - DNA, 103 bp, Artificial Sequence
  Synthetic Polynucleotide
taatacgactcactatagggtggagtcagagtctgaggagtcccctgaggaacagaggagacctcagatgactcctcagaacctggcggcagcgcaaaagatg

SEQ ID NO: 224468 - DNA, 103 bp, Artificial Sequence
  Synthetic Polynucleotide
taatacgactcactatagggtacggaacttcctcacctcattagaaatctaacagaggagaagatttatgatgaggtgaaacctggcggcagcgcaaaagatg

SEQ ID NO: 224469 - DNA, 103 bp, Artificial Sequence
  Synthetic Polynucleotide
taatacgactcactatagggtctgtcaatgtacggaacttcctcacctcaaacagaggagatgaggtatggaagttccgaacctggcggcagcgcaaaagatg

SEQ ID NO: 224470 - DNA, 103 bp, Artificial Sequence
  Synthetic Polynucleotide
taatacgactcactataggggaggatcaattctgtcaatgtacggaacttaacagaggagaaagttcatgacattgacaaacctggcggcagcgcaaaagatg

SEQ ID NO: 224471 - DNA, 103 bp, Artificial Sequence
  Synthetic Polynucleotide
taatacgactcactatagggcctgagcatcgaggatcaattctgtcaatgaacagaggagacattgaatgaattgatccaacctggcggcagcgcaaaagatg

SEQ ID NO: 224472 - DNA, 103 bp, Artificial Sequence
  Synthetic Polynucleotide
taatacgactcactatagggttaacatgttcctgagcatcgaggatcaataacagaggagaattgatatgcgatgctcaaacctggcggcagcgcaaaagatg

SEQ ID NO: 224473 - DNA, 103 bp, Artificial Sequence
  Synthetic Polynucleotide
taatacgactcactataggggtaaggatttttaacatgttcctgagcatcaacagaggagagatgctatggaacatgttaacctggcggcagcgcaaaagatg

SEQ ID NO: 224474 - DNA, 103 bp, Artificial Sequence
  Synthetic Polynucleotide
taatacgactcactatagggttttgcctttgtaaggatttttaacatgttaacagaggagaaacatgatgaaaatccttaacctggcggcagcgcaaaagatg

SEQ ID NO: 224475 - DNA, 103 bp, Artificial Sequence
  Synthetic Polynucleotide
taatacgactcactatagggttgggggcggccatttccaggtctgtggggaacagaggagaccccacatgcctggaaataacctggcggcagcgcaaaagatg

SEQ ID NO: 224476 - DNA, 103 bp, Artificial Sequence
  Synthetic Polynucleotide
taatacgactcactatagggttcttgagttttttgcctttgtaaggatttaacagaggagaaaatccatgcaaaggcaaaacctggcggcagcgcaaaagatg

SEQ ID NO: 224477 - DNA, 103 bp, Artificial Sequence
  Synthetic Polynucleotide
taatacgactcactataggggtctgggtgtttcttgagttttttgcctttaacagaggagaaaaggcatgaaactcaagaacctggcggcagcgcaaaagatg

SEQ ID NO: 224478 - DNA, 103 bp, Artificial Sequence
  Synthetic Polynucleotide
taatacgactcactatagggtctttgggaagtctgggtgtttcttgagttaacagaggagaaactcaatgaacacccagaacctggcggcagcgcaaaagatg

SEQ ID NO: 224479 - DNA, 103 bp, Artificial Sequence
  Synthetic Polynucleotide
taatacgactcactataggggtcaggggcttctttgggaagtctgggtgtaacagaggagaacacccatgcttcccaaaaacctggcggcagcgcaaaagatg

SEQ ID NO: 224480 - DNA, 103 bp, Artificial Sequence
  Synthetic Polynucleotide
taatacgactcactataggggaaataaggggtcaggggcttctttgggaaaacagaggagattcccaatgaagcccctgaacctggcggcagcgcaaaagatg

SEQ ID NO: 224481 - DNA, 103 bp, Artificial Sequence
  Synthetic Polynucleotide
taatacgactcactatagggtgaagaagcggaaataaggggtcaggggctaacagaggagaagccccatgccccttattaacctggcggcagcgcaaaagatg

SEQ ID NO: 224482 - DNA, 103 bp, Artificial Sequence
  Synthetic Polynucleotide
taatacgactcactatagggcgcttctccatgaagaagcggaaataagggaacagaggagacccttaatgccgcttcttaacctggcggcagcgcaaaagatg

SEQ ID NO: 224483 - DNA, 103 bp, Artificial Sequence
  Synthetic Polynucleotide
taatacgactcactatagggatacttggcccgcttctccatgaagaagcgaacagaggagacgcttcatgatggagaagaacctggcggcagcgcaaaagatg

SEQ ID NO: 224484 - DNA, 103 bp, Artificial Sequence
  Synthetic Polynucleotide
taatacgactcactatagggggagtttcgcatacttggcccgcttctccaaacagaggagatggagaatggggccaagtaacctggcggcagcgcaaaagatg

SEQ ID NO: 224485 - DNA, 103 bp, Artificial Sequence
  Synthetic Polynucleotide
taatacgactcactatagggatctcagggtggagtttcgcatacttggccaacagaggagaggccaaatgtgcgaaactaacctggcggcagcgcaaaagatg

SEQ ID NO: 224486 - DNA, 103 bp, Artificial Sequence
  Synthetic Polynucleotide
taatacgactcactataggggtcttggcctttgggggcggccatttccagaacagaggagactggaaatggccgcccccaacctggcggcagcgcaaaagatg

SEQ ID NO: 224487 - DNA, 103 bp, Artificial Sequence
  Synthetic Polynucleotide
taatacgactcactatagggcaggttgctcatctcagggtggagtttcgcaacagaggagagcgaaaatgcaccctgagaacctggcggcagcgcaaaagatg

SEQ ID NO: 224488 - DNA, 103 bp, Artificial Sequence
  Synthetic Polynucleotide
taatacgactcactatagggtggttaggtccaggttgctcatctcagggtaacagaggagaaccctgatgtgagcaaccaacctggcggcagcgcaaaagatg

SEQ ID NO: 224489 - DNA, 103 bp, Artificial Sequence
  Synthetic Polynucleotide
taatacgactcactataggggacagaatcttggttaggtccaggttgctcaacagaggagagagcaaatgggacctaacaacctggcggcagcgcaaaagatg

SEQ ID NO: 224490 - DNA, 103 bp, Artificial Sequence
  Synthetic Polynucleotide
taatacgactcactataggggtatttcttggacagaatcttggttaggtcaacagaggagagacctaatgaagattctgaacctggcggcagcgcaaaagatg

SEQ ID NO: 224491 - DNA, 103 bp, Artificial Sequence
  Synthetic Polynucleotide
taatacgactcactataggggaagctccttgtatttcttggacagaatctaacagaggagaagattcatgccaagaaataacctggcggcagcgcaaaagatg

SEQ ID NO: 224492 - DNA, 103 bp, Artificial Sequence
  Synthetic Polynucleotide
taatacgactcactatagggttcttctccggaagctccttgtatttcttgaacagaggagacaagaaatgcaaggagctaacctggcggcagcgcaaaagatg

SEQ ID NO: 224493 - DNA, 103 bp, Artificial Sequence
  Synthetic Polynucleotide
taatacgactcactatagggtttcatcttcttcttctccggaagctccttaacagaggagaaaggagatgccggagaagaacctggcggcagcgcaaaagatg

SEQ ID NO: 224494 - DNA, 103 bp, Artificial Sequence
  Synthetic Polynucleotide
taatacgactcactatagggcctgaatatatttcatcttcttcttctccgaacagaggagacggagaatgagaagatgaaacctggcggcagcgcaaaagatg

SEQ ID NO: 224495 - DNA, 103 bp, Artificial Sequence
  Synthetic Polynucleotide
taatacgactcactatagggctctggaagtcctgaatatatttcatcttcaacagaggagagaagatatgatatattcaaacctggcggcagcgcaaaagatg

SEQ ID NO: 224496 - DNA, 103 bp, Artificial Sequence
  Synthetic Polynucleotide
taatacgactcactatagggctgtttctctctctggaagtcctgaatataaacagaggagatatattatggacttccagaacctggcggcagcgcaaaagatg

SEQ ID NO: 224497 - DNA, 103 bp, Artificial Sequence
  Synthetic Polynucleotide
taatacgactcactataggggggaccaacggtcttggcctttgggggcggaacagaggagaccgcccatgaaggccaagaacctggcggcagcgcaaaagatg

SEQ ID NO: 224498 - DNA, 103 bp, Artificial Sequence
  Synthetic Polynucleotide
taatacgactcactataggggctcgaactcctgtttctctctctggaagtaacagaggagaacttccatggagagaaacaacctggcggcagcgcaaaagatg

SEQ ID NO: 224499 - DNA, 103 bp, Artificial Sequence
  Synthetic Polynucleotide
taatacgactcactataggggccaggtttcgctcgaactcctgtttctctaacagaggagaagagaaatgggagttcgaaacctggcggcagcgcaaaagatg

SEQ ID NO: 224500 - DNA, 103 bp, Artificial Sequence
  Synthetic Polynucleotide
taatacgactcactatagggcctgaatcgggccaggtttcgctcgaactcaacagaggagagagttcatgcgaaacctgaacctggcggcagcgcaaaagatg

SEQ ID NO: 224501 - DNA, 103 bp, Artificial Sequence
  Synthetic Polynucleotide
taatacgactcactatagggggtgatcctccctgaatcgggccaggtttcaacagaggagagaaaccatgcccgattcaaacctggcggcagcgcaaaagatg

SEQ ID NO: 224502 - DNA, 103 bp, Artificial Sequence
  Synthetic Polynucleotide
taatacgactcactatagggattaggtcggggtgatcctccctgaatcggaacagaggagaccgattatgggaggatcaaacctggcggcagcgcaaaagatg

SEQ ID NO: 224503 - DNA, 103 bp, Artificial Sequence
  Synthetic Polynucleotide
taatacgactcactatagggggcattctggattaggtcggggtgatcctcaacagaggagagaggatatgcccgacctaaacctggcggcagcgcaaaagatg

SEQ ID NO: 224504 - DNA, 103 bp, Artificial Sequence
  Synthetic Polynucleotide
taatacgactcactatagggccgatttcttggcattctggattaggtcggaacagaggagaccgaccatgtccagaatgaacctggcggcagcgcaaaagatg

SEQ ID NO: 224505 - DNA, 103 bp, Artificial Sequence
  Synthetic Polynucleotide
taatacgactcactatagggtctgggatgtccgatttcttggcattctggaacagaggagaccagaaatgcaagaaatcaacctggcggcagcgcaaaagatg

SEQ ID NO: 224506 - DNA, 103 bp, Artificial Sequence
  Synthetic Polynucleotide
taatacgactcactatagggtttgggcttctctgggatgtccgatttcttaacagaggagaaagaaaatggacatcccaaacctggcggcagcgcaaaagatg

SEQ ID NO: 224507 - DNA, 103 bp, Artificial Sequence
  Synthetic Polynucleotide
taatacgactcactataggggctggggggttttgggcttctctgggatgtaacagaggagaacatccatgagaagcccaaacctggcggcagcgcaaaagatg

SEQ ID NO: 224508 - DNA, 103 bp, Artificial Sequence
  Synthetic Polynucleotide
taatacgactcactatagggatgtcttcctgggaccaacggtcttggcctaacagaggagaaggccaatgccgttggtcaacctggcggcagcgcaaaagatg

SEQ ID NO: 224509 - DNA, 103 bp, Artificial Sequence
  Synthetic Polynucleotide
taatacgactcactatagggtaccacagctgctggggggttttgggcttcaacagaggagagaagccatgaaccccccaaacctggcggcagcgcaaaagatg

SEQ ID NO: 224510 - DNA, 103 bp, Artificial Sequence
  Synthetic Polynucleotide
taatacgactcactatagggctcgtgggtgtaccacagctgctggggggtaacagaggagaacccccatgcagctgtggaacctggcggcagcgcaaaagatg

SEQ ID NO: 224511 - DNA, 103 bp, Artificial Sequence
  Synthetic Polynucleotide
taatacgactcactatagggacaccttcttctcgtgggtgtaccacagctaacagaggagaagctgtatgacacccacgaacctggcggcagcgcaaaagatg

SEQ ID NO: 224512 - DNA, 103 bp, Artificial Sequence
  Synthetic Polynucleotide
taatacgactcactatagggactttgagatacaccttcttctcgtgggtgaacagaggagacacccaatggaagaaggtaacctggcggcagcgcaaaagatg

SEQ ID NO: 224513 - DNA, 103 bp, Artificial Sequence
  Synthetic Polynucleotide
taatacgactcactatagggatctggccgcactttgagatacaccttcttaacagaggagaaagaagatgtatctcaaaaacctggcggcagcgcaaaagatg

SEQ ID NO: 224514 - DNA, 103 bp, Artificial Sequence
  Synthetic Polynucleotide
taatacgactcactatagggtcgtagtggcatctggccgcactttgagataacagaggagaatctcaatgtgcggccagaacctggcggcagcgcaaaagatg

SEQ ID NO: 224515 - DNA, 103 bp, Artificial Sequence
  Synthetic Polynucleotide
taatacgactcactatagggttcacctccttcgtagtggcatctggccgcaacagaggagagcggccatgtgccactacaacctggcggcagcgcaaaagatg

SEQ ID NO: 224516 - DNA, 103 bp, Artificial Sequence
  Synthetic Polynucleotide
taatacgactcactatagggcagggagtccttcacctccttcgtagtggcaacagaggagagccactatgaaggaggtgaacctggcggcagcgcaaaagatg

SEQ ID NO: 224517 - DNA, 103 bp, Artificial Sequence
  Synthetic Polynucleotide
taatacgactcactatagggactgcttccccagggagtccttcacctcctaacagaggagaaggaggatgaggactcccaacctggcggcagcgcaaaagatg

SEQ ID NO: 224518 - DNA, 103 bp, Artificial Sequence
  Synthetic Polynucleotide
taatacgactcactatagggagctgagaccactgcttccccagggagtccaacagaggagaggactcatgggggaagcaaacctggcggcagcgcaaaagatg

SEQ ID NO: 224519 - DNA, 103 bp, Artificial Sequence
  Synthetic Polynucleotide
taatacgactcactatagggcaaagtcagcatgtcttcctgggaccaacgaacagaggagacgttggatgcaggaagacaacctggcggcagcgcaaaagatg

SEQ ID NO: 224520 - DNA, 103 bp, Artificial Sequence
  Synthetic Polynucleotide
taatacgactcactatagggtttgtccgagagctgagaccactgcttcccaacagaggagagggaagatgtggtctcagaacctggcggcagcgcaaaagatg

SEQ ID NO: 224521 - DNA, 103 bp, Artificial Sequence
  Synthetic Polynucleotide
taatacgactcactatagggtcagcctctttttgtccgagagctgagaccaacagaggagaggtctcatgtctcggacaaacctggcggcagcgcaaaagatg

SEQ ID NO: 224522 - DNA, 103 bp, Artificial Sequence
  Synthetic Polynucleotide
taatacgactcactatagggtgaatccatttcagcctctttttgtccgagaacagaggagactcggaatgaaagaggctaacctggcggcagcgcaaaagatg

SEQ ID NO: 224523 - DNA, 103 bp, Artificial Sequence
  Synthetic Polynucleotide
taatacgactcactatagggcagggccttatgaatccatttcagcctcttaacagaggagaaagaggatgaaatggattaacctggcggcagcgcaaaagatg

SEQ ID NO: 224524 - DNA, 103 bp, Artificial Sequence
  Synthetic Polynucleotide
taatacgactcactatagggtccgctgctccagggccttatgaatccattaacagaggagaaatggaatgataaggcccaacctggcggcagcgcaaaagatg

SEQ ID NO: 224525 - DNA, 103 bp, Artificial Sequence
  Synthetic Polynucleotide
taatacgactcactatagggtcgtactccttccgctgctccagggccttaaacagaggagataaggcatgggagcagcgaacctggcggcagcgcaaaagatg

SEQ ID NO: 224526 - DNA, 103 bp, Artificial Sequence
  Synthetic Polynucleotide
taatacgactcactatagggcatgatctcctcgtactccttccgctgctcaacagaggagagagcagatgaaggagtacaacctggcggcagcgcaaaagatg

SEQ ID NO: 224527 - DNA, 103 bp, Artificial Sequence
  Synthetic Polynucleotide
taatacgactcactatagggtatagtctctcatgatctcctcgtactcctaacagaggagaaggagtatgaggagatcaaacctggcggcagcgcaaaagatg

SEQ ID NO: 224528 - DNA, 103 bp, Artificial Sequence
  Synthetic Polynucleotide
taatacgactcactatagggtgcttctggatatagtctctcatgatctccaacagaggagaggagatatggagagactaaacctggcggcagcgcaaaagatg

SEQ ID NO: 224529 - DNA, 103 bp, Artificial Sequence
  Synthetic Polynucleotide
taatacgactcactatagggcagctctgggtgcttctggatatagtctctaacagaggagaagagacatgatccagaagaacctggcggcagcgcaaaagatg

SEQ ID NO: 224530 - DNA, 103 bp, Artificial Sequence
  Synthetic Polynucleotide
taatacgactcactatagggtgcattccagcaaagtcagcatgtcttcctaacagaggagaaggaagatgtgctgacttaacctggcggcagcgcaaaagatg

SEQ ID NO: 224531 - DNA, 103 bp, Artificial Sequence
  Synthetic Polynucleotide
taatacgactcactatagggcactgatgttcagctctgggtgcttctggaaacagaggagatccagaatgacccagagcaacctggcggcagcgcaaaagatg

SEQ ID NO: 224532 - DNA, 103 bp, Artificial Sequence
  Synthetic Polynucleotide
taatacgactcactatagggataccctcctcactgatgttcagctctgggaacagaggagacccagaatggaacatcagaacctggcggcagcgcaaaagatg

SEQ ID NO: 224533 - DNA, 103 bp, Artificial Sequence
  Synthetic Polynucleotide
taatacgactcactatagggggacttggtgataccctcctcactgatgttaacagaggagaaacatcatggaggagggtaacctggcggcagcgcaaaagatg

SEQ ID NO: 224534 - DNA, 103 bp, Artificial Sequence
  Synthetic Polynucleotide
taatacgactcactatagggtggtgagggtggacttggtgataccctcctaacagaggagaaggaggatgtcaccaagtaacctggcggcagcgcaaaagatg

SEQ ID NO: 224535 - DNA, 103 bp, Artificial Sequence
  Synthetic Polynucleotide
taatacgactcactatagggcgttcggccttggtgagggtggacttggtgaacagaggagacaccaaatgcaccctcacaacctggcggcagcgcaaaagatg

SEQ ID NO: 224536 - DNA, 103 bp, Artificial Sequence
  Synthetic Polynucleotide
taatacgactcactatagggcttgagctggcgttcggccttggtgagggtaacagaggagaaccctcatgaaggccgaaaacctggcggcagcgcaaaagatg

SEQ ID NO: 224537 - DNA, 103 bp, Artificial Sequence
  Synthetic Polynucleotide
taatacgactcactatagggcaaacttgtccttgagctggcgttcggcctaacagaggagaaggccgatggccagctcaaacctggcggcagcgcaaaagatg

SEQ ID NO: 224538 - DNA, 103 bp, Artificial Sequence
  Synthetic Polynucleotide
taatacgactcactatagggggtcgcccgtcaaacttgtccttgagctggaacagaggagaccagctatgggacaagttaacctggcggcagcgcaaaagatg

SEQ ID NO: 224539 - DNA, 103 bp, Artificial Sequence
  Synthetic Polynucleotide
taatacgactcactatagggtggcttggtgggtcgcccgtcaaacttgtcaacagaggagagacaagatggacgggcgaaacctggcggcagcgcaaaagatg

SEQ ID NO: 224540 - DNA, 103 bp, Artificial Sequence
  Synthetic Polynucleotide
taatacgactcactatagggtgttcggaggtggcttggtgggtcgcccgtaacagaggagaacgggcatgccaccaagcaacctggcggcagcgcaaaagatg

SEQ ID NO: 224541 - DNA, 103 bp, Artificial Sequence
  Synthetic Polynucleotide
taatacgactcactatagggttgttcttcatgcattccagcaaagtcagcaacagaggagagctgacatggctggaatgaacctggcggcagcgcaaaagatg

SEQ ID NO: 224542 - DNA, 103 bp, Artificial Sequence
  Synthetic Polynucleotide
taatacgactcactatagggagcgagtagctgttcggaggtggcttggtgaacagaggagacaccaaatgacctccgaaaacctggcggcagcgcaaaagatg

SEQ ID NO: 224543 - DNA, 103 bp, Artificial Sequence
  Synthetic Polynucleotide
taatacgactcactatagggtgcgcagtacagcgagtagctgttcggaggaacagaggagacctccgatgagctactcgaacctggcggcagcgcaaaagatg

SEQ ID NO: 224544 - DNA, 103 bp, Artificial Sequence
  Synthetic Polynucleotide
taatacgactcactatagggccatgagctctgcgcagtacagcgagtagcaacagaggagagctactatgtgtactgcgaacctggcggcagcgcaaaagatg

SEQ ID NO: 224545 - DNA, 103 bp, Artificial Sequence
  Synthetic Polynucleotide
taatacgactcactatagggttcatgttggccatgagctctgcgcagtacaacagaggagagtactgatgagagctcataacctggcggcagcgcaaaagatg

SEQ ID NO: 224546 - DNA, 103 bp, Artificial Sequence
  Synthetic Polynucleotide
taatacgactcactataggggggcacgtccttcatgttggccatgagctcaacagaggagagagctcatggccaacatgaacctggcggcagcgcaaaagatg

SEQ ID NO: 224547 - DNA, 103 bp, Artificial Sequence
  Synthetic Polynucleotide
taatacgactcactataggggctctgtgctgggcacgtccttcatgttggaacagaggagaccaacaatgaggacgtgcaacctggcggcagcgcaaaagatg

SEQ ID NO: 224548 - DNA, 103 bp, Artificial Sequence
  Synthetic Polynucleotide
taatacgactcactatagggagcaccatgcgctctgtgctgggcacgtccaacagaggagaggacgtatgcagcacagaaacctggcggcagcgcaaaagatg

SEQ ID NO: 224549 - DNA, 103 bp, Artificial Sequence
  Synthetic Polynucleotide
taatacgactcactatagggctggctgcacagcaccatgcgctctgtgctaacagaggagaagcacaatgcgcatggtgaacctggcggcagcgcaaaagatg

SEQ ID NO: 224550 - DNA, 103 bp, Artificial Sequence
  Synthetic Polynucleotide
taatacgactcactataggggcttccactgctggctgcacagcaccatgcaacagaggagagcatggatgtgtgcagccaacctggcggcagcgcaaaagatg

SEQ ID NO: 224551 - DNA, 103 bp, Artificial Sequence
  Synthetic Polynucleotide
taatacgactcactatagggtgggacagcagcttccactgctggctgcacaacagaggagagtgcagatggcagtggaaaacctggcggcagcgcaaaagatg

SEQ ID NO: 224552 - DNA, 103 bp, Artificial Sequence
  Synthetic Polynucleotide
taatacgactcactatagggcccgtccatggtccgaacctggatccacataacagaggagaatgtggatgcaggttcggaacctggcggcagcgcaaaagatg

SEQ ID NO: 224553 - DNA, 103 bp, Artificial Sequence
  Synthetic Polynucleotide
taatacgactcactatagggtggctccacgtggaacagctcctggatcttaacagaggagaaagatcatggagctgttcaacctggcggcagcgcaaaagatg

SEQ ID NO: 224554 - DNA, 103 bp, Artificial Sequence
  Synthetic Polynucleotide
taatacgactcactataggggaaggccatgtcgcactcatcgcacatgagaacagaggagactcatgatggatgagtgcaacctggcggcagcgcaaaagatg

SEQ ID NO: 224555 - DNA, 103 bp, Artificial Sequence
  Synthetic Polynucleotide
taatacgactcactatagggagtagatgtggaaggccatgtcgcactcataacagaggagaatgagtatgacatggcctaacctggcggcagcgcaaaagatg

SEQ ID NO: 224556 - DNA, 103 bp, Artificial Sequence
  Synthetic Polynucleotide
taatacgactcactataggggggtccaggcagtagatgtggaaggccatgaacagaggagacatggcatgccacatctaaacctggcggcagcgcaaaagatg

SEQ ID NO: 224557 - DNA, 103 bp, Artificial Sequence
  Synthetic Polynucleotide
taatacgactcactataggggctgaggggcgggtccaggcagtagatgtgaacagaggagacacatcatgtgcctggacaacctggcggcagcgcaaaagatg

SEQ ID NO: 224558 - DNA, 103 bp, Artificial Sequence
  Synthetic Polynucleotide
taatacgactcactatagggtgggaacactgctgaggggcgggtccaggcaacagaggagagcctggatgcgcccctcaaacctggcggcagcgcaaaagatg

SEQ ID NO: 224559 - DNA, 103 bp, Artificial Sequence
  Synthetic Polynucleotide
taatacgactcactatagggtcgtcctcgctgggaacactgctgaggggcaacagaggagagcccctatgcagtgttccaacctggcggcagcgcaaaagatg

SEQ ID NO: 224560 - DNA, 103 bp, Artificial Sequence
  Synthetic Polynucleotide
taatacgactcactataggggcagtaccactcgtcctcgctgggaacactaacagaggagaagtgttatgagcgaggacaacctggcggcagcgcaaaagatg

SEQ ID NO: 224561 - DNA, 103 bp, Artificial Sequence
  Synthetic Polynucleotide
taatacgactcactatagggggcactcagggcagtaccactcgtcctcgcaacagaggagagcgaggatgagtggtactaacctggcggcagcgcaaaagatg

SEQ ID NO: 224562 - DNA, 103 bp, Artificial Sequence
  Synthetic Polynucleotide
taatacgactcactataggggcatcattccggcactcagggcagtaccacaacagaggagagtggtaatgccctgagtgaacctggcggcagcgcaaaagatg

SEQ ID NO: 224563 - DNA, 103 bp, Artificial Sequence
  Synthetic Polynucleotide
taatacgactcactatagggcacctcgctggcatcattccggcactcaggaacagaggagacctgagatgcggaatgataacctggcggcagcgcaaaagatg

SEQ ID NO: 224564 - DNA, 103 bp, Artificial Sequence
  Synthetic Polynucleotide
taatacgactcactatagggtctgcaggcctggctccacgtggaacagctaacagaggagaagctgtatgacgtggagcaacctggcggcagcgcaaaagatg

SEQ ID NO: 224565 - DNA, 103 bp, Artificial Sequence
  Synthetic Polynucleotide
taatacgactcactatagggccgccagtaccacctcgctggcatcattccaacagaggagaggaatgatgccagcgaggaacctggcggcagcgcaaaagatg

SEQ ID NO: 224566 - DNA, 103 bp, Artificial Sequence
  Synthetic Polynucleotide
taatacgactcactatagggagccgctctcccgccagtaccacctcgctgaacagaggagacagcgaatgggtactggcaacctggcggcagcgcaaaagatg

SEQ ID NO: 224567 - DNA, 103 bp, Artificial Sequence
  Synthetic Polynucleotide
taatacgactcactataggggctctctctcagccgctctcccgccagtacaacagaggagagtactgatgggagagcggaacctggcggcagcgcaaaagatg

SEQ ID NO: 224568 - DNA, 103 bp, Artificial Sequence
  Synthetic Polynucleotide
taatacgactcactatagggccttcttcttgctctctctcagccgctctcaacagaggagagagagcatgtgagagagaaacctggcggcagcgcaaaagatg

SEQ ID NO: 224569 - DNA, 103 bp, Artificial Sequence
  Synthetic Polynucleotide
taatacgactcactataggggccatcttcgccttcttcttgctctctctcaacagaggagagagagaatgcaagaagaaaacctggcggcagcgcaaaagatg

SEQ ID NO: 224570 - DNA, 103 bp, Artificial Sequence
  Synthetic Polynucleotide
taatacgactcactatagggtgtggccgaggccatcttcgccttcttcttaacagaggagaaagaagatggcgaagatgaacctggcggcagcgcaaaagatg

SEQ ID NO: 224571 - DNA, 103 bp, Artificial Sequence
  Synthetic Polynucleotide
taatacgactcactataggggtgaggacgatgtggccgaggccatcttcgaacagaggagacgaagaatgcctcggccaaacctggcggcagcgcaaaagatg

SEQ ID NO: 224572 - DNA, 103 bp, Artificial Sequence
  Synthetic Polynucleotide
taatacgactcactatagggcagtcccgctgtgaggacgatgtggccgagaacagaggagactcggcatgatcgtcctcaacctggcggcagcgcaaaagatg

SEQ ID NO: 224573 - DNA, 103 bp, Artificial Sequence
  Synthetic Polynucleotide
taatacgactcactataggggcccttgccccagtcccgctgtgaggacgaaacagaggagatcgtccatgcagcgggacaacctggcggcagcgcaaaagatg

SEQ ID NO: 224574 - DNA, 103 bp, Artificial Sequence
  Synthetic Polynucleotide
taatacgactcactatagggcacaggccatgcccttgccccagtcccgctaacagaggagaagcgggatgggggcaaggaacctggcggcagcgcaaaagatg

SEQ ID NO: 224575 - DNA, 103 bp, Artificial Sequence
  Synthetic Polynucleotide
taatacgactcactatagggtagaacagcctctgcaggcctggctccacgaacagaggagacgtggaatgaggcctgcaaacctggcggcagcgcaaaagatg

SEQ ID NO: 224576 - DNA, 103 bp, Artificial Sequence
  Synthetic Polynucleotide
taatacgactcactataggggtgcggcccacacaggccatgcccttgcccaacagaggagagggcaaatgcatggcctgaacctggcggcagcgcaaaagatg

SEQ ID NO: 224577 - DNA, 103 bp, Artificial Sequence
  Synthetic Polynucleotide
taatacgactcactatagggacattccttggtgcggcccacacaggccataacagaggagaatggccatggtgggccgcaacctggcggcagcgcaaaagatg

SEQ ID NO: 224578 - DNA, 103 bp, Artificial Sequence
  Synthetic Polynucleotide
taatacgactcactatagggggacgatggtacattccttggtgcggcccaaacagaggagatgggccatgccaaggaataacctggcggcagcgcaaaagatg

SEQ ID NO: 224579 - DNA, 103 bp, Artificial Sequence
  Synthetic Polynucleotide
taatacgactcactatagggtggttggacgggacgatggtacattccttgaacagaggagacaaggaatgtaccatcgtaacctggcggcagcgcaaaagatg

SEQ ID NO: 224580 - DNA, 103 bp, Artificial Sequence
  Synthetic Polynucleotide
taatacgactcactataggggggtccgtagtggttggacgggacgatggtaacagaggagaaccatcatgccgtccaacaacctggcggcagcgcaaaagatg

SEQ ID NO: 224581 - DNA, 103 bp, Artificial Sequence
  Synthetic Polynucleotide
taatacgactcactatagggtccccgggatgggtccgtagtggttggacgaacagaggagacgtccaatgactacggacaacctggcggcagcgcaaaagatg

SEQ ID NO: 224582 - DNA, 103 bp, Artificial Sequence
  Synthetic Polynucleotide
taatacgactcactatagggcccacggggatccccgggatgggtccgtagaacagaggagactacggatgcatcccgggaacctggcggcagcgcaaaagatg

SEQ ID NO: 224583 - DNA, 103 bp, Artificial Sequence
  Synthetic Polynucleotide
taatacgactcactatagggccacatggtgcccacggggatccccgggataacagaggagaatcccgatgatccccgtgaacctggcggcagcgcaaaagatg

SEQ ID NO: 224584 - DNA, 103 bp, Artificial Sequence
  Synthetic Polynucleotide
taatacgactcactatagggctcggaaccgccacatggtgcccacggggaaacagaggagatccccgatggcaccatgtaacctggcggcagcgcaaaagatg

SEQ ID NO: 224585 - DNA, 103 bp, Artificial Sequence
  Synthetic Polynucleotide
taatacgactcactatagggctgacctggactcggaaccgccacatggtgaacagaggagacaccatatggcggttccgaacctggcggcagcgcaaaagatg

SEQ ID NO: 224586 - DNA, 103 bp, Artificial Sequence
  Synthetic Polynucleotide
taatacgactcactatagggtttgcccctgtagaacagcctctgcaggccaacagaggagaggcctgatgaggctgttcaacctggcggcagcgcaaaagatg

SEQ ID NO: 224587 - DNA, 103 bp, Artificial Sequence
  Synthetic Polynucleotide
taatacgactcactatagggacccgactcgctgacctggactcggaaccgaacagaggagacggttcatggtccaggtcaacctggcggcagcgcaaaagatg

SEQ ID NO: 224588 - DNA, 103 bp, Artificial Sequence
  Synthetic Polynucleotide
taatacgactcactataggggccgatggacacccgactcgctgacctggaaacagaggagatccaggatggcgagtcggaacctggcggcagcgcaaaagatg

SEQ ID NO: 224589 - DNA, 103 bp, Artificial Sequence
  Synthetic Polynucleotide
taatacgactcactataggggccacgtggggccgatggacacccgactcgaacagaggagacgagtcatgtgtccatcgaacctggcggcagcgcaaaagatg

SEQ ID NO: 224590 - DNA, 103 bp, Artificial Sequence
  Synthetic Polynucleotide
taatacgactcactataggggtgtatgccagccacgtggggccgatggacaacagaggagagtccatatgccccacgtgaacctggcggcagcgcaaaagatg

SEQ ID NO: 224591 - DNA, 103 bp, Artificial Sequence
  Synthetic Polynucleotide
taatacgactcactatagggtgctccggccgtgtatgccagccacgtgggaacagaggagacccacgatgctggcatacaacctggcggcagcgcaaaagatg

SEQ ID NO: 224592 - DNA, 103 bp, Artificial Sequence
  Synthetic Polynucleotide
taatacgactcactataggggctccgtcgttgctccggccgtgtatgccaaacagaggagatggcatatgcggccggagaacctggcggcagcgcaaaagatg

SEQ ID NO: 224593 - DNA, 103 bp, Artificial Sequence
  Synthetic Polynucleotide
taatacgactcactatagggtagggagtacgctccgtcgttgctccggccaacagaggagaggccggatgaacgacggaaacctggcggcagcgcaaaagatg

SEQ ID NO: 224594 - DNA, 103 bp, Artificial Sequence
  Synthetic Polynucleotide
taatacgactcactatagggccgccaggactagggagtacgctccgtcgtaacagaggagaacgacgatgcgtactcccaacctggcggcagcgcaaaagatg

SEQ ID NO: 224595 - DNA, 103 bp, Artificial Sequence
  Synthetic Polynucleotide
taatacgactcactatagggtcatagccccccgccaggactagggagtacaacagaggagagtactcatgagtcctggcaacctggcggcagcgcaaaagatg

SEQ ID NO: 224596 - DNA, 103 bp, Artificial Sequence
  Synthetic Polynucleotide
taatacgactcactatagggcacatcatcctcatagccccccgccaggacaacagaggagagtcctgatggggggctataacctggcggcagcgcaaaagatg

SEQ ID NO: 224597 - DNA, 103 bp, Artificial Sequence
  Synthetic Polynucleotide
taatacgactcactatagggcctccatctgtttgcccctgtagaacagccaacagaggagaggctgtatgacaggggcaaacctggcggcagcgcaaaagatg

SEQ ID NO: 224598 - DNA, 103 bp, Artificial Sequence
  Synthetic Polynucleotide
taatacgactcactatagggtcccatggtccacatcatcctcatagccccaacagaggagaggggctatgaggatgatgaacctggcggcagcgcaaaagatg

SEQ ID NO: 224599 - DNA, 103 bp, Artificial Sequence
  Synthetic Polynucleotide
taatacgactcactataggggtgaaaaaattcccatggtccacatcatccaacagaggagaggatgaatgggaccatggaacctggcggcagcgcaaaagatg

SEQ ID NO: 224600 - DNA, 103 bp, Artificial Sequence
  Synthetic Polynucleotide
taatacgactcactatagggacccgtgtatgtgaaaaaattcccatggtcaacagaggagagaccatatgaattttttcaacctggcggcagcgcaaaagatg

SEQ ID NO: 224601 - DNA, 103 bp, Artificial Sequence
  Synthetic Polynucleotide
taatacgactcactataggggaccaccactacccgtgtatgtgaaaaaataacagaggagaatttttatgcatacacggaacctggcggcagcgcaaaagatg

SEQ ID NO: 224602 - DNA, 103 bp, Artificial Sequence
  Synthetic Polynucleotide
taatacgactcactataggggaaagatctcgaccaccactacccgtgtataacagaggagaatacacatgtagtggtggaacctggcggcagcgcaaaagatg

SEQ ID NO: 224603 - DNA, 103 bp, Artificial Sequence
  Synthetic Polynucleotide
taatacgactcactatagggcttgttgccggaaagatctcgaccaccactaacagaggagaagtggtatgcgagatcttaacctggcggcagcgcaaaagatg

SEQ ID NO: 224604 - DNA, 103 bp, Artificial Sequence
  Synthetic Polynucleotide
taatacgactcactatagggccgcggtcctcttgttgccggaaagatctcaacagaggagagagatcatgccggcaacaaacctggcggcagcgcaaaagatg

SEQ ID NO: 224605 - DNA, 103 bp, Artificial Sequence
  Synthetic Polynucleotide
taatacgactcactatagggcaagactgttccgcggtcctcttgttgccgaacagaggagacggcaaatggaggaccgcaacctggcggcagcgcaaaagatg

SEQ ID NO: 224606 - DNA, 103 bp, Artificial Sequence
  Synthetic Polynucleotide
taatacgactcactatagggtttctgatcacaagactgttccgcggtcctaacagaggagaaggaccatggaacagtctaacctggcggcagcgcaaaagatg

SEQ ID NO: 224607 - DNA, 103 bp, Artificial Sequence
  Synthetic Polynucleotide
taatacgactcactatagggtgttggtgagtttctgatcacaagactgttaacagaggagaaacagtatggtgatcagaaacctggcggcagcgcaaaagatg

SEQ ID NO: 224608 - DNA, 103 bp, Artificial Sequence
  Synthetic Polynucleotide
taatacgactcactataggggtatggccgtcctccatctgtttgcccctgaacagaggagacaggggatgacagatggaaacctggcggcagcgcaaaagatg

SEQ ID NO: 224609 - DNA, 103 bp, Artificial Sequence
  Synthetic Polynucleotide
taatacgactcactataggggccctgttggtgttggtgagtttctgatcaaacagaggagatgatcaatgactcaccaaaacctggcggcagcgcaaaagatg

SEQ ID NO: 224610 - DNA, 103 bp, Artificial Sequence
  Synthetic Polynucleotide
taatacgactcactataggggagagccagcgccctgttggtgttggtgagaacagaggagactcaccatgaccaacaggaacctggcggcagcgcaaaagatg

SEQ ID NO: 224611 - DNA, 103 bp, Artificial Sequence
  Synthetic Polynucleotide
taatacgactcactatagggcaaagcagttgagagccagcgccctgttggaacagaggagaccaacaatgcgctggctcaacctggcggcagcgcaaaagatg

SEQ ID NO: 224612 - DNA, 103 bp, Artificial Sequence
  Synthetic Polynucleotide
taatacgactcactatagggttgatgggagcaaagcagttgagagccagcaacagaggagagctggcatgcaactgcttaacctggcggcagcgcaaaagatg

SEQ ID NO: 224613 - DNA, 103 bp, Artificial Sequence
  Synthetic Polynucleotide
taatacgactcactatagggttcttggtcattgatgggagcaaagcagttaacagaggagaaactgcatggctcccatcaacctggcggcagcgcaaaagatg

SEQ ID NO: 224614 - DNA, 103 bp, Artificial Sequence
  Synthetic Polynucleotide
taatacgactcactatagggcctcggccccttcttggtcattgatgggagaacagaggagactcccaatgatgaccaagaacctggcggcagcgcaaaagatg

SEQ ID NO: 224615 - DNA, 103 bp, Artificial Sequence
  Synthetic Polynucleotide
taatacgactcactatagggcagtccttggcctcggccccttcttggtcaaacagaggagatgaccaatgaggggccgaaacctggcggcagcgcaaaagatg

SEQ ID NO: 224616 - DNA, 103 bp, Artificial Sequence
  Synthetic Polynucleotide
taatacgactcactatagggccccgaccgccagtccttggcctcggccccaacagaggagaggggccatggccaaggacaacctggcggcagcgcaaaagatg

SEQ ID NO: 224617 - DNA, 103 bp, Artificial Sequence
  Synthetic Polynucleotide
taatacgactcactatagggtgaccggcttccccgaccgccagtccttggaacagaggagaccaaggatgggcggtcggaacctggcggcagcgcaaaagatg

SEQ ID NO: 224618 - DNA, 103 bp, Artificial Sequence
  Synthetic Polynucleotide
taatacgactcactatagggcgcaccaccctgaccggcttccccgaccgcaacagaggagagcggtcatggaagccggtaacctggcggcagcgcaaaagatg

SEQ ID NO: 224619 - DNA, 103 bp, Artificial Sequence
  Synthetic Polynucleotide
taatacgactcactataggggtcgaagagggtatggccgtcctccatctgaacagaggagacagatgatggacggccataacctggcggcagcgcaaaagatg

SEQ ID NO: 224620 - DNA, 103 bp, Artificial Sequence
  Synthetic Polynucleotide
taatacgactcactatagggcttgacattgcgcaccaccctgaccggcttaacagaggagaaagccgatgagggtggtgaacctggcggcagcgcaaaagatg

SEQ ID NO: 224621 - DNA, 103 bp, Artificial Sequence
  Synthetic Polynucleotide
taatacgactcactatagggtcttgccacccttgacattgcgcaccacccaacagaggagagggtggatggcaatgtcaaacctggcggcagcgcaaaagatg

SEQ ID NO: 224622 - DNA, 103 bp, Artificial Sequence
  Synthetic Polynucleotide
taatacgactcactatagggtacttgctattcttgccacccttgacattgaacagaggagacaatgtatggggtggcaaaacctggcggcagcgcaaaagatg

SEQ ID NO: 224623 - DNA, 103 bp, Artificial Sequence
  Synthetic Polynucleotide
taatacgactcactatagggagcgggggcgtacttgctattcttgccaccaacagaggagaggtggcatgaatagcaagaacctggcggcagcgcaaaagatg

SEQ ID NO: 224624 - DNA, 103 bp, Artificial Sequence
  Synthetic Polynucleotide
taatacgactcactatagggggttgccctcagcgggggcgtacttgctataacagaggagaatagcaatgacgcccccgaacctggcggcagcgcaaaagatg

SEQ ID NO: 224625 - DNA, 103 bp, Artificial Sequence
  Synthetic Polynucleotide
taatacgactcactatagggccatcgtagcggttgccctcagcgggggcgaacagaggagacgccccatgtgagggcaaaacctggcggcagcgcaaaagatg

SEQ ID NO: 224626 - DNA, 103 bp, Artificial Sequence
  Synthetic Polynucleotide
taatacgactcactatagggcttgtagatgccatcgtagcggttgccctcaacagaggagagagggcatgcgctacgataacctggcggcagcgcaaaagatg

SEQ ID NO: 224627 - DNA, 103 bp, Artificial Sequence
  Synthetic Polynucleotide
taatacgactcactatagggatttcacaaccttgtagatgccatcgtagcaacagaggagagctacgatggcatctacaaacctggcggcagcgcaaaagatg

SEQ ID NO: 224628 - DNA, 103 bp, Artificial Sequence
  Synthetic Polynucleotide
taatacgactcactatagggtcgggccagtatttcacaaccttgtagatgaacagaggagacatctaatgggttgtgaaaacctggcggcagcgcaaaagatg

SEQ ID NO: 224629 - DNA, 103 bp, Artificial Sequence
  Synthetic Polynucleotide
taatacgactcactatagggcttccccttctcgggccagtatttcacaacaacagaggagagttgtgatgtactggcccaacctggcggcagcgcaaaagatg

SEQ ID NO: 224630 - DNA, 103 bp, Artificial Sequence
  Synthetic Polynucleotide
taatacgactcactatagggggacctcgtagtcgaagagggtatggccgtaacagaggagaacggccatgccctcttcgaacctggcggcagcgcaaaagatg

SEQ ID NO: 224631 - DNA, 103 bp, Artificial Sequence
  Synthetic Polynucleotide
taatacgactcactataggggaaacccggacttccccttctcgggccagtaacagaggagaactggcatgagaaggggaaacctggcggcagcgcaaaagatg

SEQ ID NO: 224632 - DNA, 103 bp, Artificial Sequence
  Synthetic Polynucleotide
taatacgactcactatagggcgccacacgagaaacccggacttccccttcaacagaggagagaagggatggtccgggttaacctggcggcagcgcaaaagatg

SEQ ID NO: 224633 - DNA, 103 bp, Artificial Sequence
  Synthetic Polynucleotide
taatacgactcactatagggcagaaggtagcgccacacgagaaacccggaaacagaggagatccgggatgctcgtgtggaacctggcggcagcgcaaaagatg

SEQ ID NO: 224634 - DNA, 103 bp, Artificial Sequence
  Synthetic Polynucleotide
taatacgactcactatagggcgtccctccgcagaaggtagcgccacacgaaacagaggagatcgtgtatggctaccttcaacctggcggcagcgcaaaagatg

SEQ ID NO: 224635 - DNA, 103 bp, Artificial Sequence
  Synthetic Polynucleotide
taatacgactcactatagggggctcatcatcgtccctccgcagaaggtagaacagaggagactacctatggcggagggaaacctggcggcagcgcaaaagatg

SEQ ID NO: 224636 - DNA, 103 bp, Artificial Sequence
  Synthetic Polynucleotide
taatacgactcactatagggccaagggccaggctcatcatcgtccctccgaacagaggagacggaggatggatgatgagaacctggcggcagcgcaaaagatg

SEQ ID NO: 224637 - DNA, 103 bp, Artificial Sequence
  Synthetic Polynucleotide
taatacgactcactatagggcctccttcgtccaagggccaggctcatcataacagaggagaatgatgatgctggcccttaacctggcggcagcgcaaaagatg

SEQ ID NO: 224638 - DNA, 103 bp, Artificial Sequence
  Synthetic Polynucleotide
taatacgactcactatagggcggtccttcccctccttcgtccaagggccaaacagaggagatggcccatggacgaaggaaacctggcggcagcgcaaaagatg

SEQ ID NO: 224639 - DNA, 103 bp, Artificial Sequence
  Synthetic Polynucleotide
taatacgactcactatagggcttcttgatccggtccttcccctccttcgtaacagaggagaacgaagatggggaaggacaacctggcggcagcgcaaaagatg

SEQ ID NO: 224640 - DNA, 103 bp, Artificial Sequence
  Synthetic Polynucleotide
taatacgactcactatagggtcagccccagcttcttgatccggtccttccaacagaggagaggaaggatgggatcaagaaacctggcggcagcgcaaaagatg

SEQ ID NO: 224641 - DNA, 103 bp, Artificial Sequence
  Synthetic Polynucleotide
taatacgactcactatagggtcattcaggcggacctcgtagtcgaagaggaacagaggagacctcttatgctacgaggtaacctggcggcagcgcaaaagatg

SEQ ID NO: 224642 - DNA, 103 bp, Artificial Sequence
  Synthetic Polynucleotide
taatacgactcactatagggtactgcatggtcagccccagcttcttgatcaacagaggagagatcaaatggctggggctaacctggcggcagcgcaaaagatg

SEQ ID NO: 224643 - DNA, 103 bp, Artificial Sequence
  Synthetic Polynucleotide
taatacgactcactataggggccttctggatactgcatggtcagccccagaacagaggagactggggatgaccatgcagaacctggcggcagcgcaaaagatg

SEQ ID NO: 224644 - DNA, 103 bp, Artificial Sequence
  Synthetic Polynucleotide
taatacgactcactatagggcttccaggtagccttctggatactgcatggaacagaggagaccatgcatgatccagaagaacctggcggcagcgcaaaagatg

SEQ ID NO: 224645 - DNA, 103 bp, Artificial Sequence
  Synthetic Polynucleotide
taatacgactcactatagggttggccagggcttccaggtagccttctggaaacagaggagatccagaatgctacctggaaacctggcggcagcgcaaaagatg

SEQ ID NO: 224646 - DNA, 103 bp, Artificial Sequence
  Synthetic Polynucleotide
taatacgactcactatagggtcgctctcggttggccagggcttccaggtaaacagaggagatacctgatggccctggccaacctggcggcagcgcaaaagatg

SEQ ID NO: 224647 - DNA, 103 bp, Artificial Sequence
  Synthetic Polynucleotide
taatacgactcactatagggtctccttctctcgctctcggttggccagggaacagaggagaccctggatgaccgagagcaacctggcggcagcgcaaaagatg

SEQ ID NO: 224648 - DNA, 103 bp, Artificial Sequence
  Synthetic Polynucleotide
taatacgactcactatagggctcttgctgttctccttctctcgctctcggaacagaggagaccgagaatgagagaaggaaacctggcggcagcgcaaaagatg

SEQ ID NO: 224649 - DNA, 103 bp, Artificial Sequence
  Synthetic Polynucleotide
taatacgactcactatagggctcctcctccctcttgctgttctccttctcaacagaggagagagaagatgaacagcaagaacctggcggcagcgcaaaagatg

SEQ ID NO: 224650 - DNA, 103 bp, Artificial Sequence
  Synthetic Polynucleotide
taatacgactcactatagggcctgctgctcctcctcctccctcttgctgtaacagaggagaacagcaatggggaggaggaacctggcggcagcgcaaaagatg

SEQ ID NO: 224651 - DNA, 103 bp, Artificial Sequence
  Synthetic Polynucleotide
taatacgactcactatagggaagcccccctcctgctgctcctcctcctccaacagaggagaggaggaatgggagcagcaaacctggcggcagcgcaaaagatg

SEQ ID NO: 224652 - DNA, 103 bp, Artificial Sequence
  Synthetic Polynucleotide
taatacgactcactatagggctggatggtgtcattcaggcggacctcgtaaacagaggagatacgagatgcgcctgaataacctggcggcagcgcaaaagatg

SEQ ID NO: 224653 - DNA, 103 bp, Artificial Sequence
  Synthetic Polynucleotide
taatacgactcactataggggggggacgcgaagcccccctcctgctgctcaacagaggagagagcagatggaggggggcaacctggcggcagcgcaaaagatg

SEQ ID NO: 224654 - DNA, 103 bp, Artificial Sequence
  Synthetic Polynucleotide
taatacgactcactatagggtgcccgtcctgggggacgcgaagcccccctaacagaggagaagggggatgtcgcgtcccaacctggcggcagcgcaaaagatg

SEQ ID NO: 224655 - DNA, 103 bp, Artificial Sequence
  Synthetic Polynucleotide
taatacgactcactatagggcacttgcccttgcccgtcctgggggacgcgaacagaggagacgcgtcatgcaggacgggaacctggcggcagcgcaaaagatg

SEQ ID NO: 224656 - DNA, 103 bp, Artificial Sequence
  Synthetic Polynucleotide
taatacgactcactatagggcttccgcttccacttgcccttgcccgtcctaacagaggagaaggacgatgaagggcaagaacctggcggcagcgcaaaagatg

SEQ ID NO: 224657 - DNA, 103 bp, Artificial Sequence
  Synthetic Polynucleotide
taatacgactcactatagggctcctgccgacttccgcttccacttgccctaacagaggagaagggcaatgggaagcggaaacctggcggcagcgcaaaagatg

SEQ ID NO: 224658 - DNA, 103 bp, Artificial Sequence
  Synthetic Polynucleotide
taatacgactcactatagggctcgggccacctcctgccgacttccgcttcaacagaggagagaagcgatggtcggcaggaacctggcggcagcgcaaaagatg

SEQ ID NO: 224659 - DNA, 103 bp, Artificial Sequence
  Synthetic Polynucleotide
taatacgactcactatagggcccggccctgctcgggccacctcctgccgaaacagaggagatcggcaatgggtggcccgaacctggcggcagcgcaaaagatg

SEQ ID NO: 224660 - DNA, 103 bp, Artificial Sequence
  Synthetic Polynucleotide
taatacgactcactatagggggcgcggggacccggccctgctcgggccacaacagaggagagtggccatggcagggccgaacctggcggcagcgcaaaagatg

SEQ ID NO: 224661 - DNA, 103 bp, Artificial Sequence
  Synthetic Polynucleotide
taatacgactcactatagggttggatgtccggcgcggggacccggccctgaacagaggagacagggcatggtccccgcgaacctggcggcagcgcaaaagatg

SEQ ID NO: 224662 - DNA, 103 bp, Artificial Sequence
  Synthetic Polynucleotide
taatacgactcactatagggcttggttttcttggatgtccggcgcggggaaacagaggagatccccgatgcggacatccaacctggcggcagcgcaaaagatg

SEQ ID NO: 224663 - DNA, 103 bp, Artificial Sequence
  Synthetic Polynucleotide
taatacgactcactataggggggtctgcctcccgtccatggtccgaacctaacagaggagaaggttcatgccatggacgaacctggcggcagcgcaaaagatg

SEQ ID NO: 224664 - DNA, 103 bp, Artificial Sequence
  Synthetic Polynucleotide
taatacgactcactatagggggaccaggagctggatggtgtcattcaggcaacagaggagagcctgaatgacaccatccaacctggcggcagcgcaaaagatg

SEQ ID NO: 224665 - DNA, 103 bp, Artificial Sequence
  Synthetic Polynucleotide
taatacgactcactatagggagggctccaccttggttttcttggatgtccaacagaggagaggacatatgagaaaaccaaacctggcggcagcgcaaaagatg

SEQ ID NO: 224666 - DNA, 103 bp, Artificial Sequence
  Synthetic Polynucleotide
taatacgactcactataggggtgagactgtagggctccaccttggttttcaacagaggagagaaaacatgggtggagccaacctggcggcagcgcaaaagatg

SEQ ID NO: 224667 - DNA, 103 bp, Artificial Sequence
  Synthetic Polynucleotide
taatacgactcactatagggctgctgggccgtgagactgtagggctccacaacagaggagagtggagatgtacagtctcaacctggcggcagcgcaaaagatg

SEQ ID NO: 224668 - DNA, 103 bp, Artificial Sequence
  Synthetic Polynucleotide
taatacgactcactatagggtgaggctgctctgctgggccgtgagactgtaacagaggagaacagtcatgcggcccagcaacctggcggcagcgcaaaagatg

SEQ ID NO: 224669 - DNA, 103 bp, Artificial Sequence
  Synthetic Polynucleotide
taatacgactcactatagggtcctctctgatgaggctgctctgctgggccaacagaggagaggcccaatggagcagcctaacctggcggcagcgcaaaagatg

SEQ ID NO: 224670 - DNA, 103 bp, Artificial Sequence
  Synthetic Polynucleotide
taatacgactcactataggggttgctcttgtcctctctgatgaggctgctaacagaggagaagcagcatgatcagagagaacctggcggcagcgcaaaagatg

SEQ ID NO: 224671 - DNA, 103 bp, Artificial Sequence
  Synthetic Polynucleotide
taatacgactcactatagggacagcttggcgttgctcttgtcctctctgaaacagaggagatcagagatgacaagagcaaacctggcggcagcgcaaaagatg

SEQ ID NO: 224672 - DNA, 103 bp, Artificial Sequence
  Synthetic Polynucleotide
taatacgactcactatagggacctcattccacagcttggcgttgctcttgaacagaggagacaagagatgcgccaagctaacctggcggcagcgcaaaagatg

SEQ ID NO: 224673 - DNA, 103 bp, Artificial Sequence
  Synthetic Polynucleotide
taatacgactcactatagggtgacgccaggacctcattccacagcttggcaacagaggagagccaagatgtggaatgagaacctggcggcagcgcaaaagatg

SEQ ID NO: 224674 - DNA, 103 bp, Artificial Sequence
  Synthetic Polynucleotide
taatacgactcactatagggggtccttgagtgacgccaggacctcattccaacagaggagaggaatgatgtcctggcgtaacctggcggcagcgcaaaagatg

SEQ ID NO: 224675 - DNA, 103 bp, Artificial Sequence
  Synthetic Polynucleotide
taatacgactcactatagggaggctctggcggaccaggagctggatggtgaacagaggagacaccatatggctcctggtaacctggcggcagcgcaaaagatg

SEQ ID NO: 224676 - DNA, 103 bp, Artificial Sequence
  Synthetic Polynucleotide
taatacgactcactatagggctcgccggccggtccttgagtgacgccaggaacagaggagacctggcatgactcaaggaaacctggcggcagcgcaaaagatg

SEQ ID NO: 224677 - DNA, 103 bp, Artificial Sequence
  Synthetic Polynucleotide
taatacgactcactatagggcgggctgccgctcgccggccggtccttgagaacagaggagactcaagatgcggccggcgaacctggcggcagcgcaaaagatg

SEQ ID NO: 224678 - DNA, 103 bp, Artificial Sequence
  Synthetic Polynucleotide
taatacgactcactatagggacaactggaacgggctgccgctcgccggccaacagaggagaggccggatggcggcagccaacctggcggcagcgcaaaagatg

SEQ ID NO: 224679 - DNA, 103 bp, Artificial Sequence
  Synthetic Polynucleotide
taatacgactcactatagggttactcaggaacaactggaacgggctgccgaacagaggagacggcagatggttccagttaacctggcggcagcgcaaaagatg

SEQ ID NO: 224680 - DNA, 103 bp, Artificial Sequence
  Synthetic Polynucleotide
taatacgactcactatagggctcctccactttactcaggaacaactggaaaacagaggagattccagatgttcctgagtaacctggcggcagcgcaaaagatg

SEQ ID NO: 224681 - DNA, 103 bp, Artificial Sequence
  Synthetic Polynucleotide
taatacgactcactatagggactggaacgtctcctccactttactcaggaaacagaggagatcctgaatgaagtggaggaacctggcggcagcgcaaaagatg

SEQ ID NO: 224682 - DNA, 103 bp, Artificial Sequence
  Synthetic Polynucleotide
taatacgactcactatagggcagcagatacactggaacgtctcctccactaacagaggagaagtggaatggacgttccaaacctggcggcagcgcaaaagatg

SEQ ID NO: 224683 - DNA, 103 bp, Artificial Sequence
  Synthetic Polynucleotide
taatacgactcactatagggcagctcctgacagcagatacactggaacgtaacagaggagaacgttcatgtgtatctgcaacctggcggcagcgcaaaagatg

SEQ ID NO: 224684 - DNA, 103 bp, Artificial Sequence
  Synthetic Polynucleotide
taatacgactcactataggggccggaacaccagctcctgacagcagatacaacagaggagagtatctatggtcaggagcaacctggcggcagcgcaaaagatg

SEQ ID NO: 224685 - DNA, 103 bp, Artificial Sequence
  Synthetic Polynucleotide
taatacgactcactataggggtcgtgatgggccggaacaccagctcctgaaacagaggagatcaggaatgggtgttccgaacctggcggcagcgcaaaagatg

SEQ ID NO: 224686 - DNA, 103 bp, Artificial Sequence
  Synthetic Polynucleotide
taatacgactcactatagggggggagcacgaggctctggcggaccaggagaacagaggagactcctgatgcgccagagcaacctggcggcagcgcaaaagatg

SEQ ID NO: 224687 - DNA, 103 bp, Artificial Sequence
  Synthetic Polynucleotide
taatacgactcactatagggctggcacacggtcgtgatgggccggaacacaacagaggagagtgttcatgcccatcacgaacctggcggcagcgcaaaagatg

SEQ ID NO: 224688 - DNA, 103 bp, Artificial Sequence
  Synthetic Polynucleotide
taatacgactcactatagggacacgttgtgctggcacacggtcgtgatggaacagaggagaccatcaatgccgtgtgccaacctggcggcagcgcaaaagatg

SEQ ID NO: 224689 - DNA, 103 bp, Artificial Sequence
  Synthetic Polynucleotide
taatacgactcactatagggcagtccttgcacacgttgtgctggcacacgaacagaggagacgtgtgatggcacaacgtaacctggcggcagcgcaaaagatg

SEQ ID NO: 224690 - DNA, 103 bp, Artificial Sequence
  Synthetic Polynucleotide
taatacgactcactatagggtctgtccaggcagtccttgcacacgttgtgaacagaggagacacaacatgtgcaaggacaacctggcggcagcgcaaaagatg

SEQ ID NO: 224691 - DNA, 103 bp, Artificial Sequence
  Synthetic Polynucleotide
taatacgactcactatagggcccgaaaggatctgtccaggcagtccttgcaacagaggagagcaaggatggcctggacaaacctggcggcagcgcaaaagatg

SEQ ID NO: 224692 - DNA, 103 bp, Artificial Sequence
  Synthetic Polynucleotide
taatacgactcactatagggaacacctgtgcccgaaaggatctgtccaggaacagaggagacctggaatgatcctttcgaacctggcggcagcgcaaaagatg

SEQ ID NO: 224693 - DNA, 103 bp, Artificial Sequence
  Synthetic Polynucleotide
taatacgactcactatagggagggcagctgaacacctgtgcccgaaaggaaacagaggagatcctttatggcacaggtgaacctggcggcagcgcaaaagatg

SEQ ID NO: 224694 - DNA, 103 bp, Artificial Sequence
  Synthetic Polynucleotide
taatacgactcactatagggagcggcaggcagggcagctgaacacctgtgaacagaggagacacaggatgtcagctgccaacctggcggcagcgcaaaagatg

SEQ ID NO: 224695 - DNA, 103 bp, Artificial Sequence
  Synthetic Polynucleotide
taatacgactcactatagggcccaggtcgtagcggcaggcagggcagctgaacagaggagacagctgatgtgcctgccgaacctggcggcagcgcaaaagatg

SEQ ID NO: 224696 - DNA, 103 bp, Artificial Sequence
  Synthetic Polynucleotide
taatacgactcactatagggatagctgcggcccaggtcgtagcggcaggcaacagaggagagcctgcatgtacgacctgaacctggcggcagcgcaaaagatg

SEQ ID NO: 224697 - DNA, 103 bp, Artificial Sequence
  Synthetic Polynucleotide
taatacgactcactatagggtggtgctgtgggggagcacgaggctctggcaacagaggagagccagaatgtcgtgctccaacctggcggcagcgcaaaagatg

SEQ ID NO: 224698 - DNA, 103 bp, Artificial Sequence
  Synthetic Polynucleotide
taatacgactcactatagggcctgcatggcatagctgcggcccaggtcgtaacagaggagaacgaccatggccgcagctaacctggcggcagcgcaaaagatg

SEQ ID NO: 224699 - DNA, 103 bp, Artificial Sequence
  Synthetic Polynucleotide
taatacgactcactatagggggctggttcacctgcatggcatagctgcggaacagaggagaccgcagatgtgccatgcaaacctggcggcagcgcaaaagatg

SEQ ID NO: 224700 - DNA, 103 bp, Artificial Sequence
  Synthetic Polynucleotide
taatacgactcactatagggggtctgcagaggctggttcacctgcatggcaacagaggagagccatgatggtgaaccagaacctggcggcagcgcaaaagatg

SEQ ID NO: 224701 - DNA, 103 bp, Artificial Sequence
  Synthetic Polynucleotide
taatacgactcactatagggggttgaggacggtctgcagaggctggttcaaacagaggagatgaaccatgctctgcagaaacctggcggcagcgcaaaagatg

SEQ ID NO: 224702 - DNA, 103 bp, Artificial Sequence
  Synthetic Polynucleotide
taatacgactcactataggggggaagagctggttgaggacggtctgcagaaacagaggagatctgcaatgcgtcctcaaaacctggcggcagcgcaaaagatg

SEQ ID NO: 224703 - DNA, 103 bp, Artificial Sequence
  Synthetic Polynucleotide
taatacgactcactataggggccgtagccggggaagagctggttgaggacaacagaggagagtcctcatgcagctcttcaacctggcggcagcgcaaaagatg

SEQ ID NO: 224704 - DNA, 103 bp, Artificial Sequence
  Synthetic Polynucleotide
taatacgactcactatagggaccggccattgccgtagccggggaagagctaacagaggagaagctctatgccggctacgaacctggcggcagcgcaaaagatg

SEQ ID NO: 224705 - DNA, 103 bp, Artificial Sequence
  Synthetic Polynucleotide
taatacgactcactatagggtcccgctccttggtgctgtgggggagcacgaacagaggagacgtgctatgccacagcacaacctggcggcagcgcaaaagatg

SEQ ID NO: 224706 - DNA, 103 bp, Artificial Sequence
  Synthetic Polynucleotide
taatacgactcactataggggagctcggagtcccgctccttggtgctgtgaacagaggagacacagcatgaaggagcggaacctggcggcagcgcaaaagatg

SEQ ID NO: 224707 - DNA, 103 bp, Artificial Sequence
  Synthetic Polynucleotide
taatacgactcactatagggcggtgtcggagagctcggagtcccgctcctaacagaggagaaggagcatgactccgagcaacctggcggcagcgcaaaagatg

SEQ ID NO: 224708 - DNA, 103 bp, Artificial Sequence
  Synthetic Polynucleotide
taatacgactcactatagggcagccggagtcggtgtcggagagctcggagaacagaggagactccgaatgctccgacacaacctggcggcagcgcaaaagatg

SEQ ID NO: 224709 - DNA, 103 bp, Artificial Sequence
  Synthetic Polynucleotide
taatacgactcactataggggcccaggcagcagccggagtcggtgtcggaaacagaggagatccgacatggactccggcaacctggcggcagcgcaaaagatg

SEQ ID NO: 224710 - DNA, 103 bp, Artificial Sequence
  Synthetic Polynucleotide
taatacgactcactatagggactcactctggcccaggcagcagccggagtaacagaggagaactccgatggctgcctggaacctggcggcagcgcaaaagatg

SEQ ID NO: 224711 - DNA, 103 bp, Artificial Sequence
  Synthetic Polynucleotide
taatacgactcactatagggtccaccgtgtgggtctgcctcccgtccatgaacagaggagacatggaatggaggcagacaacctggcggcagcgcaaaagatg

SEQ ID NO: 224712 - DNA, 103 bp, Artificial Sequence
  Synthetic Polynucleotide
taatacgactcactataggggacttgtctgactcactctggcccaggcagaacagaggagactgcctatgccagagtgaaacctggcggcagcgcaaaagatg

SEQ ID NO: 224713 - DNA, 103 bp, Artificial Sequence
  Synthetic Polynucleotide
taatacgactcactataggggtgggtggaggacttgtctgactcactctgaacagaggagacagagtatgtcagacaagaacctggcggcagcgcaaaagatg

SEQ ID NO: 224714 - DNA, 103 bp, Artificial Sequence
  Synthetic Polynucleotide
taatacgactcactatagggccgcctcaccgtgggtggaggacttgtctgaacagaggagacagacaatgcctccacccaacctggcggcagcgcaaaagatg

SEQ ID NO: 224715 - DNA, 103 bp, Artificial Sequence
  Synthetic Polynucleotide
taatacgactcactataggggtctcggcggccgcctcaccgtgggtggagaacagaggagactccacatgcggtgaggcaacctggcggcagcgcaaaagatg

SEQ ID NO: 224716 - DNA, 103 bp, Artificial Sequence
  Synthetic Polynucleotide
taatacgactcactatagggcctgctgtcagtctcggcggccgcctcaccaacagaggagaggtgagatggccgccgagaacctggcggcagcgcaaaagatg

SEQ ID NO: 224717 - DNA, 103 bp, Artificial Sequence
  Synthetic Polynucleotide
taatacgactcactatagggcatcggctggcctgctgtcagtctcggcggaacagaggagaccgccgatgctgacagcaaacctggcggcagcgcaaaagatg

SEQ ID NO: 224718 - DNA, 103 bp, Artificial Sequence
  Synthetic Polynucleotide
taatacgactcactatagggcacatgtcctcatcggctggcctgctgtcaaacagaggagatgacagatggccagccgaaacctggcggcagcgcaaaagatg

SEQ ID NO: 224719 - DNA, 103 bp, Artificial Sequence
  Synthetic Polynucleotide
taatacgactcactatagggcgtctcatcccacatgtcctcatcggctggaacagaggagaccagccatggaggacatgaacctggcggcagcgcaaaagatg

SEQ ID NO: 224720 - DNA, 103 bp, Artificial Sequence
  Synthetic Polynucleotide
taatacgactcactataggggccccaattccgtctcatcccacatgtcctaacagaggagaaggacaatggggatgagaaacctggcggcagcgcaaaagatg

SEQ ID NO: 224721 - DNA, 103 bp, Artificial Sequence
  Synthetic Polynucleotide
taatacgactcactatagggaccttgtacagccccaattccgtctcatccaacagaggagaggatgaatgggaattgggaacctggcggcagcgcaaaagatg

SEQ ID NO: 224722 - DNA, 103 bp, Artificial Sequence
  Synthetic Polynucleotide
taatacgactcactatagggggacagcgagtccaccgtgtgggtctgcctaacagaggagaaggcagatgcacacggtgaacctggcggcagcgcaaaagatg

SEQ ID NO: 224723 - DNA, 103 bp, Artificial Sequence
  Synthetic Polynucleotide
taatacgactcactataggggtactcattgaccttgtacagccccaattcaacagaggagagaattgatgctgtacaagaacctggcggcagcgcaaaagatg

SEQ ID NO: 224724 - DNA, 103 bp, Artificial Sequence
  Synthetic Polynucleotide
taatacgactcactataggggagcatcgacgtactcattgaccttgtacaaacagaggagatgtacaatgtcaatgagtaacctggcggcagcgcaaaagatg

SEQ ID NO: 224725 - DNA, 103 bp, Artificial Sequence
  Synthetic Polynucleotide
taatacgactcactatagggttcgtgtcccgagcatcgacgtactcattgaacagaggagacaatgaatgcgtcgatgcaacctggcggcagcgcaaaagatg

SEQ ID NO: 224726 - DNA, 103 bp, Artificial Sequence
  Synthetic Polynucleotide
taatacgactcactatagggcgcccccatgttcgtgtcccgagcatcgacaacagaggagagtcgatatgcgggacacgaacctggcggcagcgcaaaagatg

SEQ ID NO: 224727 - DNA, 103 bp, Artificial Sequence
  Synthetic Polynucleotide
taatacgactcactatagggcctcaaaccacgcccccatgttcgtgtcccaacagaggagagggacaatgacatgggggaacctggcggcagcgcaaaagatg

SEQ ID NO: 224728 - DNA, 103 bp, Artificial Sequence
  Synthetic Polynucleotide
taatacgactcactatagggaccacctgcgcctcaaaccacgcccccatgaacagaggagacatgggatggtggtttgaaacctggcggcagcgcaaaagatg

SEQ ID NO: 224729 - DNA, 103 bp, Artificial Sequence
  Synthetic Polynucleotide
taatacgactcactatagggcgtcaccctgaccacctgcgcctcaaaccaaacagaggagatggtttatggcgcaggtgaacctggcggcagcgcaaaagatg

SEQ ID NO: 224730 - DNA, 103 bp, Artificial Sequence
  Synthetic Polynucleotide
taatacgactcactataggggggccttccgcgtcaccctgaccacctgcgaacagaggagacgcaggatgtcagggtgaaacctggcggcagcgcaaaagatg

SEQ ID NO: 224731 - DNA, 103 bp, Artificial Sequence
  Synthetic Polynucleotide
taatacgactcactatagggtcccgggagggggccttccgcgtcaccctgaacagaggagacagggtatggcggaaggcaacctggcggcagcgcaaaagatg

SEQ ID NO: 224732 - DNA, 103 bp, Artificial Sequence
  Synthetic Polynucleotide
taatacgactcactataggggcagggctcgtcccgggagggggccttccgaacagaggagacggaagatgccctcccggaacctggcggcagcgcaaaagatg

SEQ ID NO: 224733 - DNA, 103 bp, Artificial Sequence
  Synthetic Polynucleotide
taatacgactcactatagggtggtcagcctggacagcgagtccaccgtgtaacagaggagaacacggatgactcgctgtaacctggcggcagcgcaaaagatg

SEQ ID NO: 224734 - DNA, 103 bp, Artificial Sequence
  Synthetic Polynucleotide
taatacgactcactatagggacgtggagctgcagggctcgtcccgggaggaacagaggagacctcccatgacgagccctaacctggcggcagcgcaaaagatg

SEQ ID NO: 224735 - DNA, 103 bp, Artificial Sequence
  Synthetic Polynucleotide
taatacgactcactataggggccggcctggacgtggagctgcagggctcgaacagaggagacgagccatgcagctccacaacctggcggcagcgcaaaagatg

SEQ ID NO: 224736 - DNA, 103 bp, Artificial Sequence
  Synthetic Polynucleotide
taatacgactcactatagggctcctccagcgccggcctggacgtggagctaacagaggagaagctccatgtccaggccgaacctggcggcagcgcaaaagatg

SEQ ID NO: 224737 - DNA, 103 bp, Artificial Sequence
  Synthetic Polynucleotide
taatacgactcactatagggaaatgacgtcctcctccagcgccggcctggaacagaggagaccaggcatgcgctggaggaacctggcggcagcgcaaaagatg

SEQ ID NO: 224738 - DNA, 103 bp, Artificial Sequence
  Synthetic Polynucleotide
taatacgactcactatagggttcacgtggtaaatgacgtcctcctccagcaacagaggagagctggaatgggacgtcataacctggcggcagcgcaaaagatg

SEQ ID NO: 224739 - DNA, 103 bp, Artificial Sequence
  Synthetic Polynucleotide
taatacgactcactataggggtcgtcgtatttcacgtggtaaatgacgtcaacagaggagagacgtcatgtaccacgtgaacctggcggcagcgcaaaagatg

SEQ ID NO: 224740 - DNA, 103 bp, Artificial Sequence
  Synthetic Polynucleotide
taatacgactcactatagggtctccgggtagtcgtcgtatttcacgtggtaacagaggagaaccacgatgaatacgacgaacctggcggcagcgcaaaagatg

SEQ ID NO: 224741 - DNA, 103 bp, Artificial Sequence
  Synthetic Polynucleotide
taatacgactcactatagggaccacgccgttctccgggtagtcgtcgtataacagaggagaatacgaatgctacccggaaacctggcggcagcgcaaaagatg

SEQ ID NO: 224742 - DNA, 103 bp, Artificial Sequence
  Synthetic Polynucleotide
taatacgactcactataggggttcatctggaccacgccgttctccgggtaaacagaggagatacccgatgaacggcgtgaacctggcggcagcgcaaaagatg

SEQ ID NO: 224743 - DNA, 103 bp, Artificial Sequence
  Synthetic Polynucleotide
taatacgactcactatagggcgtccctggagttcatctggaccacgccgtaacagaggagaacggcgatgtccagatgaaacctggcggcagcgcaaaagatg

SEQ ID NO: 224744 - DNA, 103 bp, Artificial Sequence
  Synthetic Polynucleotide
taatacgactcactatagggtcctccaccttggtcagcctggacagcgagaacagaggagactcgctatgcaggctgacaacctggcggcagcgcaaaagatg

SEQ ID NO: 224745 - DNA, 103 bp, Artificial Sequence
  Synthetic Polynucleotide
taatacgactcactatagggcgcgctcggacgtccctggagttcatctggaacagaggagaccagatatgctccagggaaacctggcggcagcgcaaaagatg

SEQ ID NO: 224746 - DNA, 103 bp, Artificial Sequence
  Synthetic Polynucleotide
taatacgactcactatagggggtgcgggcgcgcgctcggacgtccctggaaacagaggagatccaggatggtccgagcgaacctggcggcagcgcaaaagatg

SEQ ID NO: 224747 - DNA, 103 bp, Artificial Sequence
  Synthetic Polynucleotide
taatacgactcactatagggacttgatgatggtgcgggcgcgcgctcggaaacagaggagatccgagatggcgcccgcaaacctggcggcagcgcaaaagatg

SEQ ID NO: 224748 - DNA, 103 bp, Artificial Sequence
  Synthetic Polynucleotide
taatacgactcactatagggaggtcctgccacttgatgatggtgcgggcgaacagaggagacgcccgatgcatcatcaaaacctggcggcagcgcaaaagatg

SEQ ID NO: 224749 - DNA, 103 bp, Artificial Sequence
  Synthetic Polynucleotide
taatacgactcactataggggcccacctccaggtcctgccacttgatgataacagaggagaatcatcatgtggcaggacaacctggcggcagcgcaaaagatg

SEQ ID NO: 224750 - DNA, 103 bp, Artificial Sequence
  Synthetic Polynucleotide
taatacgactcactatagggtgaccacctggcccacctccaggtcctgccaacagaggagaggcaggatgtggaggtggaacctggcggcagcgcaaaagatg

SEQ ID NO: 224751 - DNA, 103 bp, Artificial Sequence
  Synthetic Polynucleotide
taatacgactcactatagggtagttgagcatgaccacctggcccacctccaacagaggagaggaggtatgccaggtggtaacctggcggcagcgcaaaagatg

SEQ ID NO: 224752 - DNA, 103 bp, Artificial Sequence
  Synthetic Polynucleotide
taatacgactcactataggggtcggggttgtagttgagcatgaccacctgaacagaggagacaggtgatgatgctcaacaacctggcggcagcgcaaaagatg

SEQ ID NO: 224753 - DNA, 103 bp, Artificial Sequence
  Synthetic Polynucleotide
taatacgactcactatagggccttggggttgtcggggttgtagttgagcaaacagaggagatgctcaatgacaaccccgaacctggcggcagcgcaaaagatg

SEQ ID NO: 224754 - DNA, 103 bp, Artificial Sequence
  Synthetic Polynucleotide
taatacgactcactatagggaagccccgctccttggggttgtcggggttgaacagaggagacaacccatgcaaccccaaaacctggcggcagcgcaaaagatg

SEQ ID NO: 224755 - DNA, 103 bp, Artificial Sequence
  Synthetic Polynucleotide
taatacgactcactatagggccgcctcagctcctccaccttggtcagcctaacagaggagaaggctgatgaaggtggagaacctggcggcagcgcaaaagatg

SEQ ID NO: 224756 - DNA, 103 bp, Artificial Sequence
  Synthetic Polynucleotide
taatacgactcactataggggtcgtaccagaagccccgctccttggggttaacagaggagaaaccccatggagcggggcaacctggcggcagcgcaaaagatg

SEQ ID NO: 224757 - DNA, 103 bp, Artificial Sequence
  Synthetic Polynucleotide
taatacgactcactatagggagatctccgcgtcgtaccagaagccccgctaacagaggagaagcgggatgtctggtacgaacctggcggcagcgcaaaagatg

SEQ ID NO: 224758 - DNA, 103 bp, Artificial Sequence
  Synthetic Polynucleotide
taatacgactcactatagggcgcttcctggagatctccgcgtcgtaccagaacagaggagactggtaatgcgcggagataacctggcggcagcgcaaaagatg

SEQ ID NO: 224759 - DNA, 103 bp, Artificial Sequence
  Synthetic Polynucleotide
taatacgactcactatagggcctggtctcgcgcttcctggagatctccgcaacagaggagagcggagatgtccaggaagaacctggcggcagcgcaaaagatg

SEQ ID NO: 224760 - DNA, 103 bp, Artificial Sequence
  Synthetic Polynucleotide
taatacgactcactatagggcccgcgccgtcctggtctcgcgcttcctggaacagaggagaccaggaatggcgagaccaaacctggcggcagcgcaaaagatg

SEQ ID NO: 224761 - DNA, 103 bp, Artificial Sequence
  Synthetic Polynucleotide
taatacgactcactataggggcgtagagttcccgcgccgtcctggtctcgaacagaggagacgagacatggacggcgcgaacctggcggcagcgcaaaagatg

SEQ ID NO: 224762 - DNA, 103 bp, Artificial Sequence
  Synthetic Polynucleotide
taatacgactcactatagggcaccacgttggcgtagagttcccgcgccgtaacagaggagaacggcgatggaactctacaacctggcggcagcgcaaaagatg

SEQ ID NO: 224763 - DNA, 103 bp, Artificial Sequence
  Synthetic Polynucleotide
taatacgactcactatagggcatcccccagcaccacgttggcgtagagttaacagaggagaaactctatgccaacgtggaacctggcggcagcgcaaaagatg

SEQ ID NO: 224764 - DNA, 103 bp, Artificial Sequence
  Synthetic Polynucleotide
taatacgactcactatagggttcagagaatcatcccccagcaccacgttgaacagaggagacaacgtatggctgggggaaacctggcggcagcgcaaaagatg

SEQ ID NO: 224765 - DNA, 103 bp, Artificial Sequence
  Synthetic Polynucleotide
taatacgactcactatagggccgacagtcgttcagagaatcatcccccagaacagaggagactggggatggattctctgaacctggcggcagcgcaaaagatg

SEQ ID NO: 224766 - DNA, 103 bp, Artificial Sequence
  Synthetic Polynucleotide
taatacgactcactatagggcctggatcttccgcctcagctcctccacctaacagaggagaaggtggatgagctgaggcaacctggcggcagcgcaaaagatg

SEQ ID NO: 224767 - DNA, 103 bp, Artificial Sequence
  Synthetic Polynucleotide
taatacgactcactatagggcgaagatgatccgacagtcgttcagagaataacagaggagaattctcatgacgactgtcaacctggcggcagcgcaaaagatg

SEQ ID NO: 224768 - DNA, 103 bp, Artificial Sequence
  Synthetic Polynucleotide
taatacgactcactatagggacttcgtccacgaagatgatccgacagtcgaacagaggagacgactgatggatcatcttaacctggcggcagcgcaaaagatg

SEQ ID NO: 224769 - DNA, 103 bp, Artificial Sequence
  Synthetic Polynucleotide
taatacgactcactatagggaatcttgaagacttcgtccacgaagatgataacagaggagaatcatcatggtggacgaaaacctggcggcagcgcaaaagatg

SEQ ID NO: 224770 - DNA, 103 bp, Artificial Sequence
  Synthetic Polynucleotide
taatacgactcactatagggccggccgctcaatcttgaagacttcgtccaaacagaggagatggacgatgtcttcaagaaacctggcggcagcgcaaaagatg

SEQ ID NO: 224771 - DNA, 103 bp, Artificial Sequence
  Synthetic Polynucleotide
taatacgactcactatagggctcccttcacccggccgctcaatcttgaagaacagaggagacttcaaatgtgagcggccaacctggcggcagcgcaaaagatg

SEQ ID NO: 224772 - DNA, 103 bp, Artificial Sequence
  Synthetic Polynucleotide
taatacgactcactatagggaaccatggggctcccttcacccggccgctcaacagaggagagagcggatgggtgaagggaacctggcggcagcgcaaaagatg

SEQ ID NO: 224773 - DNA, 103 bp, Artificial Sequence
  Synthetic Polynucleotide
taatacgactcactatagggtggggttgtcaaccatggggctcccttcacaacagaggagagtgaagatggccccatggaacctggcggcagcgcaaaagatg

SEQ ID NO: 224774 - DNA, 103 bp, Artificial Sequence
  Synthetic Polynucleotide
taatacgactcactatagggttccgtctcatggggttgtcaaccatggggaacagaggagaccccatatgtgacaacccaacctggcggcagcgcaaaagatg

SEQ ID NO: 224775 - DNA, 103 bp, Artificial Sequence
  Synthetic Polynucleotide
taatacgactcactatagggcggcccgctcttccgtctcatggggttgtcaacagaggagagacaacatgatgagacggaacctggcggcagcgcaaaagatg

SEQ ID NO: 224776 - DNA, 103 bp, Artificial Sequence
  Synthetic Polynucleotide
taatacgactcactataggggcttgcaggacggcccgctcttccgtctcaaacagaggagatgagacatgagagcgggcaacctggcggcagcgcaaaagatg

SEQ ID NO: 224777 - DNA, 103 bp, Artificial Sequence
  Synthetic Polynucleotide
taatacgactcactatagggtggaacagctcctggatcttccgcctcagcaacagaggagagctgagatggaagatccaaacctggcggcagcgcaaaagatg

SEQ ID NO: 224778 - DNA, 103 bp, Artificial Sequence
  Synthetic Polynucleotide
taatacgactcactatagggtccttgcagtgcttgcaggacggcccgctcaacagaggagagagcggatggtcctgcaaaacctggcggcagcgcaaaagatg

SEQ ID NO: 224779 - DNA, 103 bp, Artificial Sequence
  Synthetic Polynucleotide
taatacgactcactataggggttcacgtcgtccttgcagtgcttgcaggaaacagaggagatcctgcatgcactgcaagaacctggcggcagcgcaaaagatg

SEQ ID NO: 224780 - DNA, 103 bp, Artificial Sequence
  Synthetic Polynucleotide
taatacgactcactatagggggcagagtctgttcacgtcgtccttgcagtaacagaggagaactgcaatgacgacgtgaaacctggcggcagcgcaaaagatg

SEQ ID NO: 224781 - DNA, 103 bp, Artificial Sequence
  Synthetic Polynucleotide
taatacgactcactataggggcgcagacccggcagagtctgttcacgtcgaacagaggagacgacgtatgcagactctgaacctggcggcagcgcaaaagatg

SEQ ID NO: 224782 - DNA, 103 bp, Artificial Sequence
  Synthetic Polynucleotide
taatacgactcactatagggcaggtggcaggcgcagacccggcagagtctaacagaggagaagactcatgcgggtctgcaacctggcggcagcgcaaaagatg

SEQ ID NO: 224783 - DNA, 103 bp, Artificial Sequence
  Synthetic Polynucleotide
taatacgactcactatagggggcccccgcacaggtggcaggcgcagacccaacagaggagagggtctatgcctgccaccaacctggcggcagcgcaaaagatg

SEQ ID NO: 224784 - DNA, 103 bp, Artificial Sequence
  Synthetic Polynucleotide
taatacgactcactataggggggtcctgccggcccccgcacaggtggcagaacagaggagactgccaatggtgcgggggaacctggcggcagcgcaaaagatg

SEQ ID NO: 224785 - DNA, 103 bp, Artificial Sequence
  Synthetic Polynucleotide
taatacgactcactatagggctgcttgtcggggtcctgccggcccccgcaaacagaggagatgcgggatgcggcaggacaacctggcggcagcgcaaaagatg

SEQ ID NO: 224786 - DNA, 103 bp, Artificial Sequence
  Synthetic Polynucleotide
taatacgactcactatagggcgcacatgagctgcttgtcggggtcctgccaacagaggagaggcaggatgccgacaagcaacctggcggcagcgcaaaagatg

SEQ ID NO: 224787 - DNA, 103 bp, Artificial Sequence
  Synthetic Polynucleotide
taatacgactcactatagggtcgcactcatcgcacatgagctgcttgtcgaacagaggagacgacaaatggctcatgtgaacctggcggcagcgcaaaagatg

SEQ ID NO: 224788 - DNA, 103 bp, Artificial Sequence
  Synthetic Polynucleotide
taatacgactcactataggggacgctggagctcaggtgtggacactccataacagaggagaatggagatgccacacctgaacctggcggcagcgcaaaagatg

SEQ ID NO: 224789 - DNA, 103 bp, Artificial Sequence
  Synthetic Polynucleotide
taatacgactcactataggggacccaagggcttttgttggaccggcacacaacagaggagagtgtgcatgtccaacaaaaacctggcggcagcgcaaaagatg

SEQ ID NO: 224790 - DNA, 103 bp, Artificial Sequence
  Synthetic Polynucleotide
taatacgactcactatagggaaggtctaggaatggatcaaactttctagaaacagaggagatctagaatgtttgatccaaacctggcggcagcgcaaaagatg

SEQ ID NO: 224791 - DNA, 103 bp, Artificial Sequence
  Synthetic Polynucleotide
taatacgactcactatagggtatctaatgaaaggtctaggaatggatcaaaacagaggagattgatcatgtcctagaccaacctggcggcagcgcaaaagatg

SEQ ID NO: 224792 - DNA, 103 bp, Artificial Sequence
  Synthetic Polynucleotide
taatacgactcactatagggtgacttggaatatctaatgaaaggtctaggaacagaggagacctagaatgttcattagaaacctggcggcagcgcaaaagatg

SEQ ID NO: 224793 - DNA, 103 bp, Artificial Sequence
  Synthetic Polynucleotide
taatacgactcactatagggacttctgaactgacttggaatatctaatgaaacagaggagatcattaatgattccaagtaacctggcggcagcgcaaaagatg

SEQ ID NO: 224794 - DNA, 103 bp, Artificial Sequence
  Synthetic Polynucleotide
taatacgactcactatagggtagagcgcttacttctgaactgacttggaaaacagaggagattccaaatgagttcagaaaacctggcggcagcgcaaaagatg

SEQ ID NO: 224795 - DNA, 103 bp, Artificial Sequence
  Synthetic Polynucleotide
taatacgactcactatagggtcttgattcttagagcgcttacttctgaacaacagaggagagttcagatgtaagcgctcaacctggcggcagcgcaaaagatg

SEQ ID NO: 224796 - DNA, 103 bp, Artificial Sequence
  Synthetic Polynucleotide
taatacgactcactatagggtggtccattttcttgattcttagagcgcttaacagaggagaaagcgcatgaagaatcaaaacctggcggcagcgcaaaagatg

SEQ ID NO: 224797 - DNA, 103 bp, Artificial Sequence
  Synthetic Polynucleotide
taatacgactcactatagggacgaacaaactggtccattttcttgattctaacagaggagaagaatcatgaaaatggacaacctggcggcagcgcaaaagatg

SEQ ID NO: 224798 - DNA, 103 bp, Artificial Sequence
  Synthetic Polynucleotide
taatacgactcactatagggcaatctcgtaacgaacaaactggtccatttaacagaggagaaaatggatgagtttgttcaacctggcggcagcgcaaaagatg

SEQ ID NO: 224799 - DNA, 103 bp, Artificial Sequence
  Synthetic Polynucleotide
taatacgactcactatagggactgcgaagacaatctcgtaacgaacaaacaacagaggagagtttgtatgttacgagataacctggcggcagcgcaaaagatg

SEQ ID NO: 224800 - DNA, 103 bp, Artificial Sequence
  Synthetic Polynucleotide
taatacgactcactatagggaagtcaaacagacccaagggcttttgttggaacagaggagaccaacaatggcccttgggaacctggcggcagcgcaaaagatg

SEQ ID NO: 224801 - DNA, 103 bp, Artificial Sequence
  Synthetic Polynucleotide
taatacgactcactatagggagtcggtaaaactgcgaagacaatctcgtaaacagaggagatacgagatggtcttcgcaaacctggcggcagcgcaaaagatg

SEQ ID NO: 224802 - DNA, 103 bp, Artificial Sequence
  Synthetic Polynucleotide
taatacgactcactatagggagttcttctaagtcggtaaaactgcgaagaaacagaggagatcttcgatgttttaccgaaacctggcggcagcgcaaaagatg

SEQ ID NO: 224803 - DNA, 103 bp, Artificial Sequence
  Synthetic Polynucleotide
taatacgactcactatagggtgtctcatcaagttcttctaagtcggtaaaaacagaggagatttaccatgttagaagaaaacctggcggcagcgcaaaagatg

SEQ ID NO: 224804 - DNA, 103 bp, Artificial Sequence
  Synthetic Polynucleotide
taatacgactcactatagggtatataactctgtctcatcaagttcttctaaacagaggagatagaagatgttgatgagaaacctggcggcagcgcaaaagatg

SEQ ID NO: 224805 - DNA, 103 bp, Artificial Sequence
  Synthetic Polynucleotide
taatacgactcactatagggttatggcacatatataactctgtctcatcaaacagaggagatgatgaatgagagttataaacctggcggcagcgcaaaagatg

SEQ ID NO: 224806 - DNA, 103 bp, Artificial Sequence
  Synthetic Polynucleotide
taatacgactcactatagggctttttgcatttatggcacatatataactcaacagaggagagagttaatgatgtgccataacctggcggcagcgcaaaagatg

SEQ ID NO: 224807 - DNA, 103 bp, Artificial Sequence
  Synthetic Polynucleotide
taatacgactcactatagggacttttgtttctttttgcatttatggcacaaacagaggagatgtgccatgaatgcaaaaaacctggcggcagcgcaaaagatg

SEQ ID NO: 224808 - DNA, 103 bp, Artificial Sequence
  Synthetic Polynucleotide
taatacgactcactatagggttttttgtggacttttgtttctttttgcataacagaggagaatgcaaatggaaacaaaaaacctggcggcagcgcaaaagatg

SEQ ID NO: 224809 - DNA, 103 bp, Artificial Sequence
  Synthetic Polynucleotide
taatacgactcactatagggaatccaaaacttttttgtggacttttgtttaacagaggagaaaacaaatgtccacaaaaaacctggcggcagcgcaaaagatg

SEQ ID NO: 224810 - DNA, 103 bp, Artificial Sequence
  Synthetic Polynucleotide
taatacgactcactataggggtagtttttgaatccaaaacttttttgtggaacagaggagaccacaaatgagttttggaaacctggcggcagcgcaaaagatg

SEQ ID NO: 224811 - DNA, 103 bp, Artificial Sequence
  Synthetic Polynucleotide
taatacgactcactatagggacacttgaacaagtcaaacagacccaagggaacagaggagacccttgatgctgtttgacaacctggcggcagcgcaaaagatg

SEQ ID NO: 224812 - DNA, 103 bp, Artificial Sequence
  Synthetic Polynucleotide
taatacgactcactatagggagcaccttgggtagtttttgaatccaaaacaacagaggagagttttgatgtcaaaaactaacctggcggcagcgcaaaagatg

SEQ ID NO: 224813 - DNA, 103 bp, Artificial Sequence
  Synthetic Polynucleotide
taatacgactcactatagggatgtaagcatagcaccttgggtagtttttgaacagaggagacaaaaaatgcccaaggtgaacctggcggcagcgcaaaagatg

SEQ ID NO: 224814 - DNA, 103 bp, Artificial Sequence
  Synthetic Polynucleotide
taatacgactcactatagggatcttttcaaatgtaagcatagcaccttggaacagaggagaccaaggatgtatgcttacaacctggcggcagcgcaaaagatg

SEQ ID NO: 224815 - DNA, 103 bp, Artificial Sequence
  Synthetic Polynucleotide
taatacgactcactataggggtccaatgaaatcttttcaaatgtaagcataacagaggagaatgcttatgtttgaaaagaacctggcggcagcgcaaaagatg

SEQ ID NO: 224816 - DNA, 103 bp, Artificial Sequence
  Synthetic Polynucleotide
taatacgactcactatagggtaaatatgctgtccaatgaaatcttttcaaaacagaggagattgaaaatgtttcattggaacctggcggcagcgcaaaagatg

SEQ ID NO: 224817 - DNA, 103 bp, Artificial Sequence
  Synthetic Polynucleotide
taatacgactcactatagggctttatttcttaaatatgctgtccaatgaaaacagaggagattcattatgcagcatattaacctggcggcagcgcaaaagatg

SEQ ID NO: 224818 - DNA, 103 bp, Artificial Sequence
  Synthetic Polynucleotide
taatacgactcactatagggtatgtatcaactttatttcttaaatatgctaacagaggagaagcataatgaagaaataaaacctggcggcagcgcaaaagatg

SEQ ID NO: 224819 - DNA, 103 bp, Artificial Sequence
  Synthetic Polynucleotide
taatacgactcactatagggaaattctacgtatgtatcaactttatttctaacagaggagaagaaatatggttgatacaaacctggcggcagcgcaaaagatg

SEQ ID NO: 224820 - DNA, 103 bp, Artificial Sequence
  Synthetic Polynucleotide
taatacgactcactatagggctctcagtggaaattctacgtatgtatcaaaacagaggagattgataatgacgtagaataacctggcggcagcgcaaaagatg

SEQ ID NO: 224821 - DNA, 103 bp, Artificial Sequence
  Synthetic Polynucleotide
taatacgactcactatagggatgtctaggcctctcagtggaaattctacgaacagaggagacgtagaatgtccactgagaacctggcggcagcgcaaaagatg

SEQ ID NO: 224822 - DNA, 103 bp, Artificial Sequence
  Synthetic Polynucleotide
taatacgactcactatagggtccacagtggacacttgaacaagtcaaacaaacagaggagatgtttgatgtgttcaagtaacctggcggcagcgcaaaagatg

SEQ ID NO: 224823 - DNA, 103 bp, Artificial Sequence
  Synthetic Polynucleotide
taatacgactcactataggggtagcatttcatgtctaggcctctcagtggaacagaggagaccactgatgggcctagacaacctggcggcagcgcaaaagatg

SEQ ID NO: 224824 - DNA, 103 bp, Artificial Sequence
  Synthetic Polynucleotide
taatacgactcactataggggctctagtaagtagcatttcatgtctaggcaacagaggagagcctagatgtgaaatgctaacctggcggcagcgcaaaagatg

SEQ ID NO: 224825 - DNA, 103 bp, Artificial Sequence
  Synthetic Polynucleotide
taatacgactcactatagggctgttctcaggctctagtaagtagcatttcaacagaggagagaaatgatgcttactagaaacctggcggcagcgcaaaagatg

SEQ ID NO: 224826 - DNA, 103 bp, Artificial Sequence
  Synthetic Polynucleotide
taatacgactcactatagggctccgggccactgttctcaggctctagtaaaacagaggagattactaatgcctgagaacaacctggcggcagcgcaaaagatg

SEQ ID NO: 224827 - DNA, 103 bp, Artificial Sequence
  Synthetic Polynucleotide
taatacgactcactatagggacaggcagctctccgggccactgttctcagaacagaggagactgagaatggtggcccggaacctggcggcagcgcaaaagatg

SEQ ID NO: 224828 - DNA, 103 bp, Artificial Sequence
  Synthetic Polynucleotide
taatacgactcactataggggcgaggtcatacaggcagctctccgggccaaacagaggagatggcccatggagctgcctaacctggcggcagcgcaaaagatg

SEQ ID NO: 224829 - DNA, 103 bp, Artificial Sequence
  Synthetic Polynucleotide
taatacgactcactatagggcaccacagcggcgaggtcatacaggcagctaacagaggagaagctgcatgtatgacctcaacctggcggcagcgcaaaagatg

SEQ ID NO: 224830 - DNA, 103 bp, Artificial Sequence
  Synthetic Polynucleotide
taatacgactcactatagggcatggtgcaccaccacagcggcgaggtcataacagaggagaatgaccatgccgctgtggaacctggcggcagcgcaaaagatg

SEQ ID NO: 224831 - DNA, 103 bp, Artificial Sequence
  Synthetic Polynucleotide
taatacgactcactatagggaccccggaaccatggtgcaccaccacagcgaacagaggagacgctgtatgggtgcaccaaacctggcggcagcgcaaaagatg

SEQ ID NO: 224832 - DNA, 103 bp, Artificial Sequence
  Synthetic Polynucleotide
taatacgactcactatagggtccagaaccaaccccggaaccatggtgcacaacagaggagagtgcacatgggttccgggaacctggcggcagcgcaaaagatg

SEQ ID NO: 224833 - DNA, 103 bp, Artificial Sequence
  Synthetic Polynucleotide
taatacgactcactatagggtcacataccttccacagtggacacttgaacaacagaggagagttcaaatgtccactgtgaacctggcggcagcgcaaaagatg

SEQ ID NO: 224834 - DNA, 103 bp, Artificial Sequence
  Synthetic Polynucleotide
taatacgactcactatagggctgtgtaatgtccagaaccaaccccggaacaacagaggagagttccgatgttggttctgaacctggcggcagcgcaaaagatg

SEQ ID NO: 224835 - DNA, 103 bp, Artificial Sequence
  Synthetic Polynucleotide
taatacgactcactataggggttgcgtatgctgtgtaatgtccagaaccaaacagaggagatggttcatgacattacacaacctggcggcagcgcaaaagatg

SEQ ID NO: 224836 - DNA, 103 bp, Artificial Sequence
  Synthetic Polynucleotide
taatacgactcactataggggccttcgtgagttgcgtatgctgtgtaatgaacagaggagacattacatggcatacgcaaacctggcggcagcgcaaaagatg

SEQ ID NO: 224837 - DNA, 103 bp, Artificial Sequence
  Synthetic Polynucleotide
taatacgactcactatagggggaaccagcggccttcgtgagttgcgtatgaacagaggagacatacgatgctcacgaagaacctggcggcagcgcaaaagatg

SEQ ID NO: 224838 - DNA, 103 bp, Artificial Sequence
  Synthetic Polynucleotide
taatacgactcactatagggtcattgaagtggaaccagcggccttcgtgaaacagaggagatcacgaatgccgctggttaacctggcggcagcgcaaaagatg

SEQ ID NO: 224839 - DNA, 103 bp, Artificial Sequence
  Synthetic Polynucleotide
taatacgactcactatagggtacagtactgtcattgaagtggaaccagcgaacagaggagacgctggatgcacttcaataacctggcggcagcgcaaaagatg

SEQ ID NO: 224840 - DNA, 103 bp, Artificial Sequence
  Synthetic Polynucleotide
taatacgactcactatagggcagtcagtgttacagtactgtcattgaagtaacagaggagaacttcaatgacagtactgaacctggcggcagcgcaaaagatg

SEQ ID NO: 224841 - DNA, 103 bp, Artificial Sequence
  Synthetic Polynucleotide
taatacgactcactataggggtctcctcgtcagtcagtgttacagtactgaacagaggagacagtacatgaacactgacaacctggcggcagcgcaaaagatg

SEQ ID NO: 224842 - DNA, 103 bp, Artificial Sequence
  Synthetic Polynucleotide
taatacgactcactatagggcttcaccacagtctcctcgtcagtcagtgtaacagaggagaacactgatggacgaggagaacctggcggcagcgcaaaagatg

SEQ ID NO: 224843 - DNA, 103 bp, Artificial Sequence
  Synthetic Polynucleotide
taatacgactcactatagggaggccttcgccttcaccacagtctcctcgtaacagaggagaacgaggatgctgtggtgaaacctggcggcagcgcaaaagatg

SEQ ID NO: 224844 - DNA, 103 bp, Artificial Sequence
  Synthetic Polynucleotide
taatacgactcactataggggcatggccattcacataccttccacagtggaacagaggagaccactgatgaaggtatgtaacctggcggcagcgcaaaagatg

SEQ ID NO: 224845 - DNA, 103 bp, Artificial Sequence
  Synthetic Polynucleotide
taatacgactcactatagggaaaaggatgtaggccttcgccttcaccacaaacagaggagatgtggtatgggcgaaggcaacctggcggcagcgcaaaagatg

SEQ ID NO: 224846 - DNA, 103 bp, Artificial Sequence
  Synthetic Polynucleotide
taatacgactcactatagggttccacgtagaaaaggatgtaggccttcgcaacagaggagagcgaagatgtacatccttaacctggcggcagcgcaaaagatg

SEQ ID NO: 224847 - DNA, 103 bp, Artificial Sequence
  Synthetic Polynucleotide
taatacgactcactatagggtggcctggtgttccacgtagaaaaggatgtaacagaggagaacatccatgtctacgtggaacctggcggcagcgcaaaagatg

SEQ ID NO: 224848 - DNA, 103 bp, Artificial Sequence
  Synthetic Polynucleotide
taatacgactcactataggggatccagctttggcctggtgttccacgtagaacagaggagactacgtatgacaccaggcaacctggcggcagcgcaaaagatg

SEQ ID NO: 224849 - DNA, 103 bp, Artificial Sequence
  Synthetic Polynucleotide
taatacgactcactatagggaagtttatccgatccagctttggcctggtgaacagaggagacaccagatgaaagctggaaacctggcggcagcgcaaaagatg

SEQ ID NO: 224850 - DNA, 103 bp, Artificial Sequence
  Synthetic Polynucleotide
taatacgactcactatagggatgtttttttgcatggccattcacatacctaacagaggagaaggtatatgaatggccataacctggcggcagcgcaaaagatg

SEQ ID NO: 224851 - DNA, 103 bp, Artificial Sequence
  Synthetic Polynucleotide
taatacgactcactatagggcatcttcataatgtttttttgcatggccataacagaggagaatggccatgcaaaaaaacaacctggcggcagcgcaaaagatg

SEQ ID NO: 224852 - DNA, 103 bp, Artificial Sequence
  Synthetic Polynucleotide
taatacgactcactatagggggtacttgtgcatcttcataatgtttttttaacagaggagaaaaaaaatgttatgaagaaacctggcggcagcgcaaaagatg

SEQ ID NO: 224853 - DNA, 103 bp, Artificial Sequence
  Synthetic Polynucleotide
taatacgactcactataggggttggttaaaggtacttgtgcatcttcataaacagaggagatatgaaatggcacaagtaaacctggcggcagcgcaaaagatg

SEQ ID NO: 224854 - DNA, 103 bp, Artificial Sequence
  Synthetic Polynucleotide
taatacgactcactataggggagcaatgcagacgctggagctcaggtgtgaacagaggagacacaccatggctccagcgaacctggcggcagcgcaaaagatg

SEQ ID NO: 224855 - DNA, 103 bp, Artificial Sequence
  Synthetic Polynucleotide
taatacgactcactatagggatttcttatggttggttaaaggtacttgtgaacagaggagacacaagatgctttaaccaaacctggcggcagcgcaaaagatg

SEQ ID NO: 224856 - DNA, 103 bp, Artificial Sequence
  Synthetic Polynucleotide
taatacgactcactatagggtgcttttctgatttcttatggttggttaaaaacagaggagatttaacatgccataagaaaacctggcggcagcgcaaaagatg

SEQ ID NO: 224857 - DNA, 103 bp, Artificial Sequence
  Synthetic Polynucleotide
taatacgactcactatagggaactttatcttgcttttctgatttcttatgaacagaggagacataagatgtcagaaaagaacctggcggcagcgcaaaagatg

SEQ ID NO: 224858 - DNA, 103 bp, Artificial Sequence
  Synthetic Polynucleotide
taatacgactcactatagggctgtgtgctgaactttatcttgcttttctgaacagaggagacagaaaatgaagataaagaacctggcggcagcgcaaaagatg

SEQ ID NO: 224859 - DNA, 103 bp, Artificial Sequence
  Synthetic Polynucleotide
taatacgactcactatagggtccatacatactgtgtgctgaactttatctaacagaggagaagataaatgtcagcacacaacctggcggcagcgcaaaagatg

SEQ ID NO: 224860 - DNA, 103 bp, Artificial Sequence
  Synthetic Polynucleotide
taatacgactcactataggggctactgcaatccatacatactgtgtgctgaacagaggagacagcacatggtatgtatgaacctggcggcagcgcaaaagatg

SEQ ID NO: 224861 - DNA, 103 bp, Artificial Sequence
  Synthetic Polynucleotide
taatacgactcactatagggatgtactgtagctactgcaatccatacataaacagaggagatatgtaatgattgcagtaaacctggcggcagcgcaaaagatg

SEQ ID NO: 224862 - DNA, 103 bp, Artificial Sequence
  Synthetic Polynucleotide
taatacgactcactatagggcgataacagtatgtactgtagctactgcaaaacagaggagattgcagatgctacagtacaacctggcggcagcgcaaaagatg

SEQ ID NO: 224863 - DNA, 103 bp, Artificial Sequence
  Synthetic Polynucleotide
taatacgactcactatagggatcatcacagcgataacagtatgtactgtaaacagaggagatacagtatgtactgttataacctggcggcagcgcaaaagatg

SEQ ID NO: 224864 - DNA, 103 bp, Artificial Sequence
  Synthetic Polynucleotide
taatacgactcactatagggtaaccacaaaatcatcacagcgataacagtaacagaggagaactgttatggctgtgatgaacctggcggcagcgcaaaagatg

SEQ ID NO: 224865 - DNA, 103 bp, Artificial Sequence
  Synthetic Polynucleotide
taatacgactcactataggggctgagtccggagcaatgcagacgctggagaacagaggagactccagatgctgcattgcaacctggcggcagcgcaaaagatg

SEQ ID NO: 224866 - DNA, 103 bp, Artificial Sequence
  Synthetic Polynucleotide
taatacgactcactatagggttggtgtcattaaccacaaaatcatcacagaacagaggagactgtgaatgttttgtggtaacctggcggcagcgcaaaagatg

SEQ ID NO: 224867 - DNA, 103 bp, Artificial Sequence
  Synthetic Polynucleotide
taatacgactcactatagggcagtcccagcttggtgtcattaaccacaaaaacagaggagatttgtgatgaatgacaccaacctggcggcagcgcaaaagatg

SEQ ID NO: 224868 - DNA, 103 bp, Artificial Sequence
  Synthetic Polynucleotide
taatacgactcactatagggctttctgtaccagtcccagcttggtgtcataacagaggagaatgacaatgagctgggacaacctggcggcagcgcaaaagatg

SEQ ID NO: 224869 - DNA, 103 bp, Artificial Sequence
  Synthetic Polynucleotide
taatacgactcactatagggtgttctctgactttctgtaccagtcccagcaacagaggagagctgggatgggtacagaaaacctggcggcagcgcaaaagatg

SEQ ID NO: 224870 - DNA, 103 bp, Artificial Sequence
  Synthetic Polynucleotide
taatacgactcactataggggttctgtaagtgttctctgactttctgtacaacagaggagagtacagatggtcagagaaaacctggcggcagcgcaaaagatg

SEQ ID NO: 224871 - DNA, 103 bp, Artificial Sequence
  Synthetic Polynucleotide
taatacgactcactatagggagttttccaagttctgtaagtgttctctgaaacagaggagatcagagatgacttacagaaacctggcggcagcgcaaaagatg

SEQ ID NO: 224872 - DNA, 103 bp, Artificial Sequence
  Synthetic Polynucleotide
taatacgactcactataggggtgaaagctgagttttccaagttctgtaagaacagaggagacttacaatgcttggaaaaaacctggcggcagcgcaaaagatg

SEQ ID NO: 224873 - DNA, 103 bp, Artificial Sequence
  Synthetic Polynucleotide
taatacgactcactatagggcctgtcagctgtgaaagctgagttttccaaaacagaggagattggaaatgtcagctttcaacctggcggcagcgcaaaagatg

SEQ ID NO: 224874 - DNA, 103 bp, Artificial Sequence
  Synthetic Polynucleotide
taatacgactcactatagggttttcttatgcctgtcagctgtgaaagctgaacagaggagacagcttatgcagctgacaaacctggcggcagcgcaaaagatg

SEQ ID NO: 224875 - DNA, 103 bp, Artificial Sequence
  Synthetic Polynucleotide
taatacgactcactatagggaaaagttttcttttcttatgcctgtcagctaacagaggagaagctgaatggcataagaaaacctggcggcagcgcaaaagatg

SEQ ID NO: 224876 - DNA, 103 bp, Artificial Sequence
  Synthetic Polynucleotide
taatacgactcactatagggggggaacttggctgagtccggagcaatgcaaacagaggagatgcattatgccggactcaaacctggcggcagcgcaaaagatg

SEQ ID NO: 224877 - DNA, 103 bp, Artificial Sequence
  Synthetic Polynucleotide
taatacgactcactatagggtgagttttccaaaagttttcttttcttatgaacagaggagacataagatgagaaaacttaacctggcggcagcgcaaaagatg

SEQ ID NO: 224878 - DNA, 103 bp, Artificial Sequence
  Synthetic Polynucleotide
taatacgactcactatagggtgtttagtgttgagttttccaaaagttttcaacagaggagagaaaacatgtggaaaactaacctggcggcagcgcaaaagatg

SEQ ID NO: 224879 - DNA, 103 bp, Artificial Sequence
  Synthetic Polynucleotide
taatacgactcactatagggaataacttgctgtttagtgttgagttttccaacagaggagaggaaaaatgaacactaaaaacctggcggcagcgcaaaagatg

SEQ ID NO: 224880 - DNA, 103 bp, Artificial Sequence
  Synthetic Polynucleotide
taatacgactcactatagggatttacttttaataacttgctgtttagtgtaacagaggagaacactaatgagcaagttaaacctggcggcagcgcaaaagatg

SEQ ID NO: 224881 - DNA, 103 bp, Artificial Sequence
  Synthetic Polynucleotide
taatacgactcactatagggtggtgcttccatttacttttaataacttgcaacagaggagagcaagtatgtaaaagtaaaacctggcggcagcgcaaaagatg

SEQ ID NO: 224882 - DNA, 103 bp, Artificial Sequence
  Synthetic Polynucleotide
taatacgactcactatagggcaaatggcagtggtgcttccatttacttttaacagaggagaaaaagtatgtggaagcacaacctggcggcagcgcaaaagatg

SEQ ID NO: 224883 - DNA, 103 bp, Artificial Sequence
  Synthetic Polynucleotide
taatacgactcactataggggcctgtggcacaaatggcagtggtgcttccaacagaggagaggaagcatgactgccattaacctggcggcagcgcaaaagatg

SEQ ID NO: 224884 - DNA, 103 bp, Artificial Sequence
  Synthetic Polynucleotide
taatacgactcactatagggaattccgaaggcctgtggcacaaatggcagaacagaggagactgccaatggtgccacagaacctggcggcagcgcaaaagatg

SEQ ID NO: 224885 - DNA, 103 bp, Artificial Sequence
  Synthetic Polynucleotide
taatacgactcactataggggtgttccccaaattccgaaggcctgtggcaaacagaggagatgccacatgccttcggaaaacctggcggcagcgcaaaagatg

SEQ ID NO: 224886 - DNA, 103 bp, Artificial Sequence
  Synthetic Polynucleotide
taatacgactcactatagggcatgaaacatgtgttccccaaattccgaagaacagaggagacttcggatgttggggaacaacctggcggcagcgcaaaagatg

SEQ ID NO: 224887 - DNA, 103 bp, Artificial Sequence
  Synthetic Polynucleotide
taatacgactcactataggggggagccgttggggaacttggctgagtccgaacagaggagacggactatgccaagttccaacctggcggcagcgcaaaagatg

SEQ ID NO: 224888 - DNA, 103 bp, Artificial Sequence
  Synthetic Polynucleotide
taatacgactcactatagggggatggcattcatgaaacatgtgttccccaaacagaggagatggggaatgcatgtttcaaacctggcggcagcgcaaaagatg

SEQ ID NO: 224889 - DNA, 103 bp, Artificial Sequence
  Synthetic Polynucleotide
taatacgactcactatagggagtgactgaaggatggcattcatgaaacataacagaggagaatgtttatggaatgccataacctggcggcagcgcaaaagatg

SEQ ID NO: 224890 - DNA, 103 bp, Artificial Sequence
  Synthetic Polynucleotide
taatacgactcactatagggaatgttactgagtgactgaaggatggcattaacagaggagaaatgccatgcttcagtcaaacctggcggcagcgcaaaagatg

SEQ ID NO: 224891 - DNA, 103 bp, Artificial Sequence
  Synthetic Polynucleotide
taatacgactcactatagggaaaactgctcaatgttactgagtgactgaaaacagaggagattcagtatgtcagtaacaaacctggcggcagcgcaaaagatg

SEQ ID NO: 224892 - DNA, 103 bp, Artificial Sequence
  Synthetic Polynucleotide
taatacgactcactatagggaaataacagcaaaactgctcaatgttactgaacagaggagacagtaaatgtgagcagttaacctggcggcagcgcaaaagatg

SEQ ID NO: 224893 - DNA, 103 bp, Artificial Sequence
  Synthetic Polynucleotide
taatacgactcactatagggcagttctttgaaataacagcaaaactgctcaacagaggagagagcagatgtgctgttataacctggcggcagcgcaaaagatg

SEQ ID NO: 224894 - DNA, 103 bp, Artificial Sequence
  Synthetic Polynucleotide
taatacgactcactatagggccacggcgggcagttctttgaaataacagcaacagaggagagctgttatgtcaaagaacaacctggcggcagcgcaaaagatg

SEQ ID NO: 224895 - DNA, 103 bp, Artificial Sequence
  Synthetic Polynucleotide
taatacgactcactatagggttccttaactccacggcgggcagttctttgaacagaggagacaaagaatggcccgccgtaacctggcggcagcgcaaaagatg

SEQ ID NO: 224896 - DNA, 103 bp, Artificial Sequence
  Synthetic Polynucleotide
taatacgactcactatagggtgttttcccattccttaactccacggcgggaacagaggagacccgccatggagttaaggaacctggcggcagcgcaaaagatg

SEQ ID NO: 224897 - DNA, 103 bp, Artificial Sequence
  Synthetic Polynucleotide
taatacgactcactataggggccttcctgctgttttcccattccttaactaacagaggagaagttaaatgatgggaaaaaacctggcggcagcgcaaaagatg

SEQ ID NO: 224898 - DNA, 103 bp, Artificial Sequence
  Synthetic Polynucleotide
taatacgactcactatagggcaggacgacggggagccgttggggaacttgaacagaggagacaagttatgcaacggctcaacctggcggcagcgcaaaagatg

SEQ ID NO: 224899 - DNA, 103 bp, Artificial Sequence
  Synthetic Polynucleotide
taatacgactcactatagggtggtatgtccgccttcctgctgttttcccaaacagaggagatgggaaatgagcaggaagaacctggcggcagcgcaaaagatg

SEQ ID NO: 224900 - DNA, 103 bp, Artificial Sequence
  Synthetic Polynucleotide
taatacgactcactataggggctcctggtgtggtatgtccgccttcctgcaacagaggagagcaggaatgcggacatacaacctggcggcagcgcaaaagatg

SEQ ID NO: 224901 - DNA, 103 bp, Artificial Sequence
  Synthetic Polynucleotide
taatacgactcactatagggtatccccttggctcctggtgtggtatgtccaacagaggagaggacatatgacaccaggaaacctggcggcagcgcaaaagatg

SEQ ID NO: 224902 - DNA, 103 bp, Artificial Sequence
  Synthetic Polynucleotide
taatacgactcactataggggacacattgttatccccttggctcctggtgaacagaggagacaccagatgccaaggggaaacctggcggcagcgcaaaagatg

SEQ ID NO: 224903 - DNA, 103 bp, Artificial Sequence
  Synthetic Polynucleotide
taatacgactcactatagggttctaccaaagacacattgttatccccttgaacagaggagacaagggatgaacaatgtgaacctggcggcagcgcaaaagatg

SEQ ID NO: 224904 - DNA, 103 bp, Artificial Sequence
  Synthetic Polynucleotide
taatacgactcactatagggttctaaactcttctaccaaagacacattgtaacagaggagaacaatgatgctttggtagaacctggcggcagcgcaaaagatg

SEQ ID NO: 224905 - DNA, 103 bp, Artificial Sequence
  Synthetic Polynucleotide
taatacgactcactatagggcagagtgtctttctaaactcttctaccaaaaacagaggagatttggtatgagagtttagaacctggcggcagcgcaaaagatg

SEQ ID NO: 224906 - DNA, 103 bp, Artificial Sequence
  Synthetic Polynucleotide
taatacgactcactatagggccataaagcacagagtgtctttctaaactcaacagaggagagagtttatgaagacactcaacctggcggcagcgcaaaagatg

SEQ ID NO: 224907 - DNA, 103 bp, Artificial Sequence
  Synthetic Polynucleotide
taatacgactcactatagggggctgccttgccataaagcacagagtgtctaacagaggagaagacacatggtgctttataacctggcggcagcgcaaaagatg

SEQ ID NO: 224908 - DNA, 103 bp, Artificial Sequence
  Synthetic Polynucleotide
taatacgactcactatagggaatgcagtctggctgccttgccataaagcaaacagaggagatgctttatggcaaggcagaacctggcggcagcgcaaaagatg

SEQ ID NO: 224909 - DNA, 103 bp, Artificial Sequence
  Synthetic Polynucleotide
taatacgactcactataggggctgcagcaccaggacgacggggagccgttaacagaggagaaacggcatgccgtcgtccaacctggcggcagcgcaaaagatg

SEQ ID NO: 224910 - DNA, 103 bp, Artificial Sequence
  Synthetic Polynucleotide
taatacgactcactatagggctctgggctaaatgcagtctggctgccttgaacagaggagacaaggcatgcagactgcaaacctggcggcagcgcaaaagatg

SEQ ID NO: 224911 - DNA, 103 bp, Artificial Sequence
  Synthetic Polynucleotide
taatacgactcactatagggaaaataaggactctgggctaaatgcagtctaacagaggagaagactgatgttagcccagaacctggcggcagcgcaaaagatg

SEQ ID NO: 224912 - DNA, 103 bp, Artificial Sequence
  Synthetic Polynucleotide
taatacgactcactatagggcaaacaacataaaataaggactctgggctaaacagaggagatagcccatggtccttattaacctggcggcagcgcaaaagatg

SEQ ID NO: 224913 - DNA, 103 bp, Artificial Sequence
  Synthetic Polynucleotide
taatacgactcactatagggcataatcttccaaacaacataaaataaggaaacagaggagatccttaatgtatgttgttaacctggcggcagcgcaaaagatg

SEQ ID NO: 224914 - DNA, 103 bp, Artificial Sequence
  Synthetic Polynucleotide
taatacgactcactatagggtaaagtttggcataatcttccaaacaacataacagaggagaatgttgatgggaagattaaacctggcggcagcgcaaaagatg

SEQ ID NO: 224915 - DNA, 103 bp, Artificial Sequence
  Synthetic Polynucleotide
taatacgactcactatagggtgatagcccctaaagtttggcataatcttcaacagaggagagaagatatggccaaacttaacctggcggcagcgcaaaagatg

SEQ ID NO: 224916 - DNA, 103 bp, Artificial Sequence
  Synthetic Polynucleotide
taatacgactcactataggggtcctgctgttgatagcccctaaagtttggaacagaggagaccaaacatgaggggctataacctggcggcagcgcaaaagatg

SEQ ID NO: 224917 - DNA, 103 bp, Artificial Sequence
  Synthetic Polynucleotide
taatacgactcactatagggattcatgggcgtcctgctgttgatagccccaacagaggagaggggctatgaacagcaggaacctggcggcagcgcaaaagatg

SEQ ID NO: 224918 - DNA, 103 bp, Artificial Sequence
  Synthetic Polynucleotide
taatacgactcactatagggtagcgcatgaattcatgggcgtcctgctgtaacagaggagaacagcaatgcgcccatgaaacctggcggcagcgcaaaagatg

SEQ ID NO: 224919 - DNA, 103 bp, Artificial Sequence
  Synthetic Polynucleotide
taatacgactcactataggggtccaaaaggtagcgcatgaattcatgggcaacagaggagagcccatatgttcatgcgcaacctggcggcagcgcaaaagatg

SEQ ID NO: 224920 - DNA, 103 bp, Artificial Sequence
  Synthetic Polynucleotide
taatacgactcactatagggaccggcacacgctgcagcaccaggacgacgaacagaggagacgtcgtatgggtgctgcaaacctggcggcagcgcaaaagatg

SEQ ID NO: 224921 - DNA, 103 bp, Artificial Sequence
  Synthetic Polynucleotide
taatacgactcactatagggagtgtaggtggtccaaaaggtagcgcatgaaacagaggagatcatgcatgaccttttggaacctggcggcagcgcaaaagatg

SEQ ID NO: 224922 - DNA, 103 bp, Artificial Sequence
  Synthetic Polynucleotide
taatacgactcactatagggtgaagttccaagtgtaggtggtccaaaaggaacagaggagaccttttatgccacctacaaacctggcggcagcgcaaaagatg

SEQ ID NO: 224923 - DNA, 103 bp, Artificial Sequence
  Synthetic Polynucleotide
taatacgactcactataggggaaaccgccctgaagttccaagtgtaggtgaacagaggagacacctaatgttggaacttaacctggcggcagcgcaaaagatg

SEQ ID NO: 224924 - DNA, 103 bp, Artificial Sequence
  Synthetic Polynucleotide
taatacgactcactatagggaaacaccgttgaaaccgccctgaagttccaaacagaggagatggaacatgagggcggttaacctggcggcagcgcaaaagatg

SEQ ID NO: 224925 - DNA, 103 bp, Artificial Sequence
  Synthetic Polynucleotide
taatacgactcactataggggctgagcgggaaacaccgttgaaaccgcccaacagaggagagggcggatgcaacggtgtaacctggcggcagcgcaaaagatg

SEQ ID NO: 224926 - DNA, 103 bp, Artificial Sequence
  Synthetic Polynucleotide
taatacgactcactatagggctgcagaattgctgagcgggaaacaccgttaacagaggagaaacggtatgtcccgctcaaacctggcggcagcgcaaaagatg

SEQ ID NO: 224927 - DNA, 103 bp, Artificial Sequence
  Synthetic Polynucleotide
taatacgactcactatagggtagaattctcctgcagaattgctgagcgggaacagaggagacccgctatgcaattctgcaacctggcggcagcgcaaaagatg

SEQ ID NO: 224928 - DNA, 103 bp, Artificial Sequence
  Synthetic Polynucleotide
taatacgactcactataggggcagacagagtagaattctcctgcagaattaacagaggagaaattctatgggagaattcaacctggcggcagcgcaaaagatg

SEQ ID NO: 224929 - DNA, 103 bp, Artificial Sequence
  Synthetic Polynucleotide
taatacgactcactatagggcttgttacttgcagacagagtagaattctcaacagaggagagagaatatgactctgtctaacctggcggcagcgcaaaagatg

SEQ ID NO: 224930 - DNA, 103 bp, Artificial Sequence
  Synthetic Polynucleotide
taatacgactcactatagggttatgcaacacttgttacttgcagacagagaacagaggagactctgtatgcaagtaacaaacctggcggcagcgcaaaagatg

SEQ ID NO: 224931 - DNA, 103 bp, Artificial Sequence
  Synthetic Polynucleotide
taatacgactcactatagggcttttgttggaccggcacacgctgcagcacaacagaggagagtgctgatgcgtgtgccgaacctggcggcagcgcaaaagatg

SEQ ID NO: 224932 - DNA, 103 bp, Artificial Sequence
  Synthetic Polynucleotide
taatacgactcactataggggatgctccatttatgcaacacttgttacttaacagaggagaaagtaaatggtgttgcataacctggcggcagcgcaaaagatg

SEQ ID NO: 224933 - DNA, 103 bp, Artificial Sequence
  Synthetic Polynucleotide
taatacgactcactataggggacaacagtagatgctccatttatgcaacaaacagaggagatgttgcatgaatggagcaaacctggcggcagcgcaaaagatg

SEQ ID NO: 224934 - DNA, 103 bp, Artificial Sequence
  Synthetic Polynucleotide
taatacgactcactatagggatatagccgtgacaacagtagatgctccataacagaggagaatggagatgctactgttgaacctggcggcagcgcaaaagatg

SEQ ID NO: 224935 - DNA, 103 bp, Artificial Sequence
  Synthetic Polynucleotide
taatacgactcactatagggatgcctccgaatatagccgtgacaacagtaaacagaggagatactgtatgcacggctataacctggcggcagcgcaaaagatg

SEQ ID NO: 224936 - DNA, 103 bp, Artificial Sequence
  Synthetic Polynucleotide
taatacgactcactatagggattttggagaatgcctccgaatatagccgtaacagaggagaacggctatgttcggaggcaacctggcggcagcgcaaaagatg

SEQ ID NO: 224937 - DNA, 103 bp, Artificial Sequence
  Synthetic Polynucleotide
taatacgactcactatagggagttaacctcattttggagaatgcctccgaaacagaggagatcggagatgttctccaaaaacctggcggcagcgcaaaagatg

SEQ ID NO: 224938 - DNA, 103 bp, Artificial Sequence
  Synthetic Polynucleotide
taatacgactcactatagggcatatgaggcagttaacctcattttggagaaacagaggagatctccaatgtgaggttaaaacctggcggcagcgcaaaagatg

SEQ ID NO: 224939 - DNA, 103 bp, Artificial Sequence
  Synthetic Polynucleotide
taatacgactcactatagggttctgtcccacatatgaggcagttaacctcaacagaggagagaggttatgtgcctcataaacctggcggcagcgcaaaagatg

SEQ ID NO: 224940 - DNA, 103 bp, Artificial Sequence
  Synthetic Polynucleotide
taatacgactcactatagggactttctagattctgtcccacatatgaggcaacagaggagagcctcaatggtgggacagaacctggcggcagcgcaaaagatg

SEQ ID NO: 224941 - DNA, 103 bp, Artificial Sequence
  Synthetic Polynucleotide
taatacgactcactatagggaatggatcaaactttctagattctgtcccaaacagaggagatgggacatgatctagaaaaacctggcggcagcgcaaaagatg

SEQ ID NO: 224942 - DNA, 103 bp, Artificial Sequence
  Synthetic Polynucleotide
taatacgactcactatagggggtagtgagcgacactgcgcaggatttcataacagaggagaatgaaaatgtgcgcagtgaacctggcggcagcgcaaaagatg

SEQ ID NO: 224943 - DNA, 103 bp, Artificial Sequence
  Synthetic Polynucleotide
taatacgactcactataggggactgtcaggctaacagactcctcttcactaacagaggagaagtgaaatggagtctgttaacctggcggcagcgcaaaagatg

SEQ ID NO: 224944 - DNA, 103 bp, Artificial Sequence
  Synthetic Polynucleotide
taatacgactcactatagggacaaatatatgcctgtaaagcatccataggaacagaggagacctatgatggctttacagaacctggcggcagcgcaaaagatg

SEQ ID NO: 224945 - DNA, 103 bp, Artificial Sequence
  Synthetic Polynucleotide
taatacgactcactatagggattgtacagcacaaatatatgcctgtaaagaacagaggagactttacatgcatatatttaacctggcggcagcgcaaaagatg

SEQ ID NO: 224946 - DNA, 103 bp, Artificial Sequence
  Synthetic Polynucleotide
taatacgactcactatagggccatggtccaattgtacagcacaaatatataacagaggagaatatatatgtgctgtacaaacctggcggcagcgcaaaagatg

SEQ ID NO: 224947 - DNA, 103 bp, Artificial Sequence
  Synthetic Polynucleotide
taatacgactcactatagggtgcggcatgcccatggtccaattgtacagcaacagaggagagctgtaatgttggaccataacctggcggcagcgcaaaagatg

SEQ ID NO: 224948 - DNA, 103 bp, Artificial Sequence
  Synthetic Polynucleotide
taatacgactcactatagggccatccaggctgcggcatgcccatggtccaaacagaggagatggaccatgggcatgccgaacctggcggcagcgcaaaagatg

SEQ ID NO: 224949 - DNA, 103 bp, Artificial Sequence
  Synthetic Polynucleotide
taatacgactcactataggggtacctaggtccatccaggctgcggcatgcaacagaggagagcatgcatgagcctggataacctggcggcagcgcaaaagatg

SEQ ID NO: 224950 - DNA, 103 bp, Artificial Sequence
  Synthetic Polynucleotide
taatacgactcactatagggttcatagagagtacctaggtccatccaggcaacagaggagagcctggatggacctaggtaacctggcggcagcgcaaaagatg

SEQ ID NO: 224951 - DNA, 103 bp, Artificial Sequence
  Synthetic Polynucleotide
taatacgactcactataggggattgcaggattcatagagagtacctaggtaacagaggagaacctagatgctctctatgaacctggcggcagcgcaaaagatg

SEQ ID NO: 224952 - DNA, 103 bp, Artificial Sequence
  Synthetic Polynucleotide
taatacgactcactatagggtcttgaggttgattgcaggattcatagagaaacagaggagatctctaatgatcctgcaaaacctggcggcagcgcaaaagatg

SEQ ID NO: 224953 - DNA, 103 bp, Artificial Sequence
  Synthetic Polynucleotide
taatacgactcactatagggtttaatggcatcttgaggttgattgcaggaaacagaggagatcctgcatgcaacctcaaaacctggcggcagcgcaaaagatg

SEQ ID NO: 224954 - DNA, 103 bp, Artificial Sequence
  Synthetic Polynucleotide
taatacgactcactatagggccctttcctcgactgtcaggctaacagactaacagaggagaagtctgatggcctgacagaacctggcggcagcgcaaaagatg

SEQ ID NO: 224955 - DNA, 103 bp, Artificial Sequence
  Synthetic Polynucleotide
taatacgactcactatagggttaggtagcatttaatggcatcttgaggttaacagaggagaaacctcatgatgccattaaacctggcggcagcgcaaaagatg

SEQ ID NO: 224956 - DNA, 103 bp, Artificial Sequence
  Synthetic Polynucleotide
taatacgactcactatagggctagctgcatttaggtagcatttaatggcaaacagaggagatgccatatgatgctacctaacctggcggcagcgcaaaagatg

SEQ ID NO: 224957 - DNA, 103 bp, Artificial Sequence
  Synthetic Polynucleotide
taatacgactcactatagggacgtttgcttctagctgcatttaggtagcaaacagaggagatgctacatgaatgcagctaacctggcggcagcgcaaaagatg

SEQ ID NO: 224958 - DNA, 103 bp, Artificial Sequence
  Synthetic Polynucleotide
taatacgactcactatagggtattactacaacgtttgcttctagctgcataacagaggagaatgcagatggaagcaaacaacctggcggcagcgcaaaagatg

SEQ ID NO: 224959 - DNA, 103 bp, Artificial Sequence
  Synthetic Polynucleotide
taatacgactcactatagggagcgtagaggtattactacaacgtttgcttaacagaggagaaagcaaatgttgtagtaaaacctggcggcagcgcaaaagatg

SEQ ID NO: 224960 - DNA, 103 bp, Artificial Sequence
  Synthetic Polynucleotide
taatacgactcactatagggtcttgcagcaagcgtagaggtattactacaaacagaggagatgtagtatgacctctacgaacctggcggcagcgcaaaagatg

SEQ ID NO: 224961 - DNA, 103 bp, Artificial Sequence
  Synthetic Polynucleotide
taatacgactcactataggggaaatttaattcttgcagcaagcgtagaggaacagaggagacctctaatgttgctgcaaaacctggcggcagcgcaaaagatg

SEQ ID NO: 224962 - DNA, 103 bp, Artificial Sequence
  Synthetic Polynucleotide
taatacgactcactatagggccattctgtagaaatttaattcttgcagcaaacagaggagatgctgcatgaattaaattaacctggcggcagcgcaaaagatg

SEQ ID NO: 224963 - DNA, 103 bp, Artificial Sequence
  Synthetic Polynucleotide
taatacgactcactataggggttatcagaaccattctgtagaaatttaataacagaggagaattaaaatgctacagaataacctggcggcagcgcaaaagatg

SEQ ID NO: 224964 - DNA, 103 bp, Artificial Sequence
  Synthetic Polynucleotide
taatacgactcactatagggcaccattccagttatcagaaccattctgtaaacagaggagatacagaatggttctgataaacctggcggcagcgcaaaagatg

SEQ ID NO: 224965 - DNA, 103 bp, Artificial Sequence
  Synthetic Polynucleotide
taatacgactcactatagggccaagcgcctccctttcctcgactgtcaggaacagaggagacctgacatgcgaggaaagaacctggcggcagcgcaaaagatg

SEQ ID NO: 224966 - DNA, 103 bp, Artificial Sequence
  Synthetic Polynucleotide
taatacgactcactatagggagactctggccaccattccagttatcagaaaacagaggagattctgaatgctggaatggaacctggcggcagcgcaaaagatg

SEQ ID NO: 224967 - DNA, 103 bp, Artificial Sequence
  Synthetic Polynucleotide
taatacgactcactatagggatgatgtgaaagactctggccaccattccaaacagaggagatggaatatgggccagagtaacctggcggcagcgcaaaagatg

SEQ ID NO: 224968 - DNA, 103 bp, Artificial Sequence
  Synthetic Polynucleotide
taatacgactcactataggggctgtactggatgatgtgaaagactctggcaacagaggagagccagaatgtttcacatcaacctggcggcagcgcaaaagatg

SEQ ID NO: 224969 - DNA, 103 bp, Artificial Sequence
  Synthetic Polynucleotide
taatacgactcactataggggaataaacttgctgtactggatgatgtgaaaacagaggagattcacaatgtccagtacaaacctggcggcagcgcaaaagatg

SEQ ID NO: 224970 - DNA, 103 bp, Artificial Sequence
  Synthetic Polynucleotide
taatacgactcactatagggcaaacacaacgaataaacttgctgtactggaacagaggagaccagtaatgcaagtttataacctggcggcagcgcaaaagatg

SEQ ID NO: 224971 - DNA, 103 bp, Artificial Sequence
  Synthetic Polynucleotide
taatacgactcactatagggtctgtggtgtcaaacacaacgaataaacttaacagaggagaaagtttatgcgttgtgttaacctggcggcagcgcaaaagatg

SEQ ID NO: 224972 - DNA, 103 bp, Artificial Sequence
  Synthetic Polynucleotide
taatacgactcactatagggtgctgtaatttctgtggtgtcaaacacaacaacagaggagagttgtgatggacaccacaaacctggcggcagcgcaaaagatg

SEQ ID NO: 224973 - DNA, 103 bp, Artificial Sequence
  Synthetic Polynucleotide
taatacgactcactatagggttgttccaagtgctgtaatttctgtggtgtaacagaggagaacaccaatgaaattacagaacctggcggcagcgcaaaagatg

SEQ ID NO: 224974 - DNA, 103 bp, Artificial Sequence
  Synthetic Polynucleotide
taatacgactcactatagggttgctcgcagttgttccaagtgctgtaattaacagaggagaaattacatgacttggaacaacctggcggcagcgcaaaagatg

SEQ ID NO: 224975 - DNA, 103 bp, Artificial Sequence
  Synthetic Polynucleotide
taatacgactcactatagggttatctctatttgctcgcagttgttccaagaacagaggagacttggaatgactgcgagcaacctggcggcagcgcaaaagatg

SEQ ID NO: 224976 - DNA, 103 bp, Artificial Sequence
  Synthetic Polynucleotide
taatacgactcactataggggtccatgccaccaagcgcctccctttcctcaacagaggagagaggaaatggaggcgcttaacctggcggcagcgcaaaagatg

SEQ ID NO: 224977 - DNA, 103 bp, Artificial Sequence
  Synthetic Polynucleotide
taatacgactcactatagggtggatttaaattatctctatttgctcgcagaacagaggagactgcgaatgaatagagataacctggcggcagcgcaaaagatg

SEQ ID NO: 224978 - DNA, 103 bp, Artificial Sequence
  Synthetic Polynucleotide
taatacgactcactataggggcttctgtgctggatttaaattatctctataacagaggagaatagagatgatttaaatcaacctggcggcagcgcaaaagatg

SEQ ID NO: 224979 - DNA, 103 bp, Artificial Sequence
  Synthetic Polynucleotide
taatacgactcactatagggtccagctgatgcttctgtgctggatttaaaaacagaggagatttaaaatgagcacagaaaacctggcggcagcgcaaaagatg

SEQ ID NO: 224980 - DNA, 103 bp, Artificial Sequence
  Synthetic Polynucleotide
taatacgactcactatagggttctaactgttccagctgatgcttctgtgcaacagaggagagcacagatgcatcagctgaacctggcggcagcgcaaaagatg

SEQ ID NO: 224981 - DNA, 103 bp, Artificial Sequence
  Synthetic Polynucleotide
taatacgactcactatagggcaaactgactttctaactgttccagctgataacagaggagaatcagcatgaacagttagaacctggcggcagcgcaaaagatg

SEQ ID NO: 224982 - DNA, 103 bp, Artificial Sequence
  Synthetic Polynucleotide
taatacgactcactatagggtgcattaagacaaactgactttctaactgtaacagaggagaacagttatgaagtcagttaacctggcggcagcgcaaaagatg

SEQ ID NO: 224983 - DNA, 103 bp, Artificial Sequence
  Synthetic Polynucleotide
taatacgactcactatagggtctcatttgctgcattaagacaaactgactaacagaggagaagtcagatggtcttaatgaacctggcggcagcgcaaaagatg

SEQ ID NO: 224984 - DNA, 103 bp, Artificial Sequence
  Synthetic Polynucleotide
taatacgactcactatagggcttctttgtgtctcatttgctgcattaagaaacagaggagatcttaaatgagcaaatgaaacctggcggcagcgcaaaagatg

SEQ ID NO: 224985 - DNA, 103 bp, Artificial Sequence
  Synthetic Polynucleotide
taatacgactcactatagggacctgagcaacttctttgtgtctcatttgcaacagaggagagcaaatatgacacaaagaaacctggcggcagcgcaaaagatg

SEQ ID NO: 224986 - DNA, 103 bp, Artificial Sequence
  Synthetic Polynucleotide
taatacgactcactatagggagtagttcgtacctgagcaacttctttgtgaacagaggagacacaaaatggttgctcagaacctggcggcagcgcaaaagatg

SEQ ID NO: 224987 - DNA, 103 bp, Artificial Sequence
  Synthetic Polynucleotide
taatacgactcactatagggagagacggctgtccatgccaccaagcgcctaacagaggagaaggcgcatggtggcatggaacctggcggcagcgcaaaagatg

SEQ ID NO: 224988 - DNA, 103 bp, Artificial Sequence
  Synthetic Polynucleotide
taatacgactcactatagggtatgaattccagtagttcgtacctgagcaaaacagaggagattgctcatgtacgaactaaacctggcggcagcgcaaaagatg

SEQ ID NO: 224989 - DNA, 103 bp, Artificial Sequence
  Synthetic Polynucleotide
taatacgactcactatagggatggccccgttatgaattccagtagttcgtaacagaggagaacgaacatgtggaattcaaacctggcggcagcgcaaaagatg

SEQ ID NO: 224990 - DNA, 103 bp, Artificial Sequence
  Synthetic Polynucleotide
taatacgactcactatagggtgaatcagttatggccccgttatgaattccaacagaggagaggaattatgaacggggccaacctggcggcagcgcaaaagatg

SEQ ID NO: 224991 - DNA, 103 bp, Artificial Sequence
  Synthetic Polynucleotide
taatacgactcactatagggtaggcagtgatgaatcagttatggccccgtaacagaggagaacggggatgtaactgattaacctggcggcagcgcaaaagatg

SEQ ID NO: 224992 - DNA, 103 bp, Artificial Sequence
  Synthetic Polynucleotide
taatacgactcactatagggacagagtttgtaggcagtgatgaatcagttaacagaggagaaactgaatgatcactgccaacctggcggcagcgcaaaagatg

SEQ ID NO: 224993 - DNA, 103 bp, Artificial Sequence
  Synthetic Polynucleotide
taatacgactcactatagggtcgattagagacagagtttgtaggcagtgaaacagaggagatcactgatgacaaactctaacctggcggcagcgcaaaagatg

SEQ ID NO: 224994 - DNA, 103 bp, Artificial Sequence
  Synthetic Polynucleotide
taatacgactcactatagggcatgtggttgtcgattagagacagagtttgaacagaggagacaaactatgtctctaatcaacctggcggcagcgcaaaagatg

SEQ ID NO: 224995 - DNA, 103 bp, Artificial Sequence
  Synthetic Polynucleotide
taatacgactcactataggggtcagagcaccatgtggttgtcgattagagaacagaggagactctaaatgacaaccacaaacctggcggcagcgcaaaagatg

SEQ ID NO: 224996 - DNA, 103 bp, Artificial Sequence
  Synthetic Polynucleotide
taatacgactcactatagggagatactctggtcagagcaccatgtggttgaacagaggagacaaccaatgggtgctctgaacctggcggcagcgcaaaagatg

SEQ ID NO: 224997 - DNA, 103 bp, Artificial Sequence
  Synthetic Polynucleotide
taatacgactcactataggggagagacgctagatactctggtcagagcacaacagaggagagtgctcatgccagagtataacctggcggcagcgcaaaagatg

SEQ ID NO: 224998 - DNA, 103 bp, Artificial Sequence
  Synthetic Polynucleotide
taatacgactcactatagggacgaacccgaagagacggctgtccatgccaaacagaggagatggcatatgcagccgtctaacctggcggcagcgcaaaagatg

SEQ ID NO: 224999 - DNA, 103 bp, Artificial Sequence
  Synthetic Polynucleotide
taatacgactcactatagggactccaggctgagagacgctagatactctgaacagaggagacagagtatgtagcgtctcaacctggcggcagcgcaaaagatg

SEQ ID NO: 225000 - DNA, 103 bp, Artificial Sequence
  Synthetic Polynucleotide
taatacgactcactatagggagcagggcgaactccaggctgagagacgctaacagaggagaagcgtcatgcagcctggaaacctggcggcagcgcaaaagatg

SEQ ID NO: 225001 - DNA, 103 bp, Artificial Sequence
  Synthetic Polynucleotide
taatacgactcactatagggtttcaacacaagcagggcgaactccaggctaacagaggagaagcctgatgttcgccctgaacctggcggcagcgcaaaagatg

SEQ ID NO: 225002 - DNA, 103 bp, Artificial Sequence
  Synthetic Polynucleotide
taatacgactcactataggggacaaaagtttttcaacacaagcagggcgaaacagaggagatcgcccatgttgtgttgaaacctggcggcagcgcaaaagatg

SEQ ID NO: 225003 - DNA, 103 bp, Artificial Sequence
  Synthetic Polynucleotide
taatacgactcactatagggagctccactggacaaaagtttttcaacacaaacagaggagatgtgttatgaaacttttgaacctggcggcagcgcaaaagatg

SEQ ID NO: 225004 - DNA, 103 bp, Artificial Sequence
  Synthetic Polynucleotide
taatacgactcactatagggctgcagaaaaagctccactggacaaaagttaacagaggagaaactttatgccagtggagaacctggcggcagcgcaaaagatg

SEQ ID NO: 225005 - DNA, 103 bp, Artificial Sequence
  Synthetic Polynucleotide
taatacgactcactatagggggaatacagcctgcagaaaaagctccactgaacagaggagacagtggatgtttttctgcaacctggcggcagcgcaaaagatg

SEQ ID NO: 225006 - DNA, 103 bp, Artificial Sequence
  Synthetic Polynucleotide
taatacgactcactatagggtgtgccacaaggaatacagcctgcagaaaaaacagaggagattttctatgggctgtattaacctggcggcagcgcaaaagatg

SEQ ID NO: 225007 - DNA, 103 bp, Artificial Sequence
  Synthetic Polynucleotide
taatacgactcactataggggaatttttgatgtgccacaaggaatacagcaacagaggagagctgtaatgcttgtggcaaacctggcggcagcgcaaaagatg

SEQ ID NO: 225008 - DNA, 103 bp, Artificial Sequence
  Synthetic Polynucleotide
taatacgactcactataggggtacttcctagaatttttgatgtgccacaaaacagaggagattgtggatgatcaaaaataacctggcggcagcgcaaaagatg

SEQ ID NO: 225009 - DNA, 103 bp, Artificial Sequence
  Synthetic Polynucleotide
taatacgactcactatagggatgaagcctcacgaacccgaagagacggctaacagaggagaagccgtatgttcgggttcaacctggcggcagcgcaaaagatg

SEQ ID NO: 225010 - DNA, 103 bp, Artificial Sequence
  Synthetic Polynucleotide
taatacgactcactataggggatagtgtctgtacttcctagaatttttgaaacagaggagatcaaaaatgctaggaagtaacctggcggcagcgcaaaagatg

SEQ ID NO: 225011 - DNA, 103 bp, Artificial Sequence
  Synthetic Polynucleotide
taatacgactcactatagggtgcctagcaagatagtgtctgtacttcctaaacagaggagataggaaatgcagacactaaacctggcggcagcgcaaaagatg

SEQ ID NO: 225012 - DNA, 103 bp, Artificial Sequence
  Synthetic Polynucleotide
taatacgactcactatagggatacaattactgcctagcaagatagtgtctaacagaggagaagacacatgcttgctaggaacctggcggcagcgcaaaagatg

SEQ ID NO: 225013 - DNA, 103 bp, Artificial Sequence
  Synthetic Polynucleotide
taatacgactcactatagggacttcctgctatacaattactgcctagcaaaacagaggagattgctaatgagtaattgtaacctggcggcagcgcaaaagatg

SEQ ID NO: 225014 - DNA, 103 bp, Artificial Sequence
  Synthetic Polynucleotide
taatacgactcactatagggcattactttcacttcctgctatacaattacaacagaggagagtaattatgtagcaggaaaacctggcggcagcgcaaaagatg

SEQ ID NO: 225015 - DNA, 103 bp, Artificial Sequence
  Synthetic Polynucleotide
taatacgactcactatagggggcacatttccattactttcacttcctgctaacagaggagaagcaggatgtgaaagtaaaacctggcggcagcgcaaaagatg

SEQ ID NO: 225016 - DNA, 103 bp, Artificial Sequence
  Synthetic Polynucleotide
taatacgactcactatagggctgcaggtaaggcacatttccattactttcaacagaggagagaaagtatgggaaatgtgaacctggcggcagcgcaaaagatg

SEQ ID NO: 225017 - DNA, 103 bp, Artificial Sequence
  Synthetic Polynucleotide
taatacgactcactataggggtgtattttgctgcaggtaaggcacatttcaacagaggagagaaatgatgcttacctgcaacctggcggcagcgcaaaagatg

SEQ ID NO: 225018 - DNA, 103 bp, Artificial Sequence
  Synthetic Polynucleotide
taatacgactcactatagggggtagagtgtgtgtattttgctgcaggtaaaacagaggagattacctatggcaaaatacaacctggcggcagcgcaaaagatg

SEQ ID NO: 225019 - DNA, 103 bp, Artificial Sequence
  Synthetic Polynucleotide
taatacgactcactatagggatgattatgaggtagagtgtgtgtattttgaacagaggagacaaaatatgcacactctaaacctggcggcagcgcaaaagatg

SEQ ID NO: 225020 - DNA, 103 bp, Artificial Sequence
  Synthetic Polynucleotide
taatacgactcactatagggcgccatcttcatgaagcctcacgaacccgaaacagaggagatcgggtatgtgaggcttcaacctggcggcagcgcaaaagatg

SEQ ID NO: 225021 - DNA, 103 bp, Artificial Sequence
  Synthetic Polynucleotide
taatacgactcactatagggtcaggtctgtatgattatgaggtagagtgtaacagaggagaacactcatgctcataatcaacctggcggcagcgcaaaagatg

SEQ ID NO: 225022 - DNA, 103 bp, Artificial Sequence
  Synthetic Polynucleotide
taatacgactcactataggggtgctgctgttcaggtctgtatgattatgaaacagaggagatcataaatgtacagacctaacctggcggcagcgcaaaagatg

SEQ ID NO: 225023 - DNA, 103 bp, Artificial Sequence
  Synthetic Polynucleotide
taatacgactcactatagggtggctcttctgtgctgctgttcaggtctgtaacagaggagaacagacatgaacagcagcaacctggcggcagcgcaaaagatg

SEQ ID NO: 225024 - DNA, 103 bp, Artificial Sequence
  Synthetic Polynucleotide
taatacgactcactataggggttttctccatggctcttctgtgctgctgtaacagaggagaacagcaatgcagaagagcaacctggcggcagcgcaaaagatg

SEQ ID NO: 225025 - DNA, 103 bp, Artificial Sequence
  Synthetic Polynucleotide
taatacgactcactatagggttagatagctgttttctccatggctcttctaacagaggagaagaagaatgatggagaaaaacctggcggcagcgcaaaagatg

SEQ ID NO: 225026 - DNA, 103 bp, Artificial Sequence
  Synthetic Polynucleotide
taatacgactcactatagggctgagcggagttagatagctgttttctccaaacagaggagatggagaatgcagctatctaacctggcggcagcgcaaaagatg

SEQ ID NO: 225027 - DNA, 103 bp, Artificial Sequence
  Synthetic Polynucleotide
taatacgactcactatagggtatgaagcccctgagcggagttagatagctaacagaggagaagctatatgactccgctcaacctggcggcagcgcaaaagatg

SEQ ID NO: 225028 - DNA, 103 bp, Artificial Sequence
  Synthetic Polynucleotide
taatacgactcactatagggctctgacttttatgaagcccctgagcggagaacagaggagactccgcatgggggcttcaaacctggcggcagcgcaaaagatg

SEQ ID NO: 225029 - DNA, 103 bp, Artificial Sequence
  Synthetic Polynucleotide
taatacgactcactatagggcaaacatgaactctgacttttatgaagcccaacagaggagagggcttatgaaaagtcagaacctggcggcagcgcaaaagatg

SEQ ID NO: 225030 - DNA, 103 bp, Artificial Sequence
  Synthetic Polynucleotide
taatacgactcactatagggtaggtcctgacaaacatgaactctgactttaacagaggagaaaagtcatggttcatgttaacctggcggcagcgcaaaagatg

SEQ ID NO: 225031 - DNA, 103 bp, Artificial Sequence
  Synthetic Polynucleotide
taatacgactcactatagggttcgttctggcgccatcttcatgaagcctcaacagaggagagaggctatgtgaagatggaacctggcggcagcgcaaaagatg

SEQ ID NO: 225032 - DNA, 103 bp, Artificial Sequence
  Synthetic Polynucleotide
taatacgactcactatagggtgttcttcattaggtcctgacaaacatgaaaacagaggagattcatgatggtcaggaccaacctggcggcagcgcaaaagatg

SEQ ID NO: 225033 - DNA, 103 bp, Artificial Sequence
  Synthetic Polynucleotide
taatacgactcactatagggaaacagaggttgttcttcattaggtcctgaaacagaggagatcaggaatgaatgaagaaaacctggcggcagcgcaaaagatg

SEQ ID NO: 225034 - DNA, 103 bp, Artificial Sequence
  Synthetic Polynucleotide
taatacgactcactatagggacccagtggaaaacagaggttgttcttcataacagaggagaatgaagatgaacctctgtaacctggcggcagcgcaaaagatg

SEQ ID NO: 225035 - DNA, 103 bp, Artificial Sequence
  Synthetic Polynucleotide
taatacgactcactatagggtactgggctgacccagtggaaaacagaggtaacagaggagaacctctatgttccactggaacctggcggcagcgcaaaagatg

SEQ ID NO: 225036 - DNA, 103 bp, Artificial Sequence
  Synthetic Polynucleotide
taatacgactcactatagggtgcctggtgatactgggctgacccagtggaaacagaggagatccactatgtcagcccagaacctggcggcagcgcaaaagatg

SEQ ID NO: 225037 - DNA, 103 bp, Artificial Sequence
  Synthetic Polynucleotide
taatacgactcactatagggcagtgctagttgcctggtgatactgggctgaacagaggagacagcccatgatcaccaggaacctggcggcagcgcaaaagatg

SEQ ID NO: 225038 - DNA, 103 bp, Artificial Sequence
  Synthetic Polynucleotide
taatacgactcactatagggttcttaataccagtgctagttgcctggtgaaacagaggagatcaccaatgaactagcacaacctggcggcagcgcaaaagatg

SEQ ID NO: 225039 - DNA, 103 bp, Artificial Sequence
  Synthetic Polynucleotide
taatacgactcactatagggttcattcgccttcttaataccagtgctagtaacagaggagaactagcatgggtattaagaacctggcggcagcgcaaaagatg

SEQ ID NO: 225040 - DNA, 103 bp, Artificial Sequence
  Synthetic Polynucleotide
taatacgactcactataggggagtgagatgttcattcgccttcttaatacaacagaggagagtattaatgaggcgaatgaacctggcggcagcgcaaaagatg

SEQ ID NO: 225041 - DNA, 103 bp, Artificial Sequence
  Synthetic Polynucleotide
taatacgactcactatagggttactaggcagagtgagatgttcattcgccaacagaggagaggcgaaatgacatctcacaacctggcggcagcgcaaaagatg

SEQ ID NO: 225042 - DNA, 103 bp, Artificial Sequence
  Synthetic Polynucleotide
taatacgactcactatagggtagtagggtcttcgttctggcgccatcttcaacagaggagagaagatatggccagaacgaacctggcggcagcgcaaaagatg

SEQ ID NO: 225043 - DNA, 103 bp, Artificial Sequence
  Synthetic Polynucleotide
taatacgactcactatagggtggtactgaattactaggcagagtgagatgaacagaggagacatctcatgctgcctagtaacctggcggcagcgcaaaagatg

SEQ ID NO: 225044 - DNA, 103 bp, Artificial Sequence
  Synthetic Polynucleotide
taatacgactcactatagggcatccccctgtggtactgaattactaggcaaacagaggagatgcctaatgattcagtacaacctggcggcagcgcaaaagatg

SEQ ID NO: 225045 - DNA, 103 bp, Artificial Sequence
  Synthetic Polynucleotide
taatacgactcactatagggtgactgtcagcatccccctgtggtactgaaaacagaggagattcagtatgacagggggaaacctggcggcagcgcaaaagatg

SEQ ID NO: 225046 - DNA, 103 bp, Artificial Sequence
  Synthetic Polynucleotide
taatacgactcactatagggacaggagaggtgactgtcagcatccccctgaacagaggagacaggggatggctgacagtaacctggcggcagcgcaaaagatg

SEQ ID NO: 225047 - DNA, 103 bp, Artificial Sequence
  Synthetic Polynucleotide
taatacgactcactatagggtagcagtatgacaggagaggtgactgtcagaacagaggagactgacaatgacctctcctaacctggcggcagcgcaaaagatg

SEQ ID NO: 225048 - DNA, 103 bp, Artificial Sequence
  Synthetic Polynucleotide
taatacgactcactatagggccacctgaggtagcagtatgacaggagaggaacagaggagacctctcatgtcatactgcaacctggcggcagcgcaaaagatg

SEQ ID NO: 225049 - DNA, 103 bp, Artificial Sequence
  Synthetic Polynucleotide
taatacgactcactataggggccttgttgtccacctgaggtagcagtatgaacagaggagacatactatgacctcaggtaacctggcggcagcgcaaaagatg

SEQ ID NO: 225050 - DNA, 103 bp, Artificial Sequence
  Synthetic Polynucleotide
taatacgactcactatagggtaaacataatgccttgttgtccacctgaggaacagaggagacctcagatggacaacaagaacctggcggcagcgcaaaagatg

SEQ ID NO: 225051 - DNA, 103 bp, Artificial Sequence
  Synthetic Polynucleotide
taatacgactcactatagggctctctttggtaaacataatgccttgttgtaacagaggagaacaacaatgcattatgttaacctggcggcagcgcaaaagatg

SEQ ID NO: 225052 - DNA, 103 bp, Artificial Sequence
  Synthetic Polynucleotide
taatacgactcactatagggtgaaggcttgctctctttggtaaacataataacagaggagaattatgatgaccaaagagaacctggcggcagcgcaaaagatg

SEQ ID NO: 225053 - DNA, 103 bp, Artificial Sequence
  Synthetic Polynucleotide
taatacgactcactatagggcaacagcggcggtagtgagcgacactgcgcaacagaggagagcgcagatgcgctcactaaacctggcggcagcgcaaaagatg

SEQ ID NO: 225054 - DNA, 103 bp, Artificial Sequence
  Synthetic Polynucleotide
taatacgactcactatagggcagccttgcctagtagggtcttcgttctggaacagaggagaccagaaatgagaccctacaacctggcggcagcgcaaaagatg

SEQ ID NO: 225055 - DNA, 103 bp, Artificial Sequence
  Synthetic Polynucleotide
taatacgactcactatagggatctattttttgaaggcttgctctctttggaacagaggagaccaaagatggcaagccttaacctggcggcagcgcaaaagatg

SEQ ID NO: 225056 - DNA, 103 bp, Artificial Sequence
  Synthetic Polynucleotide
taatacgactcactatagggggcaccaaggatctattttttgaaggcttgaacagaggagacaagccatgaaaaaatagaacctggcggcagcgcaaaagatg

SEQ ID NO: 225057 - DNA, 103 bp, Artificial Sequence
  Synthetic Polynucleotide
taatacgactcactataggggcttgtttcaggcaccaaggatctatttttaacagaggagaaaaaatatgtccttggtgaacctggcggcagcgcaaaagatg

SEQ ID NO: 225058 - DNA, 103 bp, Artificial Sequence
  Synthetic Polynucleotide
taatacgactcactatagggcagtatgcctgcttgtttcaggcaccaaggaacagaggagaccttggatgctgaaacaaaacctggcggcagcgcaaaagatg

SEQ ID NO: 225059 - DNA, 103 bp, Artificial Sequence
  Synthetic Polynucleotide
taatacgactcactataggggatgtgtctccagtatgcctgcttgtttcaaacagaggagatgaaacatgcaggcatacaacctggcggcagcgcaaaagatg

SEQ ID NO: 225060 - DNA, 103 bp, Artificial Sequence
  Synthetic Polynucleotide
taatacgactcactatagggacagccattagatgtgtctccagtatgcctaacagaggagaaggcatatgggagacacaaacctggcggcagcgcaaaagatg

SEQ ID NO: 225061 - DNA, 103 bp, Artificial Sequence
  Synthetic Polynucleotide
taatacgactcactatagggtgacatcagcacagccattagatgtgtctcaacagaggagagagacaatgctaatggctaacctggcggcagcgcaaaagatg

SEQ ID NO: 225062 - DNA, 103 bp, Artificial Sequence
  Synthetic Polynucleotide
taatacgactcactataggggaaagtcccttgacatcagcacagccattaaacagaggagataatggatgtgctgatgtaacctggcggcagcgcaaaagatg

SEQ ID NO: 225063 - DNA, 103 bp, Artificial Sequence
  Synthetic Polynucleotide
taatacgactcactatagggaacatgattagaaagtcccttgacatcagcaacagaggagagctgatatgaagggacttaacctggcggcagcgcaaaagatg

SEQ ID NO: 225064 - DNA, 103 bp, Artificial Sequence
  Synthetic Polynucleotide
taatacgactcactatagggtcaactgatgaacatgattagaaagtccctaacagaggagaagggacatgctaatcatgaacctggcggcagcgcaaaagatg

SEQ ID NO: 225065 - DNA, 103 bp, Artificial Sequence
  Synthetic Polynucleotide
taatacgactcactatagggtagcagcgaacagccttgcctagtagggtcaacagaggagagaccctatgaggcaaggcaacctggcggcagcgcaaaagatg

SEQ ID NO: 225066 - DNA, 103 bp, Artificial Sequence
  Synthetic Polynucleotide
taatacgactcactataggggcatctgctatcaactgatgaacatgattaaacagaggagataatcaatgtcatcagttaacctggcggcagcgcaaaagatg

SEQ ID NO: 225067 - DNA, 103 bp, Artificial Sequence
  Synthetic Polynucleotide
taatacgactcactatagggactggaaacagcatctgctatcaactgatgaacagaggagacatcagatgatagcagataacctggcggcagcgcaaaagatg

SEQ ID NO: 225068 - DNA, 103 bp, Artificial Sequence
  Synthetic Polynucleotide
taatacgactcactatagggcatggttaggactggaaacagcatctgctaaacagaggagatagcagatgctgtttccaaacctggcggcagcgcaaaagatg

SEQ ID NO: 225069 - DNA, 103 bp, Artificial Sequence
  Synthetic Polynucleotide
taatacgactcactatagggggtgaatctccatggttaggactggaaacaaacagaggagatgtttcatgtcctaaccaaacctggcggcagcgcaaaagatg

SEQ ID NO: 225070 - DNA, 103 bp, Artificial Sequence
  Synthetic Polynucleotide
taatacgactcactatagggtaataaatttggtgaatctccatggttaggaacagaggagacctaacatgggagattcaaacctggcggcagcgcaaaagatg

SEQ ID NO: 225071 - DNA, 103 bp, Artificial Sequence
  Synthetic Polynucleotide
taatacgactcactatagggtgtctgcaattaataaatttggtgaatctcaacagaggagagagattatgcaaatttataacctggcggcagcgcaaaagatg

SEQ ID NO: 225072 - DNA, 103 bp, Artificial Sequence
  Synthetic Polynucleotide
taatacgactcactatagggagctgaggattgtctgcaattaataaatttaacagaggagaaaatttatgaattgcagaaacctggcggcagcgcaaaagatg

SEQ ID NO: 225073 - DNA, 103 bp, Artificial Sequence
  Synthetic Polynucleotide
taatacgactcactatagggcaaagcagagagctgaggattgtctgcaataacagaggagaattgcaatgaatcctcagaacctggcggcagcgcaaaagatg

SEQ ID NO: 225074 - DNA, 103 bp, Artificial Sequence
  Synthetic Polynucleotide
taatacgactcactatagggttccaatcaacaaagcagagagctgaggataacagaggagaatcctcatgtctctgcttaacctggcggcagcgcaaaagatg

SEQ ID NO: 225075 - DNA, 103 bp, Artificial Sequence
  Synthetic Polynucleotide
taatacgactcactatagggccattggcttttccaatcaacaaagcagagaacagaggagactctgcatggttgattggaacctggcggcagcgcaaaagatg

SEQ ID NO: 225076 - DNA, 103 bp, Artificial Sequence
  Synthetic Polynucleotide
taatacgactcactatagggtaaagattcgtagcagcgaacagccttgccaacagaggagaggcaagatggttcgctgcaacctggcggcagcgcaaaagatg

SEQ ID NO: 225077 - DNA, 103 bp, Artificial Sequence
  Synthetic Polynucleotide
taatacgactcactatagggacccacattgccattggcttttccaatcaaaacagaggagattgattatgaaagccaataacctggcggcagcgcaaaagatg

SEQ ID NO: 225078 - DNA, 103 bp, Artificial Sequence
  Synthetic Polynucleotide
taatacgactcactatagggaggttccagtacccacattgccattggcttaacagaggagaaagccaatggcaatgtggaacctggcggcagcgcaaaagatg

SEQ ID NO: 225079 - DNA, 103 bp, Artificial Sequence
  Synthetic Polynucleotide
taatacgactcactatagggactttgtcacaggttccagtacccacattgaacagaggagacaatgtatgtactggaacaacctggcggcagcgcaaaagatg

SEQ ID NO: 225080 - DNA, 103 bp, Artificial Sequence
  Synthetic Polynucleotide
taatacgactcactatagggaatattattcactttgtcacaggttccagtaacagaggagaactggaatgtgtgacaaaaacctggcggcagcgcaaaagatg

SEQ ID NO: 225081 - DNA, 103 bp, Artificial Sequence
  Synthetic Polynucleotide
taatacgactcactatagggcagctgggtgaatattattcactttgtcacaacagaggagagtgacaatgtgaataataaacctggcggcagcgcaaaagatg

SEQ ID NO: 225082 - DNA, 103 bp, Artificial Sequence
  Synthetic Polynucleotide
taatacgactcactatagggtttgtatgaacagctgggtgaatattattcaacagaggagagaataaatgtcacccagcaacctggcggcagcgcaaaagatg

SEQ ID NO: 225083 - DNA, 103 bp, Artificial Sequence
  Synthetic Polynucleotide
taatacgactcactatagggatgatcagtctttgtatgaacagctgggtgaacagaggagacacccaatggttcatacaaacctggcggcagcgcaaaagatg

SEQ ID NO: 225084 - DNA, 103 bp, Artificial Sequence
  Synthetic Polynucleotide
taatacgactcactatagggaggcaacagaatgatcagtctttgtatgaaaacagaggagattcataatgagactgatcaacctggcggcagcgcaaaagatg

SEQ ID NO: 225085 - DNA, 103 bp, Artificial Sequence
  Synthetic Polynucleotide
taatacgactcactataggggagggtgaagaggcaacagaatgatcagtcaacagaggagagactgaatgttctgttgcaacctggcggcagcgcaaaagatg

SEQ ID NO: 225086 - DNA, 103 bp, Artificial Sequence
  Synthetic Polynucleotide
taatacgactcactatagggaatggctgaagagggtgaagaggcaacagaaacagaggagatctgttatgtcttcacccaacctggcggcagcgcaaaagatg

SEQ ID NO: 225087 - DNA, 103 bp, Artificial Sequence
  Synthetic Polynucleotide
taatacgactcactatagggcttttaagattaaagattcgtagcagcgaaaacagaggagattcgctatgacgaatcttaacctggcggcagcgcaaaagatg

SEQ ID NO: 225088 - DNA, 103 bp, Artificial Sequence
  Synthetic Polynucleotide
taatacgactcactatagggttgctgtggaaatggctgaagagggtgaagaacagaggagacttcacatgcttcagccaaacctggcggcagcgcaaaagatg

SEQ ID NO: 225089 - DNA, 103 bp, Artificial Sequence
  Synthetic Polynucleotide
taatacgactcactatagggggagaaggtgttgctgtggaaatggctgaaaacagaggagattcagcatgttccacagcaacctggcggcagcgcaaaagatg

SEQ ID NO: 225090 - DNA, 103 bp, Artificial Sequence
  Synthetic Polynucleotide
taatacgactcactatagggagtggatttaggagaaggtgttgctgtggaaacagaggagatccacaatgacaccttctaacctggcggcagcgcaaaagatg

SEQ ID NO: 225091 - DNA, 103 bp, Artificial Sequence
  Synthetic Polynucleotide
taatacgactcactatagggttctctgctcagtggatttaggagaaggtgaacagaggagacaccttatgctaaatccaaacctggcggcagcgcaaaagatg

SEQ ID NO: 225092 - DNA, 103 bp, Artificial Sequence
  Synthetic Polynucleotide
taatacgactcactatagggctgtttatgcttctctgctcagtggatttaaacagaggagataaatcatgtgagcagagaacctggcggcagcgcaaaagatg

SEQ ID NO: 225093 - DNA, 103 bp, Artificial Sequence
  Synthetic Polynucleotide
taatacgactcactataggggctggtaacactgtttatgcttctctgctcaacagaggagagagcagatgagcataaacaacctggcggcagcgcaaaagatg

SEQ ID NO: 225094 - DNA, 103 bp, Artificial Sequence
  Synthetic Polynucleotide
taatacgactcactataggggactgttaaggctggtaacactgtttatgcaacagaggagagcataaatggtgttaccaaacctggcggcagcgcaaaagatg

SEQ ID NO: 225095 - DNA, 103 bp, Artificial Sequence
  Synthetic Polynucleotide
taatacgactcactatagggccactgtgaggactgttaaggctggtaacaaacagaggagatgttacatgccttaacagaacctggcggcagcgcaaaagatg

SEQ ID NO: 225096 - DNA, 103 bp, Artificial Sequence
  Synthetic Polynucleotide
taatacgactcactatagggtgtgtgtaatccactgtgaggactgttaagaacagaggagacttaacatgcctcacagtaacctggcggcagcgcaaaagatg

SEQ ID NO: 225097 - DNA, 103 bp, Artificial Sequence
  Synthetic Polynucleotide
taatacgactcactatagggctccattgactgtgtgtaatccactgtgagaacagaggagactcacaatggattacacaaacctggcggcagcgcaaaagatg

SEQ ID NO: 225098 - DNA, 103 bp, Artificial Sequence
  Synthetic Polynucleotide
taatacgactcactatagggtttccttcagcttttaagattaaagattcgaacagaggagacgaatcatgaatcttaaaaacctggcggcagcgcaaaagatg

SEQ ID NO: 225099 - DNA, 103 bp, Artificial Sequence
  Synthetic Polynucleotide
taatacgactcactatagggcccagcccctctccattgactgtgtgtaataacagaggagaattacaatgagtcaatggaacctggcggcagcgcaaaagatg

SEQ ID NO: 225100 - DNA, 103 bp, Artificial Sequence
  Synthetic Polynucleotide
taatacgactcactatagggctgtgacttccccagcccctctccattgacaacagaggagagtcaatatggaggggctgaacctggcggcagcgcaaaagatg

SEQ ID NO: 225101 - DNA, 103 bp, Artificial Sequence
  Synthetic Polynucleotide
taatacgactcactatagggttgtagagctctgtgacttccccagcccctaacagaggagaaggggcatgggaagtcacaacctggcggcagcgcaaaagatg

SEQ ID NO: 225102 - DNA, 103 bp, Artificial Sequence
  Synthetic Polynucleotide
taatacgactcactatagggaggtctacttttgtagagctctgtgacttcaacagaggagagaagtcatggagctctacaacctggcggcagcgcaaaagatg

SEQ ID NO: 225103 - DNA, 103 bp, Artificial Sequence
  Synthetic Polynucleotide
taatacgactcactatagggagctaaaggcaggtctacttttgtagagctaacagaggagaagctctatgaaagtagacaacctggcggcagcgcaaaagatg

SEQ ID NO: 225104 - DNA, 103 bp, Artificial Sequence
  Synthetic Polynucleotide
taatacgactcactatagggatctgtggctagctaaaggcaggtctacttaacagaggagaaagtagatgtgcctttagaacctggcggcagcgcaaaagatg

SEQ ID NO: 225105 - DNA, 103 bp, Artificial Sequence
  Synthetic Polynucleotide
taatacgactcactatagggtgagaagtagatctgtggctagctaaaggcaacagaggagagcctttatgtagccacagaacctggcggcagcgcaaaagatg

SEQ ID NO: 225106 - DNA, 103 bp, Artificial Sequence
  Synthetic Polynucleotide
taatacgactcactatagggtggtaagatctgagaagtagatctgtggctaacagaggagaagccacatgtctacttctaacctggcggcagcgcaaaagatg

SEQ ID NO: 225107 - DNA, 103 bp, Artificial Sequence
  Synthetic Polynucleotide
taatacgactcactatagggctgacattgatggtaagatctgagaagtagaacagaggagactacttatgagatcttacaacctggcggcagcgcaaaagatg

SEQ ID NO: 225108 - DNA, 103 bp, Artificial Sequence
  Synthetic Polynucleotide
taatacgactcactatagggcatatagacactgacattgatggtaagatcaacagaggagagatcttatgatcaatgtcaacctggcggcagcgcaaaagatg

SEQ ID NO: 225109 - DNA, 103 bp, Artificial Sequence
  Synthetic Polynucleotide
taatacgactcactatagggagactccacttttccttcagcttttaagataacagaggagaatcttaatggctgaaggaaacctggcggcagcgcaaaagatg

SEQ ID NO: 225110 - DNA, 103 bp, Artificial Sequence
  Synthetic Polynucleotide
taatacgactcactatagggtgaactggggcatatagacactgacattgaaacagaggagatcaatgatggtgtctataaacctggcggcagcgcaaaagatg

SEQ ID NO: 225111 - DNA, 103 bp, Artificial Sequence
  Synthetic Polynucleotide
taatacgactcactataggggaacttctgttgaactggggcatatagacaaacagaggagatgtctaatggccccagttaacctggcggcagcgcaaaagatg

SEQ ID NO: 225112 - DNA, 103 bp, Artificial Sequence
  Synthetic Polynucleotide
taatacgactcactatagggcatgctttcagaacttctgttgaactggggaacagaggagaccccagatgaacagaagtaacctggcggcagcgcaaaagatg

SEQ ID NO: 225113 - DNA, 103 bp, Artificial Sequence
  Synthetic Polynucleotide
taatacgactcactatagggtggattcctgcatgctttcagaacttctgtaacagaggagaacagaaatgctgaaagcaaacctggcggcagcgcaaaagatg

SEQ ID NO: 225114 - DNA, 103 bp, Artificial Sequence
  Synthetic Polynucleotide
taatacgactcactatagggcatttttacctggattcctgcatgctttcaaacagaggagatgaaagatggcaggaatcaacctggcggcagcgcaaaagatg

SEQ ID NO: 225115 - DNA, 103 bp, Artificial Sequence
  Synthetic Polynucleotide
taatacgactcactatagggttagacaagccatttttacctggattcctgaacagaggagacaggaaatgaggtaaaaaaacctggcggcagcgcaaaagatg

SEQ ID NO: 225116 - DNA, 103 bp, Artificial Sequence
  Synthetic Polynucleotide
taatacgactcactatagggaatgcagctattagacaagccatttttaccaacagaggagaggtaaaatgggcttgtctaacctggcggcagcgcaaaagatg

SEQ ID NO: 225117 - DNA, 103 bp, Artificial Sequence
  Synthetic Polynucleotide
taatacgactcactatagggtatctaacaaaatgcagctattagacaagcaacagaggagagcttgtatgatagctgcaaacctggcggcagcgcaaaagatg

SEQ ID NO: 225118 - DNA, 103 bp, Artificial Sequence
  Synthetic Polynucleotide
taatacgactcactatagggggtggacatttatctaacaaaatgcagctaaacagaggagatagctgatgtttgttagaaacctggcggcagcgcaaaagatg

SEQ ID NO: 225119 - DNA, 103 bp, Artificial Sequence
  Synthetic Polynucleotide
taatacgactcactatagggtggtcttggaggtggacatttatctaacaaaacagaggagattgttaatgaaatgtccaaacctggcggcagcgcaaaagatg

SEQ ID NO: 225120 - DNA, 103 bp, Artificial Sequence
  Synthetic Polynucleotide
taatacgactcactatagggaaaagaagtcagactccacttttccttcagaacagaggagactgaagatgaagtggagtaacctggcggcagcgcaaaagatg

SEQ ID NO: 225121 - DNA, 103 bp, Artificial Sequence
  Synthetic Polynucleotide
taatacgactcactataggggtgaagttggtggtcttggaggtggacattaacagaggagaaatgtcatgctccaagacaacctggcggcagcgcaaaagatg

SEQ ID NO: 225122 - DNA, 103 bp, Artificial Sequence
  Synthetic Polynucleotide
taatacgactcactatagggggtgggtatggtgaagttggtggtcttggaaacagaggagatccaagatgaccaacttcaacctggcggcagcgcaaaagatg

SEQ ID NO: 225123 - DNA, 103 bp, Artificial Sequence
  Synthetic Polynucleotide
taatacgactcactatagggctttggcaagggtgggtatggtgaagttggaacagaggagaccaactatgccatacccaaacctggcggcagcgcaaaagatg

SEQ ID NO: 225124 - DNA, 103 bp, Artificial Sequence
  Synthetic Polynucleotide
taatacgactcactatagggtcaacttgtcctttggcaagggtgggtatgaacagaggagacataccatgccttgccaaaacctggcggcagcgcaaaagatg

SEQ ID NO: 225125 - DNA, 103 bp, Artificial Sequence
  Synthetic Polynucleotide
taatacgactcactataggggtgggtggattcaacttgtcctttggcaagaacagaggagacttgccatgggacaagttaacctggcggcagcgcaaaagatg

SEQ ID NO: 225126 - DNA, 103 bp, Artificial Sequence
  Synthetic Polynucleotide
taatacgactcactatagggaatactaggtgtgggtggattcaacttgtcaacagaggagagacaagatgaatccacccaacctggcggcagcgcaaaagatg

SEQ ID NO: 225127 - DNA, 103 bp, Artificial Sequence
  Synthetic Polynucleotide
taatacgactcactatagggtttccaagtaaatactaggtgtgggtggataacagaggagaatccacatgcacctagtaaacctggcggcagcgcaaaagatg

SEQ ID NO: 225128 - DNA, 103 bp, Artificial Sequence
  Synthetic Polynucleotide
taatacgactcactatagggtcacgtttattttccaagtaaatactaggtaacagaggagaacctagatgttacttggaaacctggcggcagcgcaaaagatg

SEQ ID NO: 225129 - DNA, 103 bp, Artificial Sequence
  Synthetic Polynucleotide
taatacgactcactatagggaaagaaagcatcacgtttattttccaagtaaacagaggagatacttgatgaataaacgtaacctggcggcagcgcaaaagatg

SEQ ID NO: 225130 - DNA, 103 bp, Artificial Sequence
  Synthetic Polynucleotide
taatacgactcactataggggtaatggaggaaagaaagcatcacgtttataacagaggagaataaacatgatgctttctaacctggcggcagcgcaaaagatg

SEQ ID NO: 225131 - DNA, 103 bp, Artificial Sequence
  Synthetic Polynucleotide
taatacgactcactatagggcctaattggcaaaagaagtcagactccactaacagaggagaagtggaatgtgacttcttaacctggcggcagcgcaaaagatg

SEQ ID NO: 225132 - DNA, 103 bp, Artificial Sequence
  Synthetic Polynucleotide
taatacgactcactatagggcaaaattgatgtaatggaggaaagaaagcaaacagaggagatgctttatgtcctccattaacctggcggcagcgcaaaagatg

SEQ ID NO: 225133 - DNA, 103 bp, Artificial Sequence
  Synthetic Polynucleotide
taatacgactcactatagggtggatttgtacaaaattgatgtaatggaggaacagaggagacctccaatgcatcaatttaacctggcggcagcgcaaaagatg

SEQ ID NO: 225134 - DNA, 103 bp, Artificial Sequence
  Synthetic Polynucleotide
taatacgactcactatagggcagggttttttggatttgtacaaaattgataacagaggagaatcaatatggtacaaatcaacctggcggcagcgcaaaagatg

SEQ ID NO: 225135 - DNA, 103 bp, Artificial Sequence
  Synthetic Polynucleotide
taatacgactcactatagggattactgtaacagggttttttggatttgtaaacagaggagatacaaaatgaaaaaacccaacctggcggcagcgcaaaagatg

SEQ ID NO: 225136 - DNA, 103 bp, Artificial Sequence
  Synthetic Polynucleotide
taatacgactcactatagggaaggccacgtattactgtaacagggtttttaacagaggagaaaaaacatggttacagtaaacctggcggcagcgcaaaagatg

SEQ ID NO: 225137 - DNA, 103 bp, Artificial Sequence
  Synthetic Polynucleotide
taatacgactcactataggggagctccagcaaggccacgtattactgtaaaacagaggagattacagatgtacgtggccaacctggcggcagcgcaaaagatg

SEQ ID NO: 225138 - DNA, 103 bp, Artificial Sequence
  Synthetic Polynucleotide
taatacgactcactatagggtctaatttaagagctccagcaaggccacgtaacagaggagaacgtggatgtgctggagcaacctggcggcagcgcaaaagatg

SEQ ID NO: 225139 - DNA, 103 bp, Artificial Sequence
  Synthetic Polynucleotide
taatacgactcactatagggaagtccaagatctaatttaagagctccagcaacagaggagagctggaatgcttaaattaaacctggcggcagcgcaaaagatg

SEQ ID NO: 225140 - DNA, 103 bp, Artificial Sequence
  Synthetic Polynucleotide
taatacgactcactatagggtggtagagaaaagtccaagatctaatttaaaacagaggagattaaatatgatcttggacaacctggcggcagcgcaaaagatg

SEQ ID NO: 225141 - DNA, 103 bp, Artificial Sequence
  Synthetic Polynucleotide
taatacgactcactatagggaccaaagttttggtagagaaaagtccaagaaacagaggagatcttggatgtttctctacaacctggcggcagcgcaaaagatg

SEQ ID NO: 225142 - DNA, 103 bp, Artificial Sequence
  Synthetic Polynucleotide
taatacgactcactataggggttgaagtgacctaattggcaaaagaagtcaacagaggagagacttcatgtgccaattaaacctggcggcagcgcaaaagatg

SEQ ID NO: 225143 - DNA, 103 bp, Artificial Sequence
  Synthetic Polynucleotide
taatacgactcactataggggttagcttctaccaaagttttggtagagaaaacagaggagattctctatgaaaactttgaacctggcggcagcgcaaaagatg

SEQ ID NO: 225144 - DNA, 103 bp, Artificial Sequence
  Synthetic Polynucleotide
taatacgactcactatagggtatgttcattgttagcttctaccaaagtttaacagaggagaaaacttatgtagaagctaaacctggcggcagcgcaaaagatg

SEQ ID NO: 225145 - DNA, 103 bp, Artificial Sequence
  Synthetic Polynucleotide
taatacgactcactatagggacttctaccatatgttcattgttagcttctaacagaggagaagaagcatgcaatgaacaaacctggcggcagcgcaaaagatg

SEQ ID NO: 225146 - DNA, 103 bp, Artificial Sequence
  Synthetic Polynucleotide
taatacgactcactatagggctgtgtcctcacttctaccatatgttcattaacagaggagaaatgaaatgatggtagaaaacctggcggcagcgcaaaagatg

SEQ ID NO: 225147 - DNA, 103 bp, Artificial Sequence
  Synthetic Polynucleotide
taatacgactcactataggggttgcagcaactgtgtcctcacttctaccaaacagaggagatggtagatgtgaggacacaacctggcggcagcgcaaaagatg

SEQ ID NO: 225148 - DNA, 103 bp, Artificial Sequence
  Synthetic Polynucleotide
taatacgactcactatagggtcatctgctggttgcagcaactgtgtcctcaacagaggagagaggacatggttgctgcaaacctggcggcagcgcaaaagatg

SEQ ID NO: 225149 - DNA, 103 bp, Artificial Sequence
  Synthetic Polynucleotide
taatacgactcactatagggatcccagttttcatctgctggttgcagcaaaacagaggagattgctgatgccagcagataacctggcggcagcgcaaaagatg

SEQ ID NO: 225150 - DNA, 103 bp, Artificial Sequence
  Synthetic Polynucleotide
taatacgactcactatagggttccagtgggatcccagttttcatctgctgaacagaggagacagcagatgaaaactgggaacctggcggcagcgcaaaagatg

SEQ ID NO: 225151 - DNA, 103 bp, Artificial Sequence
  Synthetic Polynucleotide
taatacgactcactatagggattttctttgttccagtgggatcccagtttaacagaggagaaaactgatgtcccactggaacctggcggcagcgcaaaagatg

SEQ ID NO: 225152 - DNA, 103 bp, Artificial Sequence
  Synthetic Polynucleotide
taatacgactcactatagggacaacgccagattttctttgttccagtgggaacagaggagacccactatgacaaagaaaaacctggcggcagcgcaaaagatg

SEQ ID NO: 225153 - DNA, 103 bp, Artificial Sequence
  Synthetic Polynucleotide
taatacgactcactatagggccaacaagaggttgaagtgacctaattggcaacagaggagagccaatatggtcacttcaaacctggcggcagcgcaaaagatg

SEQ ID NO: 225154 - DNA, 103 bp, Artificial Sequence
  Synthetic Polynucleotide
taatacgactcactatagggtattgctttcacaacgccagattttctttgaacagaggagacaaagaatgtctggcgttaacctggcggcagcgcaaaagatg

SEQ ID NO: 225155 - DNA, 103 bp, Artificial Sequence
  Synthetic Polynucleotide
taatacgactcactataggggtatgagatctattgctttcacaacgccagaacagaggagactggcgatgtgaaagcaaaacctggcggcagcgcaaaagatg

SEQ ID NO: 225156 - DNA, 103 bp, Artificial Sequence
  Synthetic Polynucleotide
taatacgactcactatagggggcaattgtagtatgagatctattgctttcaacagaggagagaaagcatgagatctcataacctggcggcagcgcaaaagatg

SEQ ID NO: 225157 - DNA, 103 bp, Artificial Sequence
  Synthetic Polynucleotide
taatacgactcactataggggtgcgtatttggcaattgtagtatgagatcaacagaggagagatctcatgctacaattgaacctggcggcagcgcaaaagatg

SEQ ID NO: 225158 - DNA, 103 bp, Artificial Sequence
  Synthetic Polynucleotide
taatacgactcactataggggcctggtattgtgcgtatttggcaattgtaaacagaggagatacaatatgcaaatacgcaacctggcggcagcgcaaaagatg

SEQ ID NO: 225159 - DNA, 103 bp, Artificial Sequence
  Synthetic Polynucleotide
taatacgactcactataggggaaggaggaagcctggtattgtgcgtatttaacagaggagaaaatacatgcaataccagaacctggcggcagcgcaaaagatg

SEQ ID NO: 225160 - DNA, 103 bp, Artificial Sequence
  Synthetic Polynucleotide
taatacgactcactatagggatgattcctggaaggaggaagcctggtattaacagaggagaaataccatgcttcctcctaacctggcggcagcgcaaaagatg

SEQ ID NO: 225161 - DNA, 103 bp, Artificial Sequence
  Synthetic Polynucleotide
taatacgactcactatagggccagctctcaatgattcctggaaggaggaaaacagaggagattcctcatgccaggaatcaacctggcggcagcgcaaaagatg

SEQ ID NO: 225162 - DNA, 103 bp, Artificial Sequence
  Synthetic Polynucleotide
taatacgactcactatagggccattgcattccagctctcaatgattcctgaacagaggagacaggaaatgttgagagctaacctggcggcagcgcaaaagatg

SEQ ID NO: 225163 - DNA, 103 bp, Artificial Sequence
  Synthetic Polynucleotide
taatacgactcactatagggtgagatcacaccattgcattccagctctcaaacagaggagatgagagatggaatgcaataacctggcggcagcgcaaaagatg

SEQ ID NO: 225164 - DNA, 103 bp, Artificial Sequence
  Synthetic Polynucleotide
taatacgactcactatagggtcaccgaaggcaacagcggcggtagtgagcaacagaggagagctcacatgcgccgctgtaacctggcggcagcgcaaaagatg

SEQ ID NO: 225165 - DNA, 103 bp, Artificial Sequence
  Synthetic Polynucleotide
taatacgactcactataggggaataatcttccaacaagaggttgaagtgaaacagaggagatcacttatgcctcttgttaacctggcggcagcgcaaaagatg

SEQ ID NO: 225166 - DNA, 103 bp, Artificial Sequence
  Synthetic Polynucleotide
taatacgactcactatagggtgcagtgagctgagatcacaccattgcattaacagaggagaaatgcaatggtgtgatctaacctggcggcagcgcaaaagatg

SEQ ID NO: 225167 - DNA, 103 bp, Artificial Sequence
  Synthetic Polynucleotide
taatacgactcactatagggaggcggaggctgcagtgagctgagatcacaaacagaggagatgtgatatgagctcactgaacctggcggcagcgcaaaagatg

SEQ ID NO: 225168 - DNA, 103 bp, Artificial Sequence
  Synthetic Polynucleotide
taatacgactcactatagggtgaacccaggaggcggaggctgcagtgagcaacagaggagagctcacatgagcctccgcaacctggcggcagcgcaaaagatg

SEQ ID NO: 225169 - DNA, 103 bp, Artificial Sequence
  Synthetic Polynucleotide
taatacgactcactataggggagaatcgcttgaacccaggaggcggaggcaacagaggagagcctccatgtcctgggttaacctggcggcagcgcaaaagatg

SEQ ID NO: 225170 - DNA, 103 bp, Artificial Sequence
  Synthetic Polynucleotide
taatacgactcactataggggctgaggtgggagaatcgcttgaacccaggaacagaggagacctgggatgaagcgattcaacctggcggcagcgcaaaagatg

SEQ ID NO: 225171 - DNA, 103 bp, Artificial Sequence
  Synthetic Polynucleotide
taatacgactcactatagggtattcgggaggctgaggtgggagaatcgctaacagaggagaagcgatatgcccacctcaaacctggcggcagcgcaaaagatg

SEQ ID NO: 225172 - DNA, 103 bp, Artificial Sequence
  Synthetic Polynucleotide
taatacgactcactatagggtaattccagctattcgggaggctgaggtggaacagaggagaccacctatgcctcccgaaaacctggcggcagcgcaaaagatg

SEQ ID NO: 225173 - DNA, 103 bp, Artificial Sequence
  Synthetic Polynucleotide
taatacgactcactatagggcaggtgcctgtaattccagctattcgggagaacagaggagactcccgatgagctggaataacctggcggcagcgcaaaagatg

SEQ ID NO: 225174 - DNA, 103 bp, Artificial Sequence
  Synthetic Polynucleotide
taatacgactcactatagggggcatgatggcaggtgcctgtaattccagcaacagaggagagctggaatgacaggcaccaacctggcggcagcgcaaaagatg

SEQ ID NO: 225175 - DNA, 103 bp, Artificial Sequence
  Synthetic Polynucleotide
taatacgactcactatagggaaattagttgggcatgatggcaggtgcctgaacagaggagacaggcaatggccatcatgaacctggcggcagcgcaaaagatg

SEQ ID NO: 225176 - DNA, 103 bp, Artificial Sequence
  Synthetic Polynucleotide
taatacgactcactatagggtaatgcttttgaataatcttccaacaagagaacagaggagactcttgatggaagattataacctggcggcagcgcaaaagatg

SEQ ID NO: 225177 - DNA, 103 bp, Artificial Sequence
  Synthetic Polynucleotide
taatacgactcactatagggaaaaatacaaaaattagttgggcatgatggaacagaggagaccatcaatgccaactaataacctggcggcagcgcaaaagatg

SEQ ID NO: 225178 - DNA, 103 bp, Artificial Sequence
  Synthetic Polynucleotide
taatacgactcactatagggctgtctctacaaaaatacaaaaattagttgaacagaggagacaactaatgtttgtatttaacctggcggcagcgcaaaagatg

SEQ ID NO: 225179 - DNA, 103 bp, Artificial Sequence
  Synthetic Polynucleotide
taatacgactcactatagggtggtgaaaccctgtctctacaaaaatacaaaacagaggagattgtatatgtgtagagacaacctggcggcagcgcaaaagatg

SEQ ID NO: 225180 - DNA, 103 bp, Artificial Sequence
  Synthetic Polynucleotide
taatacgactcactatagggctggccaacatggtgaaaccctgtctctacaacagaggagagtagagatggggtttcacaacctggcggcagcgcaaaagatg

SEQ ID NO: 225181 - DNA, 103 bp, Artificial Sequence
  Synthetic Polynucleotide
taatacgactcactatagggcaagacaagcctggccaacatggtgaaaccaacagaggagaggtttcatgatgttggccaacctggcggcagcgcaaaagatg

SEQ ID NO: 225182 - DNA, 103 bp, Artificial Sequence
  Synthetic Polynucleotide
taatacgactcactataggggtcaggagttcaagacaagcctggccaacaaacagaggagatgttggatgggcttgtctaacctggcggcagcgcaaaagatg

SEQ ID NO: 225183 - DNA, 103 bp, Artificial Sequence
  Synthetic Polynucleotide
taatacgactcactatagggaccacctgaggtcaggagttcaagacaagcaacagaggagagcttgtatggaactcctgaacctggcggcagcgcaaaagatg

SEQ ID NO: 225184 - DNA, 103 bp, Artificial Sequence
  Synthetic Polynucleotide
taatacgactcactatagggaggcaagcagaccacctgaggtcaggagttaacagaggagaaactccatgcctcaggtgaacctggcggcagcgcaaaagatg

SEQ ID NO: 225185 - DNA, 103 bp, Artificial Sequence
  Synthetic Polynucleotide
taatacgactcactatagggtgggatgctgaggcaagcagaccacctgagaacagaggagactcaggatgtctgcttgcaacctggcggcagcgcaaaagatg

SEQ ID NO: 225186 - DNA, 103 bp, Artificial Sequence
  Synthetic Polynucleotide
taatacgactcactatagggcccagcactttgggatgctgaggcaagcagaacagaggagactgcttatgtcagcatccaacctggcggcagcgcaaaagatg

SEQ ID NO: 225187 - DNA, 103 bp, Artificial Sequence
  Synthetic Polynucleotide
taatacgactcactataggggatatgcagataatgcttttgaataatcttaacagaggagaaagattatgcaaaagcataacctggcggcagcgcaaaagatg

SEQ ID NO: 225188 - DNA, 103 bp, Artificial Sequence
  Synthetic Polynucleotide
taatacgactcactatagggcacctgtaatcccagcactttgggatgctgaacagaggagacagcatatgaaagtgctgaacctggcggcagcgcaaaagatg

SEQ ID NO: 225189 - DNA, 103 bp, Artificial Sequence
  Synthetic Polynucleotide
taatacgactcactatagggtggtggctcacacctgtaatcccagcacttaacagaggagaaagtgcatggattacaggaacctggcggcagcgcaaaagatg

SEQ ID NO: 225190 - DNA, 103 bp, Artificial Sequence
  Synthetic Polynucleotide
taatacgactcactatagggttaccgggcatggtggctcacacctgtaataacagaggagaattacaatggtgagccacaacctggcggcagcgcaaaagatg

SEQ ID NO: 225191 - DNA, 103 bp, Artificial Sequence
  Synthetic Polynucleotide
taatacgactcactatagggtaatatctctgatatgcagataatgcttttaacagaggagaaaaagcatgatctgcataaacctggcggcagcgcaaaagatg

SEQ ID NO: 225192 - DNA, 103 bp, Artificial Sequence
  Synthetic Polynucleotide
taatacgactcactatagggctgtaaactgtaatatctctgatatgcagaaacagaggagatctgcaatgcagagatataacctggcggcagcgcaaaagatg

SEQ ID NO: 225193 - DNA, 103 bp, Artificial Sequence
  Synthetic Polynucleotide
taatacgactcactatagggagtagtcagcctgtaaactgtaatatctctaacagaggagaagagatatgacagtttacaacctggcggcagcgcaaaagatg

SEQ ID NO: 225194 - DNA, 103 bp, Artificial Sequence
  Synthetic Polynucleotide
taatacgactcactataggggcattcttccagtagtcagcctgtaaactgaacagaggagacagtttatgggctgactaaacctggcggcagcgcaaaagatg

SEQ ID NO: 225195 - DNA, 103 bp, Artificial Sequence
  Synthetic Polynucleotide
taatacgactcactatagggtaaaaacgcagcattcttccagtagtcagcaacagaggagagctgacatgtggaagaataacctggcggcagcgcaaaagatg

SEQ ID NO: 225196 - DNA, 103 bp, Artificial Sequence
  Synthetic Polynucleotide
taatacgactcactatagggcaaggccatataaaaacgcagcattcttccaacagaggagaggaagaatgctgcgttttaacctggcggcagcgcaaaagatg

SEQ ID NO: 225197 - DNA, 103 bp, Artificial Sequence
  Synthetic Polynucleotide
taatacgactcactatagggtagaccaaaccaaggccatataaaaacgcaaacagaggagatgcgttatgatatggcctaacctggcggcagcgcaaaagatg

SEQ ID NO: 225198 - DNA, 103 bp, Artificial Sequence
  Synthetic Polynucleotide
taatacgactcactatagggctttgcctcatcaccgaaggcaacagcggcaacagaggagagccgctatggccttcggtaacctggcggcagcgcaaaagatg

SEQ ID NO: 225199 - DNA, 103 bp, Artificial Sequence
  Synthetic Polynucleotide
taatacgactcactataggggtagtagaagtagaccaaaccaaggccataaacagaggagatatggcatgggtttggtcaacctggcggcagcgcaaaagatg

SEQ ID NO: 225200 - DNA, 103 bp, Artificial Sequence
  Synthetic Polynucleotide
taatacgactcactataggggaaatgcattgtagtagaagtagaccaaacaacagaggagagtttggatgacttctactaacctggcggcagcgcaaaagatg

SEQ ID NO: 225201 - DNA, 103 bp, Artificial Sequence
  Synthetic Polynucleotide
taatacgactcactatagggattgcccaatgaaatgcattgtagtagaagaacagaggagacttctaatgcaatgcattaacctggcggcagcgcaaaagatg

SEQ ID NO: 225202 - DNA, 103 bp, Artificial Sequence
  Synthetic Polynucleotide
taatacgactcactatagggaaatgctttaattgcccaatgaaatgcattaacagaggagaaatgcaatgcattgggcaaacctggcggcagcgcaaaagatg

SEQ ID NO: 225203 - DNA, 103 bp, Artificial Sequence
  Synthetic Polynucleotide
taatacgactcactatagggggacatcttgaaatgctttaattgcccaataacagaggagaattgggatgttaaagcataacctggcggcagcgcaaaagatg

SEQ ID NO: 225204 - DNA, 103 bp, Artificial Sequence
  Synthetic Polynucleotide
taatacgactcactatagggtcaacataaaggacatcttgaaatgctttaaacagaggagataaagcatgtcaagatgtaacctggcggcagcgcaaaagatg

SEQ ID NO: 225205 - DNA, 103 bp, Artificial Sequence
  Synthetic Polynucleotide
taatacgactcactatagggaaagctggggtcaacataaaggacatcttgaacagaggagacaagatatgctttatgttaacctggcggcagcgcaaaagatg

SEQ ID NO: 225206 - DNA, 103 bp, Artificial Sequence
  Synthetic Polynucleotide
taatacgactcactatagggtggctcgacaaaagctggggtcaacataaaaacagaggagatttatgatgaccccagctaacctggcggcagcgcaaaagatg

SEQ ID NO: 225207 - DNA, 103 bp, Artificial Sequence
  Synthetic Polynucleotide
taatacgactcactatagggtgaatttccttggctcgacaaaagctggggaacagaggagaccccagatgttgtcgagcaacctggcggcagcgcaaaagatg

SEQ ID NO: 225208 - DNA, 103 bp, Artificial Sequence
  Synthetic Polynucleotide
taatacgactcactatagggaagtcgtaaatgaatttccttggctcgacaaacagaggagatgtcgaatgaaggaaattaacctggcggcagcgcaaaagatg

SEQ ID NO: 225209 - DNA, 103 bp, Artificial Sequence
  Synthetic Polynucleotide
taatacgactcactatagggccgccattttctttgcctcatcaccgaaggaacagaggagaccttcgatgatgaggcaaaacctggcggcagcgcaaaagatg

SEQ ID NO: 225210 - DNA, 103 bp, Artificial Sequence
  Synthetic Polynucleotide
taatacgactcactatagggacatgagcccaagtcgtaaatgaatttcctaacagaggagaaggaaaatgatttacgacaacctggcggcagcgcaaaagatg

SEQ ID NO: 225211 - DNA, 103 bp, Artificial Sequence
  Synthetic Polynucleotide
taatacgactcactatagggttcactttgaacatgagcccaagtcgtaaaaacagaggagatttacgatgtgggctcataacctggcggcagcgcaaaagatg

SEQ ID NO: 225212 - DNA, 103 bp, Artificial Sequence
  Synthetic Polynucleotide
taatacgactcactataggggtagtctgtgttcactttgaacatgagcccaacagaggagagggctcatgttcaaagtgaacctggcggcagcgcaaaagatg

SEQ ID NO: 225213 - DNA, 103 bp, Artificial Sequence
  Synthetic Polynucleotide
taatacgactcactatagggaactagacttgtagtctgtgttcactttgaaacagaggagatcaaagatgacacagactaacctggcggcagcgcaaaagatg

SEQ ID NO: 225214 - DNA, 103 bp, Artificial Sequence
  Synthetic Polynucleotide
taatacgactcactatagggaaatgctttaaactagacttgtagtctgtgaacagaggagacacagaatgcaagtctagaacctggcggcagcgcaaaagatg

SEQ ID NO: 225215 - DNA, 103 bp, Artificial Sequence
  Synthetic Polynucleotide
taatacgactcactatagggggctaactgaaaatgctttaaactagacttaacagaggagaaagtctatgttaaagcataacctggcggcagcgcaaaagatg

SEQ ID NO: 225216 - DNA, 103 bp, Artificial Sequence
  Synthetic Polynucleotide
taatacgactcactatagggagtcaatcaaggctaactgaaaatgctttaaacagaggagataaagcatgttcagttagaacctggcggcagcgcaaaagatg

SEQ ID NO: 225217 - DNA, 103 bp, Artificial Sequence
  Synthetic Polynucleotide
taatacgactcactatagggcatggattacagtcaatcaaggctaactgaaacagaggagatcagttatgcttgattgaaacctggcggcagcgcaaaagatg

SEQ ID NO: 225218 - DNA, 103 bp, Artificial Sequence
  Synthetic Polynucleotide
taatacgactcactatagggggacaaagtacatggattacagtcaatcaaaacagaggagattgattatgtgtaatccaaacctggcggcagcgcaaaagatg

SEQ ID NO: 225219 - DNA, 103 bp, Artificial Sequence
  Synthetic Polynucleotide
taatacgactcactatagggtttcagcattggacaaagtacatggattacaacagaggagagtaatcatggtactttgtaacctggcggcagcgcaaaagatg

SEQ ID NO: 225220 - DNA, 103 bp, Artificial Sequence
  Synthetic Polynucleotide
taatacgactcactataggggcttttccttccgccattttctttgcctcaaacagaggagatgaggcatggaaaatggcaacctggcggcagcgcaaaagatg

SEQ ID NO: 225221 - DNA, 103 bp, Artificial Sequence
  Synthetic Polynucleotide
taatacgactcactatagggtgaaattgaatttcagcattggacaaagtaaacagaggagatactttatgcaatgctgaaacctggcggcagcgcaaaagatg

SEQ ID NO: 225222 - DNA, 103 bp, Artificial Sequence
  Synthetic Polynucleotide
taatacgactcactatagggatgggcaatatgaaattgaatttcagcattaacagaggagaaatgctatgattcaatttaacctggcggcagcgcaaaagatg

SEQ ID NO: 225223 - DNA, 103 bp, Artificial Sequence
  Synthetic Polynucleotide
taatacgactcactatagggtttcatacaaatgggcaatatgaaattgaaaacagaggagattcaatatgatattgcccaacctggcggcagcgcaaaagatg

SEQ ID NO: 225224 - DNA, 103 bp, Artificial Sequence
  Synthetic Polynucleotide
taatacgactcactatagggttcctctgggtttcatacaaatgggcaataaacagaggagatattgcatgtttgtatgaaacctggcggcagcgcaaaagatg

SEQ ID NO: 225225 - DNA, 103 bp, Artificial Sequence
  Synthetic Polynucleotide
taatacgactcactatagggagaatgatacttcctctgggtttcatacaaaacagaggagattgtatatgacccagaggaacctggcggcagcgcaaaagatg

SEQ ID NO: 225226 - DNA, 103 bp, Artificial Sequence
  Synthetic Polynucleotide
taatacgactcactatagggcctcctttgcagaatgatacttcctctgggaacagaggagacccagaatgagtatcattaacctggcggcagcgcaaaagatg

SEQ ID NO: 225227 - DNA, 103 bp, Artificial Sequence
  Synthetic Polynucleotide
taatacgactcactatagggtgttcatatgcctcctttgcagaatgatacaacagaggagagtatcaatgtgcaaaggaaacctggcggcagcgcaaaagatg

SEQ ID NO: 225228 - DNA, 103 bp, Artificial Sequence
  Synthetic Polynucleotide
taatacgactcactatagggctgcaaaagttgttcatatgcctcctttgcaacagaggagagcaaagatggcatatgaaaacctggcggcagcgcaaaagatg

SEQ ID NO: 225229 - DNA, 103 bp, Artificial Sequence
  Synthetic Polynucleotide
taatacgactcactatagggggttttctgtctgcaaaagttgttcatatgaacagaggagacatatgatgaacttttgcaacctggcggcagcgcaaaagatg

SEQ ID NO: 225230 - DNA, 103 bp, Artificial Sequence
  Synthetic Polynucleotide
taatacgactcactatagggtgtgcaggaaggttttctgtctgcaaaagtaacagaggagaacttttatggacagaaaaaacctggcggcagcgcaaaagatg

SEQ ID NO: 225231 - DNA, 103 bp, Artificial Sequence
  Synthetic Polynucleotide
taatacgactcactatagggctcgcggctcgcttttccttccgccattttaacagaggagaaaaatgatggaaggaaaaaacctggcggcagcgcaaaagatg

SEQ ID NO: 225232 - DNA, 103 bp, Artificial Sequence
  Synthetic Polynucleotide
taatacgactcactatagggtgcttttacttgtgcaggaaggttttctgtaacagaggagaacagaaatgcttcctgcaaacctggcggcagcgcaaaagatg

SEQ ID NO: 225233 - DNA, 103 bp, Artificial Sequence
  Synthetic Polynucleotide
taatacgactcactataggggcaatacagttgcttttacttgtgcaggaaaacagaggagattcctgatgaagtaaaagaacctggcggcagcgcaaaagatg

SEQ ID NO: 225234 - DNA, 103 bp, Artificial Sequence
  Synthetic Polynucleotide
taatacgactcactatagggcctaactgttgcaatacagttgcttttactaacagaggagaagtaaaatgaactgtattaacctggcggcagcgcaaaagatg

SEQ ID NO: 225235 - DNA, 103 bp, Artificial Sequence
  Synthetic Polynucleotide
taatacgactcactatagggatgcatccaacctaactgttgcaatacagtaacagaggagaactgtaatgcaacagttaaacctggcggcagcgcaaaagatg

SEQ ID NO: 225236 - DNA, 103 bp, Artificial Sequence
  Synthetic Polynucleotide
taatacgactcactatagggccatattatgatgcatccaacctaactgttaacagaggagaaacagtatggttggatgcaacctggcggcagcgcaaaagatg

SEQ ID NO: 225237 - DNA, 103 bp, Artificial Sequence
  Synthetic Polynucleotide
taatacgactcactatagggcctactagatccatattatgatgcatccaaaacagaggagattggatatgtcataatataacctggcggcagcgcaaaagatg

SEQ ID NO: 225238 - DNA, 103 bp, Artificial Sequence
  Synthetic Polynucleotide
taatacgactcactatagggggctttgtctcctactagatccatattatgaacagaggagacataatatggatctagtaaacctggcggcagcgcaaaagatg

SEQ ID NO: 225239 - DNA, 103 bp, Artificial Sequence
  Synthetic Polynucleotide
taatacgactcactatagggtttcctttgtggctttgtctcctactagataacagaggagaatctagatggagacaaagaacctggcggcagcgcaaaagatg

SEQ ID NO: 225240 - DNA, 103 bp, Artificial Sequence
  Synthetic Polynucleotide
taatacgactcactatagggatagcatagctttcctttgtggctttgtctaacagaggagaagacaaatgcacaaaggaaacctggcggcagcgcaaaagatg

SEQ ID NO: 225241 - DNA, 103 bp, Artificial Sequence
  Synthetic Polynucleotide
taatacgactcactataggggagatactgaatagcatagctttcctttgtaacagaggagaacaaagatgagctatgctaacctggcggcagcgcaaaagatg

SEQ ID NO: 225242 - DNA, 103 bp, Artificial Sequence
  Synthetic Polynucleotide
taatacgactcactatagggcctcttcactctcgcggctcgcttttccttaacagaggagaaaggaaatgcgagccgcgaacctggcggcagcgcaaaagatg

SEQ ID NO: 225243 - DNA, 103 bp, Artificial Sequence
  Synthetic Polynucleotide
taatacgactcactatagggaagacttttggagatactgaatagcatagcaacagaggagagctatgatgttcagtatcaacctggcggcagcgcaaaagatg

SEQ ID NO: 225244 - DNA, 103 bp, Artificial Sequence
  Synthetic Polynucleotide
taatacgactcactatagggtctgcctccaaagacttttggagatactgaaacagaggagatcagtaatgccaaaagtcaacctggcggcagcgcaaaagatg

SEQ ID NO: 225245 - DNA, 103 bp, Artificial Sequence
  Synthetic Polynucleotide
taatacgactcactatagggagaattaggatctgcctccaaagacttttgaacagaggagacaaaagatgttggaggcaaacctggcggcagcgcaaaagatg

SEQ ID NO: 225246 - DNA, 103 bp, Artificial Sequence
  Synthetic Polynucleotide
taatacgactcactatagggacgattggccagaattaggatctgcctccaaacagaggagatggaggatgatcctaattaacctggcggcagcgcaaaagatg

SEQ ID NO: 225247 - DNA, 103 bp, Artificial Sequence
  Synthetic Polynucleotide
taatacgactcactatagggagaaaataccacgattggccagaattaggaaacagaggagatcctaaatgtggccaatcaacctggcggcagcgcaaaagatg

SEQ ID NO: 225248 - DNA, 103 bp, Artificial Sequence
  Synthetic Polynucleotide
taatacgactcactatagggacaccttccaagaaaataccacgattggccaacagaggagaggccaaatgtggtattttaacctggcggcagcgcaaaagatg

SEQ ID NO: 225249 - DNA, 103 bp, Artificial Sequence
  Synthetic Polynucleotide
taatacgactcactatagggtacttgaataacaccttccaagaaaataccaacagaggagaggtattatgttggaaggtaacctggcggcagcgcaaaagatg

SEQ ID NO: 225250 - DNA, 103 bp, Artificial Sequence
  Synthetic Polynucleotide
taatacgactcactatagggactttcccaatacttgaataacaccttccaaacagaggagatggaagatgttattcaagaacctggcggcagcgcaaaagatg

SEQ ID NO: 225251 - DNA, 103 bp, Artificial Sequence
  Synthetic Polynucleotide
taatacgactcactatagggggcatcctgaactttcccaatacttgaataaacagaggagatattcaatgattgggaaaaacctggcggcagcgcaaaagatg

SEQ ID NO: 225252 - DNA, 103 bp, Artificial Sequence
  Synthetic Polynucleotide
taatacgactcactatagggaagatataaaggcatcctgaactttcccaaaacagaggagattgggaatgttcaggatgaacctggcggcagcgcaaaagatg

SEQ ID NO: 225253 - DNA, 103 bp, Artificial Sequence
  Synthetic Polynucleotide
taatacgactcactatagggctaacagactcctcttcactctcgcggctcaacagaggagagagccgatggagtgaagaaacctggcggcagcgcaaaagatg

SEQ ID NO: 225254 - DNA, 103 bp, Artificial Sequence
  Synthetic Polynucleotide
taatacgactcactataggggattgcctgtaagatataaaggcatcctgaaacagaggagatcaggaatgctttatatcaacctggcggcagcgcaaaagatg

SEQ ID NO: 225255 - DNA, 103 bp, Artificial Sequence
  Synthetic Polynucleotide
taatacgactcactatagggtttatcaatagattgcctgtaagatataaaaacagaggagatttataatgtacaggcaaaacctggcggcagcgcaaaagatg

SEQ ID NO: 225256 - DNA, 103 bp, Artificial Sequence
  Synthetic Polynucleotide
taatacgactcactatagggttgcttctgatttatcaatagattgcctgtaacagaggagaacaggcatgctattgataaacctggcggcagcgcaaaagatg

SEQ ID NO: 225257 - DNA, 103 bp, Artificial Sequence
  Synthetic Polynucleotide
taatacgactcactataggggtatctgcacttgcttctgatttatcaataaacagaggagatattgaatgatcagaagcaacctggcggcagcgcaaaagatg

SEQ ID NO: 225258 - DNA, 103 bp, Artificial Sequence
  Synthetic Polynucleotide
taatacgactcactatagggtgaacaccatgtatctgcacttgcttctgaaacagaggagatcagaaatgagtgcagataacctggcggcagcgcaaaagatg

SEQ ID NO: 225259 - DNA, 103 bp, Artificial Sequence
  Synthetic Polynucleotide
taatacgactcactatagggacacacctattgaacaccatgtatctgcacaacagaggagagtgcagatgcatggtgttaacctggcggcagcgcaaaagatg

SEQ ID NO: 225260 - DNA, 103 bp, Artificial Sequence
  Synthetic Polynucleotide
taatacgactcactatagggtgctgatacaacacacctattgaacaccataacagaggagaatggtgatgaataggtgtaacctggcggcagcgcaaaagatg

SEQ ID NO: 225261 - DNA, 103 bp, Artificial Sequence
  Synthetic Polynucleotide
taatacgactcactatagggctgattttgctgctgatacaacacacctataacagaggagaataggtatgttgtatcagaacctggcggcagcgcaaaagatg

SEQ ID NO: 225262 - DNA, 103 bp, Artificial Sequence
  Synthetic Polynucleotide
taatacgactcactatagggcatccataggctgattttgctgctgatacaaacagaggagatgtatcatgagcaaaatcaacctggcggcagcgcaaaagatg

SEQ ID NO: 225263 - DNA, 103 bp, Artificial Sequence
  Synthetic Polynucleotide
taatacgactcactataggggcctgtaaagcatccataggctgattttgcaacagaggagagcaaaaatggcctatggaaacctggcggcagcgcaaaagatg

SEQ ID NO: 225264 - DNA, 103 bp, Artificial Sequence
  Synthetic Polynucleotide
taatacgactcactatagggaacgtccattttgtctggtttcccgaacataacagaggagaatgttcatgaaaccagacaacctggcggcagcgcaaaagatg

SEQ ID NO: 225265 - DNA, 103 bp, Artificial Sequence
  Synthetic Polynucleotide
taatacgactcactatagggtgggaggttcccctccgcgcccttgctctcaacagaggagagagagcatgggcgcggagaacctggcggcagcgcaaaagatg

SEQ ID NO: 225266 - DNA, 103 bp, Artificial Sequence
  Synthetic Polynucleotide
taatacgactcactatagggggaaggcggctgggaggttcccctccgcgcaacagaggagagcgcggatgggaacctccaacctggcggcagcgcaaaagatg

SEQ ID NO: 225267 - DNA, 103 bp, Artificial Sequence
  Synthetic Polynucleotide
taatacgactcactatagggggctccttgaggaaggcggctgggaggttcaacagaggagagaacctatgagccgccttaacctggcggcagcgcaaaagatg

SEQ ID NO: 225268 - DNA, 103 bp, Artificial Sequence
  Synthetic Polynucleotide
taatacgactcactatagggggcgccctgcggctccttgaggaaggcggcaacagaggagagccgccatgctcaaggagaacctggcggcagcgcaaaagatg

SEQ ID NO: 225269 - DNA, 103 bp, Artificial Sequence
  Synthetic Polynucleotide
taatacgactcactatagggacgctgagaaggcgccctgcggctccttgaaacagaggagatcaaggatgcgcagggcgaacctggcggcagcgcaaaagatg

SEQ ID NO: 225270 - DNA, 103 bp, Artificial Sequence
  Synthetic Polynucleotide
taatacgactcactataggggcagcgcccgacgctgagaaggcgccctgcaacagaggagagcagggatgcttctcagcaacctggcggcagcgcaaaagatg

SEQ ID NO: 225271 - DNA, 103 bp, Artificial Sequence
  Synthetic Polynucleotide
taatacgactcactatagggacaatcctcagcagcgcccgacgctgagaaaacagaggagattctcaatgtcgggcgctaacctggcggcagcgcaaaagatg

SEQ ID NO: 225272 - DNA, 103 bp, Artificial Sequence
  Synthetic Polynucleotide
taatacgactcactatagggtacttttgttacaatcctcagcagcgcccgaacagaggagacgggcgatgctgaggattaacctggcggcagcgcaaaagatg

SEQ ID NO: 225273 - DNA, 103 bp, Artificial Sequence
  Synthetic Polynucleotide
taatacgactcactataggggaattggatttacttttgttacaatcctcaaacagaggagatgaggaatgtaacaaaagaacctggcggcagcgcaaaagatg

SEQ ID NO: 225274 - DNA, 103 bp, Artificial Sequence
  Synthetic Polynucleotide
taatacgactcactataggggtccgctgcggaattggatttacttttgttaacagaggagaaacaaaatgaaatccaataacctggcggcagcgcaaaagatg

SEQ ID NO: 225275 - DNA, 103 bp, Artificial Sequence
  Synthetic Polynucleotide
taatacgactcactatagggagtggcatcgaacgtccattttgtctggttaacagaggagaaaccagatgaaatggacgaacctggcggcagcgcaaaagatg

SEQ ID NO: 225276 - DNA, 103 bp, Artificial Sequence
  Synthetic Polynucleotide
taatacgactcactatagggagtaatccgggtccgctgcggaattggattaacagaggagaaatccaatgccgcagcggaacctggcggcagcgcaaaagatg

SEQ ID NO: 225277 - DNA, 103 bp, Artificial Sequence
  Synthetic Polynucleotide
taatacgactcactatagggatccggcggcagtaatccgggtccgctgcgaacagaggagacgcagcatgcccggattaaacctggcggcagcgcaaaagatg

SEQ ID NO: 225278 - DNA, 103 bp, Artificial Sequence
  Synthetic Polynucleotide
taatacgactcactatagggtcggaccaggatccggcggcagtaatccggaacagaggagaccggatatgtgccgccggaacctggcggcagcgcaaaagatg

SEQ ID NO: 225279 - DNA, 103 bp, Artificial Sequence
  Synthetic Polynucleotide
taatacgactcactatagggccttggcatctcggaccaggatccggcggcaacagaggagagccgccatgtcctggtccaacctggcggcagcgcaaaagatg

SEQ ID NO: 225280 - DNA, 103 bp, Artificial Sequence
  Synthetic Polynucleotide
taatacgactcactatagggcggatggaccccttggcatctcggaccaggaacagaggagacctggtatgagatgccaaaacctggcggcagcgcaaaagatg

SEQ ID NO: 225281 - DNA, 103 bp, Artificial Sequence
  Synthetic Polynucleotide
taatacgactcactataggggatgatctctcggatggaccccttggcatcaacagaggagagatgccatggggtccatcaacctggcggcagcgcaaaagatg

SEQ ID NO: 225282 - DNA, 103 bp, Artificial Sequence
  Synthetic Polynucleotide
taatacgactcactatagggccttgggcaggatgatctctcggatggaccaacagaggagaggtccaatggagagatcaaacctggcggcagcgcaaaagatg

SEQ ID NO: 225283 - DNA, 103 bp, Artificial Sequence
  Synthetic Polynucleotide
taatacgactcactatagggaagtccaggcccttgggcaggatgatctctaacagaggagaagagatatgcctgcccaaaacctggcggcagcgcaaaagatg

SEQ ID NO: 225284 - DNA, 103 bp, Artificial Sequence
  Synthetic Polynucleotide
taatacgactcactatagggaggccggtccaagtccaggcccttgggcagaacagaggagactgcccatgggcctggacaacctggcggcagcgcaaaagatg

SEQ ID NO: 225285 - DNA, 103 bp, Artificial Sequence
  Synthetic Polynucleotide
taatacgactcactataggggcgtcctcttaggccggtccaagtccaggcaacagaggagagcctggatgtggaccggcaacctggcggcagcgcaaaagatg

SEQ ID NO: 225286 - DNA, 103 bp, Artificial Sequence
  Synthetic Polynucleotide
taatacgactcactatagggtcggcgtccgagtggcatcgaacgtccattaacagaggagaaatggaatgtcgatgccaaacctggcggcagcgcaaaagatg

SEQ ID NO: 225287 - DNA, 103 bp, Artificial Sequence
  Synthetic Polynucleotide
taatacgactcactatagggaaggacgtgcgcgtcctcttaggccggtccaacagaggagaggaccgatgtaagaggacaacctggcggcagcgcaaaagatg

SEQ ID NO: 225288 - DNA, 103 bp, Artificial Sequence
  Synthetic Polynucleotide
taatacgactcactatagggctccgcggtgaaggacgtgcgcgtcctcttaacagaggagaaagaggatgcgcacgtccaacctggcggcagcgcaaaagatg

SEQ ID NO: 225289 - DNA, 103 bp, Artificial Sequence
  Synthetic Polynucleotide
taatacgactcactataggggatagagctgctccgcggtgaaggacgtgcaacagaggagagcacgtatgtcaccgcggaacctggcggcagcgcaaaagatg

SEQ ID NO: 225290 - DNA, 103 bp, Artificial Sequence
  Synthetic Polynucleotide
taatacgactcactatagggatctccagccgatagagctgctccgcggtgaacagaggagacaccgcatggcagctctaaacctggcggcagcgcaaaagatg

SEQ ID NO: 225291 - DNA, 103 bp, Artificial Sequence
  Synthetic Polynucleotide
taatacgactcactatagggctggaactccatctccagccgatagagctgaacagaggagacagctcatgcggctggagaacctggcggcagcgcaaaagatg

SEQ ID NO: 225292 - DNA, 103 bp, Artificial Sequence
  Synthetic Polynucleotide
taatacgactcactatagggactggcagcgctggaactccatctccagccaacagaggagaggctggatgtggagttccaacctggcggcagcgcaaaagatg

SEQ ID NO: 225293 - DNA, 103 bp, Artificial Sequence
  Synthetic Polynucleotide
taatacgactcactatagggcccaccacgtactggcagcgctggaactccaacagaggagaggagttatggcgctgccaaacctggcggcagcgcaaaagatg

SEQ ID NO: 225294 - DNA, 103 bp, Artificial Sequence
  Synthetic Polynucleotide
taatacgactcactatagggcctctcgcggcccaccacgtactggcagcgaacagaggagacgctgcatgtacgtggtgaacctggcggcagcgcaaaagatg

SEQ ID NO: 225295 - DNA, 103 bp, Artificial Sequence
  Synthetic Polynucleotide
taatacgactcactatagggcgagctcggtcctctcgcggcccaccacgtaacagaggagaacgtggatggccgcgagaaacctggcggcagcgcaaaagatg

SEQ ID NO: 225296 - DNA, 103 bp, Artificial Sequence
  Synthetic Polynucleotide
taatacgactcactatagggagctgccgggcgagctcggtcctctcgcggaacagaggagaccgcgaatggaccgagctaacctggcggcagcgcaaaagatg

SEQ ID NO: 225297 - DNA, 103 bp, Artificial Sequence
  Synthetic Polynucleotide
taatacgactcactatagggccgggcagcctcggcgtccgagtggcatcgaacagaggagacgatgcatgtcggacgccaacctggcggcagcgcaaaagatg

SEQ ID NO: 225298 - DNA, 103 bp, Artificial Sequence
  Synthetic Polynucleotide
taatacgactcactatagggggagaggttaagctgccgggcgagctcggtaacagaggagaaccgagatggcccggcagaacctggcggcagcgcaaaagatg

SEQ ID NO: 225299 - DNA, 103 bp, Artificial Sequence
  Synthetic Polynucleotide
taatacgactcactatagggcctgggtctcggagaggttaagctgccgggaacagaggagacccggcatgttaacctctaacctggcggcagcgcaaaagatg

SEQ ID NO: 225300 - DNA, 103 bp, Artificial Sequence
  Synthetic Polynucleotide
taatacgactcactatagggcagaccttcacctgggtctcggagaggttaaacagaggagataacctatgcgagacccaaacctggcggcagcgcaaaagatg

SEQ ID NO: 225301 - DNA, 103 bp, Artificial Sequence
  Synthetic Polynucleotide
taatacgactcactataggggttctggaaccagaccttcacctgggtctcaacagaggagagagaccatggtgaaggtcaacctggcggcagcgcaaaagatg

SEQ ID NO: 225302 - DNA, 103 bp, Artificial Sequence
  Synthetic Polynucleotide
taatacgactcactatagggtggtgcgccggttctggaaccagaccttcaaacagaggagatgaaggatgggttccagaaacctggcggcagcgcaaaagatg

SEQ ID NO: 225303 - DNA, 103 bp, Artificial Sequence
  Synthetic Polynucleotide
taatacgactcactatagggttcttctgcttggtgcgccggttctggaacaacagaggagagttccaatgccggcgcacaacctggcggcagcgcaaaagatg

SEQ ID NO: 225304 - DNA, 103 bp, Artificial Sequence
  Synthetic Polynucleotide
taatacgactcactataggggccctggtccttcttctgcttggtgcgccgaacagaggagacggcgcatgaagcagaagaacctggcggcagcgcaaaagatg

SEQ ID NO: 225305 - DNA, 103 bp, Artificial Sequence
  Synthetic Polynucleotide
taatacgactcactatagggccgagtccttgccctggtccttcttctgctaacagaggagaagcagaatgaggaccaggaacctggcggcagcgcaaaagatg

SEQ ID NO: 225306 - DNA, 103 bp, Artificial Sequence
  Synthetic Polynucleotide
taatacgactcactataggggagcgtagctccgagtccttgccctggtccaacagaggagaggaccaatgcaaggactcaacctggcggcagcgcaaaagatg

SEQ ID NO: 225307 - DNA, 103 bp, Artificial Sequence
  Synthetic Polynucleotide
taatacgactcactatagggcgacaccaccgagcgtagctccgagtccttaacagaggagaaaggacatggagctacgcaacctggcggcagcgcaaaagatg

SEQ ID NO: 225308 - DNA, 103 bp, Artificial Sequence
  Synthetic Polynucleotide
taatacgactcactatagggtcttcgagacccgggcagcctcggcgtccgaacagaggagacggacgatgaggctgcccaacctggcggcagcgcaaaagatg

SEQ ID NO: 225309 - DNA, 103 bp, Artificial Sequence
  Synthetic Polynucleotide
taatacgactcactatagggccgcggtctccgacaccaccgagcgtagctaacagaggagaagctacatgcggtggtgtaacctggcggcagcgcaaaagatg

SEQ ID NO: 225310 - DNA, 103 bp, Artificial Sequence
  Synthetic Polynucleotide
taatacgactcactatagggctgcacgtggccgcggtctccgacaccaccaacagaggagaggtggtatgggagaccgcaacctggcggcagcgcaaaagatg

SEQ ID NO: 225311 - DNA, 103 bp, Artificial Sequence
  Synthetic Polynucleotide
taatacgactcactatagggccgtagcacgctgcacgtggccgcggtctcaacagaggagagagaccatggccacgtgcaacctggcggcagcgcaaaagatg

SEQ ID NO: 225312 - DNA, 103 bp, Artificial Sequence
  Synthetic Polynucleotide
taatacgactcactataggggctccagcagccgtagcacgctgcacgtggaacagaggagaccacgtatggcgtgctacaacctggcggcagcgcaaaagatg

SEQ ID NO: 225313 - DNA, 103 bp, Artificial Sequence
  Synthetic Polynucleotide
taatacgactcactatagggaggcggccctgctccagcagccgtagcacgaacagaggagacgtgctatggctgctggaaacctggcggcagcgcaaaagatg

SEQ ID NO: 225314 - DNA, 103 bp, Artificial Sequence
  Synthetic Polynucleotide
taatacgactcactatagggcggcgacaacaggcggccctgctccagcagaacagaggagactgctgatgcagggccgcaacctggcggcagcgcaaaagatg

SEQ ID NO: 225315 - DNA, 103 bp, Artificial Sequence
  Synthetic Polynucleotide
taatacgactcactataggggcaggccgggcggcgacaacaggcggccctaacagaggagaagggccatgtgttgtcgcaacctggcggcagcgcaaaagatg

SEQ ID NO: 225316 - DNA, 103 bp, Artificial Sequence
  Synthetic Polynucleotide
taatacgactcactatagggagcagcgcaggcaggccgggcggcgacaacaacagaggagagttgtcatggcccggcctaacctggcggcagcgcaaaagatg

SEQ ID NO: 225317 - DNA, 103 bp, Artificial Sequence
  Synthetic Polynucleotide
taatacgactcactataggggcaaggcggcagcagcgcaggcaggccgggaacagaggagacccggcatgcctgcgctgaacctggcggcagcgcaaaagatg

SEQ ID NO: 225318 - DNA, 103 bp, Artificial Sequence
  Synthetic Polynucleotide
taatacgactcactatagggcgcccgtggcgcaaggcggcagcagcgcagaacagaggagactgcgcatgtgccgccttaacctggcggcagcgcaaaagatg

SEQ ID NO: 225319 - DNA, 103 bp, Artificial Sequence
  Synthetic Polynucleotide
taatacgactcactatagggttgtgcgcgttcttcgagacccgggcagccaacagaggagaggctgcatgggtctcgaaaacctggcggcagcgcaaaagatg

SEQ ID NO: 225320 - DNA, 103 bp, Artificial Sequence
  Synthetic Polynucleotide
taatacgactcactataggggagccgagagcgcccgtggcgcaaggcggcaacagaggagagccgccatgcgccacgggaacctggcggcagcgcaaaagatg

SEQ ID NO: 225321 - DNA, 103 bp, Artificial Sequence
  Synthetic Polynucleotide
taatacgactcactataggggcgcagcgctgagccgagagcgcccgtggcaacagaggagagccacgatggctctcggcaacctggcggcagcgcaaaagatg

SEQ ID NO: 225322 - DNA, 103 bp, Artificial Sequence
  Synthetic Polynucleotide
taatacgactcactatagggagctgggcccgcgcagcgctgagccgagagaacagaggagactctcgatgcagcgctgcaacctggcggcagcgcaaaagatg

SEQ ID NO: 225323 - DNA, 103 bp, Artificial Sequence
  Synthetic Polynucleotide
taatacgactcactatagggagggccggcaagctgggcccgcgcagcgctaacagaggagaagcgctatgcgggcccagaacctggcggcagcgcaaaagatg

SEQ ID NO: 225324 - DNA, 103 bp, Artificial Sequence
  Synthetic Polynucleotide
taatacgactcactataggggcccgcgcccagggccggcaagctgggcccaacagaggagagggcccatgttgccggccaacctggcggcagcgcaaaagatg

SEQ ID NO: 225325 - DNA, 103 bp, Artificial Sequence
  Synthetic Polynucleotide
taatacgactcactatagggctgcagcggcgcccgcgcccagggccggcaaacagaggagatgccggatgtgggcgcggaacctggcggcagcgcaaaagatg

SEQ ID NO: 225326 - DNA, 103 bp, Artificial Sequence
  Synthetic Polynucleotide
taatacgactcactataggggcggccgagcctgcagcggcgcccgcgcccaacagaggagagggcgcatgcgccgctgcaacctggcggcagcgcaaaagatg

SEQ ID NO: 225327 - DNA, 103 bp, Artificial Sequence
  Synthetic Polynucleotide
taatacgactcactatagggggcggctgcggcggccgagcctgcagcggcaacagaggagagccgctatgggctcggccaacctggcggcagcgcaaaagatg

SEQ ID NO: 225328 - DNA, 103 bp, Artificial Sequence
  Synthetic Polynucleotide
taatacgactcactataggggggcggcggcggcggctgcggcggccgagcaacagaggagagctcggatgccgcagccgaacctggcggcagcgcaaaagatg

SEQ ID NO: 225329 - DNA, 103 bp, Artificial Sequence
  Synthetic Polynucleotide
taatacgactcactataggggctgggcccggggcggcggcggcggctgcgaacagaggagacgcagcatgcgccgccgcaacctggcggcagcgcaaaagatg

SEQ ID NO: 225330 - DNA, 103 bp, Artificial Sequence
  Synthetic Polynucleotide
taatacgactcactatagggccgactctccttgtgcgcgttcttcgagacaacagaggagagtctcgatgaacgcgcacaacctggcggcagcgcaaaagatg

SEQ ID NO: 225331 - DNA, 103 bp, Artificial Sequence
  Synthetic Polynucleotide
taatacgactcactatagggtgcagcgcccgctgggcccggggcggcggcaacagaggagagccgccatgccgggcccaaacctggcggcagcgcaaaagatg

SEQ ID NO: 225332 - DNA, 103 bp, Artificial Sequence
  Synthetic Polynucleotide
taatacgactcactatagggggtgcggggatgcagcgcccgctgggcccgaacagaggagacgggccatgcgggcgctgaacctggcggcagcgcaaaagatg

SEQ ID NO: 225333 - DNA, 103 bp, Artificial Sequence
  Synthetic Polynucleotide
taatacgactcactatagggacagccggcgggtgcggggatgcagcgcccaacagaggagagggcgcatgatccccgcaaacctggcggcagcgcaaaagatg

SEQ ID NO: 225334 - DNA, 103 bp, Artificial Sequence
  Synthetic Polynucleotide
taatacgactcactatagggagcaccgcccacagccggcgggtgcggggaaacagaggagatccccgatgccgccggctaacctggcggcagcgcaaaagatg

SEQ ID NO: 225335 - DNA, 103 bp, Artificial Sequence
  Synthetic Polynucleotide
taatacgactcactatagggcgggacctggagcaccgcccacagccggcgaacagaggagacgccggatgtgggcggtgaacctggcggcagcgcaaaagatg

SEQ ID NO: 225336 - DNA, 103 bp, Artificial Sequence
  Synthetic Polynucleotide
taatacgactcactatagggccggcgggcccgggacctggagcaccgcccaacagaggagagggcggatgtccaggtccaacctggcggcagcgcaaaagatg

SEQ ID NO: 225337 - DNA, 103 bp, Artificial Sequence
  Synthetic Polynucleotide
taatacgactcactatagggtccccccggcccggcgggcccgggacctggaacagaggagaccaggtatggggcccgccaacctggcggcagcgcaaaagatg

SEQ ID NO: 225338 - DNA, 103 bp, Artificial Sequence
  Synthetic Polynucleotide
taatacgactcactatagggctgcgtgcaatccccccggcccggcgggccaacagaggagaggcccgatgggccgggggaacctggcggcagcgcaaaagatg

SEQ ID NO: 225339 - DNA, 103 bp, Artificial Sequence
  Synthetic Polynucleotide
taatacgactcactataggggccggggcgcctgcgtgcaatccccccggcaacagaggagagccgggatgattgcacgcaacctggcggcagcgcaaaagatg

SEQ ID NO: 225340 - DNA, 103 bp, Artificial Sequence
  Synthetic Polynucleotide
taatacgactcactataggggtggcccgcggccggggcgcctgcgtgcaaaacagaggagattgcacatgggcgccccgaacctggcggcagcgcaaaagatg

SEQ ID NO: 225341 - DNA, 103 bp, Artificial Sequence
  Synthetic Polynucleotide
taatacgactcactatagggccttgctctcccgactctccttgtgcgcgtaacagaggagaacgcgcatgaggagagtcaacctggcggcagcgcaaaagatg

SEQ ID NO: 225342 - DNA, 103 bp, Artificial Sequence
  Synthetic Polynucleotide
taatacgactcactatagggtgaagaggctgtggcccgcggccggggcgcaacagaggagagcgcccatgccgcgggccaacctggcggcagcgcaaaagatg

SEQ ID NO: 225343 - DNA, 103 bp, Artificial Sequence
  Synthetic Polynucleotide
taatacgactcactatagggaccggcaggctgaagaggctgtggcccgcgaacagaggagacgcgggatgcagcctcttaacctggcggcagcgcaaaagatg

SEQ ID NO: 225344 - DNA, 103 bp, Artificial Sequence
  Synthetic Polynucleotide
taatacgactcactatagggcagcgagggcaccggcaggctgaagaggctaacagaggagaagcctcatgagcctgccgaacctggcggcagcgcaaaagatg

SEQ ID NO: 225345 - DNA, 103 bp, Artificial Sequence
  Synthetic Polynucleotide
taatacgactcactatagggcggagccgagcagcgagggcaccggcaggcaacagaggagagcctgcatgtgccctcgcaacctggcggcagcgcaaaagatg

SEQ ID NO: 225346 - DNA, 103 bp, Artificial Sequence
  Synthetic Polynucleotide
taatacgactcactatagggcggctggcgacggagccgagcagcgagggcaacagaggagagccctcatggctcggctcaacctggcggcagcgcaaaagatg

SEQ ID NO: 225347 - DNA, 103 bp, Artificial Sequence
  Synthetic Polynucleotide
taatacgactcactatagggggaggacaggcggctggcgacggagccgagaacagaggagactcggcatggtcgccagcaacctggcggcagcgcaaaagatg

SEQ ID NO: 225348 - DNA, 103 bp, Artificial Sequence
  Synthetic Polynucleotide
taatacgactcactatagggttaacggggcggaggacaggcggctggcgaaacagaggagatcgccaatggcctgtcctaacctggcggcagcgcaaaagatg

SEQ ID NO: 225349 - DNA, 103 bp, Artificial Sequence
  Synthetic Polynucleotide
taatacgactcactatagggccagccattgttaacggggcggaggacaggaacagaggagacctgtcatgcgccccgttaacctggcggcagcgcaaaagatg

SEQ ID NO: 225350 - DNA, 103 bp, Artificial Sequence
  Synthetic Polynucleotide
taatacgactcactatagggagctagcgaaccagccattgttaacggggcaacagaggagagccccgatgacaatggctaacctggcggcagcgcaaaagatg

SEQ ID NO: 225351 - DNA, 103 bp, Artificial Sequence
  Synthetic Polynucleotide
taatacgactcactataggggcaaattcccagctagcgaaccagccattgaacagaggagacaatggatggttcgctagaacctggcggcagcgcaaaagatg

SEQ ID NO: 225352 - DNA, 103 bp, Artificial Sequence
  Synthetic Polynucleotide
taatacgactcactatagggccctccgcgcccttgctctcccgactctccaacagaggagaggagagatgggagagcaaaacctggcggcagcgcaaaagatg

SEQ ID NO: 225353 - DNA, 103 bp, Artificial Sequence
  Synthetic Polynucleotide
taatacgactcactataggggagagttcttgcaaattcccagctagcgaaaacagaggagattcgctatgtgggaatttaacctggcggcagcgcaaaagatg

SEQ ID NO: 225354 - DNA, 103 bp, Artificial Sequence
  Synthetic Polynucleotide
taatacgactcactatagggatatcgggcggagagttcttgcaaattcccaacagaggagagggaatatgcaagaactcaacctggcggcagcgcaaaagatg

SEQ ID NO: 225355 - DNA, 103 bp, Artificial Sequence
  Synthetic Polynucleotide
taatacgactcactatagggaggagctcagatatcgggcggagagttcttaacagaggagaaagaacatgccgcccgataacctggcggcagcgcaaaagatg

SEQ ID NO: 225356 - DNA, 103 bp, Artificial Sequence
  Synthetic Polynucleotide
taatacgactcactatagggtcgaaggccgaggagctcagatatcgggcgaacagaggagacgcccgatgtctgagctcaacctggcggcagcgcaaaagatg

SEQ ID NO: 225357 - DNA, 103 bp, Artificial Sequence
  Synthetic Polynucleotide
taatacgactcactatagggggagtaaggctcgaaggccgaggagctcagaacagaggagactgagcatgtcggccttcaacctggcggcagcgcaaaagatg

SEQ ID NO: 225358 - DNA, 103 bp, Artificial Sequence
  Synthetic Polynucleotide
taatacgactcactatagggtgttggtccgggagtaaggctcgaaggccgaacagaggagacggcctatgagccttactaacctggcggcagcgcaaaagatg

SEQ ID NO: 225359 - DNA, 103 bp, Artificial Sequence
  Synthetic Polynucleotide
taatacgactcactatagggccttctttattgttggtccgggagtaaggcaacagaggagagccttaatgccggaccaaaacctggcggcagcgcaaaagatg

SEQ ID NO: 225360 - DNA, 103 bp, Artificial Sequence
  Synthetic Polynucleotide
taatacgactcactatagggtttctcggccccttctttattgttggtccgaacagaggagacggaccatgaataaagaaaacctggcggcagcgcaaaagatg

SEQ ID NO: 225361 - DNA, 103 bp, Artificial Sequence
  Synthetic Polynucleotide
taatacgactcactatagggccagcgcttttttctcggccccttctttataacagaggagaataaagatggggccgagaaacctggcggcagcgcaaaagatg

SEQ ID NO: 225362 - DNA, 103 bp, Artificial Sequence
  Synthetic Polynucleotide
taatacgactcactatagggccggtcgcgctcggcgcccccatcgcccataacagaggagaatgggcatggggggcgccaacctggcggcagcgcaaaagatg

SEQ ID NO: 225363 - DNA, 103 bp, Artificial Sequence
  Synthetic Polynucleotide
taatacgactcactataggggccaccgccatcagctcgcaagtcccccgcaacagaggagagcggggatgttgcgagctaacctggcggcagcgcaaaagatg

SEQ ID NO: 225364 - DNA, 103 bp, Artificial Sequence
  Synthetic Polynucleotide
taatacgactcactatagggttgggctgtggccaccgccatcagctcgcaaacagaggagatgcgagatgatggcggtgaacctggcggcagcgcaaaagatg

SEQ ID NO: 225365 - DNA, 103 bp, Artificial Sequence
  Synthetic Polynucleotide
taatacgactcactataggggccacctccgttgggctgtggccaccgccaaacagaggagatggcggatgccacagcccaacctggcggcagcgcaaaagatg

SEQ ID NO: 225366 - DNA, 103 bp, Artificial Sequence
  Synthetic Polynucleotide
taatacgactcactatagggtgaggtcccggccacctccgttgggctgtgaacagaggagacacagcatgacggaggtgaacctggcggcagcgcaaaagatg

SEQ ID NO: 225367 - DNA, 103 bp, Artificial Sequence
  Synthetic Polynucleotide
taatacgactcactataggggactggaggctgaggtcccggccacctccgaacagaggagacggaggatgccgggacctaacctggcggcagcgcaaaagatg

SEQ ID NO: 225368 - DNA, 103 bp, Artificial Sequence
  Synthetic Polynucleotide
taatacgactcactataggggagcctgcgggactggaggctgaggtcccgaacagaggagacgggacatgagcctccagaacctggcggcagcgcaaaagatg

SEQ ID NO: 225369 - DNA, 103 bp, Artificial Sequence
  Synthetic Polynucleotide
taatacgactcactatagggactctccctggagcctgcgggactggaggcaacagaggagagcctccatgcccgcaggcaacctggcggcagcgcaaaagatg

SEQ ID NO: 225370 - DNA, 103 bp, Artificial Sequence
  Synthetic Polynucleotide
taatacgactcactatagggtgtcggctccactctccctggagcctgcggaacagaggagaccgcagatgccagggagaaacctggcggcagcgcaaaagatg

SEQ ID NO: 225371 - DNA, 103 bp, Artificial Sequence
  Synthetic Polynucleotide
taatacgactcactatagggtgcccgtcgctgtcggctccactctccctgaacagaggagacagggaatgtggagccgaaacctggcggcagcgcaaaagatg

SEQ ID NO: 225372 - DNA, 103 bp, Artificial Sequence
  Synthetic Polynucleotide
taatacgactcactataggggggcccgggctgcccgtcgctgtcggctccaacagaggagaggagccatgagcgacgggaacctggcggcagcgcaaaagatg

SEQ ID NO: 225373 - DNA, 103 bp, Artificial Sequence
  Synthetic Polynucleotide
taatacgactcactataggggcgcggggccccggtcgcgctcggcgccccaacagaggagaggggcgatgagcgcgaccaacctggcggcagcgcaaaagatg

SEQ ID NO: 225374 - DNA, 103 bp, Artificial Sequence
  Synthetic Polynucleotide
taatacgactcactatagggctgcctcgccgggcccgggctgcccgtcgcaacagaggagagcgacgatgagcccgggcaacctggcggcagcgcaaaagatg

SEQ ID NO: 225375 - DNA, 103 bp, Artificial Sequence
  Synthetic Polynucleotide
taatacgactcactatagggcggcagtggtctgcctcgccgggcccgggcaacagaggagagcccggatgcggcgaggcaacctggcggcagcgcaaaagatg

SEQ ID NO: 225376 - DNA, 103 bp, Artificial Sequence
  Synthetic Polynucleotide
taatacgactcactatagggcagtatgcggcggcagtggtctgcctcgccaacagaggagaggcgagatggaccactgcaacctggcggcagcgcaaaagatg

SEQ ID NO: 225377 - DNA, 103 bp, Artificial Sequence
  Synthetic Polynucleotide
taatacgactcactatagggcatctcgcaccagtatgcggcggcagtggtaacagaggagaaccactatggccgcatacaacctggcggcagcgcaaaagatg

SEQ ID NO: 225378 - DNA, 103 bp, Artificial Sequence
  Synthetic Polynucleotide
taatacgactcactataggggtccctttggcatctcgcaccagtatgcggaacagaggagaccgcatatgggtgcgagaaacctggcggcagcgcaaaagatg

SEQ ID NO: 225379 - DNA, 103 bp, Artificial Sequence
  Synthetic Polynucleotide
taatacgactcactatagggttcccgaattgtccctttggcatctcgcacaacagaggagagtgcgaatggccaaagggaacctggcggcagcgcaaaagatg

SEQ ID NO: 225380 - DNA, 103 bp, Artificial Sequence
  Synthetic Polynucleotide
taatacgactcactataggggcaggacaatttcccgaattgtccctttggaacagaggagaccaaagatgcaattcgggaacctggcggcagcgcaaaagatg

SEQ ID NO: 225381 - DNA, 103 bp, Artificial Sequence
  Synthetic Polynucleotide
taatacgactcactatagggaggcccttaggcaggacaatttcccgaattaacagaggagaaattcgatgaattgtcctaacctggcggcagcgcaaaagatg

SEQ ID NO: 225382 - DNA, 103 bp, Artificial Sequence
  Synthetic Polynucleotide
taatacgactcactataggggtccaggtccaggcccttaggcaggacaataacagaggagaattgtcatgcctaagggcaacctggcggcagcgcaaaagatg

SEQ ID NO: 225383 - DNA, 103 bp, Artificial Sequence
  Synthetic Polynucleotide
taatacgactcactataggggcttgggccggtccaggtccaggcccttagaacagaggagactaaggatgtggacctggaacctggcggcagcgcaaaagatg

SEQ ID NO: 225384 - DNA, 103 bp, Artificial Sequence
  Synthetic Polynucleotide
taatacgactcactatagggtccgcccggcgcgcggggccccggtcgcgcaacagaggagagcgcgaatggggccccgcaacctggcggcagcgcaaaagatg

SEQ ID NO: 225385 - DNA, 103 bp, Artificial Sequence
  Synthetic Polynucleotide
taatacgactcactataggggtacgtgtccgcttgggccggtccaggtccaacagaggagaggacctatgccggcccaaaacctggcggcagcgcaaaagatg

SEQ ID NO: 225386 - DNA, 103 bp, Artificial Sequence
  Synthetic Polynucleotide
taatacgactcactatagggagtgaaggatgtacgtgtccgcttgggccgaacagaggagacggcccatgcggacacgtaacctggcggcagcgcaaaagatg

SEQ ID NO: 225387 - DNA, 103 bp, Artificial Sequence
  Synthetic Polynucleotide
taatacgactcactataggggctgctcggcagtgaaggatgtacgtgtccaacagaggagaggacacatgcatccttcaaacctggcggcagcgcaaaagatg

SEQ ID NO: 225388 - DNA, 103 bp, Artificial Sequence
  Synthetic Polynucleotide
taatacgactcactatagggaggcggtacagctgctcggcagtgaaggataacagaggagaatccttatgtgccgagcaaacctggcggcagcgcaaaagatg

SEQ ID NO: 225389 - DNA, 103 bp, Artificial Sequence
  Synthetic Polynucleotide
taatacgactcactatagggctccatctccaggcggtacagctgctcggcaacagaggagagccgagatgctgtaccgcaacctggcggcagcgcaaaagatg

SEQ ID NO: 225390 - DNA, 103 bp, Artificial Sequence
  Synthetic Polynucleotide
taatacgactcactatagggagcgctggaactccatctccaggcggtacaaacagaggagatgtaccatgtggagatggaacctggcggcagcgcaaaagatg

SEQ ID NO: 225391 - DNA, 103 bp, Artificial Sequence
  Synthetic Polynucleotide
taatacgactcactatagggacatactggcagcgctggaactccatctccaacagaggagaggagatatggttccagcgaacctggcggcagcgcaaaagatg

SEQ ID NO: 225392 - DNA, 103 bp, Artificial Sequence
  Synthetic Polynucleotide
taatacgactcactataggggcggcccaccacatactggcagcgctggaaaacagaggagattccagatgtgccagtataacctggcggcagcgcaaaagatg

SEQ ID NO: 225393 - DNA, 103 bp, Artificial Sequence
  Synthetic Polynucleotide
taatacgactcactatagggcagtgcgctcgcggcccaccacatactggcaacagaggagagccagtatgtggtgggccaacctggcggcagcgcaaaagatg

SEQ ID NO: 225394 - DNA, 103 bp, Artificial Sequence
  Synthetic Polynucleotide
taatacgactcactatagggcgggccagctcagtgcgctcgcggcccaccaacagaggagaggtgggatgcgagcgcacaacctggcggcagcgcaaaagatg

SEQ ID NO: 225395 - DNA, 103 bp, Artificial Sequence
  Synthetic Polynucleotide
taatacgactcactataggggccaccagactccgcccggcgcgcggggccaacagaggagaggccccatgcgccgggcgaacctggcggcagcgcaaaagatg

SEQ ID NO: 225396 - DNA, 103 bp, Artificial Sequence
  Synthetic Polynucleotide
taatacgactcactataggggttcagctggcgggccagctcagtgcgctcaacagaggagagagcgcatggagctggccaacctggcggcagcgcaaaagatg

SEQ ID NO: 225397 - DNA, 103 bp, Artificial Sequence
  Synthetic Polynucleotide
taatacgactcactatagggtctcggagaggttcagctggcgggccagctaacagaggagaagctggatggccagctgaaacctggcggcagcgcaaaagatg

SEQ ID NO: 225398 - DNA, 103 bp, Artificial Sequence
  Synthetic Polynucleotide
taatacgactcactatagggttcacctgggtctcggagaggttcagctggaacagaggagaccagctatgcctctccgaaacctggcggcagcgcaaaagatg

SEQ ID NO: 225399 - DNA, 103 bp, Artificial Sequence
  Synthetic Polynucleotide
taatacgactcactataggggaaccagaccttcacctgggtctcggagagaacagaggagactctccatgacccaggtgaacctggcggcagcgcaaaagatg

SEQ ID NO: 225400 - DNA, 103 bp, Artificial Sequence
  Synthetic Polynucleotide
taatacgactcactatagggggcggttctggaaccagaccttcacctgggaacagaggagacccaggatgaggtctggtaacctggcggcagcgcaaaagatg

SEQ ID NO: 225401 - DNA, 103 bp, Artificial Sequence
  Synthetic Polynucleotide
taatacgactcactatagggtgcttggtgcggcggttctggaaccagaccaacagaggagaggtctgatgccagaaccgaacctggcggcagcgcaaaagatg

SEQ ID NO: 225402 - DNA, 103 bp, Artificial Sequence
  Synthetic Polynucleotide
taatacgactcactataggggtctttcttctgcttggtgcggcggttctgaacagaggagacagaacatgcgcaccaagaacctggcggcagcgcaaaagatg

SEQ ID NO: 225403 - DNA, 103 bp, Artificial Sequence
  Synthetic Polynucleotide
taatacgactcactatagggctctgctctggtctttcttctgcttggtgcaacagaggagagcaccaatgagaagaaagaacctggcggcagcgcaaaagatg

SEQ ID NO: 225404 - DNA, 103 bp, Artificial Sequence
  Synthetic Polynucleotide
taatacgactcactatagggttctccaggtctctgctctggtctttcttcaacagaggagagaagaaatgccagagcagaacctggcggcagcgcaaaagatg

SEQ ID NO: 225405 - DNA, 103 bp, Artificial Sequence
  Synthetic Polynucleotide
taatacgactcactatagggggacgcccgcttctccaggtctctgctctgaacagaggagacagagcatggacctggagaacctggcggcagcgcaaaagatg

SEQ ID NO: 225406 - DNA, 103 bp, Artificial Sequence
  Synthetic Polynucleotide
taatacgactcactataggggcccaccgccgccaccagactccgcccggcaacagaggagagccgggatgagtctggtgaacctggcggcagcgcaaaagatg

SEQ ID NO: 225407 - DNA, 103 bp, Artificial Sequence
  Synthetic Polynucleotide
taatacgactcactatagggaggctgaggaggacgcccgcttctccaggtaacagaggagaacctggatgagcgggcgtaacctggcggcagcgcaaaagatg

SEQ ID NO: 225408 - DNA, 103 bp, Artificial Sequence
  Synthetic Polynucleotide
taatacgactcactatagggaaggcctcggaggctgaggaggacgcccgcaacagaggagagcgggcatgctcctcagcaacctggcggcagcgcaaaagatg

SEQ ID NO: 225409 - DNA, 103 bp, Artificial Sequence
  Synthetic Polynucleotide
taatacgactcactatagggggaggtggcaaaggcctcggaggctgaggaaacagaggagatcctcaatgtccgaggccaacctggcggcagcgcaaaagatg

SEQ ID NO: 225410 - DNA, 103 bp, Artificial Sequence
  Synthetic Polynucleotide
taatacgactcactataggggcagaatgttggaggtggcaaaggcctcggaacagaggagaccgaggatgttgccacctaacctggcggcagcgcaaaagatg

SEQ ID NO: 225411 - DNA, 103 bp, Artificial Sequence
  Synthetic Polynucleotide
taatacgactcactatagggtccagcagccgcagaatgttggaggtggcaaacagaggagatgccacatgcaacattctaacctggcggcagcgcaaaagatg

SEQ ID NO: 225412 - DNA, 103 bp, Artificial Sequence
  Synthetic Polynucleotide
taatacgactcactatagggccggccctgctccagcagccgcagaatgttaacagaggagaaacattatgcggctgctgaacctggcggcagcgcaaaagatg

SEQ ID NO: 225413 - DNA, 103 bp, Artificial Sequence
  Synthetic Polynucleotide
taatacgactcactatagggcagagagcagccggccctgctccagcagccaacagaggagaggctgcatgagcagggccaacctggcggcagcgcaaaagatg

SEQ ID NO: 225414 - DNA, 103 bp, Artificial Sequence
  Synthetic Polynucleotide
taatacgactcactataggggccctgggcacagagagcagccggccctgcaacagaggagagcagggatggctgctctcaacctggcggcagcgcaaaagatg

SEQ ID NO: 225415 - DNA, 103 bp, Artificial Sequence
  Synthetic Polynucleotide
taatacgactcactataggggaggctaggggccctgggcacagagagcagaacagaggagactgctcatggtgcccaggaacctggcggcagcgcaaaagatg

SEQ ID NO: 225416 - DNA, 103 bp, Artificial Sequence
  Synthetic Polynucleotide
taatacgactcactatagggtcagcgccaggaggctaggggccctgggcaaacagaggagatgcccaatgcccctagccaacctggcggcagcgcaaaagatg

SEQ ID NO: 225417 - DNA, 103 bp, Artificial Sequence
  Synthetic Polynucleotide
taatacgactcactatagggtctccgcagcgcccaccgccgccaccagacaacagaggagagtctggatgcggcggtggaacctggcggcagcgcaaaagatg

SEQ ID NO: 225418 - DNA, 103 bp, Artificial Sequence
  Synthetic Polynucleotide
taatacgactcactatagggaggctaggggtcagcgccaggaggctagggaacagaggagaccctagatgcctggcgctaacctggcggcagcgcaaaagatg

SEQ ID NO: 225419 - DNA, 103 bp, Artificial Sequence
  Synthetic Polynucleotide
taatacgactcactatagggtaggcctggcaggctaggggtcagcgccagaacagaggagactggcgatgacccctagcaacctggcggcagcgcaaaagatg

SEQ ID NO: 225420 - DNA, 103 bp, Artificial Sequence
  Synthetic Polynucleotide
taatacgactcactatagggggctggcaggtaggcctggcaggctaggggaacagaggagacccctaatgtgccaggccaacctggcggcagcgcaaaagatg

SEQ ID NO: 225421 - DNA, 103 bp, Artificial Sequence
  Synthetic Polynucleotide
taatacgactcactataggggtgcccctgtggctggcaggtaggcctggcaacagaggagagccaggatgacctgccagaacctggcggcagcgcaaaagatg

SEQ ID NO: 225422 - DNA, 103 bp, Artificial Sequence
  Synthetic Polynucleotide
taatacgactcactatagggacctaaggaggtgcccctgtggctggcaggaacagaggagacctgccatgcacaggggcaacctggcggcagcgcaaaagatg

SEQ ID NO: 225423 - DNA, 103 bp, Artificial Sequence
  Synthetic Polynucleotide
taatacgactcactatagggtcctggggtcacctaaggaggtgcccctgtaacagaggagaacagggatgcctccttagaacctggcggcagcgcaaaagatg

SEQ ID NO: 225424 - DNA, 103 bp, Artificial Sequence
  Synthetic Polynucleotide
taatacgactcactatagggggggaggagttcctggggtcacctaaggagaacagaggagactccttatgtgaccccagaacctggcggcagcgcaaaagatg

SEQ ID NO: 225425 - DNA, 103 bp, Artificial Sequence
  Synthetic Polynucleotide
taatacgactcactataggggttgaggcgtggggaggagttcctggggtcaacagaggagagaccccatgaactcctccaacctggcggcagcgcaaaagatg

SEQ ID NO: 225426 - DNA, 103 bp, Artificial Sequence
  Synthetic Polynucleotide
taatacgactcactatagggaggacagcgggttgaggcgtggggaggagtaacagaggagaactcctatgcacgcctcaaacctggcggcagcgcaaaagatg

SEQ ID NO: 225427 - DNA, 103 bp, Artificial Sequence
  Synthetic Polynucleotide
taatacgactcactataggggctgaggccgaggacagcgggttgaggcgtaacagaggagaacgcctatgcccgctgtcaacctggcggcagcgcaaaagatg

SEQ ID NO: 225428 - DNA, 103 bp, Artificial Sequence
  Synthetic Polynucleotide
taatacgactcactatagggtccgctgcggtctccgcagcgcccaccgccaacagaggagaggcggtatgcgctgcggaaacctggcggcagcgcaaaagatg

SEQ ID NO: 225429 - DNA, 103 bp, Artificial Sequence
  Synthetic Polynucleotide
taatacgactcactatagggtgggggggacgctgaggccgaggacagcggaacagaggagaccgctgatgtcggcctcaaacctggcggcagcgcaaaagatg

SEQ ID NO: 225430 - DNA, 103 bp, Artificial Sequence
  Synthetic Polynucleotide
taatacgactcactatagggggggcggcagtgggggggacgctgaggccgaacagaggagacggcctatgcgtccccccaacctggcggcagcgcaaaagatg

SEQ ID NO: 225431 - DNA, 103 bp, Artificial Sequence
  Synthetic Polynucleotide
taatacgactcactataggggctggcagagggggcggcagtgggggggacaacagaggagagtccccatgactgccgccaacctggcggcagcgcaaaagatg

SEQ ID NO: 225432 - DNA, 103 bp, Artificial Sequence
  Synthetic Polynucleotide
taatacgactcactatagggaaagcagacagctggcagagggggcggcagaacagaggagactgccgatgcctctgccaaacctggcggcagcgcaaaagatg

SEQ ID NO: 225433 - DNA, 103 bp, Artificial Sequence
  Synthetic Polynucleotide
taatacgactcactataggggggccgaggaaaagcagacagctggcagagaacagaggagactctgcatgctgtctgctaacctggcggcagcgcaaaagatg

SEQ ID NO: 225434 - DNA, 103 bp, Artificial Sequence
  Synthetic Polynucleotide
taatacgactcactatagggtccaggagcggggccgaggaaaagcagacaaacagaggagatgtctgatgttcctcggcaacctggcggcagcgcaaaagatg

SEQ ID NO: 225435 - DNA, 103 bp, Artificial Sequence
  Synthetic Polynucleotide
taatacgactcactatagggggcaggcagatccaggagcggggccgaggaaacagaggagatcctcgatgccgctcctgaacctggcggcagcgcaaaagatg

SEQ ID NO: 225436 - DNA, 103 bp, Artificial Sequence
  Synthetic Polynucleotide
taatacgactcactataggggttcgtagccggcaggcagatccaggagcgaacagaggagacgctccatgatctgcctgaacctggcggcagcgcaaaagatg

SEQ ID NO: 225437 - DNA, 103 bp, Artificial Sequence
  Synthetic Polynucleotide
taatacgactcactataggggaggaacccagttcgtagccggcaggcagaaacagaggagatctgccatgcggctacgaaacctggcggcagcgcaaaagatg

SEQ ID NO: 225438 - DNA, 103 bp, Artificial Sequence
  Synthetic Polynucleotide
taatacgactcactatagggctcgaaggccgaggaacccagttcgtagccaacagaggagaggctacatgctgggttccaacctggcggcagcgcaaaagatg

SEQ ID NO: 225439 - DNA, 103 bp, Artificial Sequence
  Synthetic Polynucleotide
taatacgactcactatagggagtcccccgctccgctgcggtctccgcagcaacagaggagagctgcgatgaccgcagcgaacctggcggcagcgcaaaagatg

SEQ ID NO: 225440 - DNA, 103 bp, Artificial Sequence
  Synthetic Polynucleotide
taatacgactcactatagggagctgtatggctcgaaggccgaggaacccaaacagaggagatgggttatgcggccttcgaacctggcggcagcgcaaaagatg

SEQ ID NO: 225441 - DNA, 103 bp, Artificial Sequence
  Synthetic Polynucleotide
taatacgactcactatagggcgttctagccagctgtatggctcgaaggccaacagaggagaggccttatggccatacagaacctggcggcagcgcaaaagatg

SEQ ID NO: 225442 - DNA, 103 bp, Artificial Sequence
  Synthetic Polynucleotide
taatacgactcactataggggcccactttccgttctagccagctgtatggaacagaggagaccatacatgtggctagaaaacctggcggcagcgcaaaagatg

SEQ ID NO: 225443 - DNA, 103 bp, Artificial Sequence
  Synthetic Polynucleotide
taatacgactcactatagggtgctggcgctgcccactttccgttctagccaacagaggagaggctagatgggaaagtggaacctggcggcagcgcaaaagatg

SEQ ID NO: 225444 - DNA, 103 bp, Artificial Sequence
  Synthetic Polynucleotide
taatacgactcactatagggttcttgcagctgctggcgctgcccactttcaacagaggagagaaagtatgcagcgccagaacctggcggcagcgcaaaagatg

SEQ ID NO: 225445 - DNA, 103 bp, Artificial Sequence
  Synthetic Polynucleotide
taatacgactcactatagggagtgttagctttcttgcagctgctggcgctaacagaggagaagcgccatgagctgcaagaacctggcggcagcgcaaaagatg

SEQ ID NO: 225446 - DNA, 103 bp, Artificial Sequence
  Synthetic Polynucleotide
taatacgactcactatagggtcagctcgcaagtcccccgctccgctgcggaacagaggagaccgcagatgagcgggggaaacctggcggcagcgcaaaagatg

SEQ ID NO: 225447 - DNA, 103 bp, Artificial Sequence
  Synthetic Polynucleotide
taatacgactcactatagggcagggaagtgctggccgccattgcctccataacagaggagaatggagatgatggcggccaacctggcggcagcgcaaaagatg

SEQ ID NO: 225448 - DNA, 103 bp, Artificial Sequence
  Synthetic Polynucleotide
taatacgactcactatagggggtcatagcattgaagtgaaagccagtggcaacagaggagagccactatgtttcacttcaacctggcggcagcgcaaaagatg

SEQ ID NO: 225449 - DNA, 103 bp, Artificial Sequence
  Synthetic Polynucleotide
taatacgactcactatagggggagacgatgcagatggccatgagcaggacaacagaggagagtcctgatgatggccatcaacctggcggcagcgcaaaagatg

SEQ ID NO: 225450 - DNA, 103 bp, Artificial Sequence
  Synthetic Polynucleotide
taatacgactcactataggggacgatctggggagacgatgcagatggccaaacagaggagatggccaatggcatcgtctaacctggcggcagcgcaaaagatg

SEQ ID NO: 225451 - DNA, 103 bp, Artificial Sequence
  Synthetic Polynucleotide
taatacgactcactatagggtgcaccccaggacgatctggggagacgatgaacagaggagacatcgtatgcccagatcgaacctggcggcagcgcaaaagatg

SEQ ID NO: 225452 - DNA, 103 bp, Artificial Sequence
  Synthetic Polynucleotide
taatacgactcactatagggcgcggcgtcctgcaccccaggacgatctggaacagaggagaccagatatgcctggggtgaacctggcggcagcgcaaaagatg

SEQ ID NO: 225453 - DNA, 103 bp, Artificial Sequence
  Synthetic Polynucleotide
taatacgactcactatagggcctcaatcagcgcggcgtcctgcaccccagaacagaggagactggggatgaggacgccgaacctggcggcagcgcaaaagatg

SEQ ID NO: 225454 - DNA, 103 bp, Artificial Sequence
  Synthetic Polynucleotide
taatacgactcactatagggtcctggatggcctcaatcagcgcggcgtccaacagaggagaggacgcatggctgattgaaacctggcggcagcgcaaaagatg

SEQ ID NO: 225455 - DNA, 103 bp, Artificial Sequence
  Synthetic Polynucleotide
taatacgactcactatagggggacaggcggtcctggatggcctcaatcagaacagaggagactgattatggccatccagaacctggcggcagcgcaaaagatg

SEQ ID NO: 225456 - DNA, 103 bp, Artificial Sequence
  Synthetic Polynucleotide
taatacgactcactataggggcagtgtgttggacaggcggtcctggatggaacagaggagaccatccatgaccgcctgtaacctggcggcagcgcaaaagatg

SEQ ID NO: 225457 - DNA, 103 bp, Artificial Sequence
  Synthetic Polynucleotide
taatacgactcactatagggatgtacgtctgcagtgtgttggacaggcggaacagaggagaccgcctatgcaacacactaacctggcggcagcgcaaaagatg

SEQ ID NO: 225458 - DNA, 103 bp, Artificial Sequence
  Synthetic Polynucleotide
taatacgactcactataggggcggcagcggatgtacgtctgcagtgtgttaacagaggagaaacacaatgcagacgtacaacctggcggcagcgcaaaagatg

SEQ ID NO: 225459 - DNA, 103 bp, Artificial Sequence
  Synthetic Polynucleotide
taatacgactcactatagggagccttcacaggtcatagcattgaagtgaaaacagaggagattcactatgatgctatgaaacctggcggcagcgcaaaagatg

SEQ ID NO: 225460 - DNA, 103 bp, Artificial Sequence
  Synthetic Polynucleotide
taatacgactcactatagggggggcgggtggcggcagcggatgtacgtctaacagaggagaagacgtatgtccgctgccaacctggcggcagcgcaaaagatg

SEQ ID NO: 225461 - DNA, 103 bp, Artificial Sequence
  Synthetic Polynucleotide
taatacgactcactatagggtggctgcccgggggcgggtggcggcagcggaacagaggagaccgctgatgccacccgccaacctggcggcagcgcaaaagatg

SEQ ID NO: 225462 - DNA, 103 bp, Artificial Sequence
  Synthetic Polynucleotide
taatacgactcactatagggatagagcaggtggctgcccgggggcgggtgaacagaggagacacccgatgccgggcagcaacctggcggcagcgcaaaagatg

SEQ ID NO: 225463 - DNA, 103 bp, Artificial Sequence
  Synthetic Polynucleotide
taatacgactcactatagggtcatcttggcatagagcaggtggctgcccgaacagaggagacgggcaatgacctgctctaacctggcggcagcgcaaaagatg

SEQ ID NO: 225464 - DNA, 103 bp, Artificial Sequence
  Synthetic Polynucleotide
taatacgactcactatagggagcttctggatcatcttggcatagagcaggaacagaggagacctgctatgtgccaagataacctggcggcagcgcaaaagatg

SEQ ID NO: 225465 - DNA, 103 bp, Artificial Sequence
  Synthetic Polynucleotide
taatacgactcactatagggcaggtcggctagcttctggatcatcttggcaacagaggagagccaagatgatccagaagaacctggcggcagcgcaaaagatg

SEQ ID NO: 225466 - DNA, 103 bp, Artificial Sequence
  Synthetic Polynucleotide
taatacgactcactatagggtgaggctgcgcaggtcggctagcttctggaaacagaggagatccagaatgtagccgaccaacctggcggcagcgcaaaagatg

SEQ ID NO: 225467 - DNA, 103 bp, Artificial Sequence
  Synthetic Polynucleotide
taatacgactcactatagggtgctcctcattgaggctgcgcaggtcggctaacagaggagaagccgaatggcgcagcctaacctggcggcagcgcaaaagatg

SEQ ID NO: 225468 - DNA, 103 bp, Artificial Sequence
  Synthetic Polynucleotide
taatacgactcactatagggctgcttggagtgctcctcattgaggctgcgaacagaggagacgcagcatgaatgaggagaacctggcggcagcgcaaaagatg

SEQ ID NO: 225469 - DNA, 103 bp, Artificial Sequence
  Synthetic Polynucleotide
taatacgactcactatagggggcagcggtactgcttggagtgctcctcataacagaggagaatgaggatgactccaagcaacctggcggcagcgcaaaagatg

SEQ ID NO: 225470 - DNA, 103 bp, Artificial Sequence
  Synthetic Polynucleotide
taatacgactcactatagggaagcctttgcagccttcacaggtcatagcaaacagaggagatgctatatgctgtgaaggaacctggcggcagcgcaaaagatg

SEQ ID NO: 225471 - DNA, 103 bp, Artificial Sequence
  Synthetic Polynucleotide
taatacgactcactatagggtggaaggagaggcagcggtactgcttggagaacagaggagactccaaatggtaccgctgaacctggcggcagcgcaaaagatg

SEQ ID NO: 225472 - DNA, 103 bp, Artificial Sequence
  Synthetic Polynucleotide
taatacgactcactataggggcactcaggctggaaggagaggcagcggtaaacagaggagataccgcatgctctccttcaacctggcggcagcgcaaaagatg

SEQ ID NO: 225473 - DNA, 103 bp, Artificial Sequence
  Synthetic Polynucleotide
taatacgactcactataggggcttcatgctgcactcaggctggaaggagaaacagaggagatctcctatgagcctgagtaacctggcggcagcgcaaaagatg

SEQ ID NO: 225474 - DNA, 103 bp, Artificial Sequence
  Synthetic Polynucleotide
taatacgactcactatagggaggggcgttagcttcatgctgcactcaggcaacagaggagagcctgaatgcagcatgaaaacctggcggcagcgcaaaagatg

SEQ ID NO: 225475 - DNA, 103 bp, Artificial Sequence
  Synthetic Polynucleotide
taatacgactcactatagggttcgagcacaaggggcgttagcttcatgctaacagaggagaagcatgatgctaacgcccaacctggcggcagcgcaaaagatg

SEQ ID NO: 225476 - DNA, 103 bp, Artificial Sequence
  Synthetic Polynucleotide
taatacgactcactatagggtgccaaacacttcgagcacaaggggcgttaaacagaggagataacgcatgttgtgctcgaacctggcggcagcgcaaaagatg

SEQ ID NO: 225477 - DNA, 103 bp, Artificial Sequence
  Synthetic Polynucleotide
taatacgactcactataggggagatctcattgccaaacacttcgagcacaaacagaggagatgtgctatgagtgtttggaacctggcggcagcgcaaaagatg

SEQ ID NO: 225478 - DNA, 103 bp, Artificial Sequence
  Synthetic Polynucleotide
taatacgactcactatagggtcgcctgaagaagcctttgcagccttcacaaacagaggagatgtgaaatgtgcaaaggcaacctggcggcagcgcaaaagatg

SEQ ID NO: 225479 - DNA, 103 bp, Artificial Sequence
  Synthetic Polynucleotide
taatacgactcactataggggcttcatgcttcgcctgaagaagcctttgcaacagaggagagcaaagatgtcttcaggcaacctggcggcagcgcaaaagatg

SEQ ID NO: 225480 - DNA, 103 bp, Artificial Sequence
  Synthetic Polynucleotide
taatacgactcactatagggagtgccttccgcttcatgcttcgcctgaagaacagaggagacttcagatgaagcatgaaaacctggcggcagcgcaaaagatg

SEQ ID NO: 225481 - DNA, 103 bp, Artificial Sequence
  Synthetic Polynucleotide
taatacgactcactataggggcaggtgaatagtgccttccgcttcatgctaacagaggagaagcatgatgcggaaggcaaacctggcggcagcgcaaaagatg

SEQ ID NO: 225482 - DNA, 103 bp, Artificial Sequence
  Synthetic Polynucleotide
taatacgactcactatagggcgttgaaggggcaggtgaatagtgccttccaacagaggagaggaaggatgtattcacctaacctggcggcagcgcaaaagatg

SEQ ID NO: 225483 - DNA, 103 bp, Artificial Sequence
  Synthetic Polynucleotide
taatacgactcactatagggcggcagtccccgttgaaggggcaggtgaataacagaggagaattcacatgccccttcaaaacctggcggcagcgcaaaagatg

SEQ ID NO: 225484 - DNA, 103 bp, Artificial Sequence
  Synthetic Polynucleotide
taatacgactcactatagggcttggtgatgcggcagtccccgttgaagggaacagaggagacccttcatgggggactgcaacctggcggcagcgcaaaagatg

SEQ ID NO: 225485 - DNA, 103 bp, Artificial Sequence
  Synthetic Polynucleotide
taatacgactcactatagggcagggtcaggcagggaagtgctggccgccaaacagaggagatggcggatggcacttcccaacctggcggcagcgcaaaagatg

SEQ ID NO: 225486 - DNA, 103 bp, Artificial Sequence
  Synthetic Polynucleotide
taatacgactcactataggggtcggttgtccttggtgatgcggcagtcccaacagaggagagggactatggcatcaccaaacctggcggcagcgcaaaagatg

SEQ ID NO: 225487 - DNA, 103 bp, Artificial Sequence
  Synthetic Polynucleotide
taatacgactcactatagggtggcagtggcgtcggttgtccttggtgatgaacagaggagacatcacatgggacaaccgaacctggcggcagcgcaaaagatg

SEQ ID NO: 225488 - DNA, 103 bp, Artificial Sequence
  Synthetic Polynucleotide
taatacgactcactatagggccggcaggcctggcagtggcgtcggttgtcaacagaggagagacaacatgcgccactgcaacctggcggcagcgcaaaagatg

SEQ ID NO: 225489 - DNA, 103 bp, Artificial Sequence
  Synthetic Polynucleotide
taatacgactcactatagggagcgtttgagccggcaggcctggcagtggcaacagaggagagccactatgaggcctgccaacctggcggcagcgcaaaagatg

SEQ ID NO: 225490 - DNA, 103 bp, Artificial Sequence
  Synthetic Polynucleotide
taatacgactcactatagggatgtccacacagcgtttgagccggcaggccaacagaggagaggcctgatggctcaaacgaacctggcggcagcgcaaaagatg

SEQ ID NO: 225491 - DNA, 103 bp, Artificial Sequence
  Synthetic Polynucleotide
taatacgactcactatagggcatcatgccgatgtccacacagcgtttgagaacagaggagactcaaaatgtgtgtggacaacctggcggcagcgcaaaagatg

SEQ ID NO: 225492 - DNA, 103 bp, Artificial Sequence
  Synthetic Polynucleotide
taatacgactcactatagggtgaactccttcatcatgccgatgtccacacaacagaggagagtgtggatgtcggcatgaaacctggcggcagcgcaaaagatg

SEQ ID NO: 225493 - DNA, 103 bp, Artificial Sequence
  Synthetic Polynucleotide
taatacgactcactatagggtctgtcagaatgaactccttcatcatgccgaacagaggagacggcatatggaaggagttaacctggcggcagcgcaaaagatg

SEQ ID NO: 225494 - DNA, 103 bp, Artificial Sequence
  Synthetic Polynucleotide
taatacgactcactatagggcacttcctcatctgtcagaatgaactccttaacagaggagaaaggagatgattctgacaaacctggcggcagcgcaaaagatg

SEQ ID NO: 225495 - DNA, 103 bp, Artificial Sequence
  Synthetic Polynucleotide
taatacgactcactataggggcttcctctgcacttcctcatctgtcagaaaacagaggagattctgaatgatgaggaagaacctggcggcagcgcaaaagatg

SEQ ID NO: 225496 - DNA, 103 bp, Artificial Sequence
  Synthetic Polynucleotide
taatacgactcactatagggtcaaagtctccagggtcaggcagggaagtgaacagaggagacacttcatggcctgacccaacctggcggcagcgcaaaagatg

SEQ ID NO: 225497 - DNA, 103 bp, Artificial Sequence
  Synthetic Polynucleotide
taatacgactcactatagggatcatctcccgcttcctctgcacttcctcaaacagaggagatgaggaatggcagaggaaaacctggcggcagcgcaaaagatg

SEQ ID NO: 225498 - DNA, 103 bp, Artificial Sequence
  Synthetic Polynucleotide
taatacgactcactatagggccgcttcaggatcatctcccgcttcctctgaacagaggagacagaggatgcgggagatgaacctggcggcagcgcaaaagatg

SEQ ID NO: 225499 - DNA, 103 bp, Artificial Sequence
  Synthetic Polynucleotide
taatacgactcactatagggcctcctccttccgcttcaggatcatctcccaacagaggagagggagaatgtcctgaagcaacctggcggcagcgcaaaagatg

SEQ ID NO: 225500 - DNA, 103 bp, Artificial Sequence
  Synthetic Polynucleotide
taatacgactcactatagggttcaaggcctcctcctccttccgcttcaggaacagaggagacctgaaatggaaggaggaaacctggcggcagcgcaaaagatg

SEQ ID NO: 225501 - DNA, 103 bp, Artificial Sequence
  Synthetic Polynucleotide
taatacgactcactatagggcagactgtccttcaaggcctcctcctccttaacagaggagaaaggagatggaggccttgaacctggcggcagcgcaaaagatg

SEQ ID NO: 225502 - DNA, 103 bp, Artificial Sequence
  Synthetic Polynucleotide
taatacgactcactataggggcttgggccgcagactgtccttcaaggcctaacagaggagaaggcctatgaggacagtcaacctggcggcagcgcaaaagatg

SEQ ID NO: 225503 - DNA, 103 bp, Artificial Sequence
  Synthetic Polynucleotide
taatacgactcactatagggtcctcagacagcttgggccgcagactgtccaacagaggagaggacagatggcggcccaaaacctggcggcagcgcaaaagatg

SEQ ID NO: 225504 - DNA, 103 bp, Artificial Sequence
  Synthetic Polynucleotide
taatacgactcactataggggcgctgctgctcctcagacagcttgggccgaacagaggagacggcccatgctgtctgagaacctggcggcagcgcaaaagatg

SEQ ID NO: 225505 - DNA, 103 bp, Artificial Sequence
  Synthetic Polynucleotide
taatacgactcactatagggtggcaatgatgcgctgctgctcctcagacaaacagaggagatgtctgatgagcagcagcaacctggcggcagcgcaaaagatg

SEQ ID NO: 225506 - DNA, 103 bp, Artificial Sequence
  Synthetic Polynucleotide
taatacgactcactatagggtccagcagtatggcaatgatgcgctgctgcaacagaggagagcagcaatgcatcattgcaacctggcggcagcgcaaaagatg

SEQ ID NO: 225507 - DNA, 103 bp, Artificial Sequence
  Synthetic Polynucleotide
taatacgactcactatagggcacgttccggtcaaagtctccagggtcaggaacagaggagacctgacatgggagactttaacctggcggcagcgcaaaagatg

SEQ ID NO: 225508 - DNA, 103 bp, Artificial Sequence
  Synthetic Polynucleotide
taatacgactcactatagggatggtgggcgtccagcagtatggcaatgataacagaggagaatcattatgatactgctgaacctggcggcagcgcaaaagatg

SEQ ID NO: 225509 - DNA, 103 bp, Artificial Sequence
  Synthetic Polynucleotide
taatacgactcactatagggcgtaggtcttatggtgggcgtccagcagtaaacagaggagatactgcatgacgcccaccaacctggcggcagcgcaaaagatg

SEQ ID NO: 225510 - DNA, 103 bp, Artificial Sequence
  Synthetic Polynucleotide
taatacgactcactatagggtaggtggggtcgtaggtcttatggtgggcgaacagaggagacgcccaatgtaagacctaaacctggcggcagcgcaaaagatg

SEQ ID NO: 225511 - DNA, 103 bp, Artificial Sequence
  Synthetic Polynucleotide
taatacgactcactataggggaagtcggagtaggtggggtcgtaggtcttaacagaggagaaagaccatggaccccaccaacctggcggcagcgcaaaagatg

SEQ ID NO: 225512 - DNA, 103 bp, Artificial Sequence
  Synthetic Polynucleotide
taatacgactcactatagggggaactggcagaagtcggagtaggtggggtaacagaggagaaccccaatgactccgactaacctggcggcagcgcaaaagatg

SEQ ID NO: 225513 - DNA, 103 bp, Artificial Sequence
  Synthetic Polynucleotide
taatacgactcactatagggactggaggccggaactggcagaagtcggagaacagaggagactccgaatgctgccagttaacctggcggcagcgcaaaagatg

SEQ ID NO: 225514 - DNA, 103 bp, Artificial Sequence
  Synthetic Polynucleotide
taatacgactcactatagggattcacacgaactggaggccggaactggcaaacagaggagatgccagatgcggcctccaaacctggcggcagcgcaaaagatg

SEQ ID NO: 225515 - DNA, 103 bp, Artificial Sequence
  Synthetic Polynucleotide
taatacgactcactatagggctccaccatcattcacacgaactggaggccaacagaggagaggcctcatgttcgtgtgaaacctggcggcagcgcaaaagatg

SEQ ID NO: 225516 - DNA, 103 bp, Artificial Sequence
  Synthetic Polynucleotide
taatacgactcactatagggggatggctccctccaccatcattcacacgaaacagaggagatcgtgtatgtgatggtggaacctggcggcagcgcaaaagatg

SEQ ID NO: 225517 - DNA, 103 bp, Artificial Sequence
  Synthetic Polynucleotide
taatacgactcactataggggggcctggaaggatggctccctccaccatcaacagaggagagatggtatggggagccataacctggcggcagcgcaaaagatg

SEQ ID NO: 225518 - DNA, 103 bp, Artificial Sequence
  Synthetic Polynucleotide
taatacgactcactatagggagatccggggcacgttccggtcaaagtctcaacagaggagagagactatgaccggaacgaacctggcggcagcgcaaaagatg

SEQ ID NO: 225519 - DNA, 103 bp, Artificial Sequence
  Synthetic Polynucleotide
taatacgactcactataggggtctggagttgggcctggaaggatggctccaacagaggagaggagccatgcttccaggcaacctggcggcagcgcaaaagatg

SEQ ID NO: 225520 - DNA, 103 bp, Artificial Sequence
  Synthetic Polynucleotide
taatacgactcactatagggctgggagtgtgtctggagttgggcctggaaaacagaggagattccagatgcaactccagaacctggcggcagcgcaaaagatg

SEQ ID NO: 225521 - DNA, 103 bp, Artificial Sequence
  Synthetic Polynucleotide
taatacgactcactatagggcccagagaagctgggagtgtgtctggagttaacagaggagaaactccatgcacactcccaacctggcggcagcgcaaaagatg

SEQ ID NO: 225522 - DNA, 103 bp, Artificial Sequence
  Synthetic Polynucleotide
taatacgactcactatagggaggaggagtccccagagaagctgggagtgtaacagaggagaacactcatggcttctctgaacctggcggcagcgcaaaagatg

SEQ ID NO: 225523 - DNA, 103 bp, Artificial Sequence
  Synthetic Polynucleotide
taatacgactcactataggggagcaggaggaggaggagtccccagagaagaacagaggagacttctcatgggactcctcaacctggcggcagcgcaaaagatg

SEQ ID NO: 225524 - DNA, 103 bp, Artificial Sequence
  Synthetic Polynucleotide
taatacgactcactatagggacagtgatctgagcaggaggaggaggagtcaacagaggagagactccatgtcctcctgcaacctggcggcagcgcaaaagatg

SEQ ID NO: 225525 - DNA, 103 bp, Artificial Sequence
  Synthetic Polynucleotide
taatacgactcactatagggaagaggtgatacagtgatctgagcaggaggaacagaggagacctcctatgcagatcactaacctggcggcagcgcaaaagatg

SEQ ID NO: 225526 - DNA, 103 bp, Artificial Sequence
  Synthetic Polynucleotide
taatacgactcactatagggatcatgtctgaagaggtgatacagtgatctaacagaggagaagatcaatgtatcacctcaacctggcggcagcgcaaaagatg

SEQ ID NO: 225527 - DNA, 103 bp, Artificial Sequence
  Synthetic Polynucleotide
taatacgactcactatagggggacgagtccatcatgtctgaagaggtgataacagaggagaatcaccatgtcagacatgaacctggcggcagcgcaaaagatg

SEQ ID NO: 225528 - DNA, 103 bp, Artificial Sequence
  Synthetic Polynucleotide
taatacgactcactatagggtggagaagctggacgagtccatcatgtctgaacagaggagacagacaatgtggactcgtaacctggcggcagcgcaaaagatg

SEQ ID NO: 225529 - DNA, 103 bp, Artificial Sequence
  Synthetic Polynucleotide
taatacgactcactatagggcacaccccacagatccggggcacgttccggaacagaggagaccggaaatggccccggataacctggcggcagcgcaaaagatg

SEQ ID NO: 225530 - DNA, 103 bp, Artificial Sequence
  Synthetic Polynucleotide
taatacgactcactatagggagatccagattggagaagctggacgagtccaacagaggagaggactcatgcagcttctcaacctggcggcagcgcaaaagatg

SEQ ID NO: 225531 - DNA, 103 bp, Artificial Sequence
  Synthetic Polynucleotide
taatacgactcactatagggttcttcactcagatccagattggagaagctaacagaggagaagcttcatgaatctggataacctggcggcagcgcaaaagatg

SEQ ID NO: 225532 - DNA, 103 bp, Artificial Sequence
  Synthetic Polynucleotide
taatacgactcactatagggcatctgaatcttcttcactcagatccagataacagaggagaatctggatgtgagtgaagaacctggcggcagcgcaaaagatg

SEQ ID NO: 225533 - DNA, 103 bp, Artificial Sequence
  Synthetic Polynucleotide
taatacgactcactatagggacagaagggtcatctgaatcttcttcactcaacagaggagagagtgaatgagattcagaaacctggcggcagcgcaaaagatg

SEQ ID NO: 225534 - DNA, 103 bp, Artificial Sequence
  Synthetic Polynucleotide
taatacgactcactatagggctctagggtcacagaagggtcatctgaatcaacagaggagagattcaatggacccttctaacctggcggcagcgcaaaagatg

SEQ ID NO: 225535 - DNA, 103 bp, Artificial Sequence
  Synthetic Polynucleotide
taatacgactcactataggggctgggacagctctagggtcacagaagggtaacagaggagaacccttatgtgaccctagaacctggcggcagcgcaaaagatg

SEQ ID NO: 225536 - DNA, 103 bp, Artificial Sequence
  Synthetic Polynucleotide
taatacgactcactatagggagcatggagagctgggacagctctagggtcaacagaggagagaccctatggctgtcccaaacctggcggcagcgcaaaagatg

SEQ ID NO: 225537 - DNA, 103 bp, Artificial Sequence
  Synthetic Polynucleotide
taatacgactcactatagggcaggtggggcagcatggagagctgggacagaacagaggagactgtccatgctctccatgaacctggcggcagcgcaaaagatg

SEQ ID NO: 225538 - DNA, 103 bp, Artificial Sequence
  Synthetic Polynucleotide
taatacgactcactatagggccaggtcagccaggtggggcagcatggagaaacagaggagatctccaatgtgccccaccaacctggcggcagcgcaaaagatg

SEQ ID NO: 225539 - DNA, 103 bp, Artificial Sequence
  Synthetic Polynucleotide
taatacgactcactatagggctgtaactgaccaggtcagccaggtggggcaacagaggagagccccaatgggctgacctaacctggcggcagcgcaaaagatg

SEQ ID NO: 225540 - DNA, 103 bp, Artificial Sequence
  Synthetic Polynucleotide
taatacgactcactatagggtcggtctccacacaccccacagatccggggaacagaggagaccccggatgtgtggggtgaacctggcggcagcgcaaaagatg

SEQ ID NO: 225541 - DNA, 103 bp, Artificial Sequence
  Synthetic Polynucleotide
taatacgactcactatagggcttttggatgctgtaactgaccaggtcagcaacagaggagagctgacatggtcagttacaacctggcggcagcgcaaaagatg

SEQ ID NO: 225542 - DNA, 103 bp, Artificial Sequence
  Synthetic Polynucleotide
taatacgactcactatagggagccaatgaccttttggatgctgtaactgaaacagaggagatcagttatggcatccaaaaacctggcggcagcgcaaaagatg

SEQ ID NO: 225543 - DNA, 103 bp, Artificial Sequence
  Synthetic Polynucleotide
taatacgactcactatagggatcttagcaaagccaatgaccttttggatgaacagaggagacatccaatgggtcattggaacctggcggcagcgcaaaagatg

SEQ ID NO: 225544 - DNA, 103 bp, Artificial Sequence
  Synthetic Polynucleotide
taatacgactcactatagggtcctggtatcatcttagcaaagccaatgacaacagaggagagtcattatgtttgctaagaacctggcggcagcgcaaaagatg

SEQ ID NO: 225545 - DNA, 103 bp, Artificial Sequence
  Synthetic Polynucleotide
taatacgactcactatagggggtctctgaatcctggtatcatcttagcaaaacagaggagattgctaatgtgataccagaacctggcggcagcgcaaaagatg

SEQ ID NO: 225546 - DNA, 103 bp, Artificial Sequence
  Synthetic Polynucleotide
taatacgactcactatagggtcagaggtgaggtctctgaatcctggtatcaacagaggagagataccatgattcagagaaacctggcggcagcgcaaaagatg

SEQ ID NO: 225547 - DNA, 103 bp, Artificial Sequence
  Synthetic Polynucleotide
taatacgactcactataggggatctggtcctcagaggtgaggtctctgaaaacagaggagattcagaatgctcacctctaacctggcggcagcgcaaaagatg

SEQ ID NO: 225548 - DNA, 103 bp, Artificial Sequence
  Synthetic Polynucleotide
taatacgactcactatagggtcagcagtacgatctggtcctcagaggtgaaacagaggagatcacctatgaggaccagaaacctggcggcagcgcaaaagatg

SEQ ID NO: 225549 - DNA, 103 bp, Artificial Sequence
  Synthetic Polynucleotide
taatacgactcactataggggcacttgacttcagcagtacgatctggtccaacagaggagaggaccaatgcgtactgctaacctggcggcagcgcaaaagatg

SEQ ID NO: 225550 - DNA, 103 bp, Artificial Sequence
  Synthetic Polynucleotide
taatacgactcactataggggacctcaatggcacttgacttcagcagtacaacagaggagagtactgatgaagtcaagtaacctggcggcagcgcaaaagatg

SEQ ID NO: 225551 - DNA, 103 bp, Artificial Sequence
  Synthetic Polynucleotide
taatacgactcactatagggagccagtggctcggtctccacacaccccacaacagaggagagtggggatggtggagaccaacctggcggcagcgcaaaagatg

SEQ ID NO: 225552 - DNA, 103 bp, Artificial Sequence
  Synthetic Polynucleotide
taatacgactcactataggggcaacatgatgacctcaatggcacttgactaacagaggagaagtcaaatgccattgaggaacctggcggcagcgcaaaagatg

SEQ ID NO: 225553 - DNA, 103 bp, Artificial Sequence
  Synthetic Polynucleotide
taatacgactcactatagggtcattggagcgcaacatgatgacctcaatgaacagaggagacattgaatgcatcatgttaacctggcggcagcgcaaaagatg

SEQ ID NO: 225554 - DNA, 103 bp, Artificial Sequence
  Synthetic Polynucleotide
taatacgactcactatagggggtgaaggactcattggagcgcaacatgataacagaggagaatcatgatgcgctccaataacctggcggcagcgcaaaagatg

SEQ ID NO: 225555 - DNA, 103 bp, Artificial Sequence
  Synthetic Polynucleotide
taatacgactcactatagggtgtcgtccatggtgaaggactcattggagcaacagaggagagctccaatgagtccttcaaacctggcggcagcgcaaaagatg

SEQ ID NO: 225556 - DNA, 103 bp, Artificial Sequence
  Synthetic Polynucleotide
taatacgactcactataggggtccaggacatgtcgtccatggtgaaggacaacagaggagagtccttatgcatggacgaaacctggcggcagcgcaaaagatg

SEQ ID NO: 225557 - DNA, 103 bp, Artificial Sequence
  Synthetic Polynucleotide
taatacgactcactataggggttgccacaggtccaggacatgtcgtccataacagaggagaatggacatgatgtcctggaacctggcggcagcgcaaaagatg

SEQ ID NO: 225558 - DNA, 103 bp, Artificial Sequence
  Synthetic Polynucleotide
taatacgactcactatagggtgtagtcttggttgccacaggtccaggacaaacagaggagatgtcctatgcctgtggcaaacctggcggcagcgcaaaagatg

SEQ ID NO: 225559 - DNA, 103 bp, Artificial Sequence
  Synthetic Polynucleotide
taatacgactcactatagggacgcggtacttgtagtcttggttgccacagaacagaggagactgtggatgccaagactaaacctggcggcagcgcaaaagatg

SEQ ID NO: 225560 - DNA, 103 bp, Artificial Sequence
  Synthetic Polynucleotide
taatacgactcactatagggcacgtcactgacgcggtacttgtagtcttgaacagaggagacaagacatgaagtaccgcaacctggcggcagcgcaaaagatg

SEQ ID NO: 225561 - DNA, 103 bp, Artificial Sequence
  Synthetic Polynucleotide
taatacgactcactatagggcggctttggtcacgtcactgacgcggtactaacagaggagaagtaccatgtcagtgacgaacctggcggcagcgcaaaagatg

SEQ ID NO: 225562 - DNA, 103 bp, Artificial Sequence
  Synthetic Polynucleotide
taatacgactcactatagggttgaagtgaaagccagtggctcggtctccaaacagaggagatggagaatgagccactggaacctggcggcagcgcaaaagatg

SEQ ID NO: 225563 - DNA, 103 bp, Artificial Sequence
  Synthetic Polynucleotide
taatacgactcactatagggaggctgtgtccggctttggtcacgtcactgaacagaggagacagtgaatggaccaaagcaacctggcggcagcgcaaaagatg

SEQ ID NO: 225564 - DNA, 103 bp, Artificial Sequence
  Synthetic Polynucleotide
taatacgactcactatagggaatcagctccaggctgtgtccggctttggtaacagaggagaaccaaaatgggacacagcaacctggcggcagcgcaaaagatg

SEQ ID NO: 225565 - DNA, 103 bp, Artificial Sequence
  Synthetic Polynucleotide
taatacgactcactatagggtgaggggctcaatcagctccaggctgtgtcaacagaggagagacacaatgtggagctgaaacctggcggcagcgcaaaagatg

SEQ ID NO: 225566 - DNA, 103 bp, Artificial Sequence
  Synthetic Polynucleotide
taatacgactcactatagggtggaacttgatgaggggctcaatcagctccaacagaggagaggagctatgtgagcccctaacctggcggcagcgcaaaagatg

SEQ ID NO: 225567 - DNA, 103 bp, Artificial Sequence
  Synthetic Polynucleotide
taatacgactcactatagggcagtcccacctggaacttgatgaggggctcaacagaggagagagcccatgatcaagttcaacctggcggcagcgcaaaagatg

SEQ ID NO: 225568 - DNA, 103 bp, Artificial Sequence
  Synthetic Polynucleotide
taatacgactcactatagggtcagcttcttcagtcccacctggaacttgaaacagaggagatcaagtatgaggtgggacaacctggcggcagcgcaaaagatg

SEQ ID NO: 225569 - DNA, 103 bp, Artificial Sequence
  Synthetic Polynucleotide
taatacgactcactatagggtcatgcaagttcagcttcttcagtcccaccaacagaggagaggtgggatggaagaagctaacctggcggcagcgcaaaagatg

SEQ ID NO: 225570 - DNA, 103 bp, Artificial Sequence
  Synthetic Polynucleotide
taatacgactcactatagggatgctcctcctcatgcaagttcagcttcttaacagaggagaaagaagatgaacttgcataacctggcggcagcgcaaaagatg

SEQ ID NO: 225571 - DNA, 103 bp, Artificial Sequence
  Synthetic Polynucleotide
taatacgactcactatagggtgagcaggacatgctcctcctcatgcaagtaacagaggagaacttgcatgaggaggagcaacctggcggcagcgcaaaagatg

SEQ ID NO: 225572 - DNA, 103 bp, Artificial Sequence
  Synthetic Polynucleotide
taatacgactcactatagggcagatggccatgagcaggacatgctcctccaacagaggagaggaggaatgtgtcctgctaacctggcggcagcgcaaaagatg

SEQ ID NO: 225573 - DNA, 103 bp, Artificial Sequence
  Synthetic Polynucleotide
taatacgactcactataggggaacaggaacgcggtccagttggcctccataacagaggagaatggagatgaactggaccaacctggcggcagcgcaaaagatg

SEQ ID NO: 225574 - DNA, 103 bp, Artificial Sequence
  Synthetic Polynucleotide
taatacgactcactatagggctgatcagggggctccacggcagagctcagaacagaggagactgagcatggccgtggagaacctggcggcagcgcaaaagatg

SEQ ID NO: 225575 - DNA, 103 bp, Artificial Sequence
  Synthetic Polynucleotide
taatacgactcactatagggctgctgctgctgcttttggttactggtctcaacagaggagagagaccatgaaccaaaagaacctggcggcagcgcaaaagatg

SEQ ID NO: 225576 - DNA, 103 bp, Artificial Sequence
  Synthetic Polynucleotide
taatacgactcactataggggctgctgctgctgctgctgctgcttttggtaacagaggagaaccaaaatgagcagcagcaacctggcggcagcgcaaaagatg

SEQ ID NO: 225577 - DNA, 103 bp, Artificial Sequence; identical to SEQ ID NO: 88553
  Synthetic Polynucleotide

SEQ ID NO: 225578 - DNA, 103 bp, Artificial Sequence
  Synthetic Polynucleotide
taatacgactcactatagggttgttgctgctgctgctgctgctgctgctgaacagaggagacagcagatgcagcagcagaacctggcggcagcgcaaaagatg

SEQ ID NO: 225579 - DNA, 103 bp, Artificial Sequence
  Synthetic Polynucleotide
taatacgactcactataggggttgttgttgttgttgctgctgctgctgctaacagaggagaagcagcatgagcagcaacaacctggcggcagcgcaaaagatg

SEQ ID NO: 225580 - DNA, 103 bp, Artificial Sequence
  Synthetic Polynucleotide
taatacgactcactataggggtcacatgttgttgttgttgttgttgctgcaacagaggagagcagcaatgacaacaacaaacctggcggcagcgcaaaagatg

SEQ ID NO: 225581 - DNA, 103 bp, Artificial Sequence
  Synthetic Polynucleotide
taatacgactcactatagggtggccagcttgtcacatgttgttgttgttgaacagaggagacaacaaatgcaacatgtgaacctggcggcagcgcaaaagatg

SEQ ID NO: 225582 - DNA, 103 bp, Artificial Sequence
  Synthetic Polynucleotide
taatacgactcactatagggcttgcttccctggccagcttgtcacatgttaacagaggagaaacatgatgcaagctggcaacctggcggcagcgcaaaagatg

SEQ ID NO: 225583 - DNA, 103 bp, Artificial Sequence
  Synthetic Polynucleotide
taatacgactcactatagggagtgtttctacttgcttccctggccagcttaacagaggagaaagctgatgagggaagcaaacctggcggcagcgcaaaagatg

SEQ ID NO: 225584 - DNA, 103 bp, Artificial Sequence
  Synthetic Polynucleotide
taatacgactcactatagggccacagtctcagtgtttctacttgcttcccaacagaggagagggaagatggtagaaacaaacctggcggcagcgcaaaagatg

SEQ ID NO: 225585 - DNA, 103 bp, Artificial Sequence
  Synthetic Polynucleotide
taatacgactcactataggggcaatggtttctgatcagggggctccacggaacagaggagaccgtggatgcccctgatcaacctggcggcagcgcaaaagatg

SEQ ID NO: 225586 - DNA, 103 bp, Artificial Sequence
  Synthetic Polynucleotide
taatacgactcactatagggcagcttcttcccacagtctcagtgtttctaaacagaggagatagaaaatgtgagactgtaacctggcggcagcgcaaaagatg

SEQ ID NO: 225587 - DNA, 103 bp, Artificial Sequence
  Synthetic Polynucleotide
taatacgactcactatagggcttgctttaacagcttcttcccacagtctcaacagaggagagagactatgggaagaagcaacctggcggcagcgcaaaagatg

SEQ ID NO: 225588 - DNA, 103 bp, Artificial Sequence
  Synthetic Polynucleotide
taatacgactcactatagggttctttcttccttgctttaacagcttcttcaacagaggagagaagaaatggttaaagcaaacctggcggcagcgcaaaagatg

SEQ ID NO: 225589 - DNA, 103 bp, Artificial Sequence
  Synthetic Polynucleotide
taatacgactcactatagggggttagcagcttctttcttccttgctttaaaacagaggagattaaagatgggaagaaagaacctggcggcagcgcaaaagatg

SEQ ID NO: 225590 - DNA, 103 bp, Artificial Sequence
  Synthetic Polynucleotide
taatacgactcactataggggtttggcacaggttagcagcttctttcttcaacagaggagagaagaaatgagctgctaaaacctggcggcagcgcaaaagatg

SEQ ID NO: 225591 - DNA, 103 bp, Artificial Sequence
  Synthetic Polynucleotide
taatacgactcactatagggagccgtggaggtttggcacaggttagcagcaacagaggagagctgctatgctgtgccaaaacctggcggcagcgcaaaagatg

SEQ ID NO: 225592 - DNA, 103 bp, Artificial Sequence
  Synthetic Polynucleotide
taatacgactcactataggggtgtcgtagcagccgtggaggtttggcacaaacagaggagatgtgccatgcctccacggaacctggcggcagcgcaaaagatg

SEQ ID NO: 225593 - DNA, 103 bp, Artificial Sequence
  Synthetic Polynucleotide
taatacgactcactatagggagagtcacaggtgtcgtagcagccgtggagaacagaggagactccacatgtgctacgacaacctggcggcagcgcaaaagatg

SEQ ID NO: 225594 - DNA, 103 bp, Artificial Sequence
  Synthetic Polynucleotide
taatacgactcactatagggtggagtagtgagagtcacaggtgtcgtagcaacagaggagagctacgatgcctgtgactaacctggcggcagcgcaaaagatg

SEQ ID NO: 225595 - DNA, 103 bp, Artificial Sequence
  Synthetic Polynucleotide
taatacgactcactatagggttatactgaatggagtagtgagagtcacagaacagaggagactgtgaatgtcactactcaacctggcggcagcgcaaaagatg

SEQ ID NO: 225596 - DNA, 103 bp, Artificial Sequence
  Synthetic Polynucleotide
taatacgactcactatagggggtattggaagcaatggtttctgatcagggaacagaggagaccctgaatggaaaccattaacctggcggcagcgcaaaagatg

SEQ ID NO: 225597 - DNA, 103 bp, Artificial Sequence
  Synthetic Polynucleotide
taatacgactcactatagggacagaggatgttatactgaatggagtagtgaacagaggagacactacatgattcagtataacctggcggcagcgcaaaagatg

SEQ ID NO: 225598 - DNA, 103 bp, Artificial Sequence
  Synthetic Polynucleotide
taatacgactcactatagggcccagacgacacagaggatgttatactgaaaacagaggagattcagtatgacatcctctaacctggcggcagcgcaaaagatg

SEQ ID NO: 225599 - DNA, 103 bp, Artificial Sequence
  Synthetic Polynucleotide
taatacgactcactatagggttgacatagtcccagacgacacagaggatgaacagaggagacatcctatgtgtcgtctgaacctggcggcagcgcaaaagatg

SEQ ID NO: 225600 - DNA, 103 bp, Artificial Sequence
  Synthetic Polynucleotide
taatacgactcactataggggtgactgggtttgacatagtcccagacgacaacagaggagagtcgtcatggactatgtcaacctggcggcagcgcaaaagatg

SEQ ID NO: 225601 - DNA, 103 bp, Artificial Sequence
  Synthetic Polynucleotide
taatacgactcactatagggagctgccactgtgactgggtttgacatagtaacagaggagaactatgatgaacccagtcaacctggcggcagcgcaaaagatg

SEQ ID NO: 225602 - DNA, 103 bp, Artificial Sequence
  Synthetic Polynucleotide
taatacgactcactatagggtgctcattgcagctgccactgtgactgggtaacagaggagaacccagatgcagtggcagaacctggcggcagcgcaaaagatg

SEQ ID NO: 225603 - DNA, 103 bp, Artificial Sequence
  Synthetic Polynucleotide
taatacgactcactatagggggacttctcatgctcattgcagctgccactaacagaggagaagtggcatgtgcaatgagaacctggcggcagcgcaaaagatg

SEQ ID NO: 225604 - DNA, 103 bp, Artificial Sequence
  Synthetic Polynucleotide
taatacgactcactatagggaacatttactggacttctcatgctcattgcaacagaggagagcaatgatgatgagaagtaacctggcggcagcgcaaaagatg

SEQ ID NO: 225605 - DNA, 103 bp, Artificial Sequence
  Synthetic Polynucleotide
taatacgactcactatagggctgcacttgaaacatttactggacttctcaaacagaggagatgagaaatgcagtaaatgaacctggcggcagcgcaaaagatg

SEQ ID NO: 225606 - DNA, 103 bp, Artificial Sequence
  Synthetic Polynucleotide
taatacgactcactataggggttatgttaactgcacttgaaacatttactaacagaggagaagtaaaatgttcaagtgcaacctggcggcagcgcaaaagatg

SEQ ID NO: 225607 - DNA, 103 bp, Artificial Sequence
  Synthetic Polynucleotide
taatacgactcactatagggctgagttattggtattggaagcaatggtttaacagaggagaaaaccaatgcttccaataaacctggcggcagcgcaaaagatg

SEQ ID NO: 225608 - DNA, 103 bp, Artificial Sequence
  Synthetic Polynucleotide
taatacgactcactatagggcattgggctggttatgttaactgcacttgaaacagaggagatcaagtatggttaacataaacctggcggcagcgcaaaagatg

SEQ ID NO: 225609 - DNA, 103 bp, Artificial Sequence
  Synthetic Polynucleotide
taatacgactcactataggggccctatgttcattgggctggttatgttaaaacagaggagattaacaatgccagcccaaaacctggcggcagcgcaaaagatg

SEQ ID NO: 225610 - DNA, 103 bp, Artificial Sequence
  Synthetic Polynucleotide
taatacgactcactataggggttacaggatgccctatgttcattgggctgaacagaggagacagcccatggaacataggaacctggcggcagcgcaaaagatg

SEQ ID NO: 225611 - DNA, 103 bp, Artificial Sequence
  Synthetic Polynucleotide
taatacgactcactatagggactggttatagttacaggatgccctatgttaacagaggagaaacataatgcatcctgtaaacctggcggcagcgcaaaagatg

SEQ ID NO: 225612 - DNA, 103 bp, Artificial Sequence
  Synthetic Polynucleotide
taatacgactcactatagggtggataatggactggttatagttacaggataacagaggagaatcctgatgctataaccaaacctggcggcagcgcaaaagatg

SEQ ID NO: 225613 - DNA, 103 bp, Artificial Sequence
  Synthetic Polynucleotide
taatacgactcactatagggggagaggtcatggataatggactggttataaacagaggagatataacatgtccattatcaacctggcggcagcgcaaaagatg

SEQ ID NO: 225614 - DNA, 103 bp, Artificial Sequence
  Synthetic Polynucleotide
taatacgactcactataggggagtgttaaaggagaggtcatggataatggaacagaggagaccattaatgatgacctctaacctggcggcagcgcaaaagatg

SEQ ID NO: 225615 - DNA, 103 bp, Artificial Sequence
  Synthetic Polynucleotide
taatacgactcactatagggctggggtagtgagtgttaaaggagaggtcaaacagaggagatgacctatgctttaacacaacctggcggcagcgcaaaagatg

SEQ ID NO: 225616 - DNA, 103 bp, Artificial Sequence
  Synthetic Polynucleotide
taatacgactcactataggggggaggttgactggggtagtgagtgttaaaaacagaggagatttaacatgcactaccccaacctggcggcagcgcaaaagatg

SEQ ID NO: 225617 - DNA, 103 bp, Artificial Sequence
  Synthetic Polynucleotide
taatacgactcactataggggacgggggtggggaggttgactggggtagtaacagaggagaactaccatggtcaacctcaacctggcggcagcgcaaaagatg

SEQ ID NO: 225618 - DNA, 103 bp, Artificial Sequence
  Synthetic Polynucleotide
taatacgactcactatagggcctgaggtttctgagttattggtattggaaaacagaggagattccaaatgcaataactcaacctggcggcagcgcaaaagatg

SEQ ID NO: 225619 - DNA, 103 bp, Artificial Sequence
  Synthetic Polynucleotide
taatacgactcactatagggctggggcagtgacgggggtggggaggttgaaacagaggagatcaaccatgccacccccgaacctggcggcagcgcaaaagatg

SEQ ID NO: 225620 - DNA, 103 bp, Artificial Sequence
  Synthetic Polynucleotide
taatacgactcactataggggctatattcactggggcagtgacgggggtgaacagaggagacaccccatgcactgccccaacctggcggcagcgcaaaagatg

SEQ ID NO: 225621 - DNA, 103 bp, Artificial Sequence
  Synthetic Polynucleotide
taatacgactcactataggggacagggtgtgctatattcactggggcagtaacagaggagaactgccatggtgaatataaacctggcggcagcgcaaaagatg

SEQ ID NO: 225622 - DNA, 103 bp, Artificial Sequence
  Synthetic Polynucleotide
taatacgactcactatagggatgtgatggtgacagggtgtgctatattcaaacagaggagatgaataatgcacaccctgaacctggcggcagcgcaaaagatg

SEQ ID NO: 225623 - DNA, 103 bp, Artificial Sequence
  Synthetic Polynucleotide
taatacgactcactatagggttcattggagatgtgatggtgacagggtgtaacagaggagaacacccatgcaccatcacaacctggcggcagcgcaaaagatg

SEQ ID NO: 225624 - DNA, 103 bp, Artificial Sequence
  Synthetic Polynucleotide
taatacgactcactatagggtgtgggtagattcattggagatgtgatggtaacagaggagaaccatcatgtctccaatgaacctggcggcagcgcaaaagatg

SEQ ID NO: 225625 - DNA, 103 bp, Artificial Sequence
  Synthetic Polynucleotide
taatacgactcactatagggatgtcataggtgtgggtagattcattggagaacagaggagactccaaatgatctacccaaacctggcggcagcgcaaaagatg

SEQ ID NO: 225626 - DNA, 103 bp, Artificial Sequence
  Synthetic Polynucleotide
taatacgactcactatagggggggcggctaatgtcataggtgtgggtagaaacagaggagatctaccatgacctatgacaacctggcggcagcgcaaaagatg

SEQ ID NO: 225627 - DNA, 103 bp, Artificial Sequence
  Synthetic Polynucleotide
taatacgactcactatagggtatattgagaggggcggctaatgtcataggaacagaggagacctatgatgttagccgccaacctggcggcagcgcaaaagatg

SEQ ID NO: 225628 - DNA, 103 bp, Artificial Sequence
  Synthetic Polynucleotide
taatacgactcactataggggtctcattgctatattgagaggggcggctaaacagaggagatagccgatgctctcaataaacctggcggcagcgcaaaagatg

SEQ ID NO: 225629 - DNA, 103 bp, Artificial Sequence
  Synthetic Polynucleotide
taatacgactcactatagggtctggtgcaccctgaggtttctgagttattaacagaggagaaataacatggaaacctcaaacctggcggcagcgcaaaagatg

SEQ ID NO: 225630 - DNA, 103 bp, Artificial Sequence
  Synthetic Polynucleotide
taatacgactcactatagggctctctacaggtctcattgctatattgagaaacagaggagatctcaaatgagcaatgagaacctggcggcagcgcaaaagatg

SEQ ID NO: 225631 - DNA, 103 bp, Artificial Sequence
  Synthetic Polynucleotide
taatacgactcactataggggaaaggcatgctctctacaggtctcattgcaacagaggagagcaatgatgcctgtagagaacctggcggcagcgcaaaagatg

SEQ ID NO: 225632 - DNA, 103 bp, Artificial Sequence
  Synthetic Polynucleotide
taatacgactcactatagggcttggggcaagaaaggcatgctctctacagaacagaggagactgtagatggcatgccttaacctggcggcagcgcaaaagatg

SEQ ID NO: 225633 - DNA, 103 bp, Artificial Sequence
  Synthetic Polynucleotide
taatacgactcactataggggtaggcaaagcttggggcaagaaaggcatgaacagaggagacatgccatgcttgccccaaacctggcggcagcgcaaaagatg

SEQ ID NO: 225634 - DNA, 103 bp, Artificial Sequence
  Synthetic Polynucleotide
taatacgactcactatagggaggcggtgatgtaggcaaagcttggggcaaaacagaggagattgcccatggctttgcctaacctggcggcagcgcaaaagatg

SEQ ID NO: 225635 - DNA, 103 bp, Artificial Sequence
  Synthetic Polynucleotide
taatacgactcactatagggctttaatgtttctggtgcaccctgaggtttaacagaggagaaaacctatgggtgcaccaaacctggcggcagcgcaaaagatg

SEQ ID NO: 225636 - DNA, 103 bp, Artificial Sequence
  Synthetic Polynucleotide
taatacgactcactatagggcaatggcatcctttaatgtttctggtgcacaacagaggagagtgcacatgaaacattaaaacctggcggcagcgcaaaagatg

SEQ ID NO: 225637 - DNA, 103 bp, Artificial Sequence
  Synthetic Polynucleotide
taatacgactcactatagggtttttaatcccaatggcatcctttaatgttaacagaggagaaacattatgggatgccataacctggcggcagcgcaaaagatg

SEQ ID NO: 225638 - DNA, 103 bp, Artificial Sequence
  Synthetic Polynucleotide
taatacgactcactataggggggtttttcttttttaatcccaatggcatcaacagaggagagatgccatggggattaaaaacctggcggcagcgcaaaagatg

SEQ ID NO: 225639 - DNA, 103 bp, Artificial Sequence
  Synthetic Polynucleotide
taatacgactcactatagggcatgggcctggaacaggaacgcggtccagtaacagaggagaactggaatgcgttcctgtaacctggcggcagcgcaaaagatg

SEQ ID NO: 225640 - DNA, 103 bp, Artificial Sequence
  Synthetic Polynucleotide
taatacgactcactatagggatgaagttttgggtttttcttttttaatccaacagaggagaggattaatgaagaaaaacaacctggcggcagcgcaaaagatg

SEQ ID NO: 225641 - DNA, 103 bp, Artificial Sequence
  Synthetic Polynucleotide
taatacgactcactataggggtgcacacaaatgaagttttgggtttttctaacagaggagaagaaaaatgcaaaacttcaacctggcggcagcgcaaaagatg

SEQ ID NO: 225642 - DNA, 103 bp, Artificial Sequence
  Synthetic Polynucleotide
taatacgactcactatagggactgcagtaagtgcacacaaatgaagttttaacagaggagaaaaactatgtttgtgtgcaacctggcggcagcgcaaaagatg

SEQ ID NO: 225643 - DNA, 103 bp, Artificial Sequence
  Synthetic Polynucleotide
taatacgactcactatagggtgaaagctttactgcagtaagtgcacacaaaacagaggagattgtgtatgcttactgcaaacctggcggcagcgcaaaagatg

SEQ ID NO: 225644 - DNA, 103 bp, Artificial Sequence
  Synthetic Polynucleotide
taatacgactcactatagggtagctgtccctgaaagctttactgcagtaaaacagaggagattactgatgtaaagctttaacctggcggcagcgcaaaagatg

SEQ ID NO: 225645 - DNA, 103 bp, Artificial Sequence
  Synthetic Polynucleotide
taatacgactcactatagggcctcaggtgatagctgtccctgaaagctttaacagaggagaaaagctatgagggacagcaacctggcggcagcgcaaaagatg

SEQ ID NO: 225646 - DNA, 103 bp, Artificial Sequence
  Synthetic Polynucleotide
taatacgactcactatagggattcgtggcgcctcaggtgatagctgtcccaacagaggagagggacaatgatcacctgaaacctggcggcagcgcaaaagatg

SEQ ID NO: 225647 - DNA, 103 bp, Artificial Sequence
  Synthetic Polynucleotide
taatacgactcactataggggtgtggcaggattcgtggcgcctcaggtgaaacagaggagatcacctatggcgccacgaaacctggcggcagcgcaaaagatg

SEQ ID NO: 225648 - DNA, 103 bp, Artificial Sequence
  Synthetic Polynucleotide
taatacgactcactatagggcttgatccctgtgtggcaggattcgtggcgaacagaggagacgccacatgtcctgccacaacctggcggcagcgcaaaagatg

SEQ ID NO: 225649 - DNA, 103 bp, Artificial Sequence
  Synthetic Polynucleotide
taatacgactcactataggggggacaccaacttgatccctgtgtggcaggaacagaggagacctgccatgcagggatcaaacctggcggcagcgcaaaagatg

SEQ ID NO: 225650 - DNA, 103 bp, Artificial Sequence
  Synthetic Polynucleotide
taatacgactcactatagggtgggaagcttcatgggcctggaacaggaacaacagaggagagttcctatgccaggcccaaacctggcggcagcgcaaaagatg

SEQ ID NO: 225651 - DNA, 103 bp, Artificial Sequence
  Synthetic Polynucleotide
taatacgactcactatagggttctttggccgggacaccaacttgatccctaacagaggagaagggatatggttggtgtcaacctggcggcagcgcaaaagatg

SEQ ID NO: 225652 - DNA, 103 bp, Artificial Sequence
  Synthetic Polynucleotide
taatacgactcactatagggggtgggggttttctttggccgggacaccaaaacagaggagattggtgatgcggccaaagaacctggcggcagcgcaaaagatg

SEQ ID NO: 225653 - DNA, 103 bp, Artificial Sequence
  Synthetic Polynucleotide
taatacgactcactataggggaaccaccgtggtgggggttttctttggccaacagaggagaggccaaatgaaacccccaaacctggcggcagcgcaaaagatg

SEQ ID NO: 225654 - DNA, 103 bp, Artificial Sequence
  Synthetic Polynucleotide
taatacgactcactataggggagataaggggaaccaccgtggtgggggttaacagaggagaaaccccatgcacggtggtaacctggcggcagcgcaaaagatg

SEQ ID NO: 225655 - DNA, 103 bp, Artificial Sequence
  Synthetic Polynucleotide
taatacgactcactatagggagcgatggtagagataaggggaaccaccgtaacagaggagaacggtgatgccccttatcaacctggcggcagcgcaaaagatg

SEQ ID NO: 225656 - DNA, 103 bp, Artificial Sequence
  Synthetic Polynucleotide
taatacgactcactatagggtgctgtccccagcgatggtagagataagggaacagaggagacccttaatgctaccatcgaacctggcggcagcgcaaaagatg

SEQ ID NO: 225657 - DNA, 103 bp, Artificial Sequence
  Synthetic Polynucleotide
taatacgactcactataggggaagttcggctgctgtccccagcgatggtaaacagaggagataccatatgtggggacagaacctggcggcagcgcaaaagatg

SEQ ID NO: 225658 - DNA, 103 bp, Artificial Sequence
  Synthetic Polynucleotide
taatacgactcactatagggcgagaccaacgaagttcggctgctgtccccaacagaggagaggggacatgagccgaactaacctggcggcagcgcaaaagatg

SEQ ID NO: 225659 - DNA, 103 bp, Artificial Sequence
  Synthetic Polynucleotide
taatacgactcactatagggctgcaatggtcgagaccaacgaagttcggcaacagaggagagccgaaatgcgttggtctaacctggcggcagcgcaaaagatg

SEQ ID NO: 225660 - DNA, 103 bp, Artificial Sequence
  Synthetic Polynucleotide
taatacgactcactataggggacaagatgcctgcaatggtcgagaccaacaacagaggagagttggtatggaccattgcaacctggcggcagcgcaaaagatg

SEQ ID NO: 225661 - DNA, 103 bp, Artificial Sequence
  Synthetic Polynucleotide
taatacgactcactatagggctgttggtgatgggaagcttcatgggcctgaacagaggagacaggccatggaagcttccaacctggcggcagcgcaaaagatg

SEQ ID NO: 225662 - DNA, 103 bp, Artificial Sequence
  Synthetic Polynucleotide
taatacgactcactatagggagtgactgttgacaagatgcctgcaatggtaacagaggagaaccattatgggcatcttgaacctggcggcagcgcaaaagatg

SEQ ID NO: 225663 - DNA, 103 bp, Artificial Sequence
  Synthetic Polynucleotide
taatacgactcactatagggaggaagatgtagtgactgttgacaagatgcaacagaggagagcatctatgcaacagtcaaacctggcggcagcgcaaaagatg

SEQ ID NO: 225664 - DNA, 103 bp, Artificial Sequence
  Synthetic Polynucleotide
taatacgactcactatagggttggtgcccgaggaagatgtagtgactgttaacagaggagaaacagtatgtacatcttcaacctggcggcagcgcaaaagatg

SEQ ID NO: 225665 - DNA, 103 bp, Artificial Sequence
  Synthetic Polynucleotide
taatacgactcactataggggctactggggttggtgcccgaggaagatgtaacagaggagaacatctatgtcgggcaccaacctggcggcagcgcaaaagatg

SEQ ID NO: 225666 - DNA, 103 bp, Artificial Sequence
  Synthetic Polynucleotide
taatacgactcactatagggtgctggcactgctactggggttggtgcccgaacagaggagacgggcaatgaccccagtaaacctggcggcagcgcaaaagatg

SEQ ID NO: 225667 - DNA, 103 bp, Artificial Sequence
  Synthetic Polynucleotide
taatacgactcactatagggatagctgtggtgctggcactgctactggggaacagaggagaccccagatgcagtgccagaacctggcggcagcgcaaaagatg

SEQ ID NO: 225668 - DNA, 103 bp, Artificial Sequence
  Synthetic Polynucleotide
taatacgactcactatagggggtcactggcatagctgtggtgctggcactaacagaggagaagtgccatgaccacagctaacctggcggcagcgcaaaagatg

SEQ ID NO: 225669 - DNA, 103 bp, Artificial Sequence
  Synthetic Polynucleotide
taatacgactcactatagggtgacagactgggtcactggcatagctgtggaacagaggagaccacagatgtgccagtgaaacctggcggcagcgcaaaagatg

SEQ ID NO: 225670 - DNA, 103 bp, Artificial Sequence
  Synthetic Polynucleotide
taatacgactcactatagggctgggtttcttgacagactgggtcactggcaacagaggagagccagtatgccagtctgtaacctggcggcagcgcaaaagatg

SEQ ID NO: 225671 - DNA, 103 bp, Artificial Sequence
  Synthetic Polynucleotide
taatacgactcactataggggacaggcttactgggtttcttgacagactgaacagaggagacagtctatgaagaaacccaacctggcggcagcgcaaaagatg

SEQ ID NO: 225672 - DNA, 103 bp, Artificial Sequence
  Synthetic Polynucleotide
taatacgactcactataggggtgctgcctgctgttggtgatgggaagcttaacagaggagaaagcttatgatcaccaacaacctggcggcagcgcaaaagatg

SEQ ID NO: 225673 - DNA, 103 bp, Artificial Sequence
  Synthetic Polynucleotide
taatacgactcactatagggggttcttcttgacaggcttactgggtttctaacagaggagaagaaacatggtaagcctgaacctggcggcagcgcaaaagatg

SEQ ID NO: 225674 - DNA, 103 bp, Artificial Sequence
  Synthetic Polynucleotide
taatacgactcactatagggtcacaagcatggttcttcttgacaggcttaaacagaggagataagccatgcaagaagaaaacctggcggcagcgcaaaagatg

SEQ ID NO: 225675 - DNA, 103 bp, Artificial Sequence
  Synthetic Polynucleotide
taatacgactcactatagggcccacacatctcacaagcatggttcttcttaacagaggagaaagaagatgcatgcttgtaacctggcggcagcgcaaaagatg

SEQ ID NO: 225676 - DNA, 103 bp, Artificial Sequence
  Synthetic Polynucleotide
taatacgactcactatagggggaaggccttcccacacatctcacaagcataacagaggagaatgcttatgagatgtgtgaacctggcggcagcgcaaaagatg

SEQ ID NO: 225677 - DNA, 103 bp, Artificial Sequence
  Synthetic Polynucleotide
taatacgactcactatagggtacacatctcggaaggccttcccacacatcaacagaggagagatgtgatggaaggccttaacctggcggcagcgcaaaagatg

SEQ ID NO: 225678 - DNA, 103 bp, Artificial Sequence
  Synthetic Polynucleotide
taatacgactcactatagggattgagatggtacacatctcggaaggccttaacagaggagaaaggccatgcgagatgtgaacctggcggcagcgcaaaagatg

SEQ ID NO: 225679 - DNA, 103 bp, Artificial Sequence
  Synthetic Polynucleotide
taatacgactcactataggggcttgtgtcgattgagatggtacacatctcaacagaggagagagatgatgaccatctcaaacctggcggcagcgcaaaagatg

SEQ ID NO: 225680 - DNA, 103 bp, Artificial Sequence
  Synthetic Polynucleotide
taatacgactcactataggggaatgggagagcttgtgtcgattgagatggaacagaggagaccatctatgtcgacacaaaacctggcggcagcgcaaaagatg

SEQ ID NO: 225681 - DNA, 103 bp, Artificial Sequence
  Synthetic Polynucleotide
taatacgactcactatagggtttctcatctgaatgggagagcttgtgtcgaacagaggagacgacacatgctctcccataacctggcggcagcgcaaaagatg

SEQ ID NO: 225682 - DNA, 103 bp, Artificial Sequence
  Synthetic Polynucleotide
taatacgactcactatagggactcaaagggtttctcatctgaatgggagaaacagaggagatctcccatgcagatgagaaacctggcggcagcgcaaaagatg

SEQ ID NO: 225683 - DNA, 103 bp, Artificial Sequence
  Synthetic Polynucleotide
taatacgactcactatagggaagctgttctgtgctgcctgctgttggtgaaacagaggagatcaccaatggcaggcagcaacctggcggcagcgcaaaagatg

SEQ ID NO: 225684 - DNA, 103 bp, Artificial Sequence
  Synthetic Polynucleotide
taatacgactcactatagggcaaataggacactcaaagggtttctcatctaacagaggagaagatgaatgaccctttgaaacctggcggcagcgcaaaagatg

SEQ ID NO: 225685 - DNA, 103 bp, Artificial Sequence
  Synthetic Polynucleotide
taatacgactcactataggggcgctgattacaaataggacactcaaagggaacagaggagaccctttatgtgtcctattaacctggcggcagcgcaaaagatg

SEQ ID NO: 225686 - DNA, 103 bp, Artificial Sequence
  Synthetic Polynucleotide
taatacgactcactatagggtcctcttgaagcgctgattacaaataggacaacagaggagagtcctaatggtaatcagcaacctggcggcagcgcaaaagatg

SEQ ID NO: 225687 - DNA, 103 bp, Artificial Sequence
  Synthetic Polynucleotide
taatacgactcactatagggatccggtccttcctcttgaagcgctgattaaacagaggagataatcaatgcttcaagagaacctggcggcagcgcaaaagatg

SEQ ID NO: 225688 - DNA, 103 bp, Artificial Sequence
  Synthetic Polynucleotide
taatacgactcactatagggatggtaagtcatccggtccttcctcttgaaaacagaggagattcaagatgaaggaccggaacctggcggcagcgcaaaagatg

SEQ ID NO: 225689 - DNA, 103 bp, Artificial Sequence
  Synthetic Polynucleotide
taatacgactcactataggggagacctcacatggtaagtcatccggtcctaacagaggagaaggaccatgtgacttaccaacctggcggcagcgcaaaagatg

SEQ ID NO: 225690 - DNA, 103 bp, Artificial Sequence
  Synthetic Polynucleotide
taatacgactcactatagggcctccttcatgagacctcacatggtaagtcaacagaggagagacttaatgtgtgaggtcaacctggcggcagcgcaaaagatg

SEQ ID NO: 225691 - DNA, 103 bp, Artificial Sequence
  Synthetic Polynucleotide
taatacgactcactatagggtttggtgatgcctccttcatgagacctcacaacagaggagagtgaggatgcatgaaggaaacctggcggcagcgcaaaagatg

SEQ ID NO: 225692 - DNA, 103 bp, Artificial Sequence
  Synthetic Polynucleotide
taatacgactcactatagggaagtatagggtttggtgatgcctccttcataacagaggagaatgaagatggcatcaccaaacctggcggcagcgcaaaagatg

SEQ ID NO: 225693 - DNA, 103 bp, Artificial Sequence
  Synthetic Polynucleotide
taatacgactcactatagggcaaacactgcaagtatagggtttggtgatgaacagaggagacatcacatgaccctatacaacctggcggcagcgcaaaagatg

SEQ ID NO: 225694 - DNA, 103 bp, Artificial Sequence
  Synthetic Polynucleotide
taatacgactcactataggggaggggcagcaagctgttctgtgctgcctgaacagaggagacaggcaatgcagaacagcaacctggcggcagcgcaaaagatg

SEQ ID NO: 225695 - DNA, 103 bp, Artificial Sequence
  Synthetic Polynucleotide
taatacgactcactataggggcctttcccacaaacactgcaagtatagggaacagaggagaccctatatgtgcagtgttaacctggcggcagcgcaaaagatg

SEQ ID NO: 225696 - DNA, 103 bp, Artificial Sequence
  Synthetic Polynucleotide
taatacgactcactataggggccttgagaagcctttcccacaaacactgcaacagaggagagcagtgatggtgggaaagaacctggcggcagcgcaaaagatg

SEQ ID NO: 225697 - DNA, 103 bp, Artificial Sequence
  Synthetic Polynucleotide
taatacgactcactatagggaagtggtcaggccttgagaagcctttcccaaacagaggagatgggaaatgcttctcaagaacctggcggcagcgcaaaagatg

SEQ ID NO: 225698 - DNA, 103 bp, Artificial Sequence
  Synthetic Polynucleotide
taatacgactcactatagggatgacagcttaagtggtcaggccttgagaaaacagaggagattctcaatgcctgaccacaacctggcggcagcgcaaaagatg

SEQ ID NO: 225699 - DNA, 103 bp, Artificial Sequence
  Synthetic Polynucleotide
taatacgactcactatagggcatgttttacatgacagcttaagtggtcagaacagaggagactgaccatgtaagctgtcaacctggcggcagcgcaaaagatg

SEQ ID NO: 225700 - DNA, 103 bp, Artificial Sequence
  Synthetic Polynucleotide
taatacgactcactataggggttgaatggacatgttttacatgacagcttaacagaggagaaagctgatgtgtaaaacaaacctggcggcagcgcaaaagatg

SEQ ID NO: 225701 - DNA, 103 bp, Artificial Sequence
  Synthetic Polynucleotide
taatacgactcactataggggggtctttctgttgaatggacatgttttacaacagaggagagtaaaaatggtccattcaaacctggcggcagcgcaaaagatg

SEQ ID NO: 225702 - DNA, 103 bp, Artificial Sequence
  Synthetic Polynucleotide
taatacgactcactatagggggcatttgaagggtctttctgttgaatggaaacagaggagatccattatgcagaaagacaacctggcggcagcgcaaaagatg

SEQ ID NO: 225703 - DNA, 103 bp, Artificial Sequence
  Synthetic Polynucleotide
taatacgactcactataggggtgcacgtttggcatttgaagggtctttctaacagaggagaagaaagatgcttcaaatgaacctggcggcagcgcaaaagatg

SEQ ID NO: 225704 - DNA, 103 bp, Artificial Sequence
  Synthetic Polynucleotide
taatacgactcactatagggaaaggcagcagtgcacgtttggcatttgaaaacagaggagattcaaaatgcaaacgtgcaacctggcggcagcgcaaaagatg

SEQ ID NO: 225705 - DNA, 103 bp, Artificial Sequence
  Synthetic Polynucleotide
taatacgactcactatagggcagagctcaggaggggcagcaagctgttctaacagaggagaagaacaatgtgctgccccaacctggcggcagcgcaaaagatg

SEQ ID NO: 225706 - DNA, 103 bp, Artificial Sequence
  Synthetic Polynucleotide
taatacgactcactatagggctttggtggcaaaggcagcagtgcacgtttaacagaggagaaaacgtatgctgctgcctaacctggcggcagcgcaaaagatg

SEQ ID NO: 225707 - DNA, 103 bp, Artificial Sequence
  Synthetic Polynucleotide
taatacgactcactatagggcgcagtctgtctttggtggcaaaggcagcaaacagaggagatgctgcatgtgccaccaaaacctggcggcagcgcaaaagatg

SEQ ID NO: 225708 - DNA, 103 bp, Artificial Sequence
  Synthetic Polynucleotide
taatacgactcactatagggcatgtgtgtccgcagtctgtctttggtggcaacagaggagagccaccatggacagactgaacctggcggcagcgcaaaagatg

SEQ ID NO: 225709 - DNA, 103 bp, Artificial Sequence
  Synthetic Polynucleotide
taatacgactcactatagggcatggcgcaccatgtgtgtccgcagtctgtaacagaggagaacagacatgggacacacaaacctggcggcagcgcaaaagatg

SEQ ID NO: 225710 - DNA, 103 bp, Artificial Sequence
  Synthetic Polynucleotide
taatacgactcactatagggaccttgccttcatggcgcaccatgtgtgtcaacagaggagagacacaatgggtgcgccaaacctggcggcagcgcaaaagatg

SEQ ID NO: 225711 - DNA, 103 bp, Artificial Sequence
  Synthetic Polynucleotide
taatacgactcactataggggttacatgataccttgccttcatggcgcacaacagaggagagtgcgcatggaaggcaagaacctggcggcagcgcaaaagatg

SEQ ID NO: 225712 - DNA, 103 bp, Artificial Sequence
  Synthetic Polynucleotide
taatacgactcactatagggtcccacagatgttacatgataccttgccttaacagaggagaaaggcaatgtatcatgtaaacctggcggcagcgcaaaagatg

SEQ ID NO: 225713 - DNA, 103 bp, Artificial Sequence
  Synthetic Polynucleotide
taatacgactcactatagggctcaggagcttcccacagatgttacatgataacagaggagaatcatgatgcatctgtggaacctggcggcagcgcaaaagatg

SEQ ID NO: 225714 - DNA, 103 bp, Artificial Sequence
  Synthetic Polynucleotide
taatacgactcactataggggtatgctgcactcaggagcttcccacagataacagaggagaatctgtatgaagctcctgaacctggcggcagcgcaaaagatg

SEQ ID NO: 225715 - DNA, 103 bp, Artificial Sequence
  Synthetic Polynucleotide
taatacgactcactatagggggctggtgatgtatgctgcactcaggagctaacagaggagaagctccatggtgcagcataacctggcggcagcgcaaaagatg

SEQ ID NO: 225716 - DNA, 103 bp, Artificial Sequence
  Synthetic Polynucleotide
taatacgactcactatagggggctccacggcagagctcaggaggggcagcaacagaggagagctgccatgcctgagctcaacctggcggcagcgcaaaagatg

SEQ ID NO: 225717 - DNA, 103 bp, Artificial Sequence
  Synthetic Polynucleotide
taatacgactcactataggggtctttaagtggctggtgatgtatgctgcaaacagaggagatgcagcatgcatcaccagaacctggcggcagcgcaaaagatg

SEQ ID NO: 225718 - DNA, 103 bp, Artificial Sequence
  Synthetic Polynucleotide
taatacgactcactatagggctgcccatgagtctttaagtggctggtgataacagaggagaatcaccatgcacttaaagaacctggcggcagcgcaaaagatg

SEQ ID NO: 225719 - DNA, 103 bp, Artificial Sequence
  Synthetic Polynucleotide
taatacgactcactatagggtactttggctctgcccatgagtctttaagtaacagaggagaacttaaatgctcatgggcaacctggcggcagcgcaaaagatg

SEQ ID NO: 225720 - DNA, 103 bp, Artificial Sequence
  Synthetic Polynucleotide
taatacgactcactatagggttacagttgatactttggctctgcccatgaaacagaggagatcatggatggagccaaagaacctggcggcagcgcaaaagatg

SEQ ID NO: 225721 - DNA, 103 bp, Artificial Sequence
  Synthetic Polynucleotide
taatacgactcactatagggtttacatgtattacagttgatactttggctaacagaggagaagccaaatgatcaactgtaacctggcggcagcgcaaaagatg

SEQ ID NO: 225722 - DNA, 103 bp, Artificial Sequence
  Synthetic Polynucleotide
taatacgactcactatagggtgatgccttgtttacatgtattacagttgaaacagaggagatcaactatgatacatgtaaacctggcggcagcgcaaaagatg

SEQ ID NO: 225723 - DNA, 103 bp, Artificial Sequence
  Synthetic Polynucleotide
taatacgactcactatagggcatgttttactgatgccttgtttacatgtaaacagaggagatacatgatgacaaggcataacctggcggcagcgcaaaagatg

SEQ ID NO: 225724 - DNA, 103 bp, Artificial Sequence
  Synthetic Polynucleotide
taatacgactcactatagggttcactcatgcatgttttactgatgccttgaacagaggagacaaggcatgagtaaaacaaacctggcggcagcgcaaaagatg

SEQ ID NO: 225725 - DNA, 103 bp, Artificial Sequence
  Synthetic Polynucleotide
taatacgactcactatagggtactggtctcttcactcatgcatgttttacaacagaggagagtaaaaatggcatgagtgaacctggcggcagcgcaaaagatg

SEQ ID NO: 225726 - DNA, 103 bp, Artificial Sequence
  Synthetic Polynucleotide
taatacgactcactatagggtgcttttggttactggtctcttcactcatgaacagaggagacatgagatgagagaccagaacctggcggcagcgcaaaagatg

SEQ ID NO: 225727 - DNA, 103 bp, Artificial Sequence
  Synthetic Polynucleotide
taatacgactcactataggggccctccgagtgattcttgttgagcgccataacagaggagaatggcgatgaacaagaataacctggcggcagcgcaaaagatg

SEQ ID NO: 225728 - DNA, 103 bp, Artificial Sequence
  Synthetic Polynucleotide
taatacgactcactatagggttctggcacgttcttcatgtcattgaatgtaacagaggagaacattcatggacatgaagaacctggcggcagcgcaaaagatg

SEQ ID NO: 225729 - DNA, 103 bp, Artificial Sequence
  Synthetic Polynucleotide
taatacgactcactatagggctttgaaggcttctggcacgttcttcatgtaacagaggagaacatgaatgacgtgccagaacctggcggcagcgcaaaagatg

SEQ ID NO: 225730 - DNA, 103 bp, Artificial Sequence
  Synthetic Polynucleotide
taatacgactcactatagggttcttggtccctttgaaggcttctggcacgaacagaggagacgtgccatgagccttcaaaacctggcggcagcgcaaaagatg

SEQ ID NO: 225731 - DNA, 103 bp, Artificial Sequence
  Synthetic Polynucleotide
taatacgactcactataggggacagtgcctttcttggtccctttgaaggcaacagaggagagccttcatggggaccaagaacctggcggcagcgcaaaagatg

SEQ ID NO: 225732 - DNA, 103 bp, Artificial Sequence
  Synthetic Polynucleotide
taatacgactcactataggggggtaaggtagacagtgcctttcttggtccaacagaggagaggaccaatgaaggcactgaacctggcggcagcgcaaaagatg

SEQ ID NO: 225733 - DNA, 103 bp, Artificial Sequence
  Synthetic Polynucleotide
taatacgactcactatagggacccggtaaggggtaaggtagacagtgcctaacagaggagaaggcacatgctaccttacaacctggcggcagcgcaaaagatg

SEQ ID NO: 225734 - DNA, 103 bp, Artificial Sequence
  Synthetic Polynucleotide
taatacgactcactatagggcagaaagatgacccggtaaggggtaaggtaaacagaggagataccttatgccttaccggaacctggcggcagcgcaaaagatg

SEQ ID NO: 225735 - DNA, 103 bp, Artificial Sequence
  Synthetic Polynucleotide
taatacgactcactatagggtgcccttggacagaaagatgacccggtaagaacagaggagacttaccatgtcatctttcaacctggcggcagcgcaaaagatg

SEQ ID NO: 225736 - DNA, 103 bp, Artificial Sequence
  Synthetic Polynucleotide
taatacgactcactatagggatggcatccttgcccttggacagaaagatgaacagaggagacatcttatggtccaagggaacctggcggcagcgcaaaagatg

SEQ ID NO: 225737 - DNA, 103 bp, Artificial Sequence
  Synthetic Polynucleotide
taatacgactcactataggggaaggactgcatggcatccttgcccttggaaacagaggagatccaagatgaaggatgccaacctggcggcagcgcaaaagatg

SEQ ID NO: 225738 - DNA, 103 bp, Artificial Sequence
  Synthetic Polynucleotide
taatacgactcactatagggtcactccgccgccctccgagtgattcttgtaacagaggagaacaagaatgactcggaggaacctggcggcagcgcaaaagatg

SEQ ID NO: 225739 - DNA, 103 bp, Artificial Sequence
  Synthetic Polynucleotide
taatacgactcactatagggatggcatcatgaaggactgcatggcatcctaacagaggagaaggatgatgtgcagtcctaacctggcggcagcgcaaaagatg

SEQ ID NO: 225740 - DNA, 103 bp, Artificial Sequence
  Synthetic Polynucleotide
taatacgactcactatagggatgagataaaatggcatcatgaaggactgcaacagaggagagcagtcatgcatgatgccaacctggcggcagcgcaaaagatg

SEQ ID NO: 225741 - DNA, 103 bp, Artificial Sequence
  Synthetic Polynucleotide
taatacgactcactatagggacagtctttcatgagataaaatggcatcataacagaggagaatgatgatgttttatctcaacctggcggcagcgcaaaagatg

SEQ ID NO: 225742 - DNA, 103 bp, Artificial Sequence
  Synthetic Polynucleotide
taatacgactcactataggggcttgatctcacagtctttcatgagataaaaacagaggagatttatcatgtgaaagactaacctggcggcagcgcaaaagatg

SEQ ID NO: 225743 - DNA, 103 bp, Artificial Sequence
  Synthetic Polynucleotide
taatacgactcactatagggaatacgggctgcttgatctcacagtctttcaacagaggagagaaagaatgtgagatcaaaacctggcggcagcgcaaaagatg

SEQ ID NO: 225744 - DNA, 103 bp, Artificial Sequence
  Synthetic Polynucleotide
taatacgactcactataggggtttgcaccaaatacgggctgcttgatctcaacagaggagagagatcatgcagcccgtaaacctggcggcagcgcaaaagatg

SEQ ID NO: 225745 - DNA, 103 bp, Artificial Sequence
  Synthetic Polynucleotide
taatacgactcactatagggccttgatgtagtttgcaccaaatacgggctaacagaggagaagcccgatgttggtgcaaaacctggcggcagcgcaaaagatg

SEQ ID NO: 225746 - DNA, 103 bp, Artificial Sequence
  Synthetic Polynucleotide
taatacgactcactatagggttcactgttcccttgatgtagtttgcaccaaacagaggagatggtgcatgctacatcaaaacctggcggcagcgcaaaagatg

SEQ ID NO: 225747 - DNA, 103 bp, Artificial Sequence
  Synthetic Polynucleotide
taatacgactcactatagggcgcttccgccttcactgttcccttgatgtaaacagaggagatacatcatgggaacagtgaacctggcggcagcgcaaaagatg

SEQ ID NO: 225748 - DNA, 103 bp, Artificial Sequence
  Synthetic Polynucleotide
taatacgactcactatagggagccacctcccgcttccgccttcactgttcaacagaggagagaacagatgaggcggaagaacctggcggcagcgcaaaagatg

SEQ ID NO: 225749 - DNA, 103 bp, Artificial Sequence
  Synthetic Polynucleotide
taatacgactcactatagggttattgacgatcactccgccgccctccgagaacagaggagactcggaatgcggcggagtaacctggcggcagcgcaaaagatg

SEQ ID NO: 225750 - DNA, 103 bp, Artificial Sequence
  Synthetic Polynucleotide
taatacgactcactataggggagccttcccagccacctcccgcttccgccaacagaggagaggcggaatggggaggtggaacctggcggcagcgcaaaagatg

SEQ ID NO: 225751 - DNA, 103 bp, Artificial Sequence
  Synthetic Polynucleotide
taatacgactcactataggggtaggaagcagagccttcccagccacctccaacagaggagaggaggtatgtgggaaggcaacctggcggcagcgcaaaagatg

SEQ ID NO: 225752 - DNA, 103 bp, Artificial Sequence
  Synthetic Polynucleotide
taatacgactcactatagggaagtcaacttgtaggaagcagagccttcccaacagaggagagggaagatgctgcttcctaacctggcggcagcgcaaaagatg

SEQ ID NO: 225753 - DNA, 103 bp, Artificial Sequence
  Synthetic Polynucleotide
taatacgactcactatagggcctgccgtgaaagtcaacttgtaggaagcaaacagaggagatgcttcatgcaagttgacaacctggcggcagcgcaaaagatg

SEQ ID NO: 225754 - DNA, 103 bp, Artificial Sequence
  Synthetic Polynucleotide
taatacgactcactatagggaatggcgccccctgccgtgaaagtcaacttaacagaggagaaagttgatgttcacggcaaacctggcggcagcgcaaaagatg

SEQ ID NO: 225755 - DNA, 103 bp, Artificial Sequence
  Synthetic Polynucleotide
taatacgactcactataggggtccgaactcaatggcgccccctgccgtgaaacagaggagatcacggatgggggcgccaaacctggcggcagcgcaaaagatg

SEQ ID NO: 225756 - DNA, 103 bp, Artificial Sequence
  Synthetic Polynucleotide
taatacgactcactatagggagcatccgctgtccgaactcaatggcgcccaacagaggagagggcgcatgtgagttcggaacctggcggcagcgcaaaagatg

SEQ ID NO: 225757 - DNA, 103 bp, Artificial Sequence
  Synthetic Polynucleotide
taatacgactcactatagggtgccacctggagcatccgctgtccgaactcaacagaggagagagttcatgcagcggatgaacctggcggcagcgcaaaagatg

SEQ ID NO: 225758 - DNA, 103 bp, Artificial Sequence
  Synthetic Polynucleotide
taatacgactcactatagggaggcttgagatgccacctggagcatccgctaacagaggagaagcggaatgtccaggtggaacctggcggcagcgcaaaagatg

SEQ ID NO: 225759 - DNA, 103 bp, Artificial Sequence
  Synthetic Polynucleotide
taatacgactcactatagggtcacctctggaggcttgagatgccacctggaacagaggagaccaggtatgatctcaagcaacctggcggcagcgcaaaagatg

SEQ ID NO: 225760 - DNA, 103 bp, Artificial Sequence
  Synthetic Polynucleotide
taatacgactcactataggggctctcggtgttattgacgatcactccgccaacagaggagaggcggaatgatcgtcaataacctggcggcagcgcaaaagatg

SEQ ID NO: 225761 - DNA, 103 bp, Artificial Sequence
  Synthetic Polynucleotide
taatacgactcactatagggactggggacttcacctctggaggcttgagaaacagaggagatctcaaatgtccagaggtaacctggcggcagcgcaaaagatg

SEQ ID NO: 225762 - DNA, 103 bp, Artificial Sequence
  Synthetic Polynucleotide
taatacgactcactatagggcataggctccactggggacttcacctctggaacagaggagaccagagatgaagtccccaaacctggcggcagcgcaaaagatg

SEQ ID NO: 225763 - DNA, 103 bp, Artificial Sequence
  Synthetic Polynucleotide
taatacgactcactatagggtaagagtagccataggctccactggggactaacagaggagaagtcccatgtggagcctaaacctggcggcagcgcaaaagatg

SEQ ID NO: 225764 - DNA, 103 bp, Artificial Sequence
  Synthetic Polynucleotide
taatacgactcactataggggctgggcatgtaagagtagccataggctccaacagaggagaggagccatgggctactctaacctggcggcagcgcaaaagatg

SEQ ID NO: 225765 - DNA, 103 bp, Artificial Sequence
  Synthetic Polynucleotide
taatacgactcactatagggcataggccccgctgggcatgtaagagtagcaacagaggagagctactatgacatgcccaaacctggcggcagcgcaaaagatg

SEQ ID NO: 225766 - DNA, 103 bp, Artificial Sequence
  Synthetic Polynucleotide
taatacgactcactataggggggggatagacataggccccgctgggcatgaacagaggagacatgccatgcggggcctaaacctggcggcagcgcaaaagatg

SEQ ID NO: 225767 - DNA, 103 bp, Artificial Sequence
  Synthetic Polynucleotide
taatacgactcactatagggggcgactggcgggggatagacataggccccaacagaggagaggggccatggtctatcccaacctggcggcagcgcaaaagatg

SEQ ID NO: 225768 - DNA, 103 bp, Artificial Sequence
  Synthetic Polynucleotide
taatacgactcactatagggacattccattggcgactggcgggggatagaaacagaggagatctatcatgcgccagtcgaacctggcggcagcgcaaaagatg

SEQ ID NO: 225769 - DNA, 103 bp, Artificial Sequence
  Synthetic Polynucleotide
taatacgactcactataggggggcaggggtacattccattggcgactggcaacagaggagagccagtatgcaatggaataacctggcggcagcgcaaaagatg

SEQ ID NO: 225770 - DNA, 103 bp, Artificial Sequence
  Synthetic Polynucleotide
taatacgactcactataggggtagccaggagggcaggggtacattccattaacagaggagaaatggaatgtacccctgcaacctggcggcagcgcaaaagatg

SEQ ID NO: 225771 - DNA, 103 bp, Artificial Sequence
  Synthetic Polynucleotide
taatacgactcactatagggacattaggatgctctcggtgttattgacgaaacagaggagatcgtcaatgacaccgagaaacctggcggcagcgcaaaagatg

SEQ ID NO: 225772 - DNA, 103 bp, Artificial Sequence
  Synthetic Polynucleotide
taatacgactcactataggggtggataggggtagccaggagggcaggggtaacagaggagaacccctatgctcctggctaacctggcggcagcgcaaaagatg

SEQ ID NO: 225773 - DNA, 103 bp, Artificial Sequence
  Synthetic Polynucleotide
taatacgactcactatagggggtgggggcggtggataggggtagccaggaaacagaggagatcctggatgcccctatccaacctggcggcagcgcaaaagatg

SEQ ID NO: 225774 - DNA, 103 bp, Artificial Sequence
  Synthetic Polynucleotide
taatacgactcactatagggatagaactcaggtgggggcggtggatagggaacagaggagaccctatatgccgcccccaaacctggcggcagcgcaaaagatg

SEQ ID NO: 225775 - DNA, 103 bp, Artificial Sequence
  Synthetic Polynucleotide
taatacgactcactatagggggggtcctggatagaactcaggtgggggcgaacagaggagacgccccatgctgagttctaacctggcggcagcgcaaaagatg

SEQ ID NO: 225776 - DNA, 103 bp, Artificial Sequence
  Synthetic Polynucleotide
taatacgactcactatagggtccatcatggggggtcctggatagaactcaaacagaggagatgagttatgtccaggaccaacctggcggcagcgcaaaagatg

SEQ ID NO: 225777 - DNA, 103 bp, Artificial Sequence
  Synthetic Polynucleotide
taatacgactcactatagggcatggccccgtccatcatggggggtcctggaacagaggagaccaggaatgcccatgatgaacctggcggcagcgcaaaagatg

SEQ ID NO: 225778 - DNA, 103 bp, Artificial Sequence
  Synthetic Polynucleotide
taatacgactcactataggggcacgtatcccatggccccgtccatcatggaacagaggagaccatgaatgacggggccaaacctggcggcagcgcaaaagatg

SEQ ID NO: 225779 - DNA, 103 bp, Artificial Sequence
  Synthetic Polynucleotide
taatacgactcactatagggggtgggggctgcacgtatcccatggccccgaacagaggagacggggcatggggatacgtaacctggcggcagcgcaaaagatg

SEQ ID NO: 225780 - DNA, 103 bp, Artificial Sequence
  Synthetic Polynucleotide
taatacgactcactataggggtagggcggtggtgggggctgcacgtatccaacagaggagaggatacatgcagcccccaaacctggcggcagcgcaaaagatg

SEQ ID NO: 225781 - DNA, 103 bp, Artificial Sequence
  Synthetic Polynucleotide
taatacgactcactatagggtgggcccagggtagggcggtggtgggggctaacagaggagaagccccatgcaccgccctaacctggcggcagcgcaaaagatg

SEQ ID NO: 225782 - DNA, 103 bp, Artificial Sequence
  Synthetic Polynucleotide
taatacgactcactatagggtgatcataggacattaggatgctctcggtgaacagaggagacaccgaatgcatcctaataacctggcggcagcgcaaaagatg

SEQ ID NO: 225783 - DNA, 103 bp, Artificial Sequence
  Synthetic Polynucleotide
taatacgactcactatagggggaggttccatgggcccagggtagggcggtaacagaggagaaccgccatgccctgggccaacctggcggcagcgcaaaagatg

SEQ ID NO: 225784 - DNA, 103 bp, Artificial Sequence
  Synthetic Polynucleotide
taatacgactcactataggggccgctgaccggaggttccatgggcccaggaacagaggagacctgggatgatggaacctaacctggcggcagcgcaaaagatg

SEQ ID NO: 225785 - DNA, 103 bp, Artificial Sequence
  Synthetic Polynucleotide
taatacgactcactatagggggacatcggggccgctgaccggaggttccaaacagaggagatggaacatgcggtcagcgaacctggcggcagcgcaaaagatg

SEQ ID NO: 225786 - DNA, 103 bp, Artificial Sequence
  Synthetic Polynucleotide
taatacgactcactatagggggagtggaggggacatcggggccgctgaccaacagaggagaggtcagatgccccgatgtaacctggcggcagcgcaaaagatg

SEQ ID NO: 225787 - DNA, 103 bp, Artificial Sequence
  Synthetic Polynucleotide
taatacgactcactatagggttcggctgcaggagtggaggggacatcgggaacagaggagacccgatatgccctccactaacctggcggcagcgcaaaagatg

SEQ ID NO: 225788 - DNA, 103 bp, Artificial Sequence
  Synthetic Polynucleotide
taatacgactcactatagggcggccttggcttcggctgcaggagtggaggaacagaggagacctccaatgctgcagccgaacctggcggcagcgcaaaagatg

SEQ ID NO: 225789 - DNA, 103 bp, Artificial Sequence
  Synthetic Polynucleotide
taatacgactcactataggggctgcttctgcggccttggcttcggctgcaaacagaggagatgcagcatgagccaaggcaacctggcggcagcgcaaaagatg

SEQ ID NO: 225790 - DNA, 103 bp, Artificial Sequence
  Synthetic Polynucleotide
taatacgactcactatagggggcgctggcggctgcttctgcggccttggcaacagaggagagccaagatggcagaagcaaacctggcggcagcgcaaaagatg

SEQ ID NO: 225791 - DNA, 103 bp, Artificial Sequence
  Synthetic Polynucleotide
taatacgactcactatagggggttgtaataggcgctggcggctgcttctgaacagaggagacagaagatgccgccagcgaacctggcggcagcgcaaaagatg

SEQ ID NO: 225792 - DNA, 103 bp, Artificial Sequence
  Synthetic Polynucleotide
taatacgactcactatagggggattgcctgggttgtaataggcgctggcgaacagaggagacgccagatgctattacaaaacctggcggcagcgcaaaagatg

SEQ ID NO: 225793 - DNA, 103 bp, Artificial Sequence
  Synthetic Polynucleotide
taatacgactcactataggggagttccacgtgatcataggacattaggataacagaggagaatcctaatgtcctatgataacctggcggcagcgcaaaagatg

SEQ ID NO: 225794 - DNA, 103 bp, Artificial Sequence
  Synthetic Polynucleotide
taatacgactcactataggggacgttgtgaggattgcctgggttgtaataaacagaggagatattacatgccaggcaataacctggcggcagcgcaaaagatg

SEQ ID NO: 225795 - DNA, 103 bp, Artificial Sequence
  Synthetic Polynucleotide
taatacgactcactatagggtgggcatgtagacgttgtgaggattgcctgaacagaggagacaggcaatgctcacaacgaacctggcggcagcgcaaaagatg

SEQ ID NO: 225796 - DNA, 103 bp, Artificial Sequence
  Synthetic Polynucleotide
taatacgactcactatagggggctggctcgtgggcatgtagacgttgtgaaacagaggagatcacaaatgctacatgccaacctggcggcagcgcaaaagatg

SEQ ID NO: 225797 - DNA, 103 bp, Artificial Sequence
  Synthetic Polynucleotide
taatacgactcactatagggaggtggcggcggctggctcgtgggcatgtaaacagaggagatacatgatgacgagccagaacctggcggcagcgcaaaagatg

SEQ ID NO: 225798 - DNA, 103 bp, Artificial Sequence
  Synthetic Polynucleotide
taatacgactcactatagggggtagtagggaggtggcggcggctggctcgaacagaggagacgagccatgcgccgccacaacctggcggcagcgcaaaagatg

SEQ ID NO: 225799 - DNA, 103 bp, Artificial Sequence
  Synthetic Polynucleotide
taatacgactcactatagggtcttccggtgggtagtagggaggtggcggcaacagaggagagccgccatgtccctactaaacctggcggcagcgcaaaagatg

SEQ ID NO: 225800 - DNA, 103 bp, Artificial Sequence
  Synthetic Polynucleotide
taatacgactcactatagggggtcttcttatcttccggtgggtagtagggaacagaggagaccctacatgccaccggaaaacctggcggcagcgcaaaagatg

SEQ ID NO: 225801 - DNA, 103 bp, Artificial Sequence
  Synthetic Polynucleotide
taatacgactcactatagggcattgaatgtgagttccacgtgatcataggaacagaggagacctatgatgacgtggaacaacctggcggcagcgcaaaagatg

SEQ ID NO: 225802 - DNA, 103 bp, Artificial Sequence
  Synthetic Polynucleotide
taatacgactcactatagggttcttcatgtcattgaatgtgagttccacgaacagaggagacgtggaatgcacattcaaaacctggcggcagcgcaaaagatg

SEQ ID NO: 225803 - DNA, 103 bp, Artificial Sequence
  Synthetic Polynucleotide
taatacgactcactatagggccagccaggcaacagcgcccagagccccataacagaggagaatggggatgtgggcgctgaacctggcggcagcgcaaaagatg

SEQ ID NO: 225804 - DNA, 103 bp, Artificial Sequence
  Synthetic Polynucleotide
taatacgactcactatagggtacgttcacaataccccaccatcggccactaacagaggagaagtggcatgtggtggggtaacctggcggcagcgcaaaagatg

SEQ ID NO: 225805 - DNA, 103 bp, Artificial Sequence
  Synthetic Polynucleotide
taatacgactcactataggggcgctgcgtgcgcgtgcggtggcccctgccaacagaggagaggcaggatgcaccgcacgaacctggcggcagcgcaaaagatg

SEQ ID NO: 225806 - DNA, 103 bp, Artificial Sequence
  Synthetic Polynucleotide
taatacgactcactataggggctcggtgacgcgctgcgtgcgcgtgcggtaacagaggagaaccgcaatggcacgcagcaacctggcggcagcgcaaaagatg

SEQ ID NO: 225807 - DNA, 103 bp, Artificial Sequence
  Synthetic Polynucleotide
taatacgactcactatagggcagttgcagcgctcggtgacgcgctgcgtgaacagaggagacacgcaatgcgtcaccgaaacctggcggcagcgcaaaagatg

SEQ ID NO: 225808 - DNA, 103 bp, Artificial Sequence
  Synthetic Polynucleotide
taatacgactcactataggggtggaaggtgcagttgcagcgctcggtgacaacagaggagagtcaccatgcgctgcaacaacctggcggcagcgcaaaagatg

SEQ ID NO: 225809 - DNA, 103 bp, Artificial Sequence
  Synthetic Polynucleotide
taatacgactcactatagggggcagcaccagtggaaggtgcagttgcagcaacagaggagagctgcaatggcaccttccaacctggcggcagcgcaaaagatg

SEQ ID NO: 225810 - DNA, 103 bp, Artificial Sequence
  Synthetic Polynucleotide
taatacgactcactatagggcagctgacgtggcagcaccagtggaaggtgaacagaggagacaccttatgctggtgctgaacctggcggcagcgcaaaagatg

SEQ ID NO: 225811 - DNA, 103 bp, Artificial Sequence
  Synthetic Polynucleotide
taatacgactcactataggggcagttgcggcagctgacgtggcagcaccaaacagaggagatggtgcatgcacgtcagcaacctggcggcagcgcaaaagatg

SEQ ID NO: 225812 - DNA, 103 bp, Artificial Sequence
  Synthetic Polynucleotide
taatacgactcactataggggcgtgtgcgtgcagttgcggcagctgacgtaacagaggagaacgtcaatggccgcaactaacctggcggcagcgcaaaagatg

SEQ ID NO: 225813 - DNA, 103 bp, Artificial Sequence
  Synthetic Polynucleotide
taatacgactcactatagggtgcagtacgcgcgtgtgcgtgcagttgcggaacagaggagaccgcaaatgcacgcacacaacctggcggcagcgcaaaagatg

SEQ ID NO: 225814 - DNA, 103 bp, Artificial Sequence
  Synthetic Polynucleotide
taatacgactcactatagggcagacactcgtgcagtacgcgcgtgtgcgtaacagaggagaacgcacatgcgcgtactgaacctggcggcagcgcaaaagatg

SEQ ID NO: 225815 - DNA, 103 bp, Artificial Sequence
  Synthetic Polynucleotide
taatacgactcactatagggtggaggaggctacgttcacaataccccaccaacagaggagaggtgggatgttgtgaacgaacctggcggcagcgcaaaagatg

SEQ ID NO: 225816 - DNA, 103 bp, Artificial Sequence
  Synthetic Polynucleotide
taatacgactcactatagggagcaggttcgtggaggaggctacgttcacaaacagaggagatgtgaaatgagcctcctcaacctggcggcagcgcaaaagatg

SEQ ID NO: 225817 - DNA, 103 bp, Artificial Sequence
  Synthetic Polynucleotide
taatacgactcactatagggggagtctgtaagcaggttcgtggaggaggcaacagaggagagcctccatgacgaacctgaacctggcggcagcgcaaaagatg

SEQ ID NO: 225818 - DNA, 103 bp, Artificial Sequence
  Synthetic Polynucleotide
taatacgactcactataggggcagactcttggagtctgtaagcaggttcgaacagaggagacgaaccatgttacagactaacctggcggcagcgcaaaagatg

SEQ ID NO: 225819 - DNA, 103 bp, Artificial Sequence
  Synthetic Polynucleotide
taatacgactcactatagggagtaccagttgcagactcttggagtctgtaaacagaggagatacagaatgcaagagtctaacctggcggcagcgcaaaagatg

SEQ ID NO: 225820 - DNA, 103 bp, Artificial Sequence
  Synthetic Polynucleotide
taatacgactcactatagggactgggctcgagtaccagttgcagactcttaacagaggagaaagagtatgcaactggtaaacctggcggcagcgcaaaagatg

SEQ ID NO: 225821 - DNA, 103 bp, Artificial Sequence
  Synthetic Polynucleotide
taatacgactcactatagggacagctgcagactgggctcgagtaccagttaacagaggagaaactggatgtcgagcccaaacctggcggcagcgcaaaagatg

SEQ ID NO: 225822 - DNA, 103 bp, Artificial Sequence
  Synthetic Polynucleotide
taatacgactcactatagggttgcggctcaacagctgcagactgggctcgaacagaggagacgagccatgtctgcagctaacctggcggcagcgcaaaagatg

SEQ ID NO: 225823 - DNA, 103 bp, Artificial Sequence
  Synthetic Polynucleotide
taatacgactcactatagggacgccgctgtttgcggctcaacagctgcagaacagaggagactgcagatgttgagccgcaacctggcggcagcgcaaaagatg

SEQ ID NO: 225824 - DNA, 103 bp, Artificial Sequence
  Synthetic Polynucleotide
taatacgactcactatagggtagcagaaacccagccaggcaacagcgcccaacagaggagagggcgcatgtgcctggctaacctggcggcagcgcaaaagatg

SEQ ID NO: 225825 - DNA, 103 bp, Artificial Sequence
  Synthetic Polynucleotide
taatacgactcactatagggggcgtatcagacgccgctgtttgcggctcaaacagaggagatgagccatgaacagcggcaacctggcggcagcgcaaaagatg

SEQ ID NO: 225826 - DNA, 103 bp, Artificial Sequence
  Synthetic Polynucleotide
taatacgactcactatagggcccggattttggcgtatcagacgccgctgtaacagaggagaacagcgatgtctgatacgaacctggcggcagcgcaaaagatg

SEQ ID NO: 225827 - DNA, 103 bp, Artificial Sequence
  Synthetic Polynucleotide
taatacgactcactataggggtgcaggatccccggattttggcgtatcagaacagaggagactgataatgcaaaatccgaacctggcggcagcgcaaaagatg

SEQ ID NO: 225828 - DNA, 103 bp, Artificial Sequence
  Synthetic Polynucleotide
taatacgactcactatagggcactcacgctgtgcaggatccccggattttaacagaggagaaaaatcatgggatcctgcaacctggcggcagcgcaaaagatg

SEQ ID NO: 225829 - DNA, 103 bp, Artificial Sequence
  Synthetic Polynucleotide
taatacgactcactatagggtgcagccccccactcacgctgtgcaggatcaacagaggagagatcctatgcagcgtgagaacctggcggcagcgcaaaagatg

SEQ ID NO: 225830 - DNA, 103 bp, Artificial Sequence
  Synthetic Polynucleotide
taatacgactcactatagggcacggcactctgcagccccccactcacgctaacagaggagaagcgtgatgggggggctgaacctggcggcagcgcaaaagatg

SEQ ID NO: 225831 - DNA, 103 bp, Artificial Sequence
  Synthetic Polynucleotide
taatacgactcactatagggtgcactcgcgcacggcactctgcagcccccaacagaggagagggggcatgagagtgccgaacctggcggcagcgcaaaagatg

SEQ ID NO: 225832 - DNA, 103 bp, Artificial Sequence
  Synthetic Polynucleotide
taatacgactcactatagggaactgccacttgcactcgcgcacggcactcaacagaggagagagtgcatggcgcgagtgaacctggcggcagcgcaaaagatg

SEQ ID NO: 225833 - DNA, 103 bp, Artificial Sequence
  Synthetic Polynucleotide
taatacgactcactataggggcgattccggaactgccacttgcactcgcgaacagaggagacgcgagatgaagtggcagaacctggcggcagcgcaaaagatg

SEQ ID NO: 225834 - DNA, 103 bp, Artificial Sequence
  Synthetic Polynucleotide
taatacgactcactatagggagttccagcggcgattccggaactgccactaacagaggagaagtggcatgtccggaatcaacctggcggcagcgcaaaagatg

SEQ ID NO: 225835 - DNA, 103 bp, Artificial Sequence
  Synthetic Polynucleotide
taatacgactcactatagggagcagcagcgtagcagaaacccagccaggcaacagaggagagcctggatgggtttctgcaacctggcggcagcgcaaaagatg

SEQ ID NO: 225836 - DNA, 103 bp, Artificial Sequence
  Synthetic Polynucleotide
taatacgactcactataggggcagtgggacagttccagcggcgattccggaacagaggagaccggaaatgccgctggaaaacctggcggcagcgcaaaagatg

SEQ ID NO: 225837 - DNA, 103 bp, Artificial Sequence
  Synthetic Polynucleotide
taatacgactcactataggggggccctggagcagtgggacagttccagcgaacagaggagacgctggatgtgtcccactaacctggcggcagcgcaaaagatg

SEQ ID NO: 225838 - DNA, 103 bp, Artificial Sequence
  Synthetic Polynucleotide
taatacgactcactatagggcgaagaggtggggccctggagcagtgggacaacagaggagagtcccaatgctccagggcaacctggcggcagcgcaaaagatg

SEQ ID NO: 225839 - DNA, 103 bp, Artificial Sequence
  Synthetic Polynucleotide
taatacgactcactatagggacgatcttgccgaagaggtggggccctggaaacagaggagatccaggatgccacctcttaacctggcggcagcgcaaaagatg

SEQ ID NO: 225840 - DNA, 103 bp, Artificial Sequence
  Synthetic Polynucleotide
taatacgactcactataggggcctcggttgacgatcttgccgaagaggtgaacagaggagacacctcatgggcaagatcaacctggcggcagcgcaaaagatg

SEQ ID NO: 225841 - DNA, 103 bp, Artificial Sequence
  Synthetic Polynucleotide
taatacgactcactatagggtttctcgacagcctcggttgacgatcttgcaacagaggagagcaagaatgtcaaccgagaacctggcggcagcgcaaaagatg

SEQ ID NO: 225842 - DNA, 103 bp, Artificial Sequence
  Synthetic Polynucleotide
taatacgactcactatagggataaacgccgtttctcgacagcctcggttgaacagaggagacaaccgatgctgtcgagaaacctggcggcagcgcaaaagatg

SEQ ID NO: 225843 - DNA, 103 bp, Artificial Sequence
  Synthetic Polynucleotide
taatacgactcactataggggatagcgaagataaacgccgtttctcgacaaacagaggagatgtcgaatgacggcgtttaacctggcggcagcgcaaaagatg

SEQ ID NO: 225844 - DNA, 103 bp, Artificial Sequence
  Synthetic Polynucleotide
taatacgactcactatagggcggcggaggtgatagcgaagataaacgccgaacagaggagacggcgtatgtcttcgctaaacctggcggcagcgcaaaagatg

SEQ ID NO: 225845 - DNA, 103 bp, Artificial Sequence
  Synthetic Polynucleotide
taatacgactcactatagggtgggtgaccccggcggaggtgatagcgaagaacagaggagacttcgcatgcacctccgcaacctggcggcagcgcaaaagatg

SEQ ID NO: 225846 - DNA, 103 bp, Artificial Sequence
  Synthetic Polynucleotide
taatacgactcactatagggggccagcgccagcagcagcgtagcagaaacaacagaggagagtttctatgacgctgctgaacctggcggcagcgcaaaagatg

SEQ ID NO: 225847 - DNA, 103 bp, Artificial Sequence
  Synthetic Polynucleotide
taatacgactcactatagggcgccaccgaatgggtgaccccggcggaggtaacagaggagaacctccatgggggtcaccaacctggcggcagcgcaaaagatg

SEQ ID NO: 225848 - DNA, 103 bp, Artificial Sequence
  Synthetic Polynucleotide
taatacgactcactatagggagcaggagcgcgccaccgaatgggtgacccaacagaggagagggtcaatgattcggtggaacctggcggcagcgcaaaagatg

SEQ ID NO: 225849 - DNA, 103 bp, Artificial Sequence
  Synthetic Polynucleotide
taatacgactcactataggggaaccttctgagcaggagcgcgccaccgaaaacagaggagattcggtatggcgctcctgaacctggcggcagcgcaaaagatg

SEQ ID NO: 225850 - DNA, 103 bp, Artificial Sequence
  Synthetic Polynucleotide
taatacgactcactatagggggattcgatggaaccttctgagcaggagcgaacagaggagacgctccatgtcagaaggtaacctggcggcagcgcaaaagatg

SEQ ID NO: 225851 - DNA, 103 bp, Artificial Sequence
  Synthetic Polynucleotide
taatacgactcactatagggcacacgtgcaggattcgatggaaccttctgaacagaggagacagaagatgccatcgaataacctggcggcagcgcaaaagatg

SEQ ID NO: 225852 - DNA, 103 bp, Artificial Sequence
  Synthetic Polynucleotide
taatacgactcactatagggcgccggtagtcacacgtgcaggattcgatgaacagaggagacatcgaatgctgcacgtgaacctggcggcagcgcaaaagatg

SEQ ID NO: 225853 - DNA, 103 bp, Artificial Sequence
  Synthetic Polynucleotide
taatacgactcactatagggggggccgcgccgccggtagtcacacgtgcaaacagaggagatgcacgatggactaccggaacctggcggcagcgcaaaagatg

SEQ ID NO: 225854 - DNA, 103 bp, Artificial Sequence
  Synthetic Polynucleotide
taatacgactcactatagggcggggcccccggggccgcgccgccggtagtaacagaggagaactaccatgggcgcggccaacctggcggcagcgcaaaagatg

SEQ ID NO: 225855 - DNA, 103 bp, Artificial Sequence
  Synthetic Polynucleotide
taatacgactcactatagggcagtgccagtcggggcccccggggccgcgcaacagaggagagcgcggatgcgggggcccaacctggcggcagcgcaaaagatg

SEQ ID NO: 225856 - DNA, 103 bp, Artificial Sequence
  Synthetic Polynucleotide
taatacgactcactataggggcagcccccccagtgccagtcggggcccccaacagaggagagggggcatggactggcacaacctggcggcagcgcaaaagatg

SEQ ID NO: 225857 - DNA, 103 bp, Artificial Sequence
  Synthetic Polynucleotide
taatacgactcactatagggcgggcagagcggccagcgccagcagcagcgaacagaggagacgctgcatgtggcgctggaacctggcggcagcgcaaaagatg

SEQ ID NO: 225858 - DNA, 103 bp, Artificial Sequence
  Synthetic Polynucleotide
taatacgactcactatagggtgttgtcgctgcagcccccccagtgccagtaacagaggagaactggcatggggggggctaacctggcggcagcgcaaaagatg

SEQ ID NO: 225859 - DNA, 103 bp, Artificial Sequence
  Synthetic Polynucleotide
taatacgactcactatagggccgaagtcaatgttgtcgctgcagccccccaacagaggagaggggggatgcagcgacaaaacctggcggcagcgcaaaagatg

SEQ ID NO: 225860 - DNA, 103 bp, Artificial Sequence
  Synthetic Polynucleotide
taatacgactcactataggggaagaggcggccgaagtcaatgttgtcgctaacagaggagaagcgacatgattgacttcaacctggcggcagcgcaaaagatg

SEQ ID NO: 225861 - DNA, 103 bp, Artificial Sequence
  Synthetic Polynucleotide
taatacgactcactatagggactcccggccgaagaggcggccgaagtcaaaacagaggagattgactatggccgcctctaacctggcggcagcgcaaaagatg

SEQ ID NO: 225862 - DNA, 103 bp, Artificial Sequence
  Synthetic Polynucleotide
taatacgactcactataggggagtccacgaactcccggccgaagaggcggaacagaggagaccgcctatgcggccgggaaacctggcggcagcgcaaaagatg

SEQ ID NO: 225863 - DNA, 103 bp, Artificial Sequence
  Synthetic Polynucleotide
taatacgactcactatagggcttctccccggagtccacgaactcccggccaacagaggagaggccggatgttcgtggacaacctggcggcagcgcaaaagatg

SEQ ID NO: 225864 - DNA, 103 bp, Artificial Sequence
  Synthetic Polynucleotide
taatacgactcactatagggggtcccgccccttctccccggagtccacgaaacagaggagatcgtggatgccggggagaaacctggcggcagcgcaaaagatg

SEQ ID NO: 225865 - DNA, 103 bp, Artificial Sequence
  Synthetic Polynucleotide
taatacgactcactatagggaggaagcgcaggtcccgccccttctccccgaacagaggagacggggaatgggggcgggaaacctggcggcagcgcaaaagatg

SEQ ID NO: 225866 - DNA, 103 bp, Artificial Sequence
  Synthetic Polynucleotide
taatacgactcactatagggaaggttcatgaggaagcgcaggtcccgcccaacagaggagagggcggatgctgcgcttcaacctggcggcagcgcaaaagatg

SEQ ID NO: 225867 - DNA, 103 bp, Artificial Sequence
  Synthetic Polynucleotide
taatacgactcactatagggcgttgttgtgaaggttcatgaggaagcgcaaacagaggagatgcgctatgtcatgaaccaacctggcggcagcgcaaaagatg

SEQ ID NO: 225868 - DNA, 103 bp, Artificial Sequence
  Synthetic Polynucleotide
taatacgactcactataggggccagggctgcgggcagagcggccagcgccaacagaggagaggcgctatgcgctctgccaacctggcggcagcgcaaaagatg

SEQ ID NO: 225869 - DNA, 103 bp, Artificial Sequence
  Synthetic Polynucleotide
taatacgactcactatagggcggcctgcctcgttgttgtgaaggttcatgaacagaggagacatgaaatgtcacaacaaaacctggcggcagcgcaaaagatg

SEQ ID NO: 225870 - DNA, 103 bp, Artificial Sequence
  Synthetic Polynucleotide
taatacgactcactatagggtacggtcgtacggcctgcctcgttgttgtgaacagaggagacacaacatggaggcaggcaacctggcggcagcgcaaaagatg

SEQ ID NO: 225871 - DNA, 103 bp, Artificial Sequence
  Synthetic Polynucleotide
taatacgactcactatagggtctcggagaatacggtcgtacggcctgcctaacagaggagaaggcagatggtacgaccgaacctggcggcagcgcaaaagatg

SEQ ID NO: 225872 - DNA, 103 bp, Artificial Sequence
  Synthetic Polynucleotide
taatacgactcactatagggtcctggcgcatctcggagaatacggtcgtaaacagaggagatacgacatgattctccgaaacctggcggcagcgcaaaagatg

SEQ ID NO: 225873 - DNA, 103 bp, Artificial Sequence
  Synthetic Polynucleotide
taatacgactcactataggggcacttgcactcctggcgcatctcggagaaaacagaggagattctccatgatgcgccagaacctggcggcagcgcaaaagatg

SEQ ID NO: 225874 - DNA, 103 bp, Artificial Sequence
  Synthetic Polynucleotide
taatacgactcactatagggacatcccgtggcacttgcactcctggcgcaaacagaggagatgcgccatgagtgcaagtaacctggcggcagcgcaaaagatg

SEQ ID NO: 225875 - DNA, 103 bp, Artificial Sequence
  Synthetic Polynucleotide
taatacgactcactatagggcatgagccggacatcccgtggcacttgcacaacagaggagagtgcaaatgccacgggataacctggcggcagcgcaaaagatg

SEQ ID NO: 225876 - DNA, 103 bp, Artificial Sequence
  Synthetic Polynucleotide
taatacgactcactataggggcgcaccgtgcatgagccggacatcccgtgaacagaggagacacgggatgtccggctcaaacctggcggcagcgcaaaagatg

SEQ ID NO: 225877 - DNA, 103 bp, Artificial Sequence
  Synthetic Polynucleotide
taatacgactcactatagggtccagcacgtgcgcaccgtgcatgagccggaacagaggagaccggctatggcacggtgcaacctggcggcagcgcaaaagatg

SEQ ID NO: 225878 - DNA, 103 bp, Artificial Sequence
  Synthetic Polynucleotide
taatacgactcactatagggggcagccgcatccagcacgtgcgcaccgtgaacagaggagacacggtatgcacgtgctgaacctggcggcagcgcaaaagatg

SEQ ID NO: 225879 - DNA, 103 bp, Artificial Sequence
  Synthetic Polynucleotide
taatacgactcactataggggctgttggcagccagggctgcgggcagagcaacagaggagagctctgatggcagccctgaacctggcggcagcgcaaaagatg

SEQ ID NO: 225880 - DNA, 103 bp, Artificial Sequence
  Synthetic Polynucleotide
taatacgactcactataggggcgcagcgtgggcagccgcatccagcacgtaacagaggagaacgtgcatgatgcggctgaacctggcggcagcgcaaaagatg

SEQ ID NO: 225881 - DNA, 103 bp, Artificial Sequence
  Synthetic Polynucleotide
taatacgactcactatagggcgcccacggcgcgcagcgtgggcagccgcaaacagaggagatgcggcatgccacgctgcaacctggcggcagcgcaaaagatg

SEQ ID NO: 225882 - DNA, 103 bp, Artificial Sequence
  Synthetic Polynucleotide
taatacgactcactatagggcgcagcacatcgcccacggcgcgcagcgtgaacagaggagacacgctatgcgccgtgggaacctggcggcagcgcaaaagatg

SEQ ID NO: 225883 - DNA, 103 bp, Artificial Sequence
  Synthetic Polynucleotide
taatacgactcactataggggaagcggtcgcgcagcacatcgcccacggcaacagaggagagccgtgatggatgtgctgaacctggcggcagcgcaaaagatg

SEQ ID NO: 225884 - DNA, 103 bp, Artificial Sequence
  Synthetic Polynucleotide
taatacgactcactatagggaggcgccgtcgaagcggtcgcgcagcacataacagaggagaatgtgcatggcgaccgctaacctggcggcagcgcaaaagatg

SEQ ID NO: 225885 - DNA, 103 bp, Artificial Sequence
  Synthetic Polynucleotide
taatacgactcactatagggaggacgcgcgaggcgccgtcgaagcggtcgaacagaggagacgaccgatgcgacggcgcaacctggcggcagcgcaaaagatg

SEQ ID NO: 225886 - DNA, 103 bp, Artificial Sequence
  Synthetic Polynucleotide
taatacgactcactataggggttgccgtacaggacgcgcgaggcgccgtcaacagaggagagacggcatgtcgcgcgtcaacctggcggcagcgcaaaagatg

SEQ ID NO: 225887 - DNA, 103 bp, Artificial Sequence
  Synthetic Polynucleotide
taatacgactcactatagggtgctgccgcggttgccgtacaggacgcgcgaacagaggagacgcgcgatgtgtacggcaaacctggcggcagcgcaaaagatg

SEQ ID NO: 225888 - DNA, 103 bp, Artificial Sequence
  Synthetic Polynucleotide
taatacgactcactataggggaagcgcggttgctgccgcggttgccgtacaacagaggagagtacggatgccgcggcagaacctggcggcagcgcaaaagatg

SEQ ID NO: 225889 - DNA, 103 bp, Artificial Sequence
  Synthetic Polynucleotide
taatacgactcactatagggctccgcccgcgaagcgcggttgctgccgcgaacagaggagacgcggcatgaaccgcgctaacctggcggcagcgcaaaagatg

SEQ ID NO: 225890 - DNA, 103 bp, Artificial Sequence
  Synthetic Polynucleotide
taatacgactcactatagggatcggccactgctgttggcagccagggctgaacagaggagacagcccatgctgccaacaaacctggcggcagcgcaaaagatg

SEQ ID NO: 225891 - DNA, 103 bp, Artificial Sequence
  Synthetic Polynucleotide
taatacgactcactatagggggcgcagcagctccgcccgcgaagcgcggtaacagaggagaaccgcgatgcgcgggcggaacctggcggcagcgcaaaagatg

SEQ ID NO: 225892 - DNA, 103 bp, Artificial Sequence
  Synthetic Polynucleotide
taatacgactcactatagggtccggctccaggcgcagcagctccgcccgcaacagaggagagcgggcatggctgctgcgaacctggcggcagcgcaaaagatg

SEQ ID NO: 225893 - DNA, 103 bp, Artificial Sequence
  Synthetic Polynucleotide
taatacgactcactatagggggccgggtcttccggctccaggcgcagcagaacagaggagactgctgatgctggagccgaacctggcggcagcgcaaaagatg

SEQ ID NO: 225894 - DNA, 103 bp, Artificial Sequence
  Synthetic Polynucleotide
taatacgactcactataggggcggtttgtgggccgggtcttccggctccaaacagaggagatggagcatgaagacccggaacctggcggcagcgcaaaagatg

SEQ ID NO: 225895 - DNA, 103 bp, Artificial Sequence
  Synthetic Polynucleotide
taatacgactcactatagggtggggggagggcggtttgtgggccgggtctaacagaggagaagacccatgccacaaaccaacctggcggcagcgcaaaagatg

SEQ ID NO: 225896 - DNA, 103 bp, Artificial Sequence
  Synthetic Polynucleotide
taatacgactcactataggggacgaggtcgtggggggagggcggtttgtgaacagaggagacacaaaatgccctcccccaacctggcggcagcgcaaaagatg

SEQ ID NO: 225897 - DNA, 103 bp, Artificial Sequence
  Synthetic Polynucleotide
taatacgactcactatagggtctcgaagtagacgaggtcgtggggggaggaacagaggagacctcccatgacgacctcgaacctggcggcagcgcaaaagatg

SEQ ID NO: 225898 - DNA, 103 bp, Artificial Sequence
  Synthetic Polynucleotide
taatacgactcactatagggttgggcgatttctcgaagtagacgaggtcgaacagaggagacgacctatgctacttcgaaacctggcggcagcgcaaaagatg

SEQ ID NO: 225899 - DNA, 103 bp, Artificial Sequence
  Synthetic Polynucleotide
taatacgactcactatagggcgtgcagaagttgggcgatttctcgaagtaaacagaggagatacttcatgaaatcgcccaacctggcggcagcgcaaaagatg

SEQ ID NO: 225900 - DNA, 103 bp, Artificial Sequence
  Synthetic Polynucleotide
taatacgactcactataggggtccgctgtacgtgcagaagttgggcgattaacagaggagaaatcgcatgacttctgcaaacctggcggcagcgcaaaagatg

SEQ ID NO: 225901 - DNA, 103 bp, Artificial Sequence
  Synthetic Polynucleotide
taatacgactcactatagggataccccaccatcggccactgctgttggcaaacagaggagatgccaaatgcagtggccgaacctggcggcagcgcaaaagatg

SEQ ID NO: 225902 - DNA, 103 bp, Artificial Sequence
  Synthetic Polynucleotide
taatacgactcactataggggtgcccaggcgtccgctgtacgtgcagaagaacagaggagacttctgatggtacagcggaacctggcggcagcgcaaaagatg

SEQ ID NO: 225903 - DNA, 103 bp, Artificial Sequence
  Synthetic Polynucleotide
taatacgactcactatagggcgtgcctgctgtgcccaggcgtccgctgtaaacagaggagatacagcatgcgcctgggcaacctggcggcagcgcaaaagatg

SEQ ID NO: 225904 - DNA, 103 bp, Artificial Sequence
  Synthetic Polynucleotide
taatacgactcactatagggcgcgccctgccgtgcctgctgtgcccaggcaacagaggagagcctggatgcagcaggcaaacctggcggcagcgcaaaagatg

SEQ ID NO: 225905 - DNA, 103 bp, Artificial Sequence
  Synthetic Polynucleotide
taatacgactcactatagggctgttacaggcgcgccctgccgtgcctgctaacagaggagaagcaggatgggcagggcgaacctggcggcagcgcaaaagatg

SEQ ID NO: 225906 - DNA, 103 bp, Artificial Sequence
  Synthetic Polynucleotide
taatacgactcactataggggggcgacgagctgttacaggcgcgccctgcaacagaggagagcagggatggcctgtaacaacctggcggcagcgcaaaagatg

SEQ ID NO: 225907 - DNA, 103 bp, Artificial Sequence
  Synthetic Polynucleotide
taatacgactcactatagggcgtccagcgcgggcgacgagctgttacaggaacagaggagacctgtaatggctcgtcgcaacctggcggcagcgcaaaagatg

SEQ ID NO: 225908 - DNA, 103 bp, Artificial Sequence
  Synthetic Polynucleotide
taatacgactcactatagggagctcgcagccgtccagcgcgggcgacgagaacagaggagactcgtcatgcgcgctggaaacctggcggcagcgcaaaagatg

SEQ ID NO: 225909 - DNA, 103 bp, Artificial Sequence
  Synthetic Polynucleotide
taatacgactcactataggggcagcagagcagctcgcagccgtccagcgcaacagaggagagcgctgatgggctgcgagaacctggcggcagcgcaaaagatg

SEQ ID NO: 225910 - DNA, 103 bp, Artificial Sequence
  Synthetic Polynucleotide
taatacgactcactatagggggcccctgccgcagcagagcagctcgcagcaacagaggagagctgcgatgtgctctgctaacctggcggcagcgcaaaagatg

SEQ ID NO: 225911 - DNA, 103 bp, Artificial Sequence
  Synthetic Polynucleotide
taatacgactcactatagggcgcgtgcggtggcccctgccgcagcagagcaacagaggagagctctgatgcggcaggggaacctggcggcagcgcaaaagatg

SEQ ID NO: 225912 - DNA, 103 bp, Artificial Sequence
  Synthetic Polynucleotide
taatacgactcactatagggcgcctcgcagacctgcggccgcgccctcataacagaggagaatgaggatgcggccgcagaacctggcggcagcgcaaaagatg

SEQ ID NO: 225913 - DNA, 103 bp, Artificial Sequence
  Synthetic Polynucleotide
taatacgactcactataggggttcagtgccagggccgatggtgtcttggaaacagaggagatccaagatgccatcggccaacctggcggcagcgcaaaagatg

SEQ ID NO: 225914 - DNA, 103 bp, Artificial Sequence
  Synthetic Polynucleotide
taatacgactcactatagggggtgacgtagcagcaccagtggtacttacaaacagaggagatgtaagatgcactggtgcaacctggcggcagcgcaaaagatg

SEQ ID NO: 225915 - DNA, 103 bp, Artificial Sequence
  Synthetic Polynucleotide
taatacgactcactatagggacctgcggcaggtgacgtagcagcaccagtaacagaggagaactggtatggctacgtcaaacctggcggcagcgcaaaagatg

SEQ ID NO: 225916 - DNA, 103 bp, Artificial Sequence
  Synthetic Polynucleotide
taatacgactcactataggggtacgctcacacctgcggcaggtgacgtagaacagaggagactacgtatgctgccgcagaacctggcggcagcgcaaaagatg

SEQ ID NO: 225917 - DNA, 103 bp, Artificial Sequence
  Synthetic Polynucleotide
taatacgactcactataggggcgctccacggtacgctcacacctgcggcaaacagaggagatgccgcatgtgtgagcgtaacctggcggcagcgcaaaagatg

SEQ ID NO: 225918 - DNA, 103 bp, Artificial Sequence
  Synthetic Polynucleotide
taatacgactcactatagggtgcagacatagcgctccacggtacgctcacaacagaggagagtgagcatgccgtggagcaacctggcggcagcgcaaaagatg

SEQ ID NO: 225919 - DNA, 103 bp, Artificial Sequence
  Synthetic Polynucleotide
taatacgactcactataggggttgcgtctggttcagtgccagggccgatgaacagaggagacatcggatgtggcactgaaacctggcggcagcgcaaaagatg

SEQ ID NO: 225920 - DNA, 103 bp, Artificial Sequence
  Synthetic Polynucleotide
taatacgactcactatagggtgcttgcagtgttgcgtctggttcagtgccaacagaggagaggcactatgccagacgcaaacctggcggcagcgcaaaagatg

SEQ ID NO: 225921 - DNA, 103 bp, Artificial Sequence
  Synthetic Polynucleotide
taatacgactcactatagggaccctccagctgcttgcagtgttgcgtctgaacagaggagacagacgatgcactgcaagaacctggcggcagcgcaaaagatg

SEQ ID NO: 225922 - DNA, 103 bp, Artificial Sequence
  Synthetic Polynucleotide
taatacgactcactatagggcagacaccagaccctccagctgcttgcagtaacagaggagaactgcaatgagctggaggaacctggcggcagcgcaaaagatg

SEQ ID NO: 225923 - DNA, 103 bp, Artificial Sequence
  Synthetic Polynucleotide
taatacgactcactatagggtgcacctgtgcagacaccagaccctccagcaacagaggagagctggaatgtctggtgtcaacctggcggcagcgcaaaagatg

SEQ ID NO: 225924 - DNA, 103 bp, Artificial Sequence
  Synthetic Polynucleotide
taatacgactcactataggggcggcacagctgcacctgtgcagacaccagaacagaggagactggtgatggcacaggtgaacctggcggcagcgcaaaagatg

SEQ ID NO: 225925 - DNA, 103 bp, Artificial Sequence
  Synthetic Polynucleotide
taatacgactcactatagggccaggttgctgcggcacagctgcacctgtgaacagaggagacacaggatgagctgtgccaacctggcggcagcgcaaaagatg

SEQ ID NO: 225926 - DNA, 103 bp, Artificial Sequence
  Synthetic Polynucleotide
taatacgactcactatagggtgcatgagctccaggttgctgcggcacagcaacagaggagagctgtgatgcagcaacctaacctggcggcagcgcaaaagatg

SEQ ID NO: 225927 - DNA, 103 bp, Artificial Sequence
  Synthetic Polynucleotide
taatacgactcactatagggcaccaccgtgtgcatgagctccaggttgctaacagaggagaagcaacatggagctcatgaacctggcggcagcgcaaaagatg

SEQ ID NO: 225928 - DNA, 103 bp, Artificial Sequence
  Synthetic Polynucleotide
taatacgactcactatagggcgaagagcagcgcctcgcagacctgcggccaacagaggagaggccgcatgtctgcgaggaacctggcggcagcgcaaaagatg

SEQ ID NO: 225929 - DNA, 103 bp, Artificial Sequence
  Synthetic Polynucleotide
taatacgactcactataggggggcggcgtgcaccaccgtgtgcatgagctaacagaggagaagctcaatgacacggtggaacctggcggcagcgcaaaagatg

SEQ ID NO: 225930 - DNA, 103 bp, Artificial Sequence
  Synthetic Polynucleotide
taatacgactcactatagggatgacctcgcgggcggcgtgcaccaccgtgaacagaggagacacggtatggcacgccgcaacctggcggcagcgcaaaagatg

SEQ ID NO: 225931 - DNA, 103 bp, Artificial Sequence
  Synthetic Polynucleotide
taatacgactcactatagggacaggccttcatgacctcgcgggcggcgtgaacagaggagacacgccatgcgcgaggtcaacctggcggcagcgcaaaagatg

SEQ ID NO: 225932 - DNA, 103 bp, Artificial Sequence
  Synthetic Polynucleotide
taatacgactcactatagggaggcccggcgacaggccttcatgacctcgcaacagaggagagcgaggatgtgaaggcctaacctggcggcagcgcaaaagatg

SEQ ID NO: 225933 - DNA, 103 bp, Artificial Sequence
  Synthetic Polynucleotide
taatacgactcactatagggatgtcggcaaaggcccggcgacaggccttcaacagaggagagaaggcatgtcgccgggcaacctggcggcagcgcaaaagatg

SEQ ID NO: 225934 - DNA, 103 bp, Artificial Sequence
  Synthetic Polynucleotide
taatacgactcactataggggttccagcgcatgtcggcaaaggcccggcgaacagaggagacgccggatgtttgccgacaacctggcggcagcgcaaaagatg

SEQ ID NO: 225935 - DNA, 103 bp, Artificial Sequence
  Synthetic Polynucleotide
taatacgactcactatagggtggaggagcagttccagcgcatgtcggcaaaacagaggagattgccgatgtgcgctggaaacctggcggcagcgcaaaagatg

SEQ ID NO: 225936 - DNA, 103 bp, Artificial Sequence
  Synthetic Polynucleotide
taatacgactcactataggggcgagctcaatggaggagcagttccagcgcaacagaggagagcgctgatgctgctcctcaacctggcggcagcgcaaaagatg

SEQ ID NO: 225937 - DNA, 103 bp, Artificial Sequence
  Synthetic Polynucleotide
taatacgactcactatagggatagttgggggcgagctcaatggaggagcaaacagaggagatgctccatgattgagctcaacctggcggcagcgcaaaagatg

SEQ ID NO: 225938 - DNA, 103 bp, Artificial Sequence
  Synthetic Polynucleotide
taatacgactcactatagggggtcaagcaaatagttgggggcgagctcaaaacagaggagattgagcatgcccccaactaacctggcggcagcgcaaaagatg

SEQ ID NO: 225939 - DNA, 103 bp, Artificial Sequence
  Synthetic Polynucleotide
taatacgactcactatagggagcgccagggcgaagagcagcgcctcgcagaacagaggagactgcgaatggctgctcttaacctggcggcagcgcaaaagatg

SEQ ID NO: 225940 - DNA, 103 bp, Artificial Sequence
  Synthetic Polynucleotide
taatacgactcactatagggcctctctccaggtcaagcaaatagttggggaacagaggagaccccaaatgtttgcttgaaacctggcggcagcgcaaaagatg

SEQ ID NO: 225941 - DNA, 103 bp, Artificial Sequence
  Synthetic Polynucleotide
taatacgactcactatagggctcccgggtccctctctccaggtcaagcaaaacagaggagattgcttatgctggagagaaacctggcggcagcgcaaaagatg

SEQ ID NO: 225942 - DNA, 103 bp, Artificial Sequence
  Synthetic Polynucleotide
taatacgactcactatagggcgaaggccgactcccgggtccctctctccaaacagaggagatggagaatgggacccgggaacctggcggcagcgcaaaagatg

SEQ ID NO: 225943 - DNA, 103 bp, Artificial Sequence
  Synthetic Polynucleotide
taatacgactcactatagggagcgcatacacgaaggccgactcccgggtcaacagaggagagacccgatggtcggccttaacctggcggcagcgcaaaagatg

SEQ ID NO: 225944 - DNA, 103 bp, Artificial Sequence
  Synthetic Polynucleotide
taatacgactcactatagggggcggccgacagcgcatacacgaaggccgaaacagaggagatcggccatggtgtatgcgaacctggcggcagcgcaaaagatg

SEQ ID NO: 225945 - DNA, 103 bp, Artificial Sequence
  Synthetic Polynucleotide
taatacgactcactatagggggctgatggcggcggccgacagcgcatacaaacagaggagatgtatgatgtgtcggccgaacctggcggcagcgcaaaagatg

SEQ ID NO: 225946 - DNA, 103 bp, Artificial Sequence
  Synthetic Polynucleotide
taatacgactcactataggggcgatggcgtggctgatggcggcggccgacaacagaggagagtcggcatgcgccatcagaacctggcggcagcgcaaaagatg

SEQ ID NO: 225947 - DNA, 103 bp, Artificial Sequence
  Synthetic Polynucleotide
taatacgactcactataggggcaggcccgggcgatggcgtggctgatggcaacagaggagagccatcatgcacgccatcaacctggcggcagcgcaaaagatg

SEQ ID NO: 225948 - DNA, 103 bp, Artificial Sequence
  Synthetic Polynucleotide
taatacgactcactatagggcgccggaggtgcaggcccgggcgatggcgtaacagaggagaacgccaatgcccgggcctaacctggcggcagcgcaaaagatg

SEQ ID NO: 225949 - DNA, 103 bp, Artificial Sequence
  Synthetic Polynucleotide
taatacgactcactatagggccgggcaggtcgccggaggtgcaggcccggaacagaggagaccgggcatgcacctccggaacctggcggcagcgcaaaagatg

SEQ ID NO: 225950 - DNA, 103 bp, Artificial Sequence
  Synthetic Polynucleotide
taatacgactcactataggggccggtctggagcgccagggcgaagagcagaacagaggagactgctcatggccctggcgaacctggcggcagcgcaaaagatg

SEQ ID NO: 225951 - DNA, 103 bp, Artificial Sequence
  Synthetic Polynucleotide
taatacgactcactataggggcaggagcagccgggcaggtcgccggaggtaacagaggagaacctccatggacctgcccaacctggcggcagcgcaaaagatg

SEQ ID NO: 225952 - DNA, 103 bp, Artificial Sequence
  Synthetic Polynucleotide
taatacgactcactatagggggacggggccgcaggagcagccgggcaggtaacagaggagaacctgcatggctgctcctaacctggcggcagcgcaaaagatg

SEQ ID NO: 225953 - DNA, 103 bp, Artificial Sequence
  Synthetic Polynucleotide
taatacgactcactatagggggctcacctgggacggggccgcaggagcagaacagaggagactgctcatgcggccccgtaacctggcggcagcgcaaaagatg

SEQ ID NO: 225954 - DNA, 103 bp, Artificial Sequence
  Synthetic Polynucleotide
taatacgactcactataggggggcccgggtggctcacctgggacggggccaacagaggagaggccccatgccaggtgagaacctggcggcagcgcaaaagatg

SEQ ID NO: 225955 - DNA, 103 bp, Artificial Sequence
  Synthetic Polynucleotide
taatacgactcactatagggagcggttcccgggcccgggtggctcacctgaacagaggagacaggtgatgcacccgggcaacctggcggcagcgcaaaagatg

SEQ ID NO: 225956 - DNA, 103 bp, Artificial Sequence
  Synthetic Polynucleotide
taatacgactcactatagggcatcctccccagcggttcccgggcccgggtaacagaggagaacccggatgcgggaaccgaacctggcggcagcgcaaaagatg

SEQ ID NO: 225957 - DNA, 103 bp, Artificial Sequence
  Synthetic Polynucleotide
taatacgactcactataggggttgtccgcacatcctccccagcggttcccaacagaggagagggaacatgtggggaggaaacctggcggcagcgcaaaagatg

SEQ ID NO: 225958 - DNA, 103 bp, Artificial Sequence
  Synthetic Polynucleotide
taatacgactcactatagggcgtagctgaggttgtccgcacatcctccccaacagaggagaggggagatggtgcggacaaacctggcggcagcgcaaaagatg

SEQ ID NO: 225959 - DNA, 103 bp, Artificial Sequence
  Synthetic Polynucleotide
taatacgactcactatagggatgaggagcccgtagctgaggttgtccgcaaacagaggagatgcggaatgcctcagctaaacctggcggcagcgcaaaagatg

SEQ ID NO: 225960 - DNA, 103 bp, Artificial Sequence
  Synthetic Polynucleotide
taatacgactcactatagggcttggcccccatgaggagcccgtagctgagaacagaggagactcagcatggggctcctcaacctggcggcagcgcaaaagatg

SEQ ID NO: 225961 - DNA, 103 bp, Artificial Sequence
  Synthetic Polynucleotide
taatacgactcactatagggcatagcacacgccggtctggagcgccagggaacagaggagaccctggatgtccagaccgaacctggcggcagcgcaaaagatg

SEQ ID NO: 225962 - DNA, 103 bp, Artificial Sequence
  Synthetic Polynucleotide
taatacgactcactatagggcatcggaaaacttggcccccatgaggagccaacagaggagaggctccatgtgggggccaaacctggcggcagcgcaaaagatg

SEQ ID NO: 225963 - DNA, 103 bp, Artificial Sequence
  Synthetic Polynucleotide
taatacgactcactatagggttcataggagcatcggaaaacttggcccccaacagaggagagggggcatggttttccgaaacctggcggcagcgcaaaagatg

SEQ ID NO: 225964 - DNA, 103 bp, Artificial Sequence
  Synthetic Polynucleotide
taatacgactcactatagggttttttcaccttcataggagcatcggaaaaaacagaggagattttccatggctcctatgaacctggcggcagcgcaaaagatg

SEQ ID NO: 225965 - DNA, 103 bp, Artificial Sequence
  Synthetic Polynucleotide
taatacgactcactataggggggatcctgtttttttcaccttcataggagaacagaggagactcctaatgaggtgaaaaaacctggcggcagcgcaaaagatg

SEQ ID NO: 225966 - DNA, 103 bp, Artificial Sequence
  Synthetic Polynucleotide
taatacgactcactatagggttattggcttgggatcctgtttttttcaccaacagaggagaggtgaaatgaacaggatcaacctggcggcagcgcaaaagatg

SEQ ID NO: 225967 - DNA, 103 bp, Artificial Sequence
  Synthetic Polynucleotide
taatacgactcactatagggacgcatcagtttattggcttgggatcctgtaacagaggagaacaggaatgcaagccaataacctggcggcagcgcaaaagatg

SEQ ID NO: 225968 - DNA, 103 bp, Artificial Sequence
  Synthetic Polynucleotide
taatacgactcactatagggtgttgtgtagacgcatcagtttattggcttaacagaggagaaagccaatgaactgatgcaacctggcggcagcgcaaaagatg

SEQ ID NO: 225969 - DNA, 103 bp, Artificial Sequence
  Synthetic Polynucleotide
taatacgactcactatagggcccacttcactgttgtgtagacgcatcagtaacagaggagaactgatatgtctacacaaaacctggcggcagcgcaaaagatg

SEQ ID NO: 225970 - DNA, 103 bp, Artificial Sequence
  Synthetic Polynucleotide
taatacgactcactatagggagcctgtctccccacttcactgttgtgtagaacagaggagactacacatgagtgaagtgaacctggcggcagcgcaaaagatg

SEQ ID NO: 225971 - DNA, 103 bp, Artificial Sequence
  Synthetic Polynucleotide
taatacgactcactatagggaggcgcgcagagcctgtctccccacttcacaacagaggagagtgaagatgggagacaggaacctggcggcagcgcaaaagatg

SEQ ID NO: 225972 - DNA, 103 bp, Artificial Sequence
  Synthetic Polynucleotide
taatacgactcactatagggcacttgatgccatagcacacgccggtctggaacagaggagaccagacatgcgtgtgctaaacctggcggcagcgcaaaagatg

SEQ ID NO: 225973 - DNA, 103 bp, Artificial Sequence
  Synthetic Polynucleotide
taatacgactcactatagggatttccagagaggcgcgcagagcctgtctcaacagaggagagagacaatgtctgcgcgcaacctggcggcagcgcaaaagatg

SEQ ID NO: 225974 - DNA, 103 bp, Artificial Sequence
  Synthetic Polynucleotide
taatacgactcactatagggcttacacttcatttccagagaggcgcgcagaacagaggagactgcgcatgtctctggaaaacctggcggcagcgcaaaagatg

SEQ ID NO: 225975 - DNA, 103 bp, Artificial Sequence
  Synthetic Polynucleotide
taatacgactcactatagggccccatggcacttacacttcatttccagagaacagaggagactctggatgtgaagtgtaaacctggcggcagcgcaaaagatg

SEQ ID NO: 225976 - DNA, 103 bp, Artificial Sequence
  Synthetic Polynucleotide
taatacgactcactataggggagccagacaccccatggcacttacacttcaacagaggagagaagtgatggtgccatggaacctggcggcagcgcaaaagatg

SEQ ID NO: 225977 - DNA, 103 bp, Artificial Sequence
  Synthetic Polynucleotide
taatacgactcactataggggatggagcaggagccagacaccccatggcaaacagaggagatgccatatggtgtctggcaacctggcggcagcgcaaaagatg

SEQ ID NO: 225978 - DNA, 103 bp, Artificial Sequence
  Synthetic Polynucleotide
taatacgactcactatagggagcaggtgcggatggagcaggagccagacaaacagaggagatgtctgatgcctgctccaaacctggcggcagcgcaaaagatg

SEQ ID NO: 225979 - DNA, 103 bp, Artificial Sequence
  Synthetic Polynucleotide
taatacgactcactatagggagccccttccagcaggtgcggatggagcagaacagaggagactgctcatgccgcacctgaacctggcggcagcgcaaaagatg

SEQ ID NO: 225980 - DNA, 103 bp, Artificial Sequence
  Synthetic Polynucleotide
taatacgactcactatagggcagctcctgcagccccttccagcaggtgcgaacagaggagacgcaccatgtggaaggggaacctggcggcagcgcaaaagatg

SEQ ID NO: 225981 - DNA, 103 bp, Artificial Sequence
  Synthetic Polynucleotide
taatacgactcactatagggccacatcctgcagctcctgcagccccttccaacagaggagaggaaggatgtgcaggagcaacctggcggcagcgcaaaagatg

SEQ ID NO: 225982 - DNA, 103 bp, Artificial Sequence
  Synthetic Polynucleotide
taatacgactcactatagggaggtcagcagccacatcctgcagctcctgcaacagaggagagcaggaatggcaggatgtaacctggcggcagcgcaaaagatg

SEQ ID NO: 225983 - DNA, 103 bp, Artificial Sequence
  Synthetic Polynucleotide
taatacgactcactatagggcagcgccagccacttgatgccatagcacacaacagaggagagtgtgcatgggcatcaagaacctggcggcagcgcaaaagatg

SEQ ID NO: 225984 - DNA, 103 bp, Artificial Sequence
  Synthetic Polynucleotide
taatacgactcactatagggtcgggtcttgaggtcagcagccacatcctgaacagaggagacaggatatggctgctgacaacctggcggcagcgcaaaagatg

SEQ ID NO: 225985 - DNA, 103 bp, Artificial Sequence
  Synthetic Polynucleotide
taatacgactcactatagggccgacaggtatcgggtcttgaggtcagcagaacagaggagactgctgatgtcaagacccaacctggcggcagcgcaaaagatg

SEQ ID NO: 225986 - DNA, 103 bp, Artificial Sequence
  Synthetic Polynucleotide
taatacgactcactatagggaccttggtggccgacaggtatcgggtcttgaacagaggagacaagacatgatacctgtcaacctggcggcagcgcaaaagatg

SEQ ID NO: 225987 - DNA, 103 bp, Artificial Sequence
  Synthetic Polynucleotide
taatacgactcactatagggtcggtgcactaccttggtggccgacaggtaaacagaggagatacctgatggccaccaagaacctggcggcagcgcaaaagatg

SEQ ID NO: 225988 - DNA, 103 bp, Artificial Sequence
  Synthetic Polynucleotide
taatacgactcactatagggtgcccatgggtcggtgcactaccttggtggaacagaggagaccaccaatgtagtgcaccaacctggcggcagcgcaaaagatg

SEQ ID NO: 225989 - DNA, 103 bp, Artificial Sequence
  Synthetic Polynucleotide
taatacgactcactatagggtgcttgcgggtgcccatgggtcggtgcactaacagaggagaagtgcaatgacccatgggaacctggcggcagcgcaaaagatg

SEQ ID NO: 225990 - DNA, 103 bp, Artificial Sequence
  Synthetic Polynucleotide
taatacgactcactataggggggcaccaggtgcttgcgggtgcccatgggaacagaggagacccatgatgacccgcaagaacctggcggcagcgcaaaagatg

SEQ ID NO: 225991 - DNA, 103 bp, Artificial Sequence
  Synthetic Polynucleotide
taatacgactcactatagggccaggtccttgggcaccaggtgcttgcgggaacagaggagacccgcaatgacctggtgcaacctggcggcagcgcaaaagatg

SEQ ID NO: 225992 - DNA, 103 bp, Artificial Sequence
  Synthetic Polynucleotide
taatacgactcactatagggggccggatatccaggtccttgggcaccaggaacagaggagacctggtatgcaaggacctaacctggcggcagcgcaaaagatg

SEQ ID NO: 225993 - DNA, 103 bp, Artificial Sequence
  Synthetic Polynucleotide
taatacgactcactataggggtccttcacaggccggatatccaggtccttaacagaggagaaaggacatggatatccggaacctggcggcagcgcaaaagatg

SEQ ID NO: 225994 - DNA, 103 bp, Artificial Sequence
  Synthetic Polynucleotide
taatacgactcactataggggtgtcttggacagcgccagccacttgatgcaacagaggagagcatcaatgggctggcgcaacctggcggcagcgcaaaagatg

SEQ ID NO: 225995 - DNA, 103 bp, Artificial Sequence
  Synthetic Polynucleotide
taatacgactcactatagggcgagttccgagtccttcacaggccggatataacagaggagaatatccatgctgtgaaggaacctggcggcagcgcaaaagatg

SEQ ID NO: 225996 - DNA, 103 bp, Artificial Sequence
  Synthetic Polynucleotide
taatacgactcactatagggtgcagatagacgagttccgagtccttcacaaacagaggagatgtgaaatgctcggaactaacctggcggcagcgcaaaagatg

SEQ ID NO: 225997 - DNA, 103 bp, Artificial Sequence
  Synthetic Polynucleotide
taatacgactcactatagggaggtgagctctgcagatagacgagttccgaaacagaggagatcggaaatggtctatctgaacctggcggcagcgcaaaagatg

SEQ ID NO: 225998 - DNA, 103 bp, Artificial Sequence
  Synthetic Polynucleotide
taatacgactcactatagggtgcagaagtcaggtgagctctgcagatagaaacagaggagatctatcatgagagctcacaacctggcggcagcgcaaaagatg

SEQ ID NO: 225999 - DNA, 103 bp, Artificial Sequence
  Synthetic Polynucleotide
taatacgactcactatagggtcattcttcatgcagaagtcaggtgagctcaacagaggagagagctcatgtgacttctgaacctggcggcagcgcaaaagatg

SEQ ID NO: 226000 - DNA, 103 bp, Artificial Sequence
  Synthetic Polynucleotide
taatacgactcactataggggcccaccttctcattcttcatgcagaagtcaacagaggagagacttcatgatgaagaataacctggcggcagcgcaaaagatg

SEQ ID NO: 226001 - DNA, 103 bp, Artificial Sequence
  Synthetic Polynucleotide
taatacgactcactatagggtcccgtgggagcccaccttctcattcttcaaacagaggagatgaagaatgagaaggtggaacctggcggcagcgcaaaagatg

SEQ ID NO: 226002 - DNA, 103 bp, Artificial Sequence
  Synthetic Polynucleotide
taatacgactcactatagggctgtcttgtgtcccgtgggagcccaccttcaacagaggagagaaggtatgctcccacggaacctggcggcagcgcaaaagatg

SEQ ID NO: 226003 - DNA, 103 bp, Artificial Sequence
  Synthetic Polynucleotide
taatacgactcactataggggttgcactgcctgtcttgtgtcccgtgggaaacagaggagatcccacatgacacaagacaacctggcggcagcgcaaaagatg

SEQ ID NO: 226004 - DNA, 103 bp, Artificial Sequence
  Synthetic Polynucleotide
taatacgactcactatagggtggatgtcttgttgcactgcctgtcttgtgaacagaggagacacaagatgggcagtgcaaacctggcggcagcgcaaaagatg

SEQ ID NO: 226005 - DNA, 103 bp, Artificial Sequence
  Synthetic Polynucleotide
taatacgactcactatagggagggccgatggtgtcttggacagcgccagcaacagaggagagctggcatggtccaagacaacctggcggcagcgcaaaagatg

SEQ ID NO: 226006 - DNA, 103 bp, Artificial Sequence
  Synthetic Polynucleotide
taatacgactcactatagggtcgcttccgttggatgtcttgttgcactgcaacagaggagagcagtgatgcaagacatcaacctggcggcagcgcaaaagatg

SEQ ID NO: 226007 - DNA, 103 bp, Artificial Sequence
  Synthetic Polynucleotide
taatacgactcactataggggtcgcagctgtcgcttccgttggatgtcttaacagaggagaaagacaatgaacggaagcaacctggcggcagcgcaaaagatg

SEQ ID NO: 226008 - DNA, 103 bp, Artificial Sequence
  Synthetic Polynucleotide
taatacgactcactatagggagcacataaggtcgcagctgtcgcttccgtaacagaggagaacggaaatgacagctgcgaacctggcggcagcgcaaaagatg

SEQ ID NO: 226009 - DNA, 103 bp, Artificial Sequence
  Synthetic Polynucleotide
taatacgactcactatagggccacgcccgcagcacataaggtcgcagctgaacagaggagacagctgatgccttatgtgaacctggcggcagcgcaaaagatg

SEQ ID NO: 226010 - DNA, 103 bp, Artificial Sequence
  Synthetic Polynucleotide
taatacgactcactatagggggggttgtagccacgcccgcagcacataagaacagaggagacttatgatgtgcgggcgtaacctggcggcagcgcaaaagatg

SEQ ID NO: 226011 - DNA, 103 bp, Artificial Sequence
  Synthetic Polynucleotide
taatacgactcactatagggggtctgtgtaggggttgtagccacgcccgcaacagaggagagcgggcatggctacaaccaacctggcggcagcgcaaaagatg

SEQ ID NO: 226012 - DNA, 103 bp, Artificial Sequence
  Synthetic Polynucleotide
taatacgactcactatagggtcgaccacgcggtctgtgtaggggttgtagaacagaggagactacaaatgctacacagaaacctggcggcagcgcaaaagatg

SEQ ID NO: 226013 - DNA, 103 bp, Artificial Sequence
  Synthetic Polynucleotide
taatacgactcactataggggtggcaccgctcgaccacgcggtctgtgtaaacagaggagatacacaatgcgcgtggtcaacctggcggcagcgcaaaagatg

SEQ ID NO: 226014 - DNA, 103 bp, Artificial Sequence
  Synthetic Polynucleotide
taatacgactcactatagggggtacttacagtggcaccgctcgaccacgcaacagaggagagcgtggatgagcggtgccaacctggcggcagcgcaaaagatg

SEQ ID NO: 226015 - DNA, 103 bp, Artificial Sequence
  Synthetic Polynucleotide
taatacgactcactatagggcagcaccagtggtacttacagtggcaccgcaacagaggagagcggtgatgctgtaagtaaacctggcggcagcgcaaaagatg

SEQ ID NO: 226016 - DNA, 103 bp, Artificial Sequence
  Synthetic Polynucleotide
taatacgactcactatagggtgggcttaatattccaatggacttcttcataacagaggagaatgaagatgtccattggaaacctggcggcagcgcaaaagatg

SEQ ID NO: 226017 - DNA, 103 bp, Artificial Sequence
  Synthetic Polynucleotide
taatacgactcactatagggtacaacctgggcgaaggagaaaaatatggcaacagaggagagccataatgttctccttcaacctggcggcagcgcaaaagatg

SEQ ID NO: 226018 - DNA, 103 bp, Artificial Sequence
  Synthetic Polynucleotide
taatacgactcactataggggcagcacatgagctcgcagccatccatgccaacagaggagaggcatgatgggctgcgagaacctggcggcagcgcaaaagatg

SEQ ID NO: 226019 - DNA, 103 bp, Artificial Sequence
  Synthetic Polynucleotide
taatacgactcactatagggagccacggccgcagcacatgagctcgcagcaacagaggagagctgcgatgtcatgtgctaacctggcggcagcgcaaaagatg

SEQ ID NO: 226020 - DNA, 103 bp, Artificial Sequence
  Synthetic Polynucleotide
taatacgactcactatagggaactggtcgtagccacggccgcagcacatgaacagaggagacatgtgatgcggccgtggaacctggcggcagcgcaaaagatg

SEQ ID NO: 226021 - DNA, 103 bp, Artificial Sequence
  Synthetic Polynucleotide
taatacgactcactatagggcacggtcttgaactggtcgtagccacggccaacagaggagaggccgtatgtacgaccagaacctggcggcagcgcaaaagatg

SEQ ID NO: 226022 - DNA, 103 bp, Artificial Sequence
  Synthetic Polynucleotide
taatacgactcactataggggctccgtctgcacggtcttgaactggtcgtaacagaggagaacgaccatgtcaagaccgaacctggcggcagcgcaaaagatg

SEQ ID NO: 226023 - DNA, 103 bp, Artificial Sequence
  Synthetic Polynucleotide
taatacgactcactatagggcagtggcagcgctccgtctgcacggtcttgaacagaggagacaagacatggcagacggaaacctggcggcagcgcaaaagatg

SEQ ID NO: 226024 - DNA, 103 bp, Artificial Sequence
  Synthetic Polynucleotide
taatacgactcactataggggtggaacttgcagtggcagcgctccgtctgaacagaggagacagacgatgcgctgccacaacctggcggcagcgcaaaagatg

SEQ ID NO: 226025 - DNA, 103 bp, Artificial Sequence
  Synthetic Polynucleotide
taatacgactcactatagggagcagcaccagtggaacttgcagtggcagcaacagaggagagctgccatggcaagttccaacctggcggcagcgcaaaagatg

SEQ ID NO: 226026 - DNA, 103 bp, Artificial Sequence
  Synthetic Polynucleotide
taatacgactcactatagggcacttgacgtagcagcaccagtggaacttgaacagaggagacaagttatgctggtgctgaacctggcggcagcgcaaaagatg

SEQ ID NO: 226027 - DNA, 103 bp, Artificial Sequence
  Synthetic Polynucleotide
taatacgactcactataggggcacttcttgcacttgacgtagcagcaccaaacagaggagatggtgcatgtacgtcaagaacctggcggcagcgcaaaagatg

SEQ ID NO: 226028 - DNA, 103 bp, Artificial Sequence
  Synthetic Polynucleotide
taatacgactcactatagggtggcttcaattacaacctgggcgaaggagaaacagaggagatctcctatgcccaggttgaacctggcggcagcgcaaaagatg

SEQ ID NO: 226029 - DNA, 103 bp, Artificial Sequence
  Synthetic Polynucleotide
taatacgactcactatagggcgatctccgtgcacttcttgcacttgacgtaacagaggagaacgtcaatggcaagaagtaacctggcggcagcgcaaaagatg

SEQ ID NO: 226030 - DNA, 103 bp, Artificial Sequence
  Synthetic Polynucleotide
taatacgactcactatagggaactggtccacgatctccgtgcacttcttgaacagaggagacaagaaatgcacggagataacctggcggcagcgcaaaagatg

SEQ ID NO: 226031 - DNA, 103 bp, Artificial Sequence
  Synthetic Polynucleotide
taatacgactcactatagggcttgcacacaaactggtccacgatctccgtaacagaggagaacggagatggtggaccagaacctggcggcagcgcaaaagatg

SEQ ID NO: 226032 - DNA, 103 bp, Artificial Sequence
  Synthetic Polynucleotide
taatacgactcactatagggcaccaagaattggcttcaattacaacctggaacagaggagaccaggtatgaattgaagcaacctggcggcagcgcaaaagatg

SEQ ID NO: 226033 - DNA, 103 bp, Artificial Sequence
  Synthetic Polynucleotide
taatacgactcactatagggacctagcgaccaccaagaattggcttcaataacagaggagaattgaaatgaattcttggaacctggcggcagcgcaaaagatg

SEQ ID NO: 226034 - DNA, 103 bp, Artificial Sequence
  Synthetic Polynucleotide
taatacgactcactatagggggttattcatacctagcgaccaccaagaataacagaggagaattcttatgggtcgctagaacctggcggcagcgcaaaagatg

SEQ ID NO: 226035 - DNA, 103 bp, Artificial Sequence
  Synthetic Polynucleotide
taatacgactcactatagggatctgaacagggttattcatacctagcgacaacagaggagagtcgctatgtatgaataaaacctggcggcagcgcaaaagatg

SEQ ID NO: 226036 - DNA, 103 bp, Artificial Sequence
  Synthetic Polynucleotide
taatacgactcactatagggtacttctgacatctgaacagggttattcataacagaggagaatgaatatgcctgttcagaacctggcggcagcgcaaaagatg

SEQ ID NO: 226037 - DNA, 103 bp, Artificial Sequence
  Synthetic Polynucleotide
taatacgactcactatagggctataatatatacttctgacatctgaacagaacagaggagactgttcatgtgtcagaagaacctggcggcagcgcaaaagatg

SEQ ID NO: 226038 - DNA, 103 bp, Artificial Sequence
  Synthetic Polynucleotide
taatacgactcactatagggggctgtgctcctataatatatacttctgacaacagaggagagtcagaatgatatattataacctggcggcagcgcaaaagatg

SEQ ID NO: 226039 - DNA, 103 bp, Artificial Sequence
  Synthetic Polynucleotide
taatacgactcactataggggctgcagagaggctgtgctcctataatataaacagaggagatatattatgggagcacagaacctggcggcagcgcaaaagatg

SEQ ID NO: 226040 - DNA, 103 bp, Artificial Sequence
  Synthetic Polynucleotide
taatacgactcactatagggaagcaactcctgggcttaatattccaatggaacagaggagaccattgatgtattaagccaacctggcggcagcgcaaaagatg

SEQ ID NO: 226041 - DNA, 103 bp, Artificial Sequence
  Synthetic Polynucleotide
taatacgactcactatagggctgccagttggctgcagagaggctgtgctcaacagaggagagagcacatgctctctgcaaacctggcggcagcgcaaaagatg

SEQ ID NO: 226042 - DNA, 103 bp, Artificial Sequence
  Synthetic Polynucleotide
taatacgactcactatagggtgagaaagtcctgccagttggctgcagagaaacagaggagatctctgatgccaactggcaacctggcggcagcgcaaaagatg

SEQ ID NO: 226043 - DNA, 103 bp, Artificial Sequence
  Synthetic Polynucleotide
taatacgactcactatagggcttctgtccttgagaaagtcctgccagttgaacagaggagacaactgatgggactttctaacctggcggcagcgcaaaagatg

SEQ ID NO: 226044 - DNA, 103 bp, Artificial Sequence
  Synthetic Polynucleotide
taatacgactcactatagggggcacagtttcttctgtccttgagaaagtcaacagaggagagactttatgaaggacagaaacctggcggcagcgcaaaagatg

SEQ ID NO: 226045 - DNA, 103 bp, Artificial Sequence
  Synthetic Polynucleotide
taatacgactcactatagggtgatacaagtggcacagtttcttctgtcctaacagaggagaaggacaatggaaactgtgaacctggcggcagcgcaaaagatg

SEQ ID NO: 226046 - DNA, 103 bp, Artificial Sequence
  Synthetic Polynucleotide
taatacgactcactatagggcatgtggtcctgatacaagtggcacagtttaacagaggagaaaactgatgcacttgtataacctggcggcagcgcaaaagatg

SEQ ID NO: 226047 - DNA, 103 bp, Artificial Sequence
  Synthetic Polynucleotide
taatacgactcactatagggcgatgtactgcatgtggtcctgatacaagtaacagaggagaacttgtatgaggaccacaaacctggcggcagcgcaaaagatg

SEQ ID NO: 226048 - DNA, 103 bp, Artificial Sequence
  Synthetic Polynucleotide
taatacgactcactataggggcgccttctccgatgtactgcatgtggtccaacagaggagaggaccaatggcagtacataacctggcggcagcgcaaaagatg

SEQ ID NO: 226049 - DNA, 103 bp, Artificial Sequence
  Synthetic Polynucleotide
taatacgactcactataggggcctgtcttcgcgccttctccgatgtactgaacagaggagacagtacatgggagaaggcaacctggcggcagcgcaaaagatg

SEQ ID NO: 226050 - DNA, 103 bp, Artificial Sequence
  Synthetic Polynucleotide
taatacgactcactatagggattctttgatgcctgtcttcgcgccttctcaacagaggagagagaagatgcgaagacagaacctggcggcagcgcaaaagatg

SEQ ID NO: 226051 - DNA, 103 bp, Artificial Sequence
  Synthetic Polynucleotide
taatacgactcactataggggccatccccaaagcaactcctgggcttaataacagaggagaattaagatgaggagttgcaacctggcggcagcgcaaaagatg

SEQ ID NO: 226052 - DNA, 103 bp, Artificial Sequence
  Synthetic Polynucleotide
taatacgactcactatagggtgatactggcattctttgatgcctgtcttcaacagaggagagaagacatgcatcaaagaaacctggcggcagcgcaaaagatg

SEQ ID NO: 226053 - DNA, 103 bp, Artificial Sequence
  Synthetic Polynucleotide
taatacgactcactatagggatgtcggaattgatactggcattctttgataacagaggagaatcaaaatgtgccagtataacctggcggcagcgcaaaagatg

SEQ ID NO: 226054 - DNA, 103 bp, Artificial Sequence
  Synthetic Polynucleotide
taatacgactcactatagggtccaccttcgatgtcggaattgatactggcaacagaggagagccagtatgaattccgacaacctggcggcagcgcaaaagatg

SEQ ID NO: 226055 - DNA, 103 bp, Artificial Sequence
  Synthetic Polynucleotide
taatacgactcactataggggtgctgcagttccaccttcgatgtcggaataacagaggagaattccgatgtcgaaggtgaacctggcggcagcgcaaaagatg

SEQ ID NO: 226056 - DNA, 103 bp, Artificial Sequence
  Synthetic Polynucleotide
taatacgactcactataggggttatccacagtgctgcagttccaccttcgaacagaggagacgaaggatgaactgcagcaacctggcggcagcgcaaaagatg

SEQ ID NO: 226057 - DNA, 103 bp, Artificial Sequence
  Synthetic Polynucleotide
taatacgactcactatagggaaacagaggtgttatccacagtgctgcagtaacagaggagaactgcaatgctgtggataaacctggcggcagcgcaaaagatg

SEQ ID NO: 226058 - DNA, 103 bp, Artificial Sequence
  Synthetic Polynucleotide
taatacgactcactatagggaccctgccaaaaacagaggtgttatccacaaacagaggagatgtggaatgcacctctgtaacctggcggcagcgcaaaagatg

SEQ ID NO: 226059 - DNA, 103 bp, Artificial Sequence
  Synthetic Polynucleotide
taatacgactcactatagggtatctgcatcaccctgccaaaaacagaggtaacagaggagaacctctatgtttggcaggaacctggcggcagcgcaaaagatg

SEQ ID NO: 226060 - DNA, 103 bp, Artificial Sequence
  Synthetic Polynucleotide
taatacgactcactatagggcgcggctgcctatctgcatcaccctgccaaaacagaggagattggcaatgtgatgcagaaacctggcggcagcgcaaaagatg

SEQ ID NO: 226061 - DNA, 103 bp, Artificial Sequence
  Synthetic Polynucleotide
taatacgactcactatagggaaggccgtctcgcggctgcctatctgcatcaacagaggagagatgcaatgaggcagccgaacctggcggcagcgcaaaagatg

SEQ ID NO: 226062 - DNA, 103 bp, Artificial Sequence
  Synthetic Polynucleotide
taatacgactcactatagggtgcacttccagccatccccaaagcaactccaacagaggagaggagttatgttggggatgaacctggcggcagcgcaaaagatg

SEQ ID NO: 226063 - DNA, 103 bp, Artificial Sequence
  Synthetic Polynucleotide
taatacgactcactatagggcgcgtatgtgaaggccgtctcgcggctgccaacagaggagaggcagcatggagacggccaacctggcggcagcgcaaaagatg

SEQ ID NO: 226064 - DNA, 103 bp, Artificial Sequence
  Synthetic Polynucleotide
taatacgactcactatagggctgcgctcaccgcgtatgtgaaggccgtctaacagaggagaagacggatgtcacatacgaacctggcggcagcgcaaaagatg

SEQ ID NO: 226065 - DNA, 103 bp, Artificial Sequence
  Synthetic Polynucleotide
taatacgactcactatagggaccacccctgctgcgctcaccgcgtatgtgaacagaggagacacataatgggtgagcgcaacctggcggcagcgcaaaagatg

SEQ ID NO: 226066 - DNA, 103 bp, Artificial Sequence
  Synthetic Polynucleotide
taatacgactcactatagggcatggcgttcaccacccctgctgcgctcacaacagaggagagtgagcatggcaggggtgaacctggcggcagcgcaaaagatg

SEQ ID NO: 226067 - DNA, 103 bp, Artificial Sequence
  Synthetic Polynucleotide
taatacgactcactatagggacgcccggctcatggcgttcaccacccctgaacagaggagacaggggatgtgaacgccaaacctggcggcagcgcaaaagatg

SEQ ID NO: 226068 - DNA, 103 bp, Artificial Sequence
  Synthetic Polynucleotide
taatacgactcactatagggccctcgcggcacgcccggctcatggcgttcaacagaggagagaacgcatggagccgggcaacctggcggcagcgcaaaagatg

SEQ ID NO: 226069 - DNA, 103 bp, Artificial Sequence
  Synthetic Polynucleotide
taatacgactcactatagggggacagctcgccctcgcggcacgcccggctaacagaggagaagccggatgtgccgcgagaacctggcggcagcgcaaaagatg

SEQ ID NO: 226070 - DNA, 103 bp, Artificial Sequence
  Synthetic Polynucleotide
taatacgactcactatagggagccgcaggtggacagctcgccctcgcggcaacagaggagagccgcgatggcgagctgtaacctggcggcagcgcaaaagatg

SEQ ID NO: 226071 - DNA, 103 bp, Artificial Sequence
  Synthetic Polynucleotide
taatacgactcactataggggcgcggctgcagccgcaggtggacagctcgaacagaggagacgagctatgcacctgcggaacctggcggcagcgcaaaagatg

SEQ ID NO: 226072 - DNA, 103 bp, Artificial Sequence
  Synthetic Polynucleotide
taatacgactcactatagggggggcgcgcggcgcggctgcagccgcaggtaacagaggagaacctgcatgtgcagccgcaacctggcggcagcgcaaaagatg

SEQ ID NO: 226073 - DNA, 103 bp, Artificial Sequence
  Synthetic Polynucleotide
taatacgactcactatagggtggaagacattgcacttccagccatccccaaacagaggagatggggaatgctggaagtgaacctggcggcagcgcaaaagatg

SEQ ID NO: 226074 - DNA, 103 bp, Artificial Sequence
  Synthetic Polynucleotide
taatacgactcactataggggcaggtccttggggcgcgcggcgcggctgcaacagaggagagcagccatgccgcgcgccaacctggcggcagcgcaaaagatg

SEQ ID NO: 226075 - DNA, 103 bp, Artificial Sequence
  Synthetic Polynucleotide
taatacgactcactatagggcagtcccgcggcaggtccttggggcgcgcgaacagaggagacgcgcgatgcaaggacctaacctggcggcagcgcaaaagatg

SEQ ID NO: 226076 - DNA, 103 bp, Artificial Sequence
  Synthetic Polynucleotide
taatacgactcactataggggccccagagccagtcccgcggcaggtccttaacagaggagaaaggacatgccgcgggacaacctggcggcagcgcaaaagatg

SEQ ID NO: 226077 - DNA, 103 bp, Artificial Sequence
  Synthetic Polynucleotide
taatacgactcactatagggcgccgcagccgccccagagccagtcccgcgaacagaggagacgcgggatgggctctgggaacctggcggcagcgcaaaagatg

SEQ ID NO: 226078 - DNA, 103 bp, Artificial Sequence
  Synthetic Polynucleotide
taatacgactcactatagggtcgatgttgtcgccgcagccgccccagagcaacagaggagagctctgatgcggctgcggaacctggcggcagcgcaaaagatg

SEQ ID NO: 226079 - DNA, 103 bp, Artificial Sequence
  Synthetic Polynucleotide
taatacgactcactataggggtagccatagtcgatgttgtcgccgcagccaacagaggagaggctgcatggacaacatcaacctggcggcagcgcaaaagatg

SEQ ID NO: 226080 - DNA, 103 bp, Artificial Sequence
  Synthetic Polynucleotide
taatacgactcactatagggtggcaaagcggtagccatagtcgatgttgtaacagaggagaacaacaatgactatggctaacctggcggcagcgcaaaagatg

SEQ ID NO: 226081 - DNA, 103 bp, Artificial Sequence
  Synthetic Polynucleotide
taatacgactcactatagggacgaactccttggcaaagcggtagccatagaacagaggagactatggatgccgctttgcaacctggcggcagcgcaaaagatg

SEQ ID NO: 226082 - DNA, 103 bp, Artificial Sequence
  Synthetic Polynucleotide
taatacgactcactataggggcgggcgtccacgaactccttggcaaagcgaacagaggagacgctttatgaaggagttcaacctggcggcagcgcaaaagatg

SEQ ID NO: 226083 - DNA, 103 bp, Artificial Sequence
  Synthetic Polynucleotide
taatacgactcactataggggctcccgctcgcgggcgtccacgaactcctaacagaggagaaggagtatgtggacgcccaacctggcggcagcgcaaaagatg

SEQ ID NO: 226084 - DNA, 103 bp, Artificial Sequence
  Synthetic Polynucleotide
taatacgactcactatagggaggaagaacttggaagacattgcacttccaaacagaggagatggaagatgaatgtcttcaacctggcggcagcgcaaaagatg

SEQ ID NO: 226085 - DNA, 103 bp, Artificial Sequence
  Synthetic Polynucleotide
taatacgactcactataggggcgtggatgcgctcccgctcgcgggcgtccaacagaggagaggacgcatgcgagcgggaaacctggcggcagcgcaaaagatg

SEQ ID NO: 226086 - DNA, 103 bp, Artificial Sequence
  Synthetic Polynucleotide
taatacgactcactatagggggagcccttggcgtggatgcgctcccgctcaacagaggagagagcggatgcgcatccacaacctggcggcagcgcaaaagatg

SEQ ID NO: 226087 - DNA, 103 bp, Artificial Sequence
  Synthetic Polynucleotide
taatacgactcactatagggcactctcgtaggagcccttggcgtggatgcaacagaggagagcatccatgccaagggctaacctggcggcagcgcaaaagatg

SEQ ID NO: 226088 - DNA, 103 bp, Artificial Sequence
  Synthetic Polynucleotide
taatacgactcactatagggaggatgcgagcactctcgtaggagcccttgaacagaggagacaagggatgctacgagagaacctggcggcagcgcaaaagatg

SEQ ID NO: 226089 - DNA, 103 bp, Artificial Sequence
  Synthetic Polynucleotide
taatacgactcactatagggcaggttcatgaggatgcgagcactctcgtaaacagaggagatacgagatggctcgcatcaacctggcggcagcgcaaaagatg

SEQ ID NO: 226090 - DNA, 103 bp, Artificial Sequence
  Synthetic Polynucleotide
taatacgactcactatagggcgttgttgtgcaggttcatgaggatgcgagaacagaggagactcgcaatgtcatgaaccaacctggcggcagcgcaaaagatg

SEQ ID NO: 226091 - DNA, 103 bp, Artificial Sequence
  Synthetic Polynucleotide
taatacgactcactatagggcggccggcctcgttgttgtgcaggttcatgaacagaggagacatgaaatggcacaacaaaacctggcggcagcgcaaaagatg

SEQ ID NO: 226092 - DNA, 103 bp, Artificial Sequence
  Synthetic Polynucleotide
taatacgactcactatagggcaccgtcctgcggccggcctcgttgttgtgaacagaggagacacaacatggaggccggcaacctggcggcagcgcaaaagatg

SEQ ID NO: 226093 - DNA, 103 bp, Artificial Sequence
  Synthetic Polynucleotide
taatacgactcactatagggccaggttgtacaccgtcctgcggccggcctaacagaggagaaggccgatggcaggacggaacctggcggcagcgcaaaagatg

SEQ ID NO: 226094 - DNA, 103 bp, Artificial Sequence
  Synthetic Polynucleotide
taatacgactcactataggggccacatcagccaggttgtacaccgtcctgaacagaggagacaggacatggtacaacctaacctggcggcagcgcaaaagatg

SEQ ID NO: 226095 - DNA, 103 bp, Artificial Sequence
  Synthetic Polynucleotide
taatacgactcactatagggcaaagccactaggaagaacttggaagacataacagaggagaatgtctatgaagttcttcaacctggcggcagcgcaaaagatg

SEQ ID NO: 226096 - DNA, 103 bp, Artificial Sequence
  Synthetic Polynucleotide
taatacgactcactataggggcacttgcaggccacatcagccaggttgtaaacagaggagatacaacatggctgatgtgaacctggcggcagcgcaaaagatg

SEQ ID NO: 226097 - DNA, 103 bp, Artificial Sequence
  Synthetic Polynucleotide
taatacgactcactatagggacaccccatggcacttgcaggccacatcagaacagaggagactgatgatgcctgcaagtaacctggcggcagcgcaaaagatg

SEQ ID NO: 226098 - DNA, 103 bp, Artificial Sequence
  Synthetic Polynucleotide
taatacgactcactatagggcatgagccggacaccccatggcacttgcagaacagaggagactgcaaatgccatggggtaacctggcggcagcgcaaaagatg

SEQ ID NO: 226099 - DNA, 103 bp, Artificial Sequence
  Synthetic Polynucleotide
taatacgactcactatagggcttcaggctacatgagccggacaccccatgaacagaggagacatgggatgtccggctcaaacctggcggcagcgcaaaagatg

SEQ ID NO: 226100 - DNA, 103 bp, Artificial Sequence
  Synthetic Polynucleotide
taatacgactcactataggggccagcatgtcttcaggctacatgagccggaacagaggagaccggctatggtagcctgaaacctggcggcagcgcaaaagatg

SEQ ID NO: 226101 - DNA, 103 bp, Artificial Sequence
  Synthetic Polynucleotide
taatacgactcactataggggccagctgcagccagcatgtcttcaggctaaacagaggagatagcctatggacatgctgaacctggcggcagcgcaaaagatg

SEQ ID NO: 226102 - DNA, 103 bp, Artificial Sequence
  Synthetic Polynucleotide
taatacgactcactataggggcggaagtctgccagctgcagccagcatgtaacagaggagaacatgcatgctgcagctgaacctggcggcagcgcaaaagatg

SEQ ID NO: 226103 - DNA, 103 bp, Artificial Sequence
  Synthetic Polynucleotide
taatacgactcactatagggcacccaccttgcggaagtctgccagctgcaaacagaggagatgcagcatgcagacttccaacctggcggcagcgcaaaagatg

SEQ ID NO: 226104 - DNA, 103 bp, Artificial Sequence
  Synthetic Polynucleotide
taatacgactcactatagggttcagggcatcacccaccttgcggaagtctaacagaggagaagacttatgcaaggtgggaacctggcggcagcgcaaaagatg

SEQ ID NO: 226105 - DNA, 103 bp, Artificial Sequence
  Synthetic Polynucleotide
taatacgactcactataggggtacttctccttcagggcatcacccaccttaacagaggagaaaggtgatggatgccctgaacctggcggcagcgcaaaagatg

SEQ ID NO: 226106 - DNA, 103 bp, Artificial Sequence
  Synthetic Polynucleotide
taatacgactcactatagggaaaatatggccaaagccactaggaagaactaacagaggagaagttctatgtagtggcttaacctggcggcagcgcaaaagatg

SEQ ID NO: 226107 - DNA, 103 bp, Artificial Sequence
  Synthetic Polynucleotide
taatacgactcactatagggccgcgctgtcgtacttctccttcagggcataacagaggagaatgcccatgaggagaagtaacctggcggcagcgcaaaagatg

SEQ ID NO: 226108 - DNA, 103 bp, Artificial Sequence
  Synthetic Polynucleotide
taatacgactcactatagggcgcatggccgccgcgctgtcgtacttctccaacagaggagaggagaaatgcgacagcgcaacctggcggcagcgcaaaagatg

SEQ ID NO: 226109 - DNA, 103 bp, Artificial Sequence
  Synthetic Polynucleotide
taatacgactcactataggggctgttgagccgcatggccgccgcgctgtcaacagaggagagacagcatggcggccatgaacctggcggcagcgcaaaagatg

SEQ ID NO: 226110 - DNA, 103 bp, Artificial Sequence
  Synthetic Polynucleotide
taatacgactcactatagggacttgccccggctgttgagccgcatggccgaacagaggagacggccaatgggctcaacaaacctggcggcagcgcaaaagatg

SEQ ID NO: 226111 - DNA, 103 bp, Artificial Sequence
  Synthetic Polynucleotide
taatacgactcactatagggacctgtaccaacttgccccggctgttgagcaacagaggagagctcaaatgccggggcaaaacctggcggcagcgcaaaagatg

SEQ ID NO: 226112 - DNA, 103 bp, Artificial Sequence
  Synthetic Polynucleotide
taatacgactcactataggggcggctgttgacctgtaccaacttgccccgaacagaggagacggggcatgttggtacagaacctggcggcagcgcaaaagatg

SEQ ID NO: 226113 - DNA, 103 bp, Artificial Sequence
  Synthetic Polynucleotide
taatacgactcactataggggcgagttgaagcggctgttgacctgtaccaaacagaggagatggtacatgtcaacagccaacctggcggcagcgcaaaagatg

SEQ ID NO: 226114 - DNA, 103 bp, Artificial Sequence
  Synthetic Polynucleotide
taatacgactcactatagggtgtgtggtgggcgagttgaagcggctgttgaacagaggagacaacagatgcttcaactcaacctggcggcagcgcaaaagatg

SEQ ID NO: 226115 - DNA, 103 bp, Artificial Sequence
  Synthetic Polynucleotide
taatacgactcactataggggaccaggtcttgtgtggtgggcgagttgaaaacagaggagattcaacatgcccaccacaaacctggcggcagcgcaaaagatg

SEQ ID NO: 226116 - DNA, 103 bp, Artificial Sequence
  Synthetic Polynucleotide
taatacgactcactatagggggtcgatgtagaccaggtcttgtgtggtggaacagaggagaccaccaatgaagacctggaacctggcggcagcgcaaaagatg

SEQ ID NO: 226117 - DNA, 103 bp, Artificial Sequence
  Synthetic Polynucleotide
taatacgactcactataggggcgaaggagaaaaatatggccaaagccactaacagaggagaagtggcatgggccatattaacctggcggcagcgcaaaagatg

SEQ ID NO: 226118 - DNA, 103 bp, Artificial Sequence
  Synthetic Polynucleotide
taatacgactcactatagggtcagggctggggtcgatgtagaccaggtctaacagaggagaagacctatgctacatcgaaacctggcggcagcgcaaaagatg

SEQ ID NO: 226119 - DNA, 103 bp, Artificial Sequence
  Synthetic Polynucleotide
taatacgactcactatagggcacgcagtagtcagggctggggtcgatgtaaacagaggagatacatcatgcccagccctaacctggcggcagcgcaaaagatg

SEQ ID NO: 226120 - DNA, 103 bp, Artificial Sequence
  Synthetic Polynucleotide
taatacgactcactatagggtctcattgcgcacgcagtagtcagggctggaacagaggagaccagccatgactactgcgaacctggcggcagcgcaaaagatg

SEQ ID NO: 226121 - DNA, 103 bp, Artificial Sequence
  Synthetic Polynucleotide
taatacgactcactataggggagccggtgctctcattgcgcacgcagtagaacagaggagactactgatggcgcaatgaaacctggcggcagcgcaaaagatg

SEQ ID NO: 226122 - DNA, 103 bp, Artificial Sequence
  Synthetic Polynucleotide
taatacgactcactatagggcgtgcccagcgagccggtgctctcattgcgaacagaggagacgcaatatgagcaccggcaacctggcggcagcgcaaaagatg

SEQ ID NO: 226123 - DNA, 103 bp, Artificial Sequence
  Synthetic Polynucleotide
taatacgactcactatagggggcggccctgcgtgcccagcgagccggtgcaacagaggagagcaccgatgcgctgggcaaacctggcggcagcgcaaaagatg

SEQ ID NO: 226124 - DNA, 103 bp, Artificial Sequence
  Synthetic Polynucleotide
taatacgactcactatagggttgttgcacaggcggccctgcgtgcccagcaacagaggagagctgggatggcagggccgaacctggcggcagcgcaaaagatg

SEQ ID NO: 226125 - DNA, 103 bp, Artificial Sequence
  Synthetic Polynucleotide
taatacgactcactatagggctccgacgtcttgttgcacaggcggccctgaacagaggagacagggcatgctgtgcaacaacctggcggcagcgcaaaagatg

SEQ ID NO: 226126 - DNA, 103 bp, Artificial Sequence
  Synthetic Polynucleotide
taatacgactcactatagggcatccatgccctccgacgtcttgttgcacaaacagaggagatgtgcaatgagacgtcggaacctggcggcagcgcaaaagatg

SEQ ID NO: 226127 - DNA, 103 bp, Artificial Sequence
  Synthetic Polynucleotide
taatacgactcactatagggagctcgcagccatccatgccctccgacgtcaacagaggagagacgtcatggggcatggaaacctggcggcagcgcaaaagatg

SEQ ID NO: 226128 - DNA, 103 bp, Artificial Sequence
  Synthetic Polynucleotide
taatacgactcactataggggaaggtgaccgtgctgtaacccttctccataacagaggagaatggagatgggttacagcaacctggcggcagcgcaaaagatg

SEQ ID NO: 226129 - DNA, 103 bp, Artificial Sequence
  Synthetic Polynucleotide
taatacgactcactatagggctggcccatgggatcctcatgcttgaatgaaacagaggagatcattcatgcatgaggataacctggcggcagcgcaaaagatg

SEQ ID NO: 226130 - DNA, 103 bp, Artificial Sequence
  Synthetic Polynucleotide
taatacgactcactataggggcgagccctgctggcccatgggatcctcataacagaggagaatgaggatgccatgggccaacctggcggcagcgcaaaagatg

SEQ ID NO: 226131 - DNA, 103 bp, Artificial Sequence
  Synthetic Polynucleotide
taatacgactcactatagggtgctcacccagcgagccctgctggcccatgaacagaggagacatgggatggcagggctcaacctggcggcagcgcaaaagatg

SEQ ID NO: 226132 - DNA, 103 bp, Artificial Sequence
  Synthetic Polynucleotide
taatacgactcactatagggcgagtactgctgctcacccagcgagccctgaacagaggagacagggcatgctgggtgagaacctggcggcagcgcaaaagatg

SEQ ID NO: 226133 - DNA, 103 bp, Artificial Sequence
  Synthetic Polynucleotide
taatacgactcactatagggggggcggcaccgagtactgctgctcacccaaacagaggagatgggtgatgagcagtactaacctggcggcagcgcaaaagatg

SEQ ID NO: 226134 - DNA, 103 bp, Artificial Sequence
  Synthetic Polynucleotide
taatacgactcactatagggccatagaccgggggcggcaccgagtactgcaacagaggagagcagtaatgggtgccgccaacctggcggcagcgcaaaagatg

SEQ ID NO: 226135 - DNA, 103 bp, Artificial Sequence
  Synthetic Polynucleotide
taatacgactcactatagggggtgtggcagccatagaccgggggcggcacaacagaggagagtgccgatgccggtctataacctggcggcagcgcaaaagatg

SEQ ID NO: 226136 - DNA, 103 bp, Artificial Sequence
  Synthetic Polynucleotide
taatacgactcactatagggtgtcggtgggggtgtggcagccatagaccgaacagaggagacggtctatggctgccacaaacctggcggcagcgcaaaagatg

SEQ ID NO: 226137 - DNA, 103 bp, Artificial Sequence
  Synthetic Polynucleotide
taatacgactcactatagggccggtgcagctgtcggtgggggtgtggcagaacagaggagactgccaatgccccaccgaaacctggcggcagcgcaaaagatg

SEQ ID NO: 226138 - DNA, 103 bp, Artificial Sequence
  Synthetic Polynucleotide
taatacgactcactatagggagcctggctgccggtgcagctgtcggtgggaacagaggagacccaccatgagctgcaccaacctggcggcagcgcaaaagatg

SEQ ID NO: 226139 - DNA, 103 bp, Artificial Sequence
  Synthetic Polynucleotide
taatacgactcactataggggcgtcccgtcgaaggtgaccgtgctgtaacaacagaggagagttacaatgcggtcacctaacctggcggcagcgcaaaagatg

SEQ ID NO: 226140 - DNA, 103 bp, Artificial Sequence
  Synthetic Polynucleotide
taatacgactcactatagggtcagcagcaaagcctggctgccggtgcagcaacagaggagagctgcaatggcagccaggaacctggcggcagcgcaaaagatg

SEQ ID NO: 226141 - DNA, 103 bp, Artificial Sequence
  Synthetic Polynucleotide
taatacgactcactatagggtagggcgtcctcagcagcaaagcctggctgaacagaggagacagccaatgtttgctgctaacctggcggcagcgcaaaagatg

SEQ ID NO: 226142 - DNA, 103 bp, Artificial Sequence
  Synthetic Polynucleotide
taatacgactcactataggggtcactgctgtagggcgtcctcagcagcaaaacagaggagattgctgatgaggacgcccaacctggcggcagcgcaaaagatg

SEQ ID NO: 226143 - DNA, 103 bp, Artificial Sequence
  Synthetic Polynucleotide
taatacgactcactatagggggtataaattgtcactgctgtagggcgtccaacagaggagaggacgcatgacagcagtgaacctggcggcagcgcaaaagatg

SEQ ID NO: 226144 - DNA, 103 bp, Artificial Sequence
  Synthetic Polynucleotide
taatacgactcactataggggatgtcatttggtataaattgtcactgctgaacagaggagacagcagatgcaatttataaacctggcggcagcgcaaaagatg

SEQ ID NO: 226145 - DNA, 103 bp, Artificial Sequence
  Synthetic Polynucleotide
taatacgactcactatagggttcaagctgggatgtcatttggtataaattaacagaggagaaatttaatgcaaatgacaaacctggcggcagcgcaaaagatg

SEQ ID NO: 226146 - DNA, 103 bp, Artificial Sequence
  Synthetic Polynucleotide
taatacgactcactatagggaggtcatgcattcaagctgggatgtcatttaacagaggagaaaatgaatgcccagcttgaacctggcggcagcgcaaaagatg

SEQ ID NO: 226147 - DNA, 103 bp, Artificial Sequence
  Synthetic Polynucleotide
taatacgactcactatagggatctgattccaggtcatgcattcaagctggaacagaggagaccagctatgatgcatgacaacctggcggcagcgcaaaagatg

SEQ ID NO: 226148 - DNA, 103 bp, Artificial Sequence
  Synthetic Polynucleotide
taatacgactcactatagggtcctaagttcatctgattccaggtcatgcaaacagaggagatgcatgatgtggaatcagaacctggcggcagcgcaaaagatg

SEQ ID NO: 226149 - DNA, 103 bp, Artificial Sequence
  Synthetic Polynucleotide
taatacgactcactatagggttaaggtggctcctaagttcatctgattccaacagaggagaggaatcatgtgaacttagaacctggcggcagcgcaaaagatg

SEQ ID NO: 226150 - DNA, 103 bp, Artificial Sequence
  Synthetic Polynucleotide
taatacgactcactatagggccgtagctgggcgtcccgtcgaaggtgaccaacagaggagaggtcacatgcgacgggacaacctggcggcagcgcaaaagatg

SEQ ID NO: 226151 - DNA, 103 bp, Artificial Sequence
  Synthetic Polynucleotide
taatacgactcactataggggcaactccctttaaggtggctcctaagttcaacagaggagagaacttatgagccaccttaacctggcggcagcgcaaaagatg

SEQ ID NO: 226152 - DNA, 103 bp, Artificial Sequence
  Synthetic Polynucleotide
taatacgactcactataggggctcccagcagcaactccctttaaggtggcaacagaggagagccaccatgaagggagttaacctggcggcagcgcaaaagatg

SEQ ID NO: 226153 - DNA, 103 bp, Artificial Sequence
  Synthetic Polynucleotide
taatacgactcactatagggctgagctggagctcccagcagcaactccctaacagaggagaagggagatgctgctgggaaacctggcggcagcgcaaaagatg

SEQ ID NO: 226154 - DNA, 103 bp, Artificial Sequence
  Synthetic Polynucleotide
taatacgactcactataggggtccatttcactgagctggagctcccagcaaacagaggagatgctggatgctccagctcaacctggcggcagcgcaaaagatg

SEQ ID NO: 226155 - DNA, 103 bp, Artificial Sequence
  Synthetic Polynucleotide
taatacgactcactatagggctgcccttctgtccatttcactgagctggaaacagaggagatccagcatggtgaaatggaacctggcggcagcgcaaaagatg

SEQ ID NO: 226156 - DNA, 103 bp, Artificial Sequence
  Synthetic Polynucleotide
taatacgactcactatagggtgtggttgctctgcccttctgtccatttcaaacagaggagatgaaatatgcagaagggcaacctggcggcagcgcaaaagatg

SEQ ID NO: 226157 - DNA, 103 bp, Artificial Sequence
  Synthetic Polynucleotide
taatacgactcactatagggtaccctgtgctgtggttgctctgcccttctaacagaggagaagaaggatggagcaaccaaacctggcggcagcgcaaaagatg

SEQ ID NO: 226158 - DNA, 103 bp, Artificial Sequence
  Synthetic Polynucleotide
taatacgactcactatagggatcgctctcgtaccctgtgctgtggttgctaacagaggagaagcaacatgagcacagggaacctggcggcagcgcaaaagatg

SEQ ID NO: 226159 - DNA, 103 bp, Artificial Sequence
  Synthetic Polynucleotide
taatacgactcactatagggttgtgtggttatcgctctcgtaccctgtgcaacagaggagagcacagatgacgagagcgaacctggcggcagcgcaaaagatg

SEQ ID NO: 226160 - DNA, 103 bp, Artificial Sequence
  Synthetic Polynucleotide
taatacgactcactatagggaggatgggcgttgtgtggttatcgctctcgaacagaggagacgagagatgtaaccacacaacctggcggcagcgcaaaagatg

SEQ ID NO: 226161 - DNA, 103 bp, Artificial Sequence
  Synthetic Polynucleotide
taatacgactcactataggggggcgtgtgaccgtagctgggcgtcccgtcaacagaggagagacgggatgcccagctacaacctggcggcagcgcaaaagatg

SEQ ID NO: 226162 - DNA, 103 bp, Artificial Sequence
  Synthetic Polynucleotide
taatacgactcactatagggggctccgcagaggatgggcgttgtgtggttaacagaggagaaaccacatgacgcccatcaacctggcggcagcgcaaaagatg

SEQ ID NO: 226163 - DNA, 103 bp, Artificial Sequence
  Synthetic Polynucleotide
taatacgactcactatagggttctgtattgggctccgcagaggatgggcgaacagaggagacgcccaatgtctgcggagaacctggcggcagcgcaaaagatg

SEQ ID NO: 226164 - DNA, 103 bp, Artificial Sequence
  Synthetic Polynucleotide
taatacgactcactatagggtgcgtgtgtattctgtattgggctccgcagaacagaggagactgcggatgccaatacagaacctggcggcagcgcaaaagatg

SEQ ID NO: 226165 - DNA, 103 bp, Artificial Sequence
  Synthetic Polynucleotide
taatacgactcactataggggaagacaccgtgcgtgtgtattctgtattgaacagaggagacaatacatgatacacacgaacctggcggcagcgcaaaagatg

SEQ ID NO: 226166 - DNA, 103 bp, Artificial Sequence
  Synthetic Polynucleotide
taatacgactcactataggggaatgcctctgaagacaccgtgcgtgtgtaaacagaggagatacacaatgacggtgtctaacctggcggcagcgcaaaagatg

SEQ ID NO: 226167 - DNA, 103 bp, Artificial Sequence
  Synthetic Polynucleotide
taatacgactcactatagggcgcacatcctgaatgcctctgaagacaccgaacagaggagacggtgtatgcagaggcataacctggcggcagcgcaaaagatg

SEQ ID NO: 226168 - DNA, 103 bp, Artificial Sequence
  Synthetic Polynucleotide
taatacgactcactatagggaggcacacgtcgcacatcctgaatgcctctaacagaggagaagaggcatgcaggatgtgaacctggcggcagcgcaaaagatg

SEQ ID NO: 226169 - DNA, 103 bp, Artificial Sequence
  Synthetic Polynucleotide
taatacgactcactataggggggctactccaggcacacgtcgcacatcctaacagaggagaaggatgatggacgtgtgcaacctggcggcagcgcaaaagatg

SEQ ID NO: 226170 - DNA, 103 bp, Artificial Sequence
  Synthetic Polynucleotide
taatacgactcactatagggacaagagtcggggctactccaggcacacgtaacagaggagaacgtgtatgtggagtagcaacctggcggcagcgcaaaagatg

SEQ ID NO: 226171 - DNA, 103 bp, Artificial Sequence
  Synthetic Polynucleotide
taatacgactcactatagggtgccgaccgtacaagagtcggggctactccaacagaggagaggagtaatgccgactcttaacctggcggcagcgcaaaagatg

SEQ ID NO: 226172 - DNA, 103 bp, Artificial Sequence
  Synthetic Polynucleotide
taatacgactcactatagggcatggtgcgagggcgtgtgaccgtagctggaacagaggagaccagctatggtcacacgcaacctggcggcagcgcaaaagatg

SEQ ID NO: 226173 - DNA, 103 bp, Artificial Sequence
  Synthetic Polynucleotide
taatacgactcactatagggtggtctcagatgccgaccgtacaagagtcgaacagaggagacgactcatgtacggtcggaacctggcggcagcgcaaaagatg

SEQ ID NO: 226174 - DNA, 103 bp, Artificial Sequence
  Synthetic Polynucleotide
taatacgactcactatagggcgtttctcactggtctcagatgccgaccgtaacagaggagaacggtcatgatctgagacaacctggcggcagcgcaaaagatg

SEQ ID NO: 226175 - DNA, 103 bp, Artificial Sequence
  Synthetic Polynucleotide
taatacgactcactatagggcatgaaggggcgtttctcactggtctcagaaacagaggagatctgagatgagtgagaaaaacctggcggcagcgcaaaagatg

SEQ ID NO: 226176 - DNA, 103 bp, Artificial Sequence
  Synthetic Polynucleotide
taatacgactcactatagggggtaagcacacatgaaggggcgtttctcacaacagaggagagtgagaatggccccttcaaacctggcggcagcgcaaaagatg

SEQ ID NO: 226177 - DNA, 103 bp, Artificial Sequence
  Synthetic Polynucleotide
taatacgactcactatagggttgcagcctgggtaagcacacatgaaggggaacagaggagaccccttatggtgtgcttaaacctggcggcagcgcaaaagatg

SEQ ID NO: 226178 - DNA, 103 bp, Artificial Sequence
  Synthetic Polynucleotide
taatacgactcactatagggatatctcttattgcagcctgggtaagcacaaacagaggagatgtgctatgccaggctgcaacctggcggcagcgcaaaagatg

SEQ ID NO: 226179 - DNA, 103 bp, Artificial Sequence
  Synthetic Polynucleotide
taatacgactcactatagggacagcttaaaatatctcttattgcagcctgaacagaggagacaggctatgataagagataacctggcggcagcgcaaaagatg

SEQ ID NO: 226180 - DNA, 103 bp, Artificial Sequence
  Synthetic Polynucleotide
taatacgactcactatagggtgtaagtgggacagcttaaaatatctcttaaacagaggagataagagatgttttaagctaacctggcggcagcgcaaaagatg

SEQ ID NO: 226181 - DNA, 103 bp, Artificial Sequence
  Synthetic Polynucleotide
taatacgactcactataggggctgtgcatctgtaagtgggacagcttaaaaacagaggagatttaagatgtcccacttaaacctggcggcagcgcaaaagatg

SEQ ID NO: 226182 - DNA, 103 bp, Artificial Sequence
  Synthetic Polynucleotide
taatacgactcactatagggtgtgcttcctgctgtgcatctgtaagtgggaacagaggagacccactatgagatgcacaaacctggcggcagcgcaaaagatg

SEQ ID NO: 226183 - DNA, 103 bp, Artificial Sequence
  Synthetic Polynucleotide
taatacgactcactatagggaactgcgccgcatggtgcgagggcgtgtgaaacagaggagatcacacatgctcgcaccaaacctggcggcagcgcaaaagatg

SEQ ID NO: 226184 - DNA, 103 bp, Artificial Sequence
  Synthetic Polynucleotide
taatacgactcactatagggttctcaccagtgtgcttcctgctgtgcatcaacagaggagagatgcaatgcaggaagcaaacctggcggcagcgcaaaagatg

SEQ ID NO: 226185 - DNA, 103 bp, Artificial Sequence
  Synthetic Polynucleotide
taatacgactcactatagggctggtatggtttctcaccagtgtgcttcctaacagaggagaaggaagatgactggtgagaacctggcggcagcgcaaaagatg

SEQ ID NO: 226186 - DNA, 103 bp, Artificial Sequence
  Synthetic Polynucleotide
taatacgactcactatagggtgaagtcacactggtatggtttctcaccagaacagaggagactggtgatgaaccataccaacctggcggcagcgcaaaagatg

SEQ ID NO: 226187 - DNA, 103 bp, Artificial Sequence
  Synthetic Polynucleotide
taatacgactcactatagggtcacagtccttgaagtcacactggtatggtaacagaggagaaccataatggtgtgacttaacctggcggcagcgcaaaagatg

SEQ ID NO: 226188 - DNA, 103 bp, Artificial Sequence
  Synthetic Polynucleotide
taatacgactcactatagggaaaccttcgttcacagtccttgaagtcacaaacagaggagatgtgacatgaaggactgtaacctggcggcagcgcaaaagatg

SEQ ID NO: 226189 - DNA, 103 bp, Artificial Sequence
  Synthetic Polynucleotide
taatacgactcactatagggctgaacgagaaaaccttcgttcacagtcctaacagaggagaaggactatgaacgaaggtaacctggcggcagcgcaaaagatg

SEQ ID NO: 226190 - DNA, 103 bp, Artificial Sequence
  Synthetic Polynucleotide
taatacgactcactatagggttgagctggtctgaacgagaaaaccttcgtaacagaggagaacgaagatgttctcgttcaacctggcggcagcgcaaaagatg

SEQ ID NO: 226191 - DNA, 103 bp, Artificial Sequence
  Synthetic Polynucleotide
taatacgactcactatagggttggtgtcttttgagctggtctgaacgagaaacagaggagatctcgtatggaccagctcaacctggcggcagcgcaaaagatg

SEQ ID NO: 226192 - DNA, 103 bp, Artificial Sequence
  Synthetic Polynucleotide
taatacgactcactatagggtatgtctcctttggtgtcttttgagctggtaacagaggagaaccagcatgaaagacaccaacctggcggcagcgcaaaagatg

SEQ ID NO: 226193 - DNA, 103 bp, Artificial Sequence
  Synthetic Polynucleotide
taatacgactcactatagggttcacacctgtatgtctcctttggtgtcttaacagaggagaaagacaatgaaggagacaaacctggcggcagcgcaaaagatg

SEQ ID NO: 226194 - DNA, 103 bp, Artificial Sequence
  Synthetic Polynucleotide
taatacgactcactataggggtggttggggaactgcgccgcatggtgcgaaacagaggagatcgcacatggcggcgcagaacctggcggcagcgcaaaagatg

SEQ ID NO: 226195 - DNA, 103 bp, Artificial Sequence
  Synthetic Polynucleotide
taatacgactcactatagggctggaatggtttcacacctgtatgtctcctaacagaggagaaggagaatgacaggtgtgaacctggcggcagcgcaaaagatg

SEQ ID NO: 226196 - DNA, 103 bp, Artificial Sequence
  Synthetic Polynucleotide
taatacgactcactatagggaagttttacactggaatggtttcacacctgaacagaggagacaggtgatgaaccattccaacctggcggcagcgcaaaagatg

SEQ ID NO: 226197 - DNA, 103 bp, Artificial Sequence
  Synthetic Polynucleotide
taatacgactcactatagggtttcgctgacaagttttacactggaatggtaacagaggagaaccattatggtgtaaaacaacctggcggcagcgcaaaagatg

SEQ ID NO: 226198 - DNA, 103 bp, Artificial Sequence
  Synthetic Polynucleotide
taatacgactcactatagggccgggagaactttcgctgacaagttttacaaacagaggagatgtaaaatgtgtcagcgaaacctggcggcagcgcaaaagatg

SEQ ID NO: 226199 - DNA, 103 bp, Artificial Sequence
  Synthetic Polynucleotide
taatacgactcactatagggggtggtcggaccgggagaactttcgctgacaacagaggagagtcagcatgagttctcccaacctggcggcagcgcaaaagatg

SEQ ID NO: 226200 - DNA, 103 bp, Artificial Sequence
  Synthetic Polynucleotide
taatacgactcactatagggtgggtcttcaggtggtcggaccgggagaacaacagaggagagttctcatggtccgaccaaacctggcggcagcgcaaaagatg

SEQ ID NO: 226201 - DNA, 103 bp, Artificial Sequence
  Synthetic Polynucleotide
taatacgactcactatagggagtcctggtgtgggtcttcaggtggtcggaaacagaggagatccgacatgctgaagaccaacctggcggcagcgcaaaagatg

SEQ ID NO: 226202 - DNA, 103 bp, Artificial Sequence
  Synthetic Polynucleotide
taatacgactcactatagggcacctgtatgagtcctggtgtgggtcttcaaacagaggagatgaagaatgacaccaggaaacctggcggcagcgcaaaagatg

SEQ ID NO: 226203 - DNA, 103 bp, Artificial Sequence
  Synthetic Polynucleotide
taatacgactcactatagggaagggcttttcacctgtatgagtcctggtgaacagaggagacaccagatgtcatacaggaacctggcggcagcgcaaaagatg

SEQ ID NO: 226204 - DNA, 103 bp, Artificial Sequence
  Synthetic Polynucleotide
taatacgactcactatagggccgacagctgaagggcttttcacctgtatgaacagaggagacatacaatggaaaagcccaacctggcggcagcgcaaaagatg

SEQ ID NO: 226205 - DNA, 103 bp, Artificial Sequence
  Synthetic Polynucleotide
taatacgactcactataggggcttgaatgagtggttggggaactgcgccgaacagaggagacggcgcatgtccccaaccaacctggcggcagcgcaaaagatg

SEQ ID NO: 226206 - DNA, 103 bp, Artificial Sequence
  Synthetic Polynucleotide
taatacgactcactatagggaacttggccaccgacagctgaagggcttttaacagaggagaaaaagcatgtcagctgtcaacctggcggcagcgcaaaagatg

SEQ ID NO: 226207 - DNA, 103 bp, Artificial Sequence
  Synthetic Polynucleotide
taatacgactcactatagggtttttctgacaacttggccaccgacagctgaacagaggagacagctgatggtggccaagaacctggcggcagcgcaaaagatg

SEQ ID NO: 226208 - DNA, 103 bp, Artificial Sequence
  Synthetic Polynucleotide
taatacgactcactatagggccgggcaaactttttctgacaacttggccaaacagaggagatggccaatgtgtcagaaaaacctggcggcagcgcaaaagatg

SEQ ID NO: 226209 - DNA, 103 bp, Artificial Sequence
  Synthetic Polynucleotide
taatacgactcactatagggattcatctgaccgggcaaactttttctgacaacagaggagagtcagaatgagtttgcccaacctggcggcagcgcaaaagatg

SEQ ID NO: 226210 - DNA, 103 bp, Artificial Sequence
  Synthetic Polynucleotide
taatacgactcactatagggtggcggactaattcatctgaccgggcaaacaacagaggagagtttgcatggtcagatgaaacctggcggcagcgcaaaagatg

SEQ ID NO: 226211 - DNA, 103 bp, Artificial Sequence
  Synthetic Polynucleotide
taatacgactcactatagggcatgttgtgatggcggactaattcatctgaaacagaggagatcagatatgttagtccgcaacctggcggcagcgcaaaagatg

SEQ ID NO: 226212 - DNA, 103 bp, Artificial Sequence
  Synthetic Polynucleotide
taatacgactcactatagggttctctgatgcatgttgtgatggcggactaaacagaggagatagtccatgatcacaacaaacctggcggcagcgcaaaagatg

SEQ ID NO: 226213 - DNA, 103 bp, Artificial Sequence
  Synthetic Polynucleotide
taatacgactcactatagggttggtcatgtttctctgatgcatgttgtgaaacagaggagatcacaaatggcatcagagaacctggcggcagcgcaaaagatg

SEQ ID NO: 226214 - DNA, 103 bp, Artificial Sequence
  Synthetic Polynucleotide
taatacgactcactatagggcagctggagtttggtcatgtttctctgatgaacagaggagacatcagatgaacatgaccaacctggcggcagcgcaaaagatg

SEQ ID NO: 226215 - DNA, 103 bp, Artificial Sequence
  Synthetic Polynucleotide
taatacgactcactatagggggatcctcatgcttgaatgagtggttggggaacagaggagaccccaaatgctcattcaaaacctggcggcagcgcaaaagatg

SEQ ID NO: 226216 - DNA, 103 bp, Artificial Sequence
  Synthetic Polynucleotide
taatacgactcactatagggcgggttcggcgcggctgccaccaccaccataacagaggagaatggtgatggtggcagccaacctggcggcagcgcaaaagatg

SEQ ID NO: 226217 - DNA, 103 bp, Artificial Sequence
  Synthetic Polynucleotide
taatacgactcactatagggcaccatgagcggcagggcctggccggccggaacagaggagaccggccatgcaggccctgaacctggcggcagcgcaaaagatg

SEQ ID NO: 226218 - DNA, 103 bp, Artificial Sequence
  Synthetic Polynucleotide
taatacgactcactatagggtctgggctggcaccatgagcggcagggcctaacagaggagaaggcccatgcgctcatggaacctggcggcagcgcaaaagatg

SEQ ID NO: 226219 - DNA, 103 bp, Artificial Sequence
  Synthetic Polynucleotide
taatacgactcactatagggctggcccctctctgggctggcaccatgagcaacagaggagagctcatatggccagcccaaacctggcggcagcgcaaaagatg

SEQ ID NO: 226220 - DNA, 103 bp, Artificial Sequence
  Synthetic Polynucleotide
taatacgactcactatagggtgcctccgggctggcccctctctgggctggaacagaggagaccagccatgagaggggccaacctggcggcagcgcaaaagatg

SEQ ID NO: 226221 - DNA, 103 bp, Artificial Sequence
  Synthetic Polynucleotide
taatacgactcactatagggccccgctcgctgcctccgggctggcccctcaacagaggagagaggggatggcccggaggaacctggcggcagcgcaaaagatg

SEQ ID NO: 226222 - DNA, 103 bp, Artificial Sequence
  Synthetic Polynucleotide
taatacgactcactatagggtggggcagccccccgctcgctgcctccgggaacagaggagacccggaatgagcgagcggaacctggcggcagcgcaaaagatg

SEQ ID NO: 226223 - DNA, 103 bp, Artificial Sequence
  Synthetic Polynucleotide
taatacgactcactatagggcttgcgcgcctggggcagccccccgctcgcaacagaggagagcgagcatggggctgcccaacctggcggcagcgcaaaagatg

SEQ ID NO: 226224 - DNA, 103 bp, Artificial Sequence
  Synthetic Polynucleotide
taatacgactcactatagggggcgctgtcgcttgcgcgcctggggcagccaacagaggagaggctgcatgaggcgcgcaaacctggcggcagcgcaaaagatg

SEQ ID NO: 226225 - DNA, 103 bp, Artificial Sequence
  Synthetic Polynucleotide
taatacgactcactatagggaggtgcgtgaggcgctgtcgcttgcgcgccaacagaggagaggcgcgatggcgacagcgaacctggcggcagcgcaaaagatg

SEQ ID NO: 226226 - DNA, 103 bp, Artificial Sequence
  Synthetic Polynucleotide
taatacgactcactatagggctcggggctcaggtgcgtgaggcgctgtcgaacagaggagacgacagatgctcacgcacaacctggcggcagcgcaaaagatg

SEQ ID NO: 226227 - DNA, 103 bp, Artificial Sequence
  Synthetic Polynucleotide
taatacgactcactatagggtcccgtcggccgggttcggcgcggctgccaaacagaggagatggcagatgcgccgaaccaacctggcggcagcgcaaaagatg

SEQ ID NO: 226228 - DNA, 103 bp, Artificial Sequence
  Synthetic Polynucleotide
taatacgactcactataggggcgccttctcctcggggctcaggtgcgtgaaacagaggagatcacgcatgtgagccccgaacctggcggcagcgcaaaagatg

SEQ ID NO: 226229 - DNA, 103 bp, Artificial Sequence
  Synthetic Polynucleotide
taatacgactcactatagggttcctcctcagcgccttctcctcggggctcaacagaggagagagcccatgggagaaggcaacctggcggcagcgcaaaagatg

SEQ ID NO: 226230 - DNA, 103 bp, Artificial Sequence
  Synthetic Polynucleotide
taatacgactcactataggggtttttcagtttcctcctcagcgccttctcaacagaggagagagaagatgctgaggaggaacctggcggcagcgcaaaagatg

SEQ ID NO: 226231 - DNA, 103 bp, Artificial Sequence
  Synthetic Polynucleotide
taatacgactcactatagggctgctactctgtttttcagtttcctcctcaaacagaggagatgaggaatgaactgaaaaaacctggcggcagcgcaaaagatg

SEQ ID NO: 226232 - DNA, 103 bp, Artificial Sequence
  Synthetic Polynucleotide
taatacgactcactataggggcagtctgagctgctactctgtttttcagtaacagaggagaactgaaatgcagagtagcaacctggcggcagcgcaaaagatg

SEQ ID NO: 226233 - DNA, 103 bp, Artificial Sequence
  Synthetic Polynucleotide
taatacgactcactatagggtcgatctctggcagtctgagctgctactctaacagaggagaagagtaatggctcagactaacctggcggcagcgcaaaagatg

SEQ ID NO: 226234 - DNA, 103 bp, Artificial Sequence
  Synthetic Polynucleotide
taatacgactcactataggggagccttctttcgatctctggcagtctgagaacagaggagactcagaatgccagagatcaacctggcggcagcgcaaaagatg

SEQ ID NO: 226235 - DNA, 103 bp, Artificial Sequence
  Synthetic Polynucleotide
taatacgactcactatagggtcactcattcgagccttctttcgatctctgaacagaggagacagagaatgaaagaaggcaacctggcggcagcgcaaaagatg

SEQ ID NO: 226236 - DNA, 103 bp, Artificial Sequence
  Synthetic Polynucleotide
taatacgactcactatagggctgttccagctcactcattcgagccttcttaacagaggagaaagaagatgcgaatgagtaacctggcggcagcgcaaaagatg

SEQ ID NO: 226237 - DNA, 103 bp, Artificial Sequence
  Synthetic Polynucleotide
taatacgactcactatagggctaccacttgctgttccagctcactcattcaacagaggagagaatgaatgagctggaacaacctggcggcagcgcaaaagatg

SEQ ID NO: 226238 - DNA, 103 bp, Artificial Sequence
  Synthetic Polynucleotide
taatacgactcactatagggactttaggggtcccgtcggccgggttcggcaacagaggagagccgaaatgggccgacggaacctggcggcagcgcaaaagatg

SEQ ID NO: 226239 - DNA, 103 bp, Artificial Sequence
  Synthetic Polynucleotide
taatacgactcactatagggtcttctaaatctaccacttgctgttccagcaacagaggagagctggaatggcaagtggtaacctggcggcagcgcaaaagatg

SEQ ID NO: 226240 - DNA, 103 bp, Artificial Sequence
  Synthetic Polynucleotide
taatacgactcactatagggttggttctcttcttctaaatctaccacttgaacagaggagacaagtgatggatttagaaaacctggcggcagcgcaaaagatg

SEQ ID NO: 226241 - DNA, 103 bp, Artificial Sequence
  Synthetic Polynucleotide
taatacgactcactataggggcaaaagtttttggttctcttcttctaaataacagaggagaatttagatgaagagaaccaacctggcggcagcgcaaaagatg

SEQ ID NO: 226242 - DNA, 103 bp, Artificial Sequence
  Synthetic Polynucleotide
taatacgactcactatagggtgattttctagcaaaagtttttggttctctaacagaggagaagagaaatgaaaacttttaacctggcggcagcgcaaaagatg

SEQ ID NO: 226243 - DNA, 103 bp, Artificial Sequence
  Synthetic Polynucleotide
taatacgactcactatagggtcgtaaaagctgattttctagcaaaagtttaacagaggagaaaacttatgctagaaaataacctggcggcagcgcaaaagatg

SEQ ID NO: 226244 - DNA, 103 bp, Artificial Sequence
  Synthetic Polynucleotide
taatacgactcactataggggagttttctctcgtaaaagctgattttctaaacagaggagatagaaaatgagcttttacaacctggcggcagcgcaaaagatg

SEQ ID NO: 226245 - DNA, 103 bp, Artificial Sequence
  Synthetic Polynucleotide
taatacgactcactatagggacaaggccatgagttttctctcgtaaaagcaacagaggagagcttttatgagagaaaacaacctggcggcagcgcaaaagatg

SEQ ID NO: 226246 - DNA, 103 bp, Artificial Sequence
  Synthetic Polynucleotide
taatacgactcactataggggttctcaactacaaggccatgagttttctcaacagaggagagagaaaatgcatggccttaacctggcggcagcgcaaaagatg

SEQ ID NO: 226247 - DNA, 103 bp, Artificial Sequence
  Synthetic Polynucleotide
taatacgactcactatagggttaactcctggttctcaactacaaggccataacagaggagaatggccatgtagttgagaaacctggcggcagcgcaaaagatg

SEQ ID NO: 226248 - DNA, 103 bp, Artificial Sequence
  Synthetic Polynucleotide
taatacgactcactatagggaagcgctgtcttaactcctggttctcaactaacagaggagaagttgaatgccaggagttaacctggcggcagcgcaaaagatg

SEQ ID NO: 226249 - DNA, 103 bp, Artificial Sequence
  Synthetic Polynucleotide
taatacgactcactatagggcagaagcagaactttaggggtcccgtcggcaacagaggagagccgacatgacccctaaaaacctggcggcagcgcaaaagatg

SEQ ID NO: 226250 - DNA, 103 bp, Artificial Sequence
  Synthetic Polynucleotide
taatacgactcactatagggatccatccccaagcgctgtcttaactcctgaacagaggagacaggagatgagacagcgcaacctggcggcagcgcaaaagatg

SEQ ID NO: 226251 - DNA, 103 bp, Artificial Sequence
  Synthetic Polynucleotide
taatacgactcactatagggcaaccagggcatccatccccaagcgctgtcaacagaggagagacagcatgtggggatggaacctggcggcagcgcaaaagatg

SEQ ID NO: 226252 - DNA, 103 bp, Artificial Sequence
  Synthetic Polynucleotide
taatacgactcactatagggtcctcttcagcaaccagggcatccatccccaacagaggagaggggatatgtgccctggtaacctggcggcagcgcaaaagatg

SEQ ID NO: 226253 - DNA, 103 bp, Artificial Sequence
  Synthetic Polynucleotide
taatacgactcactatagggggcttccgcctcctcttcagcaaccagggcaacagaggagagccctgatggctgaagagaacctggcggcagcgcaaaagatg

SEQ ID NO: 226254 - DNA, 103 bp, Artificial Sequence
  Synthetic Polynucleotide
taatacgactcactatagggcattccccttggcttccgcctcctcttcagaacagaggagactgaagatgaggcggaagaacctggcggcagcgcaaaagatg

SEQ ID NO: 226255 - DNA, 103 bp, Artificial Sequence
  Synthetic Polynucleotide
taatacgactcactatagggggcctcacttcattccccttggcttccgccaacagaggagaggcggaatgcaaggggaaaacctggcggcagcgcaaaagatg

SEQ ID NO: 226256 - DNA, 103 bp, Artificial Sequence
  Synthetic Polynucleotide
taatacgactcactatagggcccggccactggcctcacttcattccccttaacagaggagaaaggggatggaagtgaggaacctggcggcagcgcaaaagatg

SEQ ID NO: 226257 - DNA, 103 bp, Artificial Sequence
  Synthetic Polynucleotide
taatacgactcactatagggactcagcagacccggccactggcctcacttaacagaggagaaagtgaatgcagtggccgaacctggcggcagcgcaaaagatg

SEQ ID NO: 226258 - DNA, 103 bp, Artificial Sequence
  Synthetic Polynucleotide
taatacgactcactatagggagtgctgcggactcagcagacccggccactaacagaggagaagtggcatggtctgctgaaacctggcggcagcgcaaaagatg

SEQ ID NO: 226259 - DNA, 103 bp, Artificial Sequence
  Synthetic Polynucleotide
taatacgactcactatagggacgtagtctgagtgctgcggactcagcagaaacagaggagatctgctatgtccgcagcaaacctggcggcagcgcaaaagatg

SEQ ID NO: 226260 - DNA, 103 bp, Artificial Sequence
  Synthetic Polynucleotide
taatacgactcactataggggctgccccgacagaagcagaactttaggggaacagaggagacccctaatgttctgcttcaacctggcggcagcgcaaaagatg

SEQ ID NO: 226261 - DNA, 103 bp, Artificial Sequence
  Synthetic Polynucleotide
taatacgactcactataggggcagaggtgcacgtagtctgagtgctgcggaacagaggagaccgcagatgtcagactacaacctggcggcagcgcaaaagatg

SEQ ID NO: 226262 - DNA, 103 bp, Artificial Sequence
  Synthetic Polynucleotide
taatacgactcactatagggtgcacctgctgcagaggtgcacgtagtctgaacagaggagacagactatgtgcacctctaacctggcggcagcgcaaaagatg

SEQ ID NO: 226263 - DNA, 103 bp, Artificial Sequence
  Synthetic Polynucleotide
taatacgactcactatagggcaactgggcctgcacctgctgcagaggtgcaacagaggagagcacctatgcagcaggtgaacctggcggcagcgcaaaagatg

SEQ ID NO: 226264 - DNA, 103 bp, Artificial Sequence
  Synthetic Polynucleotide
taatacgactcactatagggggaggggtgacaactgggcctgcacctgctaacagaggagaagcaggatgaggcccagtaacctggcggcagcgcaaaagatg

SEQ ID NO: 226265 - DNA, 103 bp, Artificial Sequence
  Synthetic Polynucleotide
taatacgactcactataggggagatgttctggaggggtgacaactgggccaacagaggagaggcccaatggtcacccctaacctggcggcagcgcaaaagatg

SEQ ID NO: 226266 - DNA, 103 bp, Artificial Sequence
  Synthetic Polynucleotide
taatacgactcactatagggaatccatggggagatgttctggaggggtgaaacagaggagatcacccatgcagaacatcaacctggcggcagcgcaaaagatg

SEQ ID NO: 226267 - DNA, 103 bp, Artificial Sequence
  Synthetic Polynucleotide
taatacgactcactatagggataccgccagaatccatggggagatgttctaacagaggagaagaacaatgccccatggaaacctggcggcagcgcaaaagatg

SEQ ID NO: 226268 - DNA, 103 bp, Artificial Sequence
  Synthetic Polynucleotide
taatacgactcactatagggtgaagagtcaataccgccagaatccatgggaacagaggagacccatgatgtctggcggtaacctggcggcagcgcaaaagatg

SEQ ID NO: 226269 - DNA, 103 bp, Artificial Sequence
  Synthetic Polynucleotide
taatacgactcactatagggactctgaatctgaagagtcaataccgccagaacagaggagactggcgatgttgactcttaacctggcggcagcgcaaaagatg

SEQ ID NO: 226270 - DNA, 103 bp, Artificial Sequence
  Synthetic Polynucleotide
taatacgactcactatagggaggatatcagactctgaatctgaagagtcaaacagaggagatgactcatgagattcagaaacctggcggcagcgcaaaagatg

SEQ ID NO: 226271 - DNA, 103 bp, Artificial Sequence
  Synthetic Polynucleotide
taatacgactcactataggggcggaggcgggctgccccgacagaagcagaaacagaggagatctgctatggtcggggcaaacctggcggcagcgcaaaagatg

SEQ ID NO: 226272 - DNA, 103 bp, Artificial Sequence
  Synthetic Polynucleotide
taatacgactcactatagggaatgcccaacaggatatcagactctgaatcaacagaggagagattcaatgtctgatatcaacctggcggcagcgcaaaagatg

SEQ ID NO: 226273 - DNA, 103 bp, Artificial Sequence
  Synthetic Polynucleotide
taatacgactcactatagggagttgtccagaatgcccaacaggatatcagaacagaggagactgataatgtgttgggcaaacctggcggcagcgcaaaagatg

SEQ ID NO: 226274 - DNA, 103 bp, Artificial Sequence
  Synthetic Polynucleotide
taatacgactcactatagggactgggtccaagttgtccagaatgcccaacaacagaggagagttgggatgtctggacaaaacctggcggcagcgcaaaagatg

SEQ ID NO: 226275 - DNA, 103 bp, Artificial Sequence
  Synthetic Polynucleotide
taatacgactcactataggggaagaacatgactgggtccaagttgtccagaacagaggagactggacatgttggacccaaacctggcggcagcgcaaaagatg

SEQ ID NO: 226276 - DNA, 103 bp, Artificial Sequence
  Synthetic Polynucleotide
taatacgactcactatagggaagggcatttgaagaacatgactgggtccaaacagaggagatggaccatgtcatgttctaacctggcggcagcgcaaaagatg

SEQ ID NO: 226277 - DNA, 103 bp, Artificial Sequence
  Synthetic Polynucleotide
taatacgactcactatagggggctctggggaagggcatttgaagaacatgaacagaggagacatgttatgcaaatgcccaacctggcggcagcgcaaaagatg

SEQ ID NO: 226278 - DNA, 103 bp, Artificial Sequence
  Synthetic Polynucleotide
taatacgactcactatagggcaggctggcaggctctggggaagggcatttaacagaggagaaaatgcatgtccccagagaacctggcggcagcgcaaaagatg

SEQ ID NO: 226279 - DNA, 103 bp, Artificial Sequence
  Synthetic Polynucleotide
taatacgactcactatagggggagctcctccaggctggcaggctctggggaacagaggagaccccagatgctgccagccaacctggcggcagcgcaaaagatg

SEQ ID NO: 226280 - DNA, 103 bp, Artificial Sequence
  Synthetic Polynucleotide
taatacgactcactatagggtagacctctgggagctcctccaggctggcaaacagaggagatgccagatgggaggagctaacctggcggcagcgcaaaagatg

SEQ ID NO: 226281 - DNA, 103 bp, Artificial Sequence
  Synthetic Polynucleotide
taatacgactcactatagggtccttctgggtagacctctgggagctcctcaacagaggagagaggagatgccagaggtcaacctggcggcagcgcaaaagatg

SEQ ID NO: 226282 - DNA, 103 bp, Artificial Sequence
  Synthetic Polynucleotide
taatacgactcactatagggggctccggcggcggaggcgggctgccccgaaacagaggagatcggggatgcccgcctccaacctggcggcagcgcaaaagatg

SEQ ID NO: 226283 - DNA, 103 bp, Artificial Sequence
  Synthetic Polynucleotide
taatacgactcactatagggaggaactgggtccttctgggtagacctctgaacagaggagacagaggatgacccagaagaacctggcggcagcgcaaaagatg

SEQ ID NO: 226284 - DNA, 103 bp, Artificial Sequence
  Synthetic Polynucleotide
taatacgactcactataggggaggctggtaaggaactgggtccttctgggaacagaggagacccagaatgacccagttcaacctggcggcagcgcaaaagatg

SEQ ID NO: 226285 - DNA, 103 bp, Artificial Sequence
  Synthetic Polynucleotide
taatacgactcactatagggcagagaaagggaggctggtaaggaactgggaacagaggagacccagtatgttaccagccaacctggcggcagcgcaaaagatg

SEQ ID NO: 226286 - DNA, 103 bp, Artificial Sequence
  Synthetic Polynucleotide
taatacgactcactatagggtccccactgacagagaaagggaggctggtaaacagaggagataccagatgccctttctcaacctggcggcagcgcaaaagatg

SEQ ID NO: 226287 - DNA, 103 bp, Artificial Sequence
  Synthetic Polynucleotide
taatacgactcactataggggctgatgacgtccccactgacagagaaaggaacagaggagacctttcatggtcagtgggaacctggcggcagcgcaaaagatg

SEQ ID NO: 226288 - DNA, 103 bp, Artificial Sequence
  Synthetic Polynucleotide
taatacgactcactatagggttccagcttggctgatgacgtccccactgaaacagaggagatcagtgatgacgtcatcaaacctggcggcagcgcaaaagatg

SEQ ID NO: 226289 - DNA, 103 bp, Artificial Sequence
  Synthetic Polynucleotide
taatacgactcactatagggcattaatggcttccagcttggctgatgacgaacagaggagacgtcatatgccaagctggaacctggcggcagcgcaaaagatg

SEQ ID NO: 226290 - DNA, 103 bp, Artificial Sequence
  Synthetic Polynucleotide
taatacgactcactatagggggccggccggggctccggcggcggaggcggaacagaggagaccgcctatgccgccggagaacctggcggcagcgcaaaagatg

SEQ ID NO: 226291 - DNA, 103 bp, Artificial Sequence
  Synthetic Polynucleotide
taatacgactcactatagggggcagggcctggccggccggggctccggcgaacagaggagacgccggatgcccggccggaacctggcggcagcgcaaaagatg

SEQ ID NO: 226292 - DNA, 103 bp, Artificial Sequence
  Synthetic Polynucleotide
taatacgactcactatagggaacagctgccttattccccgaccgcaccataacagaggagaatggtgatgtcggggaataacctggcggcagcgcaaaagatg

SEQ ID NO: 226293 - DNA, 103 bp, Artificial Sequence
  Synthetic Polynucleotide
taatacgactcactatagggcatggttatcaccttctttgcttgttcaaaaacagaggagatttgaaatggcaaagaagaacctggcggcagcgcaaaagatg

SEQ ID NO: 226294 - DNA, 103 bp, Artificial Sequence
  Synthetic Polynucleotide
taatacgactcactataggggaagcacttcccctccgatttatatttcataacagaggagaatgaaaatgaaatcggagaacctggcggcagcgcaaaagatg

SEQ ID NO: 226295 - DNA, 103 bp, Artificial Sequence
  Synthetic Polynucleotide
taatacgactcactatagggccaaaacagagaagcacttcccctccgattaacagaggagaaatcggatgggaagtgctaacctggcggcagcgcaaaagatg

SEQ ID NO: 226296 - DNA, 103 bp, Artificial Sequence
  Synthetic Polynucleotide
taatacgactcactatagggttacaaaatcccaaaacagagaagcacttcaacagaggagagaagtgatgctctgttttaacctggcggcagcgcaaaagatg

SEQ ID NO: 226297 - DNA, 103 bp, Artificial Sequence
  Synthetic Polynucleotide
taatacgactcactatagggctgagaagatttacaaaatcccaaaacagaaacagaggagatctgttatgggattttgtaacctggcggcagcgcaaaagatg

SEQ ID NO: 226298 - DNA, 103 bp, Artificial Sequence
  Synthetic Polynucleotide
taatacgactcactatagggttctctgaacctgagaagatttacaaaatcaacagaggagagattttatgaatcttctcaacctggcggcagcgcaaaagatg

SEQ ID NO: 226299 - DNA, 103 bp, Artificial Sequence
  Synthetic Polynucleotide
taatacgactcactatagggatgaagaatcttctctgaacctgagaagataacagaggagaatcttcatgggttcagagaacctggcggcagcgcaaaagatg

SEQ ID NO: 226300 - DNA, 103 bp, Artificial Sequence
  Synthetic Polynucleotide
taatacgactcactatagggttgatttcccatgaagaatcttctctgaacaacagaggagagttcagatgagattcttcaacctggcggcagcgcaaaagatg

SEQ ID NO: 226301 - DNA, 103 bp, Artificial Sequence
  Synthetic Polynucleotide
taatacgactcactatagggcctttagaacttgatttcccatgaagaatcaacagaggagagattctatgtgggaaatcaacctggcggcagcgcaaaagatg

SEQ ID NO: 226302 - DNA, 103 bp, Artificial Sequence
  Synthetic Polynucleotide
taatacgactcactataggggctgcaaagacctttagaacttgatttcccaacagaggagagggaaaatgagttctaaaaacctggcggcagcgcaaaagatg

SEQ ID NO: 226303 - DNA, 103 bp, Artificial Sequence
  Synthetic Polynucleotide
taatacgactcactatagggatcatctcttgctgcaaagacctttagaacaacagaggagagttctaatggtctttgcaaacctggcggcagcgcaaaagatg

SEQ ID NO: 226304 - DNA, 103 bp, Artificial Sequence
  Synthetic Polynucleotide
taatacgactcactataggggctgtacaaacatggttatcaccttctttgaacagaggagacaaagaatgtgataaccaaacctggcggcagcgcaaaagatg

SEQ ID NO: 226305 - DNA, 103 bp, Artificial Sequence
  Synthetic Polynucleotide
taatacgactcactatagggcagctgcctcatcatctcttgctgcaaagaaacagaggagatctttgatgcaagagatgaacctggcggcagcgcaaaagatg

SEQ ID NO: 226306 - DNA, 103 bp, Artificial Sequence
  Synthetic Polynucleotide
taatacgactcactatagggagtgcaactgcagctgcctcatcatctcttaacagaggagaaagagaatgtgaggcagcaacctggcggcagcgcaaaagatg

SEQ ID NO: 226307 - DNA, 103 bp, Artificial Sequence
  Synthetic Polynucleotide
taatacgactcactatagggcagggaggaaagtgcaactgcagctgcctcaacagaggagagaggcaatggcagttgcaaacctggcggcagcgcaaaagatg

SEQ ID NO: 226308 - DNA, 103 bp, Artificial Sequence
  Synthetic Polynucleotide
taatacgactcactatagggaagcatgaatcagggaggaaagtgcaactgaacagaggagacagttgatgtttcctcccaacctggcggcagcgcaaaagatg

SEQ ID NO: 226309 - DNA, 103 bp, Artificial Sequence
  Synthetic Polynucleotide
taatacgactcactatagggaagtcatccaaagcatgaatcagggaggaaaacagaggagattcctcatggattcatgcaacctggcggcagcgcaaaagatg

SEQ ID NO: 226310 - DNA, 103 bp, Artificial Sequence
  Synthetic Polynucleotide
taatacgactcactatagggcaccatgtctaagtcatccaaagcatgaataacagaggagaattcatatgttggatgacaacctggcggcagcgcaaaagatg

SEQ ID NO: 226311 - DNA, 103 bp, Artificial Sequence
  Synthetic Polynucleotide
taatacgactcactataggggaactatggccaccatgtctaagtcatccaaacagaggagatggatgatgtagacatggaacctggcggcagcgcaaaagatg

SEQ ID NO: 226312 - DNA, 103 bp, Artificial Sequence
  Synthetic Polynucleotide
taatacgactcactatagggtaagcatatcgaactatggccaccatgtctaacagaggagaagacatatgggccatagtaacctggcggcagcgcaaaagatg

SEQ ID NO: 226313 - DNA, 103 bp, Artificial Sequence
  Synthetic Polynucleotide
taatacgactcactatagggtcttttgtcataagcatatcgaactatggcaacagaggagagccataatgcgatatgctaacctggcggcagcgcaaaagatg

SEQ ID NO: 226314 - DNA, 103 bp, Artificial Sequence
  Synthetic Polynucleotide
taatacgactcactataggggaggattagctcttttgtcataagcatatcaacagaggagagatatgatgatgacaaaaaacctggcggcagcgcaaaagatg

SEQ ID NO: 226315 - DNA, 103 bp, Artificial Sequence
  Synthetic Polynucleotide
taatacgactcactatagggaacacctgtcgctgtacaaacatggttatcaacagaggagagataacatggtttgtacaaacctggcggcagcgcaaaagatg

SEQ ID NO: 226316 - DNA, 103 bp, Artificial Sequence
  Synthetic Polynucleotide
taatacgactcactatagggacgccgacttgaggattagctcttttgtcaaacagaggagatgacaaatgagctaatccaacctggcggcagcgcaaaagatg

SEQ ID NO: 226317 - DNA, 103 bp, Artificial Sequence
  Synthetic Polynucleotide
taatacgactcactatagggaggaaaagccacgccgacttgaggattagcaacagaggagagctaatatgcaagtcggcaacctggcggcagcgcaaaagatg

SEQ ID NO: 226318 - DNA, 103 bp, Artificial Sequence
  Synthetic Polynucleotide
taatacgactcactataggggcttgatatgaggaaaagccacgccgacttaacagaggagaaagtcgatgtggcttttcaacctggcggcagcgcaaaagatg

SEQ ID NO: 226319 - DNA, 103 bp, Artificial Sequence
  Synthetic Polynucleotide
taatacgactcactatagggtcatagttatgcttgatatgaggaaaagccaacagaggagaggctttatgtcatatcaaaacctggcggcagcgcaaaagatg

SEQ ID NO: 226320 - DNA, 103 bp, Artificial Sequence
  Synthetic Polynucleotide
taatacgactcactatagggcactaaacactcatagttatgcttgatatgaacagaggagacatatcatgcataactataacctggcggcagcgcaaaagatg

SEQ ID NO: 226321 - DNA, 103 bp, Artificial Sequence
  Synthetic Polynucleotide
taatacgactcactataggggctgcacatacactaaacactcatagttataacagaggagaataactatgagtgtttagaacctggcggcagcgcaaaagatg

SEQ ID NO: 226322 - DNA, 103 bp, Artificial Sequence
  Synthetic Polynucleotide
taatacgactcactatagggatgaaaggcagctgcacatacactaaacacaacagaggagagtgtttatggtatgtgcaaacctggcggcagcgcaaaagatg

SEQ ID NO: 226323 - DNA, 103 bp, Artificial Sequence
  Synthetic Polynucleotide
taatacgactcactatagggcaagtcttccatgaaaggcagctgcacataaacagaggagatatgtgatgctgcctttcaacctggcggcagcgcaaaagatg

SEQ ID NO: 226324 - DNA, 103 bp, Artificial Sequence
  Synthetic Polynucleotide
taatacgactcactatagggtgtattgccgcaagtcttccatgaaaggcaaacagaggagatgccttatgtggaagactaacctggcggcagcgcaaaagatg

SEQ ID NO: 226325 - DNA, 103 bp, Artificial Sequence
  Synthetic Polynucleotide
taatacgactcactataggggatgaaaacatgtattgccgcaagtcttccaacagaggagaggaagaatggcggcaataaacctggcggcagcgcaaaagatg

SEQ ID NO: 226326 - DNA, 103 bp, Artificial Sequence
  Synthetic Polynucleotide
taatacgactcactataggggttctcagcaaacacctgtcgctgtacaaaaacagaggagatttgtaatgcgacaggtgaacctggcggcagcgcaaaagatg

SEQ ID NO: 226327 - DNA, 103 bp, Artificial Sequence
  Synthetic Polynucleotide
taatacgactcactataggggtttttcaaggatgaaaacatgtattgccgaacagaggagacggcaaatgatgttttcaaacctggcggcagcgcaaaagatg

SEQ ID NO: 226328 - DNA, 103 bp, Artificial Sequence
  Synthetic Polynucleotide
taatacgactcactatagggatttcttactgtttttcaaggatgaaaacaaacagaggagatgttttatgccttgaaaaaacctggcggcagcgcaaaagatg

SEQ ID NO: 226329 - DNA, 103 bp, Artificial Sequence
  Synthetic Polynucleotide
taatacgactcactataggggtgggagcatatttcttactgtttttcaagaacagaggagacttgaaatgcagtaagaaaacctggcggcagcgcaaaagatg

SEQ ID NO: 226330 - DNA, 103 bp, Artificial Sequence
  Synthetic Polynucleotide
taatacgactcactatagggctgtgcctcggtgggagcatatttcttactaacagaggagaagtaagatgtatgctcccaacctggcggcagcgcaaaagatg

SEQ ID NO: 226331 - DNA, 103 bp, Artificial Sequence
  Synthetic Polynucleotide
taatacgactcactatagggcagcattcaactgtgcctcggtgggagcataacagaggagaatgctcatgccgaggcacaacctggcggcagcgcaaaagatg

SEQ ID NO: 226332 - DNA, 103 bp, Artificial Sequence
  Synthetic Polynucleotide
taatacgactcactatagggaaagcatcaacagcattcaactgtgcctcgaacagaggagacgaggcatggttgaatgcaacctggcggcagcgcaaaagatg

SEQ ID NO: 226333 - DNA, 103 bp, Artificial Sequence
  Synthetic Polynucleotide
taatacgactcactatagggggagtcaatcaaagcatcaacagcattcaaaacagaggagattgaatatggttgatgctaacctggcggcagcgcaaaagatg

SEQ ID NO: 226334 - DNA, 103 bp, Artificial Sequence
  Synthetic Polynucleotide
taatacgactcactatagggccaagctcatggagtcaatcaaagcatcaaaacagaggagattgatgatgtgattgactaacctggcggcagcgcaaaagatg

SEQ ID NO: 226335 - DNA, 103 bp, Artificial Sequence
  Synthetic Polynucleotide
taatacgactcactatagggtctttctttgccaagctcatggagtcaatcaacagaggagagattgaatgcatgagcttaacctggcggcagcgcaaaagatg

SEQ ID NO: 226336 - DNA, 103 bp, Artificial Sequence
  Synthetic Polynucleotide
taatacgactcactatagggtgtcttctcatctttctttgccaagctcataacagaggagaatgagcatggcaaagaaaaacctggcggcagcgcaaaagatg

SEQ ID NO: 226337 - DNA, 103 bp, Artificial Sequence
  Synthetic Polynucleotide
taatacgactcactatagggtctcatccttgttctcagcaaacacctgtcaacagaggagagacaggatgttgctgagaaacctggcggcagcgcaaaagatg

SEQ ID NO: 226338 - DNA, 103 bp, Artificial Sequence
  Synthetic Polynucleotide
taatacgactcactatagggcaagggtgtctgtcttctcatctttctttgaacagaggagacaaagaatgatgagaagaaacctggcggcagcgcaaaagatg

SEQ ID NO: 226339 - DNA, 103 bp, Artificial Sequence
  Synthetic Polynucleotide
taatacgactcactatagggaacaagtcttcaagggtgtctgtcttctcaaacagaggagatgagaaatgagacaccctaacctggcggcagcgcaaaagatg

SEQ ID NO: 226340 - DNA, 103 bp, Artificial Sequence
  Synthetic Polynucleotide
taatacgactcactatagggggtggttggaaacaagtcttcaagggtgtcaacagaggagagacaccatggaagacttgaacctggcggcagcgcaaaagatg

SEQ ID NO: 226341 - DNA, 103 bp, Artificial Sequence
  Synthetic Polynucleotide
taatacgactcactatagggttgggattttggtggttggaaacaagtcttaacagaggagaaagactatgttccaaccaaacctggcggcagcgcaaaagatg

SEQ ID NO: 226342 - DNA, 103 bp, Artificial Sequence
  Synthetic Polynucleotide
taatacgactcactatagggaatcgaggatttgggattttggtggttggaaacagaggagatccaacatgcaaaatcccaacctggcggcagcgcaaaagatg

SEQ ID NO: 226343 - DNA, 103 bp, Artificial Sequence
  Synthetic Polynucleotide
taatacgactcactatagggtaatctctgaaatcgaggatttgggattttaacagaggagaaaaatcatgaatcctcgaaacctggcggcagcgcaaaagatg

SEQ ID NO: 226344 - DNA, 103 bp, Artificial Sequence
  Synthetic Polynucleotide
taatacgactcactataggggacactgaaataatctctgaaatcgaggataacagaggagaatcctcatgttcagagataacctggcggcagcgcaaaagatg

SEQ ID NO: 226345 - DNA, 103 bp, Artificial Sequence
  Synthetic Polynucleotide
taatacgactcactatagggctgtgcagcagacactgaaataatctctgaaacagaggagatcagagatgatttcagtgaacctggcggcagcgcaaaagatg

SEQ ID NO: 226346 - DNA, 103 bp, Artificial Sequence
  Synthetic Polynucleotide
taatacgactcactatagggatgtaaagctctgtgcagcagacactgaaaaacagaggagatttcagatgctgctgcacaacctggcggcagcgcaaaagatg

SEQ ID NO: 226347 - DNA, 103 bp, Artificial Sequence
  Synthetic Polynucleotide
taatacgactcactataggggctcccggggatgtaaagctctgtgcagcaaacagaggagatgctgcatggagctttacaacctggcggcagcgcaaaagatg

SEQ ID NO: 226348 - DNA, 103 bp, Artificial Sequence
  Synthetic Polynucleotide
taatacgactcactatagggactaaagcaatctcatccttgttctcagcaaacagaggagatgctgaatgcaaggatgaaacctggcggcagcgcaaaagatg

SEQ ID NO: 226349 - DNA, 103 bp, Artificial Sequence
  Synthetic Polynucleotide
taatacgactcactataggggggggtagaggctcccggggatgtaaagctaacagaggagaagctttatgtccccgggaaacctggcggcagcgcaaaagatg

SEQ ID NO: 226350 - DNA, 103 bp, Artificial Sequence
  Synthetic Polynucleotide
taatacgactcactatagggctgctgaattgggggtagaggctcccggggaacagaggagaccccggatgcctctacccaacctggcggcagcgcaaaagatg

SEQ ID NO: 226351 - DNA, 103 bp, Artificial Sequence
  Synthetic Polynucleotide
taatacgactcactatagggtccaaatatgctgctgaattgggggtagagaacagaggagactctacatgcaattcagcaacctggcggcagcgcaaaagatg

SEQ ID NO: 226352 - DNA, 103 bp, Artificial Sequence
  Synthetic Polynucleotide
taatacgactcactatagggttcagcatattccaaatatgctgctgaattaacagaggagaaattcaatggcatatttgaacctggcggcagcgcaaaagatg

SEQ ID NO: 226353 - DNA, 103 bp, Artificial Sequence
  Synthetic Polynucleotide
taatacgactcactatagggagcgggaggattcagcatattccaaatatgaacagaggagacatattatgaatatgctgaacctggcggcagcgcaaaagatg

SEQ ID NO: 226354 - DNA, 103 bp, Artificial Sequence
  Synthetic Polynucleotide
taatacgactcactatagggttgtcacctcagcgggaggattcagcatataacagaggagaatatgcatgatcctcccgaacctggcggcagcgcaaaagatg

SEQ ID NO: 226355 - DNA, 103 bp, Artificial Sequence
  Synthetic Polynucleotide
taatacgactcactatagggtgactttttgttgtcacctcagcgggaggaaacagaggagatcctccatgtgaggtgacaacctggcggcagcgcaaaagatg

SEQ ID NO: 226356 - DNA, 103 bp, Artificial Sequence
  Synthetic Polynucleotide
taatacgactcactataggggagaggaatctgactttttgttgtcacctcaacagaggagagaggtgatgacaaaaagtaacctggcggcagcgcaaaagatg

SEQ ID NO: 226357 - DNA, 103 bp, Artificial Sequence
  Synthetic Polynucleotide
taatacgactcactatagggttattttagagagaggaatctgactttttgaacagaggagacaaaaaatgagattcctcaacctggcggcagcgcaaaagatg

SEQ ID NO: 226358 - DNA, 103 bp, Artificial Sequence
  Synthetic Polynucleotide
taatacgactcactatagggaaaagggtctttattttagagagaggaatcaacagaggagagattccatgctctaaaataacctggcggcagcgcaaaagatg

SEQ ID NO: 226359 - DNA, 103 bp, Artificial Sequence
  Synthetic Polynucleotide
taatacgactcactatagggaccaaacaggactaaagcaatctcatccttaacagaggagaaaggatatgattgctttaaacctggcggcagcgcaaaagatg

SEQ ID NO: 226360 - DNA, 103 bp, Artificial Sequence
  Synthetic Polynucleotide
taatacgactcactatagggaatcagaggaaaaagggtctttattttagaaacagaggagatctaaaatgaagacccttaacctggcggcagcgcaaaagatg

SEQ ID NO: 226361 - DNA, 103 bp, Artificial Sequence
  Synthetic Polynucleotide
taatacgactcactatagggtcttggcttcaatcagaggaaaaagggtctaacagaggagaagacccatgttcctctgaaacctggcggcagcgcaaaagatg

SEQ ID NO: 226362 - DNA, 103 bp, Artificial Sequence
  Synthetic Polynucleotide
taatacgactcactatagggtgatcctttttcttggcttcaatcagaggaaacagaggagatcctctatgtgaagccaaaacctggcggcagcgcaaaagatg

SEQ ID NO: 226363 - DNA, 103 bp, Artificial Sequence
  Synthetic Polynucleotide
taatacgactcactatagggagcagtcacttgatcctttttcttggcttcaacagaggagagaagccatgaaaaaggataacctggcggcagcgcaaaagatg

SEQ ID NO: 226364 - DNA, 103 bp, Artificial Sequence
  Synthetic Polynucleotide
taatacgactcactatagggaaatttcctgagcagtcacttgatccttttaacagaggagaaaaaggatgaagtgactgaacctggcggcagcgcaaaagatg

SEQ ID NO: 226365 - DNA, 103 bp, Artificial Sequence
  Synthetic Polynucleotide
taatacgactcactatagggttgtcttggaaaatttcctgagcagtcactaacagaggagaagtgacatgtcaggaaataacctggcggcagcgcaaaagatg

SEQ ID NO: 226366 - DNA, 103 bp, Artificial Sequence
  Synthetic Polynucleotide
taatacgactcactatagggatcttcatggttgtcttggaaaatttcctgaacagaggagacaggaaatgttccaagacaacctggcggcagcgcaaaagatg

SEQ ID NO: 226367 - DNA, 103 bp, Artificial Sequence
  Synthetic Polynucleotide
taatacgactcactatagggctgtaggtccatcttcatggttgtcttggaaacagaggagatccaagatgaccatgaagaacctggcggcagcgcaaaagatg

SEQ ID NO: 226368 - DNA, 103 bp, Artificial Sequence
  Synthetic Polynucleotide
taatacgactcactatagggaattttttagctgtaggtccatcttcatggaacagaggagaccatgaatgtggacctacaacctggcggcagcgcaaaagatg

SEQ ID NO: 226369 - DNA, 103 bp, Artificial Sequence
  Synthetic Polynucleotide
taatacgactcactatagggctcagtctttaattttttagctgtaggtccaacagaggagaggacctatggctaaaaaaaacctggcggcagcgcaaaagatg

SEQ ID NO: 226370 - DNA, 103 bp, Artificial Sequence
  Synthetic Polynucleotide
taatacgactcactatagggtgccatctgtaccaaacaggactaaagcaaaacagaggagattgcttatgtcctgtttgaacctggcggcagcgcaaaagatg

SEQ ID NO: 226371 - DNA, 103 bp, Artificial Sequence
  Synthetic Polynucleotide
taatacgactcactatagggctcccccttgctcagtctttaattttttagaacagaggagactaaaaatgtaaagactgaacctggcggcagcgcaaaagatg

SEQ ID NO: 226372 - DNA, 103 bp, Artificial Sequence
  Synthetic Polynucleotide
taatacgactcactatagggctgaagtgggctcccccttgctcagtctttaacagaggagaaaagacatggcaagggggaacctggcggcagcgcaaaagatg

SEQ ID NO: 226373 - DNA, 103 bp, Artificial Sequence
  Synthetic Polynucleotide
taatacgactcactatagggactggagacgctgaagtgggctcccccttgaacagaggagacaagggatggcccacttcaacctggcggcagcgcaaaagatg

SEQ ID NO: 226374 - DNA, 103 bp, Artificial Sequence
  Synthetic Polynucleotide
taatacgactcactatagggcttcagccagactggagacgctgaagtgggaacagaggagacccactatggcgtctccaaacctggcggcagcgcaaaagatg

SEQ ID NO: 226375 - DNA, 103 bp, Artificial Sequence
  Synthetic Polynucleotide
taatacgactcactataggggtgacactgccttcagccagactggagacgaacagaggagacgtctcatgtctggctgaaacctggcggcagcgcaaaagatg

SEQ ID NO: 226376 - DNA, 103 bp, Artificial Sequence
  Synthetic Polynucleotide
taatacgactcactatagggtccaacagaggtgacactgccttcagccagaacagaggagactggctatgggcagtgtcaacctggcggcagcgcaaaagatg

SEQ ID NO: 226377 - DNA, 103 bp, Artificial Sequence
  Synthetic Polynucleotide
taatacgactcactataggggattcacacttccaacagaggtgacactgcaacagaggagagcagtgatgcctctgttgaacctggcggcagcgcaaaagatg

SEQ ID NO: 226378 - DNA, 103 bp, Artificial Sequence
  Synthetic Polynucleotide
taatacgactcactatagggttttcagcaggattcacacttccaacagagaacagaggagactctgtatgaagtgtgaaaacctggcggcagcgcaaaagatg

SEQ ID NO: 226379 - DNA, 103 bp, Artificial Sequence
  Synthetic Polynucleotide
taatacgactcactatagggaacacggaagttttcagcaggattcacactaacagaggagaagtgtgatgcctgctgaaaacctggcggcagcgcaaaagatg

SEQ ID NO: 226380 - DNA, 103 bp, Artificial Sequence
  Synthetic Polynucleotide
taatacgactcactataggggtttcactagaacacggaagttttcagcagaacagaggagactgctgatgacttccgtgaacctggcggcagcgcaaaagatg

SEQ ID NO: 226381 - DNA, 103 bp, Artificial Sequence
  Synthetic Polynucleotide
taatacgactcactatagggggattgtcagtgccatctgtaccaaacaggaacagaggagacctgttatgtacagatggaacctggcggcagcgcaaaagatg

SEQ ID NO: 226382 - DNA, 103 bp, Artificial Sequence
  Synthetic Polynucleotide
taatacgactcactataggggccttcttctgtttcactagaacacggaagaacagaggagacttccgatgtctagtgaaaacctggcggcagcgcaaaagatg

SEQ ID NO: 226383 - DNA, 103 bp, Artificial Sequence
  Synthetic Polynucleotide
taatacgactcactatagggctcaaagctggccttcttctgtttcactagaacagaggagactagtgatgcagaagaagaacctggcggcagcgcaaaagatg

SEQ ID NO: 226384 - DNA, 103 bp, Artificial Sequence
  Synthetic Polynucleotide
taatacgactcactatagggtactcgcttcctcaaagctggccttcttctaacagaggagaagaagaatgccagctttgaacctggcggcagcgcaaaagatg

SEQ ID NO: 226385 - DNA, 103 bp, Artificial Sequence
  Synthetic Polynucleotide
taatacgactcactatagggatgagctggttactcgcttcctcaaagctgaacagaggagacagcttatgggaagcgagaacctggcggcagcgcaaaagatg

SEQ ID NO: 226386 - DNA, 103 bp, Artificial Sequence
  Synthetic Polynucleotide
taatacgactcactataggggatgtgatttatgagctggttactcgcttcaacagaggagagaagcgatgaaccagctcaacctggcggcagcgcaaaagatg

SEQ ID NO: 226387 - DNA, 103 bp, Artificial Sequence
  Synthetic Polynucleotide
taatacgactcactatagggaaaactgttcgatgtgatttatgagctggtaacagaggagaaccagcatgtaaatcacaaacctggcggcagcgcaaaagatg

SEQ ID NO: 226388 - DNA, 103 bp, Artificial Sequence
  Synthetic Polynucleotide
taatacgactcactatagggttagtatccaaaaactgttcgatgtgatttaacagaggagaaaatcaatgcgaacagttaacctggcggcagcgcaaaagatg

SEQ ID NO: 226389 - DNA, 103 bp, Artificial Sequence
  Synthetic Polynucleotide
taatacgactcactatagggcggtgtttcattagtatccaaaaactgttcaacagaggagagaacagatgttggatactaacctggcggcagcgcaaaagatg

SEQ ID NO: 226390 - DNA, 103 bp, Artificial Sequence
  Synthetic Polynucleotide
taatacgactcactatagggtcataaaatacggtgtttcattagtatccaaacagaggagatggataatgatgaaacacaacctggcggcagcgcaaaagatg

SEQ ID NO: 226391 - DNA, 103 bp, Artificial Sequence
  Synthetic Polynucleotide
taatacgactcactatagggtctatgctcttcataaaatacggtgtttcaaacagaggagatgaaacatggtattttataacctggcggcagcgcaaaagatg

SEQ ID NO: 226392 - DNA, 103 bp, Artificial Sequence
  Synthetic Polynucleotide
taatacgactcactatagggaccagaaaggggattgtcagtgccatctgtaacagaggagaacagatatgactgacaataacctggcggcagcgcaaaagatg

SEQ ID NO: 226393 - DNA, 103 bp, Artificial Sequence
  Synthetic Polynucleotide
taatacgactcactatagggtcggatgcagtctatgctcttcataaaataaacagaggagatattttatgaagagcataaacctggcggcagcgcaaaagatg

SEQ ID NO: 226394 - DNA, 103 bp, Artificial Sequence
  Synthetic Polynucleotide
taatacgactcactatagggcccggaaggctcggatgcagtctatgctctaacagaggagaagagcaatgactgcatccaacctggcggcagcgcaaaagatg

SEQ ID NO: 226395 - DNA, 103 bp, Artificial Sequence
  Synthetic Polynucleotide
taatacgactcactatagggatggcttcttcccggaaggctcggatgcagaacagaggagactgcatatgagccttccgaacctggcggcagcgcaaaagatg

SEQ ID NO: 226396 - DNA, 103 bp, Artificial Sequence
  Synthetic Polynucleotide
taatacgactcactatagggtgaaaacttaatggcttcttcccggaaggcaacagaggagagccttcatggaagaagccaacctggcggcagcgcaaaagatg

SEQ ID NO: 226397 - DNA, 103 bp, Artificial Sequence
  Synthetic Polynucleotide
taatacgactcactataggggctgctcttctgaaaacttaatggcttcttaacagaggagaaagaagatgttaagttttaacctggcggcagcgcaaaagatg

SEQ ID NO: 226398 - DNA, 103 bp, Artificial Sequence
  Synthetic Polynucleotide
taatacgactcactatagggttgttaaagcgctgctcttctgaaaacttaaacagaggagataagttatgagaagagcaaacctggcggcagcgcaaaagatg

SEQ ID NO: 226399 - DNA, 103 bp, Artificial Sequence
  Synthetic Polynucleotide
taatacgactcactatagggtttcaggaagttgttaaagcgctgctcttcaacagaggagagaagagatgcgctttaacaacctggcggcagcgcaaaagatg

SEQ ID NO: 226400 - DNA, 103 bp, Artificial Sequence
  Synthetic Polynucleotide
taatacgactcactatagggcttgaagggctttcaggaagttgttaaagcaacagaggagagctttaatgacttcctgaaacctggcggcagcgcaaaagatg

SEQ ID NO: 226401 - DNA, 103 bp, Artificial Sequence
  Synthetic Polynucleotide
taatacgactcactatagggtccactttctcttgaagggctttcaggaagaacagaggagacttcctatgagcccttcaaacctggcggcagcgcaaaagatg

SEQ ID NO: 226402 - DNA, 103 bp, Artificial Sequence
  Synthetic Polynucleotide
taatacgactcactatagggttgtttaatttccactttctcttgaagggcaacagaggagagcccttatggagaaagtgaacctggcggcagcgcaaaagatg

SEQ ID NO: 226403 - DNA, 103 bp, Artificial Sequence
  Synthetic Polynucleotide
taatacgactcactatagggtacacagcacaacagctgccttattccccgaacagaggagacggggaatgaggcagctgaacctggcggcagcgcaaaagatg

SEQ ID NO: 226404 - DNA, 103 bp, Artificial Sequence
  Synthetic Polynucleotide
taatacgactcactatagggactgatccccaccagaaaggggattgtcagaacagaggagactgacaatgccctttctgaacctggcggcagcgcaaaagatg

SEQ ID NO: 226405 - DNA, 103 bp, Artificial Sequence
  Synthetic Polynucleotide
taatacgactcactatagggaatgatttaattgtttaatttccactttctaacagaggagaagaaagatgaaattaaacaacctggcggcagcgcaaaagatg

SEQ ID NO: 226406 - DNA, 103 bp, Artificial Sequence
  Synthetic Polynucleotide
taatacgactcactatagggatttcccagaaatgatttaattgtttaattaacagaggagaaattaaatgattaaatcaaacctggcggcagcgcaaaagatg

SEQ ID NO: 226407 - DNA, 103 bp, Artificial Sequence
  Synthetic Polynucleotide
taatacgactcactatagggctggacaacaatttcccagaaatgatttaaaacagaggagattaaatatgttctgggaaaacctggcggcagcgcaaaagatg

SEQ ID NO: 226408 - DNA, 103 bp, Artificial Sequence
  Synthetic Polynucleotide
taatacgactcactatagggtaattccatcctggacaacaatttcccagaaacagaggagatctgggatgttgttgtccaacctggcggcagcgcaaaagatg

SEQ ID NO: 226409 - DNA, 103 bp, Artificial Sequence
  Synthetic Polynucleotide
taatacgactcactataggggtgatcagagtaattccatcctggacaacaaacagaggagatgttgtatgggatggaataacctggcggcagcgcaaaagatg

SEQ ID NO: 226410 - DNA, 103 bp, Artificial Sequence
  Synthetic Polynucleotide
taatacgactcactatagggttcctctttggtgatcagagtaattccatcaacagaggagagatggaatgactctgatcaacctggcggcagcgcaaaagatg

SEQ ID NO: 226411 - DNA, 103 bp, Artificial Sequence
  Synthetic Polynucleotide
taatacgactcactatagggttccagaggcttcctctttggtgatcagagaacagaggagactctgaatgccaaagaggaacctggcggcagcgcaaaagatg

SEQ ID NO: 226412 - DNA, 103 bp, Artificial Sequence
  Synthetic Polynucleotide
taatacgactcactataggggtgacagaacttccagaggcttcctctttgaacagaggagacaaagaatgagcctctggaacctggcggcagcgcaaaagatg

SEQ ID NO: 226413 - DNA, 103 bp, Artificial Sequence
  Synthetic Polynucleotide
taatacgactcactatagggttcctcagctgtgacagaacttccagaggcaacagaggagagcctctatgagttctgtcaacctggcggcagcgcaaaagatg

SEQ ID NO: 226414 - DNA, 103 bp, Artificial Sequence
  Synthetic Polynucleotide
taatacgactcactatagggactttttggcttcctcagctgtgacagaacaacagaggagagttctgatgcagctgaggaacctggcggcagcgcaaaagatg

SEQ ID NO: 226415 - DNA, 103 bp, Artificial Sequence
  Synthetic Polynucleotide
taatacgactcactatagggatgttctgatactgatccccaccagaaaggaacagaggagacctttcatgtggggatcaaacctggcggcagcgcaaaagatg

SEQ ID NO: 226416 - DNA, 103 bp, Artificial Sequence
  Synthetic Polynucleotide
taatacgactcactatagggggggccagaaactttttggcttcctcagctaacagaggagaagctgaatgagccaaaaaaacctggcggcagcgcaaaagatg

SEQ ID NO: 226417 - DNA, 103 bp, Artificial Sequence
  Synthetic Polynucleotide
taatacgactcactatagggtttgtctttgggggccagaaactttttggcaacagaggagagccaaaatgtttctggccaacctggcggcagcgcaaaagatg

SEQ ID NO: 226418 - DNA, 103 bp, Artificial Sequence
  Synthetic Polynucleotide
taatacgactcactatagggctccacttggtttgtctttgggggccagaaaacagaggagattctggatgccaaagacaaacctggcggcagcgcaaaagatg

SEQ ID NO: 226419 - DNA, 103 bp, Artificial Sequence
  Synthetic Polynucleotide
taatacgactcactataggggctgctgtgtctccacttggtttgtctttgaacagaggagacaaagaatgaccaagtggaacctggcggcagcgcaaaagatg

SEQ ID NO: 226420 - DNA, 103 bp, Artificial Sequence
  Synthetic Polynucleotide
taatacgactcactatagggttcaaatacagctgctgtgtctccacttggaacagaggagaccaagtatggacacagcaaacctggcggcagcgcaaaagatg

SEQ ID NO: 226421 - DNA, 103 bp, Artificial Sequence
  Synthetic Polynucleotide
taatacgactcactatagggcaccaccttcttcaaatacagctgctgtgtaacagaggagaacacagatgctgtatttgaacctggcggcagcgcaaaagatg

SEQ ID NO: 226422 - DNA, 103 bp, Artificial Sequence
  Synthetic Polynucleotide
taatacgactcactatagggtcgtccacatcaccaccttcttcaaatacaaacagaggagatgtattatgagaaggtggaacctggcggcagcgcaaaagatg

SEQ ID NO: 226423 - DNA, 103 bp, Artificial Sequence
  Synthetic Polynucleotide
taatacgactcactataggggtccaataaatcgtccacatcaccaccttcaacagaggagagaaggtatggatgtggacaacctggcggcagcgcaaaagatg

SEQ ID NO: 226424 - DNA, 103 bp, Artificial Sequence
  Synthetic Polynucleotide
taatacgactcactataggggtgcactgtgatgttctgatactgatccccaacagaggagaggggatatgtatcagaacaacctggcggcagcgcaaaagatg

SEQ ID NO: 226425 - DNA, 103 bp, Artificial Sequence
  Synthetic Polynucleotide
taatacgactcactatagggtcagatgtctgtgcactgtgatgttctgataacagaggagaatcagaatgtcacagtgcaacctggcggcagcgcaaaagatg

SEQ ID NO: 226426 - DNA, 103 bp, Artificial Sequence
  Synthetic Polynucleotide
taatacgactcactatagggtctggtagcatcagatgtctgtgcactgtgaacagaggagacacagtatgcagacatctaacctggcggcagcgcaaaagatg

SEQ ID NO: 226427 - DNA, 103 bp, Artificial Sequence
  Synthetic Polynucleotide
taatacgactcactatagggcaaatcaaaatctggtagcatcagatgtctaacagaggagaagacatatgatgctaccaaacctggcggcagcgcaaaagatg

SEQ ID NO: 226428 - DNA, 103 bp, Artificial Sequence
  Synthetic Polynucleotide
taatacgactcactatagggtgtcctccagcaaatcaaaatctggtagcaaacagaggagatgctacatgattttgattaacctggcggcagcgcaaaagatg

SEQ ID NO: 226429 - DNA, 103 bp, Artificial Sequence
  Synthetic Polynucleotide
taatacgactcactatagggttgctttcaatgtcctccagcaaatcaaaaaacagaggagattttgaatggctggaggaaacctggcggcagcgcaaaagatg

SEQ ID NO: 226430 - DNA, 103 bp, Artificial Sequence
  Synthetic Polynucleotide
taatacgactcactatagggtggttggattttgctttcaatgtcctccagaacagaggagactggagatgattgaaagcaacctggcggcagcgcaaaagatg

SEQ ID NO: 226431 - DNA, 103 bp, Artificial Sequence
  Synthetic Polynucleotide
taatacgactcactataggggttgagaacctggttggattttgctttcaaaacagaggagattgaaaatgaaatccaacaacctggcggcagcgcaaaagatg

SEQ ID NO: 226432 - DNA, 103 bp, Artificial Sequence
  Synthetic Polynucleotide
taatacgactcactatagggcccacgtccatacacagcacaacagctgccaacagaggagaggcagcatgtgtgctgtgaacctggcggcagcgcaaaagatg

SEQ ID NO: 226433 - DNA, 103 bp, Artificial Sequence
  Synthetic Polynucleotide
taatacgactcactatagggaagtcagcctgttgagaacctggttggattaacagaggagaaatccaatgaggttctcaaacctggcggcagcgcaaaagatg

SEQ ID NO: 226434 - DNA, 103 bp, Artificial Sequence
  Synthetic Polynucleotide
taatacgactcactatagggtgcatccaggaagtcagcctgttgagaaccaacagaggagaggttctatgcaggctgacaacctggcggcagcgcaaaagatg

SEQ ID NO: 226435 - DNA, 103 bp, Artificial Sequence
  Synthetic Polynucleotide
taatacgactcactatagggtcacgattagtgcatccaggaagtcagcctaacagaggagaaggctgatgtcctggatgaacctggcggcagcgcaaaagatg

SEQ ID NO: 226436 - DNA, 103 bp, Artificial Sequence
  Synthetic Polynucleotide
taatacgactcactatagggacatccatgctcacgattagtgcatccaggaacagaggagacctggaatgactaatcgtaacctggcggcagcgcaaaagatg

SEQ ID NO: 226437 - DNA, 103 bp, Artificial Sequence
  Synthetic Polynucleotide
taatacgactcactatagggatgttgaatcacatccatgctcacgattagaacagaggagactaatcatgagcatggataacctggcggcagcgcaaaagatg

SEQ ID NO: 226438 - DNA, 103 bp, Artificial Sequence
  Synthetic Polynucleotide
taatacgactcactatagggctattgtttcatgttgaatcacatccatgcaacagaggagagcatggatgtgattcaacaacctggcggcagcgcaaaagatg

SEQ ID NO: 226439 - DNA, 103 bp, Artificial Sequence
  Synthetic Polynucleotide
taatacgactcactatagggaacttctttcctattgtttcatgttgaatcaacagaggagagattcaatgtgaaacaataacctggcggcagcgcaaaagatg

SEQ ID NO: 226440 - DNA, 103 bp, Artificial Sequence
  Synthetic Polynucleotide
taatacgactcactatagggcctcttctcaaacttctttcctattgtttcaacagaggagagaaacaatgggaaagaagaacctggcggcagcgcaaaagatg

SEQ ID NO: 226441 - DNA, 103 bp, Artificial Sequence
  Synthetic Polynucleotide
taatacgactcactatagggtttcaatatgcctcttctcaaacttctttcaacagaggagagaaagaatgttgagaagaaacctggcggcagcgcaaaagatg

SEQ ID NO: 226442 - DNA, 103 bp, Artificial Sequence
  Synthetic Polynucleotide
taatacgactcactatagggtcagtgaatatttcaatatgcctcttctcaaacagaggagatgagaaatggcatattgaaacctggcggcagcgcaaaagatg

SEQ ID NO: 226443 - DNA, 103 bp, Artificial Sequence
  Synthetic Polynucleotide
taatacgactcactatagggcatggtaaagcccacgtccatacacagcacaacagaggagagtgctgatgatggacgtgaacctggcggcagcgcaaaagatg

SEQ ID NO: 226444 - DNA, 103 bp, Artificial Sequence
  Synthetic Polynucleotide
taatacgactcactataggggctgctgaggtcagtgaatatttcaatatgaacagaggagacatattatgatattcactaacctggcggcagcgcaaaagatg

SEQ ID NO: 226445 - DNA, 103 bp, Artificial Sequence
  Synthetic Polynucleotide
taatacgactcactatagggtgctgaatcggctgctgaggtcagtgaataaacagaggagatattcaatgacctcagcaaacctggcggcagcgcaaaagatg

SEQ ID NO: 226446 - DNA, 103 bp, Artificial Sequence
  Synthetic Polynucleotide
taatacgactcactatagggagctgacttttgctgaatcggctgctgaggaacagaggagacctcagatgccgattcagaacctggcggcagcgcaaaagatg

SEQ ID NO: 226447 - DNA, 103 bp, Artificial Sequence
  Synthetic Polynucleotide
taatacgactcactatagggtataatatccagctgacttttgctgaatcgaacagaggagacgattcatgaaaagtcagaacctggcggcagcgcaaaagatg

SEQ ID NO: 226448 - DNA, 103 bp, Artificial Sequence
  Synthetic Polynucleotide
taatacgactcactatagggagctatgaattataatatccagctgactttaacagaggagaaaagtcatgtggatattaaacctggcggcagcgcaaaagatg

SEQ ID NO: 226449 - DNA, 103 bp, Artificial Sequence
  Synthetic Polynucleotide
taatacgactcactatagggcatttcttcaagctatgaattataatatccaacagaggagaggatatatgaattcatagaacctggcggcagcgcaaaagatg

SEQ ID NO: 226450 - DNA, 103 bp, Artificial Sequence
  Synthetic Polynucleotide
taatacgactcactatagggggagatgtcacatttcttcaagctatgaataacagaggagaattcatatgttgaagaaaaacctggcggcagcgcaaaagatg

SEQ ID NO: 226451 - DNA, 103 bp, Artificial Sequence
  Synthetic Polynucleotide
taatacgactcactatagggagaattgcagggagatgtcacatttcttcaaacagaggagatgaagaatggtgacatctaacctggcggcagcgcaaaagatg

SEQ ID NO: 226452 - DNA, 103 bp, Artificial Sequence
  Synthetic Polynucleotide
taatacgactcactatagggaaaggcaagaagaattgcagggagatgtcaaacagaggagatgacatatgcctgcaattaacctggcggcagcgcaaaagatg

SEQ ID NO: 226453 - DNA, 103 bp, Artificial Sequence
  Synthetic Polynucleotide
taatacgactcactataggggccaagtgagaaaggcaagaagaattgcagaacagaggagactgcaaatgttcttgcctaacctggcggcagcgcaaaagatg

SEQ ID NO: 226454 - DNA, 103 bp, Artificial Sequence
  Synthetic Polynucleotide
taatacgactcactatagggtggagttactcatggtaaagcccacgtccaaacagaggagatggacgatggctttaccaaacctggcggcagcgcaaaagatg

SEQ ID NO: 226455 - DNA, 103 bp, Artificial Sequence
  Synthetic Polynucleotide
taatacgactcactatagggcatcttccttgccaagtgagaaaggcaagaaacagaggagatcttgcatgtctcacttgaacctggcggcagcgcaaaagatg

SEQ ID NO: 226456 - DNA, 103 bp, Artificial Sequence
  Synthetic Polynucleotide
taatacgactcactatagggtccccacttccatcttccttgccaagtgagaacagaggagactcactatgcaaggaagaaacctggcggcagcgcaaaagatg

SEQ ID NO: 226457 - DNA, 103 bp, Artificial Sequence
  Synthetic Polynucleotide
taatacgactcactatagggatctcctctgtccccacttccatcttccttaacagaggagaaaggaaatgggaagtgggaacctggcggcagcgcaaaagatg

SEQ ID NO: 226458 - DNA, 103 bp, Artificial Sequence
  Synthetic Polynucleotide
taatacgactcactataggggaaaggggccatctcctctgtccccacttcaacagaggagagaagtgatgacagaggagaacctggcggcagcgcaaaagatg

SEQ ID NO: 226459 - DNA, 103 bp, Artificial Sequence
  Synthetic Polynucleotide
taatacgactcactatagggccacctaagcgaaaggggccatctcctctgaacagaggagacagaggatgtggccccttaacctggcggcagcgcaaaagatg

SEQ ID NO: 226460 - DNA, 103 bp, Artificial Sequence
  Synthetic Polynucleotide
taatacgactcactatagggaggcccatggccacctaagcgaaaggggccaacagaggagaggccccatgcgcttaggtaacctggcggcagcgcaaaagatg

SEQ ID NO: 226461 - DNA, 103 bp, Artificial Sequence
  Synthetic Polynucleotide
taatacgactcactataggggtggaaaggaaggcccatggccacctaagcaacagaggagagcttagatggccatgggcaacctggcggcagcgcaaaagatg

SEQ ID NO: 226462 - DNA, 103 bp, Artificial Sequence
  Synthetic Polynucleotide
taatacgactcactatagggattccttttagtggaaaggaaggcccatggaacagaggagaccatggatgttcctttccaacctggcggcagcgcaaaagatg

SEQ ID NO: 226463 - DNA, 103 bp, Artificial Sequence
  Synthetic Polynucleotide
taatacgactcactatagggctgttcggtaattccttttagtggaaaggaaacagaggagatcctttatgctaaaaggaaacctggcggcagcgcaaaagatg

SEQ ID NO: 226464 - DNA, 103 bp, Artificial Sequence
  Synthetic Polynucleotide
taatacgactcactatagggcttctttttgctgttcggtaattccttttaaacagaggagataaaagatgttaccgaacaacctggcggcagcgcaaaagatg

SEQ ID NO: 226465 - DNA, 103 bp, Artificial Sequence
  Synthetic Polynucleotide
taatacgactcactatagggataccaggaatggagttactcatggtaaagaacagaggagactttacatggagtaactcaacctggcggcagcgcaaaagatg

SEQ ID NO: 226466 - DNA, 103 bp, Artificial Sequence
  Synthetic Polynucleotide
taatacgactcactatagggatctcaagaccttctttttgctgttcggtaaacagaggagataccgaatggcaaaaagaaacctggcggcagcgcaaaagatg

SEQ ID NO: 226467 - DNA, 103 bp, Artificial Sequence
  Synthetic Polynucleotide
taatacgactcactatagggcattttcactatctcaagaccttctttttgaacagaggagacaaaaaatgggtcttgagaacctggcggcagcgcaaaagatg

SEQ ID NO: 226468 - DNA, 103 bp, Artificial Sequence
  Synthetic Polynucleotide
taatacgactcactatagggatatcatcaccattttcactatctcaagacaacagaggagagtcttgatgtagtgaaaaaacctggcggcagcgcaaaagatg

SEQ ID NO: 226469 - DNA, 103 bp, Artificial Sequence
  Synthetic Polynucleotide
taatacgactcactatagggccttctaaagatatcatcaccattttcactaacagaggagaagtgaaatgggtgatgataacctggcggcagcgcaaaagatg

SEQ ID NO: 226470 - DNA, 103 bp, Artificial Sequence
  Synthetic Polynucleotide
taatacgactcactatagggcccatcttcaccttctaaagatatcatcacaacagaggagagtgatgatgtctttagaaaacctggcggcagcgcaaaagatg

SEQ ID NO: 226471 - DNA, 103 bp, Artificial Sequence
  Synthetic Polynucleotide
taatacgactcactatagggtttcatccaacccatcttcaccttctaaagaacagaggagactttagatggtgaagatgaacctggcggcagcgcaaaagatg

SEQ ID NO: 226472 - DNA, 103 bp, Artificial Sequence
  Synthetic Polynucleotide
taatacgactcactatagggaatgaataaatttcatccaacccatcttcaaacagaggagatgaagaatggttggatgaaacctggcggcagcgcaaaagatg

SEQ ID NO: 226473 - DNA, 103 bp, Artificial Sequence
  Synthetic Polynucleotide
taatacgactcactatagggactctcactgaatgaataaatttcatccaaaacagaggagattggatatgatttattcaaacctggcggcagcgcaaaagatg

SEQ ID NO: 226474 - DNA, 103 bp, Artificial Sequence
  Synthetic Polynucleotide
taatacgactcactataggggttttctcagactctcactgaatgaataaaaacagaggagatttattatgtcagtgagaaacctggcggcagcgcaaaagatg

SEQ ID NO: 226475 - DNA, 103 bp, Artificial Sequence
  Synthetic Polynucleotide
taatacgactcactatagggaagacgcacagttttctcagactctcactgaacagaggagacagtgaatgtctgagaaaaacctggcggcagcgcaaaagatg

SEQ ID NO: 226476 - DNA, 103 bp, Artificial Sequence
  Synthetic Polynucleotide
taatacgactcactatagggtggggattctataccaggaatggagttactaacagaggagaagtaacatgattcctggtaacctggcggcagcgcaaaagatg

SEQ ID NO: 226477 - DNA, 103 bp, Artificial Sequence
  Synthetic Polynucleotide
taatacgactcactatagggaattttcttgaagacgcacagttttctcagaacagaggagactgagaatgctgtgcgtcaacctggcggcagcgcaaaagatg

SEQ ID NO: 226478 - DNA, 103 bp, Artificial Sequence
  Synthetic Polynucleotide
taatacgactcactatagggaatgcctctcaattttcttgaagacgcacaaacagaggagatgtgcgatgtcaagaaaaaacctggcggcagcgcaaaagatg

SEQ ID NO: 226479 - DNA, 103 bp, Artificial Sequence
  Synthetic Polynucleotide
taatacgactcactatagggcagtgaatggaatgcctctcaattttcttgaacagaggagacaagaaatgtgagaggcaaacctggcggcagcgcaaaagatg

SEQ ID NO: 226480 - DNA, 103 bp, Artificial Sequence
  Synthetic Polynucleotide
taatacgactcactatagggtcggcagggccagtgaatggaatgcctctcaacagaggagagagaggatgtccattcacaacctggcggcagcgcaaaagatg

SEQ ID NO: 226481 - DNA, 103 bp, Artificial Sequence
  Synthetic Polynucleotide
taatacgactcactatagggcaatggtcagtcggcagggccagtgaatggaacagaggagaccattcatgggccctgccaacctggcggcagcgcaaaagatg

SEQ ID NO: 226482 - DNA, 103 bp, Artificial Sequence
  Synthetic Polynucleotide
taatacgactcactatagggaaattggagccaatggtcagtcggcagggcaacagaggagagccctgatgactgaccataacctggcggcagcgcaaaagatg

SEQ ID NO: 226483 - DNA, 103 bp, Artificial Sequence
  Synthetic Polynucleotide
taatacgactcactatagggccttatagacaaattggagccaatggtcagaacagaggagactgaccatgggctccaataacctggcggcagcgcaaaagatg

SEQ ID NO: 226484 - DNA, 103 bp, Artificial Sequence
  Synthetic Polynucleotide
taatacgactcactatagggaggctgcaatccttatagacaaattggagcaacagaggagagctccaatgtgtctataaaacctggcggcagcgcaaaagatg

SEQ ID NO: 226485 - DNA, 103 bp, Artificial Sequence
  Synthetic Polynucleotide
taatacgactcactatagggatcgatttataggctgcaatccttatagacaacagaggagagtctatatggattgcagcaacctggcggcagcgcaaaagatg

SEQ ID NO: 226486 - DNA, 103 bp, Artificial Sequence
  Synthetic Polynucleotide
taatacgactcactatagggctcctgtagaatcgatttataggctgcaataacagaggagaattgcaatgtataaatcgaacctggcggcagcgcaaaagatg

SEQ ID NO: 226487 - DNA, 103 bp, Artificial Sequence
  Synthetic Polynucleotide
taatacgactcactatagggcttgttcaaatggggattctataccaggaaaacagaggagattcctgatgtagaatcccaacctggcggcagcgcaaaagatg

SEQ ID NO: 226488 - DNA, 103 bp, Artificial Sequence
  Synthetic Polynucleotide
taatacgactcactatagggttttaactctctcctgtagaatcgatttataacagaggagaataaatatgttctacaggaacctggcggcagcgcaaaagatg

SEQ ID NO: 226489 - DNA, 103 bp, Artificial Sequence
  Synthetic Polynucleotide
taatacgactcactataggggtccaagtctttttaactctctcctgtagaaacagaggagatctacaatggagagttaaaacctggcggcagcgcaaaagatg

SEQ ID NO: 226490 - DNA, 103 bp, Artificial Sequence
  Synthetic Polynucleotide
taatacgactcactatagggatccacaactgtccaagtctttttaactctaacagaggagaagagttatgaagacttggaacctggcggcagcgcaaaagatg

SEQ ID NO: 226491 - DNA, 103 bp, Artificial Sequence
  Synthetic Polynucleotide
taatacgactcactataggggggtttttgcatccacaactgtccaagtctaacagaggagaagacttatgcagttgtggaacctggcggcagcgcaaaagatg

SEQ ID NO: 226492 - DNA, 103 bp, Artificial Sequence
  Synthetic Polynucleotide
taatacgactcactatagggtctttttttagggtttttgcatccacaactaacagaggagaagttgtatgtgcaaaaacaacctggcggcagcgcaaaagatg

SEQ ID NO: 226493 - DNA, 103 bp, Artificial Sequence
  Synthetic Polynucleotide
taatacgactcactatagggttgtatatcttctttttttagggtttttgcaacagaggagagcaaaaatgctaaaaaaaaacctggcggcagcgcaaaagatg

SEQ ID NO: 226494 - DNA, 103 bp, Artificial Sequence
  Synthetic Polynucleotide
taatacgactcactatagggctgtttctttttgtatatcttctttttttaaacagaggagataaaaaatgaagatatacaacctggcggcagcgcaaaagatg

SEQ ID NO: 226495 - DNA, 103 bp, Artificial Sequence
  Synthetic Polynucleotide
taatacgactcactatagggaagcaataaactgtttctttttgtatatctaacagaggagaagatatatgaaaagaaacaacctggcggcagcgcaaaagatg

SEQ ID NO: 226496 - DNA, 103 bp, Artificial Sequence
  Synthetic Polynucleotide
taatacgactcactatagggatcatcatttaagcaataaactgtttctttaacagaggagaaaagaaatggtttattgcaacctggcggcagcgcaaaagatg

SEQ ID NO: 226497 - DNA, 103 bp, Artificial Sequence
  Synthetic Polynucleotide
taatacgactcactatagggcagtttcatcatcatcatttaagcaataaaaacagaggagatttattatgtaaatgatgaacctggcggcagcgcaaaagatg

SEQ ID NO: 226498 - DNA, 103 bp, Artificial Sequence
  Synthetic Polynucleotide
taatacgactcactatagggaccttctttgcttgttcaaatggggattctaacagaggagaagaatcatgatttgaacaaacctggcggcagcgcaaaagatg

SEQ ID NO: 226499 - DNA, 103 bp, Artificial Sequence
  Synthetic Polynucleotide
taatacgactcactatagggtttaaaacttcagtttcatcatcatcatttaacagaggagaaaatgaatgtgatgaaacaacctggcggcagcgcaaaagatg

SEQ ID NO: 226500 - DNA, 103 bp, Artificial Sequence
  Synthetic Polynucleotide
taatacgactcactatagggaatatcctcttttaaaacttcagtttcatcaacagaggagagatgaaatggaagttttaaacctggcggcagcgcaaaagatg

SEQ ID NO: 226501 - DNA, 103 bp, Artificial Sequence
  Synthetic Polynucleotide
taatacgactcactatagggacccttgaataatatcctcttttaaaacttaacagaggagaaagtttatgaagaggataaacctggcggcagcgcaaaagatg

SEQ ID NO: 226502 - DNA, 103 bp, Artificial Sequence
  Synthetic Polynucleotide
taatacgactcactatagggccatagcggaacccttgaataatatcctctaacagaggagaagaggaatgtattcaaggaacctggcggcagcgcaaaagatg

SEQ ID NO: 226503 - DNA, 103 bp, Artificial Sequence
  Synthetic Polynucleotide
taatacgactcactatagggtatatcacttccatagcggaacccttgaataacagaggagaattcaaatgttccgctataacctggcggcagcgcaaaagatg

SEQ ID NO: 226504 - DNA, 103 bp, Artificial Sequence
  Synthetic Polynucleotide
taatacgactcactatagggagaaaggaactatatcacttccatagcggaaacagaggagatccgctatggaagtgataaacctggcggcagcgcaaaagatg

SEQ ID NO: 226505 - DNA, 103 bp, Artificial Sequence
  Synthetic Polynucleotide
taatacgactcactatagggtccactttagagaaaggaactatatcacttaacagaggagaaagtgaatgagttcctttaacctggcggcagcgcaaaagatg

SEQ ID NO: 226506 - DNA, 103 bp, Artificial Sequence
  Synthetic Polynucleotide
taatacgactcactatagggttgttcctcatccactttagagaaaggaacaacagaggagagttcctatgtctaaagtgaacctggcggcagcgcaaaagatg

SEQ ID NO: 226507 - DNA, 103 bp, Artificial Sequence
  Synthetic Polynucleotide
taatacgactcactatagggtatatttcatttgttcctcatccactttagaacagaggagactaaagatgatgaggaacaacctggcggcagcgcaaaagatg

SEQ ID NO: 226508 - DNA, 103 bp, Artificial Sequence
  Synthetic Polynucleotide
taatacgactcactatagggccctccgatttatatttcatttgttcctcaaacagaggagatgaggaatgaatgaaataaacctggcggcagcgcaaaagatg

SEQ ID NO: 226509 - DNA, 103 bp, Artificial Sequence
  Synthetic Polynucleotide
taatacgactcactatagggggttttgtaatatgactcccaccctgacataacagaggagaatgtcaatgtgggagtcaaacctggcggcagcgcaaaagatg

SEQ ID NO: 226510 - DNA, 103 bp, Artificial Sequence
  Synthetic Polynucleotide
taatacgactcactatagggaaaaatcaaactatctcttcctgaatatttaacagaggagaaaatatatgggaagagataacctggcggcagcgcaaaagatg

SEQ ID NO: 226511 - DNA, 103 bp, Artificial Sequence
  Synthetic Polynucleotide
taatacgactcactatagggaaaccgttttagctcttctgtttcctctttaacagaggagaaaagagatgacagaagagaacctggcggcagcgcaaaagatg

SEQ ID NO: 226512 - DNA, 103 bp, Artificial Sequence
  Synthetic Polynucleotide
taatacgactcactatagggctggatcatcaaaccgttttagctcttctgaacagaggagacagaagatgtaaaacggtaacctggcggcagcgcaaaagatg

SEQ ID NO: 226513 - DNA, 103 bp, Artificial Sequence
  Synthetic Polynucleotide
taatacgactcactatagggagcatcaaacctggatcatcaaaccgttttaacagaggagaaaaacgatgtgatgatccaacctggcggcagcgcaaaagatg

SEQ ID NO: 226514 - DNA, 103 bp, Artificial Sequence
  Synthetic Polynucleotide
taatacgactcactataggggaaacccatgagcatcaaacctggatcatcaacagaggagagatgatatgggtttgatgaacctggcggcagcgcaaaagatg

SEQ ID NO: 226515 - DNA, 103 bp, Artificial Sequence
  Synthetic Polynucleotide
taatacgactcactatagggccaacggcttgaaacccatgagcatcaaacaacagaggagagtttgaatgtcatgggttaacctggcggcagcgcaaaagatg

SEQ ID NO: 226516 - DNA, 103 bp, Artificial Sequence
  Synthetic Polynucleotide
taatacgactcactatagggttcagcagtaccaacggcttgaaacccatgaacagaggagacatgggatgcaagccgttaacctggcggcagcgcaaaagatg

SEQ ID NO: 226517 - DNA, 103 bp, Artificial Sequence
  Synthetic Polynucleotide
taatacgactcactatagggatggtgtttcttcagcagtaccaacggcttaacagaggagaaagccgatggtactgctgaacctggcggcagcgcaaaagatg

SEQ ID NO: 226518 - DNA, 103 bp, Artificial Sequence
  Synthetic Polynucleotide
taatacgactcactataggggcctcaggtaatggtgtttcttcagcagtaaacagaggagatactgcatgagaaacaccaacctggcggcagcgcaaaagatg

SEQ ID NO: 226519 - DNA, 103 bp, Artificial Sequence
  Synthetic Polynucleotide
taatacgactcactatagggaacagggagggcctcaggtaatggtgtttcaacagaggagagaaacaatgttacctgagaacctggcggcagcgcaaaagatg

SEQ ID NO: 226520 - DNA, 103 bp, Artificial Sequence
  Synthetic Polynucleotide
taatacgactcactatagggtgggtacacgaacagggagggcctcaggtaaacagaggagatacctgatgccctccctgaacctggcggcagcgcaaaagatg

SEQ ID NO: 226521 - DNA, 103 bp, Artificial Sequence
  Synthetic Polynucleotide
taatacgactcactatagggcatcaaccaaaaaaatcaaactatctcttcaacagaggagagaagagatggtttgatttaacctggcggcagcgcaaaagatg

SEQ ID NO: 226522 - DNA, 103 bp, Artificial Sequence
  Synthetic Polynucleotide
taatacgactcactataggggcgactcctctgggtacacgaacagggaggaacagaggagacctcccatgtcgtgtaccaacctggcggcagcgcaaaagatg

SEQ ID NO: 226523 - DNA, 103 bp, Artificial Sequence
  Synthetic Polynucleotide
taatacgactcactatagggccaatcaccagcgactcctctgggtacacgaacagaggagacgtgtaatgagaggagtcaacctggcggcagcgcaaaagatg

SEQ ID NO: 226524 - DNA, 103 bp, Artificial Sequence
  Synthetic Polynucleotide
taatacgactcactatagggggttgagctcccaatcaccagcgactcctcaacagaggagagaggagatgctggtgattaacctggcggcagcgcaaaagatg

SEQ ID NO: 226525 - DNA, 103 bp, Artificial Sequence
  Synthetic Polynucleotide
taatacgactcactatagggcactgaacagggttgagctcccaatcaccaaacagaggagatggtgaatgggagctcaaaacctggcggcagcgcaaaagatg

SEQ ID NO: 226526 - DNA, 103 bp, Artificial Sequence
  Synthetic Polynucleotide
taatacgactcactatagggatgagcagagcactgaacagggttgagctcaacagaggagagagctcatgcctgttcagaacctggcggcagcgcaaaagatg

SEQ ID NO: 226527 - DNA, 103 bp, Artificial Sequence
  Synthetic Polynucleotide
taatacgactcactatagggcagacacttgatgagcagagcactgaacagaacagaggagactgttcatggctctgctcaacctggcggcagcgcaaaagatg

SEQ ID NO: 226528 - DNA, 103 bp, Artificial Sequence
  Synthetic Polynucleotide
taatacgactcactatagggcctccttctccagacacttgatgagcagagaacagaggagactctgcatgtcaagtgtcaacctggcggcagcgcaaaagatg

SEQ ID NO: 226529 - DNA, 103 bp, Artificial Sequence
  Synthetic Polynucleotide
taatacgactcactatagggaatgctgcaacctccttctccagacacttgaacagaggagacaagtgatgggagaaggaaacctggcggcagcgcaaaagatg

SEQ ID NO: 226530 - DNA, 103 bp, Artificial Sequence
  Synthetic Polynucleotide
taatacgactcactataggggtatctgcacaatgctgcaacctccttctcaacagaggagagagaagatggttgcagcaaacctggcggcagcgcaaaagatg

SEQ ID NO: 226531 - DNA, 103 bp, Artificial Sequence
  Synthetic Polynucleotide
taatacgactcactatagggtgcggggtgtgtatctgcacaatgctgcaaaacagaggagattgcagatgtgtgcagataacctggcggcagcgcaaaagatg

SEQ ID NO: 226532 - DNA, 103 bp, Artificial Sequence
  Synthetic Polynucleotide
taatacgactcactataggggccttggaggcatcaaccaaaaaaatcaaaaacagaggagatttgatatgtttggttgaaacctggcggcagcgcaaaagatg

SEQ ID NO: 226533 - DNA, 103 bp, Artificial Sequence
  Synthetic Polynucleotide
taatacgactcactataggggggatgttcctgcggggtgtgtatctgcacaacagaggagagtgcagatgcacaccccgaacctggcggcagcgcaaaagatg

SEQ ID NO: 226534 - DNA, 103 bp, Artificial Sequence
  Synthetic Polynucleotide
taatacgactcactatagggaaaataaggagggatgttcctgcggggtgtaacagaggagaacacccatgaggaacatcaacctggcggcagcgcaaaagatg

SEQ ID NO: 226535 - DNA, 103 bp, Artificial Sequence
  Synthetic Polynucleotide
taatacgactcactatagggccaaagccacaaaataaggagggatgttccaacagaggagaggaacaatgctccttattaacctggcggcagcgcaaaagatg

SEQ ID NO: 226536 - DNA, 103 bp, Artificial Sequence
  Synthetic Polynucleotide
taatacgactcactatagggtcctgtggcaccaaagccacaaaataaggaaacagaggagatccttaatgtgtggctttaacctggcggcagcgcaaaagatg

SEQ ID NO: 226537 - DNA, 103 bp, Artificial Sequence
  Synthetic Polynucleotide
taatacgactcactatagggcaactcttcttcctgtggcaccaaagccacaacagaggagagtggctatggtgccacagaacctggcggcagcgcaaaagatg

SEQ ID NO: 226538 - DNA, 103 bp, Artificial Sequence
  Synthetic Polynucleotide
taatacgactcactatagggtctggtcatccaactcttcttcctgtggcaaacagaggagatgccacatgaagaagagtaacctggcggcagcgcaaaagatg

SEQ ID NO: 226539 - DNA, 103 bp, Artificial Sequence
  Synthetic Polynucleotide
taatacgactcactatagggacctgaattttctggtcatccaactcttctaacagaggagaagaagaatgggatgaccaaacctggcggcagcgcaaaagatg

SEQ ID NO: 226540 - DNA, 103 bp, Artificial Sequence
  Synthetic Polynucleotide
taatacgactcactatagggtggaggagtcacctgaattttctggtcatcaacagaggagagatgacatgaaaattcagaacctggcggcagcgcaaaagatg

SEQ ID NO: 226541 - DNA, 103 bp, Artificial Sequence
  Synthetic Polynucleotide
taatacgactcactataggggctggaagcctggaggagtcacctgaatttaacagaggagaaaattcatgtgactcctcaacctggcggcagcgcaaaagatg

SEQ ID NO: 226542 - DNA, 103 bp, Artificial Sequence
  Synthetic Polynucleotide
taatacgactcactatagggaaaaagaccagctggaagcctggaggagtcaacagaggagagactccatgaggcttccaaacctggcggcagcgcaaaagatg

SEQ ID NO: 226543 - DNA, 103 bp, Artificial Sequence
  Synthetic Polynucleotide
taatacgactcactatagggttcaaacatagccttggaggcatcaaccaaaacagaggagattggttatggcctccaagaacctggcggcagcgcaaaagatg

SEQ ID NO: 226544 - DNA, 103 bp, Artificial Sequence
  Synthetic Polynucleotide
taatacgactcactatagggagcaaagggtaaaaagaccagctggaagccaacagaggagaggcttcatgctggtctttaacctggcggcagcgcaaaagatg

SEQ ID NO: 226545 - DNA, 103 bp, Artificial Sequence
  Synthetic Polynucleotide
taatacgactcactatagggttttatcatcagcaaagggtaaaaagaccaaacagaggagatggtctatgtaccctttgaacctggcggcagcgcaaaagatg

SEQ ID NO: 226546 - DNA, 103 bp, Artificial Sequence
  Synthetic Polynucleotide
taatacgactcactatagggggcatcttccttttatcatcagcaaagggtaacagaggagaacccttatgtgatgataaaacctggcggcagcgcaaaagatg

SEQ ID NO: 226547 - DNA, 103 bp, Artificial Sequence
  Synthetic Polynucleotide
taatacgactcactatagggttcagtaaagggcatcttccttttatcatcaacagaggagagatgatatgaggaagatgaacctggcggcagcgcaaaagatg

SEQ ID NO: 226548 - DNA, 103 bp, Artificial Sequence
  Synthetic Polynucleotide
taatacgactcactatagggccatgattttttcagtaaagggcatcttccaacagaggagaggaagaatgcctttactgaacctggcggcagcgcaaaagatg

SEQ ID NO: 226549 - DNA, 103 bp, Artificial Sequence
  Synthetic Polynucleotide
taatacgactcactatagggtctggagttgccatgattttttcagtaaagaacagaggagactttacatgaaaaatcataacctggcggcagcgcaaaagatg

SEQ ID NO: 226550 - DNA, 103 bp, Artificial Sequence
  Synthetic Polynucleotide
taatacgactcactataggggcccacctgctctggagttgccatgattttaacagaggagaaaaatcatggcaactccaaacctggcggcagcgcaaaagatg

SEQ ID NO: 226551 - DNA, 103 bp, Artificial Sequence
  Synthetic Polynucleotide
taatacgactcactatagggccttcatcttgcccacctgctctggagttgaacagaggagacaactcatgagcaggtggaacctggcggcagcgcaaaagatg

SEQ ID NO: 226552 - DNA, 103 bp, Artificial Sequence
  Synthetic Polynucleotide
taatacgactcactatagggtcaacgatagccttcatcttgcccacctgcaacagaggagagcaggtatgcaagatgaaaacctggcggcagcgcaaaagatg

SEQ ID NO: 226553 - DNA, 103 bp, Artificial Sequence
  Synthetic Polynucleotide
taatacgactcactataggggcgaagcttctcaacgatagccttcatcttaacagaggagaaagatgatggctatcgttaacctggcggcagcgcaaaagatg

SEQ ID NO: 226554 - DNA, 103 bp, Artificial Sequence
  Synthetic Polynucleotide
taatacgactcactatagggcactctgagattcaaacatagccttggaggaacagaggagacctccaatgctatgtttgaacctggcggcagcgcaaaagatg

SEQ ID NO: 226555 - DNA, 103 bp, Artificial Sequence
  Synthetic Polynucleotide
taatacgactcactatagggtgtatgtgaagcgaagcttctcaacgatagaacagaggagactatcgatgagaagcttcaacctggcggcagcgcaaaagatg

SEQ ID NO: 226556 - DNA, 103 bp, Artificial Sequence
  Synthetic Polynucleotide
taatacgactcactatagggctgtcacttctgtatgtgaagcgaagcttcaacagaggagagaagctatgcttcacataaacctggcggcagcgcaaaagatg

SEQ ID NO: 226557 - DNA, 103 bp, Artificial Sequence
  Synthetic Polynucleotide
taatacgactcactataggggttctcaaagctgtcacttctgtatgtgaaaacagaggagattcacaatgagaagtgacaacctggcggcagcgcaaaagatg

SEQ ID NO: 226558 - DNA, 103 bp, Artificial Sequence
  Synthetic Polynucleotide
taatacgactcactataggggcagcacggggttctcaaagctgtcacttcaacagaggagagaagtgatggctttgagaaacctggcggcagcgcaaaagatg

SEQ ID NO: 226559 - DNA, 103 bp, Artificial Sequence
  Synthetic Polynucleotide
taatacgactcactatagggaagtgctgctgcagcacggggttctcaaagaacagaggagactttgaatgccccgtgctaacctggcggcagcgcaaaagatg

SEQ ID NO: 226560 - DNA, 103 bp, Artificial Sequence
  Synthetic Polynucleotide
taatacgactcactatagggcaggttcctgaagtgctgctgcagcacgggaacagaggagacccgtgatgcagcagcacaacctggcggcagcgcaaaagatg

SEQ ID NO: 226561 - DNA, 103 bp, Artificial Sequence
  Synthetic Polynucleotide
taatacgactcactatagggccaaggcctccaggttcctgaagtgctgctaacagaggagaagcagcatgtcaggaaccaacctggcggcagcgcaaaagatg

SEQ ID NO: 226562 - DNA, 103 bp, Artificial Sequence
  Synthetic Polynucleotide
taatacgactcactatagggaaatccaaggccaaggcctccaggttcctgaacagaggagacaggaaatgggaggccttaacctggcggcagcgcaaaagatg

SEQ ID NO: 226563 - DNA, 103 bp, Artificial Sequence
  Synthetic Polynucleotide
taatacgactcactatagggcggctccatcaaatccaaggccaaggcctcaacagaggagagaggccatggccttggataacctggcggcagcgcaaaagatg

SEQ ID NO: 226564 - DNA, 103 bp, Artificial Sequence
  Synthetic Polynucleotide
taatacgactcactatagggctgcttgttccggctccatcaaatccaaggaacagaggagaccttggatgtgatggagcaacctggcggcagcgcaaaagatg

SEQ ID NO: 226565 - DNA, 103 bp, Artificial Sequence
  Synthetic Polynucleotide
taatacgactcactatagggaactcatcttcactctgagattcaaacataaacagaggagatatgttatgatctcagagaacctggcggcagcgcaaaagatg

SEQ ID NO: 226566 - DNA, 103 bp, Artificial Sequence
  Synthetic Polynucleotide
taatacgactcactataggggtcaggtccactgcttgttccggctccatcaacagaggagagatggaatgggaacaagcaacctggcggcagcgcaaaagatg

SEQ ID NO: 226567 - DNA, 103 bp, Artificial Sequence
  Synthetic Polynucleotide
taatacgactcactatagggcttgggcaatgtcaggtccactgcttgttcaacagaggagagaacaaatggtggacctgaacctggcggcagcgcaaaagatg

SEQ ID NO: 226568 - DNA, 103 bp, Artificial Sequence
  Synthetic Polynucleotide
taatacgactcactatagggttgcttcaaccttgggcaatgtcaggtccaaacagaggagatggaccatgcattgcccaaacctggcggcagcgcaaaagatg

SEQ ID NO: 226569 - DNA, 103 bp, Artificial Sequence
  Synthetic Polynucleotide
taatacgactcactatagggcttttattcattgcttcaaccttgggcaataacagaggagaattgccatgggttgaagcaacctggcggcagcgcaaaagatg

SEQ ID NO: 226570 - DNA, 103 bp, Artificial Sequence
  Synthetic Polynucleotide
taatacgactcactatagggggagcccagtcttttattcattgcttcaacaacagaggagagttgaaatgatgaataaaaacctggcggcagcgcaaaagatg

SEQ ID NO: 226571 - DNA, 103 bp, Artificial Sequence
  Synthetic Polynucleotide
taatacgactcactatagggcatccaccaaggagcccagtcttttattcaaacagaggagatgaataatggactgggctaacctggcggcagcgcaaaagatg

SEQ ID NO: 226572 - DNA, 103 bp, Artificial Sequence
  Synthetic Polynucleotide
taatacgactcactatagggtccttaaactcatccaccaaggagcccagtaacagaggagaactgggatgcttggtggaaacctggcggcagcgcaaaagatg

SEQ ID NO: 226573 - DNA, 103 bp, Artificial Sequence
  Synthetic Polynucleotide
taatacgactcactataggggtaaacaagctccttaaactcatccaccaaaacagaggagattggtgatggagtttaagaacctggcggcagcgcaaaagatg

SEQ ID NO: 226574 - DNA, 103 bp, Artificial Sequence
  Synthetic Polynucleotide
taatacgactcactatagggaatctggtgggtaaacaagctccttaaactaacagaggagaagtttaatgagcttgtttaacctggcggcagcgcaaaagatg

SEQ ID NO: 226575 - DNA, 103 bp, Artificial Sequence
  Synthetic Polynucleotide
taatacgactcactatagggtcaggattgtaatctggtgggtaaacaagcaacagaggagagcttgtatgcccaccagaaacctggcggcagcgcaaaagatg

SEQ ID NO: 226576 - DNA, 103 bp, Artificial Sequence
  Synthetic Polynucleotide
taatacgactcactatagggaaaaggtgtcaactcatcttcactctgagaaacagaggagatctcagatggaagatgagaacctggcggcagcgcaaaagatg

SEQ ID NO: 226577 - DNA, 103 bp, Artificial Sequence
  Synthetic Polynucleotide
taatacgactcactatagggaactttcccttcaggattgtaatctggtggaacagaggagaccaccaatgtacaatcctaacctggcggcagcgcaaaagatg

SEQ ID NO: 226578 - DNA, 103 bp, Artificial Sequence
  Synthetic Polynucleotide
taatacgactcactatagggttctcttggtaactttcccttcaggattgtaacagaggagaacaatcatgaagggaaagaacctggcggcagcgcaaaagatg

SEQ ID NO: 226579 - DNA, 103 bp, Artificial Sequence
  Synthetic Polynucleotide
taatacgactcactatagggttatcgtgttttctcttggtaactttccctaacagaggagaagggaaatgtaccaagagaacctggcggcagcgcaaaagatg

SEQ ID NO: 226580 - DNA, 103 bp, Artificial Sequence
  Synthetic Polynucleotide
taatacgactcactatagggagaaccttcattatcgtgttttctcttggtaacagaggagaaccaagatgaaacacgataacctggcggcagcgcaaaagatg

SEQ ID NO: 226581 - DNA, 103 bp, Artificial Sequence
  Synthetic Polynucleotide
taatacgactcactatagggttttgcttccagaaccttcattatcgtgttaacagaggagaaacacgatgatgaaggttaacctggcggcagcgcaaaagatg

SEQ ID NO: 226582 - DNA, 103 bp, Artificial Sequence
  Synthetic Polynucleotide
taatacgactcactatagggaccttgggccttttgcttccagaaccttcaaacagaggagatgaaggatgtggaagcaaaacctggcggcagcgcaaaagatg

SEQ ID NO: 226583 - DNA, 103 bp, Artificial Sequence
  Synthetic Polynucleotide
taatacgactcactatagggtgaatactccaccttgggccttttgcttccaacagaggagaggaagcatgaggcccaagaacctggcggcagcgcaaaagatg

SEQ ID NO: 226584 - DNA, 103 bp, Artificial Sequence
  Synthetic Polynucleotide
taatacgactcactataggggctcctcttctgaatactccaccttgggccaacagaggagaggcccaatgtggagtattaacctggcggcagcgcaaaagatg

SEQ ID NO: 226585 - DNA, 103 bp, Artificial Sequence
  Synthetic Polynucleotide
taatacgactcactatagggtgggtcttcagctcctcttctgaatactccaacagaggagaggagtaatgagaagaggaaacctggcggcagcgcaaaagatg

SEQ ID NO: 226586 - DNA, 103 bp, Artificial Sequence
  Synthetic Polynucleotide
taatacgactcactatagggcttgctgatgtgggtcttcagctcctcttcaacagaggagagaagagatgctgaagaccaacctggcggcagcgcaaaagatg

SEQ ID NO: 226587 - DNA, 103 bp, Artificial Sequence
  Synthetic Polynucleotide
taatacgactcactatagggtgctcatgtcaaaaggtgtcaactcatcttaacagaggagaaagatgatgtgacaccttaacctggcggcagcgcaaaagatg

SEQ ID NO: 226588 - DNA, 103 bp, Artificial Sequence
  Synthetic Polynucleotide
taatacgactcactatagggccagcgtacccttgctgatgtgggtcttcaaacagaggagatgaagaatgacatcagcaaacctggcggcagcgcaaaagatg

SEQ ID NO: 226589 - DNA, 103 bp, Artificial Sequence
  Synthetic Polynucleotide
taatacgactcactataggggtgaacttgcccagcgtacccttgctgatgaacagaggagacatcagatggggtacgctaacctggcggcagcgcaaaagatg

SEQ ID NO: 226590 - DNA, 103 bp, Artificial Sequence
  Synthetic Polynucleotide
taatacgactcactatagggcatgggcacagtgaacttgcccagcgtaccaacagaggagaggtacgatgggcaagttcaacctggcggcagcgcaaaagatg

SEQ ID NO: 226591 - DNA, 103 bp, Artificial Sequence
  Synthetic Polynucleotide
taatacgactcactatagggcctctttcagcatgggcacagtgaacttgcaacagaggagagcaagtatgctgtgcccaaacctggcggcagcgcaaaagatg

SEQ ID NO: 226592 - DNA, 103 bp, Artificial Sequence
  Synthetic Polynucleotide
taatacgactcactataggggcccggcaggcctctttcagcatgggcacaaacagaggagatgtgccatggctgaaagaaacctggcggcagcgcaaaagatg

SEQ ID NO: 226593 - DNA, 103 bp, Artificial Sequence
  Synthetic Polynucleotide
taatacgactcactatagggcagcccgtaagcccggcaggcctctttcagaacagaggagactgaaaatggcctgccggaacctggcggcagcgcaaaagatg

SEQ ID NO: 226594 - DNA, 103 bp, Artificial Sequence
  Synthetic Polynucleotide
taatacgactcactataggggcccactcttcagcccgtaagcccggcaggaacagaggagacctgccatgcttacgggcaacctggcggcagcgcaaaagatg

SEQ ID NO: 226595 - DNA, 103 bp, Artificial Sequence
  Synthetic Polynucleotide
taatacgactcactatagggtgcttcttcagcccactcttcagcccgtaaaacagaggagattacggatggaagagtggaacctggcggcagcgcaaaagatg

SEQ ID NO: 226596 - DNA, 103 bp, Artificial Sequence
  Synthetic Polynucleotide
taatacgactcactatagggcagcagctcctgcttcttcagcccactcttaacagaggagaaagagtatgctgaagaagaacctggcggcagcgcaaaagatg

SEQ ID NO: 226597 - DNA, 103 bp, Artificial Sequence
  Synthetic Polynucleotide
taatacgactcactatagggtgagggcttccagcagctcctgcttcttcaaacagaggagatgaagaatgaggagctgcaacctggcggcagcgcaaaagatg

SEQ ID NO: 226598 - DNA, 103 bp, Artificial Sequence
  Synthetic Polynucleotide
taatacgactcactatagggatacactggatgctcatgtcaaaaggtgtcaacagaggagagacaccatgtgacatgagaacctggcggcagcgcaaaagatg

SEQ ID NO: 226599 - DNA, 103 bp, Artificial Sequence
  Synthetic Polynucleotide
taatacgactcactatagggaagtgcttggtgagggcttccagcagctccaacagaggagaggagctatgggaagccctaacctggcggcagcgcaaaagatg

SEQ ID NO: 226600 - DNA, 103 bp, Artificial Sequence
  Synthetic Polynucleotide
taatacgactcactatagggtcagtcctggaagtgcttggtgagggcttcaacagaggagagaagccatgaccaagcacaacctggcggcagcgcaaaagatg

SEQ ID NO: 226601 - DNA, 103 bp, Artificial Sequence
  Synthetic Polynucleotide
taatacgactcactatagggcacactttggatacactggatgctcatgtcaacagaggagagacatgatgatccagtgtaacctggcggcagcgcaaaagatg

SEQ ID NO: 226602 - DNA, 103 bp, Artificial Sequence
  Synthetic Polynucleotide
taatacgactcactatagggcatcgccctcggttttgtaatatgactcccaacagaggagagggagtatgattacaaaaaacctggcggcagcgcaaaagatg

SEQ ID NO: 226603 - DNA, 103 bp, Artificial Sequence
  Synthetic Polynucleotide
taatacgactcactatagggtactgatgtacacactttggatacactggaaacagaggagatccagtatgtccaaagtgaacctggcggcagcgcaaaagatg

SEQ ID NO: 226604 - DNA, 103 bp, Artificial Sequence
  Synthetic Polynucleotide
taatacgactcactatagggcttatgatcttactgatgtacacactttggaacagaggagaccaaagatggtacatcagaacctggcggcagcgcaaaagatg

SEQ ID NO: 226605 - DNA, 103 bp, Artificial Sequence
  Synthetic Polynucleotide
taatacgactcactatagggtcgatcactgcttatgatcttactgatgtaaacagaggagatacatcatgaagatcataaacctggcggcagcgcaaaagatg

SEQ ID NO: 226606 - DNA, 103 bp, Artificial Sequence
  Synthetic Polynucleotide
taatacgactcactatagggccaagagatctcgatcactgcttatgatctaacagaggagaagatcaatggcagtgatcaacctggcggcagcgcaaaagatg

SEQ ID NO: 226607 - DNA, 103 bp, Artificial Sequence
  Synthetic Polynucleotide
taatacgactcactatagggaacaccacagccaagagatctcgatcactgaacagaggagacagtgaatgagatctcttaacctggcggcagcgcaaaagatg

SEQ ID NO: 226608 - DNA, 103 bp, Artificial Sequence
  Synthetic Polynucleotide
taatacgactcactatagggggtaccatagaacaccacagccaagagatcaacagaggagagatctcatggctgtggtgaacctggcggcagcgcaaaagatg

SEQ ID NO: 226609 - DNA, 103 bp, Artificial Sequence
  Synthetic Polynucleotide
taatacgactcactatagggtgtctttctcggtaccatagaacaccacagaacagaggagactgtggatgtctatggtaaacctggcggcagcgcaaaagatg

SEQ ID NO: 226610 - DNA, 103 bp, Artificial Sequence
  Synthetic Polynucleotide
taatacgactcactatagggactgaatttttgtctttctcggtaccatagaacagaggagactatggatgcgagaaagaaacctggcggcagcgcaaaagatg

SEQ ID NO: 226611 - DNA, 103 bp, Artificial Sequence
  Synthetic Polynucleotide
taatacgactcactatagggtttaaaattcactgaatttttgtctttctcaacagaggagagagaaaatgaaaaattcaaacctggcggcagcgcaaaagatg

SEQ ID NO: 226612 - DNA, 103 bp, Artificial Sequence
  Synthetic Polynucleotide
taatacgactcactatagggcgtaaatatttttaaaattcactgaattttaacagaggagaaaaattatgtgaattttaaacctggcggcagcgcaaaagatg

SEQ ID NO: 226613 - DNA, 103 bp, Artificial Sequence
  Synthetic Polynucleotide
taatacgactcactatagggtctgcttcttcatcgccctcggttttgtaaaacagaggagattacaaatgcgagggcgaaacctggcggcagcgcaaaagatg

SEQ ID NO: 226614 - DNA, 103 bp, Artificial Sequence
  Synthetic Polynucleotide
taatacgactcactatagggtcctgtaagacgtaaatatttttaaaattcaacagaggagagaatttatgaaatatttaaacctggcggcagcgcaaaagatg

SEQ ID NO: 226615 - DNA, 103 bp, Artificial Sequence
  Synthetic Polynucleotide
taatacgactcactatagggattatccagctcctgtaagacgtaaatattaacagaggagaaatattatggtcttacagaacctggcggcagcgcaaaagatg

SEQ ID NO: 226616 - DNA, 103 bp, Artificial Sequence
  Synthetic Polynucleotide
taatacgactcactatagggttgcacctggattatccagctcctgtaagaaacagaggagatcttacatgagctggataaacctggcggcagcgcaaaagatg

SEQ ID NO: 226617 - DNA, 103 bp, Artificial Sequence
  Synthetic Polynucleotide
taatacgactcactatagggagaattcgttttgcacctggattatccagcaacagaggagagctggaatgtccaggtgcaacctggcggcagcgcaaaagatg

SEQ ID NO: 226618 - DNA, 103 bp, Artificial Sequence
  Synthetic Polynucleotide
taatacgactcactataggggtcaagctctagaattcgttttgcacctggaacagaggagaccaggtatgaaacgaattaacctggcggcagcgcaaaagatg

SEQ ID NO: 226619 - DNA, 103 bp, Artificial Sequence
  Synthetic Polynucleotide
taatacgactcactatagggccttaaactggtcaagctctagaattcgttaacagaggagaaacgaaatgtagagcttgaacctggcggcagcgcaaaagatg

SEQ ID NO: 226620 - DNA, 103 bp, Artificial Sequence
  Synthetic Polynucleotide
taatacgactcactatagggccctgctgccccttaaactggtcaagctctaacagaggagaagagctatgccagtttaaaacctggcggcagcgcaaaagatg

SEQ ID NO: 226621 - DNA, 103 bp, Artificial Sequence
  Synthetic Polynucleotide
taatacgactcactatagggacgtttttgtccctgctgccccttaaactgaacagaggagacagtttatggggcagcagaacctggcggcagcgcaaaagatg

SEQ ID NO: 226622 - DNA, 103 bp, Artificial Sequence
  Synthetic Polynucleotide
taatacgactcactatagggtgtcttggaaacgtttttgtccctgctgccaacagaggagaggcagcatggacaaaaacaacctggcggcagcgcaaaagatg

SEQ ID NO: 226623 - DNA, 103 bp, Artificial Sequence
  Synthetic Polynucleotide
taatacgactcactatagggtggcccatcatgtcttggaaacgtttttgtaacagaggagaacaaaaatgtttccaagaaacctggcggcagcgcaaaagatg

SEQ ID NO: 226624 - DNA, 103 bp, Artificial Sequence
  Synthetic Polynucleotide
taatacgactcactatagggttgttcttcctctgcttcttcatcgccctcaacagaggagagagggcatggaagaagcaaacctggcggcagcgcaaaagatg

SEQ ID NO: 226625 - DNA, 103 bp, Artificial Sequence
  Synthetic Polynucleotide
taatacgactcactataggggtcagatccgtggcccatcatgtcttggaaaacagaggagattccaaatgatgatgggcaacctggcggcagcgcaaaagatg

SEQ ID NO: 226626 - DNA, 103 bp, Artificial Sequence
  Synthetic Polynucleotide
taatacgactcactatagggtgagtgagtagtcagatccgtggcccatcaaacagaggagatgatggatgacggatctgaacctggcggcagcgcaaaagatg

SEQ ID NO: 226627 - DNA, 103 bp, Artificial Sequence
  Synthetic Polynucleotide
taatacgactcactatagggagcacttcactgagtgagtagtcagatccgaacagaggagacggatcatgctactcactaacctggcggcagcgcaaaagatg

SEQ ID NO: 226628 - DNA, 103 bp, Artificial Sequence
  Synthetic Polynucleotide
taatacgactcactatagggacagacccacagcacttcactgagtgagtaaacagaggagatactcaatgagtgaagtgaacctggcggcagcgcaaaagatg

SEQ ID NO: 226629 - DNA, 103 bp, Artificial Sequence
  Synthetic Polynucleotide
taatacgactcactatagggagaggttggcacagacccacagcacttcacaacagaggagagtgaagatgtgtgggtctaacctggcggcagcgcaaaagatg

SEQ ID NO: 226630 - DNA, 103 bp, Artificial Sequence
  Synthetic Polynucleotide
taatacgactcactatagggacatcactaaagaggttggcacagacccacaacagaggagagtgggtatgtgccaacctaacctggcggcagcgcaaaagatg

SEQ ID NO: 226631 - DNA, 103 bp, Artificial Sequence
  Synthetic Polynucleotide
taatacgactcactatagggcttgaattggacatcactaaagaggttggcaacagaggagagccaacatgtttagtgataacctggcggcagcgcaaaagatg

SEQ ID NO: 226632 - DNA, 103 bp, Artificial Sequence
  Synthetic Polynucleotide
taatacgactcactatagggtatgactcatcttgaattggacatcactaaaacagaggagattagtgatgtccaattcaaacctggcggcagcgcaaaagatg

SEQ ID NO: 226633 - DNA, 103 bp, Artificial Sequence
  Synthetic Polynucleotide
taatacgactcactatagggatgatcctcttatgactcatcttgaattggaacagaggagaccaattatggatgagtcaaacctggcggcagcgcaaaagatg

SEQ ID NO: 226634 - DNA, 103 bp, Artificial Sequence
  Synthetic Polynucleotide
taatacgactcactatagggggtgaacagcatgatcctcttatgactcataacagaggagaatgagtatgaagaggatcaacctggcggcagcgcaaaagatg

SEQ ID NO: 226635 - DNA, 103 bp, Artificial Sequence
  Synthetic Polynucleotide
taatacgactcactatagggggttctcttcttgttcttcctctgcttcttaacagaggagaaagaagatgaggaagaacaacctggcggcagcgcaaaagatg

SEQ ID NO: 226636 - DNA, 103 bp, Artificial Sequence
  Synthetic Polynucleotide
taatacgactcactatagggtgtcttcattggtgaacagcatgatcctctaacagaggagaagaggaatgtgctgttcaaacctggcggcagcgcaaaagatg

SEQ ID NO: 226637 - DNA, 103 bp, Artificial Sequence
  Synthetic Polynucleotide
taatacgactcactatagggccatgggggttgtcttcattggtgaacagcaacagaggagagctgttatgcaatgaagaaacctggcggcagcgcaaaagatg

SEQ ID NO: 226638 - DNA, 103 bp, Artificial Sequence
  Synthetic Polynucleotide
taatacgactcactatagggactgtcattgccatgggggttgtcttcattaacagaggagaaatgaaatgaacccccataacctggcggcagcgcaaaagatg

SEQ ID NO: 226639 - DNA, 103 bp, Artificial Sequence
  Synthetic Polynucleotide
taatacgactcactatagggtggctttggcactgtcattgccatgggggtaacagaggagaacccccatggcaatgacaaacctggcggcagcgcaaaagatg

SEQ ID NO: 226640 - DNA, 103 bp, Artificial Sequence
  Synthetic Polynucleotide
taatacgactcactatagggctggcccggctggctttggcactgtcattgaacagaggagacaatgaatgtgccaaagcaacctggcggcagcgcaaaagatg

SEQ ID NO: 226641 - DNA, 103 bp, Artificial Sequence
  Synthetic Polynucleotide
taatacgactcactatagggggctttggtcctggcccggctggctttggcaacagaggagagccaaaatgagccgggccaacctggcggcagcgcaaaagatg

SEQ ID NO: 226642 - DNA, 103 bp, Artificial Sequence
  Synthetic Polynucleotide
taatacgactcactatagggggagatcaccggctttggtcctggcccggcaacagaggagagccgggatgggaccaaagaacctggcggcagcgcaaaagatg

SEQ ID NO: 226643 - DNA, 103 bp, Artificial Sequence
  Synthetic Polynucleotide
taatacgactcactatagggcctgtatctcggagatcaccggctttggtcaacagaggagagaccaaatgcggtgatctaacctggcggcagcgcaaaagatg

SEQ ID NO: 226644 - DNA, 103 bp, Artificial Sequence
  Synthetic Polynucleotide
taatacgactcactatagggaaggaagatgcctgtatctcggagatcaccaacagaggagaggtgatatgcgagatacaaacctggcggcagcgcaaaagatg

SEQ ID NO: 226645 - DNA, 103 bp, Artificial Sequence
  Synthetic Polynucleotide
taatacgactcactataggggcatcaagtcaaggaagatgcctgtatctcaacagaggagagagataatggcatcttccaacctggcggcagcgcaaaagatg

SEQ ID NO: 226646 - DNA, 103 bp, Artificial Sequence
  Synthetic Polynucleotide
taatacgactcactatagggcttgcttcaaggttctcttcttgttcttccaacagaggagaggaagaatgagaagagaaaacctggcggcagcgcaaaagatg

SEQ ID NO: 226647 - DNA, 103 bp, Artificial Sequence
  Synthetic Polynucleotide
taatacgactcactatagggttcttcaggtgcatcaagtcaaggaagatgaacagaggagacatcttatgtgacttgataacctggcggcagcgcaaaagatg

SEQ ID NO: 226648 - DNA, 103 bp, Artificial Sequence
  Synthetic Polynucleotide
taatacgactcactataggggcccccaggtttcttcaggtgcatcaagtcaacagaggagagacttgatgcacctgaagaacctggcggcagcgcaaaagatg

SEQ ID NO: 226649 - DNA, 103 bp, Artificial Sequence
  Synthetic Polynucleotide
taatacgactcactatagggatatgtcaaagcccccaggtttcttcaggtaacagaggagaacctgaatgaacctggggaacctggcggcagcgcaaaagatg

SEQ ID NO: 226650 - DNA, 103 bp, Artificial Sequence
  Synthetic Polynucleotide
taatacgactcactatagggtagaacaaggatatgtcaaagcccccaggtaacagaggagaacctggatgctttgacataacctggcggcagcgcaaaagatg

SEQ ID NO: 226651 - DNA, 103 bp, Artificial Sequence
  Synthetic Polynucleotide
taatacgactcactataggggatatctctgtagaacaaggatatgtcaaaaacagaggagatttgacatgtccttgttcaacctggcggcagcgcaaaagatg

SEQ ID NO: 226652 - DNA, 103 bp, Artificial Sequence
  Synthetic Polynucleotide
taatacgactcactatagggctatgctgatgatatctctgtagaacaaggaacagaggagaccttgtatgacagagataaacctggcggcagcgcaaaagatg

SEQ ID NO: 226653 - DNA, 103 bp, Artificial Sequence
  Synthetic Polynucleotide
taatacgactcactatagggtcatcctctgctatgctgatgatatctctgaacagaggagacagagaatgcatcagcataacctggcggcagcgcaaaagatg

SEQ ID NO: 226654 - DNA, 103 bp, Artificial Sequence
  Synthetic Polynucleotide
taatacgactcactatagggcctgaggtcctcatcctctgctatgctgataacagaggagaatcagcatggcagaggataacctggcggcagcgcaaaagatg

SEQ ID NO: 226655 - DNA, 103 bp, Artificial Sequence
  Synthetic Polynucleotide
taatacgactcactatagggcaaagtgaaccctgaggtcctcatcctctgaacagaggagacagaggatgaggacctcaaacctggcggcagcgcaaaagatg

SEQ ID NO: 226656 - DNA, 103 bp, Artificial Sequence
  Synthetic Polynucleotide
taatacgactcactatagggctggattcctcaaagtgaaccctgaggtccaacagaggagaggacctatgggttcacttaacctggcggcagcgcaaaagatg

SEQ ID NO: 226657 - DNA, 103 bp, Artificial Sequence
  Synthetic Polynucleotide
taatacgactcactatagggatagtctccacttgcttcaaggttctcttcaacagaggagagaagagatgcttgaagcaaacctggcggcagcgcaaaagatg

SEQ ID NO: 226658 - DNA, 103 bp, Artificial Sequence
  Synthetic Polynucleotide
taatacgactcactatagggttctagcttgctggattcctcaaagtgaacaacagaggagagttcacatggaggaatccaacctggcggcagcgcaaaagatg

SEQ ID NO: 226659 - DNA, 103 bp, Artificial Sequence
  Synthetic Polynucleotide
taatacgactcactataggggcaacaggtcttctagcttgctggattcctaacagaggagaaggaatatggcaagctagaacctggcggcagcgcaaaagatg

SEQ ID NO: 226660 - DNA, 103 bp, Artificial Sequence
  Synthetic Polynucleotide
taatacgactcactatagggcgaaccttccgcaacaggtcttctagcttgaacagaggagacaagctatgagacctgttaacctggcggcagcgcaaaagatg

SEQ ID NO: 226661 - DNA, 103 bp, Artificial Sequence
  Synthetic Polynucleotide
taatacgactcactatagggctccttggcgcgaaccttccgcaacaggtcaacagaggagagacctgatgcggaaggttaacctggcggcagcgcaaaagatg

SEQ ID NO: 226662 - DNA, 103 bp, Artificial Sequence
  Synthetic Polynucleotide
taatacgactcactataggggcttcctggtctccttggcgcgaaccttccaacagaggagaggaaggatggcgccaaggaacctggcggcagcgcaaaagatg

SEQ ID NO: 226663 - DNA, 103 bp, Artificial Sequence
  Synthetic Polynucleotide
taatacgactcactatagggctgagtgctcgcttcctggtctccttggcgaacagaggagacgccaaatggaccaggaaaacctggcggcagcgcaaaagatg

SEQ ID NO: 226664 - DNA, 103 bp, Artificial Sequence
  Synthetic Polynucleotide
taatacgactcactatagggctttaacctgctgagtgctcgcttcctggtaacagaggagaaccaggatgcgagcactcaacctggcggcagcgcaaaagatg

SEQ ID NO: 226665 - DNA, 103 bp, Artificial Sequence
  Synthetic Polynucleotide
taatacgactcactatagggtgagcttcagctttaacctgctgagtgctcaacagaggagagagcacatggcaggttaaaacctggcggcagcgcaaaagatg

SEQ ID NO: 226666 - DNA, 103 bp, Artificial Sequence
  Synthetic Polynucleotide
taatacgactcactatagggatatctttgttgagcttcagctttaacctgaacagaggagacaggttatggctgaagctaacctggcggcagcgcaaaagatg

SEQ ID NO: 226667 - DNA, 103 bp, Artificial Sequence
  Synthetic Polynucleotide
taatacgactcactatagggagagatcactatatctttgttgagcttcagaacagaggagactgaagatgaacaaagataacctggcggcagcgcaaaagatg

SEQ ID NO: 226668 - DNA, 103 bp, Artificial Sequence
  Synthetic Polynucleotide
taatacgactcactatagggctgaatatttatagtctccacttgcttcaaaacagaggagattgaagatggtggagactaacctggcggcagcgcaaaagatg

SEQ ID NO: 226669 - DNA, 103 bp, Artificial Sequence
  Synthetic Polynucleotide
taatacgactcactatagggaaatgcccacagagatcactatatctttgtaacagaggagaacaaagatgtagtgatctaacctggcggcagcgcaaaagatg

SEQ ID NO: 226670 - DNA, 103 bp, Artificial Sequence
  Synthetic Polynucleotide
taatacgactcactatagggaccagattataaatgcccacagagatcactaacagaggagaagtgatatgtgtgggcataacctggcggcagcgcaaaagatg

SEQ ID NO: 226671 - DNA, 103 bp, Artificial Sequence
  Synthetic Polynucleotide
taatacgactcactatagggagccttctggaccagattataaatgcccacaacagaggagagtgggcatgtataatctgaacctggcggcagcgcaaaagatg

SEQ ID NO: 226672 - DNA, 103 bp, Artificial Sequence
  Synthetic Polynucleotide
taatacgactcactataggggaggcttgagagccttctggaccagattataacagaggagaataatcatgtccagaaggaacctggcggcagcgcaaaagatg

SEQ ID NO: 226673 - DNA, 103 bp, Artificial Sequence
  Synthetic Polynucleotide
taatacgactcactatagggtttattggaggaggcttgagagccttctggaacagaggagaccagaaatgtctcaagccaacctggcggcagcgcaaaagatg

SEQ ID NO: 226674 - DNA, 103 bp, Artificial Sequence
  Synthetic Polynucleotide
taatacgactcactatagggccgatagagctttattggaggaggcttgagaacagaggagactcaagatgcctccaataaacctggcggcagcgcaaaagatg

SEQ ID NO: 226675 - DNA, 103 bp, Artificial Sequence
  Synthetic Polynucleotide
taatacgactcactatagggcatttgtttcccgatagagctttattggagaacagaggagactccaaatgagctctatcaacctggcggcagcgcaaaagatg

SEQ ID NO: 226676 - DNA, 103 bp, Artificial Sequence
  Synthetic Polynucleotide
taatacgactcactatagggttcactggttcatttgtttcccgatagagcaacagaggagagctctaatgggaaacaaaaacctggcggcagcgcaaaagatg

SEQ ID NO: 226677 - DNA, 103 bp, Artificial Sequence
  Synthetic Polynucleotide
taatacgactcactatagggggtcttggttttcactggttcatttgtttcaacagaggagagaaacaatggaaccagtgaacctggcggcagcgcaaaagatg

SEQ ID NO: 226678 - DNA, 103 bp, Artificial Sequence
  Synthetic Polynucleotide
taatacgactcactatagggtaaaggtccgggtcttggttttcactggttaacagaggagaaaccagatgaaaccaagaaacctggcggcagcgcaaaagatg

SEQ ID NO: 226679 - DNA, 103 bp, Artificial Sequence
  Synthetic Polynucleotide
taatacgactcactatagggctatctcttcctgaatatttatagtctccaaacagaggagatggagaatgtaaatattcaacctggcggcagcgcaaaagatg

SEQ ID NO: 226680 - DNA, 103 bp, Artificial Sequence
  Synthetic Polynucleotide
taatacgactcactataggggtacttgtattaaaggtccgggtcttggttaacagaggagaaaccaaatgccggaccttaacctggcggcagcgcaaaagatg

SEQ ID NO: 226681 - DNA, 103 bp, Artificial Sequence
  Synthetic Polynucleotide
taatacgactcactatagggcaaaccgcctgtacttgtattaaaggtccgaacagaggagacggaccatgaatacaagtaacctggcggcagcgcaaaagatg

SEQ ID NO: 226682 - DNA, 103 bp, Artificial Sequence
  Synthetic Polynucleotide
taatacgactcactatagggtaggcagaagcaaaccgcctgtacttgtataacagaggagaatacaaatgcaggcggttaacctggcggcagcgcaaaagatg

SEQ ID NO: 226683 - DNA, 103 bp, Artificial Sequence
  Synthetic Polynucleotide
taatacgactcactatagggttggtatcgctaggcagaagcaaaccgcctaacagaggagaaggcggatggcttctgccaacctggcggcagcgcaaaagatg

SEQ ID NO: 226684 - DNA, 103 bp, Artificial Sequence
  Synthetic Polynucleotide
taatacgactcactatagggctgagacctcttggtatcgctaggcagaagaacagaggagacttctgatgagcgataccaacctggcggcagcgcaaaagatg

SEQ ID NO: 226685 - DNA, 103 bp, Artificial Sequence
  Synthetic Polynucleotide
taatacgactcactatagggtcccatagatctgagacctcttggtatcgcaacagaggagagcgataatgagaggtctcaacctggcggcagcgcaaaagatg

SEQ ID NO: 226686 - DNA, 103 bp, Artificial Sequence
  Synthetic Polynucleotide
taatacgactcactatagggatctgacgactcccatagatctgagacctcaacagaggagagaggtcatggatctatggaacctggcggcagcgcaaaagatg

SEQ ID NO: 226687 - DNA, 103 bp, Artificial Sequence
  Synthetic Polynucleotide
taatacgactcactatagggctccagtataatctgacgactcccatagataacagaggagaatctatatgagtcgtcagaacctggcggcagcgcaaaagatg

SEQ ID NO: 226688 - DNA, 103 bp, Artificial Sequence
  Synthetic Polynucleotide
taatacgactcactatagggtttcctctttctccagtataatctgacgacaacagaggagagtcgtcatgttatactggaacctggcggcagcgcaaaagatg

SEQ ID NO: 226689 - DNA, 103 bp, Artificial Sequence
  Synthetic Polynucleotide
taatacgactcactatagggagctcttctgtttcctctttctccagtataaacagaggagatatactatggaaagaggaaacctggcggcagcgcaaaagatg

SEQ ID NO: 226690 - DNA, 103 bp, Artificial Sequence
  Synthetic Polynucleotide
taatacgactcactataggggagccagcggaagaacgccgggactcccataacagaggagaatgggaatgccggcgttcaacctggcggcagcgcaaaagatg

SEQ ID NO: 226691 - DNA, 103 bp, Artificial Sequence
  Synthetic Polynucleotide
taatacgactcactatagggtttactggcatcaactggaatctttacaccaacagaggagaggtgtaatgattccagttaacctggcggcagcgcaaaagatg

SEQ ID NO: 226692 - DNA, 103 bp, Artificial Sequence
  Synthetic Polynucleotide
taatacgactcactataggggaagcacatgaaaacccagtcatcaatgctaacagaggagaagcattatggactgggttaacctggcggcagcgcaaaagatg

SEQ ID NO: 226693 - DNA, 103 bp, Artificial Sequence
  Synthetic Polynucleotide
taatacgactcactatagggttcccacaaagaagcacatgaaaacccagtaacagaggagaactgggatgtcatgtgctaacctggcggcagcgcaaaagatg

SEQ ID NO: 226694 - DNA, 103 bp, Artificial Sequence
  Synthetic Polynucleotide
taatacgactcactatagggaggaagtcatttcccacaaagaagcacatgaacagaggagacatgtgatgctttgtgggaacctggcggcagcgcaaaagatg

SEQ ID NO: 226695 - DNA, 103 bp, Artificial Sequence
  Synthetic Polynucleotide
taatacgactcactatagggcaaatgagggaggaagtcatttcccacaaaaacagaggagatttgtgatgaatgacttcaacctggcggcagcgcaaaagatg

SEQ ID NO: 226696 - DNA, 103 bp, Artificial Sequence
  Synthetic Polynucleotide
taatacgactcactatagggctaacgatggcaaatgagggaggaagtcataacagaggagaatgactatgtccctcattaacctggcggcagcgcaaaagatg

SEQ ID NO: 226697 - DNA, 103 bp, Artificial Sequence
  Synthetic Polynucleotide
taatacgactcactatagggtccctaatctctaacgatggcaaatgagggaacagaggagaccctcaatggccatcgttaacctggcggcagcgcaaaagatg

SEQ ID NO: 226698 - DNA, 103 bp, Artificial Sequence
  Synthetic Polynucleotide
taatacgactcactatagggaattgcattttccctaatctctaacgatggaacagaggagaccatcgatggagattaggaacctggcggcagcgcaaaagatg

SEQ ID NO: 226699 - DNA, 103 bp, Artificial Sequence
  Synthetic Polynucleotide
taatacgactcactatagggccaaacggtcaattgcattttccctaatctaacagaggagaagattaatgaaaatgcaaaacctggcggcagcgcaaaagatg

SEQ ID NO: 226700 - DNA, 103 bp, Artificial Sequence
  Synthetic Polynucleotide
taatacgactcactatagggtatatgttaaccaaacggtcaattgcatttaacagaggagaaaatgcatgtgaccgtttaacctggcggcagcgcaaaagatg

SEQ ID NO: 226701 - DNA, 103 bp, Artificial Sequence
  Synthetic Polynucleotide
taatacgactcactatagggcacatttttgtatatgttaaccaaacggtcaacagaggagagaccgtatggttaacataaacctggcggcagcgcaaaagatg

SEQ ID NO: 226702 - DNA, 103 bp, Artificial Sequence
  Synthetic Polynucleotide
taatacgactcactatagggttggattaggtttactggcatcaactggaaaacagaggagattccagatgatgccagtaaacctggcggcagcgcaaaagatg

SEQ ID NO: 226703 - DNA, 103 bp, Artificial Sequence
  Synthetic Polynucleotide
taatacgactcactatagggttttgtgtaccacatttttgtatatgttaaaacagaggagattaacaatgacaaaaatgaacctggcggcagcgcaaaagatg

SEQ ID NO: 226704 - DNA, 103 bp, Artificial Sequence
  Synthetic Polynucleotide
taatacgactcactatagggtaacccccagttttgtgtaccacatttttgaacagaggagacaaaaaatgggtacacaaaacctggcggcagcgcaaaagatg

SEQ ID NO: 226705 - DNA, 103 bp, Artificial Sequence
  Synthetic Polynucleotide
taatacgactcactatagggttctgtaaggtaacccccagttttgtgtacaacagaggagagtacacatgactgggggtaacctggcggcagcgcaaaagatg

SEQ ID NO: 226706 - DNA, 103 bp, Artificial Sequence
  Synthetic Polynucleotide
taatacgactcactatagggcataaccactttctgtaaggtaacccccagaacagaggagactggggatgaccttacagaacctggcggcagcgcaaaagatg

SEQ ID NO: 226707 - DNA, 103 bp, Artificial Sequence
  Synthetic Polynucleotide
taatacgactcactatagggtgcagattgacataaccactttctgtaaggaacagaggagaccttacatgaagtggttaaacctggcggcagcgcaaaagatg

SEQ ID NO: 226708 - DNA, 103 bp, Artificial Sequence
  Synthetic Polynucleotide
taatacgactcactatagggctgtactctttgcagattgacataaccactaacagaggagaagtggtatggtcaatctgaacctggcggcagcgcaaaagatg

SEQ ID NO: 226709 - DNA, 103 bp, Artificial Sequence
  Synthetic Polynucleotide
taatacgactcactatagggacatgatcatctgtactctttgcagattgaaacagaggagatcaatcatgaaagagtacaacctggcggcagcgcaaaagatg

SEQ ID NO: 226710 - DNA, 103 bp, Artificial Sequence
  Synthetic Polynucleotide
taatacgactcactatagggccaactgctaacatgatcatctgtactcttaacagaggagaaagagtatggatgatcataacctggcggcagcgcaaaagatg

SEQ ID NO: 226711 - DNA, 103 bp, Artificial Sequence
  Synthetic Polynucleotide
taatacgactcactatagggctcaacttcaccaactgctaacatgatcataacagaggagaatgatcatgttagcagttaacctggcggcagcgcaaaagatg

SEQ ID NO: 226712 - DNA, 103 bp, Artificial Sequence
  Synthetic Polynucleotide
taatacgactcactatagggaaatgctatcctcaacttcaccaactgctaaacagaggagatagcagatggtgaagttgaacctggcggcagcgcaaaagatg

SEQ ID NO: 226713 - DNA, 103 bp, Artificial Sequence
  Synthetic Polynucleotide
taatacgactcactatagggtccacatcatttggattaggtttactggcaaacagaggagatgccagatgacctaatccaacctggcggcagcgcaaaagatg

SEQ ID NO: 226714 - DNA, 103 bp, Artificial Sequence
  Synthetic Polynucleotide
taatacgactcactatagggctctttttaaaaatgctatcctcaacttcaaacagaggagatgaagtatgggatagcataacctggcggcagcgcaaaagatg

SEQ ID NO: 226715 - DNA, 103 bp, Artificial Sequence
  Synthetic Polynucleotide
taatacgactcactatagggatcatcctttctctttttaaaaatgctatcaacagaggagagatagcatgtttaaaaagaacctggcggcagcgcaaaagatg

SEQ ID NO: 226716 - DNA, 103 bp, Artificial Sequence
  Synthetic Polynucleotide
taatacgactcactatagggaactgtcctcatcatcctttctctttttaaaacagaggagattaaaaatggaaaggatgaacctggcggcagcgcaaaagatg

SEQ ID NO: 226717 - DNA, 103 bp, Artificial Sequence
  Synthetic Polynucleotide
taatacgactcactatagggcgtcttctaaaactgtcctcatcatcctttaacagaggagaaaaggaatgtgaggacagaacctggcggcagcgcaaaagatg

SEQ ID NO: 226718 - DNA, 103 bp, Artificial Sequence
  Synthetic Polynucleotide
taatacgactcactatagggttctttctgtcgtcttctaaaactgtcctcaacagaggagagaggacatgtttagaagaaacctggcggcagcgcaaaagatg

SEQ ID NO: 226719 - DNA, 103 bp, Artificial Sequence
  Synthetic Polynucleotide
taatacgactcactatagggtctttcttttttctttctgtcgtcttctaaaacagaggagattagaaatggacagaaagaacctggcggcagcgcaaaagatg

SEQ ID NO: 226720 - DNA, 103 bp, Artificial Sequence
  Synthetic Polynucleotide
taatacgactcactatagggctcttcattctctttcttttttctttctgtaacagaggagaacagaaatgaaaaagaaaaacctggcggcagcgcaaaagatg

SEQ ID NO: 226721 - DNA, 103 bp, Artificial Sequence
  Synthetic Polynucleotide
taatacgactcactatagggtggttgatctctcttcattctctttcttttaacagaggagaaaaagaatgagaatgaagaacctggcggcagcgcaaaagatg

SEQ ID NO: 226722 - DNA, 103 bp, Artificial Sequence
  Synthetic Polynucleotide
taatacgactcactataggggagtgaaagctggttgatctctcttcattcaacagaggagagaatgaatggagatcaacaacctggcggcagcgcaaaagatg

SEQ ID NO: 226723 - DNA, 103 bp, Artificial Sequence
  Synthetic Polynucleotide
taatacgactcactatagggattccactaggagtgaaagctggttgatctaacagaggagaagatcaatgagctttcacaacctggcggcagcgcaaaagatg

SEQ ID NO: 226724 - DNA, 103 bp, Artificial Sequence
  Synthetic Polynucleotide
taatacgactcactatagggattatcaaactccacatcatttggattaggaacagaggagacctaatatgaatgatgtgaacctggcggcagcgcaaaagatg

SEQ ID NO: 226725 - DNA, 103 bp, Artificial Sequence
  Synthetic Polynucleotide
taatacgactcactatagggaggagttaatattccactaggagtgaaagcaacagaggagagctttcatgcctagtggaaacctggcggcagcgcaaaagatg

SEQ ID NO: 226726 - DNA, 103 bp, Artificial Sequence
  Synthetic Polynucleotide
taatacgactcactatagggccaaggcatgaggagttaatattccactagaacagaggagactagtgatgtattaactcaacctggcggcagcgcaaaagatg

SEQ ID NO: 226727 - DNA, 103 bp, Artificial Sequence
  Synthetic Polynucleotide
taatacgactcactatagggtttcttgaacccaaggcatgaggagttaataacagaggagaattaacatgtcatgccttaacctggcggcagcgcaaaagatg

SEQ ID NO: 226728 - DNA, 103 bp, Artificial Sequence
  Synthetic Polynucleotide
taatacgactcactatagggacctggtgaatttcttgaacccaaggcatgaacagaggagacatgccatgggttcaagaaacctggcggcagcgcaaaagatg

SEQ ID NO: 226729 - DNA, 103 bp, Artificial Sequence
  Synthetic Polynucleotide
taatacgactcactatagggctacttgagaacctggtgaatttcttgaacaacagaggagagttcaaatgattcaccagaacctggcggcagcgcaaaagatg

SEQ ID NO: 226730 - DNA, 103 bp, Artificial Sequence
  Synthetic Polynucleotide
taatacgactcactatagggggattactggctacttgagaacctggtgaaaacagaggagattcaccatgttctcaagtaacctggcggcagcgcaaaagatg

SEQ ID NO: 226731 - DNA, 103 bp, Artificial Sequence
  Synthetic Polynucleotide
taatacgactcactatagggtgcttgtctcggattactggctacttgagaaacagaggagatctcaaatggccagtaataacctggcggcagcgcaaaagatg

SEQ ID NO: 226732 - DNA, 103 bp, Artificial Sequence
  Synthetic Polynucleotide
taatacgactcactatagggtttcataggctgcttgtctcggattactggaacagaggagaccagtaatgcgagacaagaacctggcggcagcgcaaaagatg

SEQ ID NO: 226733 - DNA, 103 bp, Artificial Sequence
  Synthetic Polynucleotide
taatacgactcactatagggtgcatcctcatttcataggctgcttgtctcaacagaggagagagacaatgagcctatgaaacctggcggcagcgcaaaagatg

SEQ ID NO: 226734 - DNA, 103 bp, Artificial Sequence
  Synthetic Polynucleotide
taatacgactcactatagggagagttattctgcatcctcatttcataggcaacagaggagagcctatatgatgaggatgaacctggcggcagcgcaaaagatg

SEQ ID NO: 226735 - DNA, 103 bp, Artificial Sequence
  Synthetic Polynucleotide
taatacgactcactatagggccaaatacagattatcaaactccacatcataacagaggagaatgatgatgagtttgataaacctggcggcagcgcaaaagatg

SEQ ID NO: 226736 - DNA, 103 bp, Artificial Sequence
  Synthetic Polynucleotide
taatacgactcactatagggtcgaaggactagagttattctgcatcctcaaacagaggagatgaggaatgagaataactaacctggcggcagcgcaaaagatg

SEQ ID NO: 226737 - DNA, 103 bp, Artificial Sequence
  Synthetic Polynucleotide
taatacgactcactatagggttaggagatatcgaaggactagagttattcaacagaggagagaataaatgtagtccttcaacctggcggcagcgcaaaagatg

SEQ ID NO: 226738 - DNA, 103 bp, Artificial Sequence
  Synthetic Polynucleotide
taatacgactcactataggggaaactcgtattaggagatatcgaaggactaacagaggagaagtcctatgatatctcctaacctggcggcagcgcaaaagatg

SEQ ID NO: 226739 - DNA, 103 bp, Artificial Sequence
  Synthetic Polynucleotide
taatacgactcactatagggcatcagatgtgaaactcgtattaggagataaacagaggagatatctcatgatacgagttaacctggcggcagcgcaaaagatg

SEQ ID NO: 226740 - DNA, 103 bp, Artificial Sequence
  Synthetic Polynucleotide
taatacgactcactataggggacggggagccatcagatgtgaaactcgtaaacagaggagatacgagatgcacatctgaaacctggcggcagcgcaaaagatg

SEQ ID NO: 226741 - DNA, 103 bp, Artificial Sequence
  Synthetic Polynucleotide
taatacgactcactatagggtcctaatggagacggggagccatcagatgtaacagaggagaacatctatgggctccccgaacctggcggcagcgcaaaagatg

SEQ ID NO: 226742 - DNA, 103 bp, Artificial Sequence
  Synthetic Polynucleotide
taatacgactcactataggggcttaattcctcctaatggagacggggagcaacagaggagagctcccatgctccattagaacctggcggcagcgcaaaagatg

SEQ ID NO: 226743 - DNA, 103 bp, Artificial Sequence
  Synthetic Polynucleotide
taatacgactcactatagggtctgcttttcgcttaattcctcctaatggaaacagaggagatccattatgaggaattaaaacctggcggcagcgcaaaagatg

SEQ ID NO: 226744 - DNA, 103 bp, Artificial Sequence
  Synthetic Polynucleotide
taatacgactcactataggggtcactgtcttctgcttttcgcttaattccaacagaggagaggaattatgcgaaaagcaaacctggcggcagcgcaaaagatg

SEQ ID NO: 226745 - DNA, 103 bp, Artificial Sequence
  Synthetic Polynucleotide
taatacgactcactatagggcaggttcactgtcactgtcttctgcttttcaacagaggagagaaaagatgaagacagtgaacctggcggcagcgcaaaagatg

SEQ ID NO: 226746 - DNA, 103 bp, Artificial Sequence
  Synthetic Polynucleotide
taatacgactcactatagggccattcatatccaaatacagattatcaaacaacagaggagagtttgaatgtctgtatttaacctggcggcagcgcaaaagatg

SEQ ID NO: 226747 - DNA, 103 bp, Artificial Sequence
  Synthetic Polynucleotide
taatacgactcactatagggtcctctggctcaggttcactgtcactgtctaacagaggagaagacagatgcagtgaaccaacctggcggcagcgcaaaagatg

SEQ ID NO: 226748 - DNA, 103 bp, Artificial Sequence
  Synthetic Polynucleotide
taatacgactcactatagggcctgacattatcctctggctcaggttcactaacagaggagaagtgaaatggagccagagaacctggcggcagcgcaaaagatg

SEQ ID NO: 226749 - DNA, 103 bp, Artificial Sequence
  Synthetic Polynucleotide
taatacgactcactatagggcttcccataacctgacattatcctctggctaacagaggagaagccagatgataatgtcaaacctggcggcagcgcaaaagatg

SEQ ID NO: 226750 - DNA, 103 bp, Artificial Sequence
  Synthetic Polynucleotide
taatacgactcactatagggttccagccagcttcccataacctgacattaaacagaggagataatgtatggttatgggaaacctggcggcagcgcaaaagatg

SEQ ID NO: 226751 - DNA, 103 bp, Artificial Sequence
  Synthetic Polynucleotide
taatacgactcactataggggtaccgctgcttccagccagcttcccataaaacagaggagattatggatggctggctggaacctggcggcagcgcaaaagatg

SEQ ID NO: 226752 - DNA, 103 bp, Artificial Sequence
  Synthetic Polynucleotide
taatacgactcactatagggtgttcttgtagtaccgctgcttccagccagaacagaggagactggctatgagcagcggtaacctggcggcagcgcaaaagatg

SEQ ID NO: 226753 - DNA, 103 bp, Artificial Sequence
  Synthetic Polynucleotide
taatacgactcactatagggacatcaaatttgttcttgtagtaccgctgcaacagaggagagcagcgatgctacaagaaaacctggcggcagcgcaaaagatg

SEQ ID NO: 226754 - DNA, 103 bp, Artificial Sequence
  Synthetic Polynucleotide
taatacgactcactatagggagctgcatccacatcaaatttgttcttgtaaacagaggagatacaagatgaaatttgataacctggcggcagcgcaaaagatg

SEQ ID NO: 226755 - DNA, 103 bp, Artificial Sequence
  Synthetic Polynucleotide
taatacgactcactatagggatttctcatcagctgcatccacatcaaattaacagaggagaaatttgatgtggatgcagaacctggcggcagcgcaaaagatg

SEQ ID NO: 226756 - DNA, 103 bp, Artificial Sequence
  Synthetic Polynucleotide
taatacgactcactatagggttccgacggaatttctcatcagctgcatccaacagaggagaggatgcatgtgatgagaaaacctggcggcagcgcaaaagatg

SEQ ID NO: 226757 - DNA, 103 bp, Artificial Sequence
  Synthetic Polynucleotide
taatacgactcactatagggatggatgattccattcatatccaaatacagaacagaggagactgtatatggatatgaataacctggcggcagcgcaaaagatg

SEQ ID NO: 226758 - DNA, 103 bp, Artificial Sequence
  Synthetic Polynucleotide
taatacgactcactatagggctgcacaactttccgacggaatttctcatcaacagaggagagatgagatgttccgtcggaacctggcggcagcgcaaaagatg

SEQ ID NO: 226759 - DNA, 103 bp, Artificial Sequence
  Synthetic Polynucleotide
taatacgactcactatagggcaacgtacgactgcacaactttccgacggaaacagaggagatccgtcatgaagttgtgcaacctggcggcagcgcaaaagatg

SEQ ID NO: 226760 - DNA, 103 bp, Artificial Sequence
  Synthetic Polynucleotide
taatacgactcactatagggcaaagtccttcaacgtacgactgcacaactaacagaggagaagttgtatggtcgtacgtaacctggcggcagcgcaaaagatg

SEQ ID NO: 226761 - DNA, 103 bp, Artificial Sequence
  Synthetic Polynucleotide
taatacgactcactatagggaagaacccagcaaagtccttcaacgtacgaaacagaggagatcgtacatggaaggacttaacctggcggcagcgcaaaagatg

SEQ ID NO: 226762 - DNA, 103 bp, Artificial Sequence
  Synthetic Polynucleotide
taatacgactcactatagggaataatatctaagaacccagcaaagtccttaacagaggagaaaggacatggctgggttcaacctggcggcagcgcaaaagatg

SEQ ID NO: 226763 - DNA, 103 bp, Artificial Sequence
  Synthetic Polynucleotide
taatacgactcactatagggcagccctggtaataatatctaagaacccagaacagaggagactgggtatgtagatattaaacctggcggcagcgcaaaagatg

SEQ ID NO: 226764 - DNA, 103 bp, Artificial Sequence
  Synthetic Polynucleotide
taatacgactcactatagggccaggaagcacagccctggtaataatatctaacagaggagaagatatatgtaccagggcaacctggcggcagcgcaaaagatg

SEQ ID NO: 226765 - DNA, 103 bp, Artificial Sequence
  Synthetic Polynucleotide
taatacgactcactatagggaataccacttccaggaagcacagccctggtaacagaggagaaccaggatggtgcttcctaacctggcggcagcgcaaaagatg

SEQ ID NO: 226766 - DNA, 103 bp, Artificial Sequence
  Synthetic Polynucleotide
taatacgactcactatagggtgaaatggataataccacttccaggaagcaaacagaggagatgcttcatggaagtggtaaacctggcggcagcgcaaaagatg

SEQ ID NO: 226767 - DNA, 103 bp, Artificial Sequence
  Synthetic Polynucleotide
taatacgactcactatagggtggtgcataatgaaatggataataccacttaacagaggagaaagtggatgtatccatttaacctggcggcagcgcaaaagatg

SEQ ID NO: 226768 - DNA, 103 bp, Artificial Sequence
  Synthetic Polynucleotide
taatacgactcactataggggagtacagggatggatgattccattcatataacagaggagaatatgaatggaatcatccaacctggcggcagcgcaaaagatg

SEQ ID NO: 226769 - DNA, 103 bp, Artificial Sequence
  Synthetic Polynucleotide
taatacgactcactatagggctgaagcaaatggtgcataatgaaatggataacagaggagaatccatatgattatgcacaacctggcggcagcgcaaaagatg

SEQ ID NO: 226770 - DNA, 103 bp, Artificial Sequence
  Synthetic Polynucleotide
taatacgactcactatagggccttcaaagtctgaagcaaatggtgcataaaacagaggagattatgcatgatttgcttcaacctggcggcagcgcaaaagatg

SEQ ID NO: 226771 - DNA, 103 bp, Artificial Sequence
  Synthetic Polynucleotide
taatacgactcactataggggtctgcaatgccttcaaagtctgaagcaaaaacagaggagatttgctatggactttgaaaacctggcggcagcgcaaaagatg

SEQ ID NO: 226772 - DNA, 103 bp, Artificial Sequence
  Synthetic Polynucleotide
taatacgactcactatagggcagatggcatgtctgcaatgccttcaaagtaacagaggagaactttgatggcattgcagaacctggcggcagcgcaaaagatg

SEQ ID NO: 226773 - DNA, 103 bp, Artificial Sequence
  Synthetic Polynucleotide
taatacgactcactatagggttctcaaaatcagatggcatgtctgcaatgaacagaggagacattgcatgcatgccatcaacctggcggcagcgcaaaagatg

SEQ ID NO: 226774 - DNA, 103 bp, Artificial Sequence
  Synthetic Polynucleotide
taatacgactcactatagggtttcgtacccttctcaaaatcagatggcataacagaggagaatgccaatggattttgagaacctggcggcagcgcaaaagatg

SEQ ID NO: 226775 - DNA, 103 bp, Artificial Sequence
  Synthetic Polynucleotide
taatacgactcactataggggtttaaacggtttcgtacccttctcaaaataacagaggagaattttgatgagggtacgaaacctggcggcagcgcaaaagatg

SEQ ID NO: 226776 - DNA, 103 bp, Artificial Sequence
  Synthetic Polynucleotide
taatacgactcactatagggtgttctagtggtttaaacggtttcgtacccaacagaggagagggtacatgaccgtttaaaacctggcggcagcgcaaaagatg

SEQ ID NO: 226777 - DNA, 103 bp, Artificial Sequence
  Synthetic Polynucleotide
taatacgactcactatagggccccataagttgttctagtggtttaaacggaacagaggagaccgtttatgccactagaaaacctggcggcagcgcaaaagatg

SEQ ID NO: 226778 - DNA, 103 bp, Artificial Sequence
  Synthetic Polynucleotide
taatacgactcactatagggctggaaatacccccataagttgttctagtgaacagaggagacactagatgaacttatggaacctggcggcagcgcaaaagatg

SEQ ID NO: 226779 - DNA, 103 bp, Artificial Sequence
  Synthetic Polynucleotide
taatacgactcactatagggtcttcaggatgagtacagggatggatgattaacagaggagaaatcatatgtccctgtacaacctggcggcagcgcaaaagatg

SEQ ID NO: 226780 - DNA, 103 bp, Artificial Sequence
  Synthetic Polynucleotide
taatacgactcactatagggccacttgcagctggaaatacccccataagtaacagaggagaacttatatgggtatttccaacctggcggcagcgcaaaagatg

SEQ ID NO: 226781 - DNA, 103 bp, Artificial Sequence
  Synthetic Polynucleotide
taatacgactcactatagggtagaaaattaccacttgcagctggaaatacaacagaggagagtatttatggctgcaagtaacctggcggcagcgcaaaagatg

SEQ ID NO: 226782 - DNA, 103 bp, Artificial Sequence
  Synthetic Polynucleotide
taatacgactcactatagggatgatggaggtagaaaattaccacttgcagaacagaggagactgcaaatggtaattttcaacctggcggcagcgcaaaagatg

SEQ ID NO: 226783 - DNA, 103 bp, Artificial Sequence
  Synthetic Polynucleotide
taatacgactcactatagggagcttccgccatgatggaggtagaaaattaaacagaggagataatttatgacctccatcaacctggcggcagcgcaaaagatg

SEQ ID NO: 226784 - DNA, 103 bp, Artificial Sequence
  Synthetic Polynucleotide
taatacgactcactatagggatcactcatgagcttccgccatgatggaggaacagaggagacctccaatgtggcggaagaacctggcggcagcgcaaaagatg

SEQ ID NO: 226785 - DNA, 103 bp, Artificial Sequence
  Synthetic Polynucleotide
taatacgactcactatagggtagaatcaggatcactcatgagcttccgccaacagaggagaggcggaatgtcatgagtgaacctggcggcagcgcaaaagatg

SEQ ID NO: 226786 - DNA, 103 bp, Artificial Sequence
  Synthetic Polynucleotide
taatacgactcactatagggtcaattatactagaatcaggatcactcatgaacagaggagacatgagatgtcctgattcaacctggcggcagcgcaaaagatg

SEQ ID NO: 226787 - DNA, 103 bp, Artificial Sequence
  Synthetic Polynucleotide
taatacgactcactatagggaggatagaagtcaattatactagaatcaggaacagaggagacctgatatgagtataattaacctggcggcagcgcaaaagatg

SEQ ID NO: 226788 - DNA, 103 bp, Artificial Sequence
  Synthetic Polynucleotide
taatacgactcactatagggcaaaatcttcaggatagaagtcaattatacaacagaggagagtataaatgacttctatcaacctggcggcagcgcaaaagatg

SEQ ID NO: 226789 - DNA, 103 bp, Artificial Sequence
  Synthetic Polynucleotide
taatacgactcactatagggaaatcaatagcaaaatcttcaggatagaagaacagaggagacttctaatgtgaagatttaacctggcggcagcgcaaaagatg

SEQ ID NO: 226790 - DNA, 103 bp, Artificial Sequence
  Synthetic Polynucleotide
taatacgactcactatagggtgctggtttgtcttcaggatgagtacagggaacagaggagaccctgtatgcatcctgaaaacctggcggcagcgcaaaagatg

SEQ ID NO: 226791 - DNA, 103 bp, Artificial Sequence
  Synthetic Polynucleotide
taatacgactcactatagggcttcccattcaaatcaatagcaaaatcttcaacagaggagagaagatatggctattgataacctggcggcagcgcaaaagatg

SEQ ID NO: 226792 - DNA, 103 bp, Artificial Sequence
  Synthetic Polynucleotide
taatacgactcactatagggatgcatatttcttcccattcaaatcaatagaacagaggagactattgatgtgaatgggaaacctggcggcagcgcaaaagatg

SEQ ID NO: 226793 - DNA, 103 bp, Artificial Sequence
  Synthetic Polynucleotide
taatacgactcactatagggacaccttgccatgcatatttcttcccattcaacagaggagagaatggatggaaatatgcaacctggcggcagcgcaaaagatg

SEQ ID NO: 226794 - DNA, 103 bp, Artificial Sequence
  Synthetic Polynucleotide
taatacgactcactatagggcaagagagcaacaccttgccatgcatatttaacagaggagaaaatatatgtggcaaggtaacctggcggcagcgcaaaagatg

SEQ ID NO: 226795 - DNA, 103 bp, Artificial Sequence
  Synthetic Polynucleotide
taatacgactcactatagggccacgaatggcaagagagcaacaccttgccaacagaggagaggcaagatgttgctctctaacctggcggcagcgcaaaagatg

SEQ ID NO: 226796 - DNA, 103 bp, Artificial Sequence
  Synthetic Polynucleotide
taatacgactcactatagggcttcgctcatccacgaatggcaagagagcaaacagaggagatgctctatggccattcgtaacctggcggcagcgcaaaagatg

SEQ ID NO: 226797 - DNA, 103 bp, Artificial Sequence
  Synthetic Polynucleotide
taatacgactcactatagggagctcgtagccttcgctcatccacgaatggaacagaggagaccattcatggatgagcgaaacctggcggcagcgcaaaagatg

SEQ ID NO: 226798 - DNA, 103 bp, Artificial Sequence
  Synthetic Polynucleotide
taatacgactcactatagggcttctagggcagctcgtagccttcgctcataacagaggagaatgagcatgggctacgagaacctggcggcagcgcaaaagatg

SEQ ID NO: 226799 - DNA, 103 bp, Artificial Sequence
  Synthetic Polynucleotide
taatacgactcactataggggggtatacctcttctagggcagctcgtagcaacagaggagagctacgatgtgccctagaaacctggcggcagcgcaaaagatg

SEQ ID NO: 226800 - DNA, 103 bp, Artificial Sequence
  Synthetic Polynucleotide
taatacgactcactatagggagtgaggtctgggtatacctcttctagggcaacagaggagagccctaatggaggtatacaacctggcggcagcgcaaaagatg

SEQ ID NO: 226801 - DNA, 103 bp, Artificial Sequence
  Synthetic Polynucleotide
taatacgactcactatagggacttgcggctgagccagcggaagaacgccgaacagaggagacggcgtatgtccgctggcaacctggcggcagcgcaaaagatg

SEQ ID NO: 226802 - DNA, 103 bp, Artificial Sequence
  Synthetic Polynucleotide
taatacgactcactatagggcattttttggtgctggtttgtcttcaggataacagaggagaatcctgatgacaaaccagaacctggcggcagcgcaaaagatg

SEQ ID NO: 226803 - DNA, 103 bp, Artificial Sequence
  Synthetic Polynucleotide
taatacgactcactatagggtctcttctggagtgaggtctgggtatacctaacagaggagaaggtatatgcagacctcaaacctggcggcagcgcaaaagatg

SEQ ID NO: 226804 - DNA, 103 bp, Artificial Sequence
  Synthetic Polynucleotide
taatacgactcactatagggtttcttctggtctcttctggagtgaggtctaacagaggagaagacctatgtccagaagaaacctggcggcagcgcaaaagatg

SEQ ID NO: 226805 - DNA, 103 bp, Artificial Sequence
  Synthetic Polynucleotide
taatacgactcactatagggtccaaggctgtttcttctggtctcttctggaacagaggagaccagaaatgaccagaagaaacctggcggcagcgcaaaagatg

SEQ ID NO: 226806 - DNA, 103 bp, Artificial Sequence
  Synthetic Polynucleotide
taatacgactcactatagggagacatcacctccaaggctgtttcttctggaacagaggagaccagaaatgacagccttgaacctggcggcagcgcaaaagatg

SEQ ID NO: 226807 - DNA, 103 bp, Artificial Sequence
  Synthetic Polynucleotide
taatacgactcactatagggcccacaaataagacatcacctccaaggctgaacagaggagacagcctatgaggtgatgtaacctggcggcagcgcaaaagatg

SEQ ID NO: 226808 - DNA, 103 bp, Artificial Sequence
  Synthetic Polynucleotide
taatacgactcactataggggtgatgtttccccacaaataagacatcaccaacagaggagaggtgatatgttatttgtgaacctggcggcagcgcaaaagatg

SEQ ID NO: 226809 - DNA, 103 bp, Artificial Sequence
  Synthetic Polynucleotide
taatacgactcactatagggcatggagtgggtgatgtttccccacaaataaacagaggagatatttgatgggaaacatcaacctggcggcagcgcaaaagatg

SEQ ID NO: 226810 - DNA, 103 bp, Artificial Sequence
  Synthetic Polynucleotide
taatacgactcactatagggaaaatgaagtcatggagtgggtgatgtttcaacagaggagagaaacaatgcccactccaaacctggcggcagcgcaaaagatg

SEQ ID NO: 226811 - DNA, 103 bp, Artificial Sequence
  Synthetic Polynucleotide
taatacgactcactataggggtacagctctaaaatgaagtcatggagtggaacagaggagaccactcatggacttcattaacctggcggcagcgcaaaagatg

SEQ ID NO: 226812 - DNA, 103 bp, Artificial Sequence
  Synthetic Polynucleotide
taatacgactcactatagggaacctgtctggtacagctctaaaatgaagtaacagaggagaacttcaatgtagagctgtaacctggcggcagcgcaaaagatg

SEQ ID NO: 226813 - DNA, 103 bp, Artificial Sequence
  Synthetic Polynucleotide
taatacgactcactatagggatttcatcttcattttttggtgctggtttgaacagaggagacaaaccatgaccaaaaaaaacctggcggcagcgcaaaagatg

SEQ ID NO: 226814 - DNA, 103 bp, Artificial Sequence
  Synthetic Polynucleotide
taatacgactcactatagggggctctgtggaacctgtctggtacagctctaacagaggagaagagctatgccagacaggaacctggcggcagcgcaaaagatg

SEQ ID NO: 226815 - DNA, 103 bp, Artificial Sequence
  Synthetic Polynucleotide
taatacgactcactatagggtacctccactggctctgtggaacctgtctgaacagaggagacagacaatgtccacagagaacctggcggcagcgcaaaagatg

SEQ ID NO: 226816 - DNA, 103 bp, Artificial Sequence
  Synthetic Polynucleotide
taatacgactcactataggggttcagggggtacctccactggctctgtggaacagaggagaccacagatgcagtggaggaacctggcggcagcgcaaaagatg

SEQ ID NO: 226817 - DNA, 103 bp, Artificial Sequence
  Synthetic Polynucleotide
taatacgactcactatagggccatgacatagttcagggggtacctccactaacagaggagaagtggaatgaccccctgaaacctggcggcagcgcaaaagatg

SEQ ID NO: 226818 - DNA, 103 bp, Artificial Sequence
  Synthetic Polynucleotide
taatacgactcactatagggtccttgaatcccatgacatagttcagggggaacagaggagaccccctatgctatgtcataacctggcggcagcgcaaaagatg

SEQ ID NO: 226819 - DNA, 103 bp, Artificial Sequence
  Synthetic Polynucleotide
taatacgactcactatagggaagaaaactttccttgaatcccatgacataaacagaggagatatgtcatgggattcaagaacctggcggcagcgcaaaagatg

SEQ ID NO: 226820 - DNA, 103 bp, Artificial Sequence
  Synthetic Polynucleotide
taatacgactcactatagggtcttcatccaaagaaaactttccttgaatcaacagaggagagattcaatgaaagttttcaacctggcggcagcgcaaaagatg

SEQ ID NO: 226821 - DNA, 103 bp, Artificial Sequence
  Synthetic Polynucleotide
taatacgactcactatagggaagaatggcttcttcatccaaagaaaacttaacagaggagaaagtttatgttggatgaaaacctggcggcagcgcaaaagatg

SEQ ID NO: 226822 - DNA, 103 bp, Artificial Sequence
  Synthetic Polynucleotide
taatacgactcactatagggtttgatctggaagaatggcttcttcatccaaacagaggagatggatgatgaagccattcaacctggcggcagcgcaaaagatg

SEQ ID NO: 226823 - DNA, 103 bp, Artificial Sequence
  Synthetic Polynucleotide
taatacgactcactataggggaacatactatttgatctggaagaatggctaacagaggagaagccatatgtccagatcaaacctggcggcagcgcaaaagatg

SEQ ID NO: 226824 - DNA, 103 bp, Artificial Sequence
  Synthetic Polynucleotide
taatacgactcactatagggtgcaaccatcatttcatcttcattttttggaacagaggagaccaaaaatggaagatgaaaacctggcggcagcgcaaaagatg

SEQ ID NO: 226825 - DNA, 103 bp, Artificial Sequence
  Synthetic Polynucleotide
taatacgactcactatagggaggaacaggagaacatactatttgatctggaacagaggagaccagatatgatagtatgtaacctggcggcagcgcaaaagatg

SEQ ID NO: 226826 - DNA, 103 bp, Artificial Sequence
  Synthetic Polynucleotide
taatacgactcactatagggcccttaacataggaacaggagaacatactaaacagaggagatagtatatgctcctgttcaacctggcggcagcgcaaaagatg

SEQ ID NO: 226827 - DNA, 103 bp, Artificial Sequence
  Synthetic Polynucleotide
taatacgactcactatagggtgtgtcagatcccttaacataggaacaggaaacagaggagatcctgtatgtatgttaagaacctggcggcagcgcaaaagatg

SEQ ID NO: 226828 - DNA, 103 bp, Artificial Sequence
  Synthetic Polynucleotide
taatacgactcactatagggtacagtgttctgtgtcagatcccttaacataacagaggagaatgttaatggatctgacaaacctggcggcagcgcaaaagatg

SEQ ID NO: 226829 - DNA, 103 bp, Artificial Sequence
  Synthetic Polynucleotide
taatacgactcactatagggtaatactgactacagtgttctgtgtcagataacagaggagaatctgaatgagaacactgaacctggcggcagcgcaaaagatg

SEQ ID NO: 226830 - DNA, 103 bp, Artificial Sequence
  Synthetic Polynucleotide
taatacgactcactatagggtctttaaaattaatactgactacagtgttcaacagaggagagaacacatgagtcagtataacctggcggcagcgcaaaagatg

SEQ ID NO: 226831 - DNA, 103 bp, Artificial Sequence
  Synthetic Polynucleotide
taatacgactcactatagggaaactgtgggtctttaaaattaatactgacaacagaggagagtcagtatgaattttaaaaacctggcggcagcgcaaaagatg

SEQ ID NO: 226832 - DNA, 103 bp, Artificial Sequence
  Synthetic Polynucleotide
taatacgactcactatagggaatcttcagcaaactgtgggtctttaaaataacagaggagaattttaatgacccacagtaacctggcggcagcgcaaaagatg

SEQ ID NO: 226833 - DNA, 103 bp, Artificial Sequence
  Synthetic Polynucleotide
taatacgactcactatagggttaaaaatgtaatcttcagcaaactgtgggaacagaggagacccacaatgtgctgaagaaacctggcggcagcgcaaaagatg

SEQ ID NO: 226834 - DNA, 103 bp, Artificial Sequence
  Synthetic Polynucleotide
taatacgactcactatagggcattacagctttaaaaatgtaatcttcagcaacagaggagagctgaaatgtacatttttaacctggcggcagcgcaaaagatg

SEQ ID NO: 226835 - DNA, 103 bp, Artificial Sequence
  Synthetic Polynucleotide
taatacgactcactatagggactcaaaaattgcaaccatcatttcatcttaacagaggagaaagatgatgtgatggttgaacctggcggcagcgcaaaagatg

SEQ ID NO: 226836 - DNA, 103 bp, Artificial Sequence
  Synthetic Polynucleotide
taatacgactcactatagggctcctggaagcattacagctttaaaaatgtaacagaggagaacatttatgaagctgtaaaacctggcggcagcgcaaaagatg

SEQ ID NO: 226837 - DNA, 103 bp, Artificial Sequence
  Synthetic Polynucleotide
taatacgactcactatagggggctttcttgctcctggaagcattacagctaacagaggagaagctgtatggcttccaggaacctggcggcagcgcaaaagatg

SEQ ID NO: 226838 - DNA, 103 bp, Artificial Sequence
  Synthetic Polynucleotide
taatacgactcactatagggtactgctgctggctttcttgctcctggaagaacagaggagacttccaatggcaagaaagaacctggcggcagcgcaaaagatg

SEQ ID NO: 226839 - DNA, 103 bp, Artificial Sequence
  Synthetic Polynucleotide
taatacgactcactatagggtaggtttcagtactgctgctggctttcttgaacagaggagacaagaaatgcagcagcagaacctggcggcagcgcaaaagatg

SEQ ID NO: 226840 - DNA, 103 bp, Artificial Sequence
  Synthetic Polynucleotide
taatacgactcactatagggtcccagtcactaggtttcagtactgctgctaacagaggagaagcagcatgactgaaaccaacctggcggcagcgcaaaagatg

SEQ ID NO: 226841 - DNA, 103 bp, Artificial Sequence
  Synthetic Polynucleotide
taatacgactcactataggggctggatttttcccagtcactaggtttcagaacagaggagactgaaaatgagtgactggaacctggcggcagcgcaaaagatg

SEQ ID NO: 226842 - DNA, 103 bp, Artificial Sequence
  Synthetic Polynucleotide
taatacgactcactataggggccgtccattgctggatttttcccagtcacaacagaggagagtgactatgaaaaatccaaacctggcggcagcgcaaaagatg

SEQ ID NO: 226843 - DNA, 103 bp, Artificial Sequence
  Synthetic Polynucleotide
taatacgactcactatagggggcttccactgccgtccattgctggattttaacagaggagaaaaatcatgcaatggacgaacctggcggcagcgcaaaagatg

SEQ ID NO: 226844 - DNA, 103 bp, Artificial Sequence
  Synthetic Polynucleotide
taatacgactcactataggggccaagctgaggcttccactgccgtccattaacagaggagaaatggaatgcagtggaagaacctggcggcagcgcaaaagatg

SEQ ID NO: 226845 - DNA, 103 bp, Artificial Sequence
  Synthetic Polynucleotide
taatacgactcactatagggcacggttaaagccaagctgaggcttccactaacagaggagaagtggaatgctcagcttgaacctggcggcagcgcaaaagatg

SEQ ID NO: 226846 - DNA, 103 bp, Artificial Sequence
  Synthetic Polynucleotide
taatacgactcactatagggctgtcaatgtactcaaaaattgcaaccatcaacagaggagagatggtatgaatttttgaaacctggcggcagcgcaaaagatg

SEQ ID NO: 226847 - DNA, 103 bp, Artificial Sequence
  Synthetic Polynucleotide
taatacgactcactatagggggcctccggtcacggttaaagccaagctgaaacagaggagatcagctatgctttaaccgaacctggcggcagcgcaaaagatg

SEQ ID NO: 226848 - DNA, 103 bp, Artificial Sequence
  Synthetic Polynucleotide
taatacgactcactatagggcaggtgcacaggcctccggtcacggttaaaaacagaggagatttaacatggaccggaggaacctggcggcagcgcaaaagatg

SEQ ID NO: 226849 - DNA, 103 bp, Artificial Sequence
  Synthetic Polynucleotide
taatacgactcactatagggctgcctgatccaggtgcacaggcctccggtaacagaggagaaccggaatgctgtgcaccaacctggcggcagcgcaaaagatg

SEQ ID NO: 226850 - DNA, 103 bp, Artificial Sequence
  Synthetic Polynucleotide
taatacgactcactataggggtcctgaaggctgcctgatccaggtgcacaaacagaggagatgtgcaatgggatcaggcaacctggcggcagcgcaaaagatg

SEQ ID NO: 226851 - DNA, 103 bp, Artificial Sequence
  Synthetic Polynucleotide
taatacgactcactatagggatggcccaaagtcctgaaggctgcctgatcaacagaggagagatcagatggccttcaggaacctggcggcagcgcaaaagatg

SEQ ID NO: 226852 - DNA, 103 bp, Artificial Sequence
  Synthetic Polynucleotide
taatacgactcactatagggttggcatcacatggcccaaagtcctgaaggaacagaggagaccttcaatgctttgggccaacctggcggcagcgcaaaagatg

SEQ ID NO: 226853 - DNA, 103 bp, Artificial Sequence
  Synthetic Polynucleotide
taatacgactcactatagggcctgagcctcttggcatcacatggcccaaaaacagaggagatttgggatgtgtgatgccaacctggcggcagcgcaaaagatg

SEQ ID NO: 226854 - DNA, 103 bp, Artificial Sequence
  Synthetic Polynucleotide
taatacgactcactatagggaatgccagttcctgagcctcttggcatcacaacagaggagagtgatgatgagaggctcaaacctggcggcagcgcaaaagatg

SEQ ID NO: 226855 - DNA, 103 bp, Artificial Sequence
  Synthetic Polynucleotide
taatacgactcactatagggcattgctgtaaatgccagttcctgagcctcaacagaggagagaggctatggaactggcaaacctggcggcagcgcaaaagatg

SEQ ID NO: 226856 - DNA, 103 bp, Artificial Sequence
  Synthetic Polynucleotide
taatacgactcactatagggggtggtgcagcattgctgtaaatgccagttaacagaggagaaactggatgttacagcaaaacctggcggcagcgcaaaagatg

SEQ ID NO: 226857 - DNA, 103 bp, Artificial Sequence
  Synthetic Polynucleotide
taatacgactcactatagggactgaaaagtctgtcaatgtactcaaaaataacagaggagaatttttatgtacattgacaacctggcggcagcgcaaaagatg

SEQ ID NO: 226858 - DNA, 103 bp, Artificial Sequence
  Synthetic Polynucleotide
taatacgactcactatagggagtcacaggtggtggtgcagcattgctgtaaacagaggagatacagcatggctgcaccaaacctggcggcagcgcaaaagatg

SEQ ID NO: 226859 - DNA, 103 bp, Artificial Sequence
  Synthetic Polynucleotide
taatacgactcactatagggttccctggtaagtcacaggtggtggtgcagaacagaggagactgcacatgcacctgtgaaacctggcggcagcgcaaaagatg

SEQ ID NO: 226860 - DNA, 103 bp, Artificial Sequence
  Synthetic Polynucleotide
taatacgactcactatagggctgtataagtttccctggtaagtcacaggtaacagaggagaacctgtatgttaccagggaacctggcggcagcgcaaaagatg

SEQ ID NO: 226861 - DNA, 103 bp, Artificial Sequence
  Synthetic Polynucleotide
taatacgactcactatagggcaaaagcggcctgtataagtttccctggtaaacagaggagataccagatgaacttatacaacctggcggcagcgcaaaagatg

SEQ ID NO: 226862 - DNA, 103 bp, Artificial Sequence
  Synthetic Polynucleotide
taatacgactcactatagggcttgtcctctcaaaagcggcctgtataagtaacagaggagaacttatatgggccgctttaacctggcggcagcgcaaaagatg

SEQ ID NO: 226863 - DNA, 103 bp, Artificial Sequence
  Synthetic Polynucleotide
taatacgactcactatagggggaatctgggcttgtcctctcaaaagcggcaacagaggagagccgctatggagaggacaaacctggcggcagcgcaaaagatg

SEQ ID NO: 226864 - DNA, 103 bp, Artificial Sequence
  Synthetic Polynucleotide
taatacgactcactatagggcataagttttggaatctgggcttgtcctctaacagaggagaagaggaatggcccagattaacctggcggcagcgcaaaagatg

SEQ ID NO: 226865 - DNA, 103 bp, Artificial Sequence
  Synthetic Polynucleotide
taatacgactcactatagggtcatatttgacataagttttggaatctgggaacagaggagacccagaatgcaaaacttaaacctggcggcagcgcaaaagatg

SEQ ID NO: 226866 - DNA, 103 bp, Artificial Sequence
  Synthetic Polynucleotide
taatacgactcactatagggtcctggggcctcatatttgacataagttttaacagaggagaaaaactatggtcaaatataacctggcggcagcgcaaaagatg

SEQ ID NO: 226867 - DNA, 103 bp, Artificial Sequence
  Synthetic Polynucleotide
taatacgactcactatagggtcgccaggaatcctggggcctcatatttgaaacagaggagatcaaatatgaggccccagaacctggcggcagcgcaaaagatg

SEQ ID NO: 226868 - DNA, 103 bp, Artificial Sequence
  Synthetic Polynucleotide
taatacgactcactataggggtcttacaatactgaaaagtctgtcaatgtaacagaggagaacattgatggacttttcaaacctggcggcagcgcaaaagatg

SEQ ID NO: 226869 - DNA, 103 bp, Artificial Sequence
  Synthetic Polynucleotide
taatacgactcactataggggaggaggacctcgccaggaatcctggggccaacagaggagaggccccatgattcctggcaacctggcggcagcgcaaaagatg

SEQ ID NO: 226870 - DNA, 103 bp, Artificial Sequence
  Synthetic Polynucleotide
taatacgactcactatagggtggaaaaggggaggaggacctcgccaggaaaacagaggagattcctgatgaggtcctccaacctggcggcagcgcaaaagatg

SEQ ID NO: 226871 - DNA, 103 bp, Artificial Sequence
  Synthetic Polynucleotide
taatacgactcactatagggcctttgctgctggaaaaggggaggaggaccaacagaggagaggtcctatgccccttttcaacctggcggcagcgcaaaagatg

SEQ ID NO: 226872 - DNA, 103 bp, Artificial Sequence
  Synthetic Polynucleotide
taatacgactcactatagggctctgtcaaacctttgctgctggaaaagggaacagaggagaccctttatgagcagcaaaaacctggcggcagcgcaaaagatg

SEQ ID NO: 226873 - DNA, 103 bp, Artificial Sequence
  Synthetic Polynucleotide
taatacgactcactataggggccccaacgcctctgtcaaacctttgctgcaacagaggagagcagcaatggtttgacagaacctggcggcagcgcaaaagatg

SEQ ID NO: 226874 - DNA, 103 bp, Artificial Sequence
  Synthetic Polynucleotide
taatacgactcactatagggcagaggttcagccccaacgcctctgtcaaaaacagaggagatttgacatgggcgttgggaacctggcggcagcgcaaaagatg

SEQ ID NO: 226875 - DNA, 103 bp, Artificial Sequence
  Synthetic Polynucleotide
taatacgactcactatagggtccatgggagcagaggttcagccccaacgcaacagaggagagcgttgatgctgaacctcaacctggcggcagcgcaaaagatg

SEQ ID NO: 226876 - DNA, 103 bp, Artificial Sequence
  Synthetic Polynucleotide
taatacgactcactatagggagcatccggttccatgggagcagaggttcaaacagaggagatgaaccatggctcccatgaacctggcggcagcgcaaaagatg

SEQ ID NO: 226877 - DNA, 103 bp, Artificial Sequence
  Synthetic Polynucleotide
taatacgactcactatagggctgggtttgcagcatccggttccatgggagaacagaggagactcccaatgaaccggatgaacctggcggcagcgcaaaagatg

SEQ ID NO: 226878 - DNA, 103 bp, Artificial Sequence
  Synthetic Polynucleotide
taatacgactcactatagggaggctgcattctgggtttgcagcatccggtaacagaggagaaccggaatgtgcaaacccaacctggcggcagcgcaaaagatg

SEQ ID NO: 226879 - DNA, 103 bp, Artificial Sequence
  Synthetic Polynucleotide
taatacgactcactatagggagtcttcttggtcttacaatactgaaaagtaacagaggagaacttttatgtattgtaagaacctggcggcagcgcaaaagatg

SEQ ID NO: 226880 - DNA, 103 bp, Artificial Sequence
  Synthetic Polynucleotide
taatacgactcactatagggtttggctggaaggctgcattctgggtttgcaacagaggagagcaaacatggaatgcagcaacctggcggcagcgcaaaagatg

SEQ ID NO: 226881 - DNA, 103 bp, Artificial Sequence
  Synthetic Polynucleotide
taatacgactcactatagggctggtactggtttggctggaaggctgcattaacagaggagaaatgcaatgttccagccaaacctggcggcagcgcaaaagatg

SEQ ID NO: 226882 - DNA, 103 bp, Artificial Sequence
  Synthetic Polynucleotide
taatacgactcactatagggcagctagcatctggtactggtttggctggaaacagaggagatccagcatgaccagtaccaacctggcggcagcgcaaaagatg

SEQ ID NO: 226883 - DNA, 103 bp, Artificial Sequence
  Synthetic Polynucleotide
taatacgactcactatagggccaccaggcccagctagcatctggtactggaacagaggagaccagtaatggatgctagcaacctggcggcagcgcaaaagatg

SEQ ID NO: 226884 - DNA, 103 bp, Artificial Sequence
  Synthetic Polynucleotide
taatacgactcactataggggggtggatacccaccaggcccagctagcataacagaggagaatgctaatggggcctggtaacctggcggcagcgcaaaagatg

SEQ ID NO: 226885 - DNA, 103 bp, Artificial Sequence
  Synthetic Polynucleotide
taatacgactcactatagggcatctcgtctgggtggatacccaccaggccaacagaggagaggcctgatgggtatccacaacctggcggcagcgcaaaagatg

SEQ ID NO: 226886 - DNA, 103 bp, Artificial Sequence
  Synthetic Polynucleotide
taatacgactcactatagggcctccacgatcatctcgtctgggtggatacaacagaggagagtatccatgcagacgagaaacctggcggcagcgcaaaagatg

SEQ ID NO: 226887 - DNA, 103 bp, Artificial Sequence
  Synthetic Polynucleotide
taatacgactcactatagggtccctgtctccctccacgatcatctcgtctaacagaggagaagacgaatggatcgtggaaacctggcggcagcgcaaaagatg

SEQ ID NO: 226888 - DNA, 103 bp, Artificial Sequence
  Synthetic Polynucleotide
taatacgactcactatagggctctgggatatccctgtctccctccacgataacagaggagaatcgtgatgggagacaggaacctggcggcagcgcaaaagatg

SEQ ID NO: 226889 - DNA, 103 bp, Artificial Sequence
  Synthetic Polynucleotide
taatacgactcactatagggttccttccttctctgggatatccctgtctcaacagaggagagagacaatgatatcccagaacctggcggcagcgcaaaagatg

SEQ ID NO: 226890 - DNA, 103 bp, Artificial Sequence
  Synthetic Polynucleotide
taatacgactcactatagggcatgtagagaagtcttcttggtcttacaataacagaggagaattgtaatgccaagaagaaacctggcggcagcgcaaaagatg

SEQ ID NO: 226891 - DNA, 103 bp, Artificial Sequence
  Synthetic Polynucleotide
taatacgactcactatagggcaaagggtatttccttccttctctgggataaacagaggagatatcccatggaaggaaggaacctggcggcagcgcaaaagatg

SEQ ID NO: 226892 - DNA, 103 bp, Artificial Sequence
  Synthetic Polynucleotide
taatacgactcactatagggagggtggtggcaaagggtatttccttccttaacagaggagaaaggaaatgaatacccttaacctggcggcagcgcaaaagatg

SEQ ID NO: 226893 - DNA, 103 bp, Artificial Sequence
  Synthetic Polynucleotide
taatacgactcactatagggtatcttcctgagggtggtggcaaagggtataacagaggagaatacccatggccaccaccaacctggcggcagcgcaaaagatg

SEQ ID NO: 226894 - DNA, 103 bp, Artificial Sequence
  Synthetic Polynucleotide
taatacgactcactatagggattccaattgtatcttcctgagggtggtggaacagaggagaccaccaatgtcaggaagaaacctggcggcagcgcaaaagatg

SEQ ID NO: 226895 - DNA, 103 bp, Artificial Sequence
  Synthetic Polynucleotide
taatacgactcactatagggcatctattgccatgtagagaagtcttcttgaacagaggagacaagaaatgttctctacaaacctggcggcagcgcaaaagatg

SEQ ID NO: 226896 - DNA, 103 bp, Artificial Sequence
  Synthetic Polynucleotide
taatacgactcactatagggatggacgggtacttgcggctgagccagcggaacagaggagaccgctgatgcagccgcaaaacctggcggcagcgcaaaagatg

SEQ ID NO: 226897 - DNA, 103 bp, Artificial Sequence
  Synthetic Polynucleotide
taatacgactcactatagggggtgccactccatctattgccatgtagagaaacagaggagatctctaatgggcaatagaaacctggcggcagcgcaaaagatg

SEQ ID NO: 226898 - DNA, 103 bp, Artificial Sequence
  Synthetic Polynucleotide
taatacgactcactatagggtttagcacgtggtgccactccatctattgcaacagaggagagcaataatgggagtggcaaacctggcggcagcgcaaaagatg

SEQ ID NO: 226899 - DNA, 103 bp, Artificial Sequence
  Synthetic Polynucleotide
taatacgactcactataggggctggttcattttagcacgtggtgccactcaacagaggagagagtggatgcacgtgctaaacctggcggcagcgcaaaagatg

SEQ ID NO: 226900 - DNA, 103 bp, Artificial Sequence
  Synthetic Polynucleotide
taatacgactcactatagggcttgaacgctgctggttcattttagcacgtaacagaggagaacgtgcatgaatgaaccaaacctggcggcagcgcaaaagatg

SEQ ID NO: 226901 - DNA, 103 bp, Artificial Sequence
  Synthetic Polynucleotide
taatacgactcactatagggcctgaacctccttgaacgctgctggttcataacagaggagaatgaacatgcagcgttcaaacctggcggcagcgcaaaagatg

SEQ ID NO: 226902 - DNA, 103 bp, Artificial Sequence
  Synthetic Polynucleotide
taatacgactcactatagggcttttgatgccctgaacctccttgaacgctaacagaggagaagcgttatgggaggttcaaacctggcggcagcgcaaaagatg

SEQ ID NO: 226903 - DNA, 103 bp, Artificial Sequence
  Synthetic Polynucleotide
taatacgactcactatagggtccattccttcttttgatgccctgaacctcaacagaggagagaggttatgggcatcaaaaacctggcggcagcgcaaaagatg

SEQ ID NO: 226904 - DNA, 103 bp, Artificial Sequence
  Synthetic Polynucleotide
taatacgactcactataggggactgctgcttccattccttcttttgatgcaacagaggagagcatcaatggaaggaatgaacctggcggcagcgcaaaagatg

SEQ ID NO: 226905 - DNA, 103 bp, Artificial Sequence
  Synthetic Polynucleotide
taatacgactcactataggggctgcttctcgactgctgcttccattccttaacagaggagaaaggaaatgaagcagcagaacctggcggcagcgcaaaagatg

SEQ ID NO: 226906 - DNA, 103 bp, Artificial Sequence
  Synthetic Polynucleotide
taatacgactcactatagggtccctgactcgctgcttctcgactgctgctaacagaggagaagcagcatgcgagaagcaaacctggcggcagcgcaaaagatg

SEQ ID NO: 226907 - DNA, 103 bp, Artificial Sequence
  Synthetic Polynucleotide
taatacgactcactataggggttgactatgatggacgggtacttgcggctaacagaggagaagccgcatgtacccgtccaacctggcggcagcgcaaaagatg

SEQ ID NO: 226908 - DNA, 103 bp, Artificial Sequence
  Synthetic Polynucleotide
taatacgactcactatagggcaatatttcttccctgactcgctgcttctcaacagaggagagagaagatgcgagtcaggaacctggcggcagcgcaaaagatg

SEQ ID NO: 226909 - DNA, 103 bp, Artificial Sequence
  Synthetic Polynucleotide
taatacgactcactatagggcaccttttgccaatatttcttccctgactcaacagaggagagagtcaatgaagaaatataacctggcggcagcgcaaaagatg

SEQ ID NO: 226910 - DNA, 103 bp, Artificial Sequence
  Synthetic Polynucleotide
taatacgactcactatagggggaagaaagccaccttttgccaatatttctaacagaggagaagaaatatgggcaaaaggaacctggcggcagcgcaaaagatg

SEQ ID NO: 226911 - DNA, 103 bp, Artificial Sequence
  Synthetic Polynucleotide
taatacgactcactatagggttcttctggaggaagaaagccaccttttgcaacagaggagagcaaaaatgggctttcttaacctggcggcagcgcaaaagatg

SEQ ID NO: 226912 - DNA, 103 bp, Artificial Sequence
  Synthetic Polynucleotide
taatacgactcactatagggtttcttttatttcttctggaggaagaaagcaacagaggagagctttcatgctccagaagaacctggcggcagcgcaaaagatg

SEQ ID NO: 226913 - DNA, 103 bp, Artificial Sequence
  Synthetic Polynucleotide
taatacgactcactatagggctgtcaaatctttcttttatttcttctggaaacagaggagatccagaatgaataaaagaaacctggcggcagcgcaaaagatg

SEQ ID NO: 226914 - DNA, 103 bp, Artificial Sequence
  Synthetic Polynucleotide
taatacgactcactatagggaatacagttgctgtcaaatctttcttttataacagaggagaataaaaatgagatttgacaacctggcggcagcgcaaaagatg

SEQ ID NO: 226915 - DNA, 103 bp, Artificial Sequence
  Synthetic Polynucleotide
taatacgactcactatagggttcctggtgtaatacagttgctgtcaaatcaacagaggagagatttgatggcaactgtaaacctggcggcagcgcaaaagatg

SEQ ID NO: 226916 - DNA, 103 bp, Artificial Sequence
  Synthetic Polynucleotide
taatacgactcactatagggatgaattcagttcctggtgtaatacagttgaacagaggagacaactgatgtacaccaggaacctggcggcagcgcaaaagatg

SEQ ID NO: 226917 - DNA, 103 bp, Artificial Sequence
  Synthetic Polynucleotide
taatacgactcactatagggaagattgtccatgaattcagttcctggtgtaacagaggagaacaccaatgactgaattcaacctggcggcagcgcaaaagatg

SEQ ID NO: 226918 - DNA, 103 bp, Artificial Sequence
  Synthetic Polynucleotide
taatacgactcactatagggcttccacgcagttgactatgatggacgggtaacagaggagaacccgtatgtcatagtcaaacctggcggcagcgcaaaagatg

SEQ ID NO: 226919 - DNA, 103 bp, Artificial Sequence
  Synthetic Polynucleotide
taatacgactcactatagggggcatttagcaagattgtccatgaattcagaacagaggagactgaatatgtggacaatcaacctggcggcagcgcaaaagatg

SEQ ID NO: 226920 - DNA, 103 bp, Artificial Sequence
  Synthetic Polynucleotide
taatacgactcactatagggtaatagcgaaggcatttagcaagattgtccaacagaggagaggacaaatgtgctaaatgaacctggcggcagcgcaaaagatg

SEQ ID NO: 226921 - DNA, 103 bp, Artificial Sequence
  Synthetic Polynucleotide
taatacgactcactatagggatcagctatgtaatagcgaaggcatttagcaacagaggagagctaaaatgcttcgctataacctggcggcagcgcaaaagatg

SEQ ID NO: 226922 - DNA, 103 bp, Artificial Sequence
  Synthetic Polynucleotide
taatacgactcactatagggtatttaaacgatcagctatgtaatagcgaaaacagaggagattcgctatgacatagctgaacctggcggcagcgcaaaagatg

SEQ ID NO: 226923 - DNA, 103 bp, Artificial Sequence
  Synthetic Polynucleotide
taatacgactcactatagggccagggtcattatttaaacgatcagctatgaacagaggagacatagcatgtcgtttaaaaacctggcggcagcgcaaaagatg

SEQ ID NO: 226924 - DNA, 103 bp, Artificial Sequence
  Synthetic Polynucleotide
taatacgactcactatagggatttttccacccagggtcattatttaaacgaacagaggagacgtttaatgaatgaccctaacctggcggcagcgcaaaagatg

SEQ ID NO: 226925 - DNA, 103 bp, Artificial Sequence
  Synthetic Polynucleotide
taatacgactcactatagggtaactgtcaaatttttccacccagggtcataacagaggagaatgaccatgggtggaaaaaacctggcggcagcgcaaaagatg

SEQ ID NO: 226926 - DNA, 103 bp, Artificial Sequence
  Synthetic Polynucleotide
taatacgactcactatagggtcagataaaataactgtcaaatttttccacaacagaggagagtggaaatgtttgacagtaacctggcggcagcgcaaaagatg

SEQ ID NO: 226927 - DNA, 103 bp, Artificial Sequence
  Synthetic Polynucleotide
taatacgactcactatagggagcactagcatcagataaaataactgtcaaaacagaggagattgacaatgattttatctaacctggcggcagcgcaaaagatg

SEQ ID NO: 226928 - DNA, 103 bp, Artificial Sequence
  Synthetic Polynucleotide
taatacgactcactatagggcttcaccaggagcactagcatcagataaaaaacagaggagattttatatgatgctagtgaacctggcggcagcgcaaaagatg

SEQ ID NO: 226929 - DNA, 103 bp, Artificial Sequence
  Synthetic Polynucleotide
taatacgactcactatagggtttggcttctcttccacgcagttgactatgaacagaggagacatagtatgctgcgtggaaacctggcggcagcgcaaaagatg

SEQ ID NO: 226930 - DNA, 103 bp, Artificial Sequence
  Synthetic Polynucleotide
taatacgactcactatagggttatgttctccttcaccaggagcactagcaaacagaggagatgctagatgtcctggtgaaacctggcggcagcgcaaaagatg

SEQ ID NO: 226931 - DNA, 103 bp, Artificial Sequence
  Synthetic Polynucleotide
taatacgactcactatagggatccatgattttatgttctccttcaccaggaacagaggagacctggtatgggagaacataacctggcggcagcgcaaaagatg

SEQ ID NO: 226932 - DNA, 103 bp, Artificial Sequence
  Synthetic Polynucleotide
taatacgactcactatagggttctaatgtaatccatgattttatgttctcaacagaggagagagaacatgaaatcatggaacctggcggcagcgcaaaagatg

SEQ ID NO: 226933 - DNA, 103 bp, Artificial Sequence
  Synthetic Polynucleotide
taatacgactcactataggggctctttgccttctaatgtaatccatgattaacagaggagaaatcatatgttacattagaacctggcggcagcgcaaaagatg

SEQ ID NO: 226934 - DNA, 103 bp, Artificial Sequence
  Synthetic Polynucleotide
taatacgactcactataggggttaggctgggctctttgccttctaatgtaaacagaggagatacattatgaggcaaagaaacctggcggcagcgcaaaagatg

SEQ ID NO: 226935 - DNA, 103 bp, Artificial Sequence
  Synthetic Polynucleotide
taatacgactcactatagggttgggtcatggttaggctgggctctttgccaacagaggagaggcaaaatgcccagcctaaacctggcggcagcgcaaaagatg

SEQ ID NO: 226936 - DNA, 103 bp, Artificial Sequence
  Synthetic Polynucleotide
taatacgactcactatagggtgatgagtatttgggtcatggttaggctggaacagaggagaccagccatgccatgacccaacctggcggcagcgcaaaagatg

SEQ ID NO: 226937 - DNA, 103 bp, Artificial Sequence
  Synthetic Polynucleotide
taatacgactcactatagggacataaacaatgatgagtatttgggtcatgaacagaggagacatgacatgaatactcataacctggcggcagcgcaaaagatg

SEQ ID NO: 226938 - DNA, 103 bp, Artificial Sequence
  Synthetic Polynucleotide
taatacgactcactatagggcatctgctccacataaacaatgatgagtataacagaggagaatactcatgattgtttataacctggcggcagcgcaaaagatg

SEQ ID NO: 226939 - DNA, 103 bp, Artificial Sequence
  Synthetic Polynucleotide
taatacgactcactatagggatgagatcagcatctgctccacataaacaaaacagaggagattgtttatgtggagcagaaacctggcggcagcgcaaaagatg

SEQ ID NO: 226940 - DNA, 103 bp, Artificial Sequence
  Synthetic Polynucleotide
taatacgactcactatagggattgcattcttttggcttctcttccacgcaaacagaggagatgcgtgatggagaagccaaacctggcggcagcgcaaaagatg

SEQ ID NO: 226941 - DNA, 103 bp, Artificial Sequence
  Synthetic Polynucleotide
taatacgactcactataggggccaagcataatgagatcagcatctgctccaacagaggagaggagcaatggctgatctcaacctggcggcagcgcaaaagatg

SEQ ID NO: 226942 - DNA, 103 bp, Artificial Sequence
  Synthetic Polynucleotide
taatacgactcactataggggtgtggcaaggccaagcataatgagatcagaacagaggagactgatcatgttatgcttgaacctggcggcagcgcaaaagatg

SEQ ID NO: 226943 - DNA, 103 bp, Artificial Sequence
  Synthetic Polynucleotide
taatacgactcactatagggttcggttcatgtgtggcaaggccaagcataaacagaggagatatgctatgccttgccacaacctggcggcagcgcaaaagatg

SEQ ID NO: 226944 - DNA, 103 bp, Artificial Sequence
  Synthetic Polynucleotide
taatacgactcactatagggaatggtaaagttcggttcatgtgtggcaagaacagaggagacttgccatgcatgaaccgaacctggcggcagcgcaaaagatg

SEQ ID NO: 226945 - DNA, 103 bp, Artificial Sequence
  Synthetic Polynucleotide
taatacgactcactatagggcttctctaataatggtaaagttcggttcataacagaggagaatgaacatgactttaccaaacctggcggcagcgcaaaagatg

SEQ ID NO: 226946 - DNA, 103 bp, Artificial Sequence
  Synthetic Polynucleotide
taatacgactcactatagggggtttgaattcttctctaataatggtaaagaacagaggagactttacatgtattagagaaacctggcggcagcgcaaaagatg

SEQ ID NO: 226947 - DNA, 103 bp, Artificial Sequence
  Synthetic Polynucleotide
taatacgactcactataggggggcttgtttggtttgaattcttctctaataacagaggagaattagaatggaattcaaaaacctggcggcagcgcaaaagatg

SEQ ID NO: 226948 - DNA, 103 bp, Artificial Sequence
  Synthetic Polynucleotide
taatacgactcactatagggcacatggtttgggcttgtttggtttgaattaacagaggagaaattcaatgcaaacaagcaacctggcggcagcgcaaaagatg

SEQ ID NO: 226949 - DNA, 103 bp, Artificial Sequence
  Synthetic Polynucleotide
taatacgactcactatagggttacaaagaccacatggtttgggcttgtttaacagaggagaaaacaaatgcaaaccatgaacctggcggcagcgcaaaagatg

SEQ ID NO: 226950 - DNA, 103 bp, Artificial Sequence
  Synthetic Polynucleotide
taatacgactcactatagggtccaaactgattacaaagaccacatggtttaacagaggagaaaaccaatgggtctttgtaacctggcggcagcgcaaaagatg

SEQ ID NO: 226951 - DNA, 103 bp, Artificial Sequence
  Synthetic Polynucleotide
taatacgactcactatagggtctttacaccattgcattcttttggcttctaacagaggagaagaagcatgaagaatgcaaacctggcggcagcgcaaaagatg

SEQ ID NO: 226952 - DNA, 103 bp, Artificial Sequence
  Synthetic Polynucleotide
taatacgactcactatagggtgacctcatgtccaaactgattacaaagacaacagaggagagtctttatgatcagtttgaacctggcggcagcgcaaaagatg

SEQ ID NO: 226953 - DNA, 103 bp, Artificial Sequence
  Synthetic Polynucleotide
taatacgactcactatagggtcacaatctttgacctcatgtccaaactgaaacagaggagatcagttatgacatgaggtaacctggcggcagcgcaaaagatg

SEQ ID NO: 226954 - DNA, 103 bp, Artificial Sequence
  Synthetic Polynucleotide
taatacgactcactatagggtggcaaaccttcacaatctttgacctcatgaacagaggagacatgagatgaaagattgtaacctggcggcagcgcaaaagatg

SEQ ID NO: 226955 - DNA, 103 bp, Artificial Sequence
  Synthetic Polynucleotide
taatacgactcactatagggtcttttctcttggcaaaccttcacaatcttaacagaggagaaagattatgaaggtttgcaacctggcggcagcgcaaaagatg

SEQ ID NO: 226956 - DNA, 103 bp, Artificial Sequence
  Synthetic Polynucleotide
taatacgactcactatagggtgctttcccttcttttctcttggcaaacctaacagaggagaaggtttatgaagagaaaaaacctggcggcagcgcaaaagatg

SEQ ID NO: 226957 - DNA, 103 bp, Artificial Sequence
  Synthetic Polynucleotide
taatacgactcactatagggaagttcatcatgctttcccttcttttctctaacagaggagaagagaaatgaagggaaagaacctggcggcagcgcaaaagatg

SEQ ID NO: 226958 - DNA, 103 bp, Artificial Sequence
  Synthetic Polynucleotide
taatacgactcactataggggactatcggcaagttcatcatgctttccctaacagaggagaagggaaatgatgatgaacaacctggcggcagcgcaaaagatg

SEQ ID NO: 226959 - DNA, 103 bp, Artificial Sequence
  Synthetic Polynucleotide
taatacgactcactataggggcacaaggaagactatcggcaagttcatcaaacagaggagatgatgaatgtgccgatagaacctggcggcagcgcaaaagatg

SEQ ID NO: 226960 - DNA, 103 bp, Artificial Sequence
  Synthetic Polynucleotide
taatacgactcactatagggctctccttctgcacaaggaagactatcggcaacagaggagagccgatatgcttccttgtaacctggcggcagcgcaaaagatg

SEQ ID NO: 226961 - DNA, 103 bp, Artificial Sequence
  Synthetic Polynucleotide
taatacgactcactatagggggaagataaactctccttctgcacaaggaaaacagaggagattccttatgcagaaggagaacctggcggcagcgcaaaagatg

SEQ ID NO: 226962 - DNA, 103 bp, Artificial Sequence
  Synthetic Polynucleotide
taatacgactcactatagggtcaactggaatctttacaccattgcattctaacagaggagaagaatgatgtggtgtaaaaacctggcggcagcgcaaaagatg

SEQ ID NO: 226963 - DNA, 103 bp, Artificial Sequence
  Synthetic Polynucleotide
taatacgactcactatagggttaagccgaaggaagataaactctccttctaacagaggagaagaaggatggtttatcttaacctggcggcagcgcaaaagatg

SEQ ID NO: 226964 - DNA, 103 bp, Artificial Sequence
  Synthetic Polynucleotide
taatacgactcactatagggacgaagaacattaagccgaaggaagataaaaacagaggagatttatcatgcttcggcttaacctggcggcagcgcaaaagatg

SEQ ID NO: 226965 - DNA, 103 bp, Artificial Sequence
  Synthetic Polynucleotide
taatacgactcactatagggccaaatactcacgaagaacattaagccgaaaacagaggagattcggcatgatgttcttcaacctggcggcagcgcaaaagatg

SEQ ID NO: 226966 - DNA, 103 bp, Artificial Sequence
  Synthetic Polynucleotide
taatacgactcactatagggagttctctttccaaatactcacgaagaacaaacagaggagatgttctatgtgagtatttaacctggcggcagcgcaaaagatg

SEQ ID NO: 226967 - DNA, 103 bp, Artificial Sequence
  Synthetic Polynucleotide
taatacgactcactatagggggccattgtgagttctctttccaaatactcaacagaggagagagtatatggaaagagaaaacctggcggcagcgcaaaagatg

SEQ ID NO: 226968 - DNA, 103 bp, Artificial Sequence
  Synthetic Polynucleotide
taatacgactcactatagggatggtaggctggccattgtgagttctctttaacagaggagaaaagagatgtcacaatggaacctggcggcagcgcaaaagatg

SEQ ID NO: 226969 - DNA, 103 bp, Artificial Sequence
  Synthetic Polynucleotide
taatacgactcactatagggtcaaatgtgaatggtaggctggccattgtgaacagaggagacacaatatgcagcctaccaacctggcggcagcgcaaaagatg

SEQ ID NO: 226970 - DNA, 103 bp, Artificial Sequence
  Synthetic Polynucleotide
taatacgactcactatagggcctctcaacatcaaatgtgaatggtaggctaacagaggagaagcctaatgttcacatttaacctggcggcagcgcaaaagatg

SEQ ID NO: 226971 - DNA, 103 bp, Artificial Sequence
  Synthetic Polynucleotide
taatacgactcactatagggcatcaatgctcctctcaacatcaaatgtgaaacagaggagatcacatatgatgttgagaaacctggcggcagcgcaaaagatg

SEQ ID NO: 226972 - DNA, 103 bp, Artificial Sequence
  Synthetic Polynucleotide
taatacgactcactatagggaaaacccagtcatcaatgctcctctcaacaaacagaggagatgttgaatggagcattgaaacctggcggcagcgcaaaagatg

SEQ ID NO: 226973 - DNA, 103 bp, Artificial Sequence
  Synthetic Polynucleotide
taatacgactcactatagggttgaggcggcggctgctgcccgggatccataacagaggagaatggatatggggcagcagaacctggcggcagcgcaaaagatg

SEQ ID NO: 226974 - DNA, 103 bp, Artificial Sequence
  Synthetic Polynucleotide
taatacgactcactatagggcgccgcgggtgccggttgcccgggtccggaaacagaggagatccggaatggggcaaccgaacctggcggcagcgcaaaagatg

SEQ ID NO: 226975 - DNA, 103 bp, Artificial Sequence
  Synthetic Polynucleotide
taatacgactcactatagggagaatttgctgtgctgggattgatattccgaacagaggagacggaatatgaatcccagcaacctggcggcagcgcaaaagatg

SEQ ID NO: 226976 - DNA, 103 bp, Artificial Sequence
  Synthetic Polynucleotide
taatacgactcactataggggacattttggagaatttgctgtgctgggataacagaggagaatcccaatgcagcaaattaacctggcggcagcgcaaaagatg

SEQ ID NO: 226977 - DNA, 103 bp, Artificial Sequence
  Synthetic Polynucleotide
taatacgactcactataggggctaactcctgacattttggagaatttgctaacagaggagaagcaaaatgtccaaaatgaacctggcggcagcgcaaaagatg

SEQ ID NO: 226978 - DNA, 103 bp, Artificial Sequence
  Synthetic Polynucleotide
taatacgactcactataggggctacgcagggctaactcctgacattttggaacagaggagaccaaaaatgcaggagttaaacctggcggcagcgcaaaagatg

SEQ ID NO: 226979 - DNA, 103 bp, Artificial Sequence
  Synthetic Polynucleotide
taatacgactcactatagggttggtaactggctacgcagggctaactcctaacagaggagaaggagtatgccctgcgtaaacctggcggcagcgcaaaagatg

SEQ ID NO: 226980 - DNA, 103 bp, Artificial Sequence
  Synthetic Polynucleotide
taatacgactcactatagggtgctccagtgttggtaactggctacgcaggaacagaggagacctgcgatgccagttaccaacctggcggcagcgcaaaagatg

SEQ ID NO: 226981 - DNA, 103 bp, Artificial Sequence
  Synthetic Polynucleotide
taatacgactcactatagggcccaccatcctgctccagtgttggtaactgaacagaggagacagttaatgacactggagaacctggcggcagcgcaaaagatg

SEQ ID NO: 226982 - DNA, 103 bp, Artificial Sequence
  Synthetic Polynucleotide
taatacgactcactataggggattttgagtcccaccatcctgctccagtgaacagaggagacactggatgaggatggtgaacctggcggcagcgcaaaagatg

SEQ ID NO: 226983 - DNA, 103 bp, Artificial Sequence
  Synthetic Polynucleotide
taatacgactcactataggggaagacactggattttgagtcccaccatccaacagaggagaggatggatggactcaaaaaacctggcggcagcgcaaaagatg

SEQ ID NO: 226984 - DNA, 103 bp, Artificial Sequence
  Synthetic Polynucleotide
taatacgactcactatagggcatcccgggagaagacactggattttgagtaacagaggagaactcaaatgccagtgtctaacctggcggcagcgcaaaagatg

SEQ ID NO: 226985 - DNA, 103 bp, Artificial Sequence
  Synthetic Polynucleotide
taatacgactcactatagggccgcctgggtcgccgcgggtgccggttgccaacagaggagaggcaacatgcacccgcggaacctggcggcagcgcaaaagatg

SEQ ID NO: 226986 - DNA, 103 bp, Artificial Sequence
  Synthetic Polynucleotide
taatacgactcactatagggattcctgagacatcccgggagaagacactgaacagaggagacagtgtatgctcccgggaaacctggcggcagcgcaaaagatg

SEQ ID NO: 226987 - DNA, 103 bp, Artificial Sequence
  Synthetic Polynucleotide
taatacgactcactatagggattgttctcaattcctgagacatcccgggaaacagaggagatcccggatggtctcaggaaacctggcggcagcgcaaaagatg

SEQ ID NO: 226988 - DNA, 103 bp, Artificial Sequence
  Synthetic Polynucleotide
taatacgactcactatagggattggtcgtcattgttctcaattcctgagaaacagaggagatctcagatgttgagaacaaacctggcggcagcgcaaaagatg

SEQ ID NO: 226989 - DNA, 103 bp, Artificial Sequence
  Synthetic Polynucleotide
taatacgactcactataggggatctgagctattggtcgtcattgttctcaaacagaggagatgagaaatgtgacgaccaaacctggcggcagcgcaaaagatg

SEQ ID NO: 226990 - DNA, 103 bp, Artificial Sequence
  Synthetic Polynucleotide
taatacgactcactatagggttaaggaaaggatctgagctattggtcgtcaacagaggagagacgacatgtagctcagaaacctggcggcagcgcaaaagatg

SEQ ID NO: 226991 - DNA, 103 bp, Artificial Sequence
  Synthetic Polynucleotide
taatacgactcactatagggggtgccactgttaaggaaaggatctgagctaacagaggagaagctcaatgcctttccttaacctggcggcagcgcaaaagatg

SEQ ID NO: 226992 - DNA, 103 bp, Artificial Sequence
  Synthetic Polynucleotide
taatacgactcactataggggagagtgataggtgccactgttaaggaaagaacagaggagactttccatgacagtggcaaacctggcggcagcgcaaaagatg

SEQ ID NO: 226993 - DNA, 103 bp, Artificial Sequence
  Synthetic Polynucleotide
taatacgactcactatagggctctcatctcgagagtgataggtgccactgaacagaggagacagtggatgctatcactcaacctggcggcagcgcaaaagatg

SEQ ID NO: 226994 - DNA, 103 bp, Artificial Sequence
  Synthetic Polynucleotide
taatacgactcactatagggactgtctgtactctcatctcgagagtgataaacagaggagatatcacatgcgagatgagaacctggcggcagcgcaaaagatg

SEQ ID NO: 226995 - DNA, 103 bp, Artificial Sequence
  Synthetic Polynucleotide
taatacgactcactatagggtgcttagtccactgtctgtactctcatctcaacagaggagagagatgatggtacagacaaacctggcggcagcgcaaaagatg

SEQ ID NO: 226996 - DNA, 103 bp, Artificial Sequence
  Synthetic Polynucleotide
taatacgactcactataggggcctgcggcgccgcctgggtcgccgcgggtaacagaggagaacccgcatggacccaggcaacctggcggcagcgcaaaagatg

SEQ ID NO: 226997 - DNA, 103 bp, Artificial Sequence
  Synthetic Polynucleotide
taatacgactcactatagggtagctgctcatgcttagtccactgtctgtaaacagaggagatacagaatgtggactaagaacctggcggcagcgcaaaagatg

SEQ ID NO: 226998 - DNA, 103 bp, Artificial Sequence
  Synthetic Polynucleotide
taatacgactcactatagggagggacactgtagctgctcatgcttagtccaacagaggagaggactaatgatgagcagcaacctggcggcagcgcaaaagatg

SEQ ID NO: 226999 - DNA, 103 bp, Artificial Sequence
  Synthetic Polynucleotide
taatacgactcactatagggctggggttcgagggacactgtagctgctcaaacagaggagatgagcaatgacagtgtccaacctggcggcagcgcaaaagatg

SEQ ID NO: 227000 - DNA, 103 bp, Artificial Sequence
  Synthetic Polynucleotide
taatacgactcactatagggaggaagtcatctggggttcgagggacactgaacagaggagacagtgtatgtcgaaccccaacctggcggcagcgcaaaagatg

SEQ ID NO: 227001 - DNA, 103 bp, Artificial Sequence
  Synthetic Polynucleotide
taatacgactcactatagggcacactgttcaggaagtcatctggggttcgaacagaggagacgaaccatggatgacttcaacctggcggcagcgcaaaagatg

SEQ ID NO: 227002 - DNA, 103 bp, Artificial Sequence
  Synthetic Polynucleotide
taatacgactcactatagggccatctcatccacactgttcaggaagtcataacagaggagaatgactatgtgaacagtgaacctggcggcagcgcaaaagatg

SEQ ID NO: 227003 - DNA, 103 bp, Artificial Sequence
  Synthetic Polynucleotide
taatacgactcactatagggtcacctgtatccatctcatccacactgttcaacagaggagagaacagatgggatgagataacctggcggcagcgcaaaagatg

SEQ ID NO: 227004 - DNA, 103 bp, Artificial Sequence
  Synthetic Polynucleotide
taatacgactcactataggggttgatagtatcacctgtatccatctcatcaacagaggagagatgagatggatacaggtaacctggcggcagcgcaaaagatg

SEQ ID NO: 227005 - DNA, 103 bp, Artificial Sequence
  Synthetic Polynucleotide
taatacgactcactataggggggtgctttggttgatagtatcacctgtataacagaggagaatacagatgatactatcaaacctggcggcagcgcaaaagatg

SEQ ID NO: 227006 - DNA, 103 bp, Artificial Sequence
  Synthetic Polynucleotide
taatacgactcactatagggtgtgagggcagggtgctttggttgatagtaaacagaggagatactatatgccaaagcacaacctggcggcagcgcaaaagatg

SEQ ID NO: 227007 - DNA, 103 bp, Artificial Sequence
  Synthetic Polynucleotide
taatacgactcactatagggggcggggggtgcctgcggcgccgcctgggtaacagaggagaacccagatggcgccgcagaacctggcggcagcgcaaaagatg

SEQ ID NO: 227008 - DNA, 103 bp, Artificial Sequence
  Synthetic Polynucleotide
taatacgactcactatagggacggttctgctgtgagggcagggtgctttgaacagaggagacaaagcatgctgccctcaaacctggcggcagcgcaaaagatg

SEQ ID NO: 227009 - DNA, 103 bp, Artificial Sequence
  Synthetic Polynucleotide
taatacgactcactatagggagtctgggaaacggttctgctgtgagggcaaacagaggagatgccctatgagcagaaccaacctggcggcagcgcaaaagatg

SEQ ID NO: 227010 - DNA, 103 bp, Artificial Sequence
  Synthetic Polynucleotide
taatacgactcactataggggcttcaaggtagtctgggaaacggttctgcaacagaggagagcagaaatgtttcccagaaacctggcggcagcgcaaaagatg

SEQ ID NO: 227011 - DNA, 103 bp, Artificial Sequence
  Synthetic Polynucleotide
taatacgactcactatagggcccaggaatggcttcaaggtagtctgggaaaacagaggagattcccaatgtaccttgaaaacctggcggcagcgcaaaagatg

SEQ ID NO: 227012 - DNA, 103 bp, Artificial Sequence
  Synthetic Polynucleotide
taatacgactcactatagggccacatttgtcccaggaatggcttcaaggtaacagaggagaaccttgatgccattcctgaacctggcggcagcgcaaaagatg

SEQ ID NO: 227013 - DNA, 103 bp, Artificial Sequence
  Synthetic Polynucleotide
taatacgactcactataggggttccaaggtccacatttgtcccaggaatgaacagaggagacattccatggacaaatgtaacctggcggcagcgcaaaagatg

SEQ ID NO: 227014 - DNA, 103 bp, Artificial Sequence
  Synthetic Polynucleotide
taatacgactcactatagggtccttccagtgttccaaggtccacatttgtaacagaggagaacaaatatggaccttggaaacctggcggcagcgcaaaagatg

SEQ ID NO: 227015 - DNA, 103 bp, Artificial Sequence
  Synthetic Polynucleotide
taatacgactcactatagggtcattccatctccttccagtgttccaaggtaacagaggagaaccttgatgcactggaagaacctggcggcagcgcaaaagatg

SEQ ID NO: 227016 - DNA, 103 bp, Artificial Sequence
  Synthetic Polynucleotide
taatacgactcactatagggccttctatgttcattccatctccttccagtaacagaggagaactggaatgagatggaataacctggcggcagcgcaaaagatg

SEQ ID NO: 227017 - DNA, 103 bp, Artificial Sequence
  Synthetic Polynucleotide
taatacgactcactatagggcagctcctctccttctatgttcattccatcaacagaggagagatggaatgaacatagaaaacctggcggcagcgcaaaagatg

SEQ ID NO: 227018 - DNA, 103 bp, Artificial Sequence
  Synthetic Polynucleotide
taatacgactcactatagggtctgatgcccggcggggggtgcctgcggcgaacagaggagacgccgcatgcaccccccgaacctggcggcagcgcaaaagatg

SEQ ID NO: 227019 - DNA, 103 bp, Artificial Sequence
  Synthetic Polynucleotide
taatacgactcactataggggacttggcatcagctcctctccttctatgtaacagaggagaacatagatggagaggagcaacctggcggcagcgcaaaagatg

SEQ ID NO: 227020 - DNA, 103 bp, Artificial Sequence
  Synthetic Polynucleotide
taatacgactcactataggggcttcctgcagacttggcatcagctcctctaacagaggagaagaggaatggatgccaagaacctggcggcagcgcaaaagatg

SEQ ID NO: 227021 - DNA, 103 bp, Artificial Sequence
  Synthetic Polynucleotide
taatacgactcactatagggagaactcaaagcttcctgcagacttggcataacagaggagaatgccaatgctgcaggaaaacctggcggcagcgcaaaagatg

SEQ ID NO: 227022 - DNA, 103 bp, Artificial Sequence
  Synthetic Polynucleotide
taatacgactcactatagggtaaggatgtcagaactcaaagcttcctgcaaacagaggagatgcaggatgctttgagttaacctggcggcagcgcaaaagatg

SEQ ID NO: 227023 - DNA, 103 bp, Artificial Sequence
  Synthetic Polynucleotide
taatacgactcactatagggtccatgtcattaaggatgtcagaactcaaaaacagaggagatttgagatgtgacatcctaacctggcggcagcgcaaaagatg

SEQ ID NO: 227024 - DNA, 103 bp, Artificial Sequence
  Synthetic Polynucleotide
taatacgactcactatagggcaaaacagactccatgtcattaaggatgtcaacagaggagagacatcatgaatgacatgaacctggcggcagcgcaaaagatg

SEQ ID NO: 227025 - DNA, 103 bp, Artificial Sequence
  Synthetic Polynucleotide
taatacgactcactatagggtggtggcagccaaaacagactccatgtcataacagaggagaatgacaatgagtctgtttaacctggcggcagcgcaaaagatg

SEQ ID NO: 227026 - DNA, 103 bp, Artificial Sequence
  Synthetic Polynucleotide
taatacgactcactatagggttatctagcttggtggcagccaaaacagacaacagaggagagtctgtatgggctgccacaacctggcggcagcgcaaaagatg

SEQ ID NO: 227027 - DNA, 103 bp, Artificial Sequence
  Synthetic Polynucleotide
taatacgactcactatagggaaagctttctttatctagcttggtggcagcaacagaggagagctgccatgaagctagataacctggcggcagcgcaaaagatg

SEQ ID NO: 227028 - DNA, 103 bp, Artificial Sequence
  Synthetic Polynucleotide
taatacgactcactatagggaccatgtaagaaagctttctttatctagctaacagaggagaagctagatgaagaaagctaacctggcggcagcgcaaaagatg

SEQ ID NO: 227029 - DNA, 103 bp, Artificial Sequence
  Synthetic Polynucleotide
taatacgactcactatagggacgtgcacgatctgatgcccggcggggggtaacagaggagaacccccatgcgggcatcaaacctggcggcagcgcaaaagatg

SEQ ID NO: 227030 - DNA, 103 bp, Artificial Sequence
  Synthetic Polynucleotide
taatacgactcactataggggtccccgcggacgtgcacgatctgatgcccaacagaggagagggcatatgatcgtgcacaacctggcggcagcgcaaaagatg

SEQ ID NO: 227031 - DNA, 103 bp, Artificial Sequence
  Synthetic Polynucleotide
taatacgactcactatagggcggtctccgagtccccgcggacgtgcacgaaacagaggagatcgtgcatgtccgcggggaacctggcggcagcgcaaaagatg

SEQ ID NO: 227032 - DNA, 103 bp, Artificial Sequence
  Synthetic Polynucleotide
taatacgactcactataggggcctccaggtcggtctccgagtccccgcggaacagaggagaccgcggatgctcggagacaacctggcggcagcgcaaaagatg

SEQ ID NO: 227033 - DNA, 103 bp, Artificial Sequence
  Synthetic Polynucleotide
taatacgactcactataggggttgaagagcgcctccaggtcggtctccgaaacagaggagatcggagatggacctggagaacctggcggcagcgcaaaagatg

SEQ ID NO: 227034 - DNA, 103 bp, Artificial Sequence
  Synthetic Polynucleotide
taatacgactcactatagggggggggccggttgaggcggcggctgctgccaacagaggagaggcagcatgcgccgcctcaacctggcggcagcgcaaaagatg

SEQ ID NO: 227035 - DNA, 103 bp, Artificial Sequence
  Synthetic Polynucleotide
taatacgactcactatagggtcatgacggcgttgaagagcgcctccaggtaacagaggagaacctggatgcgctcttcaaacctggcggcagcgcaaaagatg

SEQ ID NO: 227036 - DNA, 103 bp, Artificial Sequence
  Synthetic Polynucleotide
taatacgactcactataggggtcttggggttcatgacggcgttgaagagcaacagaggagagctcttatgcgccgtcataacctggcggcagcgcaaaagatg

SEQ ID NO: 227037 - DNA, 103 bp, Artificial Sequence
  Synthetic Polynucleotide
taatacgactcactatagggcacgttggccgtcttggggttcatgacggcaacagaggagagccgtcatgaaccccaagaacctggcggcagcgcaaaagatg

SEQ ID NO: 227038 - DNA, 103 bp, Artificial Sequence
  Synthetic Polynucleotide
taatacgactcactatagggcggtctggggcacgttggccgtcttggggtaacagaggagaaccccaatgcggccaacgaacctggcggcagcgcaaaagatg

SEQ ID NO: 227039 - DNA, 103 bp, Artificial Sequence
  Synthetic Polynucleotide
taatacgactcactatagggctcatgggcacggtctggggcacgttggccaacagaggagaggccaaatggccccagacaacctggcggcagcgcaaaagatg

SEQ ID NO: 227040 - DNA, 103 bp, Artificial Sequence
  Synthetic Polynucleotide
taatacgactcactatagggcttccggagcctcatgggcacggtctggggaacagaggagaccccagatggtgcccatgaacctggcggcagcgcaaaagatg

SEQ ID NO: 227041 - DNA, 103 bp, Artificial Sequence
  Synthetic Polynucleotide
taatacgactcactatagggagtcgggcagcttccggagcctcatgggcaaacagaggagatgcccaatgggctccggaaacctggcggcagcgcaaaagatg

SEQ ID NO: 227042 - DNA, 103 bp, Artificial Sequence
  Synthetic Polynucleotide
taatacgactcactatagggttgaagaaggagtcgggcagcttccggagcaacagaggagagctccgatggctgcccgaaacctggcggcagcgcaaaagatg

SEQ ID NO: 227043 - DNA, 103 bp, Artificial Sequence
  Synthetic Polynucleotide
taatacgactcactatagggctccggcggcttgaagaaggagtcgggcagaacagaggagactgcccatgtccttcttcaacctggcggcagcgcaaaagatg

SEQ ID NO: 227044 - DNA, 103 bp, Artificial Sequence
  Synthetic Polynucleotide
taatacgactcactataggggggatttgggctccggcggcttgaagaaggaacagaggagaccttctatgagccgccggaacctggcggcagcgcaaaagatg

SEQ ID NO: 227045 - DNA, 103 bp, Artificial Sequence
  Synthetic Polynucleotide
taatacgactcactatagggccttggccctggggggccggttgaggcggcaacagaggagagccgccatgaccggccccaacctggcggcagcgcaaaagatg

SEQ ID NO: 227046 - DNA, 103 bp, Artificial Sequence
  Synthetic Polynucleotide
taatacgactcactatagggtgtcgggagtgggatttgggctccggcggcaacagaggagagccgccatggcccaaatcaacctggcggcagcgcaaaagatg

SEQ ID NO: 227047 - DNA, 103 bp, Artificial Sequence
  Synthetic Polynucleotide
taatacgactcactatagggagtactggcctgtcgggagtgggatttgggaacagaggagacccaaaatgcactcccgaaacctggcggcagcgcaaaagatg

SEQ ID NO: 227048 - DNA, 103 bp, Artificial Sequence
  Synthetic Polynucleotide
taatacgactcactatagggtgcctgcatcagtactggcctgtcgggagtaacagaggagaactcccatgaggccagtaaacctggcggcagcgcaaaagatg

SEQ ID NO: 227049 - DNA, 103 bp, Artificial Sequence
  Synthetic Polynucleotide
taatacgactcactataggggctcctgcagtgcctgcatcagtactggccaacagaggagaggccagatgtgatgcaggaacctggcggcagcgcaaaagatg

SEQ ID NO: 227050 - DNA, 103 bp, Artificial Sequence
  Synthetic Polynucleotide
taatacgactcactatagggtggagtcagggctcctgcagtgcctgcatcaacagaggagagatgcaatgactgcaggaaacctggcggcagcgcaaaagatg

SEQ ID NO: 227051 - DNA, 103 bp, Artificial Sequence
  Synthetic Polynucleotide
taatacgactcactataggggaacatgctgtggagtcagggctcctgcagaacagaggagactgcagatgccctgactcaacctggcggcagcgcaaaagatg

SEQ ID NO: 227052 - DNA, 103 bp, Artificial Sequence
  Synthetic Polynucleotide
taatacgactcactataggggaatgagctcgaacatgctgtggagtcaggaacagaggagacctgacatgacagcatgtaacctggcggcagcgcaaaagatg

SEQ ID NO: 227053 - DNA, 103 bp, Artificial Sequence
  Synthetic Polynucleotide
taatacgactcactatagggagctggagaggaatgagctcgaacatgctgaacagaggagacagcatatgcgagctcataacctggcggcagcgcaaaagatg

SEQ ID NO: 227054 - DNA, 103 bp, Artificial Sequence
  Synthetic Polynucleotide
taatacgactcactatagggactgcagagaagctggagaggaatgagctcaacagaggagagagctcatgcctctccagaacctggcggcagcgcaaaagatg

SEQ ID NO: 227055 - DNA, 103 bp, Artificial Sequence
  Synthetic Polynucleotide
taatacgactcactatagggacagctcccaactgcagagaagctggagagaacagaggagactctccatgttctctgcaaacctggcggcagcgcaaaagatg

SEQ ID NO: 227056 - DNA, 103 bp, Artificial Sequence
  Synthetic Polynucleotide
taatacgactcactatagggaggcggctgcccttggccctggggggccggaacagaggagaccggccatgcagggccaaaacctggcggcagcgcaaaagatg

SEQ ID NO: 227057 - DNA, 103 bp, Artificial Sequence
  Synthetic Polynucleotide
taatacgactcactatagggcccaggagaaacagctcccaactgcagagaaacagaggagatctctgatgttgggagctaacctggcggcagcgcaaaagatg

SEQ ID NO: 227058 - DNA, 103 bp, Artificial Sequence
  Synthetic Polynucleotide
taatacgactcactataggggggtcagtgtcccaggagaaacagctcccaaacagaggagatgggagatgtttctcctgaacctggcggcagcgcaaaagatg

SEQ ID NO: 227059 - DNA, 103 bp, Artificial Sequence
  Synthetic Polynucleotide
taatacgactcactatagggactccagtgggggtcagtgtcccaggagaaaacagaggagattctccatggacactgacaacctggcggcagcgcaaaagatg

SEQ ID NO: 227060 - DNA, 103 bp, Artificial Sequence
  Synthetic Polynucleotide
taatacgactcactataggggccagagactactccagtgggggtcagtgtaacagaggagaacactgatgcccactggaaacctggcggcagcgcaaaagatg

SEQ ID NO: 227061 - DNA, 103 bp, Artificial Sequence
  Synthetic Polynucleotide
taatacgactcactatagggtagctgctgggccagagactactccagtggaacagaggagaccactgatgtagtctctgaacctggcggcagcgcaaaagatg

SEQ ID NO: 227062 - DNA, 103 bp, Artificial Sequence
  Synthetic Polynucleotide
taatacgactcactataggggctgtgggtgtagctgctgggccagagactaacagaggagaagtctcatgcccagcagcaacctggcggcagcgcaaaagatg

SEQ ID NO: 227063 - DNA, 103 bp, Artificial Sequence
  Synthetic Polynucleotide
taatacgactcactatagggaagatgctgagctgtgggtgtagctgctggaacagaggagaccagcaatgacacccacaaacctggcggcagcgcaaaagatg

SEQ ID NO: 227064 - DNA, 103 bp, Artificial Sequence
  Synthetic Polynucleotide
taatacgactcactatagggaagactgtcgaagatgctgagctgtgggtgaacagaggagacacccaatgctcagcatcaacctggcggcagcgcaaaagatg

SEQ ID NO: 227065 - DNA, 103 bp, Artificial Sequence
  Synthetic Polynucleotide
taatacgactcactatagggatctcaaaagaagactgtcgaagatgctgaaacagaggagatcagcaatgtcgacagtcaacctggcggcagcgcaaaagatg

SEQ ID NO: 227066 - DNA, 103 bp, Artificial Sequence
  Synthetic Polynucleotide
taatacgactcactatagggatcatcaggtatctcaaaagaagactgtcgaacagaggagacgacagatgtcttttgagaacctggcggcagcgcaaaagatg

SEQ ID NO: 227067 - DNA, 103 bp, Artificial Sequence
  Synthetic Polynucleotide
taatacgactcactatagggggggctgcgaaggcggctgcccttggccctaacagaggagaagggccatgggcagccgcaacctggcggcagcgcaaaagatg

SEQ ID NO: 227068 - DNA, 103 bp, Artificial Sequence
  Synthetic Polynucleotide
taatacgactcactataggggcagaggtacatcatcaggtatctcaaaagaacagaggagacttttgatgtacctgatgaacctggcggcagcgcaaaagatg

SEQ ID NO: 227069 - DNA, 103 bp, Artificial Sequence
  Synthetic Polynucleotide
taatacgactcactatagggcaacctgctggcagaggtacatcatcaggtaacagaggagaacctgaatgtgtacctctaacctggcggcagcgcaaaagatg

SEQ ID NO: 227070 - DNA, 103 bp, Artificial Sequence
  Synthetic Polynucleotide
taatacgactcactatagggtgccatctcccaacctgctggcagaggtacaacagaggagagtacctatgccagcaggtaacctggcggcagcgcaaaagatg

SEQ ID NO: 227071 - DNA, 103 bp, Artificial Sequence
  Synthetic Polynucleotide
taatacgactcactatagggaagatgtctttgccatctcccaacctgctgaacagaggagacagcagatggggagatggaacctggcggcagcgcaaaagatg

SEQ ID NO: 227072 - DNA, 103 bp, Artificial Sequence
  Synthetic Polynucleotide
taatacgactcactatagggctctgaccagaagatgtctttgccatctccaacagaggagaggagatatgaaagacatcaacctggcggcagcgcaaaagatg

SEQ ID NO: 227073 - DNA, 103 bp, Artificial Sequence
  Synthetic Polynucleotide
taatacgactcactatagggtaagaagtatctctgaccagaagatgtcttaacagaggagaaagacaatgtctggtcagaacctggcggcagcgcaaaagatg

SEQ ID NO: 227074 - DNA, 103 bp, Artificial Sequence
  Synthetic Polynucleotide
taatacgactcactatagggcgatgtgatttaagaagtatctctgaccagaacagaggagactggtcatggatacttctaacctggcggcagcgcaaaagatg

SEQ ID NO: 227075 - DNA, 103 bp, Artificial Sequence
  Synthetic Polynucleotide
taatacgactcactataggggttgtctgatcgatgtgatttaagaagtataacagaggagaatacttatgaaatcacataacctggcggcagcgcaaaagatg

SEQ ID NO: 227076 - DNA, 103 bp, Artificial Sequence
  Synthetic Polynucleotide
taatacgactcactatagggctgccatgttgttgtctgatcgatgtgattaacagaggagaaatcacatggatcagacaaacctggcggcagcgcaaaagatg

SEQ ID NO: 227077 - DNA, 103 bp, Artificial Sequence
  Synthetic Polynucleotide
taatacgactcactatagggtcctggggtcctgccatgttgttgtctgataacagaggagaatcagaatgcaacatggcaacctggcggcagcgcaaaagatg

SEQ ID NO: 227078 - DNA, 103 bp, Artificial Sequence
  Synthetic Polynucleotide
taatacgactcactatagggtgcccctgcgggggctgcgaaggcggctgcaacagaggagagcagccatgttcgcagccaacctggcggcagcgcaaaagatg

SEQ ID NO: 227079 - DNA, 103 bp, Artificial Sequence
  Synthetic Polynucleotide
taatacgactcactatagggagcatggccttcctggggtcctgccatgttaacagaggagaaacatgatgggaccccagaacctggcggcagcgcaaaagatg

SEQ ID NO: 227080 - DNA, 103 bp, Artificial Sequence
  Synthetic Polynucleotide
taatacgactcactatagggcatctgggacagcatggccttcctggggtcaacagaggagagaccccatgaaggccatgaacctggcggcagcgcaaaagatg

SEQ ID NO: 227081 - DNA, 103 bp, Artificial Sequence
  Synthetic Polynucleotide
taatacgactcactatagggctgtgacgttcatctgggacagcatggcctaacagaggagaaggccaatgtgtcccagaaacctggcggcagcgcaaaagatg

SEQ ID NO: 227082 - DNA, 103 bp, Artificial Sequence
  Synthetic Polynucleotide
taatacgactcactatagggctggtgggggctgtgacgttcatctgggacaacagaggagagtcccaatggaacgtcacaacctggcggcagcgcaaaagatg

SEQ ID NO: 227083 - DNA, 103 bp, Artificial Sequence
  Synthetic Polynucleotide
taatacgactcactatagggcactggtggactggtgggggctgtgacgttaacagaggagaaacgtcatggcccccaccaacctggcggcagcgcaaaagatg

SEQ ID NO: 227084 - DNA, 103 bp, Artificial Sequence
  Synthetic Polynucleotide
taatacgactcactatagggtattctgctgcactggtggactggtgggggaacagaggagacccccaatggtccaccagaacctggcggcagcgcaaaagatg

SEQ ID NO: 227085 - DNA, 103 bp, Artificial Sequence
  Synthetic Polynucleotide
taatacgactcactataggggagttcatcatattctgctgcactggtggaaacagaggagatccaccatggcagcagaaaacctggcggcagcgcaaaagatg

SEQ ID NO: 227086 - DNA, 103 bp, Artificial Sequence
  Synthetic Polynucleotide
taatacgactcactatagggacctgaagccgagttcatcatattctgctgaacagaggagacagcagatgatgatgaacaacctggcggcagcgcaaaagatg

SEQ ID NO: 227087 - DNA, 103 bp, Artificial Sequence
  Synthetic Polynucleotide
taatacgactcactatagggcaggaagaggacctgaagccgagttcatcaaacagaggagatgatgaatgcggcttcagaacctggcggcagcgcaaaagatg

SEQ ID NO: 227088 - DNA, 103 bp, Artificial Sequence
  Synthetic Polynucleotide
taatacgactcactatagggtcccatccatcaggaagaggacctgaagccaacagaggagaggcttcatgtcctcttccaacctggcggcagcgcaaaagatg

SEQ ID NO: 227089 - DNA, 103 bp, Artificial Sequence
  Synthetic Polynucleotide
taatacgactcactatagggcggcgggccctgcccctgcgggggctgcgaaacagaggagatcgcagatgccgcaggggaacctggcggcagcgcaaaagatg

SEQ ID NO: 227090 - DNA, 103 bp, Artificial Sequence
  Synthetic Polynucleotide
taatacgactcactatagggcatggcttgttcccatccatcaggaagaggaacagaggagacctcttatggatggatggaacctggcggcagcgcaaaagatg

SEQ ID NO: 227091 - DNA, 103 bp, Artificial Sequence
  Synthetic Polynucleotide
taatacgactcactatagggcatcctgagtcatggcttgttcccatccataacagaggagaatggatatgaacaagccaaacctggcggcagcgcaaaagatg

SEQ ID NO: 227092 - DNA, 103 bp, Artificial Sequence
  Synthetic Polynucleotide
taatacgactcactatagggtaaatttctccatcctgagtcatggcttgtaacagaggagaacaagcatggactcaggaaacctggcggcagcgcaaaagatg

SEQ ID NO: 227093 - DNA, 103 bp, Artificial Sequence
  Synthetic Polynucleotide
taatacgactcactataggggtttatatagtaaatttctccatcctgagtaacagaggagaactcagatgggagaaattaacctggcggcagcgcaaaagatg

SEQ ID NO: 227094 - DNA, 103 bp, Artificial Sequence
  Synthetic Polynucleotide
taatacgactcactatagggtgttcttatggtttatatagtaaatttctcaacagaggagagagaaaatgactatataaaacctggcggcagcgcaaaagatg

SEQ ID NO: 227095 - DNA, 103 bp, Artificial Sequence
  Synthetic Polynucleotide
taatacgactcactataggggaggtggtcttgttcttatggtttatatagaacagaggagactatatatgccataagaaaacctggcggcagcgcaaaagatg

SEQ ID NO: 227096 - DNA, 103 bp, Artificial Sequence
  Synthetic Polynucleotide
taatacgactcactataggggtctagccaagaggtggtcttgttcttatgaacagaggagacataagatgaagaccaccaacctggcggcagcgcaaaagatg

SEQ ID NO: 227097 - DNA, 103 bp, Artificial Sequence
  Synthetic Polynucleotide
taatacgactcactatagggcaagccttgggtctagccaagaggtggtctaacagaggagaagaccaatgcttggctagaacctggcggcagcgcaaaagatg

SEQ ID NO: 227098 - DNA, 103 bp, Artificial Sequence
  Synthetic Polynucleotide
taatacgactcactatagggaaacgagggtcaagccttgggtctagccaaaacagaggagattggctatgcccaaggctaacctggcggcagcgcaaaagatg

SEQ ID NO: 227099 - DNA, 103 bp, Artificial Sequence
  Synthetic Polynucleotide
taatacgactcactataggggttcatggcaaaacgagggtcaagccttggaacagaggagaccaaggatggaccctcgtaacctggcggcagcgcaaaagatg

SEQ ID NO: 227100 - DNA, 103 bp, Artificial Sequence
  Synthetic Polynucleotide
taatacgactcactatagggcgggtccggacggcgggccctgcccctgcgaacagaggagacgcaggatgagggcccgcaacctggcggcagcgcaaaagatg

SEQ ID NO: 227101 - DNA, 103 bp, Artificial Sequence
  Synthetic Polynucleotide
taatacgactcactatagggtgattctctggttcatggcaaaacgagggtaacagaggagaaccctcatgttgccatgaaacctggcggcagcgcaaaagatg

SEQ ID NO: 227102 - DNA, 103 bp, Artificial Sequence
  Synthetic Polynucleotide
taatacgactcactataggggcactctgactgattctctggttcatggcaaacagaggagatgccatatgccagagaataacctggcggcagcgcaaaagatg

SEQ ID NO: 227103 - DNA, 103 bp, Artificial Sequence
  Synthetic Polynucleotide
taatacgactcactatagggtttcactggagcactctgactgattctctgaacagaggagacagagaatgagtcagagtaacctggcggcagcgcaaaagatg

SEQ ID NO: 227104 - DNA, 103 bp, Artificial Sequence
  Synthetic Polynucleotide
taatacgactcactataggggtggtggctgtttcactggagcactctgacaacagaggagagtcagaatgctccagtgaaacctggcggcagcgcaaaagatg

SEQ ID NO: 227105 - DNA, 103 bp, Artificial Sequence
  Synthetic Polynucleotide
taatacgactcactatagggggagccaggggtggtggctgtttcactggaaacagaggagatccagtatgacagccaccaacctggcggcagcgcaaaagatg

SEQ ID NO: 227106 - DNA, 103 bp, Artificial Sequence
  Synthetic Polynucleotide
taatacgactcactatagggtgggctctggggagccaggggtggtggctgaacagaggagacagccaatgcccctggctaacctggcggcagcgcaaaagatg

SEQ ID NO: 227107 - DNA, 103 bp, Artificial Sequence
  Synthetic Polynucleotide
taatacgactcactatagggcgcctccctgtgggctctggggagccagggaacagaggagaccctggatgcccagagccaacctggcggcagcgcaaaagatg

SEQ ID NO: 227108 - DNA, 103 bp, Artificial Sequence
  Synthetic Polynucleotide
taatacgactcactatagggccacccatgacgcctccctgtgggctctggaacagaggagaccagagatgacagggaggaacctggcggcagcgcaaaagatg

SEQ ID NO: 227109 - DNA, 103 bp, Artificial Sequence
  Synthetic Polynucleotide
taatacgactcactatagggggagttgctgccacccatgacgcctccctgaacagaggagacagggaatggtcatgggtaacctggcggcagcgcaaaagatg

SEQ ID NO: 227110 - DNA, 103 bp, Artificial Sequence
  Synthetic Polynucleotide
taatacgactcactataggggctgctggttggagttgctgccacccatgaaacagaggagatcatggatggcagcaactaacctggcggcagcgcaaaagatg

SEQ ID NO: 227111 - DNA, 103 bp, Artificial Sequence
  Synthetic Polynucleotide
taatacgactcactataggggccggttgcccgggtccggacggcgggcccaacagaggagagggcccatggtccggaccaacctggcggcagcgcaaaagatg

SEQ ID NO: 227112 - DNA, 103 bp, Artificial Sequence
  Synthetic Polynucleotide
taatacgactcactatagggcgcatctgttgctgctggttggagttgctgaacagaggagacagcaaatgcaaccagcaaacctggcggcagcgcaaaagatg

SEQ ID NO: 227113 - DNA, 103 bp, Artificial Sequence
  Synthetic Polynucleotide
taatacgactcactatagggttgctgcagtcgcatctgttgctgctggttaacagaggagaaaccagatgcaacagatgaacctggcggcagcgcaaaagatg

SEQ ID NO: 227114 - DNA, 103 bp, Artificial Sequence
  Synthetic Polynucleotide
taatacgactcactatagggccatctgcagttgctgcagtcgcatctgttaacagaggagaaacagaatggactgcagcaacctggcggcagcgcaaaagatg

SEQ ID NO: 227115 - DNA, 103 bp, Artificial Sequence
  Synthetic Polynucleotide
taatacgactcactatagggctctccttctccatctgcagttgctgcagtaacagaggagaactgcaatgactgcagataacctggcggcagcgcaaaagatg

SEQ ID NO: 227116 - DNA, 103 bp, Artificial Sequence
  Synthetic Polynucleotide
taatacgactcactatagggcagccgcagcctctccttctccatctgcagaacagaggagactgcagatggagaaggagaacctggcggcagcgcaaaagatg

SEQ ID NO: 227117 - DNA, 103 bp, Artificial Sequence
  Synthetic Polynucleotide
taatacgactcactatagggcttgctgtttcagccgcagcctctccttctaacagaggagaagaaggatgggctgcggcaacctggcggcagcgcaaaagatg

SEQ ID NO: 227118 - DNA, 103 bp, Artificial Sequence
  Synthetic Polynucleotide
taatacgactcactatagggcgaagcagttcttgctgtttcagccgcagcaacagaggagagctgcgatggaaacagcaaacctggcggcagcgcaaaagatg

SEQ ID NO: 227119 - DNA, 103 bp, Artificial Sequence
  Synthetic Polynucleotide
taatacgactcactatagggcattgcctgccgaagcagttcttgctgtttaacagaggagaaaacagatggaactgcttaacctggcggcagcgcaaaagatg

SEQ ID NO: 227120 - DNA, 103 bp, Artificial Sequence
  Synthetic Polynucleotide
taatacgactcactatagggtgatattccgcattgcctgccgaagcagttaacagaggagaaactgcatgggcaggcaaaacctggcggcagcgcaaaagatg

SEQ ID NO: 227121 - DNA, 103 bp, Artificial Sequence
  Synthetic Polynucleotide
taatacgactcactataggggtgctgggattgatattccgcattgcctgcaacagaggagagcaggcatggcggaatataacctggcggcagcgcaaaagatg

SEQ ID NO: 227122 - DNA, 103 bp, Artificial Sequence
  Synthetic Polynucleotide
taatacgactcactatagggcggctgctgggtctcggcctcgctgctcataacagaggagaatgagcatggaggccgagaacctggcggcagcgcaaaagatg

SEQ ID NO: 227123 - DNA, 103 bp, Artificial Sequence
  Synthetic Polynucleotide
taatacgactcactataggggcccgggccaccgctccctgcgccgctgccaacagaggagaggcagcatggcagggagcaacctggcggcagcgcaaaagatg

SEQ ID NO: 227124 - DNA, 103 bp, Artificial Sequence
  Synthetic Polynucleotide
taatacgactcactatagggatgtgaggccgcccgggccaccgctccctgaacagaggagacagggaatggtggcccggaacctggcggcagcgcaaaagatg

SEQ ID NO: 227125 - DNA, 103 bp, Artificial Sequence
  Synthetic Polynucleotide
taatacgactcactatagggggcgccgccgatgtgaggccgcccgggccaaacagaggagatggcccatgcggcctcacaacctggcggcagcgcaaaagatg

SEQ ID NO: 227126 - DNA, 103 bp, Artificial Sequence
  Synthetic Polynucleotide
taatacgactcactatagggcccgccggcaggcgccgccgatgtgaggccaacagaggagaggcctcatgtcggcggcgaacctggcggcagcgcaaaagatg

SEQ ID NO: 227127 - DNA, 103 bp, Artificial Sequence
  Synthetic Polynucleotide
taatacgactcactatagggccttcttgtccccgccggcaggcgccgccgaacagaggagacggcggatgctgccggcgaacctggcggcagcgcaaaagatg

SEQ ID NO: 227128 - DNA, 103 bp, Artificial Sequence
  Synthetic Polynucleotide
taatacgactcactataggggttgcgatgaccttcttgtccccgccggcaaacagaggagatgccggatgggacaagaaaacctggcggcagcgcaaaagatg

SEQ ID NO: 227129 - DNA, 103 bp, Artificial Sequence
  Synthetic Polynucleotide
taatacgactcactatagggcaaaaccttcgttgcgatgaccttcttgtcaacagaggagagacaagatggtcatcgcaaacctggcggcagcgcaaaagatg

SEQ ID NO: 227130 - DNA, 103 bp, Artificial Sequence
  Synthetic Polynucleotide
taatacgactcactatagggttactgttcccaaaaccttcgttgcgatgaaacagaggagatcatcgatgcgaaggtttaacctggcggcagcgcaaaagatg

SEQ ID NO: 227131 - DNA, 103 bp, Artificial Sequence
  Synthetic Polynucleotide
taatacgactcactatagggttgaaccattttactgttcccaaaaccttcaacagaggagagaaggtatggggaacagtaacctggcggcagcgcaaaagatg

SEQ ID NO: 227132 - DNA, 103 bp, Artificial Sequence
  Synthetic Polynucleotide
taatacgactcactataggggttccttacattgaaccattttactgttccaacagaggagaggaacaatgaaatggttcaacctggcggcagcgcaaaagatg

SEQ ID NO: 227133 - DNA, 103 bp, Artificial Sequence
  Synthetic Polynucleotide
taatacgactcactataggggggcggcgggcggctgctgggtctcggcctaacagaggagaaggccgatgcccagcagcaacctggcggcagcgcaaaagatg

SEQ ID NO: 227134 - DNA, 103 bp, Artificial Sequence
  Synthetic Polynucleotide
taatacgactcactatagggaaccatatccgttccttacattgaaccattaacagaggagaaatggtatgatgtaaggaaacctggcggcagcgcaaaagatg

SEQ ID NO: 227135 - DNA, 103 bp, Artificial Sequence
  Synthetic Polynucleotide
taatacgactcactatagggctgttgatgaaaccatatccgttccttacaaacagaggagatgtaagatgcggatatggaacctggcggcagcgcaaaagatg

SEQ ID NO: 227136 - DNA, 103 bp, Artificial Sequence
  Synthetic Polynucleotide
taatacgactcactatagggggtgtcattcctgttgatgaaaccatatccaacagaggagaggatatatgttcatcaacaacctggcggcagcgcaaaagatg

SEQ ID NO: 227137 - DNA, 103 bp, Artificial Sequence
  Synthetic Polynucleotide
taatacgactcactatagggcatcttccttggtgtcattcctgttgatgaaacagaggagatcatcaatgggaatgacaaacctggcggcagcgcaaaagatg

SEQ ID NO: 227138 - DNA, 103 bp, Artificial Sequence
  Synthetic Polynucleotide
taatacgactcactatagggtgtacaaatacatcttccttggtgtcattcaacagaggagagaatgaatgcaaggaagaaacctggcggcagcgcaaaagatg

SEQ ID NO: 227139 - DNA, 103 bp, Artificial Sequence
  Synthetic Polynucleotide
taatacgactcactatagggggcagtctggtgtacaaatacatcttccttaacagaggagaaaggaaatggtatttgtaaacctggcggcagcgcaaaagatg

SEQ ID NO: 227140 - DNA, 103 bp, Artificial Sequence
  Synthetic Polynucleotide
taatacgactcactatagggtcttctttatggcagtctggtgtacaaataaacagaggagatatttgatgaccagactgaacctggcggcagcgcaaaagatg

SEQ ID NO: 227141 - DNA, 103 bp, Artificial Sequence
  Synthetic Polynucleotide
taatacgactcactatagggctggggttattcttctttatggcagtctggaacagaggagaccagacatgcataaagaaaacctggcggcagcgcaaaagatg

SEQ ID NO: 227142 - DNA, 103 bp, Artificial Sequence
  Synthetic Polynucleotide
taatacgactcactatagggaaggtacttcctggggttattcttctttataacagaggagaataaagatgaataaccccaacctggcggcagcgcaaaagatg

SEQ ID NO: 227143 - DNA, 103 bp, Artificial Sequence
  Synthetic Polynucleotide
taatacgactcactatagggctacactgcgaaggtacttcctggggttataacagaggagaataaccatgggaagtaccaacctggcggcagcgcaaaagatg

SEQ ID NO: 227144 - DNA, 103 bp, Artificial Sequence
  Synthetic Polynucleotide
taatacgactcactataggggcggcggggggggcggcgggcggctgctggaacagaggagaccagcaatggcccgccgcaacctggcggcagcgcaaaagatg

SEQ ID NO: 227145 - DNA, 103 bp, Artificial Sequence
  Synthetic Polynucleotide
taatacgactcactatagggtctccatctcctacactgcgaaggtacttcaacagaggagagaagtaatgtcgcagtgtaacctggcggcagcgcaaaagatg

SEQ ID NO: 227146 - DNA, 103 bp, Artificial Sequence
  Synthetic Polynucleotide
taatacgactcactatagggctccacagtctctccatctcctacactgcgaacagaggagacgcagtatgggagatggaaacctggcggcagcgcaaaagatg

SEQ ID NO: 227147 - DNA, 103 bp, Artificial Sequence
  Synthetic Polynucleotide
taatacgactcactatagggcaacatcaaactccacagtctctccatctcaacagaggagagagatgatgagactgtggaacctggcggcagcgcaaaagatg

SEQ ID NO: 227148 - DNA, 103 bp, Artificial Sequence
  Synthetic Polynucleotide
taatacgactcactatagggtctccttcaacaacatcaaactccacagtcaacagaggagagactgtatggtttgatgtaacctggcggcagcgcaaaagatg

SEQ ID NO: 227149 - DNA, 103 bp, Artificial Sequence
  Synthetic Polynucleotide
taatacgactcactatagggcgcacccttttctccttcaacaacatcaaaaacagaggagatttgatatggttgaaggaaacctggcggcagcgcaaaagatg

SEQ ID NO: 227150 - DNA, 103 bp, Artificial Sequence
  Synthetic Polynucleotide
taatacgactcactatagggttgctgcctccgcacccttttctccttcaaaacagaggagattgaagatgaaaagggtgaacctggcggcagcgcaaaagatg

SEQ ID NO: 227151 - DNA, 103 bp, Artificial Sequence
  Synthetic Polynucleotide
taatacgactcactatagggcctgtaacatttgctgcctccgcaccctttaacagaggagaaaagggatgggaggcagcaacctggcggcagcgcaaaagatg

SEQ ID NO: 227152 - DNA, 103 bp, Artificial Sequence
  Synthetic Polynucleotide
taatacgactcactatagggaccaccaggacctgtaacatttgctgcctcaacagaggagagaggcaatgaatgttacaaacctggcggcagcgcaaaagatg

SEQ ID NO: 227153 - DNA, 103 bp, Artificial Sequence
  Synthetic Polynucleotide
taatacgactcactataggggaactggaacaccaccaggacctgtaacataacagaggagaatgttaatggtcctggtgaacctggcggcagcgcaaaagatg

SEQ ID NO: 227154 - DNA, 103 bp, Artificial Sequence
  Synthetic Polynucleotide
taatacgactcactatagggttactgccttgaactggaacaccaccaggaaacagaggagatcctggatgtgttccagtaacctggcggcagcgcaaaagatg

SEQ ID NO: 227155 - DNA, 103 bp, Artificial Sequence
  Synthetic Polynucleotide
taatacgactcactataggggagggcgggggcggcggggggggcggcgggaacagaggagacccgccatgccccccgccaacctggcggcagcgcaaaagatg

SEQ ID NO: 227156 - DNA, 103 bp, Artificial Sequence
  Synthetic Polynucleotide
taatacgactcactatagggtgctgcatatttactgccttgaactggaacaacagaggagagttccaatgcaaggcagtaacctggcggcagcgcaaaagatg

SEQ ID NO: 227157 - DNA, 103 bp, Artificial Sequence
  Synthetic Polynucleotide
taatacgactcactatagggggttacggtctgctgcatatttactgccttaacagaggagaaaggcaatgaatatgcagaacctggcggcagcgcaaaagatg

SEQ ID NO: 227158 - DNA, 103 bp, Artificial Sequence
  Synthetic Polynucleotide
taatacgactcactatagggcgtctataatggttacggtctgctgcatataacagaggagaatatgcatgagaccgtaaaacctggcggcagcgcaaaagatg

SEQ ID NO: 227159 - DNA, 103 bp, Artificial Sequence
  Synthetic Polynucleotide
taatacgactcactatagggacgtggatagcgtctataatggttacggtcaacagaggagagaccgtatgcattatagaaacctggcggcagcgcaaaagatg

SEQ ID NO: 227160 - DNA, 103 bp, Artificial Sequence
  Synthetic Polynucleotide
taatacgactcactataggggacccctacgacgtggatagcgtctataataacagaggagaattataatggctatccacaacctggcggcagcgcaaaagatg

SEQ ID NO: 227161 - DNA, 103 bp, Artificial Sequence
  Synthetic Polynucleotide
taatacgactcactatagggttgcgtggaggacccctacgacgtggatagaacagaggagactatccatgtcgtaggggaacctggcggcagcgcaaaagatg

SEQ ID NO: 227162 - DNA, 103 bp, Artificial Sequence
  Synthetic Polynucleotide
taatacgactcactatagggttgctggtaattgcgtggaggacccctacgaacagaggagacgtaggatgcctccacgcaacctggcggcagcgcaaaagatg

SEQ ID NO: 227163 - DNA, 103 bp, Artificial Sequence
  Synthetic Polynucleotide
taatacgactcactatagggtctggtaattttgctggtaattgcgtggagaacagaggagactccacatgattaccagcaacctggcggcagcgcaaaagatg

SEQ ID NO: 227164 - DNA, 103 bp, Artificial Sequence
  Synthetic Polynucleotide
taatacgactcactatagggctctcactattctggtaattttgctggtaaaacagaggagattaccaatgaaattaccaaacctggcggcagcgcaaaagatg

SEQ ID NO: 227165 - DNA, 103 bp, Artificial Sequence
  Synthetic Polynucleotide
taatacgactcactatagggcttttccccactctcactattctggtaattaacagaggagaaattacatgaatagtgagaacctggcggcagcgcaaaagatg

SEQ ID NO: 227166 - DNA, 103 bp, Artificial Sequence
  Synthetic Polynucleotide
taatacgactcactatagggcggcggcgctgagggcgggggcggcgggggaacagaggagacccccgatgcccccgcccaacctggcggcagcgcaaaagatg

SEQ ID NO: 227167 - DNA, 103 bp, Artificial Sequence
  Synthetic Polynucleotide
taatacgactcactatagggatccctcgttcttttccccactctcactataacagaggagaatagtgatggtggggaaaaacctggcggcagcgcaaaagatg

SEQ ID NO: 227168 - DNA, 103 bp, Artificial Sequence
  Synthetic Polynucleotide
taatacgactcactataggggcactctccgatccctcgttcttttccccaaacagaggagatggggaatggaacgagggaacctggcggcagcgcaaaagatg

SEQ ID NO: 227169 - DNA, 103 bp, Artificial Sequence
  Synthetic Polynucleotide
taatacgactcactataggggccttcgggagcactctccgatccctcgttaacagaggagaaacgagatgtcggagagtaacctggcggcagcgcaaaagatg

SEQ ID NO: 227170 - DNA, 103 bp, Artificial Sequence
  Synthetic Polynucleotide
taatacgactcactataggggttgggcctggccttcgggagcactctccgaacagaggagacggagaatgctcccgaagaacctggcggcagcgcaaaagatg

SEQ ID NO: 227171 - DNA, 103 bp, Artificial Sequence
  Synthetic Polynucleotide
taatacgactcactatagggggccggcgttgttgggcctggccttcgggaaacagaggagatcccgaatgccaggcccaaacctggcggcagcgcaaaagatg

SEQ ID NO: 227172 - DNA, 103 bp, Artificial Sequence
  Synthetic Polynucleotide
taatacgactcactatagggcctgcggtagggccggcgttgttgggcctgaacagaggagacaggccatgcaacgccggaacctggcggcagcgcaaaagatg

SEQ ID NO: 227173 - DNA, 103 bp, Artificial Sequence
  Synthetic Polynucleotide
taatacgactcactatagggggaaccttcgcctgcggtagggccggcgttaacagaggagaaacgccatgcctaccgcaaacctggcggcagcgcaaaagatg

SEQ ID NO: 227174 - DNA, 103 bp, Artificial Sequence
  Synthetic Polynucleotide
taatacgactcactatagggtagtaaggtgggaaccttcgcctgcggtagaacagaggagactaccgatggcgaaggttaacctggcggcagcgcaaaagatg

SEQ ID NO: 227175 - DNA, 103 bp, Artificial Sequence
  Synthetic Polynucleotide
taatacgactcactatagggtctccgcatgtagtaaggtgggaaccttcgaacagaggagacgaaggatgccaccttacaacctggcggcagcgcaaaagatg

SEQ ID NO: 227176 - DNA, 103 bp, Artificial Sequence
  Synthetic Polynucleotide
taatacgactcactataggggcccatagggtctccgcatgtagtaaggtgaacagaggagacaccttatgacatgcggaaacctggcggcagcgcaaaagatg

SEQ ID NO: 227177 - DNA, 103 bp, Artificial Sequence
  Synthetic Polynucleotide
taatacgactcactatagggggcttggtgtcggcggcgctgagggcggggaacagaggagaccccgcatgcagcgccgcaacctggcggcagcgcaaaagatg

SEQ ID NO: 227178 - DNA, 103 bp, Artificial Sequence
  Synthetic Polynucleotide
taatacgactcactatagggtgtggtcgacgcccatagggtctccgcatgaacagaggagacatgcgatgaccctatggaacctggcggcagcgcaaaagatg

SEQ ID NO: 227179 - DNA, 103 bp, Artificial Sequence
  Synthetic Polynucleotide
taatacgactcactataggggttggaatactgtggtcgacgcccatagggaacagaggagaccctatatgcgtcgaccaaacctggcggcagcgcaaaagatg

SEQ ID NO: 227180 - DNA, 103 bp, Artificial Sequence
  Synthetic Polynucleotide
taatacgactcactataggggcacaggagggttggaatactgtggtcgacaacagaggagagtcgacatgagtattccaaacctggcggcagcgcaaaagatg

SEQ ID NO: 227181 - DNA, 103 bp, Artificial Sequence
  Synthetic Polynucleotide
taatacgactcactatagggacttctccctgcacaggagggttggaatacaacagaggagagtattcatgccctcctgtaacctggcggcagcgcaaaagatg

SEQ ID NO: 227182 - DNA, 103 bp, Artificial Sequence
  Synthetic Polynucleotide
taatacgactcactatagggaccctccatcacttctccctgcacaggaggaacagaggagacctcctatgcagggagaaaacctggcggcagcgcaaaagatg

SEQ ID NO: 227183 - DNA, 103 bp, Artificial Sequence
  Synthetic Polynucleotide
taatacgactcactatagggggttgtcagcaccctccatcacttctccctaacagaggagaagggagatgtgatggaggaacctggcggcagcgcaaaagatg

SEQ ID NO: 227184 - DNA, 103 bp, Artificial Sequence
  Synthetic Polynucleotide
taatacgactcactatagggcctgcaccctggttgtcagcaccctccatcaacagaggagagatggaatgtgctgacaaaacctggcggcagcgcaaaagatg

SEQ ID NO: 227185 - DNA, 103 bp, Artificial Sequence
  Synthetic Polynucleotide
taatacgactcactatagggaccttgttctcctgcaccctggttgtcagcaacagaggagagctgacatgcagggtgcaaacctggcggcagcgcaaaagatg

SEQ ID NO: 227186 - DNA, 103 bp, Artificial Sequence
  Synthetic Polynucleotide
taatacgactcactatagggtcactggtctaccttgttctcctgcaccctaacagaggagaagggtgatggagaacaagaacctggcggcagcgcaaaagatg

SEQ ID NO: 227187 - DNA, 103 bp, Artificial Sequence
  Synthetic Polynucleotide
taatacgactcactatagggatattctgcctcactggtctaccttgttctaacagaggagaagaacaatgtagaccagtaacctggcggcagcgcaaaagatg

SEQ ID NO: 227188 - DNA, 103 bp, Artificial Sequence
  Synthetic Polynucleotide
taatacgactcactatagggcgtagtgccgggcttggtgtcggcggcgctaacagaggagaagcgccatggacaccaagaacctggcggcagcgcaaaagatg

SEQ ID NO: 227189 - DNA, 103 bp, Artificial Sequence
  Synthetic Polynucleotide
taatacgactcactatagggtccccgatacatattctgcctcactggtctaacagaggagaagaccaatgaggcagaataacctggcggcagcgcaaaagatg

SEQ ID NO: 227190 - DNA, 103 bp, Artificial Sequence
  Synthetic Polynucleotide
taatacgactcactataggggtggtctatatccccgatacatattctgccaacagaggagaggcagaatgtgtatcgggaacctggcggcagcgcaaaagatg

SEQ ID NO: 227191 - DNA, 103 bp, Artificial Sequence
  Synthetic Polynucleotide
taatacgactcactatagggctgcggaatcgtggtctatatccccgatacaacagaggagagtatcgatgatatagaccaacctggcggcagcgcaaaagatg

SEQ ID NO: 227192 - DNA, 103 bp, Artificial Sequence
  Synthetic Polynucleotide
taatacgactcactatagggaggagggcccctgcggaatcgtggtctataaacagaggagatatagaatgcgattccgcaacctggcggcagcgcaaaagatg

SEQ ID NO: 227193 - DNA, 103 bp, Artificial Sequence
  Synthetic Polynucleotide
taatacgactcactataggggtctttggcgaggagggcccctgcggaatcaacagaggagagattccatgggggccctcaacctggcggcagcgcaaaagatg

SEQ ID NO: 227194 - DNA, 103 bp, Artificial Sequence
  Synthetic Polynucleotide
taatacgactcactatagggtctctaggctgtctttggcgaggagggcccaacagaggagagggcccatgtcgccaaagaacctggcggcagcgcaaaagatg

SEQ ID NO: 227195 - DNA, 103 bp, Artificial Sequence
  Synthetic Polynucleotide
taatacgactcactatagggattgccgtcctctctaggctgtctttggcgaacagaggagacgccaaatgcagcctagaaacctggcggcagcgcaaaagatg

SEQ ID NO: 227196 - DNA, 103 bp, Artificial Sequence
  Synthetic Polynucleotide
taatacgactcactatagggtatcttcttcattgccgtcctctctaggctaacagaggagaagcctaatgaggacggcaaacctggcggcagcgcaaaagatg

SEQ ID NO: 227197 - DNA, 103 bp, Artificial Sequence
  Synthetic Polynucleotide
taatacgactcactatagggtgattttctttatcttcttcattgccgtccaacagaggagaggacggatgtgaagaagaaacctggcggcagcgcaaaagatg

SEQ ID NO: 227198 - DNA, 103 bp, Artificial Sequence
  Synthetic Polynucleotide
taatacgactcactatagggctcatctccttgattttctttatcttcttcaacagaggagagaagaaatgaaagaaaataacctggcggcagcgcaaaagatg

SEQ ID NO: 227199 - DNA, 103 bp, Artificial Sequence
  Synthetic Polynucleotide
taatacgactcactatagggcgccgctgcccgtagtgccgggcttggtgtaacagaggagaacaccaatgccggcactaaacctggcggcagcgcaaaagatg

SEQ ID NO: 227200 - DNA, 103 bp, Artificial Sequence
  Synthetic Polynucleotide
taatacgactcactataggggaccttgggtctcatctccttgattttcttaacagaggagaaagaaaatgaaggagatgaacctggcggcagcgcaaaagatg

SEQ ID NO: 227201 - DNA, 103 bp, Artificial Sequence
  Synthetic Polynucleotide
taatacgactcactatagggggtggctgctgaccttgggtctcatctcctaacagaggagaaggagaatggacccaaggaacctggcggcagcgcaaaagatg

SEQ ID NO: 227202 - DNA, 103 bp, Artificial Sequence
  Synthetic Polynucleotide
taatacgactcactatagggccgacgttgaggtggctgctgaccttgggtaacagaggagaacccaaatgcagcagccaaacctggcggcagcgcaaaagatg

SEQ ID NO: 227203 - DNA, 103 bp, Artificial Sequence
  Synthetic Polynucleotide
taatacgactcactatagggtgcggcggtaccgacgttgaggtggctgctaacagaggagaagcagcatgctcaacgtcaacctggcggcagcgcaaaagatg

SEQ ID NO: 227204 - DNA, 103 bp, Artificial Sequence
  Synthetic Polynucleotide
taatacgactcactatagggtaattgaagttgcggcggtaccgacgttgaaacagaggagatcaacgatggtaccgccgaacctggcggcagcgcaaaagatg

SEQ ID NO: 227205 - DNA, 103 bp, Artificial Sequence
  Synthetic Polynucleotide
taatacgactcactatagggtctgcgtcggtaattgaagttgcggcggtaaacagaggagataccgcatgaacttcaataacctggcggcagcgcaaaagatg

SEQ ID NO: 227206 - DNA, 103 bp, Artificial Sequence
  Synthetic Polynucleotide
taatacgactcactatagggtttctgggcgtctgcgtcggtaattgaagtaacagaggagaacttcaatgaccgacgcaaacctggcggcagcgcaaaagatg

SEQ ID NO: 227207 - DNA, 103 bp, Artificial Sequence
  Synthetic Polynucleotide
taatacgactcactatagggggtttagggttttctgggcgtctgcgtcggaacagaggagaccgacgatgacgcccagaaacctggcggcagcgcaaaagatg

SEQ ID NO: 227208 - DNA, 103 bp, Artificial Sequence
  Synthetic Polynucleotide
taatacgactcactataggggccatcttgtggtttagggttttctgggcgaacagaggagacgcccaatgaaccctaaaaacctggcggcagcgcaaaagatg

SEQ ID NO: 227209 - DNA, 103 bp, Artificial Sequence
  Synthetic Polynucleotide
taatacgactcactatagggttgtctctttgccatcttgtggtttagggtaacagaggagaaccctaatgcacaagatgaacctggcggcagcgcaaaagatg

SEQ ID NO: 227210 - DNA, 103 bp, Artificial Sequence
  Synthetic Polynucleotide
taatacgactcactatagggccgctccctgcgccgctgcccgtagtgccgaacagaggagacggcacatggggcagcggaacctggcggcagcgcaaaagatg

SEQ ID NO: 227211 - DNA, 103 bp, Artificial Sequence
  Synthetic Polynucleotide
taatacgactcactatagggtcggctgcttttgtctctttgccatcttgtaacagaggagaacaagaatgcaaagagacaacctggcggcagcgcaaaagatg

SEQ ID NO: 227212 - DNA, 103 bp, Artificial Sequence
  Synthetic Polynucleotide
taatacgactcactatagggagctggtggatcggctgcttttgtctctttaacagaggagaaaagagatgaaagcagccaacctggcggcagcgcaaaagatg

SEQ ID NO: 227213 - DNA, 103 bp, Artificial Sequence
  Synthetic Polynucleotide
taatacgactcactatagggacgaattctcagctggtggatcggctgcttaacagaggagaaagcagatgatccaccagaacctggcggcagcgcaaaagatg

SEQ ID NO: 227214 - DNA, 103 bp, Artificial Sequence
  Synthetic Polynucleotide
taatacgactcactatagggtcgggagcggacgaattctcagctggtggaaacagaggagatccaccatgtgagaattcaacctggcggcagcgcaaaagatg

SEQ ID NO: 227215 - DNA, 103 bp, Artificial Sequence
  Synthetic Polynucleotide
taatacgactcactatagggctgctcagcctcgggagcggacgaattctcaacagaggagagagaatatgtccgctcccaacctggcggcagcgcaaaagatg

SEQ ID NO: 227216 - DNA, 103 bp, Artificial Sequence
  Synthetic Polynucleotide
taatacgactcactatagggcagccccgccctgctcagcctcgggagcggaacagaggagaccgctcatgaggctgagcaacctggcggcagcgcaaaagatg

SEQ ID NO: 227217 - DNA, 103 bp, Artificial Sequence
  Synthetic Polynucleotide
taatacgactcactatagggggtggtggtggcctcgcccgcctcactcataacagaggagaatgagtatggcgggcgagaacctggcggcagcgcaaaagatg

SEQ ID NO: 227218 - DNA, 103 bp, Artificial Sequence
  Synthetic Polynucleotide
taatacgactcactatagggcgcaccgctgcccaccgggctcttgggcgcaacagaggagagcgcccatgagcccggtgaacctggcggcagcgcaaaagatg

SEQ ID NO: 227219 - DNA, 103 bp, Artificial Sequence
  Synthetic Polynucleotide
taatacgactcactatagggacgcgggcgacgccggtaattgtagggacgaacagaggagacgtcccatgaattaccggaacctggcggcagcgcaaaagatg

SEQ ID NO: 227220 - DNA, 103 bp, Artificial Sequence
  Synthetic Polynucleotide
taatacgactcactatagggcgttaggaggacgcgggcgacgccggtaataacagaggagaattaccatggtcgcccgcaacctggcggcagcgcaaaagatg

SEQ ID NO: 227221 - DNA, 103 bp, Artificial Sequence
  Synthetic Polynucleotide
taatacgactcactatagggtgtgaaggagcgttaggaggacgcgggcgaaacagaggagatcgcccatgtcctcctaaaacctggcggcagcgcaaaagatg

SEQ ID NO: 227222 - DNA, 103 bp, Artificial Sequence
  Synthetic Polynucleotide
taatacgactcactatagggtttgccatcttgtgaaggagcgttaggaggaacagaggagacctcctatggctccttcaaacctggcggcagcgcaaaagatg

SEQ ID NO: 227223 - DNA, 103 bp, Artificial Sequence
  Synthetic Polynucleotide
taatacgactcactatagggccttggcctctttgccatcttgtgaaggagaacagaggagactccttatgaagatggcaaacctggcggcagcgcaaaagatg

SEQ ID NO: 227224 - DNA, 103 bp, Artificial Sequence
  Synthetic Polynucleotide
taatacgactcactataggggcttcacctgccttggcctctttgccatctaacagaggagaagatggatgagaggccaaaacctggcggcagcgcaaaagatg

SEQ ID NO: 227225 - DNA, 103 bp, Artificial Sequence
  Synthetic Polynucleotide
taatacgactcactatagggctcagttggtgcttcacctgccttggcctcaacagaggagagaggccatggcaggtgaaaacctggcggcagcgcaaaagatg

SEQ ID NO: 227226 - DNA, 103 bp, Artificial Sequence
  Synthetic Polynucleotide
taatacgactcactataggggagcagggttctcagttggtgcttcacctgaacagaggagacaggtgatgcaccaactgaacctggcggcagcgcaaaagatg

SEQ ID NO: 227227 - DNA, 103 bp, Artificial Sequence
  Synthetic Polynucleotide
taatacgactcactatagggtgggtgggtggagcagggttctcagttggtaacagaggagaaccaacatggaaccctgcaacctggcggcagcgcaaaagatg

SEQ ID NO: 227228 - DNA, 103 bp, Artificial Sequence
  Synthetic Polynucleotide
taatacgactcactatagggactgctctgctgggtgggtggagcagggttaacagaggagaaaccctatgccacccaccaacctggcggcagcgcaaaagatg

SEQ ID NO: 227229 - DNA, 103 bp, Artificial Sequence
  Synthetic Polynucleotide
taatacgactcactatagggcggcctggggcgcaccgctgcccaccgggcaacagaggagagcccggatggcagcggtgaacctggcggcagcgcaaaagatg

SEQ ID NO: 227230 - DNA, 103 bp, Artificial Sequence
  Synthetic Polynucleotide
taatacgactcactataggggccggggccgcggcctggggcgcaccgctgaacagaggagacagcggatggccccaggcaacctggcggcagcgcaaaagatg

SEQ ID NO: 227231 - DNA, 103 bp, Artificial Sequence
  Synthetic Polynucleotide
taatacgactcactatagggggcggcgggcgccggggccgcggcctggggaacagaggagaccccagatggcggccccgaacctggcggcagcgcaaaagatg

SEQ ID NO: 227232 - DNA, 103 bp, Artificial Sequence
  Synthetic Polynucleotide
taatacgactcactatagggctgcgacgtgggcggcgggcgccggggccgaacagaggagacggcccatgcgcccgccgaacctggcggcagcgcaaaagatg

SEQ ID NO: 227233 - DNA, 103 bp, Artificial Sequence
  Synthetic Polynucleotide
taatacgactcactatagggccggggtttcctgcgacgtgggcggcgggcaacagaggagagcccgcatgccacgtcgcaacctggcggcagcgcaaaagatg

SEQ ID NO: 227234 - DNA, 103 bp, Artificial Sequence
  Synthetic Polynucleotide
taatacgactcactatagggcgcgtccccaccggggtttcctgcgacgtgaacagaggagacacgtcatgggaaaccccaacctggcggcagcgcaaaagatg

SEQ ID NO: 227235 - DNA, 103 bp, Artificial Sequence
  Synthetic Polynucleotide
taatacgactcactatagggctgcgggggccgcgtccccaccggggtttcaacagaggagagaaaccatggtggggacgaacctggcggcagcgcaaaagatg

SEQ ID NO: 227236 - DNA, 103 bp, Artificial Sequence
  Synthetic Polynucleotide
taatacgactcactataggggtgcccgtggctgcgggggccgcgtccccaaacagaggagatggggaatgggcccccgcaacctggcggcagcgcaaaagatg

SEQ ID NO: 227237 - DNA, 103 bp, Artificial Sequence
  Synthetic Polynucleotide
taatacgactcactatagggggcggccgcggtgcccgtggctgcgggggcaacagaggagagcccccatggccacgggcaacctggcggcagcgcaaaagatg

SEQ ID NO: 227238 - DNA, 103 bp, Artificial Sequence
  Synthetic Polynucleotide
taatacgactcactatagggtggtggtggtggtggtggtggcctcgcccgaacagaggagacgggcgatgccaccaccaaacctggcggcagcgcaaaagatg

SEQ ID NO: 227239 - DNA, 103 bp, Artificial Sequence
  Synthetic Polynucleotide
taatacgactcactatagggctaaagaggcggcggccgcggtgcccgtggaacagaggagaccacggatgccgcggccgaacctggcggcagcgcaaaagatg

SEQ ID NO: 227240 - DNA, 103 bp, Artificial Sequence
  Synthetic Polynucleotide
taatacgactcactataggggcggcggtggctaaagaggcggcggccgcgaacagaggagacgcggcatgcgcctctttaacctggcggcagcgcaaaagatg

SEQ ID NO: 227241 - DNA, 103 bp, Artificial Sequence
  Synthetic Polynucleotide
taatacgactcactatagggttcgctgccggcggcggtggctaaagaggcaacagaggagagcctctatggccaccgccaacctggcggcagcgcaaaagatg

SEQ ID NO: 227242 - DNA, 103 bp, Artificial Sequence
  Synthetic Polynucleotide
taatacgactcactatagggtctccgcgtcttcgctgccggcggcggtggaacagaggagaccaccgatgccggcagcgaacctggcggcagcgcaaaagatg

SEQ ID NO: 227243 - DNA, 103 bp, Artificial Sequence
  Synthetic Polynucleotide
taatacgactcactatagggagaacttttttctccgcgtcttcgctgccgaacagaggagacggcagatgagacgcggaaacctggcggcagcgcaaaagatg

SEQ ID NO: 227244 - DNA, 103 bp, Artificial Sequence
  Synthetic Polynucleotide
taatacgactcactatagggtttggtggcgagaacttttttctccgcgtcaacagaggagagacgcgatgaaaaaagttaacctggcggcagcgcaaaagatg

SEQ ID NO: 227245 - DNA, 103 bp, Artificial Sequence
  Synthetic Polynucleotide
taatacgactcactatagggtgccaaggactttggtggcgagaactttttaacagaggagaaaaaagatgtcgccaccaaacctggcggcagcgcaaaagatg

SEQ ID NO: 227246 - DNA, 103 bp, Artificial Sequence
  Synthetic Polynucleotide
taatacgactcactatagggcatttgacagtgccaaggactttggtggcgaacagaggagacgccacatgagtccttggaacctggcggcagcgcaaaagatg

SEQ ID NO: 227247 - DNA, 103 bp, Artificial Sequence
  Synthetic Polynucleotide
taatacgactcactataggggacgttgaaccatttgacagtgccaaggacaacagaggagagtccttatgactgtcaaaaacctggcggcagcgcaaaagatg

SEQ ID NO: 227248 - DNA, 103 bp, Artificial Sequence
  Synthetic Polynucleotide
taatacgactcactatagggatccatttctgacgttgaaccatttgacagaacagaggagactgtcaatgggttcaacgaacctggcggcagcgcaaaagatg

SEQ ID NO: 227249 - DNA, 103 bp, Artificial Sequence
  Synthetic Polynucleotide
taatacgactcactatagggtgcgggagggtggtggtggtggtggtggtgaacagaggagacaccacatgcaccaccacaacctggcggcagcgcaaaagatg

SEQ ID NO: 227250 - DNA, 103 bp, Artificial Sequence
  Synthetic Polynucleotide
taatacgactcactatagggataaatccatatccatttctgacgttgaacaacagaggagagttcaaatgcagaaatggaacctggcggcagcgcaaaagatg

SEQ ID NO: 227251 - DNA, 103 bp, Artificial Sequence
  Synthetic Polynucleotide
taatacgactcactatagggatttcgatttataaatccatatccatttctaacagaggagaagaaatatgtatggatttaacctggcggcagcgcaaaagatg

SEQ ID NO: 227252 - DNA, 103 bp, Artificial Sequence
  Synthetic Polynucleotide
taatacgactcactatagggctttggtgtcatttcgatttataaatccataacagaggagaatggatatgtaaatcgaaaacctggcggcagcgcaaaagatg

SEQ ID NO: 227253 - DNA, 103 bp, Artificial Sequence
  Synthetic Polynucleotide
taatacgactcactatagggaatacatcttctttggtgtcatttcgatttaacagaggagaaaatcgatgtgacaccaaaacctggcggcagcgcaaaagatg

SEQ ID NO: 227254 - DNA, 103 bp, Artificial Sequence
  Synthetic Polynucleotide
taatacgactcactatagggctgatgtacaaatacatcttctttggtgtcaacagaggagagacaccatggaagatgtaaacctggcggcagcgcaaaagatg

SEQ ID NO: 227255 - DNA, 103 bp, Artificial Sequence
  Synthetic Polynucleotide
taatacgactcactatagggtgatggcagtctgatgtacaaatacatcttaacagaggagaaagatgatgttgtacatcaacctggcggcagcgcaaaagatg

SEQ ID NO: 227256 - DNA, 103 bp, Artificial Sequence
  Synthetic Polynucleotide
taatacgactcactatagggttattcttcttgatggcagtctgatgtacaaacagaggagatgtacaatggactgccataacctggcggcagcgcaaaagatg

SEQ ID NO: 227257 - DNA, 103 bp, Artificial Sequence
  Synthetic Polynucleotide
taatacgactcactatagggtttccgtgggttattcttcttgatggcagtaacagaggagaactgccatgaagaagaataacctggcggcagcgcaaaagatg

SEQ ID NO: 227258 - DNA, 103 bp, Artificial Sequence
  Synthetic Polynucleotide
taatacgactcactatagggtgcgcagatatttccgtgggttattcttctaacagaggagaagaagaatgacccacggaaacctggcggcagcgcaaaagatg

SEQ ID NO: 227259 - DNA, 103 bp, Artificial Sequence
  Synthetic Polynucleotide
taatacgactcactatagggtctcctacactgcgcagatatttccgtgggaacagaggagacccacgatgatatctgcgaacctggcggcagcgcaaaagatg

SEQ ID NO: 227260 - DNA, 103 bp, Artificial Sequence
  Synthetic Polynucleotide
taatacgactcactatagggcgtcggagcctgcgggagggtggtggtggtaacagaggagaaccaccatgaccctcccgaacctggcggcagcgcaaaagatg

SEQ ID NO: 227261 - DNA, 103 bp, Artificial Sequence
  Synthetic Polynucleotide
taatacgactcactatagggagtttctccatctcctacactgcgcagataaacagaggagatatctgatgagtgtaggaaacctggcggcagcgcaaaagatg

SEQ ID NO: 227262 - DNA, 103 bp, Artificial Sequence
  Synthetic Polynucleotide
taatacgactcactatagggcaaactctacagtttctccatctcctacacaacagaggagagtgtagatgatggagaaaaacctggcggcagcgcaaaagatg

SEQ ID NO: 227263 - DNA, 103 bp, Artificial Sequence
  Synthetic Polynucleotide
taatacgactcactatagggtcaaccacatcaaactctacagtttctccaaacagaggagatggagaatgtgtagagttaacctggcggcagcgcaaaagatg

SEQ ID NO: 227264 - DNA, 103 bp, Artificial Sequence
  Synthetic Polynucleotide
taatacgactcactatagggcttctctccttcaaccacatcaaactctacaacagaggagagtagagatggatgtggttaacctggcggcagcgcaaaagatg

SEQ ID NO: 227265 - DNA, 103 bp, Artificial Sequence
  Synthetic Polynucleotide
taatacgactcactatagggcttctgcacccttctctccttcaaccacataacagaggagaatgtggatgaaggagagaaacctggcggcagcgcaaaagatg

SEQ ID NO: 227266 - DNA, 103 bp, Artificial Sequence
  Synthetic Polynucleotide
taatacgactcactatagggacattggcagcttctgcacccttctctcctaacagaggagaaggagaatggggtgcagaaacctggcggcagcgcaaaagatg

SEQ ID NO: 227267 - DNA, 103 bp, Artificial Sequence
  Synthetic Polynucleotide
taatacgactcactatagggcgggccagtcacattggcagcttctgcaccaacagaggagaggtgcaatggctgccaataacctggcggcagcgcaaaagatg

SEQ ID NO: 227268 - DNA, 103 bp, Artificial Sequence
  Synthetic Polynucleotide
taatacgactcactataggggaactccatccgggccagtcacattggcagaacagaggagactgccaatgtgactggccaacctggcggcagcgcaaaagatg

SEQ ID NO: 227269 - DNA, 103 bp, Artificial Sequence
  Synthetic Polynucleotide
taatacgactcactatagggccttccacaggaactccatccgggccagtcaacagaggagagactggatgggatggagtaacctggcggcagcgcaaaagatg

SEQ ID NO: 227270 - DNA, 103 bp, Artificial Sequence
  Synthetic Polynucleotide
taatacgactcactataggggtaacgactcccttccacaggaactccatcaacagaggagagatggaatgcctgtggaaaacctggcggcagcgcaaaagatg

SEQ ID NO: 227271 - DNA, 103 bp, Artificial Sequence
  Synthetic Polynucleotide
taatacgactcactatagggcggccgcctccgtcggagcctgcgggagggaacagaggagaccctccatgaggctccgaaacctggcggcagcgcaaaagatg

SEQ ID NO: 227272 - DNA, 103 bp, Artificial Sequence
  Synthetic Polynucleotide
taatacgactcactataggggatctgcagcgtaacgactcccttccacagaacagaggagactgtggatgggagtcgttaacctggcggcagcgcaaaagatg

SEQ ID NO: 227273 - DNA, 103 bp, Artificial Sequence
  Synthetic Polynucleotide
taatacgactcactatagggtaacggcgccgatctgcagcgtaacgactcaacagaggagagagtcgatgcgctgcagaaacctggcggcagcgcaaaagatg

SEQ ID NO: 227274 - DNA, 103 bp, Artificial Sequence
  Synthetic Polynucleotide
taatacgactcactataggggccacgtctgtaacggcgccgatctgcagcaacagaggagagctgcaatgcggcgccgtaacctggcggcagcgcaaaagatg

SEQ ID NO: 227275 - DNA, 103 bp, Artificial Sequence
  Synthetic Polynucleotide
taatacgactcactatagggttccatagtagccacgtctgtaacggcgccaacagaggagaggcgccatgacagacgtgaacctggcggcagcgcaaaagatg

SEQ ID NO: 227276 - DNA, 103 bp, Artificial Sequence
  Synthetic Polynucleotide
taatacgactcactatagggccacggcgccttccatagtagccacgtctgaacagaggagacagacgatgctactatggaacctggcggcagcgcaaaagatg

SEQ ID NO: 227277 - DNA, 103 bp, Artificial Sequence
  Synthetic Polynucleotide
taatacgactcactatagggccggggagggccacggcgccttccatagtaaacagaggagatactatatgaggcgccgtaacctggcggcagcgcaaaagatg

SEQ ID NO: 227278 - DNA, 103 bp, Artificial Sequence
  Synthetic Polynucleotide
taatacgactcactatagggcagcgtaattccggggagggccacggcgccaacagaggagaggcgccatggccctccccaacctggcggcagcgcaaaagatg

SEQ ID NO: 227279 - DNA, 103 bp, Artificial Sequence
  Synthetic Polynucleotide
taatacgactcactatagggtcctcctccccagcgtaattccggggagggaacagaggagaccctccatggaattacgcaacctggcggcagcgcaaaagatg

SEQ ID NO: 227280 - DNA, 103 bp, Artificial Sequence
  Synthetic Polynucleotide
taatacgactcactatagggcccttcctcctcctcctccccagcgtaattaacagaggagaaattacatgggggaggagaacctggcggcagcgcaaaagatg

SEQ ID NO: 227281 - DNA, 103 bp, Artificial Sequence
  Synthetic Polynucleotide
taatacgactcactatagggtgctgccgctcccttcctcctcctcctcccaacagaggagagggaggatgaggaggaagaacctggcggcagcgcaaaagatg

SEQ ID NO: 227282 - DNA, 103 bp, Artificial Sequence
  Synthetic Polynucleotide
taatacgactcactatagggggagccgcggcggccgcctccgtcggagccaacagaggagaggctccatgggaggcggcaacctggcggcagcgcaaaagatg

SEQ ID NO: 227283 - DNA, 103 bp, Artificial Sequence
  Synthetic Polynucleotide
taatacgactcactatagggaatccttcactgctgccgctcccttcctccaacagaggagaggaggaatggagcggcagaacctggcggcagcgcaaaagatg

SEQ ID NO: 227284 - DNA, 103 bp, Artificial Sequence
  Synthetic Polynucleotide
taatacgactcactatagggaggggggtcaaatccttcactgctgccgctaacagaggagaagcggcatgagtgaaggaaacctggcggcagcgcaaaagatg

SEQ ID NO: 227285 - DNA, 103 bp, Artificial Sequence
  Synthetic Polynucleotide
taatacgactcactatagggtatcagtggcaggggggtcaaatccttcacaacagaggagagtgaagatgttgacccccaacctggcggcagcgcaaaagatg

SEQ ID NO: 227286 - DNA, 103 bp, Artificial Sequence
  Synthetic Polynucleotide
taatacgactcactataggggagaactgcctatcagtggcaggggggtcaaacagaggagatgacccatgtgccactgaaacctggcggcagcgcaaaagatg

SEQ ID NO: 227287 - DNA, 103 bp, Artificial Sequence
  Synthetic Polynucleotide
taatacgactcactatagggccgggccccagagaactgcctatcagtggcaacagaggagagccactatgaggcagttcaacctggcggcagcgcaaaagatg

SEQ ID NO: 227288 - DNA, 103 bp, Artificial Sequence
  Synthetic Polynucleotide
taatacgactcactataggggcagctgattccgggccccagagaactgccaacagaggagaggcagtatgctggggcccaacctggcggcagcgcaaaagatg

SEQ ID NO: 227289 - DNA, 103 bp, Artificial Sequence
  Synthetic Polynucleotide
taatacgactcactatagggtgggggcggcgcagctgattccgggccccaaacagaggagatggggcatggaatcagctaacctggcggcagcgcaaaagatg

SEQ ID NO: 227290 - DNA, 103 bp, Artificial Sequence
  Synthetic Polynucleotide
taatacgactcactatagggagggcgatactgggggcggcgcagctgattaacagaggagaaatcagatgcgccgccccaacctggcggcagcgcaaaagatg

SEQ ID NO: 227291 - DNA, 103 bp, Artificial Sequence
  Synthetic Polynucleotide
taatacgactcactataggggccggtactgagggcgatactgggggcggcaacagaggagagccgccatgagtatcgccaacctggcggcagcgcaaaagatg

SEQ ID NO: 227292 - DNA, 103 bp, Artificial Sequence
  Synthetic Polynucleotide
taatacgactcactatagggaaccgccgctgccggtactgagggcgatacaacagaggagagtatcgatgtcagtaccgaacctggcggcagcgcaaaagatg

SEQ ID NO: 227293 - DNA, 103 bp, Artificial Sequence
  Synthetic Polynucleotide
taatacgactcactatagggggggtcctggggagccgcggcggccgcctcaacagaggagagaggcgatggccgcggctaacctggcggcagcgcaaaagatg

SEQ ID NO: 227294 - DNA, 103 bp, Artificial Sequence
  Synthetic Polynucleotide
taatacgactcactataggggtaaggcgggaaccgccgctgccggtactgaacagaggagacagtacatgcagcggcggaacctggcggcagcgcaaaagatg

SEQ ID NO: 227295 - DNA, 103 bp, Artificial Sequence
  Synthetic Polynucleotide
taatacgactcactataggggtcccacgtggtaaggcgggaaccgccgctaacagaggagaagcggcatgtcccgccttaacctggcggcagcgcaaaagatg

SEQ ID NO: 227296 - DNA, 103 bp, Artificial Sequence
  Synthetic Polynucleotide
taatacgactcactatagggtcaaaggtctgtcccacgtggtaaggcgggaacagaggagacccgccatgccacgtgggaacctggcggcagcgcaaaagatg

SEQ ID NO: 227297 - DNA, 103 bp, Artificial Sequence
  Synthetic Polynucleotide
taatacgactcactatagggtgagcgacggtcaaaggtctgtcccacgtgaacagaggagacacgtgatgcagacctttaacctggcggcagcgcaaaagatg

SEQ ID NO: 227298 - DNA, 103 bp, Artificial Sequence
  Synthetic Polynucleotide
taatacgactcactataggggtaagacccgtgagcgacggtcaaaggtctaacagaggagaagacctatgaccgtcgctaacctggcggcagcgcaaaagatg

SEQ ID NO: 227299 - DNA, 103 bp, Artificial Sequence
  Synthetic Polynucleotide
taatacgactcactatagggttgggatggggtaagacccgtgagcgacggaacagaggagaccgtcgatgacgggtcttaacctggcggcagcgcaaaagatg

SEQ ID NO: 227300 - DNA, 103 bp, Artificial Sequence
  Synthetic Polynucleotide
taatacgactcactatagggctgtattctgttgggatggggtaagacccgaacagaggagacgggtcatgccccatcccaacctggcggcagcgcaaaagatg

SEQ ID NO: 227301 - DNA, 103 bp, Artificial Sequence
  Synthetic Polynucleotide
taatacgactcactatagggtctcaccagcctgtattctgttgggatgggaacagaggagacccatcatgacagaatacaacctggcggcagcgcaaaagatg

SEQ ID NO: 227302 - DNA, 103 bp, Artificial Sequence
  Synthetic Polynucleotide
taatacgactcactatagggatctctccaatctcaccagcctgtattctgaacagaggagacagaatatgggctggtgaaacctggcggcagcgcaaaagatg

SEQ ID NO: 227303 - DNA, 103 bp, Artificial Sequence
  Synthetic Polynucleotide
taatacgactcactatagggtccatccttcatctctccaatctcaccagcaacagaggagagctggtatgattggagagaacctggcggcagcgcaaaagatg

SEQ ID NO: 227304 - DNA, 103 bp, Artificial Sequence
  Synthetic Polynucleotide
taatacgactcactatagggtcttgggcgcggggtcctggggagccgcggaacagaggagaccgcggatgcccaggaccaacctggcggcagcgcaaaagatg

SEQ ID NO: 227305 - DNA, 103 bp, Artificial Sequence
  Synthetic Polynucleotide
taatacgactcactatagggcctctgggactccatccttcatctctccaaaacagaggagattggagatgtgaaggatgaacctggcggcagcgcaaaagatg

SEQ ID NO: 227306 - DNA, 103 bp, Artificial Sequence
  Synthetic Polynucleotide
taatacgactcactatagggagttgtgctccctctgggactccatccttcaacagaggagagaaggaatgagtcccagaaacctggcggcagcgcaaaagatg

SEQ ID NO: 227307 - DNA, 103 bp, Artificial Sequence
  Synthetic Polynucleotide
taatacgactcactatagggcggtccctgaagttgtgctccctctgggacaacagaggagagtcccaatgggagcacaaaacctggcggcagcgcaaaagatg

SEQ ID NO: 227308 - DNA, 103 bp, Artificial Sequence
  Synthetic Polynucleotide
taatacgactcactatagggttcgatgaaccggtccctgaagttgtgctcaacagaggagagagcacatgttcagggacaacctggcggcagcgcaaaagatg

SEQ ID NO: 227309 - DNA, 103 bp, Artificial Sequence
  Synthetic Polynucleotide
taatacgactcactatagggtaagttggatttcgatgaaccggtccctgaaacagaggagatcagggatgggttcatcgaacctggcggcagcgcaaaagatg

SEQ ID NO: 227310 - DNA, 103 bp, Artificial Sequence
  Synthetic Polynucleotide
taatacgactcactatagggccttgggcggtaagttggatttcgatgaacaacagaggagagttcatatgaatccaactaacctggcggcagcgcaaaagatg

SEQ ID NO: 227311 - DNA, 103 bp, Artificial Sequence
  Synthetic Polynucleotide
taatacgactcactatagggtgctacggtaccttgggcggtaagttggataacagaggagaatccaaatgaccgcccaaaacctggcggcagcgcaaaagatg

SEQ ID NO: 227312 - DNA, 103 bp, Artificial Sequence
  Synthetic Polynucleotide
taatacgactcactatagggggaggtcccctgctacggtaccttgggcggaacagaggagaccgcccatggtaccgtagaacctggcggcagcgcaaaagatg

SEQ ID NO: 227313 - DNA, 103 bp, Artificial Sequence
  Synthetic Polynucleotide
taatacgactcactatagggtcgtgggcgaggaggtcccctgctacggtaaacagaggagataccgtatgaggggacctaacctggcggcagcgcaaaagatg

SEQ ID NO: 227314 - DNA, 103 bp, Artificial Sequence
  Synthetic Polynucleotide
taatacgactcactatagggctggggcaggtcgtgggcgaggaggtccccaacagaggagaggggacatgctcgcccacaacctggcggcagcgcaaaagatg

SEQ ID NO: 227315 - DNA, 103 bp, Artificial Sequence
  Synthetic Polynucleotide
taatacgactcactatagggcccaccgggctcttgggcgcggggtcctggaacagaggagaccaggaatgcgcgcccaaaacctggcggcagcgcaaaagatg

SEQ ID NO: 227316 - DNA, 103 bp, Artificial Sequence
  Synthetic Polynucleotide
taatacgactcactatagggtctccaactgctggggcaggtcgtgggcgaaacagaggagatcgcccatgacctgccccaacctggcggcagcgcaaaagatg

SEQ ID NO: 227317 - DNA, 103 bp, Artificial Sequence
  Synthetic Polynucleotide
taatacgactcactatagggatcttcagcctctccaactgctggggcaggaacagaggagacctgccatggcagttggaaacctggcggcagcgcaaaagatg

SEQ ID NO: 227318 - DNA, 103 bp, Artificial Sequence
  Synthetic Polynucleotide
taatacgactcactataggggattttctttatcttcagcctctccaactgaacagaggagacagttgatgaggctgaagaacctggcggcagcgcaaaagatg

SEQ ID NO: 227319 - DNA, 103 bp, Artificial Sequence
  Synthetic Polynucleotide
taatacgactcactataggggtggcttgctgattttctttatcttcagccaacagaggagaggctgaatgtaaagaaaaaacctggcggcagcgcaaaagatg

SEQ ID NO: 227320 - DNA, 103 bp, Artificial Sequence
  Synthetic Polynucleotide
taatacgactcactatagggtggaccactggtggcttgctgattttctttaacagaggagaaaagaaatgcagcaagccaacctggcggcagcgcaaaagatg

SEQ ID NO: 227321 - DNA, 103 bp, Artificial Sequence
  Synthetic Polynucleotide
taatacgactcactatagggacggctggtttggaccactggtggcttgctaacagaggagaagcaagatgccagtggtcaacctggcggcagcgcaaaagatg

SEQ ID NO: 227322 - DNA, 103 bp, Artificial Sequence
  Synthetic Polynucleotide
taatacgactcactatagggcggcgaacagacggctggtttggaccactgaacagaggagacagtggatgaaaccagccaacctggcggcagcgcaaaagatg

SEQ ID NO: 227323 - DNA, 103 bp, Artificial Sequence
  Synthetic Polynucleotide
taatacgactcactatagggccggtatccacggcgaacagacggctggttaacagaggagaaaccagatgtctgttcgcaacctggcggcagcgcaaaagatg

SEQ ID NO: 227324 - DNA, 103 bp, Artificial Sequence
  Synthetic Polynucleotide
taatacgactcactatagggtgtagggacgccggtatccacggcgaacagaacagaggagactgttcatggtggataccaacctggcggcagcgcaaaagatg

SEQ ID NO: 227325 - DNA, 103 bp, Artificial Sequence
  Synthetic Polynucleotide
taatacgactcactatagggcgccggtaattgtagggacgccggtatccaaacagaggagatggataatggcgtccctaaacctggcggcagcgcaaaagatg

SEQ ID NO: 227326 - DNA, 103 bp, Artificial Sequence
  Synthetic Polynucleotide
taatacgactcactatagggggcgatgtagagggtgtcgcccgaggccataacagaggagaatggccatgggcgacaccaacctggcggcagcgcaaaagatg

SEQ ID NO: 227327 - DNA, 103 bp, Artificial Sequence
  Synthetic Polynucleotide
taatacgactcactatagggcactgtggtctcgatggtctccaccgggataacagaggagaatcccgatggagaccatcaacctggcggcagcgcaaaagatg

SEQ ID NO: 227328 - DNA, 103 bp, Artificial Sequence
  Synthetic Polynucleotide
taatacgactcactatagggtagttttgaactctcaacaaaagctttgccaacagaggagaggcaaaatgtttgttgagaacctggcggcagcgcaaaagatg

SEQ ID NO: 227329 - DNA, 103 bp, Artificial Sequence
  Synthetic Polynucleotide
taatacgactcactatagggggtgtcgttttagttttgaactctcaacaaaacagaggagattgttgatggttcaaaacaacctggcggcagcgcaaaagatg

SEQ ID NO: 227330 - DNA, 103 bp, Artificial Sequence
  Synthetic Polynucleotide
taatacgactcactatagggtgaaccagttggtgtcgttttagttttgaaaacagaggagattcaaaatgaaaacgacaaacctggcggcagcgcaaaagatg

SEQ ID NO: 227331 - DNA, 103 bp, Artificial Sequence
  Synthetic Polynucleotide
taatacgactcactatagggctctccagtatgaaccagttggtgtcgtttaacagaggagaaaacgaatgcaactggttaacctggcggcagcgcaaaagatg

SEQ ID NO: 227332 - DNA, 103 bp, Artificial Sequence
  Synthetic Polynucleotide
taatacgactcactataggggaaagggcttctctccagtatgaaccagttaacagaggagaaactggatgatactggagaacctggcggcagcgcaaaagatg

SEQ ID NO: 227333 - DNA, 103 bp, Artificial Sequence
  Synthetic Polynucleotide
taatacgactcactatagggaacgtgcactgaaagggcttctctccagtaaacagaggagatactggatggaagcccttaacctggcggcagcgcaaaagatg

SEQ ID NO: 227334 - DNA, 103 bp, Artificial Sequence
  Synthetic Polynucleotide
taatacgactcactatagggacagccttcgaacgtgcactgaaagggcttaacagaggagaaagcccatgcagtgcacgaacctggcggcagcgcaaaagatg

SEQ ID NO: 227335 - DNA, 103 bp, Artificial Sequence
  Synthetic Polynucleotide
taatacgactcactatagggagcgtttcccacagccttcgaacgtgcactaacagaggagaagtgcaatgtcgaaggctaacctggcggcagcgcaaaagatg

SEQ ID NO: 227336 - DNA, 103 bp, Artificial Sequence
  Synthetic Polynucleotide
taatacgactcactatagggtccagtgaaaagcgtttcccacagccttcgaacagaggagacgaaggatgtgggaaacgaacctggcggcagcgcaaaagatg

SEQ ID NO: 227337 - DNA, 103 bp, Artificial Sequence
  Synthetic Polynucleotide
taatacgactcactatagggcaaattgaagtccagtgaaaagcgtttcccaacagaggagagggaaaatgttttcactgaacctggcggcagcgcaaaagatg

SEQ ID NO: 227338 - DNA, 103 bp, Artificial Sequence
  Synthetic Polynucleotide
taatacgactcactatagggcctcgcccaccactgtggtctcgatggtctaacagaggagaagaccaatgagaccacagaacctggcggcagcgcaaaagatg

SEQ ID NO: 227339 - DNA, 103 bp, Artificial Sequence
  Synthetic Polynucleotide
taatacgactcactatagggcatgtgtgcgcaaattgaagtccagtgaaaaacagaggagatttcacatgacttcaattaacctggcggcagcgcaaaagatg

SEQ ID NO: 227340 - DNA, 103 bp, Artificial Sequence
  Synthetic Polynucleotide
taatacgactcactatagggtggattcgcacatgtgtgcgcaaattgaagaacagaggagacttcaaatggcgcacacaaacctggcggcagcgcaaaagatg

SEQ ID NO: 227341 - DNA, 103 bp, Artificial Sequence
  Synthetic Polynucleotide
taatacgactcactataggggtctccggtatggattcgcacatgtgtgcgaacagaggagacgcacaatggtgcgaatcaacctggcggcagcgcaaaagatg

SEQ ID NO: 227342 - DNA, 103 bp, Artificial Sequence
  Synthetic Polynucleotide
taatacgactcactatagggcatagggcctgtctccggtatggattcgcaaacagaggagatgcgaaatgataccggagaacctggcggcagcgcaaaagatg

SEQ ID NO: 227343 - DNA, 103 bp, Artificial Sequence
  Synthetic Polynucleotide
taatacgactcactatagggaaggggcacacatagggcctgtctccggtaaacagaggagataccggatgcaggccctaaacctggcggcagcgcaaaagatg

SEQ ID NO: 227344 - DNA, 103 bp, Artificial Sequence
  Synthetic Polynucleotide
taatacgactcactatagggacaaccatcgaaggggcacacatagggcctaacagaggagaaggcccatggtgtgccccaacctggcggcagcgcaaaagatg

SEQ ID NO: 227345 - DNA, 103 bp, Artificial Sequence
  Synthetic Polynucleotide
taatacgactcactatagggacttcttattacaaccatcgaaggggcacaaacagaggagatgtgccatgtcgatggttaacctggcggcagcgcaaaagatg

SEQ ID NO: 227346 - DNA, 103 bp, Artificial Sequence
  Synthetic Polynucleotide
taatacgactcactataggggactgagcaaacttcttattacaaccatcgaacagaggagacgatggatgtaataagaaaacctggcggcagcgcaaaagatg

SEQ ID NO: 227347 - DNA, 103 bp, Artificial Sequence
  Synthetic Polynucleotide
taatacgactcactatagggcaggttagttgactgagcaaacttcttattaacagaggagaaataagatgtttgctcagaacctggcggcagcgcaaaagatg

SEQ ID NO: 227348 - DNA, 103 bp, Artificial Sequence
  Synthetic Polynucleotide
taatacgactcactatagggtgtgagatttcaggttagttgactgagcaaaacagaggagattgctcatgcaactaaccaacctggcggcagcgcaaaagatg

SEQ ID NO: 227349 - DNA, 103 bp, Artificial Sequence
  Synthetic Polynucleotide
taatacgactcactatagggtcctcctcctcctcgcccaccactgtggtcaacagaggagagaccacatgggtgggcgaaacctggcggcagcgcaaaagatg

SEQ ID NO: 227350 - DNA, 103 bp, Artificial Sequence
  Synthetic Polynucleotide
taatacgactcactatagggtgtgttaagatgtgagatttcaggttagttaacagaggagaaactaaatggaaatctcaaacctggcggcagcgcaaaagatg

SEQ ID NO: 227351 - DNA, 103 bp, Artificial Sequence
  Synthetic Polynucleotide
taatacgactcactatagggggccttagcatgtgttaagatgtgagatttaacagaggagaaaatctatgatcttaacaaacctggcggcagcgcaaaagatg

SEQ ID NO: 227352 - DNA, 103 bp, Artificial Sequence
  Synthetic Polynucleotide
taatacgactcactatagggggttgtttttggccttagcatgtgttaagaaacagaggagatcttaaatgatgctaaggaacctggcggcagcgcaaaagatg

SEQ ID NO: 227353 - DNA, 103 bp, Artificial Sequence
  Synthetic Polynucleotide
taatacgactcactataggggtcgtcgtcctcctcctcctcctcgcccacaacagaggagagtgggcatggaggaggagaacctggcggcagcgcaaaagatg

SEQ ID NO: 227354 - DNA, 103 bp, Artificial Sequence
  Synthetic Polynucleotide
taatacgactcactatagggcgtcctcgtcgtcgtcgtcctcctcctcctaacagaggagaaggaggatgaggacgacgaacctggcggcagcgcaaaagatg

SEQ ID NO: 227355 - DNA, 103 bp, Artificial Sequence
  Synthetic Polynucleotide
taatacgactcactatagggccaccgccgccgtcctcgtcgtcgtcgtccaacagaggagaggacgaatgcgacgaggaaacctggcggcagcgcaaaagatg

SEQ ID NO: 227356 - DNA, 103 bp, Artificial Sequence
  Synthetic Polynucleotide
taatacgactcactataggggccgtggtcgccaccgccgccgtcctcgtcaacagaggagagacgagatgggcggcggtaacctggcggcagcgcaaaagatg

SEQ ID NO: 227357 - DNA, 103 bp, Artificial Sequence
  Synthetic Polynucleotide
taatacgactcactatagggcgcccccgccgccgtggtcgccaccgccgcaacagaggagagcggcgatggcgaccacgaacctggcggcagcgcaaaagatg

SEQ ID NO: 227358 - DNA, 103 bp, Artificial Sequence
  Synthetic Polynucleotide
taatacgactcactatagggtgcccgtggccgcccccgccgccgtggtcgaacagaggagacgaccaatgcggcgggggaacctggcggcagcgcaaaagatg

SEQ ID NO: 227359 - DNA, 103 bp, Artificial Sequence
  Synthetic Polynucleotide
taatacgactcactataggggtggccggcgtgcccgtggccgcccccgccaacagaggagaggcgggatgggccacgggaacctggcggcagcgcaaaagatg

SEQ ID NO: 227360 - DNA, 103 bp, Artificial Sequence
  Synthetic Polynucleotide
taatacgactcactatagggagccgtccgtggcgatgtagagggtgtcgcaacagaggagagcgacaatgtctacatcgaacctggcggcagcgcaaaagatg

SEQ ID NO: 227361 - DNA, 103 bp, Artificial Sequence
  Synthetic Polynucleotide
taatacgactcactatagggggtggtggtggtggccggcgtgcccgtggcaacagaggagagccacgatgacgccggccaacctggcggcagcgcaaaagatg

SEQ ID NO: 227362 - DNA, 103 bp, Artificial Sequence
  Synthetic Polynucleotide
taatacgactcactatagggtggtgatggtggtggtggtggtggccggcgaacagaggagacgccggatgccaccaccaaacctggcggcagcgcaaaagatg

SEQ ID NO: 227363 - DNA, 103 bp, Artificial Sequence
  Synthetic Polynucleotide
taatacgactcactataggggtggtggtggtggtgatggtggtggtggtgaacagaggagacaccacatgcaccatcacaacctggcggcagcgcaaaagatg

SEQ ID NO: 227364 - DNA, 103 bp, Artificial Sequence
  Synthetic Polynucleotide
taatacgactcactatagggtcatgggcgggtggtggtggtggtgatggtaacagaggagaaccatcatgaccaccaccaacctggcggcagcgcaaaagatg

SEQ ID NO: 227365 - DNA, 103 bp, Artificial Sequence
  Synthetic Polynucleotide
taatacgactcactatagggtgcagagcgatcatgggcgggtggtggtggaacagaggagaccaccaatgcccgcccataacctggcggcagcgcaaaagatg

SEQ ID NO: 227366 - DNA, 103 bp, Artificial Sequence
  Synthetic Polynucleotide
taatacgactcactataggggaccagcggctgcagagcgatcatgggcggaacagaggagaccgcccatgatcgctctgaacctggcggcagcgcaaaagatg

SEQ ID NO: 227367 - DNA, 103 bp, Artificial Sequence
  Synthetic Polynucleotide
taatacgactcactatagggggtcgtcggtgaccagcggctgcagagcgaaacagaggagatcgctcatgagccgctggaacctggcggcagcgcaaaagatg

SEQ ID NO: 227368 - DNA, 103 bp, Artificial Sequence
  Synthetic Polynucleotide
taatacgactcactatagggacctgggtcgggtcgtcggtgaccagcggcaacagaggagagccgctatgcaccgacgaaacctggcggcagcgcaaaagatg

SEQ ID NO: 227369 - DNA, 103 bp, Artificial Sequence
  Synthetic Polynucleotide
taatacgactcactataggggtggtggtgcacctgggtcgggtcgtcggtaacagaggagaaccgacatgccgacccagaacctggcggcagcgcaaaagatg

SEQ ID NO: 227370 - DNA, 103 bp, Artificial Sequence
  Synthetic Polynucleotide
taatacgactcactatagggtcacctcctggtggtggtgcacctgggtcgaacagaggagacgacccatgtgcaccaccaacctggcggcagcgcaaaagatg

SEQ ID NO: 227371 - DNA, 103 bp, Artificial Sequence
  Synthetic Polynucleotide
taatacgactcactatagggggcatctccgagccgtccgtggcgatgtagaacagaggagactacatatgcacggacggaacctggcggcagcgcaaaagatg

SEQ ID NO: 227372 - DNA, 103 bp, Artificial Sequence
  Synthetic Polynucleotide
taatacgactcactatagggtgcaccaggatcacctcctggtggtggtgcaacagaggagagcaccaatgccaggaggtaacctggcggcagcgcaaaagatg

SEQ ID NO: 227373 - DNA, 103 bp, Artificial Sequence
  Synthetic Polynucleotide
taatacgactcactatagggctcgcgcgtctgcaccaggatcacctcctgaacagaggagacaggagatgatcctggtgaacctggcggcagcgcaaaagatg

SEQ ID NO: 227374 - DNA, 103 bp, Artificial Sequence
  Synthetic Polynucleotide
taatacgactcactatagggccaccacctcctcgcgcgtctgcaccaggaaacagaggagatcctggatgagacgcgcgaacctggcggcagcgcaaaagatg

SEQ ID NO: 227375 - DNA, 103 bp, Artificial Sequence
  Synthetic Polynucleotide
taatacgactcactatagggtcgtcgccgcccaccacctcctcgcgcgtcaacagaggagagacgcgatgggaggtggtaacctggcggcagcgcaaaagatg

SEQ ID NO: 227376 - DNA, 103 bp, Artificial Sequence
  Synthetic Polynucleotide
taatacgactcactatagggcccgtccgagtcgtcgccgcccaccacctcaacagaggagagaggtgatgggcggcgacaacctggcggcagcgcaaaagatg

SEQ ID NO: 227377 - DNA, 103 bp, Artificial Sequence
  Synthetic Polynucleotide
taatacgactcactatagggcggcgcgcagcccgtccgagtcgtcgccgcaacagaggagagcggcgatgactcggacgaacctggcggcagcgcaaaagatg

SEQ ID NO: 227378 - DNA, 103 bp, Artificial Sequence
  Synthetic Polynucleotide
taatacgactcactatagggaagccgtcctcggcgcgcagcccgtccgagaacagaggagactcggaatggctgcgcgcaacctggcggcagcgcaaaagatg

SEQ ID NO: 227379 - DNA, 103 bp, Artificial Sequence
  Synthetic Polynucleotide
taatacgactcactatagggctgatcctcgaagccgtcctcggcgcgcagaacagaggagactgcgcatggaggacggcaacctggcggcagcgcaaaagatg

SEQ ID NO: 227380 - DNA, 103 bp, Artificial Sequence
  Synthetic Polynucleotide
taatacgactcactatagggggatgagaatctgatcctcgaagccgtcctaacagaggagaaggacgatgtcgaggatcaacctggcggcagcgcaaaagatg

SEQ ID NO: 227381 - DNA, 103 bp, Artificial Sequence
  Synthetic Polynucleotide
taatacgactcactataggggcgggcaccgggatgagaatctgatcctcgaacagaggagacgaggaatggattctcataacctggcggcagcgcaaaagatg

SEQ ID NO: 227382 - DNA, 103 bp, Artificial Sequence
  Synthetic Polynucleotide
taatacgactcactataggggatctcggccggcatctccgagccgtccgtaacagaggagaacggacatgtcggagatgaacctggcggcagcgcaaaagatg

SEQ ID NO: 227383 - DNA, 103 bp, Artificial Sequence
  Synthetic Polynucleotide
taatacgactcactataggggccggccggcgcgggcaccgggatgagaataacagaggagaattctcatgccggtgcccaacctggcggcagcgcaaaagatg

SEQ ID NO: 227384 - DNA, 103 bp, Artificial Sequence
  Synthetic Polynucleotide
taatacgactcactatagggcgtcgtcgccgccggccggcgcgggcaccgaacagaggagacggtgcatgcgccggccgaacctggcggcagcgcaaaagatg

SEQ ID NO: 227385 - DNA, 103 bp, Artificial Sequence
  Synthetic Polynucleotide
taatacgactcactatagggtcaatgtagtcgtcgtcgccgccggccggcaacagaggagagccggcatgcggcgacgaaacctggcggcagcgcaaaagatg

SEQ ID NO: 227386 - DNA, 103 bp, Artificial Sequence
  Synthetic Polynucleotide
taatacgactcactatagggcagcgtttgttcaatgtagtcgtcgtcgccaacagaggagaggcgacatggactacattaacctggcggcagcgcaaaagatg

SEQ ID NO: 227387 - DNA, 103 bp, Artificial Sequence
  Synthetic Polynucleotide
taatacgactcactatagggccacggtgaccagcgtttgttcaatgtagtaacagaggagaactacaatgaacaaacgcaacctggcggcagcgcaaaagatg

SEQ ID NO: 227388 - DNA, 103 bp, Artificial Sequence
  Synthetic Polynucleotide
taatacgactcactatagggccggccgccgccacggtgaccagcgtttgtaacagaggagaacaaacatgggtcaccgtaacctggcggcagcgcaaaagatg

SEQ ID NO: 227389 - DNA, 103 bp, Artificial Sequence
  Synthetic Polynucleotide
taatacgactcactataggggccgctcttgccggccgccgccacggtgacaacagaggagagtcaccatggcggcggccaacctggcggcagcgcaaaagatg

SEQ ID NO: 227390 - DNA, 103 bp, Artificial Sequence
  Synthetic Polynucleotide
taatacgactcactatagggagccgccgccgccgctcttgccggccgccgaacagaggagacggcggatggcaagagcgaacctggcggcagcgcaaaagatg

SEQ ID NO: 227391 - DNA, 103 bp, Artificial Sequence
  Synthetic Polynucleotide
taatacgactcactataggggacgacgacgagccgccgccgccgctcttgaacagaggagacaagagatgcggcggcggaacctggcggcagcgcaaaagatg

SEQ ID NO: 227392 - DNA, 103 bp, Artificial Sequence
  Synthetic Polynucleotide
taatacgactcactataggggccgcctcccgacgacgacgagccgccgccaacagaggagaggcggcatgtcgtcgtcgaacctggcggcagcgcaaaagatg

SEQ ID NO: 227393 - DNA, 103 bp, Artificial Sequence
  Synthetic Polynucleotide
taatacgactcactataggggcagctccacgatctcggccggcatctccgaacagaggagacggagaatgcggccgagaaacctggcggcagcgcaaaagatg

SEQ ID NO: 227394 - DNA, 103 bp, Artificial Sequence
  Synthetic Polynucleotide
taatacgactcactatagggtcttgacgcggccgcctcccgacgacgacgaacagaggagacgtcgtatgcgggaggcgaacctggcggcagcgcaaaagatg

SEQ ID NO: 227395 - DNA, 103 bp, Artificial Sequence
  Synthetic Polynucleotide
taatacgactcactatagggccgccgcccttcttgacgcggccgcctcccaacagaggagagggaggatgccgcgtcaaaacctggcggcagcgcaaaagatg

SEQ ID NO: 227396 - DNA, 103 bp, Artificial Sequence
  Synthetic Polynucleotide
taatacgactcactataggggctcttcttgccgccgcccttcttgacgcgaacagaggagacgcgtcatgaagggcggcaacctggcggcagcgcaaaagatg

SEQ ID NO: 227397 - DNA, 103 bp, Artificial Sequence
  Synthetic Polynucleotide
taatacgactcactatagggtcttcttgccgctcttcttgccgccgccctaacagaggagaagggcgatggcaagaagaaacctggcggcagcgcaaaagatg

SEQ ID NO: 227398 - DNA, 103 bp, Artificial Sequence
  Synthetic Polynucleotide
taatacgactcactatagggctgaggtaactcttcttgccgctcttcttgaacagaggagacaagaaatgcggcaagaaaacctggcggcagcgcaaaagatg

SEQ ID NO: 227399 - DNA, 103 bp, Artificial Sequence
  Synthetic Polynucleotide
taatacgactcactatagggggccccgccgctgaggtaactcttcttgccaacagaggagaggcaagatgagttacctcaacctggcggcagcgcaaaagatg

SEQ ID NO: 227400 - DNA, 103 bp, Artificial Sequence
  Synthetic Polynucleotide
taatacgactcactatagggccgccgcgccggccccgccgctgaggtaacaacagaggagagttaccatggcggcggggaacctggcggcagcgcaaaagatg

SEQ ID NO: 227401 - DNA, 103 bp, Artificial Sequence
  Synthetic Polynucleotide
taatacgactcactatagggccgccgccgcccgccgcgccggccccgccgaacagaggagacggcggatgcggcgcggcaacctggcggcagcgcaaaagatg

SEQ ID NO: 227402 - DNA, 103 bp, Artificial Sequence
  Synthetic Polynucleotide
taatacgactcactatagggcgggtcggcgccgccgccgcccgccgcgccaacagaggagaggcgcgatgggcggcggcaacctggcggcagcgcaaaagatg

SEQ ID NO: 227403 - DNA, 103 bp, Artificial Sequence
  Synthetic Polynucleotide
taatacgactcactatagggtcttgttgcccgggtcggcgccgccgccgcaacagaggagagcggcgatggcgccgaccaacctggcggcagcgcaaaagatg

SEQ ID NO: 227404 - DNA, 103 bp, Artificial Sequence
  Synthetic Polynucleotide
taatacgactcactatagggtcgatctcgtgcagctccacgatctcggccaacagaggagaggccgaatgcgtggagctaacctggcggcagcgcaaaagatg

SEQ ID NO: 227405 - DNA, 103 bp, Artificial Sequence
  Synthetic Polynucleotide
taatacgactcactatagggtgctcccacttcttgttgcccgggtcggcgaacagaggagacgccgaatggggcaacaaaacctggcggcagcgcaaaagatg

SEQ ID NO: 227406 - DNA, 103 bp, Artificial Sequence
  Synthetic Polynucleotide
taatacgactcactatagggcacctgcttctgctcccacttcttgttgccaacagaggagaggcaacatgaagtgggagaacctggcggcagcgcaaaagatg

SEQ ID NO: 227407 - DNA, 103 bp, Artificial Sequence
  Synthetic Polynucleotide
taatacgactcactatagggtcttgatctgcacctgcttctgctcccactaacagaggagaagtgggatgagaagcaggaacctggcggcagcgcaaaagatg

SEQ ID NO: 227408 - DNA, 103 bp, Artificial Sequence
  Synthetic Polynucleotide
taatacgactcactatagggccctccagggtcttgatctgcacctgcttcaacagaggagagaagcaatggcagatcaaaacctggcggcagcgcaaaagatg

SEQ ID NO: 227409 - DNA, 103 bp, Artificial Sequence
  Synthetic Polynucleotide
taatacgactcactatagggcgagaactcgccctccagggtcttgatctgaacagaggagacagatcatgaccctggagaacctggcggcagcgcaaaagatg

SEQ ID NO: 227410 - DNA, 103 bp, Artificial Sequence
  Synthetic Polynucleotide
taatacgactcactatagggacatggtgaccgagaactcgccctccagggaacagaggagaccctggatggcgagttctaacctggcggcagcgcaaaagatg

SEQ ID NO: 227411 - DNA, 103 bp, Artificial Sequence
  Synthetic Polynucleotide
taatacgactcactatagggtctgaggaccacatggtgaccgagaactcgaacagaggagacgagttatgggtcaccataacctggcggcagcgcaaaagatg

SEQ ID NO: 227412 - DNA, 103 bp, Artificial Sequence
  Synthetic Polynucleotide
taatacgactcactatagggttttttttcatctgaggaccacatggtgacaacagaggagagtcaccatgtggtcctcaaacctggcggcagcgcaaaagatg

SEQ ID NO: 227413 - DNA, 103 bp, Artificial Sequence
  Synthetic Polynucleotide
taatacgactcactatagggggtcaatatcttttttttcatctgaggaccaacagaggagaggtcctatgatgaaaaaaaacctggcggcagcgcaaaagatg

SEQ ID NO: 227414 - DNA, 103 bp, Artificial Sequence
  Synthetic Polynucleotide
taatacgactcactatagggactgtctcatggtcaatatcttttttttcaaacagaggagatgaaaaatgagatattgaaacctggcggcagcgcaaaagatg

SEQ ID NO: 227415 - DNA, 103 bp, Artificial Sequence
  Synthetic Polynucleotide
taatacgactcactatagggggtctccacctcgatctcgtgcagctccacaacagaggagagtggagatgcacgagatcaacctggcggcagcgcaaaagatg

SEQ ID NO: 227416 - DNA, 103 bp, Artificial Sequence
  Synthetic Polynucleotide
taatacgactcactatagggttcttcaaccactgtctcatggtcaatatcaacagaggagagatattatgcatgagacaaacctggcggcagcgcaaaagatg

SEQ ID NO: 227417 - DNA, 103 bp, Artificial Sequence
  Synthetic Polynucleotide
taatacgactcactatagggcaatgatctgttcttcaaccactgtctcataacagaggagaatgagaatgtggttgaagaacctggcggcagcgcaaaagatg

SEQ ID NO: 227418 - DNA, 103 bp, Artificial Sequence
  Synthetic Polynucleotide
taatacgactcactataggggagttctctccaatgatctgttcttcaaccaacagaggagaggttgaatgacagatcataacctggcggcagcgcaaaagatg

SEQ ID NO: 227419 - DNA, 103 bp, Artificial Sequence
  Synthetic Polynucleotide
taatacgactcactatagggatcaggaggtgagttctctccaatgatctgaacagaggagacagatcatgggagagaacaacctggcggcagcgcaaaagatg

SEQ ID NO: 227420 - DNA, 103 bp, Artificial Sequence
  Synthetic Polynucleotide
taatacgactcactatagggattctgaataatcaggaggtgagttctctcaacagaggagagagagaatgcacctcctgaacctggcggcagcgcaaaagatg

SEQ ID NO: 227421 - DNA, 103 bp, Artificial Sequence
  Synthetic Polynucleotide
taatacgactcactatagggcctgtcatatattctgaataatcaggaggtaacagaggagaacctccatgttattcagaaacctggcggcagcgcaaaagatg

SEQ ID NO: 227422 - DNA, 103 bp, Artificial Sequence
  Synthetic Polynucleotide
taatacgactcactatagggaagtttctttcctgtcatatattctgaataaacagaggagatattcaatgtatatgacaaacctggcggcagcgcaaaagatg

SEQ ID NO: 227423 - DNA, 103 bp, Artificial Sequence
  Synthetic Polynucleotide
taatacgactcactatagggctccaggaggaagtttctttcctgtcatataacagaggagaatatgaatggaaagaaacaacctggcggcagcgcaaaagatg

SEQ ID NO: 227424 - DNA, 103 bp, Artificial Sequence
  Synthetic Polynucleotide
taatacgactcactatagggccaggtattcctccaggaggaagtttctttaacagaggagaaaagaaatgtcctcctggaacctggcggcagcgcaaaagatg

SEQ ID NO: 227425 - DNA, 103 bp, Artificial Sequence
  Synthetic Polynucleotide
taatacgactcactataggggaggtcaatgccaggtattcctccaggaggaacagaggagacctcctatgggaatacctaacctggcggcagcgcaaaagatg

SEQ ID NO: 227426 - DNA, 103 bp, Artificial Sequence
  Synthetic Polynucleotide
taatacgactcactatagggccaccgggatggtctccacctcgatctcgtaacagaggagaacgagaatgaggtggagaaacctggcggcagcgcaaaagatg

SEQ ID NO: 227427 - DNA, 103 bp, Artificial Sequence
  Synthetic Polynucleotide
taatacgactcactatagggtgggatctgagaggtcaatgccaggtattcaacagaggagagaatacatggcattgaccaacctggcggcagcgcaaaagatg

SEQ ID NO: 227428 - DNA, 103 bp, Artificial Sequence
  Synthetic Polynucleotide
taatacgactcactataggggccagttgtttgggatctgagaggtcaatgaacagaggagacattgaatgctcagatccaacctggcggcagcgcaaaagatg

SEQ ID NO: 227429 - DNA, 103 bp, Artificial Sequence
  Synthetic Polynucleotide
taatacgactcactatagggagcaaattctgccagttgtttgggatctgaaacagaggagatcagatatgaaacaactgaacctggcggcagcgcaaaagatg

SEQ ID NO: 227430 - DNA, 103 bp, Artificial Sequence
  Synthetic Polynucleotide
taatacgactcactataggggcttcattctagcaaattctgccagttgttaacagaggagaaacaacatgcagaatttgaacctggcggcagcgcaaaagatg

SEQ ID NO: 227431 - DNA, 103 bp, Artificial Sequence
  Synthetic Polynucleotide
taatacgactcactatagggatttttcttggcttcattctagcaaattctaacagaggagaagaattatgtagaatgaaaacctggcggcagcgcaaaagatg

SEQ ID NO: 227432 - DNA, 103 bp, Artificial Sequence
  Synthetic Polynucleotide
taatacgactcactatagggatcttctttaatttttcttggcttcattctaacagaggagaagaatgatgccaagaaaaaacctggcggcagcgcaaaagatg

SEQ ID NO: 227433 - DNA, 103 bp, Artificial Sequence
  Synthetic Polynucleotide
taatacgactcactatagggttggagcatcatcttctttaatttttcttgaacagaggagacaagaaatgttaaagaagaacctggcggcagcgcaaaagatg

SEQ ID NO: 227434 - DNA, 103 bp, Artificial Sequence
  Synthetic Polynucleotide
taatacgactcactataggggctattgttcttggagcatcatcttctttaaacagaggagataaagaatgtgatgctccaacctggcggcagcgcaaaagatg

SEQ ID NO: 227435 - DNA, 103 bp, Artificial Sequence
  Synthetic Polynucleotide
taatacgactcactatagggatgagggcaagctattgttcttggagcatcaacagaggagagatgctatgagaacaataaacctggcggcagcgcaaaagatg

SEQ ID NO: 227436 - DNA, 103 bp, Artificial Sequence
  Synthetic Polynucleotide
taatacgactcactatagggtgcagcctttatgagggcaagctattgttcaacagaggagagaacaaatgcttgccctcaacctggcggcagcgcaaaagatg

SEQ ID NO: 227437 - DNA, 103 bp, Artificial Sequence
  Synthetic Polynucleotide
taatacgactcactatagggtcgatggtctccaccgggatggtctccaccaacagaggagaggtggaatgcatcccggtaacctggcggcagcgcaaaagatg

SEQ ID NO: 227438 - DNA, 103 bp, Artificial Sequence
  Synthetic Polynucleotide
taatacgactcactatagggaacatctttgtgcagcctttatgagggcaaaacagaggagattgcccatgtaaaggctgaacctggcggcagcgcaaaagatg

SEQ ID NO: 227439 - DNA, 103 bp, Artificial Sequence
  Synthetic Polynucleotide
taatacgactcactataggggttatccctgaacatctttgtgcagcctttaacagaggagaaaaggcatgacaaagatgaacctggcggcagcgcaaaagatg

SEQ ID NO: 227440 - DNA, 103 bp, Artificial Sequence
  Synthetic Polynucleotide
taatacgactcactatagggtcatggccgagttatccctgaacatctttgaacagaggagacaaagaatgtcagggataaacctggcggcagcgcaaaagatg

SEQ ID NO: 227441 - DNA, 103 bp, Artificial Sequence
  Synthetic Polynucleotide
taatacgactcactatagggagatgttttctcatggccgagttatccctgaacagaggagacagggaatgctcggccataacctggcggcagcgcaaaagatg

SEQ ID NO: 227442 - DNA, 103 bp, Artificial Sequence
  Synthetic Polynucleotide
taatacgactcactataggggtgggtgtgcagatgttttctcatggccgaaacagaggagatcggccatgagaaaacataacctggcggcagcgcaaaagatg

SEQ ID NO: 227443 - DNA, 103 bp, Artificial Sequence
  Synthetic Polynucleotide
taatacgactcactatagggctctgggaccgtgggtgtgcagatgttttcaacagaggagagaaaacatgtgcacacccaacctggcggcagcgcaaaagatg

SEQ ID NO: 227444 - DNA, 103 bp, Artificial Sequence
  Synthetic Polynucleotide
taatacgactcactatagggcagacgtggactctgggaccgtgggtgtgcaacagaggagagcacacatgcggtcccagaacctggcggcagcgcaaaagatg

SEQ ID NO: 227445 - DNA, 103 bp, Artificial Sequence
  Synthetic Polynucleotide
taatacgactcactatagggacattctgcacagacgtggactctgggaccaacagaggagaggtcccatggtccacgtcaacctggcggcagcgcaaaagatg

SEQ ID NO: 227446 - DNA, 103 bp, Artificial Sequence
  Synthetic Polynucleotide
taatacgactcactatagggaagctttgccacattctgcacagacgtggaaacagaggagatccacgatggtgcagaataacctggcggcagcgcaaaagatg

SEQ ID NO: 227447 - DNA, 103 bp, Artificial Sequence
  Synthetic Polynucleotide
taatacgactcactatagggctctcaacaaaagctttgccacattctgcaaacagaggagatgcagaatgtggcaaagcaacctggcggcagcgcaaaagatg

SEQ ID NO: 227448 - DNA, 103 bp, Artificial Sequence
  Synthetic Polynucleotide
taatacgactcactatagggtgtgatggagaaatcttcgttggaggccataacagaggagaatggccatgaacgaagataacctggcggcagcgcaaaagatg

SEQ ID NO: 227449 - DNA, 103 bp, Artificial Sequence
  Synthetic Polynucleotide
taatacgactcactataggggacgctttccgtcggaatgtcctccataggaacagaggagacctatgatggacattccgaacctggcggcagcgcaaaagatg

SEQ ID NO: 227450 - DNA, 103 bp, Artificial Sequence
  Synthetic Polynucleotide
taatacgactcactataggggggcttatcgccggtgtggatgcgcaagtgaacagaggagacacttgatgatccacaccaacctggcggcagcgcaaaagatg

SEQ ID NO: 227451 - DNA, 103 bp, Artificial Sequence
  Synthetic Polynucleotide
taatacgactcactatagggggcacacgaagggcttatcgccggtgtggaaacagaggagatccacaatggcgataagcaacctggcggcagcgcaaaagatg

SEQ ID NO: 227452 - DNA, 103 bp, Artificial Sequence
  Synthetic Polynucleotide
taatacgactcactatagggacatcgaaggggcacacgaagggcttatcgaacagaggagacgataaatgcttcgtgtgaacctggcggcagcgcaaaagatg

SEQ ID NO: 227453 - DNA, 103 bp, Artificial Sequence
  Synthetic Polynucleotide
taatacgactcactatagggcctgttgcaaacatcgaaggggcacacgaaaacagaggagattcgtgatgcccttcgataacctggcggcagcgcaaaagatg

SEQ ID NO: 227454 - DNA, 103 bp, Artificial Sequence
  Synthetic Polynucleotide
taatacgactcactataggggagcgaacttcctgttgcaaacatcgaaggaacagaggagaccttcgatgtttgcaacaaacctggcggcagcgcaaaagatg

SEQ ID NO: 227455 - DNA, 103 bp, Artificial Sequence
  Synthetic Polynucleotide
taatacgactcactatagggttggttgactgagcgaacttcctgttgcaaaacagaggagattgcaaatggaagttcgcaacctggcggcagcgcaaaagatg

SEQ ID NO: 227456 - DNA, 103 bp, Artificial Sequence
  Synthetic Polynucleotide
taatacgactcactatagggggttttcaggttggttgactgagcgaacttaacagaggagaaagttcatgcagtcaaccaacctggcggcagcgcaaaagatg

SEQ ID NO: 227457 - DNA, 103 bp, Artificial Sequence
  Synthetic Polynucleotide
taatacgactcactatagggttaatatgtgggttttcaggttggttgactaacagaggagaagtcaaatgacctgaaaaaacctggcggcagcgcaaaagatg

SEQ ID NO: 227458 - DNA, 103 bp, Artificial Sequence
  Synthetic Polynucleotide
taatacgactcactatagggttcacatgcgttaatatgtgggttttcaggaacagaggagacctgaaatgccacatattaacctggcggcagcgcaaaagatg

SEQ ID NO: 227459 - DNA, 103 bp, Artificial Sequence
  Synthetic Polynucleotide
taatacgactcactataggggtttttggtcttcacatgcgttaatatgtgaacagaggagacacataatgacgcatgtgaacctggcggcagcgcaaaagatg

SEQ ID NO: 227460 - DNA, 103 bp, Artificial Sequence
  Synthetic Polynucleotide
taatacgactcactatagggcctcgtactggacgctttccgtcggaatgtaacagaggagaacattcatgcggaaagcgaacctggcggcagcgcaaaagatg

SEQ ID NO: 227461 - DNA, 103 bp, Artificial Sequence
  Synthetic Polynucleotide
taatacgactcactatagggccatccacatcctcgtactggacgctttccaacagaggagaggaaagatgccagtacgaaacctggcggcagcgcaaaagatg

SEQ ID NO: 227462 - DNA, 103 bp, Artificial Sequence
  Synthetic Polynucleotide
taatacgactcactataggggatccaattgccatccacatcctcgtactgaacagaggagacagtacatggatgtggataacctggcggcagcgcaaaagatg

SEQ ID NO: 227463 - DNA, 103 bp, Artificial Sequence
  Synthetic Polynucleotide
taatacgactcactatagggggccaccgtagatccaattgccatccacataacagaggagaatgtggatggcaattggaaacctggcggcagcgcaaaagatg

SEQ ID NO: 227464 - DNA, 103 bp, Artificial Sequence
  Synthetic Polynucleotide
taatacgactcactatagggggatggttgtggccaccgtagatccaattgaacagaggagacaattgatgctacggtggaacctggcggcagcgcaaaagatg

SEQ ID NO: 227465 - DNA, 103 bp, Artificial Sequence
  Synthetic Polynucleotide
taatacgactcactatagggcatcaatggcggatggttgtggccaccgtaaacagaggagatacggtatgcacaaccataacctggcggcagcgcaaaagatg

SEQ ID NO: 227466 - DNA, 103 bp, Artificial Sequence
  Synthetic Polynucleotide
taatacgactcactataggggctgcaacaccatcaatggcggatggttgtaacagaggagaacaaccatgcgccattgaaacctggcggcagcgcaaaagatg

SEQ ID NO: 227467 - DNA, 103 bp, Artificial Sequence
  Synthetic Polynucleotide
taatacgactcactataggggtgaagagcggctgcaacaccatcaatggcaacagaggagagccattatgggtgttgcaaacctggcggcagcgcaaaagatg

SEQ ID NO: 227468 - DNA, 103 bp, Artificial Sequence
  Synthetic Polynucleotide
taatacgactcactataggggcccgtgttcgtgaagagcggctgcaacacaacagaggagagtgttgatgccgctcttcaacctggcggcagcgcaaaagatg

SEQ ID NO: 227469 - DNA, 103 bp, Artificial Sequence
  Synthetic Polynucleotide
taatacgactcactatagggccaggtcttgtgtgatggagaaatcttcgtaacagaggagaacgaagatgtctccatcaaacctggcggcagcgcaaaagatg

SEQ ID NO: 227470 - DNA, 103 bp, Artificial Sequence
  Synthetic Polynucleotide
taatacgactcactatagggggtcgccatagcccgtgttcgtgaagagcgaacagaggagacgctctatgcgaacacggaacctggcggcagcgcaaaagatg

SEQ ID NO: 227471 - DNA, 103 bp, Artificial Sequence
  Synthetic Polynucleotide
taatacgactcactatagggtcctggtcgtggtcgccatagcccgtgttcaacagaggagagaacacatgctatggcgaaacctggcggcagcgcaaaagatg

SEQ ID NO: 227472 - DNA, 103 bp, Artificial Sequence
  Synthetic Polynucleotide
taatacgactcactatagggcataagcatttcctggtcgtggtcgccataaacagaggagatatggcatgcacgaccagaacctggcggcagcgcaaaagatg

SEQ ID NO: 227473 - DNA, 103 bp, Artificial Sequence
  Synthetic Polynucleotide
taatacgactcactataggggtgtctgcaacataagcatttcctggtcgtaacagaggagaacgaccatgaaatgcttaaacctggcggcagcgcaaaagatg

SEQ ID NO: 227474 - DNA, 103 bp, Artificial Sequence
  Synthetic Polynucleotide
taatacgactcactatagggacttcctcttgtgtctgcaacataagcattaacagaggagaaatgctatggttgcagacaacctggcggcagcgcaaaagatg

SEQ ID NO: 227475 - DNA, 103 bp, Artificial Sequence
  Synthetic Polynucleotide
taatacgactcactatagggatagcccaccacttcctcttgtgtctgcaaaacagaggagattgcagatgcaagaggaaaacctggcggcagcgcaaaagatg

SEQ ID NO: 227476 - DNA, 103 bp, Artificial Sequence
  Synthetic Polynucleotide
taatacgactcactatagggctgagtcgcaatagcccaccacttcctcttaacagaggagaaagaggatgtggtgggctaacctggcggcagcgcaaaagatg

SEQ ID NO: 227477 - DNA, 103 bp, Artificial Sequence
  Synthetic Polynucleotide
taatacgactcactatagggagctggttgtctgagtcgcaatagcccaccaacagaggagaggtgggatgttgcgactcaacctggcggcagcgcaaaagatg

SEQ ID NO: 227478 - DNA, 103 bp, Artificial Sequence
  Synthetic Polynucleotide
taatacgactcactataggggtcgttgcctagctggttgtctgagtcgcaaacagaggagatgcgacatggacaaccagaacctggcggcagcgcaaaagatg

SEQ ID NO: 227479 - DNA, 103 bp, Artificial Sequence
  Synthetic Polynucleotide
taatacgactcactatagggggtcctccaagtcgttgcctagctggttgtaacagaggagaacaaccatgtaggcaacgaacctggcggcagcgcaaaagatg

SEQ ID NO: 227480 - DNA, 103 bp, Artificial Sequence
  Synthetic Polynucleotide
taatacgactcactataggggccgggatctccaggtcttgtgtgatggagaacagaggagactccatatgacaagacctaacctggcggcagcgcaaaagatg

SEQ ID NO: 227481 - DNA, 103 bp, Artificial Sequence
  Synthetic Polynucleotide
taatacgactcactatagggagggccaactggtcctccaagtcgttgcctaacagaggagaaggcaaatgcttggaggaaacctggcggcagcgcaaaagatg

SEQ ID NO: 227482 - DNA, 103 bp, Artificial Sequence
  Synthetic Polynucleotide
taatacgactcactataggggctatccgggagggccaactggtcctccaaaacagaggagattggagatgcagttggccaacctggcggcagcgcaaaagatg

SEQ ID NO: 227483 - DNA, 103 bp, Artificial Sequence
  Synthetic Polynucleotide
taatacgactcactatagggcgtcttcaatgctatccgggagggccaactaacagaggagaagttggatgtcccggataaacctggcggcagcgcaaaagatg

SEQ ID NO: 227484 - DNA, 103 bp, Artificial Sequence
  Synthetic Polynucleotide
taatacgactcactatagggtggaagtgctcgtcttcaatgctatccgggaacagaggagacccggaatgcattgaagaaacctggcggcagcgcaaaagatg

SEQ ID NO: 227485 - DNA, 103 bp, Artificial Sequence
  Synthetic Polynucleotide
taatacgactcactatagggcagggtcatctggaagtgctcgtcttcaataacagaggagaattgaaatggagcacttcaacctggcggcagcgcaaaagatg

SEQ ID NO: 227486 - DNA, 103 bp, Artificial Sequence
  Synthetic Polynucleotide
taatacgactcactatagggacagagaggccagggtcatctggaagtgctaacagaggagaagcactatgagatgacccaacctggcggcagcgcaaaagatg

SEQ ID NO: 227487 - DNA, 103 bp, Artificial Sequence
  Synthetic Polynucleotide
taatacgactcactataggggccgaggccgacagagaggccagggtcatcaacagaggagagatgacatgggcctctctaacctggcggcagcgcaaaagatg

SEQ ID NO: 227488 - DNA, 103 bp, Artificial Sequence
  Synthetic Polynucleotide
taatacgactcactatagggtgttgatgccgccgaggccgacagagaggcaacagaggagagcctctatgtcggcctcgaacctggcggcagcgcaaaagatg

SEQ ID NO: 227489 - DNA, 103 bp, Artificial Sequence
  Synthetic Polynucleotide
taatacgactcactatagggttgatgttgatgttgatgccgccgaggccgaacagaggagacggcctatgcggcatcaaaacctggcggcagcgcaaaagatg

SEQ ID NO: 227490 - DNA, 103 bp, Artificial Sequence
  Synthetic Polynucleotide
taatacgactcactatagggcggctctgggttgatgttgatgttgatgccaacagaggagaggcatcatgatcaacatcaacctggcggcagcgcaaaagatg

SEQ ID NO: 227491 - DNA, 103 bp, Artificial Sequence
  Synthetic Polynucleotide
taatacgactcactatagggcacaatatctgccgggatctccaggtcttgaacagaggagacaagacatggagatcccgaacctggcggcagcgcaaaagatg

SEQ ID NO: 227492 - DNA, 103 bp, Artificial Sequence
  Synthetic Polynucleotide
taatacgactcactatagggctttttgctgcggctctgggttgatgttgaaacagaggagatcaacaatgacccagagcaacctggcggcagcgcaaaagatg

SEQ ID NO: 227493 - DNA, 103 bp, Artificial Sequence
  Synthetic Polynucleotide
taatacgactcactatagggttttgctgggctttttgctgcggctctgggaacagaggagacccagaatggcagcaaaaaacctggcggcagcgcaaaagatg

SEQ ID NO: 227494 - DNA, 103 bp, Artificial Sequence
  Synthetic Polynucleotide
taatacgactcactatagggccgctgggctttttgctgggctttttgctgaacagaggagacagcaaatggcccagcaaaacctggcggcagcgcaaaagatg

SEQ ID NO: 227495 - DNA, 103 bp, Artificial Sequence
  Synthetic Polynucleotide
taatacgactcactatagggggcactcttgccgctgggctttttgctgggaacagaggagacccagcatgaagcccagcaacctggcggcagcgcaaaagatg

SEQ ID NO: 227496 - DNA, 103 bp, Artificial Sequence
  Synthetic Polynucleotide
taatacgactcactatagggcagtgctggtggcactcttgccgctgggctaacagaggagaagcccaatggcaagagtgaacctggcggcagcgcaaaagatg

SEQ ID NO: 227497 - DNA, 103 bp, Artificial Sequence
  Synthetic Polynucleotide
taatacgactcactataggggggttggcctcagtgctggtggcactcttgaacagaggagacaagagatgcaccagcacaacctggcggcagcgcaaaagatg

SEQ ID NO: 227498 - DNA, 103 bp, Artificial Sequence
  Synthetic Polynucleotide
taatacgactcactataggggctgcctgccgggttggcctcagtgctggtaacagaggagaaccagcatggaggccaacaacctggcggcagcgcaaaagatg

SEQ ID NO: 227499 - DNA, 103 bp, Artificial Sequence
  Synthetic Polynucleotide
taatacgactcactatagggggctggagctgctgcctgccgggttggcctaacagaggagaaggccaatgcggcaggcaaacctggcggcagcgcaaaagatg

SEQ ID NO: 227500 - DNA, 103 bp, Artificial Sequence
  Synthetic Polynucleotide
taatacgactcactatagggctcgtgcccaggctggagctgctgcctgccaacagaggagaggcaggatgcagctccagaacctggcggcagcgcaaaagatg

SEQ ID NO: 227501 - DNA, 103 bp, Artificial Sequence
  Synthetic Polynucleotide
taatacgactcactatagggctcccacttcctcgtgcccaggctggagctaacagaggagaagctccatgctgggcacgaacctggcggcagcgcaaaagatg

SEQ ID NO: 227502 - DNA, 103 bp, Artificial Sequence
  Synthetic Polynucleotide
taatacgactcactatagggcgtggagctccacaatatctgccgggatctaacagaggagaagatccatgcagatattgaacctggcggcagcgcaaaagatg

SEQ ID NO: 227503 - DNA, 103 bp, Artificial Sequence
  Synthetic Polynucleotide
taatacgactcactatagggtttgcttctgctcccacttcctcgtgcccaaacagaggagatgggcaatgggaagtgggaacctggcggcagcgcaaaagatg

SEQ ID NO: 227504 - DNA, 103 bp, Artificial Sequence
  Synthetic Polynucleotide
taatacgactcactatagggttgacctgcatttgcttctgctcccacttcaacagaggagagaagtgatggcagaagcaaacctggcggcagcgcaaaagatg

SEQ ID NO: 227505 - DNA, 103 bp, Artificial Sequence
  Synthetic Polynucleotide
taatacgactcactatagggctccagcgttttgacctgcatttgcttctgaacagaggagacagaagatgatgcaggtcaacctggcggcagcgcaaaagatg

SEQ ID NO: 227506 - DNA, 103 bp, Artificial Sequence
  Synthetic Polynucleotide
taatacgactcactatagggaaaactcaccctccagcgttttgacctgcaaacagaggagatgcaggatgaaacgctggaacctggcggcagcgcaaaagatg

SEQ ID NO: 227507 - DNA, 103 bp, Artificial Sequence
  Synthetic Polynucleotide
taatacgactcactatagggatagtcacggaaaactcaccctccagcgttaacagaggagaaacgctatggggtgagttaacctggcggcagcgcaaaagatg

SEQ ID NO: 227508 - DNA, 103 bp, Artificial Sequence
  Synthetic Polynucleotide
taatacgactcactatagggaggggaccacatagtcacggaaaactcaccaacagaggagaggtgagatgtccgtgactaacctggcggcagcgcaaaagatg

SEQ ID NO: 227509 - DNA, 103 bp, Artificial Sequence
  Synthetic Polynucleotide
taatacgactcactatagggtgttatcgttaggggaccacatagtcacggaacagaggagaccgtgaatgtgtggtcccaacctggcggcagcgcaaaagatg

SEQ ID NO: 227510 - DNA, 103 bp, Artificial Sequence
  Synthetic Polynucleotide
taatacgactcactatagggccttggtcattgttatcgttaggggaccacaacagaggagagtggtcatgtaacgataaaacctggcggcagcgcaaaagatg

SEQ ID NO: 227511 - DNA, 103 bp, Artificial Sequence
  Synthetic Polynucleotide
taatacgactcactatagggacccactgccccttggtcattgttatcgttaacagaggagaaacgatatgaatgaccaaaacctggcggcagcgcaaaagatg

SEQ ID NO: 227512 - DNA, 103 bp, Artificial Sequence
  Synthetic Polynucleotide
taatacgactcactatagggcctggccttcacccactgccccttggtcataacagaggagaatgaccatggggcagtggaacctggcggcagcgcaaaagatg

SEQ ID NO: 227513 - DNA, 103 bp, Artificial Sequence
  Synthetic Polynucleotide
taatacgactcactatagggacattgatgtcgtggagctccacaatatctaacagaggagaagatatatgggagctccaaacctggcggcagcgcaaaagatg

SEQ ID NO: 227514 - DNA, 103 bp, Artificial Sequence
  Synthetic Polynucleotide
taatacgactcactataggggggttttcagcctggccttcacccactgccaacagaggagaggcagtatgtgaaggccaaacctggcggcagcgcaaaagatg

SEQ ID NO: 227515 - DNA, 103 bp, Artificial Sequence
  Synthetic Polynucleotide
taatacgactcactatagggataatcaggtgggttttcagcctggccttcaacagaggagagaaggcatggctgaaaacaacctggcggcagcgcaaaagatg

SEQ ID NO: 227516 - DNA, 103 bp, Artificial Sequence
  Synthetic Polynucleotide
taatacgactcactatagggagtactcggaataatcaggtgggttttcagaacagaggagactgaaaatgcacctgattaacctggcggcagcgcaaaagatg

SEQ ID NO: 227517 - DNA, 103 bp, Artificial Sequence
  Synthetic Polynucleotide
taatacgactcactatagggttccctttcaagtactcggaataatcaggtaacagaggagaacctgaatgttccgagtaaacctggcggcagcgcaaaagatg

SEQ ID NO: 227518 - DNA, 103 bp, Artificial Sequence
  Synthetic Polynucleotide
taatacgactcactatagggaggaagtttcttccctttcaagtactcggaaacagaggagatccgagatgttgaaagggaacctggcggcagcgcaaaagatg

SEQ ID NO: 227519 - DNA, 103 bp, Artificial Sequence
  Synthetic Polynucleotide
taatacgactcactatagggaccccccaggaggaagtttcttccctttcaaacagaggagatgaaagatgagaaacttcaacctggcggcagcgcaaaagatg

SEQ ID NO: 227520 - DNA, 103 bp, Artificial Sequence
  Synthetic Polynucleotide
taatacgactcactatagggatgcctggtaaccccccaggaggaagtttcaacagaggagagaaactatgtcctgggggaacctggcggcagcgcaaaagatg

SEQ ID NO: 227521 - DNA, 103 bp, Artificial Sequence
  Synthetic Polynucleotide
taatacgactcactatagggtgagagatcaatgcctggtaaccccccaggaacagaggagacctgggatgttaccaggcaacctggcggcagcgcaaaagatg

SEQ ID NO: 227522 - DNA, 103 bp, Artificial Sequence
  Synthetic Polynucleotide
taatacgactcactataggggtttaggatctgagagatcaatgcctggtaaacagaggagataccagatgttgatctctaacctggcggcagcgcaaaagatg

SEQ ID NO: 227523 - DNA, 103 bp, Artificial Sequence
  Synthetic Polynucleotide
taatacgactcactatagggtctgccagctgtttaggatctgagagatcaaacagaggagatgatctatgagatcctaaaacctggcggcagcgcaaaagatg

SEQ ID NO: 227524 - DNA, 103 bp, Artificial Sequence
  Synthetic Polynucleotide
taatacgactcactatagggaaggggctccacattgatgtcgtggagctcaacagaggagagagctcatggacatcaataacctggcggcagcgcaaaagatg

SEQ ID NO: 227525 - DNA, 103 bp, Artificial Sequence
  Synthetic Polynucleotide
taatacgactcactatagggtttagtaaattctgccagctgtttaggatcaacagaggagagatcctatgcagctggcaaacctggcggcagcgcaaaagatg

SEQ ID NO: 227526 - DNA, 103 bp, Artificial Sequence
  Synthetic Polynucleotide
taatacgactcactatagggtgggcttcactttagtaaattctgccagctaacagaggagaagctggatgaatttactaaacctggcggcagcgcaaaagatg

SEQ ID NO: 227527 - DNA, 103 bp, Artificial Sequence
  Synthetic Polynucleotide
taatacgactcactatagggttggaccttttgggcttcactttagtaaataacagaggagaatttacatgagtgaagccaacctggcggcagcgcaaaagatg

SEQ ID NO: 227528 - DNA, 103 bp, Artificial Sequence
  Synthetic Polynucleotide
taatacgactcactatagggaggttctcctttggaccttttgggcttcacaacagaggagagtgaagatgaaaaggtccaacctggcggcagcgcaaaagatg

SEQ ID NO: 227529 - DNA, 103 bp, Artificial Sequence
  Synthetic Polynucleotide
taatacgactcactatagggctgttttgggaggttctcctttggacctttaacagaggagaaaaggtatgaaggagaacaacctggcggcagcgcaaaagatg

SEQ ID NO: 227530 - DNA, 103 bp, Artificial Sequence
  Synthetic Polynucleotide
taatacgactcactataggggagcaagggactgttttgggaggttctcctaacagaggagaaggagaatgtcccaaaacaacctggcggcagcgcaaaagatg

SEQ ID NO: 227531 - DNA, 103 bp, Artificial Sequence
  Synthetic Polynucleotide
taatacgactcactataggggccgctataagagcaagggactgttttgggaacagaggagacccaaaatggtcccttgcaacctggcggcagcgcaaaagatg

SEQ ID NO: 227532 - DNA, 103 bp, Artificial Sequence
  Synthetic Polynucleotide
taatacgactcactatagggtcttttcgcagccgctataagagcaagggaaacagaggagatcccttatgcttatagcgaacctggcggcagcgcaaaagatg

SEQ ID NO: 227533 - DNA, 103 bp, Artificial Sequence
  Synthetic Polynucleotide
taatacgactcactatagggtcccggaacatcttttcgcagccgctataaaacagaggagattatagatgctgcgaaaaaacctggcggcagcgcaaaagatg

SEQ ID NO: 227534 - DNA, 103 bp, Artificial Sequence
  Synthetic Polynucleotide
taatacgactcactatagggggcggcgtaatcccggaacatcttttcgcaaacagaggagatgcgaaatgatgttccggaacctggcggcagcgcaaaagatg

SEQ ID NO: 227535 - DNA, 103 bp, Artificial Sequence
  Synthetic Polynucleotide
taatacgactcactatagggcctccataggaaggggctccacattgatgtaacagaggagaacatcaatgtggagccccaacctggcggcagcgcaaaagatg

SEQ ID NO: 227536 - DNA, 103 bp, Artificial Sequence
  Synthetic Polynucleotide
taatacgactcactataggggttttctcatggcggcgtaatcccggaacaaacagaggagatgttccatgattacgccgaacctggcggcagcgcaaaagatg

SEQ ID NO: 227537 - DNA, 103 bp, Artificial Sequence
  Synthetic Polynucleotide
taatacgactcactatagggatgtggagatgttttctcatggcggcgtaaaacagaggagattacgcatgcatgagaaaaacctggcggcagcgcaaaagatg

SEQ ID NO: 227538 - DNA, 103 bp, Artificial Sequence
  Synthetic Polynucleotide
taatacgactcactataggggggcccgtggatgtggagatgttttctcataacagaggagaatgagaatgcatctccacaacctggcggcagcgcaaaagatg

SEQ ID NO: 227539 - DNA, 103 bp, Artificial Sequence
  Synthetic Polynucleotide
taatacgactcactatagggcgtggactctgggcccgtggatgtggagataacagaggagaatctccatgtccacgggcaacctggcggcagcgcaaaagatg

SEQ ID NO: 227540 - DNA, 103 bp, Artificial Sequence
  Synthetic Polynucleotide
taatacgactcactatagggtctgcacatacgtggactctgggcccgtggaacagaggagaccacggatgcagagtccaaacctggcggcagcgcaaaagatg

SEQ ID NO: 227541 - DNA, 103 bp, Artificial Sequence
  Synthetic Polynucleotide
taatacgactcactatagggtttgccacattctgcacatacgtggactctaacagaggagaagagtcatggtatgtgcaaacctggcggcagcgcaaaagatg

SEQ ID NO: 227542 - DNA, 103 bp, Artificial Sequence
  Synthetic Polynucleotide
taatacgactcactatagggcaagaaaagctttgccacattctgcacataaacagaggagatatgtgatgaatgtggcaaacctggcggcagcgcaaaagatg

SEQ ID NO: 227543 - DNA, 103 bp, Artificial Sequence
  Synthetic Polynucleotide
taatacgactcactatagggtttgagctctcaagaaaagctttgccacataacagaggagaatgtggatgagcttttctaacctggcggcagcgcaaaagatg

SEQ ID NO: 227544 - DNA, 103 bp, Artificial Sequence
  Synthetic Polynucleotide
taatacgactcactatagggtcgtctcagctttgagctctcaagaaaagcaacagaggagagcttttatggagagctcaaacctggcggcagcgcaaaagatg

SEQ ID NO: 227545 - DNA, 103 bp, Artificial Sequence
  Synthetic Polynucleotide
taatacgactcactatagggccagctggtgtcgtctcagctttgagctctaacagaggagaagagctatgagctgagacaacctggcggcagcgcaaaagatg

SEQ ID NO: 227546 - DNA, 103 bp, Artificial Sequence
  Synthetic Polynucleotide
taatacgactcactataggggtcggaatgtcctccataggaaggggctccaacagaggagaggagccatgtcctatggaaacctggcggcagcgcaaaagatg

SEQ ID NO: 227547 - DNA, 103 bp, Artificial Sequence
  Synthetic Polynucleotide
taatacgactcactatagggccggtgtggaccagctggtgtcgtctcagcaacagaggagagctgagatgacaccagctaacctggcggcagcgcaaaagatg

SEQ ID NO: 227548 - DNA, 103 bp, Artificial Sequence
  Synthetic Polynucleotide
taatacgactcactataggggggcttctcgccggtgtggaccagctggtgaacagaggagacaccagatggtccacaccaacctggcggcagcgcaaaagatg

SEQ ID NO: 227549 - DNA, 103 bp, Artificial Sequence
  Synthetic Polynucleotide
taatacgactcactatagggtgcactgaaagggcttctcgccggtgtggaaacagaggagatccacaatggcgagaagcaacctggcggcagcgcaaaagatg

SEQ ID NO: 227550 - DNA, 103 bp, Artificial Sequence
  Synthetic Polynucleotide
taatacgactcactatagggccttcgaatgtgcactgaaagggcttctcgaacagaggagacgagaaatgctttcagtgaacctggcggcagcgcaaaagatg

SEQ ID NO: 227551 - DNA, 103 bp, Artificial Sequence
  Synthetic Polynucleotide
taatacgactcactatagggtttcccgcagccttcgaatgtgcactgaaaaacagaggagatttcagatgacattcgaaaacctggcggcagcgcaaaagatg

SEQ ID NO: 227552 - DNA, 103 bp, Artificial Sequence
  Synthetic Polynucleotide
taatacgactcactataggggggaaaagcgtttcccgcagccttcgaatgaacagaggagacattcgatggctgcgggaaacctggcggcagcgcaaaagatg

SEQ ID NO: 227553 - DNA, 103 bp, Artificial Sequence
  Synthetic Polynucleotide
taatacgactcactatagggttgaaatcaagggaaaagcgtttcccgcagaacagaggagactgcggatgacgcttttcaacctggcggcagcgcaaaagatg

SEQ ID NO: 227554 - DNA, 103 bp, Artificial Sequence
  Synthetic Polynucleotide
taatacgactcactatagggtgtgcgcaaattgaaatcaagggaaaagcgaacagaggagacgctttatgcttgatttcaacctggcggcagcgcaaaagatg

SEQ ID NO: 227555 - DNA, 103 bp, Artificial Sequence
  Synthetic Polynucleotide
taatacgactcactatagggtgcgcaagtgtgtgcgcaaattgaaatcaaaacagaggagattgattatgatttgcgcaaacctggcggcagcgcaaaagatg

SEQ ID NO: 227556 - DNA, 103 bp, Artificial Sequence
  Synthetic Polynucleotide
taatacgactcactatagggccggtgtggatgcgcaagtgtgtgcgcaaaaacagaggagatttgcgatgacacttgcgaacctggcggcagcgcaaaagatg

SEQ ID NO: 227557 - DNA, 103 bp, Artificial Sequence
  Synthetic Polynucleotide
taatacgactcactatagggctgggagctctccaggcttttattctccataacagaggagaatggagatgaaaagcctgaacctggcggcagcgcaaaagatg

SEQ ID NO: 227558 - DNA, 103 bp, Artificial Sequence
  Synthetic Polynucleotide
taatacgactcactatagggcaggatgcatccctcggcgttggtgtcgaaaacagaggagattcgacatgaacgccgagaacctggcggcagcgcaaaagatg

SEQ ID NO: 227559 - DNA, 103 bp, Artificial Sequence
  Synthetic Polynucleotide
taatacgactcactataggggttctgctgcttctgcttctcatagagcataacagaggagaatgctcatggagaagcagaacctggcggcagcgcaaaagatg

SEQ ID NO: 227560 - DNA, 103 bp, Artificial Sequence
  Synthetic Polynucleotide
taatacgactcactatagggagtgggccacgttctgctgcttctgcttctaacagaggagaagaagcatgagcagcagaaacctggcggcagcgcaaaagatg

SEQ ID NO: 227561 - DNA, 103 bp, Artificial Sequence
  Synthetic Polynucleotide
taatacgactcactatagggaccagcatgcagtgggccacgttctgctgcaacagaggagagcagcaatgcgtggcccaaacctggcggcagcgcaaaagatg

SEQ ID NO: 227562 - DNA, 103 bp, Artificial Sequence
  Synthetic Polynucleotide
taatacgactcactataggggcggttgctcaccagcatgcagtgggccacaacagaggagagtggccatgtgcatgctgaacctggcggcagcgcaaaagatg

SEQ ID NO: 227563 - DNA, 103 bp, Artificial Sequence
  Synthetic Polynucleotide
taatacgactcactatagggaccaggagacgcggttgctcaccagcatgcaacagaggagagcatgcatgtgagcaaccaacctggcggcagcgcaaaagatg

SEQ ID NO: 227564 - DNA, 103 bp, Artificial Sequence
  Synthetic Polynucleotide
taatacgactcactataggggtgctcccccaccaggagacgcggttgctcaacagaggagagagcaaatgcgtctcctgaacctggcggcagcgcaaaagatg

SEQ ID NO: 227565 - DNA, 103 bp, Artificial Sequence
  Synthetic Polynucleotide
taatacgactcactatagggcatggccagcgtgctcccccaccaggagacaacagaggagagtctccatgtgggggagcaacctggcggcagcgcaaaagatg

SEQ ID NO: 227566 - DNA, 103 bp, Artificial Sequence
  Synthetic Polynucleotide
taatacgactcactatagggggcgctgcagcatggccagcgtgctcccccaacagaggagagggggaatgcgctggccaaacctggcggcagcgcaaaagatg

SEQ ID NO: 227567 - DNA, 103 bp, Artificial Sequence
  Synthetic Polynucleotide
taatacgactcactatagggtgctccttgaggcgctgcagcatggccagcaacagaggagagctggcatggctgcagcgaacctggcggcagcgcaaaagatg

SEQ ID NO: 227568 - DNA, 103 bp, Artificial Sequence
  Synthetic Polynucleotide
taatacgactcactataggggacgaactgctgctccttgaggcgctgcagaacagaggagactgcagatgctcaaggagaacctggcggcagcgcaaaagatg

SEQ ID NO: 227569 - DNA, 103 bp, Artificial Sequence
  Synthetic Polynucleotide
taatacgactcactatagggtcttccactgcaggatgcatccctcggcgtaacagaggagaacgccgatggatgcatccaacctggcggcagcgcaaaagatg

SEQ ID NO: 227570 - DNA, 103 bp, Artificial Sequence
  Synthetic Polynucleotide
taatacgactcactatagggccccggcgatgacgaactgctgctccttgaaacagaggagatcaaggatgagcagttcgaacctggcggcagcgcaaaagatg

SEQ ID NO: 227571 - DNA, 103 bp, Artificial Sequence
  Synthetic Polynucleotide
taatacgactcactatagggtccaccaagaccccggcgatgacgaactgcaacagaggagagcagttatgcatcgccggaacctggcggcagcgcaaaagatg

SEQ ID NO: 227572 - DNA, 103 bp, Artificial Sequence
  Synthetic Polynucleotide
taatacgactcactataggggttgctgtcctccaccaagaccccggcgataacagaggagaatcgccatggtcttggtgaacctggcggcagcgcaaaagatg

SEQ ID NO: 227573 - DNA, 103 bp, Artificial Sequence
  Synthetic Polynucleotide
taatacgactcactatagggggtggtggttgttgctgtcctccaccaagaaacagaggagatcttggatgaggacagcaaacctggcggcagcgcaaaagatg

SEQ ID NO: 227574 - DNA, 103 bp, Artificial Sequence
  Synthetic Polynucleotide
taatacgactcactatagggtccagcatgaggtggtggttgttgctgtccaacagaggagaggacagatgcaaccaccaaacctggcggcagcgcaaaagatg

SEQ ID NO: 227575 - DNA, 103 bp, Artificial Sequence
  Synthetic Polynucleotide
taatacgactcactatagggctcgctggcctccagcatgaggtggtggttaacagaggagaaaccacatgctcatgctgaacctggcggcagcgcaaaagatg

SEQ ID NO: 227576 - DNA, 103 bp, Artificial Sequence
  Synthetic Polynucleotide
taatacgactcactatagggtggtggcccactcgctggcctccagcatgaaacagaggagatcatgcatgaggccagcgaacctggcggcagcgcaaaagatg

SEQ ID NO: 227577 - DNA, 103 bp, Artificial Sequence
  Synthetic Polynucleotide
taatacgactcactatagggagcccctcgatggtggcccactcgctggccaacagaggagaggccagatggtgggccacaacctggcggcagcgcaaaagatg

SEQ ID NO: 227578 - DNA, 103 bp, Artificial Sequence
  Synthetic Polynucleotide
taatacgactcactataggggagctccaccagcccctcgatggtggcccaaacagaggagatgggccatgatcgaggggaacctggcggcagcgcaaaagatg

SEQ ID NO: 227579 - DNA, 103 bp, Artificial Sequence
  Synthetic Polynucleotide
taatacgactcactatagggagggctgcaggagctccaccagcccctcgaaacagaggagatcgaggatgtggtggagcaacctggcggcagcgcaaaagatg

SEQ ID NO: 227580 - DNA, 103 bp, Artificial Sequence
  Synthetic Polynucleotide
taatacgactcactatagggcagtagattttcttccactgcaggatgcataacagaggagaatgcatatggcagtggaaaacctggcggcagcgcaaaagatg

SEQ ID NO: 227581 - DNA, 103 bp, Artificial Sequence
  Synthetic Polynucleotide
taatacgactcactatagggacctgcttgaagggctgcaggagctccaccaacagaggagaggtggaatgcctgcagccaacctggcggcagcgcaaaagatg

SEQ ID NO: 227582 - DNA, 103 bp, Artificial Sequence
  Synthetic Polynucleotide
taatacgactcactatagggcatctcggccacctgcttgaagggctgcagaacagaggagactgcagatgttcaagcagaacctggcggcagcgcaaaagatg

SEQ ID NO: 227583 - DNA, 103 bp, Artificial Sequence
  Synthetic Polynucleotide
taatacgactcactatagggaggccgacagcatctcggccacctgcttgaaacagaggagatcaagcatgtggccgagaaacctggcggcagcgcaaaagatg

SEQ ID NO: 227584 - DNA, 103 bp, Artificial Sequence
  Synthetic Polynucleotide
taatacgactcactataggggggtacctggaggccgacagcatctcggccaacagaggagaggccgaatggctgtcggcaacctggcggcagcgcaaaagatg

SEQ ID NO: 227585 - DNA, 103 bp, Artificial Sequence
  Synthetic Polynucleotide
taatacgactcactataggggctgatggtggggtacctggaggccgacagaacagaggagactgtcgatgtccaggtacaacctggcggcagcgcaaaagatg

SEQ ID NO: 227586 - DNA, 103 bp, Artificial Sequence
  Synthetic Polynucleotide
taatacgactcactataggggcttcaccatgctgatggtggggtacctggaacagaggagaccaggtatgccaccatcaaacctggcggcagcgcaaaagatg

SEQ ID NO: 227587 - DNA, 103 bp, Artificial Sequence
  Synthetic Polynucleotide
taatacgactcactatagggtgcagcagcggcttcaccatgctgatggtgaacagaggagacaccatatgcatggtgaaaacctggcggcagcgcaaaagatg

SEQ ID NO: 227588 - DNA, 103 bp, Artificial Sequence
  Synthetic Polynucleotide
taatacgactcactatagggcaggagcatgtgcagcagcggcttcaccataacagaggagaatggtgatgccgctgctgaacctggcggcagcgcaaaagatg

SEQ ID NO: 227589 - DNA, 103 bp, Artificial Sequence
  Synthetic Polynucleotide
taatacgactcactataggggcgtggtgttcaggagcatgtgcagcagcgaacagaggagacgctgcatgacatgctccaacctggcggcagcgcaaaagatg

SEQ ID NO: 227590 - DNA, 103 bp, Artificial Sequence
  Synthetic Polynucleotide
taatacgactcactatagggttgatgttgagcgtggtgttcaggagcatgaacagaggagacatgctatggaacaccacaacctggcggcagcgcaaaagatg

SEQ ID NO: 227591 - DNA, 103 bp, Artificial Sequence
  Synthetic Polynucleotide
taatacgactcactataggggcagatgcggcagtagattttcttccactgaacagaggagacagtggatgaaaatctacaacctggcggcagcgcaaaagatg

SEQ ID NO: 227592 - DNA, 103 bp, Artificial Sequence
  Synthetic Polynucleotide
taatacgactcactataggggtcggtctccttgatgttgagcgtggtgttaacagaggagaaacaccatgctcaacatcaacctggcggcagcgcaaaagatg

SEQ ID NO: 227593 - DNA, 103 bp, Artificial Sequence
  Synthetic Polynucleotide
taatacgactcactataggggctccttggagtcggtctccttgatgttgaaacagaggagatcaacaatgaggagaccgaacctggcggcagcgcaaaagatg

SEQ ID NO: 227594 - DNA, 103 bp, Artificial Sequence
  Synthetic Polynucleotide
taatacgactcactataggggccatgctgagctccttggagtcggtctccaacagaggagaggagacatgctccaaggaaacctggcggcagcgcaaaagatg

SEQ ID NO: 227595 - DNA, 103 bp, Artificial Sequence
  Synthetic Polynucleotide
taatacgactcactataggggacctccttggccatgctgagctccttggaaacagaggagatccaagatgctcagcatgaacctggcggcagcgcaaaagatg

SEQ ID NO: 227596 - DNA, 103 bp, Artificial Sequence
  Synthetic Polynucleotide
taatacgactcactatagggccttggcgatgacctccttggccatgctgaaacagaggagatcagcaatgccaaggaggaacctggcggcagcgcaaaagatg

SEQ ID NO: 227597 - DNA, 103 bp, Artificial Sequence
  Synthetic Polynucleotide
taatacgactcactatagggttggaaagctccttggcgatgacctccttgaacagaggagacaaggaatgcatcgccaaaacctggcggcagcgcaaaagatg

SEQ ID NO: 227598 - DNA, 103 bp, Artificial Sequence
  Synthetic Polynucleotide
taatacgactcactatagggctggtaggtcttggaaagctccttggcgataacagaggagaatcgccatggagctttccaacctggcggcagcgcaaaagatg

SEQ ID NO: 227599 - DNA, 103 bp, Artificial Sequence
  Synthetic Polynucleotide
taatacgactcactatagggcgggcgtctcctggtaggtcttggaaagctaacagaggagaagctttatgagacctaccaacctggcggcagcgcaaaagatg

SEQ ID NO: 227600 - DNA, 103 bp, Artificial Sequence
  Synthetic Polynucleotide
taatacgactcactatagggatgtcgatctcgggcgtctcctggtaggtcaacagaggagagacctaatgggagacgccaacctggcggcagcgcaaaagatg

SEQ ID NO: 227601 - DNA, 103 bp, Artificial Sequence
  Synthetic Polynucleotide
taatacgactcactataggggttgagaaacatgtcgatctcgggcgtctcaacagaggagagagacgatggagatcgacaacctggcggcagcgcaaaagatg

SEQ ID NO: 227602 - DNA, 103 bp, Artificial Sequence
  Synthetic Polynucleotide
taatacgactcactatagggtctgggccatgcagatgcggcagtagatttaacagaggagaaaatctatggccgcatctaacctggcggcagcgcaaaagatg

SEQ ID NO: 227603 - DNA, 103 bp, Artificial Sequence
  Synthetic Polynucleotide
taatacgactcactatagggaggtggccacgttgagaaacatgtcgatctaacagaggagaagatcgatgtgtttctcaaacctggcggcagcgcaaaagatg

SEQ ID NO: 227604 - DNA, 103 bp, Artificial Sequence
  Synthetic Polynucleotide
taatacgactcactataggggggtccaggaaggtggccacgttgagaaacaacagaggagagtttctatgcgtggccacaacctggcggcagcgcaaaagatg

SEQ ID NO: 227605 - DNA, 103 bp, Artificial Sequence
  Synthetic Polynucleotide
taatacgactcactatagggcttgtagcgggggtccaggaaggtggccacaacagaggagagtggccatgttcctggacaacctggcggcagcgcaaaagatg

SEQ ID NO: 227606 - DNA, 103 bp, Artificial Sequence
  Synthetic Polynucleotide
taatacgactcactatagggagggcagcctcttgtagcgggggtccaggaaacagaggagatcctggatgcccgctacaaacctggcggcagcgcaaaagatg

SEQ ID NO: 227607 - DNA, 103 bp, Artificial Sequence
  Synthetic Polynucleotide
taatacgactcactataggggcggagaggaagggcagcctcttgtagcggaacagaggagaccgctaatggaggctgccaacctggcggcagcgcaaaagatg

SEQ ID NO: 227608 - DNA, 103 bp, Artificial Sequence
  Synthetic Polynucleotide
taatacgactcactatagggccgctcgaaggcggagaggaagggcagcctaacagaggagaaggctgatgttcctctccaacctggcggcagcgcaaaagatg

SEQ ID NO: 227609 - DNA, 103 bp, Artificial Sequence
  Synthetic Polynucleotide
taatacgactcactatagggccacctgctgccgctcgaaggcggagaggaaacagaggagatcctctatgccttcgagcaacctggcggcagcgcaaaagatg

SEQ ID NO: 227610 - DNA, 103 bp, Artificial Sequence
  Synthetic Polynucleotide
taatacgactcactatagggacgcgattctccacctgctgccgctcgaagaacagaggagacttcgaatggcagcaggtaacctggcggcagcgcaaaagatg

SEQ ID NO: 227611 - DNA, 103 bp, Artificial Sequence
  Synthetic Polynucleotide
taatacgactcactatagggctcttccaccacgcgattctccacctgctgaacagaggagacagcagatggagaatcgcaacctggcggcagcgcaaaagatg

SEQ ID NO: 227612 - DNA, 103 bp, Artificial Sequence
  Synthetic Polynucleotide
taatacgactcactatagggggcccttggcctcttccaccacgcgattctaacagaggagaagaatcatgtggtggaagaacctggcggcagcgcaaaagatg

SEQ ID NO: 227613 - DNA, 103 bp, Artificial Sequence
  Synthetic Polynucleotide
taatacgactcactataggggagtaggcgatctgggccatgcagatgcggaacagaggagaccgcatatgcatggcccaaacctggcggcagcgcaaaagatg

SEQ ID NO: 227614 - DNA, 103 bp, Artificial Sequence
  Synthetic Polynucleotide
taatacgactcactatagggttgtccagcaggcccttggcctcttccaccaacagaggagaggtggaatgggccaagggaacctggcggcagcgcaaaagatg

SEQ ID NO: 227615 - DNA, 103 bp, Artificial Sequence
  Synthetic Polynucleotide
taatacgactcactataggggtctttgaccttgtccagcaggcccttggcaacagaggagagccaagatgctgctggacaacctggcggcagcgcaaaagatg

SEQ ID NO: 227616 - DNA, 103 bp, Artificial Sequence
  Synthetic Polynucleotide
taatacgactcactatagggggtagccgccgtctttgaccttgtccagcaaacagaggagatgctggatgaggtcaaagaacctggcggcagcgcaaaagatg

SEQ ID NO: 227617 - DNA, 103 bp, Artificial Sequence
  Synthetic Polynucleotide
taatacgactcactatagggtcagccggccggtagccgccgtctttgaccaacagaggagaggtcaaatgcggcggctaaacctggcggcagcgcaaaagatg

SEQ ID NO: 227618 - DNA, 103 bp, Artificial Sequence
  Synthetic Polynucleotide
taatacgactcactataggggatcttgtcctcagccggccggtagccgccaacagaggagaggcggcatgcggccggctaacctggcggcagcgcaaaagatg

SEQ ID NO: 227619 - DNA, 103 bp, Artificial Sequence
  Synthetic Polynucleotide
taatacgactcactataggggcaccgggaagatcttgtcctcagccggccaacagaggagaggccggatgaggacaagaaacctggcggcagcgcaaaagatg

SEQ ID NO: 227620 - DNA, 103 bp, Artificial Sequence
  Synthetic Polynucleotide
taatacgactcactatagggggctcctcgggcaccgggaagatcttgtccaacagaggagaggacaaatgcttcccggtaacctggcggcagcgcaaaagatg

SEQ ID NO: 227621 - DNA, 103 bp, Artificial Sequence
  Synthetic Polynucleotide
taatacgactcactatagggcttgacgggaggctcctcgggcaccgggaaaacagaggagattcccgatgcccgaggagaacctggcggcagcgcaaaagatg

SEQ ID NO: 227622 - DNA, 103 bp, Artificial Sequence
  Synthetic Polynucleotide
taatacgactcactataggggcatgagcttcttgacgggaggctcctcggaacagaggagaccgaggatgctcccgtcaaacctggcggcagcgcaaaagatg

SEQ ID NO: 227623 - DNA, 103 bp, Artificial Sequence
  Synthetic Polynucleotide
taatacgactcactataggggtggatgtccgcatgagcttcttgacgggaaacagaggagatcccgtatggaagctcataacctggcggcagcgcaaaagatg

SEQ ID NO: 227624 - DNA, 103 bp, Artificial Sequence
  Synthetic Polynucleotide
taatacgactcactatagggggtgtttccggagtaggcgatctgggccataacagaggagaatggccatgatcgcctacaacctggcggcagcgcaaaagatg

SEQ ID NO: 227625 - DNA, 103 bp, Artificial Sequence
  Synthetic Polynucleotide
taatacgactcactataggggggcggcggcgtggatgtccgcatgagcttaacagaggagaaagctcatgcggacatccaacctggcggcagcgcaaaagatg

SEQ ID NO: 227626 - DNA, 103 bp, Artificial Sequence
  Synthetic Polynucleotide
taatacgactcactatagggtgacgctggcgggcggcggcgtggatgtccaacagaggagaggacatatgcgccgccgcaacctggcggcagcgcaaaagatg

SEQ ID NO: 227627 - DNA, 103 bp, Artificial Sequence
  Synthetic Polynucleotide
taatacgactcactatagggatgttgttgatgacgctggcgggcggcggcaacagaggagagccgccatgcgccagcgtaacctggcggcagcgcaaaagatg

SEQ ID NO: 227628 - DNA, 103 bp, Artificial Sequence
  Synthetic Polynucleotide
taatacgactcactatagggctcggccagcatgttgttgatgacgctggcaacagaggagagccagcatgatcaacaacaacctggcggcagcgcaaaagatg

SEQ ID NO: 227629 - DNA, 103 bp, Artificial Sequence
  Synthetic Polynucleotide
taatacgactcactatagggggcagaagatctcggccagcatgttgttgaaacagaggagatcaacaatgtgctggccgaacctggcggcagcgcaaaagatg

SEQ ID NO: 227630 - DNA, 103 bp, Artificial Sequence
  Synthetic Polynucleotide
taatacgactcactatagggccgcctgtctggcagaagatctcggccagcaacagaggagagctggcatggatcttctgaacctggcggcagcgcaaaagatg

SEQ ID NO: 227631 - DNA, 103 bp, Artificial Sequence
  Synthetic Polynucleotide
taatacgactcactataggggtcctccacgccgcctgtctggcagaagataacagaggagaatcttcatgcagacaggcaacctggcggcagcgcaaaagatg

SEQ ID NO: 227632 - DNA, 103 bp, Artificial Sequence
  Synthetic Polynucleotide
taatacgactcactatagggactcttcctggtcctccacgccgcctgtctaacagaggagaagacagatggcgtggaggaacctggcggcagcgcaaaagatg

SEQ ID NO: 227633 - DNA, 103 bp, Artificial Sequence
  Synthetic Polynucleotide
taatacgactcactatagggtgggcatgccactcttcctggtcctccacgaacagaggagacgtggaatgccaggaagaaacctggcggcagcgcaaaagatg

SEQ ID NO: 227634 - DNA, 103 bp, Artificial Sequence
  Synthetic Polynucleotide
taatacgactcactatagggctccaccacctgggcatgccactcttcctgaacagaggagacaggaaatgtggcatgccaacctggcggcagcgcaaaagatg

SEQ ID NO: 227635 - DNA, 103 bp, Artificial Sequence
  Synthetic Polynucleotide
taatacgactcactatagggacaggttggaggtgtttccggagtaggcgaaacagaggagatcgcctatgccggaaacaaacctggcggcagcgcaaaagatg

SEQ ID NO: 227636 - DNA, 103 bp, Artificial Sequence
  Synthetic Polynucleotide
taatacgactcactatagggtgctcagctcctccaccacctgggcatgccaacagaggagaggcatgatgaggtggtggaacctggcggcagcgcaaaagatg

SEQ ID NO: 227637 - DNA, 103 bp, Artificial Sequence
  Synthetic Polynucleotide
taatacgactcactataggggacttgaagttgctcagctcctccaccaccaacagaggagaggtggtatgggagctgagaacctggcggcagcgcaaaagatg

SEQ ID NO: 227638 - DNA, 103 bp, Artificial Sequence
  Synthetic Polynucleotide
taatacgactcactatagggcaccttctgggacttgaagttgctcagctcaacagaggagagagctgatgaacttcaagaacctggcggcagcgcaaaagatg

SEQ ID NO: 227639 - DNA, 103 bp, Artificial Sequence
  Synthetic Polynucleotide
taatacgactcactatagggtgaggccaagcaccttctgggacttgaagtaacagaggagaacttcaatgcccagaaggaacctggcggcagcgcaaaagatg

SEQ ID NO: 227640 - DNA, 103 bp, Artificial Sequence
  Synthetic Polynucleotide
taatacgactcactataggggggtcttcgttgaggccaagcaccttctggaacagaggagaccagaaatggcttggcctaacctggcggcagcgcaaaagatg

SEQ ID NO: 227641 - DNA, 103 bp, Artificial Sequence
  Synthetic Polynucleotide
taatacgactcactatagggccacttgagggggtcttcgttgaggccaagaacagaggagacttggcatgaacgaagacaacctggcggcagcgcaaaagatg

SEQ ID NO: 227642 - DNA, 103 bp, Artificial Sequence
  Synthetic Polynucleotide
taatacgactcactatagggggtctgaccaccacttgagggggtcttcgtaacagaggagaacgaagatgccctcaagtaacctggcggcagcgcaaaagatg

SEQ ID NO: 227643 - DNA, 103 bp, Artificial Sequence
  Synthetic Polynucleotide
taatacgactcactatagggagggccaggcggtctgaccaccacttgaggaacagaggagacctcaaatggtggtcagaaacctggcggcagcgcaaaagatg

SEQ ID NO: 227644 - DNA, 103 bp, Artificial Sequence
  Synthetic Polynucleotide
taatacgactcactatagggcagggggaagagggccaggcggtctgaccaaacagaggagatggtcaatgcgcctggccaacctggcggcagcgcaaaagatg

SEQ ID NO: 227645 - DNA, 103 bp, Artificial Sequence
  Synthetic Polynucleotide
taatacgactcactatagggccttgggcagcagggggaagagggccaggcaacagaggagagcctggatgtcttcccccaacctggcggcagcgcaaaagatg

SEQ ID NO: 227646 - DNA, 103 bp, Artificial Sequence
  Synthetic Polynucleotide
taatacgactcactatagggaggtggtaggacaggttggaggtgtttccgaacagaggagacggaaaatgctccaacctaacctggcggcagcgcaaaagatg

SEQ ID NO: 227647 - DNA, 103 bp, Artificial Sequence
  Synthetic Polynucleotide
taatacgactcactatagggttctgcagcaccttgggcagcagggggaagaacagaggagacttcccatggctgcccaaaacctggcggcagcgcaaaagatg

SEQ ID NO: 227648 - DNA, 103 bp, Artificial Sequence
  Synthetic Polynucleotide
taatacgactcactataggggcaccagtacttctgcagcaccttgggcagaacagaggagactgcccatggtgctgcagaacctggcggcagcgcaaaagatg

SEQ ID NO: 227649 - DNA, 103 bp, Artificial Sequence
  Synthetic Polynucleotide
taatacgactcactatagggtggccgtcacgcaccagtacttctgcagcaaacagaggagatgctgcatgagtactggtaacctggcggcagcgcaaaagatg

SEQ ID NO: 227650 - DNA, 103 bp, Artificial Sequence
  Synthetic Polynucleotide
taatacgactcactataggggcgacgcgcgtggccgtcacgcaccagtacaacagaggagagtactgatgcgtgacggcaacctggcggcagcgcaaaagatg

SEQ ID NO: 227651 - DNA, 103 bp, Artificial Sequence
  Synthetic Polynucleotide
taatacgactcactatagggacgctcaggggcgacgcgcgtggccgtcacaacagaggagagtgacgatgacgcgcgtcaacctggcggcagcgcaaaagatg

SEQ ID NO: 227652 - DNA, 103 bp, Artificial Sequence
  Synthetic Polynucleotide
taatacgactcactatagggatccgaagagacgctcaggggcgacgcgcgaacagaggagacgcgcgatgcccctgagcaacctggcggcagcgcaaaagatg

SEQ ID NO: 227653 - DNA, 103 bp, Artificial Sequence
  Synthetic Polynucleotide
taatacgactcactatagggttggcggcggatccgaagagacgctcagggaacagaggagaccctgaatgtctcttcggaacctggcggcagcgcaaaagatg

SEQ ID NO: 227654 - DNA, 103 bp, Artificial Sequence
  Synthetic Polynucleotide
taatacgactcactataggggctgaccacgttggcggcggatccgaagagaacagaggagactcttcatgtccgccgccaacctggcggcagcgcaaaagatg

SEQ ID NO: 227655 - DNA, 103 bp, Artificial Sequence
  Synthetic Polynucleotide
taatacgactcactatagggtcctcttggcgctgaccacgttggcggcggaacagaggagaccgccgatgacgtggtcaaacctggcggcagcgcaaaagatg

SEQ ID NO: 227656 - DNA, 103 bp, Artificial Sequence
  Synthetic Polynucleotide
taatacgactcactataggggccagccggttcctcttggcgctgaccacgaacagaggagacgtggtatgcgccaagagaacctggcggcagcgcaaaagatg

SEQ ID NO: 227657 - DNA, 103 bp, Artificial Sequence
  Synthetic Polynucleotide
taatacgactcactataggggttcttctccaggtggtaggacaggttggaaacagaggagatccaacatgtcctaccacaacctggcggcagcgcaaaagatg

SEQ ID NO: 227658 - DNA, 103 bp, Artificial Sequence
  Synthetic Polynucleotide
taatacgactcactataggggtgcgcgggagccagccggttcctcttggcaacagaggagagccaagatgaaccggctgaacctggcggcagcgcaaaagatg

SEQ ID NO: 227659 - DNA, 103 bp, Artificial Sequence
  Synthetic Polynucleotide
taatacgactcactataggggctcgtccacgtgcgcgggagccagccggtaacagaggagaaccggcatgctcccgcgcaacctggcggcagcgcaaaagatg

SEQ ID NO: 227660 - DNA, 103 bp, Artificial Sequence
  Synthetic Polynucleotide
taatacgactcactatagggagaaacacctgctcgtccacgtgcgcgggaaacagaggagatcccgcatgcgtggacgaaacctggcggcagcgcaaaagatg

SEQ ID NO: 227661 - DNA, 103 bp, Artificial Sequence
  Synthetic Polynucleotide
taatacgactcactataggggttctcatacagaaacacctgctcgtccacaacagaggagagtggacatgcaggtgtttaacctggcggcagcgcaaaagatg

SEQ ID NO: 227662 - DNA, 103 bp, Artificial Sequence
  Synthetic Polynucleotide
taatacgactcactatagggcactccgggcgttctcatacagaaacacctaacagaggagaaggtgtatgtgtatgagaaacctggcggcagcgcaaaagatg

SEQ ID NO: 227663 - DNA, 103 bp, Artificial Sequence
  Synthetic Polynucleotide
taatacgactcactataggggcctctgccccactccgggcgttctcatacaacagaggagagtatgaatgcgcccggagaacctggcggcagcgcaaaagatg

SEQ ID NO: 227664 - DNA, 103 bp, Artificial Sequence
  Synthetic Polynucleotide
taatacgactcactatagggctcgggttccgcctctgccccactccgggcaacagaggagagcccggatgggggcagagaacctggcggcagcgcaaaagatg

SEQ ID NO: 227665 - DNA, 103 bp, Artificial Sequence
  Synthetic Polynucleotide
taatacgactcactatagggcgtcctggtcctcgggttccgcctctgcccaacagaggagagggcagatgcggaacccgaacctggcggcagcgcaaaagatg

SEQ ID NO: 227666 - DNA, 103 bp, Artificial Sequence
  Synthetic Polynucleotide
taatacgactcactatagggcactccccctcgtcctggtcctcgggttccaacagaggagaggaaccatgggaccaggaaacctggcggcagcgcaaaagatg

SEQ ID NO: 227667 - DNA, 103 bp, Artificial Sequence
  Synthetic Polynucleotide
taatacgactcactataggggtccaggccccactccccctcgtcctggtcaacagaggagagaccagatggagggggagaacctggcggcagcgcaaaagatg

SEQ ID NO: 227668 - DNA, 103 bp, Artificial Sequence
  Synthetic Polynucleotide
taatacgactcactatagggtcaggtctgtctgggagctctccaggctttaacagaggagaaaagccatgagagctcccaacctggcggcagcgcaaaagatg

SEQ ID NO: 227669 - DNA, 103 bp, Artificial Sequence
  Synthetic Polynucleotide
taatacgactcactatagggcctcggggtggttcttctccaggtggtaggaacagaggagacctaccatgtggagaagaaacctggcggcagcgcaaaagatg

SEQ ID NO: 227670 - DNA, 103 bp, Artificial Sequence
  Synthetic Polynucleotide
taatacgactcactatagggcctgctcctggtccaggccccactccccctaacagaggagaagggggatgggggcctggaacctggcggcagcgcaaaagatg

SEQ ID NO: 227671 - DNA, 103 bp, Artificial Sequence
  Synthetic Polynucleotide
taatacgactcactatagggaaggagaacacctgctcctggtccaggcccaacagaggagagggcctatgccaggagcaaacctggcggcagcgcaaaagatg

SEQ ID NO: 227672 - DNA, 103 bp, Artificial Sequence
  Synthetic Polynucleotide
taatacgactcactataggggccatcccccaaggagaacacctgctcctgaacagaggagacaggagatggtgttctccaacctggcggcagcgcaaaagatg

SEQ ID NO: 227673 - DNA, 103 bp, Artificial Sequence
  Synthetic Polynucleotide
taatacgactcactatagggcgccgctgacgccatcccccaaggagaacaaacagaggagatgttctatgtgggggatgaacctggcggcagcgcaaaagatg

SEQ ID NO: 227674 - DNA, 103 bp, Artificial Sequence
  Synthetic Polynucleotide
taatacgactcactatagggccaaagaaaccgccgctgacgccatcccccaacagaggagagggggaatgcgtcagcggaacctggcggcagcgcaaaagatg

SEQ ID NO: 227675 - DNA, 103 bp, Artificial Sequence
  Synthetic Polynucleotide
taatacgactcactataggggtccctaatgccaaagaaaccgccgctgacaacagaggagagtcagcatgggtttctttaacctggcggcagcgcaaaagatg

SEQ ID NO: 227676 - DNA, 103 bp, Artificial Sequence
  Synthetic Polynucleotide
taatacgactcactatagggggaagctgctgtccctaatgccaaagaaacaacagaggagagtttctatggcattagggaacctggcggcagcgcaaaagatg

SEQ ID NO: 227677 - DNA, 103 bp, Artificial Sequence
  Synthetic Polynucleotide
taatacgactcactatagggtcgcagaattcctcggggtggttcttctccaacagaggagaggagaaatgccaccccgaaacctggcggcagcgcaaaagatg

SEQ ID NO: 227678 - DNA, 103 bp, Artificial Sequence
  Synthetic Polynucleotide
taatacgactcactatagggcttgacgaactcgcagaattcctcggggtgaacagaggagacaccccatggaattctgcaacctggcggcagcgcaaaagatg

SEQ ID NO: 227679 - DNA, 103 bp, Artificial Sequence
  Synthetic Polynucleotide
taatacgactcactatagggccgtgttgctcttgacgaactcgcagaattaacagaggagaaattctatgagttcgtcaaacctggcggcagcgcaaaagatg

SEQ ID NO: 227680 - DNA, 103 bp, Artificial Sequence
  Synthetic Polynucleotide
taatacgactcactatagggcgcatctgctccgtgttgctcttgacgaacaacagaggagagttcgtatggagcaacacaacctggcggcagcgcaaaagatg

SEQ ID NO: 227681 - DNA, 103 bp, Artificial Sequence
  Synthetic Polynucleotide
taatacgactcactataggggaaggcttcacgcatctgctccgtgttgctaacagaggagaagcaacatggagcagatgaacctggcggcagcgcaaaagatg

SEQ ID NO: 227682 - DNA, 103 bp, Artificial Sequence
  Synthetic Polynucleotide
taatacgactcactatagggaggcggtggcgaaggcttcacgcatctgctaacagaggagaagcagaatggtgaagcctaacctggcggcagcgcaaaagatg

SEQ ID NO: 227683 - DNA, 103 bp, Artificial Sequence
  Synthetic Polynucleotide
taatacgactcactatagggagcttggagaaggcggtggcgaaggcttcaaacagaggagatgaagcatgcgccaccgcaacctggcggcagcgcaaaagatg

SEQ ID NO: 227684 - DNA, 103 bp, Artificial Sequence
  Synthetic Polynucleotide
taatacgactcactatagggctcgggcttcagcttggagaaggcggtggcaacagaggagagccaccatgttctccaagaacctggcggcagcgcaaaagatg

SEQ ID NO: 227685 - DNA, 103 bp, Artificial Sequence
  Synthetic Polynucleotide
taatacgactcactataggggctgggacgactcgggcttcagcttggagaaacagaggagatctccaatgtgaagcccgaacctggcggcagcgcaaaagatg

SEQ ID NO: 227686 - DNA, 103 bp, Artificial Sequence
  Synthetic Polynucleotide
taatacgactcactataggggccaccagcttcaggtctgtctgggagctcaacagaggagagagctcatggacagacctaacctggcggcagcgcaaaagatg

SEQ ID NO: 227687 - DNA, 103 bp, Artificial Sequence
  Synthetic Polynucleotide
taatacgactcactatagggtgcccgggctgctgggacgactcgggcttcaacagaggagagaagccatggtcgtcccaaacctggcggcagcgcaaaagatg

SEQ ID NO: 227688 - DNA, 103 bp, Artificial Sequence
  Synthetic Polynucleotide
taatacgactcactatagggcagcgcgtcctgcccgggctgctgggacgaaacagaggagatcgtccatgcagcccgggaacctggcggcagcgcaaaagatg

SEQ ID NO: 227689 - DNA, 103 bp, Artificial Sequence
  Synthetic Polynucleotide
taatacgactcactatagggccttgacggccagcgcgtcctgcccgggctaacagaggagaagcccgatgaggacgcgcaacctggcggcagcgcaaaagatg

SEQ ID NO: 227690 - DNA, 103 bp, Artificial Sequence
  Synthetic Polynucleotide
taatacgactcactatagggccgtggccggccttgacggccagcgcgtccaacagaggagaggacgcatgggccgtcaaaacctggcggcagcgcaaaagatg

SEQ ID NO: 227691 - DNA, 103 bp, Artificial Sequence
  Synthetic Polynucleotide
taatacgactcactataggggctgtcgtagccgtggccggccttgacggcaacagaggagagccgtcatggccggccacaacctggcggcagcgcaaaagatg

SEQ ID NO: 227692 - DNA, 103 bp, Artificial Sequence
  Synthetic Polynucleotide
taatacgactcactataggggctgcttcttgctgtcgtagccgtggccggaacagaggagaccggccatggctacgacaaacctggcggcagcgcaaaagatg

SEQ ID NO: 227693 - DNA, 103 bp, Artificial Sequence
  Synthetic Polynucleotide
taatacgactcactataggggtcagctcctgctgcttcttgctgtcgtagaacagaggagactacgaatgcaagaagcaaacctggcggcagcgcaaaagatg

SEQ ID NO: 227694 - DNA, 103 bp, Artificial Sequence
  Synthetic Polynucleotide
taatacgactcactatagggcacggcggccgtcagctcctgctgcttcttaacagaggagaaagaagatgcaggagctgaacctggcggcagcgcaaaagatg

SEQ ID NO: 227695 - DNA, 103 bp, Artificial Sequence
  Synthetic Polynucleotide
taatacgactcactatagggtgaggcccagcacggcggccgtcagctcctaacagaggagaaggagcatgcggccgccgaacctggcggcagcgcaaaagatg

SEQ ID NO: 227696 - DNA, 103 bp, Artificial Sequence
  Synthetic Polynucleotide
taatacgactcactatagggccctcgcagatgaggcccagcacggcggccaacagaggagaggccgcatggctgggcctaacctggcggcagcgcaaaagatg

SEQ ID NO: 227697 - DNA, 103 bp, Artificial Sequence
  Synthetic Polynucleotide
taatacgactcactataggggcgggggtgggccaccagcttcaggtctgtaacagaggagaacagacatgaagctggtgaacctggcggcagcgcaaaagatg

SEQ ID NO: 227698 - DNA, 103 bp, Artificial Sequence
  Synthetic Polynucleotide
taatacgactcactatagggtgggtacagcccctcgcagatgaggcccagaacagaggagactgggcatgatctgcgagaacctggcggcagcgcaaaagatg

SEQ ID NO: 227699 - DNA, 103 bp, Artificial Sequence
  Synthetic Polynucleotide
taatacgactcactatagggcgatggaggctgggtacagcccctcgcagaaacagaggagatctgcgatgggctgtaccaacctggcggcagcgcaaaagatg

SEQ ID NO: 227700 - DNA, 103 bp, Artificial Sequence
  Synthetic Polynucleotide
taatacgactcactatagggggctcgtccacgatggaggctgggtacagcaacagaggagagctgtaatgagcctccataacctggcggcagcgcaaaagatg

SEQ ID NO: 227701 - DNA, 103 bp, Artificial Sequence
  Synthetic Polynucleotide
taatacgactcactatagggcttgaaggtgggctcgtccacgatggaggcaacagaggagagcctccatggtggacgagaacctggcggcagcgcaaaagatg

SEQ ID NO: 227702 - DNA, 103 bp, Artificial Sequence
  Synthetic Polynucleotide
taatacgactcactatagggtcagcagcaccttgaaggtgggctcgtccaaacagaggagatggacgatgccaccttcaaacctggcggcagcgcaaaagatg

SEQ ID NO: 227703 - DNA, 103 bp, Artificial Sequence
  Synthetic Polynucleotide
taatacgactcactatagggtcggccgtcttcagcagcaccttgaaggtgaacagaggagacaccttatgggtgctgctaacctggcggcagcgcaaaagatg

SEQ ID NO: 227704 - DNA, 103 bp, Artificial Sequence
  Synthetic Polynucleotide
taatacgactcactatagggataccgggggtcggccgtcttcagcagcacaacagaggagagtgctgatgaagacggccaacctggcggcagcgcaaaagatg

SEQ ID NO: 227705 - DNA, 103 bp, Artificial Sequence
  Synthetic Polynucleotide
taatacgactcactatagggtgggcagctcataccgggggtcggccgtctaacagaggagaagacggatgacccccggtaacctggcggcagcgcaaaagatg

SEQ ID NO: 227706 - DNA, 103 bp, Artificial Sequence
  Synthetic Polynucleotide
taatacgactcactatagggtacttccggctgggcagctcataccgggggaacagaggagacccccgatgtgagctgccaacctggcggcagcgcaaaagatg

SEQ ID NO: 227707 - DNA, 103 bp, Artificial Sequence
  Synthetic Polynucleotide
taatacgactcactatagggggtagagatgtacttccggctgggcagctcaacagaggagagagctgatgagccggaagaacctggcggcagcgcaaaagatg

SEQ ID NO: 227708 - DNA, 103 bp, Artificial Sequence
  Synthetic Polynucleotide
taatacgactcactatagggtgctcttggcgcgggggtgggccaccagctaacagaggagaagctggatgcccacccccaacctggcggcagcgcaaaagatg

SEQ ID NO: 227709 - DNA, 103 bp, Artificial Sequence
  Synthetic Polynucleotide
taatacgactcactatagggggatggccttggtagagatgtacttccggcaacagaggagagccggaatgacatctctaaacctggcggcagcgcaaaagatg

SEQ ID NO: 227710 - DNA, 103 bp, Artificial Sequence
  Synthetic Polynucleotide
taatacgactcactatagggtacttctcagggatggccttggtagagatgaacagaggagacatctcatgcaaggccataacctggcggcagcgcaaaagatg

SEQ ID NO: 227711 - DNA, 103 bp, Artificial Sequence
  Synthetic Polynucleotide
taatacgactcactataggggacggccccgtacttctcagggatggccttaacagaggagaaaggccatgcctgagaagaacctggcggcagcgcaaaagatg

SEQ ID NO: 227712 - DNA, 103 bp, Artificial Sequence
  Synthetic Polynucleotide
taatacgactcactatagggtcacctcccggacggccccgtacttctcagaacagaggagactgagaatgacggggccgaacctggcggcagcgcaaaagatg

SEQ ID NO: 227713 - DNA, 103 bp, Artificial Sequence
  Synthetic Polynucleotide
taatacgactcactatagggtccttcaggatcacctcccggacggccccgaacagaggagacggggcatgccgggaggtaacctggcggcagcgcaaaagatg

SEQ ID NO: 227714 - DNA, 103 bp, Artificial Sequence
  Synthetic Polynucleotide
taatacgactcactatagggctcggccagctccttcaggatcacctcccgaacagaggagacgggagatgatcctgaagaacctggcggcagcgcaaaagatg

SEQ ID NO: 227715 - DNA, 103 bp, Artificial Sequence
  Synthetic Polynucleotide
taatacgactcactatagggaccaggtggcctcggccagctccttcaggaaacagaggagatcctgaatgagctggccgaacctggcggcagcgcaaaagatg

SEQ ID NO: 227716 - DNA, 103 bp, Artificial Sequence
  Synthetic Polynucleotide
taatacgactcactataggggagatgccacaccaggtggcctcggccagcaacagaggagagctggcatgggccacctgaacctggcggcagcgcaaaagatg

SEQ ID NO: 227717 - DNA, 103 bp, Artificial Sequence
  Synthetic Polynucleotide
taatacgactcactatagggcatgtcggtggagatgccacaccaggtggcaacagaggagagccaccatgtgtggcatcaacctggcggcagcgcaaaagatg

SEQ ID NO: 227718 - DNA, 103 bp, Artificial Sequence
  Synthetic Polynucleotide
taatacgactcactatagggcactcctccacatgtcggtggagatgccacaacagaggagagtggcaatgccaccgacaaacctggcggcagcgcaaaagatg

SEQ ID NO: 227719 - DNA, 103 bp, Artificial Sequence
  Synthetic Polynucleotide
taatacgactcactatagggttccacaccttgctcttggcgcgggggtggaacagaggagaccacccatgcgccaagagaacctggcggcagcgcaaaagatg

SEQ ID NO: 227720 - DNA, 103 bp, Artificial Sequence
  Synthetic Polynucleotide
taatacgactcactatagggttctgattctcactcctccacatgtcggtgaacagaggagacaccgaatggtggaggagaacctggcggcagcgcaaaagatg

SEQ ID NO: 227721 - DNA, 103 bp, Artificial Sequence
  Synthetic Polynucleotide
taatacgactcactataggggtaggcgcggttctgattctcactcctccaaacagaggagatggaggatggagaatcagaacctggcggcagcgcaaaagatg

SEQ ID NO: 227722 - DNA, 103 bp, Artificial Sequence
  Synthetic Polynucleotide
taatacgactcactatagggccagcgtgacgtaggcgcggttctgattctaacagaggagaagaatcatgaccgcgcctaacctggcggcagcgcaaaagatg

SEQ ID NO: 227723 - DNA, 103 bp, Artificial Sequence
  Synthetic Polynucleotide
taatacgactcactatagggaagtgggcggccagcgtgacgtaggcgcggaacagaggagaccgcgcatgcgtcacgctaacctggcggcagcgcaaaagatg

SEQ ID NO: 227724 - DNA, 103 bp, Artificial Sequence
  Synthetic Polynucleotide
taatacgactcactatagggcaggcccaggaagtgggcggccagcgtgacaacagaggagagtcacgatggccgcccacaacctggcggcagcgcaaaagatg

SEQ ID NO: 227725 - DNA, 103 bp, Artificial Sequence
  Synthetic Polynucleotide
taatacgactcactatagggtgggggcgcccaggcccaggaagtgggcggaacagaggagaccgcccatgtcctgggccaacctggcggcagcgcaaaagatg

SEQ ID NO: 227726 - DNA, 103 bp, Artificial Sequence
  Synthetic Polynucleotide
taatacgactcactataggggacaggcagttgggggcgcccaggcccaggaacagaggagacctgggatggggcgccccaacctggcggcagcgcaaaagatg

SEQ ID NO: 227727 - DNA, 103 bp, Artificial Sequence
  Synthetic Polynucleotide
taatacgactcactatagggggagcccatggacaggcagttgggggcgccaacagaggagaggcgccatgaactgcctgaacctggcggcagcgcaaaagatg

SEQ ID NO: 227728 - DNA, 103 bp, Artificial Sequence
  Synthetic Polynucleotide
taatacgactcactatagggtcaggcagcgggagcccatggacaggcagtaacagaggagaactgccatgccatgggctaacctggcggcagcgcaaaagatg

SEQ ID NO: 227729 - DNA, 103 bp, Artificial Sequence
  Synthetic Polynucleotide
taatacgactcactatagggtcgaaggtcttcaggcagcgggagcccatgaacagaggagacatgggatgccgctgcctaacctggcggcagcgcaaaagatg

SEQ ID NO: 227730 - DNA, 103 bp, Artificial Sequence
  Synthetic Polynucleotide
taatacgactcactataggggccgaaatacttccacaccttgctcttggcaacagaggagagccaagatgaaggtgtggaacctggcggcagcgcaaaagatg

SEQ ID NO: 227731 - DNA, 103 bp, Artificial Sequence
  Synthetic Polynucleotide
taatacgactcactatagggttcgggcacctcgaaggtcttcaggcagcgaacagaggagacgctgcatgaagaccttcaacctggcggcagcgcaaaagatg

SEQ ID NO: 227732 - DNA, 103 bp, Artificial Sequence
  Synthetic Polynucleotide
taatacgactcactatagggccgtgttctcttcgggcacctcgaaggtctaacagaggagaagacctatgaggtgcccgaacctggcggcagcgcaaaagatg

SEQ ID NO: 227733 - DNA, 103 bp, Artificial Sequence
  Synthetic Polynucleotide
taatacgactcactatagggatggtctccgccgtgttctcttcgggcaccaacagaggagaggtgccatgagagaacacaacctggcggcagcgcaaaagatg

SEQ ID NO: 227734 - DNA, 103 bp, Artificial Sequence
  Synthetic Polynucleotide
taatacgactcactatagggcactcgcgtgatggtctccgccgtgttctcaacagaggagagagaacatggcggagaccaacctggcggcagcgcaaaagatg

SEQ ID NO: 227735 - DNA, 103 bp, Artificial Sequence
  Synthetic Polynucleotide
taatacgactcactatagggcctcatagagcactcgcgtgatggtctccgaacagaggagacggagaatgtcacgcgagaacctggcggcagcgcaaaagatg

SEQ ID NO: 227736 - DNA, 103 bp, Artificial Sequence
  Synthetic Polynucleotide
taatacgactcactatagggtcgatgaagacctcatagagcactcgcgtgaacagaggagacacgcgatggctctatgaaacctggcggcagcgcaaaagatg

SEQ ID NO: 227737 - DNA, 103 bp, Artificial Sequence
  Synthetic Polynucleotide
taatacgactcactataggggatgccccactcgatgaagacctcatagagaacagaggagactctatatggtcttcatcaacctggcggcagcgcaaaagatg

SEQ ID NO: 227738 - DNA, 103 bp, Artificial Sequence
  Synthetic Polynucleotide
taatacgactcactatagggccttggcgctgatgccccactcgatgaagaaacagaggagatcttcaatgagtggggcaaacctggcggcagcgcaaaagatg

SEQ ID NO: 227739 - DNA, 103 bp, Artificial Sequence
  Synthetic Polynucleotide
taatacgactcactataggggccccgaagaccttggcgctgatgccccacaacagaggagagtggggatgcagcgccaaaacctggcggcagcgcaaaagatg

SEQ ID NO: 227740 - DNA, 103 bp, Artificial Sequence
  Synthetic Polynucleotide
taatacgactcactataggggttggtggtggccccgaagaccttggcgctaacagaggagaagcgccatggtcttcgggaacctggcggcagcgcaaaagatg

SEQ ID NO: 227741 - DNA, 103 bp, Artificial Sequence
  Synthetic Polynucleotide
taatacgactcactatagggtggtgtcgaagccgaaatacttccacacctaacagaggagaaggtgtatgagtatttcgaacctggcggcagcgcaaaagatg

SEQ ID NO: 227742 - DNA, 103 bp, Artificial Sequence
  Synthetic Polynucleotide
taatacgactcactatagggccttgccatagttggtggtggccccgaagaaacagaggagatcttcgatgccaccaccaaacctggcggcagcgcaaaagatg

SEQ ID NO: 227743 - DNA, 103 bp, Artificial Sequence
  Synthetic Polynucleotide
taatacgactcactatagggttcacgatgtccttgccatagttggtggtgaacagaggagacaccacatgctatggcaaaacctggcggcagcgcaaaagatg

SEQ ID NO: 227744 - DNA, 103 bp, Artificial Sequence
  Synthetic Polynucleotide
taatacgactcactatagggggagcacgccttcacgatgtccttgccataaacagaggagatatggcatggacatcgtgaacctggcggcagcgcaaaagatg

SEQ ID NO: 227745 - DNA, 103 bp, Artificial Sequence
  Synthetic Polynucleotide
taatacgactcactatagggcgtccagcagggagcacgccttcacgatgtaacagaggagaacatcgatgaggcgtgctaacctggcggcagcgcaaaagatg

SEQ ID NO: 227746 - DNA, 103 bp, Artificial Sequence
  Synthetic Polynucleotide
taatacgactcactatagggtgcactgcgacgtccagcagggagcacgccaacagaggagaggcgtgatgcctgctggaaacctggcggcagcgcaaaagatg

SEQ ID NO: 227747 - DNA, 103 bp, Artificial Sequence
  Synthetic Polynucleotide
taatacgactcactataggggcagggcatgtgcactgcgacgtccagcagaacagaggagactgctgatggtcgcagtgaacctggcggcagcgcaaaagatg

SEQ ID NO: 227748 - DNA, 103 bp, Artificial Sequence
  Synthetic Polynucleotide
taatacgactcactatagggtgtggcccaggcagggcatgtgcactgcgaaacagaggagatcgcagatgacatgccctaacctggcggcagcgcaaaagatg

SEQ ID NO: 227749 - DNA, 103 bp, Artificial Sequence
  Synthetic Polynucleotide
taatacgactcactataggggcattgaaggtgtggcccaggcagggcatgaacagaggagacatgccatgcctgggccaaacctggcggcagcgcaaaagatg

SEQ ID NO: 227750 - DNA, 103 bp, Artificial Sequence
  Synthetic Polynucleotide
taatacgactcactatagggctggatgccggcattgaaggtgtggcccagaacagaggagactgggcatgaccttcaataacctggcggcagcgcaaaagatg

SEQ ID NO: 227751 - DNA, 103 bp, Artificial Sequence
  Synthetic Polynucleotide
taatacgactcactatagggggaaggcctgctggatgccggcattgaaggaacagaggagaccttcaatgccggcatccaacctggcggcagcgcaaaagatg

SEQ ID NO: 227752 - DNA, 103 bp, Artificial Sequence
  Synthetic Polynucleotide
taatacgactcactatagggccctcggcgttggtgtcgaagccgaaatacaacagaggagagtatttatgcttcgacacaacctggcggcagcgcaaaagatg

SEQ ID NO: 227753 - DNA, 103 bp, Artificial Sequence
  Synthetic Polynucleotide
taatacgactcactatagggttcgggagctggaaggcctgctggatgccgaacagaggagacggcatatggcaggccttaacctggcggcagcgcaaaagatg

SEQ ID NO: 227754 - DNA, 103 bp, Artificial Sequence
  Synthetic Polynucleotide
taatacgactcactatagggcgcccccagcttcgggagctggaaggcctgaacagaggagacaggccatgcagctcccgaacctggcggcagcgcaaaagatg

SEQ ID NO: 227755 - DNA, 103 bp, Artificial Sequence
  Synthetic Polynucleotide
taatacgactcactataggggcgacagcagcgcccccagcttcgggagctaacagaggagaagctccatgagctgggggaacctggcggcagcgcaaaagatg

SEQ ID NO: 227756 - DNA, 103 bp, Artificial Sequence
  Synthetic Polynucleotide
taatacgactcactatagggttgcggcagcgcgacagcagcgcccccagcaacagaggagagctgggatggctgctgtcaacctggcggcagcgcaaaagatg

SEQ ID NO: 227757 - DNA, 103 bp, Artificial Sequence
  Synthetic Polynucleotide
taatacgactcactatagggctccaccagtttgcggcagcgcgacagcagaacagaggagactgctgatgcgctgccgcaacctggcggcagcgcaaaagatg

SEQ ID NO: 227758 - DNA, 103 bp, Artificial Sequence
  Synthetic Polynucleotide
taatacgactcactataggggctggaagtactccaccagtttgcggcagcaacagaggagagctgccatgaactggtggaacctggcggcagcgcaaaagatg

SEQ ID NO: 227759 - DNA, 103 bp, Artificial Sequence
  Synthetic Polynucleotide
taatacgactcactatagggacggcagactgctggaagtactccaccagtaacagaggagaactggtatggtacttccaaacctggcggcagcgcaaaagatg

SEQ ID NO: 227760 - DNA, 103 bp, Artificial Sequence
  Synthetic Polynucleotide
taatacgactcactataggggtacatggccacggcagactgctggaagtaaacagaggagatacttcatgcagtctgccaacctggcggcagcgcaaaagatg

SEQ ID NO: 227761 - DNA, 103 bp, Artificial Sequence
  Synthetic Polynucleotide
taatacgactcactatagggcatagagcatgtacatggccacggcagactaacagaggagaagtctgatgtggccatgtaacctggcggcagcgcaaaagatg

SEQ ID NO: 227762 - DNA, 103 bp, Artificial Sequence
  Synthetic Polynucleotide
taatacgactcactatagggttctgcttctcatagagcatgtacatggccaacagaggagaggccatatgcatgctctaaacctggcggcagcgcaaaagatg

SEQ ID NO: 227763 - DNA, 103 bp, Artificial Sequence
  Synthetic Polynucleotide
taatacgactcactatagggggtttcagacatactgatgaaaaactccataacagaggagaatggagatgttcatcagtaacctggcggcagcgcaaaagatg

SEQ ID NO: 227764 - DNA, 103 bp, Artificial Sequence
  Synthetic Polynucleotide
taatacgactcactatagggaatagcaatatcacaaaattctccttccagaacagaggagactggaaatggaattttgtaacctggcggcagcgcaaaagatg

SEQ ID NO: 227765 - DNA, 103 bp, Artificial Sequence
  Synthetic Polynucleotide
taatacgactcactatagggttttccacacacctcacagctatagggcttaacagaggagaaagcccatgagctgtgagaacctggcggcagcgcaaaagatg

SEQ ID NO: 227766 - DNA, 103 bp, Artificial Sequence
  Synthetic Polynucleotide
taatacgactcactatagggggataaatgattttccacacacctcacagcaacagaggagagctgtgatgtgtgtggaaaacctggcggcagcgcaaaagatg

SEQ ID NO: 227767 - DNA, 103 bp, Artificial Sequence
  Synthetic Polynucleotide
taatacgactcactatagggtctggggcacggataaatgattttccacacaacagaggagagtgtggatgatcatttataacctggcggcagcgcaaaagatg

SEQ ID NO: 227768 - DNA, 103 bp, Artificial Sequence
  Synthetic Polynucleotide
taatacgactcactatagggcttctttaagtctggggcacggataaatgaaacagaggagatcatttatgcgtgccccaaacctggcggcagcgcaaaagatg

SEQ ID NO: 227769 - DNA, 103 bp, Artificial Sequence
  Synthetic Polynucleotide
taatacgactcactatagggctctctcatgcttctttaagtctggggcacaacagaggagagtgcccatgacttaaagaaacctggcggcagcgcaaaagatg

SEQ ID NO: 227770 - DNA, 103 bp, Artificial Sequence
  Synthetic Polynucleotide
taatacgactcactatagggttactgtgaactctctcatgcttctttaagaacagaggagacttaaaatggcatgagagaacctggcggcagcgcaaaagatg

SEQ ID NO: 227771 - DNA, 103 bp, Artificial Sequence
  Synthetic Polynucleotide
taatacgactcactatagggcggtctttcattactgtgaactctctcatgaacagaggagacatgagatggttcacagtaacctggcggcagcgcaaaagatg

SEQ ID NO: 227772 - DNA, 103 bp, Artificial Sequence
  Synthetic Polynucleotide
taatacgactcactatagggggcacgcaaacggtctttcattactgtgaaaacagaggagattcacaatgatgaaagacaacctggcggcagcgcaaaagatg

SEQ ID NO: 227773 - DNA, 103 bp, Artificial Sequence
  Synthetic Polynucleotide
taatacgactcactatagggtcacacatgtggcacgcaaacggtctttcaaacagaggagatgaaagatggtttgcgtgaacctggcggcagcgcaaaagatg

SEQ ID NO: 227774 - DNA, 103 bp, Artificial Sequence
  Synthetic Polynucleotide
taatacgactcactataggggaaggctttgtcacacatgtggcacgcaaaaacagaggagatttgcgatgcacatgtgtaacctggcggcagcgcaaaagatg

SEQ ID NO: 227775 - DNA, 103 bp, Artificial Sequence
  Synthetic Polynucleotide
taatacgactcactatagggcctcaaccacaatagcaatatcacaaaattaacagaggagaaattttatgatattgctaaacctggcggcagcgcaaaagatg

SEQ ID NO: 227776 - DNA, 103 bp, Artificial Sequence
  Synthetic Polynucleotide
taatacgactcactatagggacttgtgtttgaaggctttgtcacacatgtaacagaggagaacatgtatgacaaagcctaacctggcggcagcgcaaaagatg

SEQ ID NO: 227777 - DNA, 103 bp, Artificial Sequence
  Synthetic Polynucleotide
taatacgactcactatagggttgaggtgagacttgtgtttgaaggctttgaacagaggagacaaagcatgcaaacacaaaacctggcggcagcgcaaaagatg

SEQ ID NO: 227778 - DNA, 103 bp, Artificial Sequence
  Synthetic Polynucleotide
taatacgactcactatagggttcatgatccttgaggtgagacttgtgtttaacagaggagaaaacacatgtctcacctcaacctggcggcagcgcaaaagatg

SEQ ID NO: 227779 - DNA, 103 bp, Artificial Sequence
  Synthetic Polynucleotide
taatacgactcactatagggtgtgtcttctttcatgatccttgaggtgagaacagaggagactcaccatgaggatcatgaacctggcggcagcgcaaaagatg

SEQ ID NO: 227780 - DNA, 103 bp, Artificial Sequence
  Synthetic Polynucleotide
taatacgactcactatagggttttcccctctgtgtcttctttcatgatccaacagaggagaggatcaatgaagaagacaaacctggcggcagcgcaaaagatg

SEQ ID NO: 227781 - DNA, 103 bp, Artificial Sequence
  Synthetic Polynucleotide
taatacgactcactatagggcacaaaaggcttttcccctctgtgtcttctaacagaggagaagaagaatgagaggggaaaacctggcggcagcgcaaaagatg

SEQ ID NO: 227782 - DNA, 103 bp, Artificial Sequence
  Synthetic Polynucleotide
taatacgactcactatagggaggagccacacacaaaaggcttttcccctcaacagaggagagaggggatgagccttttgaacctggcggcagcgcaaaagatg

SEQ ID NO: 227783 - DNA, 103 bp, Artificial Sequence
  Synthetic Polynucleotide
taatacgactcactataggggccttggtgcaggagccacacacaaaaggcaacagaggagagcctttatggtgtggctcaacctggcggcagcgcaaaagatg

SEQ ID NO: 227784 - DNA, 103 bp, Artificial Sequence
  Synthetic Polynucleotide
taatacgactcactatagggcttggcaaatgccttggtgcaggagccacaaacagaggagatgtggcatgtgcaccaagaacctggcggcagcgcaaaagatg

SEQ ID NO: 227785 - DNA, 103 bp, Artificial Sequence
  Synthetic Polynucleotide
taatacgactcactataggggatcagatgccttggcaaatgccttggtgcaacagaggagagcaccaatgcatttgccaaacctggcggcagcgcaaaagatg

SEQ ID NO: 227786 - DNA, 103 bp, Artificial Sequence
  Synthetic Polynucleotide
taatacgactcactatagggaatttcacatcctcaaccacaatagcaataaacagaggagatattgcatgtgtggttgaaacctggcggcagcgcaaaagatg

SEQ ID NO: 227787 - DNA, 103 bp, Artificial Sequence
  Synthetic Polynucleotide
taatacgactcactatagggtgccttttcagatcagatgccttggcaaataacagaggagaatttgcatgggcatctgaaacctggcggcagcgcaaaagatg

SEQ ID NO: 227788 - DNA, 103 bp, Artificial Sequence
  Synthetic Polynucleotide
taatacgactcactatagggattgttctcgtgccttttcagatcagatgcaacagaggagagcatctatgctgaaaaggaacctggcggcagcgcaaaagatg

SEQ ID NO: 227789 - DNA, 103 bp, Artificial Sequence
  Synthetic Polynucleotide
taatacgactcactatagggcactgtgcatattgttctcgtgccttttcaaacagaggagatgaaaaatgacgagaacaaacctggcggcagcgcaaaagatg

SEQ ID NO: 227790 - DNA, 103 bp, Artificial Sequence
  Synthetic Polynucleotide
taatacgactcactatagggtgcttcctttcactgtgcatattgttctcgaacagaggagacgagaaatgtatgcacagaacctggcggcagcgcaaaagatg

SEQ ID NO: 227791 - DNA, 103 bp, Artificial Sequence
  Synthetic Polynucleotide
taatacgactcactataggggggggtaacctgcttcctttcactgtgcataacagaggagaatgcacatggaaaggaagaacctggcggcagcgcaaaagatg

SEQ ID NO: 227792 - DNA, 103 bp, Artificial Sequence
  Synthetic Polynucleotide
taatacgactcactatagggggatggcactgggggtaacctgcttcctttaacagaggagaaaaggaatgaggttacccaacctggcggcagcgcaaaagatg

SEQ ID NO: 227793 - DNA, 103 bp, Artificial Sequence
  Synthetic Polynucleotide
taatacgactcactataggggtctcgctctggatggcactgggggtaaccaacagaggagaggttacatgcagtgccataacctggcggcagcgcaaaagatg

SEQ ID NO: 227794 - DNA, 103 bp, Artificial Sequence
  Synthetic Polynucleotide
taatacgactcactatagggcaactgttctgtctcgctctggatggcactaacagaggagaagtgccatgcagagcgagaacctggcggcagcgcaaaagatg

SEQ ID NO: 227795 - DNA, 103 bp, Artificial Sequence
  Synthetic Polynucleotide
taatacgactcactatagggctgccgcctgcaactgttctgtctcgctctaacagaggagaagagcgatgcagaacagtaacctggcggcagcgcaaaagatg

SEQ ID NO: 227796 - DNA, 103 bp, Artificial Sequence
  Synthetic Polynucleotide
taatacgactcactataggggcagccatcgctgccgcctgcaactgttctaacagaggagaagaacaatggcaggcggcaacctggcggcagcgcaaaagatg

SEQ ID NO: 227797 - DNA, 103 bp, Artificial Sequence
  Synthetic Polynucleotide
taatacgactcactataggggtgtgctctgaatttcacatcctcaaccacaacagaggagagtggttatggatgtgaaaaacctggcggcagcgcaaaagatg

SEQ ID NO: 227798 - DNA, 103 bp, Artificial Sequence
  Synthetic Polynucleotide
taatacgactcactatagggttctgcttccgcagccatcgctgccgcctgaacagaggagacaggcgatggcgatggctaacctggcggcagcgcaaaagatg

SEQ ID NO: 227799 - DNA, 103 bp, Artificial Sequence
  Synthetic Polynucleotide
taatacgactcactatagggccagctgctgttctgcttccgcagccatcgaacagaggagacgatggatgcggaagcagaacctggcggcagcgcaaaagatg

SEQ ID NO: 227800 - DNA, 103 bp, Artificial Sequence
  Synthetic Polynucleotide
taatacgactcactataggggctatcgtctccagctgctgttctgcttccaacagaggagaggaagcatgacagcagctaacctggcggcagcgcaaaagatg

SEQ ID NO: 227801 - DNA, 103 bp, Artificial Sequence
  Synthetic Polynucleotide
taatacgactcactatagggctagctacaggctatcgtctccagctgctgaacagaggagacagcagatggagacgataaacctggcggcagcgcaaaagatg

SEQ ID NO: 227802 - DNA, 103 bp, Artificial Sequence
  Synthetic Polynucleotide
taatacgactcactataggggaacacatctgtgtgctctgaatttcacataacagaggagaatgtgaatgtcagagcacaacctggcggcagcgcaaaagatg

SEQ ID NO: 227803 - DNA, 103 bp, Artificial Sequence
  Synthetic Polynucleotide
taatacgactcactatagggcaggcagcaagaacacatctgtgtgctctgaacagaggagacagagcatgcagatgtgtaacctggcggcagcgcaaaagatg

SEQ ID NO: 227804 - DNA, 103 bp, Artificial Sequence
  Synthetic Polynucleotide
taatacgactcactataggggtaagtgctgcaggcagcaagaacacatctaacagaggagaagatgtatgcttgctgccaacctggcggcagcgcaaaagatg

SEQ ID NO: 227805 - DNA, 103 bp, Artificial Sequence
  Synthetic Polynucleotide
taatacgactcactataggggctttttaaagtaagtgctgcaggcagcaaaacagaggagattgctgatggcagcacttaacctggcggcagcgcaaaagatg

SEQ ID NO: 227806 - DNA, 103 bp, Artificial Sequence
  Synthetic Polynucleotide
taatacgactcactatagggttcttgaaaagctttttaaagtaagtgctgaacagaggagacagcacatgctttaaaaaaacctggcggcagcgcaaaagatg

SEQ ID NO: 227807 - DNA, 103 bp, Artificial Sequence
  Synthetic Polynucleotide
taatacgactcactatagggaacctcaagcttcttgaaaagctttttaaaaacagaggagatttaaaatgcttttcaagaacctggcggcagcgcaaaagatg

SEQ ID NO: 227808 - DNA, 103 bp, Artificial Sequence
  Synthetic Polynucleotide
taatacgactcactatagggtatatttaatggtttcagacatactgatgaaacagaggagatcatcaatgtgtctgaaaaacctggcggcagcgcaaaagatg

SEQ ID NO: 227809 - DNA, 103 bp, Artificial Sequence
  Synthetic Polynucleotide
taatacgactcactatagggaagaactatcaacctcaagcttcttgaaaaaacagaggagattttcaatgagcttgaggaacctggcggcagcgcaaaagatg

SEQ ID NO: 227810 - DNA, 103 bp, Artificial Sequence
  Synthetic Polynucleotide
taatacgactcactatagggtctatgaccgaagaactatcaacctcaagcaacagaggagagcttgaatgtgatagttcaacctggcggcagcgcaaaagatg

SEQ ID NO: 227811 - DNA, 103 bp, Artificial Sequence
  Synthetic Polynucleotide
taatacgactcactatagggaaaatctatttctatgaccgaagaactatcaacagaggagagatagtatgtcggtcataaacctggcggcagcgcaaaagatg

SEQ ID NO: 227812 - DNA, 103 bp, Artificial Sequence
  Synthetic Polynucleotide
taatacgactcactatagggcagaacgaagaaaatctatttctatgaccgaacagaggagacggtcaatgaaatagattaacctggcggcagcgcaaaagatg

SEQ ID NO: 227813 - DNA, 103 bp, Artificial Sequence
  Synthetic Polynucleotide
taatacgactcactatagggtcaaatatatcagaacgaagaaaatctattaacagaggagaaatagaatgtcttcgttcaacctggcggcagcgcaaaagatg

SEQ ID NO: 227814 - DNA, 103 bp, Artificial Sequence
  Synthetic Polynucleotide
taatacgactcactatagggcaggacctcttcaaatatatcagaacgaagaacagaggagacttcgtatggatatatttaacctggcggcagcgcaaaagatg

SEQ ID NO: 227815 - DNA, 103 bp, Artificial Sequence
  Synthetic Polynucleotide
taatacgactcactatagggacatgtagttcaggacctcttcaaatatataacagaggagaatatatatgaagaggtccaacctggcggcagcgcaaaagatg

SEQ ID NO: 227816 - DNA, 103 bp, Artificial Sequence
  Synthetic Polynucleotide
taatacgactcactatagggtttgctgtgtacatgtagttcaggacctctaacagaggagaagaggtatggaactacataacctggcggcagcgcaaaagatg

SEQ ID NO: 227817 - DNA, 103 bp, Artificial Sequence
  Synthetic Polynucleotide
taatacgactcactatagggcacggaaatctttgctgtgtacatgtagttaacagaggagaaactacatgtacacagcaaacctggcggcagcgcaaaagatg

SEQ ID NO: 227818 - DNA, 103 bp, Artificial Sequence
  Synthetic Polynucleotide
taatacgactcactatagggcttcttttttcacggaaatctttgctgtgtaacagaggagaacacagatgagatttccgaacctggcggcagcgcaaaagatg

SEQ ID NO: 227819 - DNA, 103 bp, Artificial Sequence
  Synthetic Polynucleotide
taatacgactcactatagggtcatcgtcattatatttaatggtttcagacaacagaggagagtctgaatgcattaaataaacctggcggcagcgcaaaagatg

SEQ ID NO: 227820 - DNA, 103 bp, Artificial Sequence
  Synthetic Polynucleotide
taatacgactcactatagggaagttaacatcttcttttttcacggaaatcaacagaggagagatttcatggaaaaaagaaacctggcggcagcgcaaaagatg

SEQ ID NO: 227821 - DNA, 103 bp, Artificial Sequence
  Synthetic Polynucleotide
taatacgactcactatagggtgacatcattaagttaacatcttcttttttaacagaggagaaaaaaaatggatgttaacaacctggcggcagcgcaaaagatg

SEQ ID NO: 227822 - DNA, 103 bp, Artificial Sequence
  Synthetic Polynucleotide
taatacgactcactatagggtctgacccgatgacatcattaagttaacataacagaggagaatgttaatgtaatgatgtaacctggcggcagcgcaaaagatg

SEQ ID NO: 227823 - DNA, 103 bp, Artificial Sequence
  Synthetic Polynucleotide
taatacgactcactatagggataccaagaatctgacccgatgacatcattaacagaggagaaatgatatgatcgggtcaaacctggcggcagcgcaaaagatg

SEQ ID NO: 227824 - DNA, 103 bp, Artificial Sequence
  Synthetic Polynucleotide
taatacgactcactatagggcaaaaatcggataccaagaatctgacccgaaacagaggagatcgggtatgattcttggtaacctggcggcagcgcaaaagatg

SEQ ID NO: 227825 - DNA, 103 bp, Artificial Sequence
  Synthetic Polynucleotide
taatacgactcactatagggacagtttatccaaaaatcggataccaagaaaacagaggagattcttgatgtccgattttaacctggcggcagcgcaaaagatg

SEQ ID NO: 227826 - DNA, 103 bp, Artificial Sequence
  Synthetic Polynucleotide
taatacgactcactatagggttctgagaacacagtttatccaaaaatcggaacagaggagaccgattatgggataaactaacctggcggcagcgcaaaagatg

SEQ ID NO: 227827 - DNA, 103 bp, Artificial Sequence
  Synthetic Polynucleotide
taatacgactcactatagggcacatcacgcttctgagaacacagtttatcaacagaggagagataaaatgtgttctcagaacctggcggcagcgcaaaagatg

SEQ ID NO: 227828 - DNA, 103 bp, Artificial Sequence
  Synthetic Polynucleotide
taatacgactcactatagggcgggactggacacatcacgcttctgagaacaacagaggagagttctcatgagcgtgatgaacctggcggcagcgcaaaagatg

SEQ ID NO: 227829 - DNA, 103 bp, Artificial Sequence
  Synthetic Polynucleotide
taatacgactcactatagggttgttttcatcgggactggacacatcacgcaacagaggagagcgtgaatggtccagtccaacctggcggcagcgcaaaagatg

SEQ ID NO: 227830 - DNA, 103 bp, Artificial Sequence
  Synthetic Polynucleotide
taatacgactcactatagggagttttatgatcatcgtcattatatttaataacagaggagaattaaaatgaatgacgataacctggcggcagcgcaaaagatg

SEQ ID NO: 227831 - DNA, 103 bp, Artificial Sequence
  Synthetic Polynucleotide
taatacgactcactatagggggactgaccattgttttcatcgggactggaaacagaggagatccagtatggatgaaaacaacctggcggcagcgcaaaagatg

SEQ ID NO: 227832 - DNA, 103 bp, Artificial Sequence
  Synthetic Polynucleotide
taatacgactcactatagggacttacttttggactgaccattgttttcataacagaggagaatgaaaatgatggtcagtaacctggcggcagcgcaaaagatg

SEQ ID NO: 227833 - DNA, 103 bp, Artificial Sequence
  Synthetic Polynucleotide
taatacgactcactatagggttaaggcaatacttacttttggactgaccaaacagaggagatggtcaatgcaaaagtaaaacctggcggcagcgcaaaagatg

SEQ ID NO: 227834 - DNA, 103 bp, Artificial Sequence
  Synthetic Polynucleotide
taatacgactcactataggggcgatttattttaaggcaatacttacttttaacagaggagaaaaagtatgtattgccttaacctggcggcagcgcaaaagatg

SEQ ID NO: 227835 - DNA, 103 bp, Artificial Sequence
  Synthetic Polynucleotide
taatacgactcactatagggctccaatggggcgatttattttaaggcaataacagaggagaattgccatgaaataaatcaacctggcggcagcgcaaaagatg

SEQ ID NO: 227836 - DNA, 103 bp, Artificial Sequence
  Synthetic Polynucleotide
taatacgactcactatagggtcagcagcatctccaatggggcgatttattaacagaggagaaataaaatgccccattggaacctggcggcagcgcaaaagatg

SEQ ID NO: 227837 - DNA, 103 bp, Artificial Sequence
  Synthetic Polynucleotide
taatacgactcactatagggatcctgggtgtcagcagcatctccaatgggaacagaggagacccattatggatgctgctaacctggcggcagcgcaaaagatg

SEQ ID NO: 227838 - DNA, 103 bp, Artificial Sequence
  Synthetic Polynucleotide
taatacgactcactatagggctacatcatcatcctgggtgtcagcagcataacagaggagaatgctgatgacacccaggaacctggcggcagcgcaaaagatg

SEQ ID NO: 227839 - DNA, 103 bp, Artificial Sequence
  Synthetic Polynucleotide
taatacgactcactatagggccgatttcctctacatcatcatcctgggtgaacagaggagacacccaatgtgatgatgtaacctggcggcagcgcaaaagatg

SEQ ID NO: 227840 - DNA, 103 bp, Artificial Sequence
  Synthetic Polynucleotide
taatacgactcactatagggatcctgatccccgatttcctctacatcatcaacagaggagagatgatatggaggaaatcaacctggcggcagcgcaaaagatg

SEQ ID NO: 227841 - DNA, 103 bp, Artificial Sequence
  Synthetic Polynucleotide
taatacgactcactatagggtcagaaacagagttttatgatcatcgtcataacagaggagaatgacgatgatcataaaaaacctggcggcagcgcaaaagatg

SEQ ID NO: 227842 - DNA, 103 bp, Artificial Sequence
  Synthetic Polynucleotide
taatacgactcactatagggaaggactgtcatcctgatccccgatttcctaacagaggagaaggaaaatggggatcaggaacctggcggcagcgcaaaagatg

SEQ ID NO: 227843 - DNA, 103 bp, Artificial Sequence
  Synthetic Polynucleotide
taatacgactcactataggggtgtcatcagaaggactgtcatcctgatccaacagaggagaggatcaatgtgacagtccaacctggcggcagcgcaaaagatg

SEQ ID NO: 227844 - DNA, 103 bp, Artificial Sequence
  Synthetic Polynucleotide
taatacgactcactataggggccttctactgtgtcatcagaaggactgtcaacagaggagagacagtatgtctgatgacaacctggcggcagcgcaaaagatg

SEQ ID NO: 227845 - DNA, 103 bp, Artificial Sequence
  Synthetic Polynucleotide
taatacgactcactatagggtcgggggtgtgccttctactgtgtcatcagaacagaggagactgatgatgcagtagaagaacctggcggcagcgcaaaagatg

SEQ ID NO: 227846 - DNA, 103 bp, Artificial Sequence
  Synthetic Polynucleotide
taatacgactcactatagggtcctcctgactcgggggtgtgccttctactaacagaggagaagtagaatgcacacccccaacctggcggcagcgcaaaagatg

SEQ ID NO: 227847 - DNA, 103 bp, Artificial Sequence
  Synthetic Polynucleotide
taatacgactcactatagggcgacttgccgtcctcctgactcgggggtgtaacagaggagaacacccatgagtcaggagaacctggcggcagcgcaaaagatg

SEQ ID NO: 227848 - DNA, 103 bp, Artificial Sequence
  Synthetic Polynucleotide
taatacgactcactatagggttgtggtgggcgacttgccgtcctcctgacaacagaggagagtcaggatgacggcaagtaacctggcggcagcgcaaaagatg

SEQ ID NO: 227849 - DNA, 103 bp, Artificial Sequence
  Synthetic Polynucleotide
taatacgactcactatagggaccctgagcgttgtggtgggcgacttgccgaacagaggagacggcaaatggcccaccacaacctggcggcagcgcaaaagatg

SEQ ID NO: 227850 - DNA, 103 bp, Artificial Sequence
  Synthetic Polynucleotide
taatacgactcactatagggcgcttcctgaaccctgagcgttgtggtgggaacagaggagacccaccatgacgctcaggaacctggcggcagcgcaaaagatg

SEQ ID NO: 227851 - DNA, 103 bp, Artificial Sequence
  Synthetic Polynucleotide
taatacgactcactatagggctttcaggatcgcttcctgaaccctgagcgaacagaggagacgctcaatgttcaggaagaacctggcggcagcgcaaaagatg

SEQ ID NO: 227852 - DNA, 103 bp, Artificial Sequence
  Synthetic Polynucleotide
taatacgactcactatagggtttagtgttttcagaaacagagttttatgaaacagaggagatcataaatgtctgtttctaacctggcggcagcgcaaaagatg

SEQ ID NO: 227853 - DNA, 103 bp, Artificial Sequence
  Synthetic Polynucleotide
taatacgactcactatagggctccccagctctttcaggatcgcttcctgaaacagaggagatcaggaatggatcctgaaaacctggcggcagcgcaaaagatg

SEQ ID NO: 227854 - DNA, 103 bp, Artificial Sequence
  Synthetic Polynucleotide
taatacgactcactatagggaacttcctcactccccagctctttcaggataacagaggagaatcctgatggagctggggaacctggcggcagcgcaaaagatg

SEQ ID NO: 227855 - DNA, 103 bp, Artificial Sequence
  Synthetic Polynucleotide
taatacgactcactatagggtgaccttccgaacttcctcactccccagctaacagaggagaagctggatggtgaggaagaacctggcggcagcgcaaaagatg

SEQ ID NO: 227856 - DNA, 103 bp, Artificial Sequence
  Synthetic Polynucleotide
taatacgactcactatagggccgtagcaattgaccttccgaacttcctcaaacagaggagatgaggaatgtcggaaggtaacctggcggcagcgcaaaagatg

SEQ ID NO: 227857 - DNA, 103 bp, Artificial Sequence
  Synthetic Polynucleotide
taatacgactcactatagggtacttcctggccgtagcaattgaccttccgaacagaggagacggaagatgaattgctacaacctggcggcagcgcaaaagatg

SEQ ID NO: 227858 - DNA, 103 bp, Artificial Sequence
  Synthetic Polynucleotide
taatacgactcactatagggccatggattctacttcctggccgtagcaataacagaggagaattgctatggccaggaagaacctggcggcagcgcaaaagatg

SEQ ID NO: 227859 - DNA, 103 bp, Artificial Sequence
  Synthetic Polynucleotide
taatacgactcactatagggtctggggtctccatggattctacttcctggaacagaggagaccaggaatgagaatccataacctggcggcagcgcaaaagatg

SEQ ID NO: 227860 - DNA, 103 bp, Artificial Sequence
  Synthetic Polynucleotide
taatacgactcactataggggtcttttgattctggggtctccatggattcaacagaggagagaatccatggagaccccaaacctggcggcagcgcaaaagatg

SEQ ID NO: 227861 - DNA, 103 bp, Artificial Sequence
  Synthetic Polynucleotide
taatacgactcactataggggggaccccaagtcttttgattctggggtctaacagaggagaagacccatgaatcaaaagaacctggcggcagcgcaaaagatg

SEQ ID NO: 227862 - DNA, 103 bp, Artificial Sequence
  Synthetic Polynucleotide
taatacgactcactatagggtgaggggtctgggaccccaagtcttttgataacagaggagaatcaaaatgcttggggtcaacctggcggcagcgcaaaagatg

SEQ ID NO: 227863 - DNA, 103 bp, Artificial Sequence
  Synthetic Polynucleotide
taatacgactcactataggggcgttgttcatttagtgttttcagaaacagaacagaggagactgtttatgaaaacactaaacctggcggcagcgcaaaagatg

SEQ ID NO: 227864 - DNA, 103 bp, Artificial Sequence
  Synthetic Polynucleotide
taatacgactcactatagggtgttaaggcttgaggggtctgggaccccaaaacagaggagattggggatgcagacccctaacctggcggcagcgcaaaagatg

SEQ ID NO: 227865 - DNA, 103 bp, Artificial Sequence
  Synthetic Polynucleotide
taatacgactcactatagggcatcattaaatgttaaggcttgaggggtctaacagaggagaagacccatgaagccttaaaacctggcggcagcgcaaaagatg

SEQ ID NO: 227866 - DNA, 103 bp, Artificial Sequence
  Synthetic Polynucleotide
taatacgactcactatagggtcactcatcccatcattaaatgttaaggctaacagaggagaagccttatgatttaatgaaacctggcggcagcgcaaaagatg

SEQ ID NO: 227867 - DNA, 103 bp, Artificial Sequence
  Synthetic Polynucleotide
taatacgactcactatagggatctttcacttcactcatcccatcattaaaaacagaggagatttaatatggggatgagtaacctggcggcagcgcaaaagatg

SEQ ID NO: 227868 - DNA, 103 bp, Artificial Sequence
  Synthetic Polynucleotide
taatacgactcactataggggtgtctgttcatctttcacttcactcatccaacagaggagaggatgaatgaagtgaaagaacctggcggcagcgcaaaagatg

SEQ ID NO: 227869 - DNA, 103 bp, Artificial Sequence
  Synthetic Polynucleotide
taatacgactcactataggggtccagcctggtgtctgttcatctttcactaacagaggagaagtgaaatgtgaacagacaacctggcggcagcgcaaaagatg

SEQ ID NO: 227870 - DNA, 103 bp, Artificial Sequence
  Synthetic Polynucleotide
taatacgactcactatagggggcggctgttgtccagcctggtgtctgttcaacagaggagagaacagatgccaggctggaacctggcggcagcgcaaaagatg

SEQ ID NO: 227871 - DNA, 103 bp, Artificial Sequence
  Synthetic Polynucleotide
taatacgactcactatagggtcatgtcactggcggctgttgtccagcctgaacagaggagacaggctatgcaacagccgaacctggcggcagcgcaaaagatg

SEQ ID NO: 227872 - DNA, 103 bp, Artificial Sequence
  Synthetic Polynucleotide
taatacgactcactatagggtactcaaacttcatgtcactggcggctgttaacagaggagaaacagcatgcagtgacataacctggcggcagcgcaaaagatg

SEQ ID NO: 227873 - DNA, 103 bp, Artificial Sequence
  Synthetic Polynucleotide
taatacgactcactatagggataaagcaaatactcaaacttcatgtcactaacagaggagaagtgacatgaagtttgagaacctggcggcagcgcaaaagatg

SEQ ID NO: 227874 - DNA, 103 bp, Artificial Sequence
  Synthetic Polynucleotide
taatacgactcactatagggctccttccaggcgttgttcatttagtgtttaacagaggagaaaacacatgatgaacaacaacctggcggcagcgcaaaagatg

SEQ ID NO: 227875 - DNA, 103 bp, Artificial Sequence
  Synthetic Polynucleotide
taatacgactcactataggggatggtgaccataaagcaaatactcaaactaacagaggagaagtttgatgatttgctttaacctggcggcagcgcaaaagatg

SEQ ID NO: 227876 - DNA, 103 bp, Artificial Sequence
  Synthetic Polynucleotide
taatacgactcactatagggatctgctcccgatggtgaccataaagcaaaaacagaggagatttgctatgtggtcaccaaacctggcggcagcgcaaaagatg

SEQ ID NO: 227877 - DNA, 103 bp, Artificial Sequence
  Synthetic Polynucleotide
taatacgactcactatagggctggcaggcaatctgctcccgatggtgaccaacagaggagaggtcacatgcgggagcagaacctggcggcagcgcaaaagatg

SEQ ID NO: 227878 - DNA, 103 bp, Artificial Sequence
  Synthetic Polynucleotide
taatacgactcactatagggtcccacacgcctggcaggcaatctgctcccaacagaggagagggagcatgttgcctgccaacctggcggcagcgcaaaagatg

SEQ ID NO: 227879 - DNA, 103 bp, Artificial Sequence
  Synthetic Polynucleotide
taatacgactcactataggggaaaacgtcttcccacacgcctggcaggcaaacagaggagatgcctgatgggcgtgtggaacctggcggcagcgcaaaagatg

SEQ ID NO: 227880 - DNA, 103 bp, Artificial Sequence
  Synthetic Polynucleotide
taatacgactcactataggggccttcatcagaaaacgtcttcccacacgcaacagaggagagcgtgtatgaagacgtttaacctggcggcagcgcaaaagatg

SEQ ID NO: 227881 - DNA, 103 bp, Artificial Sequence
  Synthetic Polynucleotide
taatacgactcactatagggtcctcaatctgccttcatcagaaaacgtctaacagaggagaagacgtatgctgatgaagaacctggcggcagcgcaaaagatg

SEQ ID NO: 227882 - DNA, 103 bp, Artificial Sequence
  Synthetic Polynucleotide
taatacgactcactatagggttctcatgcttcctcaatctgccttcatcaaacagaggagatgatgaatgcagattgagaacctggcggcagcgcaaaagatg

SEQ ID NO: 227883 - DNA, 103 bp, Artificial Sequence
  Synthetic Polynucleotide
taatacgactcactatagggcgtgtggagtttctcatgcttcctcaatctaacagaggagaagattgatgaagcatgagaacctggcggcagcgcaaaagatg

SEQ ID NO: 227884 - DNA, 103 bp, Artificial Sequence
  Synthetic Polynucleotide
taatacgactcactataggggcctgtccgccgtgtggagtttctcatgctaacagaggagaagcatgatgaactccacaaacctggcggcagcgcaaaagatg

SEQ ID NO: 227885 - DNA, 103 bp, Artificial Sequence
  Synthetic Polynucleotide
taatacgactcactatagggtcacaaaattctccttccaggcgttgttcaaacagaggagatgaacaatgcctggaaggaacctggcggcagcgcaaaagatg

SEQ ID NO: 227886 - DNA, 103 bp, Artificial Sequence
  Synthetic Polynucleotide
taatacgactcactatagggcaaacaaatggcctgtccgccgtgtggagtaacagaggagaactccaatgggcggacagaacctggcggcagcgcaaaagatg

SEQ ID NO: 227887 - DNA, 103 bp, Artificial Sequence
  Synthetic Polynucleotide
taatacgactcactataggggcacatttcacaaacaaatggcctgtccgcaacagaggagagcggacatgccatttgttaacctggcggcagcgcaaaagatg

SEQ ID NO: 227888 - DNA, 103 bp, Artificial Sequence
  Synthetic Polynucleotide
taatacgactcactatagggaaccttttgtgcacatttcacaaacaaatgaacagaggagacatttgatggtgaaatgtaacctggcggcagcgcaaaagatg

SEQ ID NO: 227889 - DNA, 103 bp, Artificial Sequence
  Synthetic Polynucleotide
taatacgactcactatagggtgtgtggtgaaaccttttgtgcacatttcaaacagaggagatgaaatatgcacaaaaggaacctggcggcagcgcaaaagatg

SEQ ID NO: 227890 - DNA, 103 bp, Artificial Sequence
  Synthetic Polynucleotide
taatacgactcactatagggcaggtgggcctgtgtggtgaaaccttttgtaacagaggagaacaaaaatgttcaccacaaacctggcggcagcgcaaaagatg

SEQ ID NO: 227891 - DNA, 103 bp, Artificial Sequence
  Synthetic Polynucleotide
taatacgactcactatagggggtgttctttcaggtgggcctgtgtggtgaaacagaggagatcaccaatgaggcccaccaacctggcggcagcgcaaaagatg

SEQ ID NO: 227892 - DNA, 103 bp, Artificial Sequence
  Synthetic Polynucleotide
taatacgactcactatagggtggatttttaggtgttctttcaggtgggccaacagaggagaggcccaatggaaagaacaaacctggcggcagcgcaaaagatg

SEQ ID NO: 227893 - DNA, 103 bp, Artificial Sequence
  Synthetic Polynucleotide
taatacgactcactatagggatatcctgtgtggatttttaggtgttctttaacagaggagaaaagaaatgctaaaaatcaacctggcggcagcgcaaaagatg

SEQ ID NO: 227894 - DNA, 103 bp, Artificial Sequence
  Synthetic Polynucleotide
taatacgactcactatagggtatagggcttatatcctgtgtggatttttaaacagaggagataaaaaatgacacaggataacctggcggcagcgcaaaagatg

SEQ ID NO: 227895 - DNA, 103 bp, Artificial Sequence
  Synthetic Polynucleotide
taatacgactcactatagggacctcacagctatagggcttatatcctgtgaacagaggagacacaggatgtaagccctaaacctggcggcagcgcaaaagatg

SEQ ID NO: 227896 - DNA, 103 bp, Artificial Sequence
  Synthetic Polynucleotide
taatacgactcactatagggctggatcatgcccatttttgtcagatccataacagaggagaatggatatgacaaaaatgaacctggcggcagcgcaaaagatg

SEQ ID NO: 227897 - DNA, 103 bp, Artificial Sequence
  Synthetic Polynucleotide
taatacgactcactatagggcaccatgatgaccacatcgcacaaagtcccaacagaggagagggactatgtgcgatgtgaacctggcggcagcgcaaaagatg

SEQ ID NO: 227898 - DNA, 103 bp, Artificial Sequence
  Synthetic Polynucleotide
taatacgactcactataggggtggttgggcaacacggagtagatgcccagaacagaggagactgggcatgtactccgtgaacctggcggcagcgcaaaagatg

SEQ ID NO: 227899 - DNA, 103 bp, Artificial Sequence
  Synthetic Polynucleotide
taatacgactcactatagggcgtcagccttgtggttgggcaacacggagtaacagaggagaactccgatgtgcccaaccaacctggcggcagcgcaaaagatg

SEQ ID NO: 227900 - DNA, 103 bp, Artificial Sequence
  Synthetic Polynucleotide
taatacgactcactatagggctcaatacagcgtcagccttgtggttgggcaacagaggagagcccaaatgcaaggctgaaacctggcggcagcgcaaaagatg

SEQ ID NO: 227901 - DNA, 103 bp, Artificial Sequence
  Synthetic Polynucleotide
taatacgactcactatagggagacggcatgctcaatacagcgtcagccttaacagaggagaaaggctatggctgtattgaacctggcggcagcgcaaaagatg

SEQ ID NO: 227902 - DNA, 103 bp, Artificial Sequence
  Synthetic Polynucleotide
taatacgactcactatagggaggtcacggaagacggcatgctcaatacagaacagaggagactgtatatggcatgccgtaacctggcggcagcgcaaaagatg

SEQ ID NO: 227903 - DNA, 103 bp, Artificial Sequence
  Synthetic Polynucleotide
taatacgactcactatagggtggaggccagaggtcacggaagacggcatgaacagaggagacatgccatgttccgtgacaacctggcggcagcgcaaaagatg

SEQ ID NO: 227904 - DNA, 103 bp, Artificial Sequence
  Synthetic Polynucleotide
taatacgactcactatagggaggctgcacgtggaggccagaggtcacggaaacagaggagatccgtgatgtctggcctcaacctggcggcagcgcaaaagatg

SEQ ID NO: 227905 - DNA, 103 bp, Artificial Sequence
  Synthetic Polynucleotide
taatacgactcactatagggcagccagggcaggctgcacgtggaggccagaacagaggagactggccatgacgtgcagcaacctggcggcagcgcaaaagatg

SEQ ID NO: 227906 - DNA, 103 bp, Artificial Sequence
  Synthetic Polynucleotide
taatacgactcactatagggtccatggagacagccagggcaggctgcacgaacagaggagacgtgcaatgtgccctggcaacctggcggcagcgcaaaagatg

SEQ ID NO: 227907 - DNA, 103 bp, Artificial Sequence
  Synthetic Polynucleotide
taatacgactcactatagggggtgctgaagtccatggagacagccagggcaacagaggagagccctgatggtctccatgaacctggcggcagcgcaaaagatg

SEQ ID NO: 227908 - DNA, 103 bp, Artificial Sequence
  Synthetic Polynucleotide
taatacgactcactatagggcctggctgtccaccatgatgaccacatcgcaacagaggagagcgatgatgtcatcatggaacctggcggcagcgcaaaagatg

SEQ ID NO: 227909 - DNA, 103 bp, Artificial Sequence
  Synthetic Polynucleotide
taatacgactcactataggggccccccataggtgctgaagtccatggagaaacagaggagatctccaatgacttcagcaaacctggcggcagcgcaaaagatg

SEQ ID NO: 227910 - DNA, 103 bp, Artificial Sequence
  Synthetic Polynucleotide
taatacgactcactatagggtggggcagcagccccccataggtgctgaagaacagaggagacttcagatgctatgggggaacctggcggcagcgcaaaagatg

SEQ ID NO: 227911 - DNA, 103 bp, Artificial Sequence
  Synthetic Polynucleotide
taatacgactcactataggggatgaagccctggggcagcagccccccataaacagaggagatatgggatgctgctgcccaacctggcggcagcgcaaaagatg

SEQ ID NO: 227912 - DNA, 103 bp, Artificial Sequence
  Synthetic Polynucleotide
taatacgactcactataggggctccctctggatgaagccctggggcagcaaacagaggagatgctgcatgagggcttcaaacctggcggcagcgcaaaagatg

SEQ ID NO: 227913 - DNA, 103 bp, Artificial Sequence
  Synthetic Polynucleotide
taatacgactcactatagggttgctgaacagctccctctggatgaagcccaacagaggagagggcttatgccagagggaaacctggcggcagcgcaaaagatg

SEQ ID NO: 227914 - DNA, 103 bp, Artificial Sequence
  Synthetic Polynucleotide
taatacgactcactatagggctcccccagcttgctgaacagctccctctgaacagaggagacagaggatgctgttcagcaacctggcggcagcgcaaaagatg

SEQ ID NO: 227915 - DNA, 103 bp, Artificial Sequence
  Synthetic Polynucleotide
taatacgactcactatagggccacagccagctcccccagcttgctgaacaaacagaggagatgttcaatgagctgggggaacctggcggcagcgcaaaagatg

SEQ ID NO: 227916 - DNA, 103 bp, Artificial Sequence
  Synthetic Polynucleotide
taatacgactcactataggggacttcatgcccacagccagctcccccagcaacagaggagagctgggatggctggctgtaacctggcggcagcgcaaaagatg

SEQ ID NO: 227917 - DNA, 103 bp, Artificial Sequence
  Synthetic Polynucleotide
taatacgactcactatagggccggctctctgacttcatgcccacagccagaacagaggagactggctatgggcatgaagaacctggcggcagcgcaaaagatg

SEQ ID NO: 227918 - DNA, 103 bp, Artificial Sequence
  Synthetic Polynucleotide
taatacgactcactatagggctccgatggtccggctctctgacttcatgcaacagaggagagcatgaatgcagagagccaacctggcggcagcgcaaaagatg

SEQ ID NO: 227919 - DNA, 103 bp, Artificial Sequence
  Synthetic Polynucleotide
taatacgactcactataggggcgtggaactcctggctgtccaccatgatgaacagaggagacatcatatgggacagccaaacctggcggcagcgcaaaagatg

SEQ ID NO: 227920 - DNA, 103 bp, Artificial Sequence
  Synthetic Polynucleotide
taatacgactcactatagggctgcactgctctccgatggtccggctctctaacagaggagaagagagatggaccatcggaacctggcggcagcgcaaaagatg

SEQ ID NO: 227921 - DNA, 103 bp, Artificial Sequence
  Synthetic Polynucleotide
taatacgactcactatagggcccacacacgctgcactgctctccgatggtaacagaggagaaccatcatggagcagtgcaacctggcggcagcgcaaaagatg

SEQ ID NO: 227922 - DNA, 103 bp, Artificial Sequence
  Synthetic Polynucleotide
taatacgactcactataggggaagctcgaccccacacacgctgcactgctaacagaggagaagcagtatggcgtgtgtgaacctggcggcagcgcaaaagatg

SEQ ID NO: 227923 - DNA, 103 bp, Artificial Sequence
  Synthetic Polynucleotide
taatacgactcactatagggtcgttatcaggaagctcgaccccacacacgaacagaggagacgtgtgatgggtcgagctaacctggcggcagcgcaaaagatg

SEQ ID NO: 227924 - DNA, 103 bp, Artificial Sequence
  Synthetic Polynucleotide
taatacgactcactatagggctccacagcctcgttatcaggaagctcgacaacagaggagagtcgagatgcctgataacaacctggcggcagcgcaaaagatg

SEQ ID NO: 227925 - DNA, 103 bp, Artificial Sequence
  Synthetic Polynucleotide
taatacgactcactatagggtcctgtgctgctccacagcctcgttatcagaacagaggagactgataatgaggctgtggaacctggcggcagcgcaaaagatg

SEQ ID NO: 227926 - DNA, 103 bp, Artificial Sequence
  Synthetic Polynucleotide
taatacgactcactatagggctgtgcagcttcctgtgctgctccacagccaacagaggagaggctgtatggcagcacagaacctggcggcagcgcaaaagatg

SEQ ID NO: 227927 - DNA, 103 bp, Artificial Sequence
  Synthetic Polynucleotide
taatacgactcactatagggcttcatcccactgtgcagcttcctgtgctgaacagaggagacagcacatgaagctgcacaacctggcggcagcgcaaaagatg

SEQ ID NO: 227928 - DNA, 103 bp, Artificial Sequence
  Synthetic Polynucleotide
taatacgactcactatagggacccgtacgtcttcatcccactgtgcagctaacagaggagaagctgcatggtgggatgaaacctggcggcagcgcaaaagatg

SEQ ID NO: 227929 - DNA, 103 bp, Artificial Sequence
  Synthetic Polynucleotide
taatacgactcactatagggcagagctcgcacccgtacgtcttcatcccaaacagaggagatgggatatggacgtacggaacctggcggcagcgcaaaagatg

SEQ ID NO: 227930 - DNA, 103 bp, Artificial Sequence
  Synthetic Polynucleotide
taatacgactcactatagggcgtccggtgggcgtggaactcctggctgtcaacagaggagagacagcatggagttccacaacctggcggcagcgcaaaagatg

SEQ ID NO: 227931 - DNA, 103 bp, Artificial Sequence
  Synthetic Polynucleotide
taatacgactcactatagggccgcttcccgcagagctcgcacccgtacgtaacagaggagaacgtacatgtgcgagctcaacctggcggcagcgcaaaagatg

SEQ ID NO: 227932 - DNA, 103 bp, Artificial Sequence
  Synthetic Polynucleotide
taatacgactcactatagggtatccaggaaccgcttcccgcagagctcgcaacagaggagagcgagcatggcgggaagcaacctggcggcagcgcaaaagatg

SEQ ID NO: 227933 - DNA, 103 bp, Artificial Sequence
  Synthetic Polynucleotide
taatacgactcactatagggagccgcaaactatccaggaaccgcttcccgaacagaggagacgggaaatggttcctggaaacctggcggcagcgcaaaagatg

SEQ ID NO: 227934 - DNA, 103 bp, Artificial Sequence
  Synthetic Polynucleotide
taatacgactcactataggggtgcattctcagccgcaaactatccaggaaaacagaggagattcctgatgagtttgcggaacctggcggcagcgcaaaagatg

SEQ ID NO: 227935 - DNA, 103 bp, Artificial Sequence
  Synthetic Polynucleotide
taatacgactcactataggggagccagtaagtgcattctcagccgcaaacaacagaggagagtttgcatgtgagaatgcaacctggcggcagcgcaaaagatg

SEQ ID NO: 227936 - DNA, 103 bp, Artificial Sequence
  Synthetic Polynucleotide
taatacgactcactatagggcccgctgaatgagccagtaagtgcattctcaacagaggagagagaatatgcttactggcaacctggcggcagcgcaaaagatg

SEQ ID NO: 227937 - DNA, 103 bp, Artificial Sequence
  Synthetic Polynucleotide
taatacgactcactatagggggctttggcacccgctgaatgagccagtaaaacagaggagattactgatgcattcagcgaacctggcggcagcgcaaaagatg

SEQ ID NO: 227938 - DNA, 103 bp, Artificial Sequence
  Synthetic Polynucleotide
taatacgactcactatagggcacagacaaaggctttggcacccgctgaataacagaggagaattcagatggtgccaaagaacctggcggcagcgcaaaagatg

SEQ ID NO: 227939 - DNA, 103 bp, Artificial Sequence
  Synthetic Polynucleotide
taatacgactcactatagggccgcactgatcacagacaaaggctttggcaaacagaggagatgccaaatgctttgtctgaacctggcggcagcgcaaaagatg

SEQ ID NO: 227940 - DNA, 103 bp, Artificial Sequence
  Synthetic Polynucleotide
taatacgactcactatagggaaactgtgcaccgcactgatcacagacaaaaacagaggagatttgtcatggatcagtgcaacctggcggcagcgcaaaagatg

SEQ ID NO: 227941 - DNA, 103 bp, Artificial Sequence
  Synthetic Polynucleotide
taatacgactcactatagggaggccagcaccgtccggtgggcgtggaactaacagaggagaagttccatgcccaccggaaacctggcggcagcgcaaaagatg

SEQ ID NO: 227942 - DNA, 103 bp, Artificial Sequence
  Synthetic Polynucleotide
taatacgactcactatagggcctccttcgaaaactgtgcaccgcactgataacagaggagaatcagtatggtgcacagtaacctggcggcagcgcaaaagatg

SEQ ID NO: 227943 - DNA, 103 bp, Artificial Sequence
  Synthetic Polynucleotide
taatacgactcactatagggtccagggcatcctccttcgaaaactgtgcaaacagaggagatgcacaatgttcgaaggaaacctggcggcagcgcaaaagatg

SEQ ID NO: 227944 - DNA, 103 bp, Artificial Sequence
  Synthetic Polynucleotide
taatacgactcactatagggcctgtgtgtctccagggcatcctccttcgaaacagaggagatcgaagatggatgccctgaacctggcggcagcgcaaaagatg

SEQ ID NO: 227945 - DNA, 103 bp, Artificial Sequence
  Synthetic Polynucleotide
taatacgactcactatagggtatgggtctgcctgtgtgtctccagggcataacagaggagaatgcccatgagacacacaaacctggcggcagcgcaaaagatg

SEQ ID NO: 227946 - DNA, 103 bp, Artificial Sequence
  Synthetic Polynucleotide
taatacgactcactatagggtcagtgccagtatgggtctgcctgtgtgtcaacagaggagagacacaatggcagacccaaacctggcggcagcgcaaaagatg

SEQ ID NO: 227947 - DNA, 103 bp, Artificial Sequence
  Synthetic Polynucleotide
taatacgactcactataggggacggccatgtcagtgccagtatgggtctgaacagaggagacagaccatgactggcactaacctggcggcagcgcaaaagatg

SEQ ID NO: 227948 - DNA, 103 bp, Artificial Sequence
  Synthetic Polynucleotide
taatacgactcactataggggcagacagaagacggccatgtcagtgccagaacagaggagactggcaatgacatggccgaacctggcggcagcgcaaaagatg

SEQ ID NO: 227949 - DNA, 103 bp, Artificial Sequence
  Synthetic Polynucleotide
taatacgactcactatagggttcccacacagcagacagaagacggccatgaacagaggagacatggcatgcttctgtctaacctggcggcagcgcaaaagatg

SEQ ID NO: 227950 - DNA, 103 bp, Artificial Sequence
  Synthetic Polynucleotide
taatacgactcactatagggctggaagcgcttcccacacagcagacagaaaacagaggagattctgtatgctgtgtgggaacctggcggcagcgcaaaagatg

SEQ ID NO: 227951 - DNA, 103 bp, Artificial Sequence
  Synthetic Polynucleotide
taatacgactcactatagggcgctctgcgcctggaagcgcttcccacacaaacagaggagatgtgtgatgagcgcttccaacctggcggcagcgcaaaagatg

SEQ ID NO: 227952 - DNA, 103 bp, Artificial Sequence
  Synthetic Polynucleotide
taatacgactcactatagggttgctggtgcaggccagcaccgtccggtggaacagaggagaccaccgatgggtgctggcaacctggcggcagcgcaaaagatg

SEQ ID NO: 227953 - DNA, 103 bp, Artificial Sequence
  Synthetic Polynucleotide
taatacgactcactatagggtgctgcagtgcgctctgcgcctggaagcgcaacagaggagagcgcttatgggcgcagagaacctggcggcagcgcaaaagatg

SEQ ID NO: 227954 - DNA, 103 bp, Artificial Sequence
  Synthetic Polynucleotide
taatacgactcactatagggctccatgtgctgctgcagtgcgctctgcgcaacagaggagagcgcagatggcactgcagaacctggcggcagcgcaaaagatg

SEQ ID NO: 227955 - DNA, 103 bp, Artificial Sequence
  Synthetic Polynucleotide
taatacgactcactatagggccgcgtggacctccatgtgctgctgcagtgaacagaggagacactgcatgagcacatggaacctggcggcagcgcaaaagatg

SEQ ID NO: 227956 - DNA, 103 bp, Artificial Sequence
  Synthetic Polynucleotide
taatacgactcactatagggctgcgcacgcccgcgtggacctccatgtgcaacagaggagagcacatatgggtccacgcaacctggcggcagcgcaaaagatg

SEQ ID NO: 227957 - DNA, 103 bp, Artificial Sequence
  Synthetic Polynucleotide
taatacgactcactataggggcagatgtagctgcgcacgcccgcgtggacaacagaggagagtccacatgggcgtgcgcaacctggcggcagcgcaaaagatg

SEQ ID NO: 227958 - DNA, 103 bp, Artificial Sequence
  Synthetic Polynucleotide
taatacgactcactatagggtgcactcactgcagatgtagctgcgcacgcaacagaggagagcgtgcatggctacatctaacctggcggcagcgcaaaagatg

SEQ ID NO: 227959 - DNA, 103 bp, Artificial Sequence
  Synthetic Polynucleotide
taatacgactcactatagggaaggtgcggttgcactcactgcagatgtagaacagaggagactacatatgcagtgagtgaacctggcggcagcgcaaaagatg

SEQ ID NO: 227960 - DNA, 103 bp, Artificial Sequence
  Synthetic Polynucleotide
taatacgactcactataggggtggctggggaaggtgcggttgcactcactaacagaggagaagtgagatgaaccgcaccaacctggcggcagcgcaaaagatg

SEQ ID NO: 227961 - DNA, 103 bp, Artificial Sequence
  Synthetic Polynucleotide
taatacgactcactatagggtgagagccgtgtggctggggaaggtgcggtaacagaggagaaccgcaatgtccccagccaacctggcggcagcgcaaaagatg

SEQ ID NO: 227962 - DNA, 103 bp, Artificial Sequence
  Synthetic Polynucleotide
taatacgactcactatagggaggtggcgtttgagagccgtgtggctggggaacagaggagaccccagatgcacggctctaacctggcggcagcgcaaaagatg

SEQ ID NO: 227963 - DNA, 103 bp, Artificial Sequence
  Synthetic Polynucleotide
taatacgactcactatagggctcaaacatcttgctggtgcaggccagcacaacagaggagagtgctgatgtgcaccagcaacctggcggcagcgcaaaagatg

SEQ ID NO: 227964 - DNA, 103 bp, Artificial Sequence
  Synthetic Polynucleotide
taatacgactcactatagggatgtgagcgcaggtggcgtttgagagccgtaacagaggagaacggctatgaaacgccacaacctggcggcagcgcaaaagatg

SEQ ID NO: 227965 - DNA, 103 bp, Artificial Sequence
  Synthetic Polynucleotide
taatacgactcactatagggggtcgcctgtatgtgagcgcaggtggcgttaacagaggagaaacgccatgtgcgctcacaacctggcggcagcgcaaaagatg

SEQ ID NO: 227966 - DNA, 103 bp, Artificial Sequence
  Synthetic Polynucleotide
taatacgactcactatagggtcgtaggggtggtcgcctgtatgtgagcgcaacagaggagagcgctcatgtacaggcgaaacctggcggcagcgcaaaagatg

SEQ ID NO: 227967 - DNA, 103 bp, Artificial Sequence
  Synthetic Polynucleotide
taatacgactcactataggggaactcacactcgtaggggtggtcgcctgtaacagaggagaacaggcatgcacccctacaacctggcggcagcgcaaaagatg

SEQ ID NO: 227968 - DNA, 103 bp, Artificial Sequence
  Synthetic Polynucleotide
taatacgactcactatagggagctgccacagaactcacactcgtaggggtaacagaggagaacccctatgagtgtgagtaacctggcggcagcgcaaaagatg

SEQ ID NO: 227969 - DNA, 103 bp, Artificial Sequence
  Synthetic Polynucleotide
taatacgactcactatagggtcccggaagcagctgccacagaactcacacaacagaggagagtgtgaatgctgtggcagaacctggcggcagcgcaaaagatg

SEQ ID NO: 227970 - DNA, 103 bp, Artificial Sequence
  Synthetic Polynucleotide
taatacgactcactatagggtgtgctctcatcccggaagcagctgccacaaacagaggagatgtggcatgtgcttccggaacctggcggcagcgcaaaagatg

SEQ ID NO: 227971 - DNA, 103 bp, Artificial Sequence
  Synthetic Polynucleotide
taatacgactcactatagggggctcttgagtgtgctctcatcccggaagcaacagaggagagcttccatgatgagagcaaacctggcggcagcgcaaaagatg

SEQ ID NO: 227972 - DNA, 103 bp, Artificial Sequence
  Synthetic Polynucleotide
taatacgactcactatagggatgcgtttgtggctcttgagtgtgctctcaaacagaggagatgagagatgactcaagagaacctggcggcagcgcaaaagatg

SEQ ID NO: 227973 - DNA, 103 bp, Artificial Sequence
  Synthetic Polynucleotide
taatacgactcactatagggacccgtgtggatgcgtttgtggctcttgagaacagaggagactcaagatgcacaaacgcaacctggcggcagcgcaaaagatg

SEQ ID NO: 227974 - DNA, 103 bp, Artificial Sequence
  Synthetic Polynucleotide
taatacgactcactatagggggaagaggatctcaaacatcttgctggtgcaacagaggagagcaccaatgagatgtttgaacctggcggcagcgcaaaagatg

SEQ ID NO: 227975 - DNA, 103 bp, Artificial Sequence
  Synthetic Polynucleotide
taatacgactcactatagggagggtttctcacccgtgtggatgcgtttgtaacagaggagaacaaacatgtccacacggaacctggcggcagcgcaaaagatg

SEQ ID NO: 227976 - DNA, 103 bp, Artificial Sequence
  Synthetic Polynucleotide
taatacgactcactatagggttgcactcgtagggtttctcacccgtgtggaacagaggagaccacacatgtgagaaaccaacctggcggcagcgcaaaagatg

SEQ ID NO: 227977 - DNA, 103 bp, Artificial Sequence
  Synthetic Polynucleotide
taatacgactcactataggggccacagccattgcactcgtagggtttctcaacagaggagagagaaaatgtacgagtgcaacctggcggcagcgcaaaagatg

SEQ ID NO: 227978 - DNA, 103 bp, Artificial Sequence
  Synthetic Polynucleotide
taatacgactcactatagggtgaacttcttgccacagccattgcactcgtaacagaggagaacgagtatgatggctgtgaacctggcggcagcgcaaaagatg

SEQ ID NO: 227979 - DNA, 103 bp, Artificial Sequence
  Synthetic Polynucleotide
taatacgactcactatagggtgcttgaggctgaacttcttgccacagccaaacagaggagatggctgatgcaagaagttaacctggcggcagcgcaaaagatg

SEQ ID NO: 227980 - DNA, 103 bp, Artificial Sequence
  Synthetic Polynucleotide
taatacgactcactatagggctccagctgatgcttgaggctgaacttcttaacagaggagaaagaagatgagcctcaagaacctggcggcagcgcaaaagatg

SEQ ID NO: 227981 - DNA, 103 bp, Artificial Sequence
  Synthetic Polynucleotide
taatacgactcactatagggtatagtgcgtctccagctgatgcttgaggcaacagaggagagcctcaatgatcagctggaacctggcggcagcgcaaaagatg

SEQ ID NO: 227982 - DNA, 103 bp, Artificial Sequence
  Synthetic Polynucleotide
taatacgactcactataggggtgtgcaccctatagtgcgtctccagctgaaacagaggagatcagctatggacgcactaaacctggcggcagcgcaaaagatg

SEQ ID NO: 227983 - DNA, 103 bp, Artificial Sequence
  Synthetic Polynucleotide
taatacgactcactatagggcttctcacctgtgtgcaccctatagtgcgtaacagaggagaacgcacatgagggtgcacaacctggcggcagcgcaaaagatg

SEQ ID NO: 227984 - DNA, 103 bp, Artificial Sequence
  Synthetic Polynucleotide
taatacgactcactatagggactcaaagggcttctcacctgtgtgcacccaacagaggagagggtgcatgcaggtgagaaacctggcggcagcgcaaaagatg

SEQ ID NO: 227985 - DNA, 103 bp, Artificial Sequence
  Synthetic Polynucleotide
taatacgactcactatagggctattgcggtggaagaggatctcaaacatcaacagaggagagatgttatggatcctcttaacctggcggcagcgcaaaagatg

SEQ ID NO: 227986 - DNA, 103 bp, Artificial Sequence
  Synthetic Polynucleotide
taatacgactcactatagggcagagcttacactcaaagggcttctcacctaacagaggagaaggtgaatggccctttgaaacctggcggcagcgcaaaagatg

SEQ ID NO: 227987 - DNA, 103 bp, Artificial Sequence
  Synthetic Polynucleotide
taatacgactcactataggggcgctggtggcagagcttacactcaaagggaacagaggagaccctttatgtgtaagctcaacctggcggcagcgcaaaagatg

SEQ ID NO: 227988 - DNA, 103 bp, Artificial Sequence
  Synthetic Polynucleotide
taatacgactcactatagggagtcccgggagcgctggtggcagagcttacaacagaggagagtaagcatggccaccagcaacctggcggcagcgcaaaagatg

SEQ ID NO: 227989 - DNA, 103 bp, Artificial Sequence
  Synthetic Polynucleotide
taatacgactcactatagggatggccgagtagtcccgggagcgctggtggaacagaggagaccaccaatgctcccgggaaacctggcggcagcgcaaaagatg

SEQ ID NO: 227990 - DNA, 103 bp, Artificial Sequence
  Synthetic Polynucleotide
taatacgactcactataggggtgcttgatcatggccgagtagtcccgggaaacagaggagatcccggatgtactcggccaacctggcggcagcgcaaaagatg

SEQ ID NO: 227991 - DNA, 103 bp, Artificial Sequence
  Synthetic Polynucleotide
taatacgactcactataggggcgttctcaggtgcttgatcatggccgagtaacagaggagaactcggatgtgatcaagcaacctggcggcagcgcaaaagatg

SEQ ID NO: 227992 - DNA, 103 bp, Artificial Sequence
  Synthetic Polynucleotide
taatacgactcactataggggcgccgttgtgcgttctcaggtgcttgatcaacagaggagagatcaaatgcctgagaacaacctggcggcagcgcaaaagatg

SEQ ID NO: 227993 - DNA, 103 bp, Artificial Sequence
  Synthetic Polynucleotide
taatacgactcactataggggtagggcgaggcgccgttgtgcgttctcagaacagaggagactgagaatgcacaacggcaacctggcggcagcgcaaaagatg

SEQ ID NO: 227994 - DNA, 103 bp, Artificial Sequence
  Synthetic Polynucleotide
taatacgactcactatagggtggtgcactggtagggcgaggcgccgttgtaacagaggagaacaacgatgcctcgccctaacctggcggcagcgcaaaagatg

SEQ ID NO: 227995 - DNA, 103 bp, Artificial Sequence
  Synthetic Polynucleotide
taatacgactcactatagggtctgtgcagatggtgcactggtagggcgagaacagaggagactcgccatgccagtgcacaacctggcggcagcgcaaaagatg

SEQ ID NO: 227996 - DNA, 103 bp, Artificial Sequence
  Synthetic Polynucleotide
taatacgactcactatagggatagtgttgactattgcggtggaagaggataacagaggagaatcctcatgcaccgcaataacctggcggcagcgcaaaagatg

SEQ ID NO: 227997 - DNA, 103 bp, Artificial Sequence
  Synthetic Polynucleotide
taatacgactcactatagggggggcagtactctgtgcagatggtgcactgaacagaggagacagtgcatgatctgcacaaacctggcggcagcgcaaaagatg

SEQ ID NO: 227998 - DNA, 103 bp, Artificial Sequence
  Synthetic Polynucleotide
taatacgactcactatagggaggagaggctggggcagtactctgtgcagaaacagaggagatctgcaatgagtactgccaacctggcggcagcgcaaaagatg

SEQ ID NO: 227999 - DNA, 103 bp, Artificial Sequence
  Synthetic Polynucleotide
taatacgactcactatagggttctgcatggaggagaggctggggcagtacaacagaggagagtactgatgcagcctctcaacctggcggcagcgcaaaagatg

SEQ ID NO: 228000 - DNA, 103 bp, Artificial Sequence
  Synthetic Polynucleotide
taatacgactcactatagggcttcatgtgcttctgcatggaggagaggctaacagaggagaagcctcatgtccatgcagaacctggcggcagcgcaaaagatg

SEQ ID NO: 228001 - DNA, 103 bp, Artificial Sequence
  Synthetic Polynucleotide
taatacgactcactataggggcttgtggcccttcatgtgcttctgcatggaacagaggagaccatgcatgagcacatgaaacctggcggcagcgcaaaagatg

SEQ ID NO: 228002 - DNA, 103 bp, Artificial Sequence
  Synthetic Polynucleotide
taatacgactcactatagggatctcctcgggcttgtggcccttcatgtgcaacagaggagagcacatatggggccacaaaacctggcggcagcgcaaaagatg

SEQ ID NO: 228003 - DNA, 103 bp, Artificial Sequence
  Synthetic Polynucleotide
taatacgactcactataggggtcgggcgggatctcctcgggcttgtggccaacagaggagaggccacatgcccgaggagaacctggcggcagcgcaaaagatg

SEQ ID NO: 228004 - DNA, 103 bp, Artificial Sequence
  Synthetic Polynucleotide
taatacgactcactatagggctatcctccagtcgggcgggatctcctcggaacagaggagaccgaggatgtcccgcccgaacctggcggcagcgcaaaagatg

SEQ ID NO: 228005 - DNA, 103 bp, Artificial Sequence
  Synthetic Polynucleotide
taatacgactcactatagggtacgtcttctctatcctccagtcgggcgggaacagaggagacccgccatgctggaggataacctggcggcagcgcaaaagatg

SEQ ID NO: 228006 - DNA, 103 bp, Artificial Sequence
  Synthetic Polynucleotide
taatacgactcactatagggcaggtagaggtacgtcttctctatcctccaaacagaggagatggaggatggagaagacgaacctggcggcagcgcaaaagatg

SEQ ID NO: 228007 - DNA, 103 bp, Artificial Sequence
  Synthetic Polynucleotide
taatacgactcactatagggggttctgcagctggatcatgcccatttttgaacagaggagacaaaaaatggcatgatccaacctggcggcagcgcaaaagatg

SEQ ID NO: 228008 - DNA, 103 bp, Artificial Sequence
  Synthetic Polynucleotide
taatacgactcactatagggagtccaaagtatagtgttgactattgcggtaacagaggagaaccgcaatggtcaacactaacctggcggcagcgcaaaagatg

SEQ ID NO: 228009 - DNA, 103 bp, Artificial Sequence
  Synthetic Polynucleotide
taatacgactcactatagggacacatagcacaggtagaggtacgtcttctaacagaggagaagaagaatgacctctaccaacctggcggcagcgcaaaagatg

SEQ ID NO: 228010 - DNA, 103 bp, Artificial Sequence
  Synthetic Polynucleotide
taatacgactcactatagggggcgagaggaagtccaaagtatagtgttgaaacagaggagatcaacaatgtactttggaaacctggcggcagcgcaaaagatg

SEQ ID NO: 228011 - DNA, 103 bp, Artificial Sequence
  Synthetic Polynucleotide
taatacgactcactataggggaaggtctttggcgagaggaagtccaaagtaacagaggagaactttgatgttcctctcgaacctggcggcagcgcaaaagatg

SEQ ID NO: 228012 - DNA, 103 bp, Artificial Sequence
  Synthetic Polynucleotide
taatacgactcactataggggaatctgctggaaggtctttggcgagaggaaacagaggagatcctctatgcaaagacctaacctggcggcagcgcaaaagatg

SEQ ID NO: 228013 - DNA, 103 bp, Artificial Sequence
  Synthetic Polynucleotide
taatacgactcactataggggcatactccagaatctgctggaaggtctttaacagaggagaaaagacatgccagcagataacctggcggcagcgcaaaagatg

SEQ ID NO: 228014 - DNA, 103 bp, Artificial Sequence
  Synthetic Polynucleotide
taatacgactcactatagggggctgtatatgcatactccagaatctgctgaacagaggagacagcagatgctggagtataacctggcggcagcgcaaaagatg

SEQ ID NO: 228015 - DNA, 103 bp, Artificial Sequence
  Synthetic Polynucleotide
taatacgactcactatagggcttgcagcgtggctgtatatgcatactccaaacagaggagatggagtatgcatatacagaacctggcggcagcgcaaaagatg

SEQ ID NO: 228016 - DNA, 103 bp, Artificial Sequence
  Synthetic Polynucleotide
taatacgactcactatagggtccgccttggcttgcagcgtggctgtatataacagaggagaatatacatgcacgctgcaaacctggcggcagcgcaaaagatg

SEQ ID NO: 228017 - DNA, 103 bp, Artificial Sequence
  Synthetic Polynucleotide
taatacgactcactatagggatccaggtcctccgccttggcttgcagcgtaacagaggagaacgctgatggccaaggcgaacctggcggcagcgcaaaagatg

SEQ ID NO: 228018 - DNA, 103 bp, Artificial Sequence
  Synthetic Polynucleotide
taatacgactcactatagggacagcaggtcatccaggtcctccgccttggaacagaggagaccaaggatgaggacctggaacctggcggcagcgcaaaagatg

SEQ ID NO: 228019 - DNA, 103 bp, Artificial Sequence
  Synthetic Polynucleotide
taatacgactcactataggggggtggctagggttctgcagctggatcatgaacagaggagacatgatatggctgcagaaaacctggcggcagcgcaaaagatg

SEQ ID NO: 228020 - DNA, 103 bp, Artificial Sequence
  Synthetic Polynucleotide
taatacgactcactatagggtcggccgcatacagcaggtcatccaggtccaacagaggagaggacctatgtgacctgctaacctggcggcagcgcaaaagatg

SEQ ID NO: 228021 - DNA, 103 bp, Artificial Sequence
  Synthetic Polynucleotide
taatacgactcactatagggctccaggatctcggccgcatacagcaggtcaacagaggagagacctgatgtatgcggccaacctggcggcagcgcaaaagatg

SEQ ID NO: 228022 - DNA, 103 bp, Artificial Sequence
  Synthetic Polynucleotide
taatacgactcactatagggggtactcgatctccaggatctcggccgcataacagaggagaatgcggatgagatcctggaacctggcggcagcgcaaaagatg

SEQ ID NO: 228023 - DNA, 103 bp, Artificial Sequence
  Synthetic Polynucleotide
taatacgactcactatagggtgttcctccaggtactcgatctccaggatcaacagaggagagatcctatggatcgagtaaacctggcggcagcgcaaaagatg

SEQ ID NO: 228024 - DNA, 103 bp, Artificial Sequence
  Synthetic Polynucleotide
taatacgactcactatagggcttcaggcactgttcctccaggtactcgataacagaggagaatcgagatgctggaggaaaacctggcggcagcgcaaaagatg

SEQ ID NO: 228025 - DNA, 103 bp, Artificial Sequence
  Synthetic Polynucleotide
taatacgactcactatagggtctccagcatcttcaggcactgttcctccaaacagaggagatggaggatgagtgcctgaaacctggcggcagcgcaaaagatg

SEQ ID NO: 228026 - DNA, 103 bp, Artificial Sequence
  Synthetic Polynucleotide
taatacgactcactataggggcctggatggtctccagcatcttcaggcacaacagaggagagtgcctatggatgctggaaacctggcggcagcgcaaaagatg

SEQ ID NO: 228027 - DNA, 103 bp, Artificial Sequence
  Synthetic Polynucleotide
taatacgactcactataggggtcgtctgaggcctggatggtctccagcataacagaggagaatgctgatgaccatccagaacctggcggcagcgcaaaagatg

SEQ ID NO: 228028 - DNA, 103 bp, Artificial Sequence
  Synthetic Polynucleotide
taatacgactcactatagggccgtgtcattgtcgtctgaggcctggatggaacagaggagaccatccatgcctcagacgaacctggcggcagcgcaaaagatg

SEQ ID NO: 228029 - DNA, 103 bp, Artificial Sequence
  Synthetic Polynucleotide
taatacgactcactatagggatggtggcctccgtgtcattgtcgtctgagaacagaggagactcagaatgcaatgacacaacctggcggcagcgcaaaagatg

SEQ ID NO: 228030 - DNA, 103 bp, Artificial Sequence
  Synthetic Polynucleotide
taatacgactcactatagggtagccccgtggggtggctagggttctgcagaacagaggagactgcagatgcctagccacaacctggcggcagcgcaaaagatg

SEQ ID NO: 228031 - DNA, 103 bp, Artificial Sequence
  Synthetic Polynucleotide
taatacgactcactataggggccatcggccatggtggcctccgtgtcattaacagaggagaaatgacatggaggccaccaacctggcggcagcgcaaaagatg

SEQ ID NO: 228032 - DNA, 103 bp, Artificial Sequence
  Synthetic Polynucleotide
taatacgactcactatagggcctcggccccgccatcggccatggtggcctaacagaggagaaggccaatgtggccgatgaacctggcggcagcgcaaaagatg

SEQ ID NO: 228033 - DNA, 103 bp, Artificial Sequence
  Synthetic Polynucleotide
taatacgactcactatagggtcctcttcttcctcggccccgccatcggccaacagaggagaggccgaatgcggggccgaaacctggcggcagcgcaaaagatg

SEQ ID NO: 228034 - DNA, 103 bp, Artificial Sequence
  Synthetic Polynucleotide
taatacgactcactatagggagccttgcggtcctcttcttcctcggccccaacagaggagaggggccatggaagaagagaacctggcggcagcgcaaaagatg

SEQ ID NO: 228035 - DNA, 103 bp, Artificial Sequence
  Synthetic Polynucleotide
taatacgactcactatagggtgaggtaccgagccttgcggtcctcttcttaacagaggagaaagaagatgaccgcaaggaacctggcggcagcgcaaaagatg

SEQ ID NO: 228036 - DNA, 103 bp, Artificial Sequence
  Synthetic Polynucleotide
taatacgactcactatagggaagatgttcttgaggtaccgagccttgcggaacagaggagaccgcaaatgtcggtacctaacctggcggcagcgcaaaagatg

SEQ ID NO: 228037 - DNA, 103 bp, Artificial Sequence
  Synthetic Polynucleotide
taatacgactcactatagggcttcgagatgaagatgttcttgaggtaccgaacagaggagacggtacatgaagaacatcaacctggcggcagcgcaaaagatg

SEQ ID NO: 228038 - DNA, 103 bp, Artificial Sequence
  Synthetic Polynucleotide
taatacgactcactatagggcgctggaatgcttcgagatgaagatgttctaacagaggagaagaacaatgtcatctcgaaacctggcggcagcgcaaaagatg

SEQ ID NO: 228039 - DNA, 103 bp, Artificial Sequence
  Synthetic Polynucleotide
taatacgactcactatagggccactctcctcgctggaatgcttcgagatgaacagaggagacatctcatggcattccagaacctggcggcagcgcaaaagatg

SEQ ID NO: 228040 - DNA, 103 bp, Artificial Sequence
  Synthetic Polynucleotide
taatacgactcactatagggactggcatacccactctcctcgctggaatgaacagaggagacattccatggaggagagtaacctggcggcagcgcaaaagatg

SEQ ID NO: 228041 - DNA, 103 bp, Artificial Sequence
  Synthetic Polynucleotide
taatacgactcactatagggccttgcacagtagccccgtggggtggctagaacagaggagactagccatgccacggggcaacctggcggcagcgcaaaagatg

SEQ ID NO: 228042 - DNA, 103 bp, Artificial Sequence
  Synthetic Polynucleotide
taatacgactcactataggggtccagccacactggcatacccactctcctaacagaggagaaggagaatgggtatgccaaacctggcggcagcgcaaaagatg

SEQ ID NO: 228043 - DNA, 103 bp, Artificial Sequence
  Synthetic Polynucleotide
taatacgactcactataggggggaggctctgtccagccacactggcatacaacagaggagagtatgcatgtgtggctggaacctggcggcagcgcaaaagatg

SEQ ID NO: 228044 - DNA, 103 bp, Artificial Sequence
  Synthetic Polynucleotide
taatacgactcactatagggcatgggcccagggaggctctgtccagccacaacagaggagagtggctatgcagagcctcaacctggcggcagcgcaaaagatg

SEQ ID NO: 228045 - DNA, 103 bp, Artificial Sequence
  Synthetic Polynucleotide
taatacgactcactatagggtctggtccaccatgggcccagggaggctctaacagaggagaagagccatgctgggcccaaacctggcggcagcgcaaaagatg

SEQ ID NO: 228046 - DNA, 103 bp, Artificial Sequence
  Synthetic Polynucleotide
taatacgactcactatagggactgaagggctctggtccaccatgggcccaaacagaggagatgggccatgggtggaccaaacctggcggcagcgcaaaagatg

SEQ ID NO: 228047 - DNA, 103 bp, Artificial Sequence
  Synthetic Polynucleotide
taatacgactcactatagggtgaagtggagactgaagggctctggtccacaacagaggagagtggacatgagcccttcaaacctggcggcagcgcaaaagatg

SEQ ID NO: 228048 - DNA, 103 bp, Artificial Sequence
  Synthetic Polynucleotide
taatacgactcactatagggaaagaccaaatgaagtggagactgaagggcaacagaggagagcccttatgtctccacttaacctggcggcagcgcaaaagatg

SEQ ID NO: 228049 - DNA, 103 bp, Artificial Sequence
  Synthetic Polynucleotide
taatacgactcactatagggctcatggctgaaagaccaaatgaagtggagaacagaggagactccacatgatttggtctaacctggcggcagcgcaaaagatg

SEQ ID NO: 228050 - DNA, 103 bp, Artificial Sequence
  Synthetic Polynucleotide
taatacgactcactatagggcttggtgggactcatggctgaaagaccaaaaacagaggagatttggtatgtcagccatgaacctggcggcagcgcaaaagatg

SEQ ID NO: 228051 - DNA, 103 bp, Artificial Sequence
  Synthetic Polynucleotide
taatacgactcactatagggccactgcagccttggtgggactcatggctgaacagaggagacagccaatggtcccaccaaacctggcggcagcgcaaaagatg

SEQ ID NO: 228052 - DNA, 103 bp, Artificial Sequence
  Synthetic Polynucleotide
taatacgactcactatagggatctggttggccttgcacagtagccccgtgaacagaggagacacgggatgactgtgcaaaacctggcggcagcgcaaaagatg

SEQ ID NO: 228053 - DNA, 103 bp, Artificial Sequence
  Synthetic Polynucleotide
taatacgactcactatagggatcaaactgtccactgcagccttggtgggaaacagaggagatcccacatgggctgcagtaacctggcggcagcgcaaaagatg

SEQ ID NO: 228054 - DNA, 103 bp, Artificial Sequence
  Synthetic Polynucleotide
taatacgactcactatagggtcctatggtcatcaaactgtccactgcagcaacagaggagagctgcaatggacagtttgaacctggcggcagcgcaaaagatg

SEQ ID NO: 228055 - DNA, 103 bp, Artificial Sequence
  Synthetic Polynucleotide
taatacgactcactatagggggagagactgtcctatggtcatcaaactgtaacagaggagaacagttatgtgaccatagaacctggcggcagcgcaaaagatg

SEQ ID NO: 228056 - DNA, 103 bp, Artificial Sequence
  Synthetic Polynucleotide
taatacgactcactataggggttccctgcaggagagactgtcctatggtcaacagaggagagaccatatgacagtctctaacctggcggcagcgcaaaagatg

SEQ ID NO: 228057 - DNA, 103 bp, Artificial Sequence
  Synthetic Polynucleotide
taatacgactcactatagggtggctgaagagttccctgcaggagagactgaacagaggagacagtctatgctgcagggaaacctggcggcagcgcaaaagatg

SEQ ID NO: 228058 - DNA, 103 bp, Artificial Sequence
  Synthetic Polynucleotide
taatacgactcactataggggccctgcaggtggctgaagagttccctgcaaacagaggagatgcaggatgctcttcagcaacctggcggcagcgcaaaagatg

SEQ ID NO: 228059 - DNA, 103 bp, Artificial Sequence
  Synthetic Polynucleotide
taatacgactcactatagggggctcctcgggccctgcaggtggctgaagaaacagaggagatcttcaatgacctgcaggaacctggcggcagcgcaaaagatg

SEQ ID NO: 228060 - DNA, 103 bp, Artificial Sequence
  Synthetic Polynucleotide
taatacgactcactatagggagccagagttggctcctcgggccctgcaggaacagaggagacctgcaatgcccgaggagaacctggcggcagcgcaaaagatg

SEQ ID NO: 228061 - DNA, 103 bp, Artificial Sequence
  Synthetic Polynucleotide
taatacgactcactataggggcccacccccagccagagttggctcctcggaacagaggagaccgaggatgcaactctggaacctggcggcagcgcaaaagatg

SEQ ID NO: 228062 - DNA, 103 bp, Artificial Sequence
  Synthetic Polynucleotide
taatacgactcactatagggccagggtgccgcccacccccagccagagttaacagaggagaaactctatgtgggggtggaacctggcggcagcgcaaaagatg

SEQ ID NO: 228063 - DNA, 103 bp, Artificial Sequence
  Synthetic Polynucleotide
taatacgactcactatagggggccagccgcatctggttggccttgcacagaacagaggagactgtgcatggccaaccagaacctggcggcagcgcaaaagatg

SEQ ID NO: 228064 - DNA, 103 bp, Artificial Sequence
  Synthetic Polynucleotide
taatacgactcactatagggctcagccaccccagggtgccgcccacccccaacagaggagagggggtatgcggcaccctaacctggcggcagcgcaaaagatg

SEQ ID NO: 228065 - DNA, 103 bp, Artificial Sequence
  Synthetic Polynucleotide
taatacgactcactatagggccgtcttcacctcagccaccccagggtgccaacagaggagaggcaccatggggtggctgaacctggcggcagcgcaaaagatg

SEQ ID NO: 228066 - DNA, 103 bp, Artificial Sequence
  Synthetic Polynucleotide
taatacgactcactatagggtgcatcatctccgtcttcacctcagccaccaacagaggagaggtggcatgggtgaagacaacctggcggcagcgcaaaagatg

SEQ ID NO: 228067 - DNA, 103 bp, Artificial Sequence
  Synthetic Polynucleotide
taatacgactcactatagggctcatccacctgcatcatctccgtcttcacaacagaggagagtgaagatggagatgatgaacctggcggcagcgcaaaagatg

SEQ ID NO: 228068 - DNA, 103 bp, Artificial Sequence
  Synthetic Polynucleotide
taatacgactcactatagggggctgggcacctcatccacctgcatcatctaacagaggagaagatgaatgaggtggatgaacctggcggcagcgcaaaagatg

SEQ ID NO: 228069 - DNA, 103 bp, Artificial Sequence
  Synthetic Polynucleotide
taatacgactcactataggggggctgtcctggctgggcacctcatccaccaacagaggagaggtggaatgggtgcccagaacctggcggcagcgcaaaagatg

SEQ ID NO: 228070 - DNA, 103 bp, Artificial Sequence
  Synthetic Polynucleotide
taatacgactcactatagggggctgccccagggctgtcctggctgggcacaacagaggagagtgcccatgcaggacagcaacctggcggcagcgcaaaagatg

SEQ ID NO: 228071 - DNA, 103 bp, Artificial Sequence
  Synthetic Polynucleotide
taatacgactcactatagggtgctggactcggctgccccagggctgtcctaacagaggagaaggacaatgctggggcagaacctggcggcagcgcaaaagatg

SEQ ID NO: 228072 - DNA, 103 bp, Artificial Sequence
  Synthetic Polynucleotide
taatacgactcactatagggcctcctgagatgctggactcggctgccccaaacagaggagatggggcatgcgagtccagaacctggcggcagcgcaaaagatg

SEQ ID NO: 228073 - DNA, 103 bp, Artificial Sequence
  Synthetic Polynucleotide
taatacgactcactataggggtcccccatccctcctgagatgctggactcaacagaggagagagtccatgatctcaggaaacctggcggcagcgcaaaagatg

SEQ ID NO: 228074 - DNA, 103 bp, Artificial Sequence
  Synthetic Polynucleotide
taatacgactcactatagggacaaagtcccggccagccgcatctggttggaacagaggagaccaaccatgtgcggctggaacctggcggcagcgcaaaagatg

SEQ ID NO: 228075 - DNA, 103 bp, Artificial Sequence
  Synthetic Polynucleotide
taatacgactcactatagggcctcaaccttgtcccccatccctcctgagaaacagaggagatctcagatgggatgggggaacctggcggcagcgcaaaagatg

SEQ ID NO: 228076 - DNA, 103 bp, Artificial Sequence
  Synthetic Polynucleotide
taatacgactcactatagggttgcctctttcctcaaccttgtcccccatcaacagaggagagatgggatgcaaggttgaaacctggcggcagcgcaaaagatg

SEQ ID NO: 228077 - DNA, 103 bp, Artificial Sequence
  Synthetic Polynucleotide
taatacgactcactatagggaggcccctctttgcctctttcctcaaccttaacagaggagaaaggttatggaaagaggcaacctggcggcagcgcaaaagatg

SEQ ID NO: 228078 - DNA, 103 bp, Artificial Sequence
  Synthetic Polynucleotide
taatacgactcactatagggtcggggtcccaggcccctctttgcctctttaacagaggagaaaagagatgaagaggggcaacctggcggcagcgcaaaagatg

SEQ ID NO: 228079 - DNA, 103 bp, Artificial Sequence
  Synthetic Polynucleotide
taatacgactcactatagggctgcttcgagtcggggtcccaggcccctctaacagaggagaagagggatgtgggaccccaacctggcggcagcgcaaaagatg

SEQ ID NO: 228080 - DNA, 103 bp, Artificial Sequence
  Synthetic Polynucleotide
taatacgactcactatagggggtgatgacgctgcttcgagtcggggtcccaacagaggagagggaccatgactcgaagcaacctggcggcagcgcaaaagatg

SEQ ID NO: 228081 - DNA, 103 bp, Artificial Sequence
  Synthetic Polynucleotide
taatacgactcactatagggccctagcactggtgatgacgctgcttcgagaacagaggagactcgaaatggcgtcatcaaacctggcggcagcgcaaaagatg

SEQ ID NO: 228082 - DNA, 103 bp, Artificial Sequence
  Synthetic Polynucleotide
taatacgactcactatagggtagtgtagctccctagcactggtgatgacgaacagaggagacgtcatatgcagtgctagaacctggcggcagcgcaaaagatg

SEQ ID NO: 228083 - DNA, 103 bp, Artificial Sequence
  Synthetic Polynucleotide
taatacgactcactatagggctctcgcccatagtgtagctccctagcactaacagaggagaagtgctatggagctacacaacctggcggcagcgcaaaagatg

SEQ ID NO: 228084 - DNA, 103 bp, Artificial Sequence
  Synthetic Polynucleotide
taatacgactcactatagggcggcactctcctctcgcccatagtgtagctaacagaggagaagctacatgatgggcgagaacctggcggcagcgcaaaagatg

SEQ ID NO: 228085 - DNA, 103 bp, Artificial Sequence
  Synthetic Polynucleotide
taatacgactcactatagggaccacatcgcacaaagtcccggccagccgcaacagaggagagcggctatgcgggactttaacctggcggcagcgcaaaagatg

SEQ ID NO: 228086 - DNA, 103 bp, Artificial Sequence
  Synthetic Polynucleotide
taatacgactcactatagggggcacctgctcggcactctcctctcgcccaaacagaggagatgggcgatgggagagtgcaacctggcggcagcgcaaaagatg

SEQ ID NO: 228087 - DNA, 103 bp, Artificial Sequence
  Synthetic Polynucleotide
taatacgactcactatagggagctgggggtggcacctgctcggcactctcaacagaggagagagagtatggagcaggtgaacctggcggcagcgcaaaagatg

SEQ ID NO: 228088 - DNA, 103 bp, Artificial Sequence
  Synthetic Polynucleotide
taatacgactcactatagggggccagcctcagctgggggtggcacctgctaacagaggagaagcaggatgcacccccagaacctggcggcagcgcaaaagatg

SEQ ID NO: 228089 - DNA, 103 bp, Artificial Sequence
  Synthetic Polynucleotide
taatacgactcactataggggtgggggcctggccagcctcagctgggggtaacagaggagaacccccatgtgaggctggaacctggcggcagcgcaaaagatg

SEQ ID NO: 228090 - DNA, 103 bp, Artificial Sequence
  Synthetic Polynucleotide
taatacgactcactatagggaggtcggccagtgggggcctggccagcctcaacagaggagagaggctatgcaggcccccaacctggcggcagcgcaaaagatg

SEQ ID NO: 228091 - DNA, 103 bp, Artificial Sequence
  Synthetic Polynucleotide
taatacgactcactatagggctgggtgctcaggtcggccagtgggggcctaacagaggagaaggcccatgctggccgacaacctggcggcagcgcaaaagatg

SEQ ID NO: 228092 - DNA, 103 bp, Artificial Sequence
  Synthetic Polynucleotide
taatacgactcactatagggggcgggggtgctgggtgctcaggtcggccaaacagaggagatggccgatgtgagcacccaacctggcggcagcgcaaaagatg

SEQ ID NO: 228093 - DNA, 103 bp, Artificial Sequence
  Synthetic Polynucleotide
taatacgactcactatagggatgcttctcaggcgggggtgctgggtgctcaacagaggagagagcacatggcacccccgaacctggcggcagcgcaaaagatg

SEQ ID NO: 228094 - DNA, 103 bp, Artificial Sequence
  Synthetic Polynucleotide
taatacgactcactatagggagatgcccagatgcttctcaggcgggggtgaacagaggagacaccccatgctgagaagcaacctggcggcagcgcaaaagatg

SEQ ID NO: 228095 - DNA, 103 bp, Artificial Sequence
  Synthetic Polynucleotide
taatacgactcactatagggaacacggagtagatgcccagatgcttctcaaacagaggagatgagaaatgtctgggcataacctggcggcagcgcaaaagatg

SEQ ID NO: 228096 - DNA, 103 bp, Artificial Sequence
  Synthetic Polynucleotide
taatacgactcactataggggacatgctggctgtgctggggaaagtccataacagaggagaatggacatgccccagcacaacctggcggcagcgcaaaagatg

SEQ ID NO: 228097 - DNA, 103 bp, Artificial Sequence
  Synthetic Polynucleotide
taatacgactcactatagggtgctttatgagccttaaagtgaacaccgtcaacagaggagagacggtatgcactttaagaacctggcggcagcgcaaaagatg

SEQ ID NO: 228098 - DNA, 103 bp, Artificial Sequence
  Synthetic Polynucleotide
taatacgactcactataggggctgcactcccggcacgagaagggcttctcaacagaggagagagaagatgttctcgtgcaacctggcggcagcgcaaaagatg

SEQ ID NO: 228099 - DNA, 103 bp, Artificial Sequence
  Synthetic Polynucleotide
taatacgactcactatagggaaaaggccttgctgcactcccggcacgagaaacagaggagatctcgtatggggagtgcaaacctggcggcagcgcaaaagatg

SEQ ID NO: 228100 - DNA, 103 bp, Artificial Sequence
  Synthetic Polynucleotide
taatacgactcactataggggccgggtcggaaaaggccttgctgcactccaacagaggagaggagtgatgcaaggccttaacctggcggcagcgcaaaagatg

SEQ ID NO: 228101 - DNA, 103 bp, Artificial Sequence
  Synthetic Polynucleotide
taatacgactcactatagggcttgcacgcggccgggtcggaaaaggccttaacagaggagaaaggccatgtccgacccgaacctggcggcagcgcaaaagatg

SEQ ID NO: 228102 - DNA, 103 bp, Artificial Sequence
  Synthetic Polynucleotide
taatacgactcactatagggtctcatgggccttgcacgcggccgggtcggaacagaggagaccgaccatgccgcgtgcaaacctggcggcagcgcaaaagatg

SEQ ID NO: 228103 - DNA, 103 bp, Artificial Sequence
  Synthetic Polynucleotide
taatacgactcactatagggctgtgcgtcttctcatgggccttgcacgcgaacagaggagacgcgtgatgggcccatgaaacctggcggcagcgcaaaagatg

SEQ ID NO: 228104 - DNA, 103 bp, Artificial Sequence
  Synthetic Polynucleotide
taatacgactcactatagggcttcagagggctgtgcgtcttctcatgggcaacagaggagagcccatatgaagacgcacaacctggcggcagcgcaaaagatg

SEQ ID NO: 228105 - DNA, 103 bp, Artificial Sequence
  Synthetic Polynucleotide
taatacgactcactatagggagccgtagggcttcagagggctgtgcgtctaacagaggagaagacgcatggccctctgaaacctggcggcagcgcaaaagatg

SEQ ID NO: 228106 - DNA, 103 bp, Artificial Sequence
  Synthetic Polynucleotide
taatacgactcactatagggcactcctcgcagccgtagggcttcagagggaacagaggagaccctctatggccctacggaacctggcggcagcgcaaaagatg

SEQ ID NO: 228107 - DNA, 103 bp, Artificial Sequence
  Synthetic Polynucleotide
taatacgactcactataggggctcttcccgcactcctcgcagccgtagggaacagaggagaccctacatgtgcgaggagaacctggcggcagcgcaaaagatg

SEQ ID NO: 228108 - DNA, 103 bp, Artificial Sequence
  Synthetic Polynucleotide
taatacgactcactatagggccgccagcactgctttatgagccttaaagtaacagaggagaactttaatgctcataaagaacctggcggcagcgcaaaagatg

SEQ ID NO: 228109 - DNA, 103 bp, Artificial Sequence
  Synthetic Polynucleotide
taatacgactcactatagggtgaggcggtagctcttcccgcactcctcgcaacagaggagagcgaggatggcgggaagaaacctggcggcagcgcaaaagatg

SEQ ID NO: 228110 - DNA, 103 bp, Artificial Sequence
  Synthetic Polynucleotide
taatacgactcactatagggagcaggctgatgaggcggtagctcttcccgaacagaggagacgggaaatgctaccgcctaacctggcggcagcgcaaaagatg

SEQ ID NO: 228111 - DNA, 103 bp, Artificial Sequence
  Synthetic Polynucleotide
taatacgactcactataggggtgcaggttcagcaggctgatgaggcggtaaacagaggagataccgcatgatcagcctgaacctggcggcagcgcaaaagatg

SEQ ID NO: 228112 - DNA, 103 bp, Artificial Sequence
  Synthetic Polynucleotide
taatacgactcactataggggccgcttcttgtgcaggttcagcaggctgaaacagaggagatcagccatgtgaacctgcaacctggcggcagcgcaaaagatg

SEQ ID NO: 228113 - DNA, 103 bp, Artificial Sequence
  Synthetic Polynucleotide
taatacgactcactatagggtcgcccgagtgccgcttcttgtgcaggttcaacagaggagagaacctatgcaagaagcgaacctggcggcagcgcaaaagatg

SEQ ID NO: 228114 - DNA, 103 bp, Artificial Sequence
  Synthetic Polynucleotide
taatacgactcactataggggtagcgcgcctcgcccgagtgccgcttcttaacagaggagaaagaagatgcactcgggcaacctggcggcagcgcaaaagatg

SEQ ID NO: 228115 - DNA, 103 bp, Artificial Sequence
  Synthetic Polynucleotide
taatacgactcactatagggcctcgcagcggtagcgcgcctcgcccgagtaacagaggagaactcggatgaggcgcgctaacctggcggcagcgcaaaagatg

SEQ ID NO: 228116 - DNA, 103 bp, Artificial Sequence
  Synthetic Polynucleotide
taatacgactcactatagggttgccgcagtcctcgcagcggtagcgcgccaacagaggagaggcgcgatgccgctgcgaaacctggcggcagcgcaaaagatg

SEQ ID NO: 228117 - DNA, 103 bp, Artificial Sequence
  Synthetic Polynucleotide
taatacgactcactatagggggtgaagagcttgccgcagtcctcgcagcgaacagaggagacgctgcatggactgcggcaacctggcggcagcgcaaaagatg

SEQ ID NO: 228118 - DNA, 103 bp, Artificial Sequence
  Synthetic Polynucleotide
taatacgactcactatagggtgcccgaggtggtgaagagcttgccgcagtaacagaggagaactgcgatgagctcttcaaacctggcggcagcgcaaaagatg

SEQ ID NO: 228119 - DNA, 103 bp, Artificial Sequence
  Synthetic Polynucleotide
taatacgactcactatagggtcgctgcaggccgccagcactgctttatgaaacagaggagatcataaatgagtgctggcaacctggcggcagcgcaaaagatg

SEQ ID NO: 228120 - DNA, 103 bp, Artificial Sequence
  Synthetic Polynucleotide
taatacgactcactatagggcgcttgaggttgcccgaggtggtgaagagcaacagaggagagctcttatgcacctcgggaacctggcggcagcgcaaaagatg

SEQ ID NO: 228121 - DNA, 103 bp, Artificial Sequence
  Synthetic Polynucleotide
taatacgactcactatagggcagctggtggcgcttgaggttgcccgaggtaacagaggagaacctcgatgaacctcaagaacctggcggcagcgcaaaagatg

SEQ ID NO: 228122 - DNA, 103 bp, Artificial Sequence
  Synthetic Polynucleotide
taatacgactcactatagggcgctgtgcaccagctggtggcgcttgaggtaacagaggagaacctcaatggccaccagcaacctggcggcagcgcaaaagatg

SEQ ID NO: 228123 - DNA, 103 bp, Artificial Sequence
  Synthetic Polynucleotide
taatacgactcactatagggggcttctcgccgctgtgcaccagctggtggaacagaggagaccaccaatgggtgcacagaacctggcggcagcgcaaaagatg

SEQ ID NO: 228124 - DNA, 103 bp, Artificial Sequence
  Synthetic Polynucleotide
taatacgactcactataggggcactggtagggcttctcgccgctgtgcacaacagaggagagtgcacatgggcgagaagaacctggcggcagcgcaaaagatg

SEQ ID NO: 228125 - DNA, 103 bp, Artificial Sequence
  Synthetic Polynucleotide
taatacgactcactatagggcgcagtagtcgcactggtagggcttctcgcaacagaggagagcgagaatgcctaccagtaacctggcggcagcgcaaaagatg

SEQ ID NO: 228126 - DNA, 103 bp, Artificial Sequence
  Synthetic Polynucleotide
taatacgactcactatagggaaggagcggccgcagtagtcgcactggtagaacagaggagactaccaatgcgactactgaacctggcggcagcgcaaaagatg

SEQ ID NO: 228127 - DNA, 103 bp, Artificial Sequence
  Synthetic Polynucleotide
taatacgactcactatagggggggtcggagaaggagcggccgcagtagtcaacagaggagagactacatgggccgctccaacctggcggcagcgcaaaagatg

SEQ ID NO: 228128 - DNA, 103 bp, Artificial Sequence
  Synthetic Polynucleotide
taatacgactcactatagggtcttggaagtggggtcggagaaggagcggcaacagaggagagccgctatgtctccgaccaacctggcggcagcgcaaaagatg

SEQ ID NO: 228129 - DNA, 103 bp, Artificial Sequence
  Synthetic Polynucleotide
taatacgactcactatagggaggtggcgcatcttggaagtggggtcggagaacagaggagactccgaatgcacttccaaaacctggcggcagcgcaaaagatg

SEQ ID NO: 228130 - DNA, 103 bp, Artificial Sequence
  Synthetic Polynucleotide
taatacgactcactatagggcttgaagtactcgctgcaggccgccagcacaacagaggagagtgctgatggcctgcagcaacctggcggcagcgcaaaagatg

SEQ ID NO: 228131 - DNA, 103 bp, Artificial Sequence
  Synthetic Polynucleotide
taatacgactcactataggggtgggtctccaggtggcgcatcttggaagtaacagaggagaacttccatgatgcgccacaacctggcggcagcgcaaaagatg

SEQ ID NO: 228132 - DNA, 103 bp, Artificial Sequence
  Synthetic Polynucleotide
taatacgactcactatagggtgtccgtgtcgtgggtctccaggtggcgcaaacagaggagatgcgccatgtggagacccaacctggcggcagcgcaaaagatg

SEQ ID NO: 228133 - DNA, 103 bp, Artificial Sequence
  Synthetic Polynucleotide
taatacgactcactatagggttgtgctccttgtccgtgtcgtgggtctccaacagaggagaggagacatgcgacacggaaacctggcggcagcgcaaaagatg

SEQ ID NO: 228134 - DNA, 103 bp, Artificial Sequence
  Synthetic Polynucleotide
taatacgactcactataggggtgtgggcacttgtgctccttgtccgtgtcaacagaggagagacacgatgaaggagcacaacctggcggcagcgcaaaagatg

SEQ ID NO: 228135 - DNA, 103 bp, Artificial Sequence
  Synthetic Polynucleotide
taatacgactcactatagggtcttgtcgcagtgtgggcacttgtgctcctaacagaggagaaggagcatgagtgcccacaacctggcggcagcgcaaaagatg

SEQ ID NO: 228136 - DNA, 103 bp, Artificial Sequence
  Synthetic Polynucleotide
taatacgactcactatagggtggttgaacttcttgtcgcagtgtgggcacaacagaggagagtgcccatgctgcgacaaaacctggcggcagcgcaaaagatg

SEQ ID NO: 228137 - DNA, 103 bp, Artificial Sequence
  Synthetic Polynucleotide
taatacgactcactataggggttccctacctggttgaacttcttgtcgcaaacagaggagatgcgacatgaagttcaacaacctggcggcagcgcaaaagatg

SEQ ID NO: 228138 - DNA, 103 bp, Artificial Sequence
  Synthetic Polynucleotide
taatacgactcactataggggggccttcaggttccctacctggttgaactaacagaggagaagttcaatgaggtagggaaacctggcggcagcgcaaaagatg

SEQ ID NO: 228139 - DNA, 103 bp, Artificial Sequence
  Synthetic Polynucleotide
taatacgactcactatagggatcttcaggtgggccttcaggttccctaccaacagaggagaggtaggatgcctgaaggcaacctggcggcagcgcaaaagatg

SEQ ID NO: 228140 - DNA, 103 bp, Artificial Sequence
  Synthetic Polynucleotide
taatacgactcactatagggagcgatgtggatcttcaggtgggccttcagaacagaggagactgaagatgcacctgaagaacctggcggcagcgcaaaagatg

SEQ ID NO: 228141 - DNA, 103 bp, Artificial Sequence
  Synthetic Polynucleotide
taatacgactcactatagggcgaagagcatcttgaagtactcgctgcaggaacagaggagacctgcaatgagtacttcaaacctggcggcagcgcaaaagatg

SEQ ID NO: 228142 - DNA, 103 bp, Artificial Sequence
  Synthetic Polynucleotide
taatacgactcactatagggggggcccgtcagcgatgtggatcttcaggtaacagaggagaacctgaatgtccacatcgaacctggcggcagcgcaaaagatg

SEQ ID NO: 228143 - DNA, 103 bp, Artificial Sequence
  Synthetic Polynucleotide
taatacgactcactatagggcggcacttgaggggcccgtcagcgatgtggaacagaggagaccacatatgtgacgggccaacctggcggcagcgcaaaagatg

SEQ ID NO: 228144 - DNA, 103 bp, Artificial Sequence
  Synthetic Polynucleotide
taatacgactcactatagggcccacactctcggcacttgaggggcccgtcaacagaggagagacgggatgctcaagtgcaacctggcggcagcgcaaaagatg

SEQ ID NO: 228145 - DNA, 103 bp, Artificial Sequence
  Synthetic Polynucleotide
taatacgactcactatagggtgaactgcttcccacactctcggcacttgaaacagaggagatcaagtatggagagtgtgaacctggcggcagcgcaaaagatg

SEQ ID NO: 228146 - DNA, 103 bp, Artificial Sequence
  Synthetic Polynucleotide
taatacgactcactatagggcctgaggtggtgaactgcttcccacactctaacagaggagaagagtgatggaagcagttaacctggcggcagcgcaaaagatg

SEQ ID NO: 228147 - DNA, 103 bp, Artificial Sequence
  Synthetic Polynucleotide
taatacgactcactatagggcttcaggttccctgaggtggtgaactgcttaacagaggagaaagcagatgaccacctcaaacctggcggcagcgcaaaagatg

SEQ ID NO: 228148 - DNA, 103 bp, Artificial Sequence
  Synthetic Polynucleotide
taatacgactcactataggggaaggtgccgcttcaggttccctgaggtggaacagaggagaccacctatgggaacctgaaacctggcggcagcgcaaaagatg

SEQ ID NO: 228149 - DNA, 103 bp, Artificial Sequence
  Synthetic Polynucleotide
taatacgactcactatagggctgtggatccgaaggtgccgcttcaggttcaacagaggagagaacctatggcggcacctaacctggcggcagcgcaaaagatg

SEQ ID NO: 228150 - DNA, 103 bp, Artificial Sequence
  Synthetic Polynucleotide
taatacgactcactatagggcttctccccgctgtggatccgaaggtgccgaacagaggagacggcacatgcggatccacaacctggcggcagcgcaaaagatg

SEQ ID NO: 228151 - DNA, 103 bp, Artificial Sequence
  Synthetic Polynucleotide
taatacgactcactatagggacacgtagggcttctccccgctgtggatccaacagaggagaggatccatggcggggagaaacctggcggcagcgcaaaagatg

SEQ ID NO: 228152 - DNA, 103 bp, Artificial Sequence
  Synthetic Polynucleotide
taatacgactcactatagggttctggtccacgaagagcatcttgaagtacaacagaggagagtacttatggatgctcttaacctggcggcagcgcaaaagatg

SEQ ID NO: 228153 - DNA, 103 bp, Artificial Sequence
  Synthetic Polynucleotide
taatacgactcactatagggcagtggatgcacacgtagggcttctccccgaacagaggagacggggaatggccctacgtaacctggcggcagcgcaaaagatg

SEQ ID NO: 228154 - DNA, 103 bp, Artificial Sequence
  Synthetic Polynucleotide
taatacgactcactatagggctgtcgctggcagtggatgcacacgtagggaacagaggagaccctacatgtgcatccacaacctggcggcagcgcaaaagatg

SEQ ID NO: 228155 - DNA, 103 bp, Artificial Sequence
  Synthetic Polynucleotide
taatacgactcactatagggggtctgcaaactgtcgctggcagtggatgcaacagaggagagcatccatggccagcgacaacctggcggcagcgcaaaagatg

SEQ ID NO: 228156 - DNA, 103 bp, Artificial Sequence
  Synthetic Polynucleotide
taatacgactcactatagggagagcgccggggtctgcaaactgtcgctggaacagaggagaccagcgatggtttgcagaaacctggcggcagcgcaaaagatg

SEQ ID NO: 228157 - DNA, 103 bp, Artificial Sequence
  Synthetic Polynucleotide
taatacgactcactataggggtgccgctgcagagcgccggggtctgcaaaaacagaggagatttgcaatgcccggcgctaacctggcggcagcgcaaaagatg

SEQ ID NO: 228158 - DNA, 103 bp, Artificial Sequence
  Synthetic Polynucleotide
taatacgactcactataggggaatgcggacgtgccgctgcagagcgccggaacagaggagaccggcgatgtgcagcggcaacctggcggcagcgcaaaagatg

SEQ ID NO: 228159 - DNA, 103 bp, Artificial Sequence
  Synthetic Polynucleotide
taatacgactcactatagggtcacctgtgtgaatgcggacgtgccgctgcaacagaggagagcagcgatgcgtccgcataacctggcggcagcgcaaaagatg

SEQ ID NO: 228160 - DNA, 103 bp, Artificial Sequence
  Synthetic Polynucleotide
taatacgactcactataggggcatggcttctcacctgtgtgaatgcggacaacagaggagagtccgcatgcacacaggtaacctggcggcagcgcaaaagatg

SEQ ID NO: 228161 - DNA, 103 bp, Artificial Sequence
  Synthetic Polynucleotide
taatacgactcactatagggtcacacactggcatggcttctcacctgtgtaacagaggagaacacagatgagaagccataacctggcggcagcgcaaaagatg

SEQ ID NO: 228162 - DNA, 103 bp, Artificial Sequence
  Synthetic Polynucleotide
taatacgactcactatagggttaccgcacatcacacactggcatggcttcaacagaggagagaagccatgccagtgtgtaacctggcggcagcgcaaaagatg

SEQ ID NO: 228163 - DNA, 103 bp, Artificial Sequence
  Synthetic Polynucleotide
taatacgactcactatagggcaccacgtccttctggtccacgaagagcataacagaggagaatgctcatggtggaccagaacctggcggcagcgcaaaagatg

SEQ ID NO: 228164 - DNA, 103 bp, Artificial Sequence
  Synthetic Polynucleotide
taatacgactcactatagggggtgaaggccttaccgcacatcacacactgaacagaggagacagtgtatgatgtgcggtaacctggcggcagcgcaaaagatg

SEQ ID NO: 228165 - DNA, 103 bp, Artificial Sequence
  Synthetic Polynucleotide
taatacgactcactatagggagctggcctgggtgaaggccttaccgcacaaacagaggagatgtgcgatgaggccttcaaacctggcggcagcgcaaaagatg

SEQ ID NO: 228166 - DNA, 103 bp, Artificial Sequence
  Synthetic Polynucleotide
taatacgactcactataggggcgatgagggagctggcctgggtgaaggccaacagaggagaggccttatgccaggccagaacctggcggcagcgcaaaagatg

SEQ ID NO: 228167 - DNA, 103 bp, Artificial Sequence
  Synthetic Polynucleotide
taatacgactcactataggggcgcacgtgggcgatgagggagctggcctgaacagaggagacaggccatgtccctcatcaacctggcggcagcgcaaaagatg

SEQ ID NO: 228168 - DNA, 103 bp, Artificial Sequence
  Synthetic Polynucleotide
taatacgactcactatagggcggtgtgctggcgcacgtgggcgatgagggaacagaggagaccctcaatgcccacgtgcaacctggcggcagcgcaaaagatg

SEQ ID NO: 228169 - DNA, 103 bp, Artificial Sequence
  Synthetic Polynucleotide
taatacgactcactatagggggcttctccccggtgtgctggcgcacgtggaacagaggagaccacgtatgccagcacacaacctggcggcagcgcaaaagatg

SEQ ID NO: 228170 - DNA, 103 bp, Artificial Sequence
  Synthetic Polynucleotide
taatacgactcactataggggcagacgtagggcttctccccggtgtgctgaacagaggagacagcacatgggggagaagaacctggcggcagcgcaaaagatg

SEQ ID NO: 228171 - DNA, 103 bp, Artificial Sequence
  Synthetic Polynucleotide
taatacgactcactatagggcgcagcgctcgcagacgtagggcttctcccaacagaggagagggagaatgcctacgtctaacctggcggcagcgcaaaagatg

SEQ ID NO: 228172 - DNA, 103 bp, Artificial Sequence
  Synthetic Polynucleotide
taatacgactcactatagggaatctcttgccgcagcgctcgcagacgtagaacagaggagactacgtatgcgagcgctgaacctggcggcagcgcaaaagatg

SEQ ID NO: 228173 - DNA, 103 bp, Artificial Sequence
  Synthetic Polynucleotide
taatacgactcactatagggggactggacgaatctcttgccgcagcgctcaacagaggagagagcgcatgggcaagagaaacctggcggcagcgcaaaagatg

SEQ ID NO: 228174 - DNA, 103 bp, Artificial Sequence
  Synthetic Polynucleotide
taatacgactcactatagggtgtccaggtgcaccacgtccttctggtccaaacagaggagatggaccatgaggacgtggaacctggcggcagcgcaaaagatg

SEQ ID NO: 228175 - DNA, 103 bp, Artificial Sequence
  Synthetic Polynucleotide
taatacgactcactatagggccaactggctggactggacgaatctcttgcaacagaggagagcaagaatgtcgtccagtaacctggcggcagcgcaaaagatg

SEQ ID NO: 228176 - DNA, 103 bp, Artificial Sequence
  Synthetic Polynucleotide
taatacgactcactatagggatatgattggccaactggctggactggacgaacagaggagacgtccaatgcagccagttaacctggcggcagcgcaaaagatg

SEQ ID NO: 228177 - DNA, 103 bp, Artificial Sequence
  Synthetic Polynucleotide
taatacgactcactataggggtggtggcgaatatgattggccaactggctaacagaggagaagccagatggccaatcataacctggcggcagcgcaaaagatg

SEQ ID NO: 228178 - DNA, 103 bp, Artificial Sequence
  Synthetic Polynucleotide
taatacgactcactatagggggatgttgtcgtggtggcgaatatgattggaacagaggagaccaatcatgttcgccaccaacctggcggcagcgcaaaagatg

SEQ ID NO: 228179 - DNA, 103 bp, Artificial Sequence
  Synthetic Polynucleotide
taatacgactcactatagggttgtgtgggcggatgttgtcgtggtggcgaaacagaggagatcgccaatgcgacaacataacctggcggcagcgcaaaagatg

SEQ ID NO: 228180 - DNA, 103 bp, Artificial Sequence
  Synthetic Polynucleotide
taatacgactcactatagggcacgctgcacttgtgtgggcggatgttgtcaacagaggagagacaacatgcgcccacacaacctggcggcagcgcaaaagatg

SEQ ID NO: 228181 - DNA, 103 bp, Artificial Sequence
  Synthetic Polynucleotide
taatacgactcactatagggccttgctgcacacgctgcacttgtgtgggcaacagaggagagcccacatgagtgcagcgaacctggcggcagcgcaaaagatg

SEQ ID NO: 228182 - DNA, 103 bp, Artificial Sequence
  Synthetic Polynucleotide
taatacgactcactatagggttcacgaaggccttgctgcacacgctgcacaacagaggagagtgcagatggtgcagcaaaacctggcggcagcgcaaaagatg

SEQ ID NO: 228183 - DNA, 103 bp, Artificial Sequence
  Synthetic Polynucleotide
taatacgactcactataggggtcccccacgttcacgaaggccttgctgcaaacagaggagatgcagcatggccttcgtgaacctggcggcagcgcaaaagatg

SEQ ID NO: 228184 - DNA, 103 bp, Artificial Sequence
  Synthetic Polynucleotide
taatacgactcactataggggcttggacaggtcccccacgttcacgaaggaacagaggagaccttcgatgacgtgggggaacctggcggcagcgcaaaagatg

SEQ ID NO: 228185 - DNA, 103 bp, Artificial Sequence
  Synthetic Polynucleotide
taatacgactcactataggggcgttactgatgtccaggtgcaccacgtccaacagaggagaggacgtatggcacctggaaacctggcggcagcgcaaaagatg

SEQ ID NO: 228186 - DNA, 103 bp, Artificial Sequence
  Synthetic Polynucleotide
taatacgactcactatagggatgatgatgtgcttggacaggtcccccacgaacagaggagacgtgggatgcctgtccaaaacctggcggcagcgcaaaagatg

SEQ ID NO: 228187 - DNA, 103 bp, Artificial Sequence
  Synthetic Polynucleotide
taatacgactcactatagggtccagtgtgaatgatgatgtgcttggacagaacagaggagactgtccatgcacatcatcaacctggcggcagcgcaaaagatg

SEQ ID NO: 228188 - DNA, 103 bp, Artificial Sequence
  Synthetic Polynucleotide
taatacgactcactatagggaaggcttctctccagtgtgaatgatgatgtaacagaggagaacatcaatgttcacactgaacctggcggcagcgcaaaagatg

SEQ ID NO: 228189 - DNA, 103 bp, Artificial Sequence
  Synthetic Polynucleotide
taatacgactcactatagggtcacacaggtaaggcttctctccagtgtgaaacagaggagatcacacatgagagaagccaacctggcggcagcgcaaaagatg

SEQ ID NO: 228190 - DNA, 103 bp, Artificial Sequence
  Synthetic Polynucleotide
taatacgactcactatagggcccacacttatcacacaggtaaggcttctcaacagaggagagagaagatgtacctgtgtaacctggcggcagcgcaaaagatg

SEQ ID NO: 228191 - DNA, 103 bp, Artificial Sequence
  Synthetic Polynucleotide
taatacgactcactatagggtgaagccacgcccacacttatcacacaggtaacagaggagaacctgtatgataagtgtgaacctggcggcagcgcaaaagatg

SEQ ID NO: 228192 - DNA, 103 bp, Artificial Sequence
  Synthetic Polynucleotide
taatacgactcactatagggtctacccggttgaagccacgcccacacttaaacagaggagataagtgatggcgtggcttaacctggcggcagcgcaaaagatg

SEQ ID NO: 228193 - DNA, 103 bp, Artificial Sequence
  Synthetic Polynucleotide
taatacgactcactataggggcgcaggttgtctacccggttgaagccacgaacagaggagacgtggcatgaaccgggtaaacctggcggcagcgcaaaagatg

SEQ ID NO: 228194 - DNA, 103 bp, Artificial Sequence
  Synthetic Polynucleotide
taatacgactcactatagggtcacgtgggagcgcaggttgtctacccggtaacagaggagaaccgggatgacaacctgcaacctggcggcagcgcaaaagatg

SEQ ID NO: 228195 - DNA, 103 bp, Artificial Sequence
  Synthetic Polynucleotide
taatacgactcactatagggtgcacggtcttcacgtgggagcgcaggttgaacagaggagacaacctatgctcccacgtaacctggcggcagcgcaaaagatg

SEQ ID NO: 228196 - DNA, 103 bp, Artificial Sequence
  Synthetic Polynucleotide
taatacgactcactatagggcaggcctgccgcgttactgatgtccaggtgaacagaggagacacctgatgatcagtaacaacctggcggcagcgcaaaagatg

SEQ ID NO: 228197 - DNA, 103 bp, Artificial Sequence
  Synthetic Polynucleotide
taatacgactcactatagggcttgccctggtgcacggtcttcacgtgggaaacagaggagatcccacatgaagaccgtgaacctggcggcagcgcaaaagatg

SEQ ID NO: 228198 - DNA, 103 bp, Artificial Sequence
  Synthetic Polynucleotide
taatacgactcactatagggtgatgcctgccttgccctggtgcacggtctaacagaggagaagaccgatgaccagggcaaacctggcggcagcgcaaaagatg

SEQ ID NO: 228199 - DNA, 103 bp, Artificial Sequence
  Synthetic Polynucleotide
taatacgactcactatagggtccaggatcttgatgcctgccttgccctggaacagaggagaccagggatgggcaggcataacctggcggcagcgcaaaagatg

SEQ ID NO: 228200 - DNA, 103 bp, Artificial Sequence
  Synthetic Polynucleotide
taatacgactcactatagggctcctcgggctccaggatcttgatgcctgcaacagaggagagcaggcatgaagatcctgaacctggcggcagcgcaaaagatg

SEQ ID NO: 228201 - DNA, 103 bp, Artificial Sequence
  Synthetic Polynucleotide
taatacgactcactatagggcctcactgccctcctcgggctccaggatctaacagaggagaagatccatgagcccgaggaacctggcggcagcgcaaaagatg

SEQ ID NO: 228202 - DNA, 103 bp, Artificial Sequence
  Synthetic Polynucleotide
taatacgactcactatagggaccacgctgacctcactgccctcctcgggcaacagaggagagcccgaatggggcagtgaaacctggcggcagcgcaaaagatg

SEQ ID NO: 228203 - DNA, 103 bp, Artificial Sequence
  Synthetic Polynucleotide
taatacgactcactatagggatccacagtgaccacgctgacctcactgccaacagaggagaggcagtatggtcagcgtgaacctggcggcagcgcaaaagatg

SEQ ID NO: 228204 - DNA, 103 bp, Artificial Sequence
  Synthetic Polynucleotide
taatacgactcactatagggtgaccatgtcatccacagtgaccacgctgaaacagaggagatcagcgatgtcactgtggaacctggcggcagcgcaaaagatg

SEQ ID NO: 228205 - DNA, 103 bp, Artificial Sequence
  Synthetic Polynucleotide
taatacgactcactataggggtagccagcgtgaccatgtcatccacagtgaacagaggagacactgtatgtgacatggtaacctggcggcagcgcaaaagatg

SEQ ID NO: 228206 - DNA, 103 bp, Artificial Sequence
  Synthetic Polynucleotide
taatacgactcactatagggcagtgcctcggtagccagcgtgaccatgtcaacagaggagagacatgatgacgctggctaacctggcggcagcgcaaaagatg

SEQ ID NO: 228207 - DNA, 103 bp, Artificial Sequence
  Synthetic Polynucleotide
taatacgactcactataggggctgttccaagacatgctggctgtgctgggaacagaggagacccagcatggccagcatgaacctggcggcagcgcaaaagatg

SEQ ID NO: 228208 - DNA, 103 bp, Artificial Sequence
  Synthetic Polynucleotide
taatacgactcactataggggcacctgccccaggcctgccgcgttactgaaacagaggagatcagtaatgcggcaggccaacctggcggcagcgcaaaagatg

SEQ ID NO: 228209 - DNA, 103 bp, Artificial Sequence
  Synthetic Polynucleotide
taatacgactcactatagggctgtcgctgccagtgcctcggtagccagcgaacagaggagacgctggatgccgaggcacaacctggcggcagcgcaaaagatg

SEQ ID NO: 228210 - DNA, 103 bp, Artificial Sequence
  Synthetic Polynucleotide
taatacgactcactatagggtgagtgacggctgtcgctgccagtgcctcgaacagaggagacgaggcatgggcagcgacaacctggcggcagcgcaaaagatg

SEQ ID NO: 228211 - DNA, 103 bp, Artificial Sequence
  Synthetic Polynucleotide
taatacgactcactataggggcctgtgagctgagtgacggctgtcgctgcaacagaggagagcagcgatggccgtcactaacctggcggcagcgcaaaagatg

SEQ ID NO: 228212 - DNA, 103 bp, Artificial Sequence
  Synthetic Polynucleotide
taatacgactcactataggggagtcgcagggcctgtgagctgagtgacggaacagaggagaccgtcaatgagctcacagaacctggcggcagcgcaaaagatg

SEQ ID NO: 228213 - DNA, 103 bp, Artificial Sequence
  Synthetic Polynucleotide
taatacgactcactatagggactgcgggcagagtcgcagggcctgtgagcaacagaggagagctcacatgccctgcgacaacctggcggcagcgcaaaagatg

SEQ ID NO: 228214 - DNA, 103 bp, Artificial Sequence
  Synthetic Polynucleotide
taatacgactcactatagggcaccggcaccactgcgggcagagtcgcaggaacagaggagacctgcgatgctgcccgcaaacctggcggcagcgcaaaagatg

SEQ ID NO: 228215 - DNA, 103 bp, Artificial Sequence
  Synthetic Polynucleotide
taatacgactcactatagggctgcagctcccaccggcaccactgcgggcaaacagaggagatgcccgatgtggtgccggaacctggcggcagcgcaaaagatg

SEQ ID NO: 228216 - DNA, 103 bp, Artificial Sequence
  Synthetic Polynucleotide
taatacgactcactatagggtcggctgtcactgcagctcccaccggcaccaacagaggagaggtgccatggggagctgcaacctggcggcagcgcaaaagatg

SEQ ID NO: 228217 - DNA, 103 bp, Artificial Sequence
  Synthetic Polynucleotide
taatacgactcactatagggttccgtctcatcggctgtcactgcagctccaacagaggagaggagctatggtgacagccaacctggcggcagcgcaaaagatg

SEQ ID NO: 228218 - DNA, 103 bp, Artificial Sequence
  Synthetic Polynucleotide
taatacgactcactatagggccttcaggacttccgtctcatcggctgtcaaacagaggagatgacagatgatgagacggaacctggcggcagcgcaaaagatg

SEQ ID NO: 228219 - DNA, 103 bp, Artificial Sequence
  Synthetic Polynucleotide
taatacgactcactatagggataaactccagcacctgccccaggcctgccaacagaggagaggcaggatgggggcaggtaacctggcggcagcgcaaaagatg

SEQ ID NO: 228220 - DNA, 103 bp, Artificial Sequence
  Synthetic Polynucleotide
taatacgactcactatagggctgatctcggccttcaggacttccgtctcaaacagaggagatgagacatgagtcctgaaaacctggcggcagcgcaaaagatg

SEQ ID NO: 228221 - DNA, 103 bp, Artificial Sequence
  Synthetic Polynucleotide
taatacgactcactatagggcacagctttgctgatctcggccttcaggacaacagaggagagtcctgatggccgagatcaacctggcggcagcgcaaaagatg

SEQ ID NO: 228222 - DNA, 103 bp, Artificial Sequence
  Synthetic Polynucleotide
taatacgactcactataggggcacttgcttcacagctttgctgatctcggaacagaggagaccgagaatggcaaagctgaacctggcggcagcgcaaaagatg

SEQ ID NO: 228223 - DNA, 103 bp, Artificial Sequence
  Synthetic Polynucleotide
taatacgactcactatagggtcttcttcctgcacttgcttcacagctttgaacagaggagacaaagcatggaagcaagtaacctggcggcagcgcaaaagatg

SEQ ID NO: 228224 - DNA, 103 bp, Artificial Sequence
  Synthetic Polynucleotide
taatacgactcactatagggagtgttggggtcttcttcctgcacttgcttaacagaggagaaagcaaatgcaggaagaaaacctggcggcagcgcaaaagatg

SEQ ID NO: 228225 - DNA, 103 bp, Artificial Sequence
  Synthetic Polynucleotide
taatacgactcactatagggagaggatgtgagtgttggggtcttcttcctaacagaggagaaggaagatgaccccaacaaacctggcggcagcgcaaaagatg

SEQ ID NO: 228226 - DNA, 103 bp, Artificial Sequence
  Synthetic Polynucleotide
taatacgactcactatagggtcacaggcgtagaggatgtgagtgttggggaacagaggagaccccaaatgtcacatcctaacctggcggcagcgcaaaagatg

SEQ ID NO: 228227 - DNA, 103 bp, Artificial Sequence
  Synthetic Polynucleotide
taatacgactcactatagggcccacaggagtcacaggcgtagaggatgtgaacagaggagacacatcatgtacgcctgtaacctggcggcagcgcaaaagatg

SEQ ID NO: 228228 - DNA, 103 bp, Artificial Sequence
  Synthetic Polynucleotide
taatacgactcactataggggaaacttgtccccacaggagtcacaggcgtaacagaggagaacgcctatgactcctgtgaacctggcggcagcgcaaaagatg

SEQ ID NO: 228229 - DNA, 103 bp, Artificial Sequence
  Synthetic Polynucleotide
taatacgactcactatagggttggcatccagaaacttgtccccacaggagaacagaggagactcctgatgggacaagttaacctggcggcagcgcaaaagatg

SEQ ID NO: 228230 - DNA, 103 bp, Artificial Sequence
  Synthetic Polynucleotide
taatacgactcactatagggggccgtgtacataaactccagcacctgcccaacagaggagagggcagatgctggagtttaacctggcggcagcgcaaaagatg

SEQ ID NO: 228231 - DNA, 103 bp, Artificial Sequence
  Synthetic Polynucleotide
taatacgactcactatagggagccaggctgttggcatccagaaacttgtcaacagaggagagacaagatgctggatgccaacctggcggcagcgcaaaagatg

SEQ ID NO: 228232 - DNA, 103 bp, Artificial Sequence
  Synthetic Polynucleotide
taatacgactcactataggggcacatgctgagccaggctgttggcatccaaacagaggagatggatgatgacagcctggaacctggcggcagcgcaaaagatg

SEQ ID NO: 228233 - DNA, 103 bp, Artificial Sequence
  Synthetic Polynucleotide
taatacgactcactataggggtgtggattcgcacatgctgagccaggctgaacagaggagacagcctatgtcagcatgtaacctggcggcagcgcaaaagatg

SEQ ID NO: 228234 - DNA, 103 bp, Artificial Sequence
  Synthetic Polynucleotide
taatacgactcactatagggtgcctgggctgtgtggattcgcacatgctgaacagaggagacagcatatgcgaatccacaacctggcggcagcgcaaaagatg

SEQ ID NO: 228235 - DNA, 103 bp, Artificial Sequence
  Synthetic Polynucleotide
taatacgactcactatagggacatgaccagtgcctgggctgtgtggattcaacagaggagagaatccatgcagcccaggaacctggcggcagcgcaaaagatg

SEQ ID NO: 228236 - DNA, 103 bp, Artificial Sequence
  Synthetic Polynucleotide
taatacgactcactatagggtctgtctggaacatgaccagtgcctgggctaacagaggagaagcccaatgactggtcataacctggcggcagcgcaaaagatg

SEQ ID NO: 228237 - DNA, 103 bp, Artificial Sequence
  Synthetic Polynucleotide
taatacgactcactataggggaagtccgcgtctgtctggaacatgaccagaacagaggagactggtcatgttccagacaaacctggcggcagcgcaaaagatg

SEQ ID NO: 228238 - DNA, 103 bp, Artificial Sequence
  Synthetic Polynucleotide
taatacgactcactatagggactgctgatagaagtccgcgtctgtctggaaacagaggagatccagaatgacgcggactaacctggcggcagcgcaaaagatg

SEQ ID NO: 228239 - DNA, 103 bp, Artificial Sequence
  Synthetic Polynucleotide
taatacgactcactatagggcctggcccatactgctgatagaagtccgcgaacagaggagacgcggaatgctatcagcaaacctggcggcagcgcaaaagatg

SEQ ID NO: 228240 - DNA, 103 bp, Artificial Sequence
  Synthetic Polynucleotide
taatacgactcactatagggccacgtgccacctggcccatactgctgataaacagaggagatatcagatgtatgggccaaacctggcggcagcgcaaaagatg

SEQ ID NO: 228241 - DNA, 103 bp, Artificial Sequence
  Synthetic Polynucleotide
taatacgactcactatagggggctcagcttggccgtgtacataaactccaaacagaggagatggagtatgtgtacacggaacctggcggcagcgcaaaagatg

SEQ ID NO: 228242 - DNA, 103 bp, Artificial Sequence
  Synthetic Polynucleotide
taatacgactcactataggggcccggcaggccacgtgccacctggcccataacagaggagaatgggcatggtggcacgtaacctggcggcagcgcaaaagatg

SEQ ID NO: 228243 - DNA, 103 bp, Artificial Sequence
  Synthetic Polynucleotide
taatacgactcactatagggtgcagcacctgcccggcaggccacgtgccaaacagaggagatggcacatggcctgccggaacctggcggcagcgcaaaagatg

SEQ ID NO: 228244 - DNA, 103 bp, Artificial Sequence
  Synthetic Polynucleotide
taatacgactcactatagggctccccagcctgcagcacctgcccggcaggaacagaggagacctgccatgcaggtgctgaacctggcggcagcgcaaaagatg

SEQ ID NO: 228245 - DNA, 103 bp, Artificial Sequence
  Synthetic Polynucleotide
taatacgactcactatagggggaagaccagctccccagcctgcagcacctaacagaggagaaggtgcatgaggctggggaacctggcggcagcgcaaaagatg

SEQ ID NO: 228246 - DNA, 103 bp, Artificial Sequence
  Synthetic Polynucleotide
taatacgactcactatagggtcgcgagggcggaagaccagctccccagccaacagaggagaggctggatggctggtcttaacctggcggcagcgcaaaagatg

SEQ ID NO: 228247 - DNA, 103 bp, Artificial Sequence
  Synthetic Polynucleotide
taatacgactcactatagggctcagccccgtcgcgagggcggaagaccagaacagaggagactggtcatgcgccctcgcaacctggcggcagcgcaaaagatg

SEQ ID NO: 228248 - DNA, 103 bp, Artificial Sequence
  Synthetic Polynucleotide
taatacgactcactatagggcgggctggccctcagccccgtcgcgagggcaacagaggagagccctcatgacggggctgaacctggcggcagcgcaaaagatg

SEQ ID NO: 228249 - DNA, 103 bp, Artificial Sequence
  Synthetic Polynucleotide
taatacgactcactatagggtctgccagtgcgggctggccctcagccccgaacagaggagacggggcatggggccagccaacctggcggcagcgcaaaagatg

SEQ ID NO: 228250 - DNA, 103 bp, Artificial Sequence
  Synthetic Polynucleotide
taatacgactcactatagggaggggaggtctctgccagtgcgggctggccaacagaggagaggccagatggcactggcaaacctggcggcagcgcaaaagatg

SEQ ID NO: 228251 - DNA, 103 bp, Artificial Sequence
  Synthetic Polynucleotide
taatacgactcactatagggcaggagctgtaggggaggtctctgccagtgaacagaggagacactggatgagacctcccaacctggcggcagcgcaaaagatg

SEQ ID NO: 228252 - DNA, 103 bp, Artificial Sequence
  Synthetic Polynucleotide
taatacgactcactatagggtcagggctcaggctcagcttggccgtgtacaacagaggagagtacacatgcaagctgagaacctggcggcagcgcaaaagatg

SEQ ID NO: 228253 - DNA, 103 bp, Artificial Sequence
  Synthetic Polynucleotide
taatacgactcactataggggggggacattcaggagctgtaggggaggtcaacagaggagagacctcatgtacagctccaacctggcggcagcgcaaaagatg

SEQ ID NO: 228254 - DNA, 103 bp, Artificial Sequence
  Synthetic Polynucleotide
taatacgactcactatagggctcggcaggcgggggacattcaggagctgtaacagaggagaacagctatggaatgtcccaacctggcggcagcgcaaaagatg

SEQ ID NO: 228255 - DNA, 103 bp, Artificial Sequence
  Synthetic Polynucleotide
taatacgactcactatagggatccacgttctcagggctcaggctcagcttaacagaggagaaagctgatgctgagccctaacctggcggcagcgcaaaagatg

SEQ ID NO: 228256 - DNA, 103 bp, Artificial Sequence
  Synthetic Polynucleotide
taatacgactcactatagggccagcacatcatccacgttctcagggctcaaacagaggagatgagccatgagaacgtggaacctggcggcagcgcaaaagatg

SEQ ID NO: 228257 - DNA, 103 bp, Artificial Sequence
  Synthetic Polynucleotide
taatacgactcactataggggtggccacggccagcacatcatccacgttcaacagaggagagaacgtatgtgatgtgctaacctggcggcagcgcaaaagatg

SEQ ID NO: 228258 - DNA, 103 bp, Artificial Sequence
  Synthetic Polynucleotide
taatacgactcactatagggttggaggaaagtggccacggccagcacatcaacagaggagagatgtgatggccgtggccaacctggcggcagcgcaaaagatg

SEQ ID NO: 228259 - DNA, 103 bp, Artificial Sequence
  Synthetic Polynucleotide
taatacgactcactatagggtgtcctgcatttggaggaaagtggccacggaacagaggagaccgtggatgctttcctccaacctggcggcagcgcaaaagatg

SEQ ID NO: 228260 - DNA, 103 bp, Artificial Sequence
  Synthetic Polynucleotide
taatacgactcactatagggtgctggttcagctgttccaagacatgctggaacagaggagaccagcaatgcttggaacaaacctggcggcagcgcaaaagatg

SEQ ID NO: 228261 - DNA, 103 bp, Artificial Sequence
  Synthetic Polynucleotide
taatacgactcactataggggccgtgatgatgtcctgcatttggaggaaaaacagaggagatttcctatgaatgcaggaaacctggcggcagcgcaaaagatg

SEQ ID NO: 228262 - DNA, 103 bp, Artificial Sequence
  Synthetic Polynucleotide
taatacgactcactatagggggcatggcaggccgtgatgatgtcctgcataacagaggagaatgcagatgatcatcacgaacctggcggcagcgcaaaagatg

SEQ ID NO: 228263 - DNA, 103 bp, Artificial Sequence
  Synthetic Polynucleotide
taatacgactcactataggggtgacttgagggcatggcaggccgtgatgaaacagaggagatcatcaatgcctgccatgaacctggcggcagcgcaaaagatg

SEQ ID NO: 228264 - DNA, 103 bp, Artificial Sequence
  Synthetic Polynucleotide
taatacgactcactatagggggctcagcaagtgacttgagggcatggcagaacagaggagactgccaatgcctcaagtcaacctggcggcagcgcaaaagatg

SEQ ID NO: 228265 - DNA, 103 bp, Artificial Sequence
  Synthetic Polynucleotide
taatacgactcactataggggctggtagccggctcagcaagtgacttgagaacagaggagactcaagatgcttgctgagaacctggcggcagcgcaaaagatg

SEQ ID NO: 228266 - DNA, 103 bp, Artificial Sequence
  Synthetic Polynucleotide
taatacgactcactatagggttcccccagggctggtagccggctcagcaaaacagaggagattgctgatgcggctaccaaacctggcggcagcgcaaaagatg

SEQ ID NO: 228267 - DNA, 103 bp, Artificial Sequence
  Synthetic Polynucleotide
taatacgactcactataggggcctccgcatttcccccagggctggtagccaacagaggagaggctacatgccctgggggaacctggcggcagcgcaaaagatg

SEQ ID NO: 228268 - DNA, 103 bp, Artificial Sequence
  Synthetic Polynucleotide
taatacgactcactatagggtgtggccaaggcctccgcatttcccccaggaacagaggagacctgggatgaatgcggagaacctggcggcagcgcaaaagatg

SEQ ID NO: 228269 - DNA, 103 bp, Artificial Sequence
  Synthetic Polynucleotide
taatacgactcactatagggcccctccttctgtggccaaggcctccgcataacagaggagaatgcggatgccttggccaaacctggcggcagcgcaaaagatg

SEQ ID NO: 228270 - DNA, 103 bp, Artificial Sequence
  Synthetic Polynucleotide
taatacgactcactataggggctctcttgtcccctccttctgtggccaagaacagaggagacttggcatgagaaggaggaacctggcggcagcgcaaaagatg

SEQ ID NO: 228271 - DNA, 103 bp, Artificial Sequence
  Synthetic Polynucleotide
taatacgactcactatagggcagctgccgctgctggttcagctgttccaaaacagaggagattggaaatgctgaaccagaacctggcggcagcgcaaaagatg

SEQ ID NO: 228272 - DNA, 103 bp, Artificial Sequence
  Synthetic Polynucleotide
taatacgactcactatagggctcctctttggctctcttgtcccctccttcaacagaggagagaaggaatggacaagagaaacctggcggcagcgcaaaagatg

SEQ ID NO: 228273 - DNA, 103 bp, Artificial Sequence
  Synthetic Polynucleotide
taatacgactcactatagggtggccaccttctcctctttggctctcttgtaacagaggagaacaagaatgccaaagaggaacctggcggcagcgcaaaagatg

SEQ ID NO: 228274 - DNA, 103 bp, Artificial Sequence
  Synthetic Polynucleotide
taatacgactcactatagggagcgtgctggtggccaccttctcctctttgaacagaggagacaaagaatggaaggtggcaacctggcggcagcgcaaaagatg

SEQ ID NO: 228275 - DNA, 103 bp, Artificial Sequence
  Synthetic Polynucleotide
taatacgactcactatagggcagcctgctcagcgtgctggtggccaccttaacagaggagaaaggtgatgaccagcacgaacctggcggcagcgcaaaagatg

SEQ ID NO: 228276 - DNA, 103 bp, Artificial Sequence
  Synthetic Polynucleotide
taatacgactcactatagggctgcctgctccagcctgctcagcgtgctggaacagaggagaccagcaatgtgagcaggcaacctggcggcagcgcaaaagatg

SEQ ID NO: 228277 - DNA, 103 bp, Artificial Sequence
  Synthetic Polynucleotide
taatacgactcactataggggtgctgcgtcctgcctgctccagcctgctcaacagaggagagagcagatgggagcaggcaacctggcggcagcgcaaaagatg

SEQ ID NO: 228278 - DNA, 103 bp, Artificial Sequence
  Synthetic Polynucleotide
taatacgactcactataggggcctatgggtgtgctgcgtcctgcctgctcaacagaggagagagcagatgggacgcagcaacctggcggcagcgcaaaagatg

SEQ ID NO: 228279 - DNA, 103 bp, Artificial Sequence
  Synthetic Polynucleotide
taatacgactcactatagggccctgctggggcctatgggtgtgctgcgtcaacagaggagagacgcaatgcacccatagaacctggcggcagcgcaaaagatg

SEQ ID NO: 228280 - DNA, 103 bp, Artificial Sequence
  Synthetic Polynucleotide
taatacgactcactatagggtccttgaggtccctgctggggcctatgggtaacagaggagaacccatatgccccagcagaacctggcggcagcgcaaaagatg

SEQ ID NO: 228281 - DNA, 103 bp, Artificial Sequence
  Synthetic Polynucleotide
taatacgactcactataggggccgcgctcctccttgaggtccctgctgggaacagaggagacccagcatggacctcaagaacctggcggcagcgcaaaagatg

SEQ ID NO: 228282 - DNA, 103 bp, Artificial Sequence
  Synthetic Polynucleotide
taatacgactcactatagggagagaagccccagctgccgctgctggttcaaacagaggagatgaaccatgagcggcagcaacctggcggcagcgcaaaagatg

SEQ ID NO: 228283 - DNA, 103 bp, Artificial Sequence
  Synthetic Polynucleotide
taatacgactcactataggggggcctgaccgccgcgctcctccttgaggtaacagaggagaacctcaatgaggagcgcgaacctggcggcagcgcaaaagatg

SEQ ID NO: 228284 - DNA, 103 bp, Artificial Sequence
  Synthetic Polynucleotide
taatacgactcactataggggccgcactctgggcctgaccgccgcgctccaacagaggagaggagcgatgcggtcaggcaacctggcggcagcgcaaaagatg

SEQ ID NO: 228285 - DNA, 103 bp, Artificial Sequence
  Synthetic Polynucleotide
taatacgactcactatagggtgcaccgctggccgcactctgggcctgaccaacagaggagaggtcagatgcagagtgcgaacctggcggcagcgcaaaagatg

SEQ ID NO: 228286 - DNA, 103 bp, Artificial Sequence
  Synthetic Polynucleotide
taatacgactcactatagggctgtctgctctgcaccgctggccgcactctaacagaggagaagagtgatgccagcggtgaacctggcggcagcgcaaaagatg

SEQ ID NO: 228287 - DNA, 103 bp, Artificial Sequence
  Synthetic Polynucleotide
taatacgactcactatagggtcggctttctctgtctgctctgcaccgctgaacagaggagacagcggatgagagcagacaacctggcggcagcgcaaaagatg

SEQ ID NO: 228288 - DNA, 103 bp, Artificial Sequence
  Synthetic Polynucleotide
taatacgactcactatagggccggggcgcatcggctttctctgtctgctcaacagaggagagagcagatggagaaagccaacctggcggcagcgcaaaagatg

SEQ ID NO: 228289 - DNA, 103 bp, Artificial Sequence
  Synthetic Polynucleotide
taatacgactcactataggggcggcggctcccggggcgcatcggctttctaacagaggagaagaaagatgatgcgccccaacctggcggcagcgcaaaagatg

SEQ ID NO: 228290 - DNA, 103 bp, Artificial Sequence
  Synthetic Polynucleotide
taatacgactcactatagggagctccacaggcggcggctcccggggcgcaaacagaggagatgcgccatgggagccgccaacctggcggcagcgcaaaagatg

SEQ ID NO: 228291 - DNA, 103 bp, Artificial Sequence
  Synthetic Polynucleotide
taatacgactcactataggggtctggcttgagctccacaggcggcggctcaacagaggagagagccgatgcctgtggagaacctggcggcagcgcaaaagatg

SEQ ID NO: 228292 - DNA, 103 bp, Artificial Sequence
  Synthetic Polynucleotide
taatacgactcactatagggcactcgtggggtctggcttgagctccacagaacagaggagactgtggatgtcaagccagaacctggcggcagcgcaaaagatg

SEQ ID NO: 228293 - DNA, 103 bp, Artificial Sequence
  Synthetic Polynucleotide
taatacgactcactataggggtgcagtcacagagaagccccagctgccgcaacagaggagagcggcaatgggggcttctaacctggcggcagcgcaaaagatg

SEQ ID NO: 228294 - DNA, 103 bp, Artificial Sequence
  Synthetic Polynucleotide
taatacgactcactataggggcagccatgccactcgtggggtctggcttgaacagaggagacaagccatgccccacgagaacctggcggcagcgcaaaagatg

SEQ ID NO: 228295 - DNA, 103 bp, Artificial Sequence
  Synthetic Polynucleotide
taatacgactcactatagggagcttctgcagcagccatgccactcgtgggaacagaggagacccacgatgggcatggctaacctggcggcagcgcaaaagatg

SEQ ID NO: 228296 - DNA, 103 bp, Artificial Sequence
  Synthetic Polynucleotide
taatacgactcactatagggaagcggcctcagcttctgcagcagccatgcaacagaggagagcatggatgctgcagaagaacctggcggcagcgcaaaagatg

SEQ ID NO: 228297 - DNA, 103 bp, Artificial Sequence
  Synthetic Polynucleotide
taatacgactcactatagggctctcggacaaagcggcctcagcttctgcaaacagaggagatgcagaatgtgaggccgcaacctggcggcagcgcaaaagatg

SEQ ID NO: 228298 - DNA, 103 bp, Artificial Sequence
  Synthetic Polynucleotide
taatacgactcactatagggttgctccgagctctcggacaaagcggcctcaacagaggagagaggccatgttgtccgagaacctggcggcagcgcaaaagatg

SEQ ID NO: 228299 - DNA, 103 bp, Artificial Sequence
  Synthetic Polynucleotide
taatacgactcactatagggcctccatttcttgctccgagctctcggacaaacagaggagatgtccgatggctcggagcaacctggcggcagcgcaaaagatg

SEQ ID NO: 228300 - DNA, 103 bp, Artificial Sequence
  Synthetic Polynucleotide
taatacgactcactataggggcgggctccacctccatttcttgctccgagaacagaggagactcggaatgagaaatggaaacctggcggcagcgcaaaagatg

SEQ ID NO: 228301 - DNA, 103 bp, Artificial Sequence
  Synthetic Polynucleotide
taatacgactcactatagggccctttccgggcgggctccacctccatttcaacagaggagagaaatgatggtggagcccaacctggcggcagcgcaaaagatg

SEQ ID NO: 228302 - DNA, 103 bp, Artificial Sequence
  Synthetic Polynucleotide
taatacgactcactataggggctcctcttcccctttccgggcgggctccaaacagaggagatggagcatgcccggaaagaacctggcggcagcgcaaaagatg

SEQ ID NO: 228303 - DNA, 103 bp, Artificial Sequence
  Synthetic Polynucleotide
taatacgactcactatagggtgctccttttgctcctcttcccctttccggaacagaggagaccggaaatgggaagaggaaacctggcggcagcgcaaaagatg

SEQ ID NO: 228304 - DNA, 103 bp, Artificial Sequence
  Synthetic Polynucleotide
taatacgactcactatagggcaccacaaaggtgcagtcacagagaagcccaacagaggagagggcttatgtgtgactgcaacctggcggcagcgcaaaagatg

SEQ ID NO: 228305 - DNA, 103 bp, Artificial Sequence
  Synthetic Polynucleotide
taatacgactcactatagggttgctcctcttgctccttttgctcctcttcaacagaggagagaagagatgcaaaaggagaacctggcggcagcgcaaaagatg

SEQ ID NO: 228306 - DNA, 103 bp, Artificial Sequence
  Synthetic Polynucleotide
taatacgactcactatagggcctcctcctcttgctcctcttgctccttttaacagaggagaaaaaggatgaagaggagcaacctggcggcagcgcaaaagatg

SEQ ID NO: 228307 - DNA, 103 bp, Artificial Sequence
  Synthetic Polynucleotide
taatacgactcactatagggggccctgcgccctcctcctcttgctcctctaacagaggagaagaggaatgagaggaggaaacctggcggcagcgcaaaagatg

SEQ ID NO: 228308 - DNA, 103 bp, Artificial Sequence
  Synthetic Polynucleotide
taatacgactcactataggggacctcagctggccctgcgccctcctcctcaacagaggagagaggagatgggcgcagggaacctggcggcagcgcaaaagatg

SEQ ID NO: 228309 - DNA, 103 bp, Artificial Sequence
  Synthetic Polynucleotide
taatacgactcactatagggcctcctccttgacctcagctggccctgcgcaacagaggagagcgcagatgcagctgaggaacctggcggcagcgcaaaagatg

SEQ ID NO: 228310 - DNA, 103 bp, Artificial Sequence
  Synthetic Polynucleotide
taatacgactcactatagggagctgggaaccctcctccttgacctcagctaacagaggagaagctgaatgcaaggaggaaacctggcggcagcgcaaaagatg

SEQ ID NO: 228311 - DNA, 103 bp, Artificial Sequence
  Synthetic Polynucleotide
taatacgactcactatagggtccgttctccagctgggaaccctcctccttaacagaggagaaaggagatgggttcccagaacctggcggcagcgcaaaagatg

SEQ ID NO: 228312 - DNA, 103 bp, Artificial Sequence
  Synthetic Polynucleotide
taatacgactcactatagggcgggggcctctccgttctccagctgggaacaacagaggagagttcccatgtggagaacgaacctggcggcagcgcaaaagatg

SEQ ID NO: 228313 - DNA, 103 bp, Artificial Sequence
  Synthetic Polynucleotide
taatacgactcactatagggtcgttctcctcgggggcctctccgttctccaacagaggagaggagaaatgagaggccccaacctggcggcagcgcaaaagatg

SEQ ID NO: 228314 - DNA, 103 bp, Artificial Sequence
  Synthetic Polynucleotide
taatacgactcactatagggctcctcattctcgttctcctcgggggcctcaacagaggagagaggccatggaggagaacaacctggcggcagcgcaaaagatg

SEQ ID NO: 228315 - DNA, 103 bp, Artificial Sequence
  Synthetic Polynucleotide
taatacgactcactataggggaacaccgtccaccacaaaggtgcagtcacaacagaggagagtgactatgcctttgtggaacctggcggcagcgcaaaagatg

SEQ ID NO: 228316 - DNA, 103 bp, Artificial Sequence
  Synthetic Polynucleotide
taatacgactcactatagggtgcccgctgactcctcattctcgttctcctaacagaggagaaggagaatgagaatgaggaacctggcggcagcgcaaaagatg

SEQ ID NO: 228317 - DNA, 103 bp, Artificial Sequence
  Synthetic Polynucleotide
taatacgactcactatagggcccgagtctgtgcccgctgactcctcattcaacagaggagagaatgaatggtcagcgggaacctggcggcagcgcaaaagatg

SEQ ID NO: 228318 - DNA, 103 bp, Artificial Sequence
  Synthetic Polynucleotide
taatacgactcactataggggagctcctgccccgagtctgtgcccgctgaaacagaggagatcagcgatgacagactcgaacctggcggcagcgcaaaagatg

SEQ ID NO: 228319 - DNA, 103 bp, Artificial Sequence
  Synthetic Polynucleotide
taatacgactcactatagggcctcggagccgagctcctgccccgagtctgaacagaggagacagactatgggcaggagcaacctggcggcagcgcaaaagatg

SEQ ID NO: 228320 - DNA, 103 bp, Artificial Sequence
  Synthetic Polynucleotide
taatacgactcactatagggaggccccgggcctcggagccgagctcctgcaacagaggagagcaggaatgcggctccgaaacctggcggcagcgcaaaagatg

SEQ ID NO: 228321 - DNA, 103 bp, Artificial Sequence
  Synthetic Polynucleotide
taatacgactcactataggggcctgagcgcaggccccgggcctcggagccaacagaggagaggctccatggcccggggcaacctggcggcagcgcaaaagatg

SEQ ID NO: 228322 - DNA, 103 bp, Artificial Sequence
  Synthetic Polynucleotide
taatacgactcactatagggcgccgtaggtgcctgagcgcaggccccgggaacagaggagacccgggatgtgcgctcagaacctggcggcagcgcaaaagatg

SEQ ID NO: 228323 - DNA, 103 bp, Artificial Sequence
  Synthetic Polynucleotide
taatacgactcactatagggtccgtgcggtcgccgtaggtgcctgagcgcaacagaggagagcgctcatgcacctacggaacctggcggcagcgcaaaagatg

SEQ ID NO: 228324 - DNA, 103 bp, Artificial Sequence
  Synthetic Polynucleotide
taatacgactcactatagggggccttggactccgtgcggtcgccgtaggtaacagaggagaacctacatggaccgcacgaacctggcggcagcgcaaaagatg

SEQ ID NO: 228325 - DNA, 103 bp, Artificial Sequence
  Synthetic Polynucleotide
taatacgactcactatagggcggagccgtaggccttggactccgtgcggtaacagaggagaaccgcaatgagtccaaggaacctggcggcagcgcaaaagatg

SEQ ID NO: 228326 - DNA, 103 bp, Artificial Sequence
  Synthetic Polynucleotide
taatacgactcactataggggccttaaagtgaacaccgtccaccacaaagaacagaggagactttgtatgggacggtgtaacctggcggcagcgcaaaagatg

SEQ ID NO: 228327 - DNA, 103 bp, Artificial Sequence
  Synthetic Polynucleotide
taatacgactcactatagggttgtggatgacggagccgtaggccttggacaacagaggagagtccaaatgctacggctcaacctggcggcagcgcaaaagatg

SEQ ID NO: 228328 - DNA, 103 bp, Artificial Sequence
  Synthetic Polynucleotide
taatacgactcactataggggtcctcgcacttgtggatgacggagccgtaaacagaggagatacggcatggtcatccacaacctggcggcagcgcaaaagatg

SEQ ID NO: 228329 - DNA, 103 bp, Artificial Sequence
  Synthetic Polynucleotide
taatacgactcactatagggccttcccacagtcctcgcacttgtggatgaaacagaggagatcatccatgagtgcgaggaacctggcggcagcgcaaaagatg

SEQ ID NO: 228330 - DNA, 103 bp, Artificial Sequence
  Synthetic Polynucleotide
taatacgactcactatagggtgcgtgaactccttcccacagtcctcgcacaacagaggagagtgcgaatgctgtgggaaaacctggcggcagcgcaaaagatg

SEQ ID NO: 228331 - DNA, 103 bp, Artificial Sequence
  Synthetic Polynucleotide
taatacgactcactataggggttccccgtgtgcgtgaactccttcccacaaacagaggagatgtgggatggagttcacgaacctggcggcagcgcaaaagatg

SEQ ID NO: 228332 - DNA, 103 bp, Artificial Sequence
  Synthetic Polynucleotide
taatacgactcactataggggccgcttgaagttccccgtgtgcgtgaactaacagaggagaagttcaatgacacggggaaacctggcggcagcgcaaaagatg

SEQ ID NO: 228333 - DNA, 103 bp, Artificial Sequence
  Synthetic Polynucleotide
taatacgactcactatagggatgcggatgtgccgcttgaagttccccgtgaacagaggagacacgggatgcttcaagcgaacctggcggcagcgcaaaagatg

SEQ ID NO: 228334 - DNA, 103 bp, Artificial Sequence
  Synthetic Polynucleotide
taatacgactcactatagggccccgtgtggatgcggatgtgccgcttgaaaacagaggagattcaagatgcacatccgcaacctggcggcagcgcaaaagatg

SEQ ID NO: 228335 - DNA, 103 bp, Artificial Sequence
  Synthetic Polynucleotide
taatacgactcactatagggagggcttctcccccgtgtggatgcggatgtaacagaggagaacatccatgtccacacggaacctggcggcagcgcaaaagatg

SEQ ID NO: 228336 - DNA, 103 bp, Artificial Sequence
  Synthetic Polynucleotide
taatacgactcactatagggcggcacgagaagggcttctcccccgtgtggaacagaggagaccacacatgggagaagccaacctggcggcagcgcaaaagatg

SEQ ID NO: 228337 - DNA, 103 bp, Artificial Sequence
  Synthetic Polynucleotide
taatacgactcactatagggtagaataagtccatggttggccaaatccataacagaggagaatggatatggccaaccataacctggcggcagcgcaaaagatg

SEQ ID NO: 228338 - DNA, 103 bp, Artificial Sequence
  Synthetic Polynucleotide
taatacgactcactatagggtgatttgtgtgccttgaagtatacatcgccaacagaggagaggcgatatgtacttcaagaacctggcggcagcgcaaaagatg

SEQ ID NO: 228339 - DNA, 103 bp, Artificial Sequence
  Synthetic Polynucleotide
taatacgactcactatagggggggggtggggtttccgactgctgctgcccaacagaggagagggcagatgcagtcggaaaacctggcggcagcgcaaaagatg

SEQ ID NO: 228340 - DNA, 103 bp, Artificial Sequence
  Synthetic Polynucleotide
taatacgactcactatagggcaatgtctgaggggggtggggtttccgactaacagaggagaagtcggatgccccaccccaacctggcggcagcgcaaaagatg

SEQ ID NO: 228341 - DNA, 103 bp, Artificial Sequence
  Synthetic Polynucleotide
taatacgactcactatagggtcaatgtcagcaatgtctgaggggggtgggaacagaggagacccaccatgctcagacataacctggcggcagcgcaaaagatg

SEQ ID NO: 228342 - DNA, 103 bp, Artificial Sequence
  Synthetic Polynucleotide
taatacgactcactatagggctccaggttgtcaatgtcagcaatgtctgaaacagaggagatcagacatggctgacattaacctggcggcagcgcaaaagatg

SEQ ID NO: 228343 - DNA, 103 bp, Artificial Sequence
  Synthetic Polynucleotide
taatacgactcactatagggggtcggcctgctccaggttgtcaatgtcagaacagaggagactgacaatgacaacctggaacctggcggcagcgcaaaagatg

SEQ ID NO: 228344 - DNA, 103 bp, Artificial Sequence
  Synthetic Polynucleotide
taatacgactcactatagggtccctctcctggtcggcctgctccaggttgaacagaggagacaacctatggcaggccgaaacctggcggcagcgcaaaagatg

SEQ ID NO: 228345 - DNA, 103 bp, Artificial Sequence
  Synthetic Polynucleotide
taatacgactcactatagggcctcttcacctccctctcctggtcggcctgaacagaggagacaggccatgcaggagaggaacctggcggcagcgcaaaagatg

SEQ ID NO: 228346 - DNA, 103 bp, Artificial Sequence
  Synthetic Polynucleotide
taatacgactcactatagggcgtacttccgcctcttcacctccctctcctaacagaggagaaggagaatgaggtgaagaaacctggcggcagcgcaaaagatg

SEQ ID NO: 228347 - DNA, 103 bp, Artificial Sequence
  Synthetic Polynucleotide
taatacgactcactatagggattgtgcactcgtacttccgcctcttcaccaacagaggagaggtgaaatggcggaagtaaacctggcggcagcgcaaaagatg

SEQ ID NO: 228348 - DNA, 103 bp, Artificial Sequence
  Synthetic Polynucleotide
taatacgactcactataggggcgtccacatattgtgcactcgtacttccgaacagaggagacggaagatggagtgcacaaacctggcggcagcgcaaaagatg

SEQ ID NO: 228349 - DNA, 103 bp, Artificial Sequence
  Synthetic Polynucleotide
taatacgactcactatagggaagcaagaactgatttgtgtgccttgaagtaacagaggagaacttcaatgcacacaaataacctggcggcagcgcaaaagatg

SEQ ID NO: 228350 - DNA, 103 bp, Artificial Sequence
  Synthetic Polynucleotide
taatacgactcactatagggggataaatttgcgtccacatattgtgcactaacagaggagaagtgcaatgtatgtggacaacctggcggcagcgcaaaagatg

SEQ ID NO: 228351 - DNA, 103 bp, Artificial Sequence
  Synthetic Polynucleotide
taatacgactcactatagggtggcttttctggataaatttgcgtccacataacagaggagaatgtggatgcaaatttataacctggcggcagcgcaaaagatg

SEQ ID NO: 228352 - DNA, 103 bp, Artificial Sequence
  Synthetic Polynucleotide
taatacgactcactatagggttccctccagtggcttttctggataaatttaacagaggagaaaatttatgcagaaaagcaacctggcggcagcgcaaaagatg

SEQ ID NO: 228353 - DNA, 103 bp, Artificial Sequence
  Synthetic Polynucleotide
taatacgactcactatagggtgtacatgtgttccctccagtggcttttctaacagaggagaagaaaaatgactggagggaacctggcggcagcgcaaaagatg

SEQ ID NO: 228354 - DNA, 103 bp, Artificial Sequence
  Synthetic Polynucleotide
taatacgactcactatagggccggtgtgtatgtacatgtgttccctccagaacagaggagactggagatgacacatgtaaacctggcggcagcgcaaaagatg

SEQ ID NO: 228355 - DNA, 103 bp, Artificial Sequence
  Synthetic Polynucleotide
taatacgactcactataggggaaaggcttcccggtgtgtatgtacatgtgaacagaggagacacatgatgatacacaccaacctggcggcagcgcaaaagatg

SEQ ID NO: 228356 - DNA, 103 bp, Artificial Sequence
  Synthetic Polynucleotide
taatacgactcactatagggtgctgcacttgaaaggcttcccggtgtgtaaacagaggagatacacaatgggaagccttaacctggcggcagcgcaaaagatg

SEQ ID NO: 228357 - DNA, 103 bp, Artificial Sequence
  Synthetic Polynucleotide
taatacgactcactatagggttgtcacaagtgctgcacttgaaaggcttcaacagaggagagaagccatgcaagtgcagaacctggcggcagcgcaaaagatg

SEQ ID NO: 228358 - DNA, 103 bp, Artificial Sequence
  Synthetic Polynucleotide
taatacgactcactataggggcaaaagcttttgtcacaagtgctgcacttaacagaggagaaagtgcatgacttgtgacaacctggcggcagcgcaaaagatg

SEQ ID NO: 228359 - DNA, 103 bp, Artificial Sequence
  Synthetic Polynucleotide
taatacgactcactatagggggttggccctgcaaaagcttttgtcacaagaacagaggagacttgtgatgaaagcttttaacctggcggcagcgcaaaagatg

SEQ ID NO: 228360 - DNA, 103 bp, Artificial Sequence
  Synthetic Polynucleotide
taatacgactcactatagggttggagaatgaagcaagaactgatttgtgtaacagaggagaacacaaatgagttcttgcaacctggcggcagcgcaaaagatg

SEQ ID NO: 228361 - DNA, 103 bp, Artificial Sequence
  Synthetic Polynucleotide
taatacgactcactatagggcgggcagcctggttggccctgcaaaagcttaacagaggagaaagcttatgcagggccaaaacctggcggcagcgcaaaagatg

SEQ ID NO: 228362 - DNA, 103 bp, Artificial Sequence
  Synthetic Polynucleotide
taatacgactcactataggggcacacgtggcgggcagcctggttggccctaacagaggagaagggccatgcaggctgccaacctggcggcagcgcaaaagatg

SEQ ID NO: 228363 - DNA, 103 bp, Artificial Sequence
  Synthetic Polynucleotide
taatacgactcactatagggtctggttgaggcacacgtggcgggcagcctaacagaggagaaggctgatggccacgtgtaacctggcggcagcgcaaaagatg

SEQ ID NO: 228364 - DNA, 103 bp, Artificial Sequence
  Synthetic Polynucleotide
taatacgactcactataggggtgtcgatgctctggttgaggcacacgtggaacagaggagaccacgtatgcctcaaccaaacctggcggcagcgcaaaagatg

SEQ ID NO: 228365 - DNA, 103 bp, Artificial Sequence
  Synthetic Polynucleotide
taatacgactcactatagggcatggtgtaagtgtcgatgctctggttgagaacagaggagactcaacatgagcatcgacaacctggcggcagcgcaaaagatg

SEQ ID NO: 228366 - DNA, 103 bp, Artificial Sequence
  Synthetic Polynucleotide
taatacgactcactataggggtttgtccaccatggtgtaagtgtcgatgcaacagaggagagcatcgatgcttacaccaaacctggcggcagcgcaaaagatg

SEQ ID NO: 228367 - DNA, 103 bp, Artificial Sequence
  Synthetic Polynucleotide
taatacgactcactatagggtccagagtctgtttgtccaccatggtgtaaaacagaggagattacacatgggtggacaaaacctggcggcagcgcaaaagatg

SEQ ID NO: 228368 - DNA, 103 bp, Artificial Sequence
  Synthetic Polynucleotide
taatacgactcactatagggtgtgcagagttccagagtctgtttgtccacaacagaggagagtggacatgcagactctgaacctggcggcagcgcaaaagatg

SEQ ID NO: 228369 - DNA, 103 bp, Artificial Sequence
  Synthetic Polynucleotide
taatacgactcactatagggcttcctcaaatgtgcagagttccagagtctaacagaggagaagactcatgaactctgcaaacctggcggcagcgcaaaagatg

SEQ ID NO: 228370 - DNA, 103 bp, Artificial Sequence
  Synthetic Polynucleotide
taatacgactcactatagggatctgactcccttcctcaaatgtgcagagtaacagaggagaactctgatgatttgaggaaacctggcggcagcgcaaaagatg

SEQ ID NO: 228371 - DNA, 103 bp, Artificial Sequence
  Synthetic Polynucleotide
taatacgactcactatagggcttaaagtaattggagaatgaagcaagaacaacagaggagagttcttatgtcattctccaacctggcggcagcgcaaaagatg

SEQ ID NO: 228372 - DNA, 103 bp, Artificial Sequence
  Synthetic Polynucleotide
taatacgactcactatagggcatgttgtccatctgactcccttcctcaaaaacagaggagatttgagatggggagtcagaacctggcggcagcgcaaaagatg

SEQ ID NO: 228373 - DNA, 103 bp, Artificial Sequence
  Synthetic Polynucleotide
taatacgactcactatagggtttgcaccagcatgttgtccatctgactccaacagaggagaggagtcatgtggacaacaaacctggcggcagcgcaaaagatg

SEQ ID NO: 228374 - DNA, 103 bp, Artificial Sequence
  Synthetic Polynucleotide
taatacgactcactatagggggtttgtttgtttgcaccagcatgttgtccaacagaggagaggacaaatggctggtgcaaacctggcggcagcgcaaaagatg

SEQ ID NO: 228375 - DNA, 103 bp, Artificial Sequence
  Synthetic Polynucleotide
taatacgactcactataggggcatttgtagggtttgtttgtttgcaccagaacagaggagactggtgatgacaaacaaaaacctggcggcagcgcaaaagatg

SEQ ID NO: 228376 - DNA, 103 bp, Artificial Sequence
  Synthetic Polynucleotide
taatacgactcactatagggcacacaagttgcatttgtagggtttgtttgaacagaggagacaaacaatgcctacaaataacctggcggcagcgcaaaagatg

SEQ ID NO: 228377 - DNA, 103 bp, Artificial Sequence
  Synthetic Polynucleotide
taatacgactcactatagggaatgttttgtcacacaagttgcatttgtagaacagaggagactacaaatgcaacttgtgaacctggcggcagcgcaaaagatg

SEQ ID NO: 228378 - DNA, 103 bp, Artificial Sequence
  Synthetic Polynucleotide
taatacgactcactataggggggagtggagaatgttttgtcacacaagttaacagaggagaaacttgatggacaaaacaaacctggcggcagcgcaaaagatg

SEQ ID NO: 228379 - DNA, 103 bp, Artificial Sequence
  Synthetic Polynucleotide
taatacgactcactatagggcaacctcattgggagtggagaatgttttgtaacagaggagaacaaaaatgtctccactcaacctggcggcagcgcaaaagatg

SEQ ID NO: 228380 - DNA, 103 bp, Artificial Sequence
  Synthetic Polynucleotide
taatacgactcactataggggaatgtttaacaacctcattgggagtggagaacagaggagactccacatgcaatgaggtaacctggcggcagcgcaaaagatg

SEQ ID NO: 228381 - DNA, 103 bp, Artificial Sequence
  Synthetic Polynucleotide
taatacgactcactataggggttttggcatgaatgtttaacaacctcattaacagaggagaaatgagatggttaaacataacctggcggcagcgcaaaagatg

SEQ ID NO: 228382 - DNA, 103 bp, Artificial Sequence
  Synthetic Polynucleotide
taatacgactcactatagggcaaacaacatcttaaagtaattggagaatgaacagaggagacattctatgattactttaaacctggcggcagcgcaaaagatg

SEQ ID NO: 228383 - DNA, 103 bp, Artificial Sequence
  Synthetic Polynucleotide
taatacgactcactatagggccgagttctggttttggcatgaatgtttaaaacagaggagattaaacatgcatgccaaaaacctggcggcagcgcaaaagatg

SEQ ID NO: 228384 - DNA, 103 bp, Artificial Sequence
  Synthetic Polynucleotide
taatacgactcactataggggcaaaaacatccgagttctggttttggcataacagaggagaatgccaatgccagaactcaacctggcggcagcgcaaaagatg

SEQ ID NO: 228385 - DNA, 103 bp, Artificial Sequence
  Synthetic Polynucleotide
taatacgactcactatagggttcgtctagggcaaaaacatccgagttctgaacagaggagacagaacatggatgtttttaacctggcggcagcgcaaaagatg

SEQ ID NO: 228386 - DNA, 103 bp, Artificial Sequence
  Synthetic Polynucleotide
taatacgactcactatagggtggatcgcccttcgtctagggcaaaaacataacagaggagaatgtttatgccctagacgaacctggcggcagcgcaaaagatg

SEQ ID NO: 228387 - DNA, 103 bp, Artificial Sequence
  Synthetic Polynucleotide
taatacgactcactatagggcccaggagaatggatcgcccttcgtctaggaacagaggagacctagaatgagggcgatcaacctggcggcagcgcaaaagatg

SEQ ID NO: 228388 - DNA, 103 bp, Artificial Sequence
  Synthetic Polynucleotide
taatacgactcactataggggtccccactgcccaggagaatggatcgcccaacagaggagagggcgaatgattctcctgaacctggcggcagcgcaaaagatg

SEQ ID NO: 228389 - DNA, 103 bp, Artificial Sequence
  Synthetic Polynucleotide
taatacgactcactatagggttacttccgagtccccactgcccaggagaaaacagaggagattctccatggcagtggggaacctggcggcagcgcaaaagatg

SEQ ID NO: 228390 - DNA, 103 bp, Artificial Sequence
  Synthetic Polynucleotide
taatacgactcactatagggtcaggctccgttacttccgagtccccactgaacagaggagacagtggatgctcggaagtaacctggcggcagcgcaaaagatg

SEQ ID NO: 228391 - DNA, 103 bp, Artificial Sequence
  Synthetic Polynucleotide
taatacgactcactatagggcactgggtggtcaggctccgttacttccgaaacagaggagatcggaaatgacggagcctaacctggcggcagcgcaaaagatg

SEQ ID NO: 228392 - DNA, 103 bp, Artificial Sequence
  Synthetic Polynucleotide
taatacgactcactatagggtggaagctaacactgggtggtcaggctccgaacagaggagacggagcatgaccacccagaacctggcggcagcgcaaaagatg

SEQ ID NO: 228393 - DNA, 103 bp, Artificial Sequence
  Synthetic Polynucleotide
taatacgactcactataggggtctgatggacaaacaacatcttaaagtaaaacagaggagattacttatggatgttgttaacctggcggcagcgcaaaagatg

SEQ ID NO: 228394 - DNA, 103 bp, Artificial Sequence
  Synthetic Polynucleotide
taatacgactcactatagggtcctttttgatggaagctaacactgggtggaacagaggagaccacccatggttagcttcaacctggcggcagcgcaaaagatg

SEQ ID NO: 228395 - DNA, 103 bp, Artificial Sequence
  Synthetic Polynucleotide
taatacgactcactatagggggtttcttgttcctttttgatggaagctaaaacagaggagattagctatgatcaaaaagaacctggcggcagcgcaaaagatg

SEQ ID NO: 228396 - DNA, 103 bp, Artificial Sequence
  Synthetic Polynucleotide
taatacgactcactatagggctagtaagacggtttcttgttcctttttgaaacagaggagatcaaaaatgaacaagaaaaacctggcggcagcgcaaaagatg

SEQ ID NO: 228397 - DNA, 103 bp, Artificial Sequence
  Synthetic Polynucleotide
taatacgactcactatagggacactcactggtctgatggacaaacaacataacagaggagaatgttgatggtccatcagaacctggcggcagcgcaaaagatg

SEQ ID NO: 228398 - DNA, 103 bp, Artificial Sequence
  Synthetic Polynucleotide
taatacgactcactatagggtcaagcggacacactcactggtctgatggaaacagaggagatccatcatgccagtgagtaacctggcggcagcgcaaaagatg

SEQ ID NO: 228399 - DNA, 103 bp, Artificial Sequence
  Synthetic Polynucleotide
taatacgactcactatagggtcagttggtttcaagcggacacactcactgaacagaggagacagtgaatgtgtccgcttaacctggcggcagcgcaaaagatg

SEQ ID NO: 228400 - DNA, 103 bp, Artificial Sequence
  Synthetic Polynucleotide
taatacgactcactataggggggctgtatgtcagttggtttcaagcggacaacagaggagagtccgcatgaaaccaactaacctggcggcagcgcaaaagatg

SEQ ID NO: 228401 - DNA, 103 bp, Artificial Sequence
  Synthetic Polynucleotide
taatacgactcactatagggactgttgcagtagaataagtccatggttggaacagaggagaccaaccatggacttattcaacctggcggcagcgcaaaagatg

SEQ ID NO: 228402 - DNA, 103 bp, Artificial Sequence
  Synthetic Polynucleotide
taatacgactcactatagggtgaagatgtcgggctgtatgtcagttggttaacagaggagaaaccaaatgacatacagcaacctggcggcagcgcaaaagatg

SEQ ID NO: 228403 - DNA, 103 bp, Artificial Sequence
  Synthetic Polynucleotide
taatacgactcactatagggaagagatagctgaagatgtcgggctgtatgaacagaggagacatacaatgcgacatcttaacctggcggcagcgcaaaagatg

SEQ ID NO: 228404 - DNA, 103 bp, Artificial Sequence
  Synthetic Polynucleotide
taatacgactcactatagggcatcaagtgtaagagatagctgaagatgtcaacagaggagagacatcatgagctatctcaacctggcggcagcgcaaaagatg

SEQ ID NO: 228405 - DNA, 103 bp, Artificial Sequence
  Synthetic Polynucleotide
taatacgactcactatagggtcccagtgtacatcaagtgtaagagatagcaacagaggagagctatcatgtacacttgaaacctggcggcagcgcaaaagatg

SEQ ID NO: 228406 - DNA, 103 bp, Artificial Sequence
  Synthetic Polynucleotide
taatacgactcactatagggggcgccatcttcccagtgtacatcaagtgtaacagaggagaacacttatggtacactggaacctggcggcagcgcaaaagatg

SEQ ID NO: 228407 - DNA, 103 bp, Artificial Sequence
  Synthetic Polynucleotide
taatacgactcactataggggatgagctgaggcgccatcttcccagtgtaaacagaggagatacactatgaagatggcgaacctggcggcagcgcaaaagatg

SEQ ID NO: 228408 - DNA, 103 bp, Artificial Sequence
  Synthetic Polynucleotide
taatacgactcactataggggaaccgggtcgatgagctgaggcgccatctaacagaggagaagatggatgctcagctcaaacctggcggcagcgcaaaagatg

SEQ ID NO: 228409 - DNA, 103 bp, Artificial Sequence
  Synthetic Polynucleotide
taatacgactcactatagggtgttctaatcgaaccgggtcgatgagctgaaacagaggagatcagctatgcgacccggtaacctggcggcagcgcaaaagatg

SEQ ID NO: 228410 - DNA, 103 bp, Artificial Sequence
  Synthetic Polynucleotide
taatacgactcactatagggcttgatgccctgttctaatcgaaccgggtcaacagaggagagacccgatgcgattagaaaacctggcggcagcgcaaaagatg

SEQ ID NO: 228411 - DNA, 103 bp, Artificial Sequence
  Synthetic Polynucleotide
taatacgactcactatagggcgtgcagaaacttgatgccctgttctaatcaacagaggagagattagatgagggcatcaaacctggcggcagcgcaaaagatg

SEQ ID NO: 228412 - DNA, 103 bp, Artificial Sequence
  Synthetic Polynucleotide
taatacgactcactatagggtgagcgtttaactgttgcagtagaataagtaacagaggagaacttatatgactgcaacaaacctggcggcagcgcaaaagatg

SEQ ID NO: 228413 - DNA, 103 bp, Artificial Sequence
  Synthetic Polynucleotide
taatacgactcactatagggagcgggtaggcgtgcagaaacttgatgcccaacagaggagagggcatatggtttctgcaaacctggcggcagcgcaaaagatg

SEQ ID NO: 228414 - DNA, 103 bp, Artificial Sequence
  Synthetic Polynucleotide
taatacgactcactatagggttcctgaatgagcgggtaggcgtgcagaaaaacagaggagatttctgatggcctacccgaacctggcggcagcgcaaaagatg

SEQ ID NO: 228415 - DNA, 103 bp, Artificial Sequence
  Synthetic Polynucleotide
taatacgactcactatagggcgaggctggcttcctgaatgagcgggtaggaacagaggagacctaccatgtcattcaggaacctggcggcagcgcaaaagatg

SEQ ID NO: 228416 - DNA, 103 bp, Artificial Sequence
  Synthetic Polynucleotide
taatacgactcactatagggccctggctggcgaggctggcttcctgaatgaacagaggagacattcaatgagccagcctaacctggcggcagcgcaaaagatg

SEQ ID NO: 228417 - DNA, 103 bp, Artificial Sequence
  Synthetic Polynucleotide
taatacgactcactatagggagaaaaggctccctggctggcgaggctggcaacagaggagagccagcatggccagccagaacctggcggcagcgcaaaagatg

SEQ ID NO: 228418 - DNA, 103 bp, Artificial Sequence
  Synthetic Polynucleotide
taatacgactcactatagggggtcagggtgagaaaaggctccctggctggaacagaggagaccagccatggagccttttaacctggcggcagcgcaaaagatg

SEQ ID NO: 228419 - DNA, 103 bp, Artificial Sequence
  Synthetic Polynucleotide
taatacgactcactataggggggaaaacttggtcagggtgagaaaaggctaacagaggagaagccttatgtcaccctgaaacctggcggcagcgcaaaagatg

SEQ ID NO: 228420 - DNA, 103 bp, Artificial Sequence
  Synthetic Polynucleotide
taatacgactcactatagggagaagccagtgggaaaacttggtcagggtgaacagaggagacaccctatgcaagttttcaacctggcggcagcgcaaaagatg

SEQ ID NO: 228421 - DNA, 103 bp, Artificial Sequence
  Synthetic Polynucleotide
taatacgactcactatagggcatacaatgaagaagccagtgggaaaacttaacagaggagaaagtttatgcactggcttaacctggcggcagcgcaaaagatg

SEQ ID NO: 228422 - DNA, 103 bp, Artificial Sequence
  Synthetic Polynucleotide
taatacgactcactatagggatctgaatgccatacaatgaagaagccagtaacagaggagaactggcatgttcattgtaaacctggcggcagcgcaaaagatg

SEQ ID NO: 228423 - DNA, 103 bp, Artificial Sequence
  Synthetic Polynucleotide
taatacgactcactatagggaaactctcgctgagcgtttaactgttgcagaacagaggagactgcaaatgttaaacgctaacctggcggcagcgcaaaagatg

SEQ ID NO: 228424 - DNA, 103 bp, Artificial Sequence
  Synthetic Polynucleotide
taatacgactcactatagggatgatctgcaatctgaatgccatacaatgaaacagaggagatcattgatgggcattcagaacctggcggcagcgcaaaagatg

SEQ ID NO: 228425 - DNA, 103 bp, Artificial Sequence
  Synthetic Polynucleotide
taatacgactcactataggggtctcaactgatgatctgcaatctgaatgcaacagaggagagcattcatgttgcagatcaacctggcggcagcgcaaaagatg

SEQ ID NO: 228426 - DNA, 103 bp, Artificial Sequence
  Synthetic Polynucleotide
taatacgactcactatagggttggtggcttgtctcaactgatgatctgcaaacagaggagatgcagaatgtcagttgagaacctggcggcagcgcaaaagatg

SEQ ID NO: 228427 - DNA, 103 bp, Artificial Sequence
  Synthetic Polynucleotide
taatacgactcactatagggtgaagcaatcttggtggcttgtctcaactgaacagaggagacagttgatgcaagccaccaacctggcggcagcgcaaaagatg

SEQ ID NO: 228428 - DNA, 103 bp, Artificial Sequence
  Synthetic Polynucleotide
taatacgactcactatagggtttcaggtgctgaagcaatcttggtggcttaacagaggagaaagccaatgagattgcttaacctggcggcagcgcaaaagatg

SEQ ID NO: 228429 - DNA, 103 bp, Artificial Sequence
  Synthetic Polynucleotide
taatacgactcactatagggcgcccgagtttttcaggtgctgaagcaatcaacagaggagagattgcatgagcacctgaaacctggcggcagcgcaaaagatg

SEQ ID NO: 228430 - DNA, 103 bp, Artificial Sequence
  Synthetic Polynucleotide
taatacgactcactatagggccgtggatctcgcccgagtttttcaggtgcaacagaggagagcacctatgaaactcgggaacctggcggcagcgcaaaagatg

SEQ ID NO: 228431 - DNA, 103 bp, Artificial Sequence
  Synthetic Polynucleotide
taatacgactcactatagggaggtctgtggccgtggatctcgcccgagttaacagaggagaaactcgatggagatccacaacctggcggcagcgcaaaagatg

SEQ ID NO: 228432 - DNA, 103 bp, Artificial Sequence
  Synthetic Polynucleotide
taatacgactcactatagggcttatcctggaggtctgtggccgtggatctaacagaggagaagatccatggccacagacaacctggcggcagcgcaaaagatg

SEQ ID NO: 228433 - DNA, 103 bp, Artificial Sequence
  Synthetic Polynucleotide
taatacgactcactatagggctgctcctggcttatcctggaggtctgtggaacagaggagaccacagatgtccaggataaacctggcggcagcgcaaaagatg

SEQ ID NO: 228434 - DNA, 103 bp, Artificial Sequence
  Synthetic Polynucleotide
taatacgactcactatagggacaggaaaccaaactctcgctgagcgtttaaacagaggagataaacgatgagcgagagtaacctggcggcagcgcaaaagatg

SEQ ID NO: 228435 - DNA, 103 bp, Artificial Sequence
  Synthetic Polynucleotide
taatacgactcactatagggcctcagggacctgctcctggcttatcctggaacagaggagaccaggaatggccaggagcaacctggcggcagcgcaaaagatg

SEQ ID NO: 228436 - DNA, 103 bp, Artificial Sequence
  Synthetic Polynucleotide
taatacgactcactatagggagctgtgaggcctcagggacctgctcctggaacagaggagaccaggaatgggtccctgaaacctggcggcagcgcaaaagatg

SEQ ID NO: 228437 - DNA, 103 bp, Artificial Sequence
  Synthetic Polynucleotide
taatacgactcactatagggcagctgggagagctgtgaggcctcagggacaacagaggagagtccctatggcctcacagaacctggcggcagcgcaaaagatg

SEQ ID NO: 228438 - DNA, 103 bp, Artificial Sequence
  Synthetic Polynucleotide
taatacgactcactataggggatttgaagtcagctgggagagctgtgaggaacagaggagacctcacatgtctcccagcaacctggcggcagcgcaaaagatg

SEQ ID NO: 228439 - DNA, 103 bp, Artificial Sequence
  Synthetic Polynucleotide
taatacgactcactatagggacctgggccagatttgaagtcagctgggagaacagaggagactcccaatggacttcaaaaacctggcggcagcgcaaaagatg

SEQ ID NO: 228440 - DNA, 103 bp, Artificial Sequence
  Synthetic Polynucleotide
taatacgactcactatagggtgtccgattcacctgggccagatttgaagtaacagaggagaacttcaatgctggcccagaacctggcggcagcgcaaaagatg

SEQ ID NO: 228441 - DNA, 103 bp, Artificial Sequence
  Synthetic Polynucleotide
taatacgactcactataggggagtcatatttgtccgattcacctgggccaaacagaggagatggcccatgtgaatcggaaacctggcggcagcgcaaaagatg

SEQ ID NO: 228442 - DNA, 103 bp, Artificial Sequence
  Synthetic Polynucleotide
taatacgactcactataggggggtctgagggagtcatatttgtccgattcaacagaggagagaatcgatgaaatatgacaacctggcggcagcgcaaaagatg

SEQ ID NO: 228443 - DNA, 103 bp, Artificial Sequence
  Synthetic Polynucleotide
taatacgactcactatagggggtctgcagggggtctgagggagtcatattaacagaggagaaatatgatgccctcagacaacctggcggcagcgcaaaagatg

SEQ ID NO: 228444 - DNA, 103 bp, Artificial Sequence
  Synthetic Polynucleotide
taatacgactcactataggggagacagcgaggtctgcagggggtctgaggaacagaggagacctcagatgccctgcagaaacctggcggcagcgcaaaagatg

SEQ ID NO: 228445 - DNA, 103 bp, Artificial Sequence
  Synthetic Polynucleotide
taatacgactcactataggggtgcagtcacacaggaaaccaaactctcgcaacagaggagagcgagaatgtggtttcctaacctggcggcagcgcaaaagatg

SEQ ID NO: 228446 - DNA, 103 bp, Artificial Sequence
  Synthetic Polynucleotide
taatacgactcactatagggacaagttctggagacagcgaggtctgcaggaacagaggagacctgcaatgctcgctgtcaacctggcggcagcgcaaaagatg

SEQ ID NO: 228447 - DNA, 103 bp, Artificial Sequence
  Synthetic Polynucleotide
taatacgactcactatagggaggagtggaaacaagttctggagacagcgaaacagaggagatcgctgatgccagaacttaacctggcggcagcgcaaaagatg

SEQ ID NO: 228448 - DNA, 103 bp, Artificial Sequence
  Synthetic Polynucleotide
taatacgactcactatagggggggaggaacaggagtggaaacaagttctgaacagaggagacagaacatgtttccactcaacctggcggcagcgcaaaagatg

SEQ ID NO: 228449 - DNA, 103 bp, Artificial Sequence
  Synthetic Polynucleotide
taatacgactcactatagggccgggaggagggggaggaacaggagtggaaaacagaggagattccacatgtgttcctccaacctggcggcagcgcaaaagatg

SEQ ID NO: 228450 - DNA, 103 bp, Artificial Sequence
  Synthetic Polynucleotide
taatacgactcactatagggggtctcctccccgggaggagggggaggaacaacagaggagagttcctatgcctcctcccaacctggcggcagcgcaaaagatg

SEQ ID NO: 228451 - DNA, 103 bp, Artificial Sequence
  Synthetic Polynucleotide
taatacgactcactatagggcttccagattggtctcctccccgggaggagaacagaggagactcctcatggggaggagaaacctggcggcagcgcaaaagatg

SEQ ID NO: 228452 - DNA, 103 bp, Artificial Sequence
  Synthetic Polynucleotide
taatacgactcactataggggaggaagatgcttccagattggtctcctccaacagaggagaggaggaatgcaatctggaaacctggcggcagcgcaaaagatg

SEQ ID NO: 228453 - DNA, 103 bp, Artificial Sequence
  Synthetic Polynucleotide
taatacgactcactatagggctgctcatcggaggaagatgcttccagattaacagaggagaaatctgatggcatcttccaacctggcggcagcgcaaaagatg

SEQ ID NO: 228454 - DNA, 103 bp, Artificial Sequence
  Synthetic Polynucleotide
taatacgactcactataggggggacgcaggctgctcatcggaggaagatgaacagaggagacatcttatgccgatgagcaacctggcggcagcgcaaaagatg

SEQ ID NO: 228455 - DNA, 103 bp, Artificial Sequence
  Synthetic Polynucleotide
taatacgactcactataggggctattgtgagggacgcaggctgctcatcgaacagaggagacgatgaatggcctgcgtcaacctggcggcagcgcaaaagatg

SEQ ID NO: 228456 - DNA, 103 bp, Artificial Sequence
  Synthetic Polynucleotide
taatacgactcactataggggattgcaaccgtgcagtcacacaggaaaccaacagaggagaggtttcatgtgtgactgcaacctggcggcagcgcaaaagatg

SEQ ID NO: 228457 - DNA, 103 bp, Artificial Sequence
  Synthetic Polynucleotide
taatacgactcactatagggcttgacgtgggctattgtgagggacgcaggaacagaggagacctgcgatgctcacaataaacctggcggcagcgcaaaagatg

SEQ ID NO: 228458 - DNA, 103 bp, Artificial Sequence
  Synthetic Polynucleotide
taatacgactcactatagggtgatgcttggcttgacgtgggctattgtgaaacagaggagatcacaaatgcccacgtcaaacctggcggcagcgcaaaagatg

SEQ ID NO: 228459 - DNA, 103 bp, Artificial Sequence
  Synthetic Polynucleotide
taatacgactcactatagggttcctcttcatgatgcttggcttgacgtggaacagaggagaccacgtatggccaagcataacctggcggcagcgcaaaagatg

SEQ ID NO: 228460 - DNA, 103 bp, Artificial Sequence
  Synthetic Polynucleotide
taatacgactcactatagggaaagctcccattcctcttcatgatgcttggaacagaggagaccaagcatgatgaagaggaacctggcggcagcgcaaaagatg

SEQ ID NO: 228461 - DNA, 103 bp, Artificial Sequence
  Synthetic Polynucleotide
taatacgactcactatagggagtactttggaaagctcccattcctcttcaaacagaggagatgaagaatgatgggagctaacctggcggcagcgcaaaagatg

SEQ ID NO: 228462 - DNA, 103 bp, Artificial Sequence
  Synthetic Polynucleotide
taatacgactcactatagggtggcaggcatagtactttggaaagctcccaaacagaggagatgggagatgtccaaagtaaacctggcggcagcgcaaaagatg

SEQ ID NO: 228463 - DNA, 103 bp, Artificial Sequence
  Synthetic Polynucleotide
taatacgactcactatagggtccacacaggtggcaggcatagtactttggaacagaggagaccaaagatgtatgcctgcaacctggcggcagcgcaaaagatg

SEQ ID NO: 228464 - DNA, 103 bp, Artificial Sequence
  Synthetic Polynucleotide
taatacgactcactatagggtgaagcgccgtccacacaggtggcaggcataacagaggagaatgcctatgacctgtgtgaacctggcggcagcgcaaaagatg

SEQ ID NO: 228465 - DNA, 103 bp, Artificial Sequence
  Synthetic Polynucleotide
taatacgactcactatagggctccggagagtgaagcgccgtccacacaggaacagaggagacctgtgatgacggcgcttaacctggcggcagcgcaaaagatg

SEQ ID NO: 228466 - DNA, 103 bp, Artificial Sequence
  Synthetic Polynucleotide
taatacgactcactatagggacgtaagctgctccggagagtgaagcgccgaacagaggagacggcgcatgactctccggaacctggcggcagcgcaaaagatg

SEQ ID NO: 228467 - DNA, 103 bp, Artificial Sequence
  Synthetic Polynucleotide
taatacgactcactatagggatacatcgccgattgcaaccgtgcagtcacaacagaggagagtgactatgcggttgcaaaacctggcggcagcgcaaaagatg

SEQ ID NO: 228468 - DNA, 103 bp, Artificial Sequence
  Synthetic Polynucleotide
taatacgactcactatagggggaggtgttcacgtaagctgctccggagagaacagaggagactctccatggcagcttacaacctggcggcagcgcaaaagatg

SEQ ID NO: 228469 - DNA, 103 bp, Artificial Sequence
  Synthetic Polynucleotide
taatacgactcactataggggtgtggatctggaggtgttcacgtaagctgaacagaggagacagcttatgtgaacacctaacctggcggcagcgcaaaagatg

SEQ ID NO: 228470 - DNA, 103 bp, Artificial Sequence
  Synthetic Polynucleotide
taatacgactcactatagggaggtactcctgtgtggatctggaggtgttcaacagaggagagaacacatgcagatccacaacctggcggcagcgcaaaagatg

SEQ ID NO: 228471 - DNA, 103 bp, Artificial Sequence
  Synthetic Polynucleotide
taatacgactcactatagggtagatgtgaaaggtactcctgtgtggatctaacagaggagaagatccatgcaggagtacaacctggcggcagcgcaaaagatg

SEQ ID NO: 228472 - DNA, 103 bp, Artificial Sequence
  Synthetic Polynucleotide
taatacgactcactatagggccctgttggctagatgtgaaaggtactcctaacagaggagaaggagtatgtttcacatcaacctggcggcagcgcaaaagatg

SEQ ID NO: 228473 - DNA, 103 bp, Artificial Sequence
  Synthetic Polynucleotide
taatacgactcactataggggcgactttctccctgttggctagatgtgaaaacagaggagattcacaatgagccaacagaacctggcggcagcgcaaaagatg

SEQ ID NO: 228474 - DNA, 103 bp, Artificial Sequence
  Synthetic Polynucleotide
taatacgactcactatagggtcagggggacgcgactttctccctgttggcaacagaggagagccaacatggagaaagtcaacctggcggcagcgcaaaagatg

SEQ ID NO: 228475 - DNA, 103 bp, Artificial Sequence
  Synthetic Polynucleotide
taatacgactcactatagggctacagagagtcagggggacgcgactttctaacagaggagaagaaagatgcgtccccctaacctggcggcagcgcaaaagatg

SEQ ID NO: 228476 - DNA, 103 bp, Artificial Sequence
  Synthetic Polynucleotide
taatacgactcactatagggagctgcattgctacagagagtcagggggacaacagaggagagtccccatgactctctgtaacctggcggcagcgcaaaagatg

SEQ ID NO: 228477 - DNA, 103 bp, Artificial Sequence
  Synthetic Polynucleotide
taatacgactcactatagggtcccgaggtcagctgcattgctacagagagaacagaggagactctctatggcaatgcagaacctggcggcagcgcaaaagatg

SEQ ID NO: 228478 - DNA, 103 bp, Artificial Sequence
  Synthetic Polynucleotide
taatacgactcactataggggccttgaagtatacatcgccgattgcaaccaacagaggagaggttgcatgcggcgatgtaacctggcggcagcgcaaaagatg

SEQ ID NO: 228479 - DNA, 103 bp, Artificial Sequence
  Synthetic Polynucleotide
taatacgactcactatagggatggcatctttcccgaggtcagctgcattgaacagaggagacaatgcatgtgacctcggaacctggcggcagcgcaaaagatg

SEQ ID NO: 228480 - DNA, 103 bp, Artificial Sequence
  Synthetic Polynucleotide
taatacgactcactatagggaggcacttccatggcatctttcccgaggtcaacagaggagagacctcatgaaagatgccaacctggcggcagcgcaaaagatg

SEQ ID NO: 228481 - DNA, 103 bp, Artificial Sequence
  Synthetic Polynucleotide
taatacgactcactatagggtcccggcttcaggcacttccatggcatcttaacagaggagaaagatgatgtggaagtgcaacctggcggcagcgcaaaagatg

SEQ ID NO: 228482 - DNA, 103 bp, Artificial Sequence
  Synthetic Polynucleotide
taatacgactcactatagggtcacttatcatcccggcttcaggcacttccaacagaggagaggaagtatgtgaagccggaacctggcggcagcgcaaaagatg

SEQ ID NO: 228483 - DNA, 103 bp, Artificial Sequence
  Synthetic Polynucleotide
taatacgactcactatagggcagctcactgtcacttatcatcccggcttcaacagaggagagaagccatgatgataagtaacctggcggcagcgcaaaagatg

SEQ ID NO: 228484 - DNA, 103 bp, Artificial Sequence
  Synthetic Polynucleotide
taatacgactcactatagggagatgtgctgcagctcactgtcacttatcaaacagaggagatgataaatgacagtgagcaacctggcggcagcgcaaaagatg

SEQ ID NO: 228485 - DNA, 103 bp, Artificial Sequence
  Synthetic Polynucleotide
taatacgactcactatagggggagaatcagagatgtgctgcagctcactgaacagaggagacagtgaatggcagcacataacctggcggcagcgcaaaagatg

SEQ ID NO: 228486 - DNA, 103 bp, Artificial Sequence
  Synthetic Polynucleotide
taatacgactcactatagggatcgatgatgggagaatcagagatgtgctgaacagaggagacagcacatgtctgattctaacctggcggcagcgcaaaagatg

SEQ ID NO: 228487 - DNA, 103 bp, Artificial Sequence
  Synthetic Polynucleotide
taatacgactcactataggggctgctgcccatcgatgatgggagaatcagaacagaggagactgattatgccatcatcgaacctggcggcagcgcaaaagatg

SEQ ID NO: 228488 - DNA, 103 bp, Artificial Sequence
  Synthetic Polynucleotide
taatacgactcactataggggtttccgactgctgctgcccatcgatgatgaacagaggagacatcatatgtgggcagcaaacctggcggcagcgcaaaagatg

SEQ ID NO: 228489 - DNA, 103 bp, Artificial Sequence
  Synthetic Polynucleotide
taatacgactcactatagggaaggttgatgctgtgaatgcgctcggtcataacagaggagaatgaccatgcgcattcacaacctggcggcagcgcaaaagatg

SEQ ID NO: 228490 - DNA, 103 bp, Artificial Sequence
  Synthetic Polynucleotide
taatacgactcactataggggctcccgtggatgcgcaccgttacgtcacaaacagaggagatgtgacatgacggtgcgcaacctggcggcagcgcaaaagatg

SEQ ID NO: 228491 - DNA, 103 bp, Artificial Sequence
  Synthetic Polynucleotide
taatacgactcactatagggtgcagcctgctcgggttgggtgggttcagcaacagaggagagctgaaatgacccaacccaacctggcggcagcgcaaaagatg

SEQ ID NO: 228492 - DNA, 103 bp, Artificial Sequence
  Synthetic Polynucleotide
taatacgactcactatagggcgggggcttctgcagcctgctcgggttgggaacagaggagacccaacatgagcaggctgaacctggcggcagcgcaaaagatg

SEQ ID NO: 228493 - DNA, 103 bp, Artificial Sequence
  Synthetic Polynucleotide
taatacgactcactatagggccaccctcagcgggggcttctgcagcctgcaacagaggagagcaggcatgagaagccccaacctggcggcagcgcaaaagatg

SEQ ID NO: 228494 - DNA, 103 bp, Artificial Sequence
  Synthetic Polynucleotide
taatacgactcactatagggtgtctgcggaccaccctcagcgggggcttcaacagaggagagaagccatggctgagggtaacctggcggcagcgcaaaagatg

SEQ ID NO: 228495 - DNA, 103 bp, Artificial Sequence
  Synthetic Polynucleotide
taatacgactcactatagggctagctggtttgtctgcggaccaccctcagaacagaggagactgaggatggtccgcagaaacctggcggcagcgcaaaagatg

SEQ ID NO: 228496 - DNA, 103 bp, Artificial Sequence
  Synthetic Polynucleotide
taatacgactcactataggggcacctgtttctagctggtttgtctgcggaaacagaggagatccgcaatgaaaccagctaacctggcggcagcgcaaaagatg

SEQ ID NO: 228497 - DNA, 103 bp, Artificial Sequence
  Synthetic Polynucleotide
taatacgactcactatagggcggagaggaagcacctgtttctagctggttaacagaggagaaaccagatggaaacaggtaacctggcggcagcgcaaaagatg

SEQ ID NO: 228498 - DNA, 103 bp, Artificial Sequence
  Synthetic Polynucleotide
taatacgactcactatagggtgcttctctccggagaggaagcacctgtttaacagaggagaaaacagatgcttcctctcaacctggcggcagcgcaaaagatg

SEQ ID NO: 228499 - DNA, 103 bp, Artificial Sequence
  Synthetic Polynucleotide
taatacgactcactatagggtccacttcattgcttctctccggagaggaaaacagaggagattcctcatgggagagaagaacctggcggcagcgcaaaagatg

SEQ ID NO: 228500 - DNA, 103 bp, Artificial Sequence
  Synthetic Polynucleotide
taatacgactcactataggggctgtccatctccacttcattgcttctctcaacagaggagagagagaatgaatgaagtgaacctggcggcagcgcaaaagatg

SEQ ID NO: 228501 - DNA, 103 bp, Artificial Sequence
  Synthetic Polynucleotide
taatacgactcactatagggcgcgcagcatgctcccgtggatgcgcaccgaacagaggagacggtgcatgtccacgggaaacctggcggcagcgcaaaagatg

SEQ ID NO: 228502 - DNA, 103 bp, Artificial Sequence
  Synthetic Polynucleotide
taatacgactcactatagggtgataacagtgctgtccatctccacttcataacagaggagaatgaagatgagatggacaaacctggcggcagcgcaaaagatg

SEQ ID NO: 228503 - DNA, 103 bp, Artificial Sequence
  Synthetic Polynucleotide
taatacgactcactatagggttgctgacagtgataacagtgctgtccatcaacagaggagagatggaatgcactgttataacctggcggcagcgcaaaagatg

SEQ ID NO: 228504 - DNA, 103 bp, Artificial Sequence
  Synthetic Polynucleotide
taatacgactcactataggggtcggagctgttgctgacagtgataacagtaacagaggagaactgttatgactgtcagcaacctggcggcagcgcaaaagatg

SEQ ID NO: 228505 - DNA, 103 bp, Artificial Sequence
  Synthetic Polynucleotide
taatacgactcactatagggggacgctcttgtcggagctgttgctgacagaacagaggagactgtcaatgacagctccgaacctggcggcagcgcaaaagatg

SEQ ID NO: 228506 - DNA, 103 bp, Artificial Sequence
  Synthetic Polynucleotide
taatacgactcactatagggggctgttgtaggacgctcttgtcggagctgaacagaggagacagctcatgcaagagcgtaacctggcggcagcgcaaaagatg

SEQ ID NO: 228507 - DNA, 103 bp, Artificial Sequence
  Synthetic Polynucleotide
taatacgactcactataggggttgaccgaaggctgttgtaggacgctcttaacagaggagaaagagcatgctacaacagaacctggcggcagcgcaaaagatg

SEQ ID NO: 228508 - DNA, 103 bp, Artificial Sequence
  Synthetic Polynucleotide
taatacgactcactatagggcgatggacgtgttgaccgaaggctgttgtaaacagaggagatacaacatgcttcggtcaaacctggcggcagcgcaaaagatg

SEQ ID NO: 228509 - DNA, 103 bp, Artificial Sequence
  Synthetic Polynucleotide
taatacgactcactatagggaatggctgcccgatggacgtgttgaccgaaaacagaggagattcggtatgcacgtccataacctggcggcagcgcaaaagatg

SEQ ID NO: 228510 - DNA, 103 bp, Artificial Sequence
  Synthetic Polynucleotide
taatacgactcactatagggggtacttggcaatggctgcccgatggacgtaacagaggagaacgtccatggggcagccaaacctggcggcagcgcaaaagatg

SEQ ID NO: 228511 - DNA, 103 bp, Artificial Sequence
  Synthetic Polynucleotide
taatacgactcactatagggagtagagctgggtacttggcaatggctgccaacagaggagaggcagcatgtgccaagtaaacctggcggcagcgcaaaagatg

SEQ ID NO: 228512 - DNA, 103 bp, Artificial Sequence
  Synthetic Polynucleotide
taatacgactcactatagggcagcggtgtgcgcgcagcatgctcccgtggaacagaggagaccacggatgcatgctgcgaacctggcggcagcgcaaaagatg

SEQ ID NO: 228513 - DNA, 103 bp, Artificial Sequence
  Synthetic Polynucleotide
taatacgactcactataggggtctggcgtaagtagagctgggtacttggcaacagaggagagccaagatgccagctctaaacctggcggcagcgcaaaagatg

SEQ ID NO: 228514 - DNA, 103 bp, Artificial Sequence
  Synthetic Polynucleotide
taatacgactcactataggggagggtttctgtctggcgtaagtagagctgaacagaggagacagctcatgttacgccagaacctggcggcagcgcaaaagatg

SEQ ID NO: 228515 - DNA, 103 bp, Artificial Sequence
  Synthetic Polynucleotide
taatacgactcactatagggggttgctggtgagggtttctgtctggcgtaaacagaggagatacgccatgcagaaacccaacctggcggcagcgcaaaagatg

SEQ ID NO: 228516 - DNA, 103 bp, Artificial Sequence
  Synthetic Polynucleotide
taatacgactcactatagggggcatcctcaggttgctggtgagggtttctaacagaggagaagaaacatgcaccagcaaaacctggcggcagcgcaaaagatg

SEQ ID NO: 228517 - DNA, 103 bp, Artificial Sequence
  Synthetic Polynucleotide
taatacgactcactatagggcaaggtcagaggcatcctcaggttgctggtaacagaggagaaccagcatgctgaggatgaacctggcggcagcgcaaaagatg

SEQ ID NO: 228518 - DNA, 103 bp, Artificial Sequence
  Synthetic Polynucleotide
taatacgactcactatagggtgttgctggtcaaggtcagaggcatcctcaaacagaggagatgaggaatgctctgacctaacctggcggcagcgcaaaagatg

SEQ ID NO: 228519 - DNA, 103 bp, Artificial Sequence
  Synthetic Polynucleotide
taatacgactcactatagggatgacctgcgtgttgctggtcaaggtcagaaacagaggagatctgacatggaccagcaaaacctggcggcagcgcaaaagatg

SEQ ID NO: 228520 - DNA, 103 bp, Artificial Sequence
  Synthetic Polynucleotide
taatacgactcactatagggagctgtgccaatgacctgcgtgttgctggtaacagaggagaaccagcatgacgcaggtcaacctggcggcagcgcaaaagatg

SEQ ID NO: 228521 - DNA, 103 bp, Artificial Sequence
  Synthetic Polynucleotide
taatacgactcactatagggaggtgttgccagctgtgccaatgacctgcgaacagaggagacgcaggatgttggcacagaacctggcggcagcgcaaaagatg

SEQ ID NO: 228522 - DNA, 103 bp, Artificial Sequence
  Synthetic Polynucleotide
taatacgactcactataggggctggcaggtaggtgttgccagctgtgccaaacagaggagatggcacatgtggcaacacaacctggcggcagcgcaaaagatg

SEQ ID NO: 228523 - DNA, 103 bp, Artificial Sequence
  Synthetic Polynucleotide
taatacgactcactatagggtgccagcacgcagcggtgtgcgcgcagcataacagaggagaatgctgatggcacaccgcaacctggcggcagcgcaaaagatg

SEQ ID NO: 228524 - DNA, 103 bp, Artificial Sequence
  Synthetic Polynucleotide
taatacgactcactatagggagtgaagagggctggcaggtaggtgttgccaacagaggagaggcaacatgtacctgccaaacctggcggcagcgcaaaagatg

SEQ ID NO: 228525 - DNA, 103 bp, Artificial Sequence
  Synthetic Polynucleotide
taatacgactcactatagggcgggctgggtagtgaagagggctggcaggtaacagaggagaacctgcatgccctcttcaaacctggcggcagcgcaaaagatg

SEQ ID NO: 228526 - DNA, 103 bp, Artificial Sequence
  Synthetic Polynucleotide
taatacgactcactatagggccactgcccgcgggctgggtagtgaagaggaacagaggagacctcttatgtacccagccaacctggcggcagcgcaaaagatg

SEQ ID NO: 228527 - DNA, 103 bp, Artificial Sequence
  Synthetic Polynucleotide
taatacgactcactatagggaggcttggggccactgcccgcgggctgggtaacagaggagaacccagatggcgggcagtaacctggcggcagcgcaaaagatg

SEQ ID NO: 228528 - DNA, 103 bp, Artificial Sequence
  Synthetic Polynucleotide
taatacgactcactatagggtgaagaggaaaggcttggggccactgcccgaacagaggagacgggcaatggccccaagcaacctggcggcagcgcaaaagatg

SEQ ID NO: 228529 - DNA, 103 bp, Artificial Sequence
  Synthetic Polynucleotide
taatacgactcactatagggtgtggcaggctgaagaggaaaggcttggggaacagaggagaccccaaatgtttcctcttaacctggcggcagcgcaaaagatg

SEQ ID NO: 228530 - DNA, 103 bp, Artificial Sequence
  Synthetic Polynucleotide
taatacgactcactatagggtgccaggggctgtggcaggctgaagaggaaaacagaggagattcctcatgagcctgccaaacctggcggcagcgcaaaagatg

SEQ ID NO: 228531 - DNA, 103 bp, Artificial Sequence
  Synthetic Polynucleotide
taatacgactcactatagggtctgctggcctgccaggggctgtggcaggcaacagaggagagcctgcatgagcccctggaacctggcggcagcgcaaaagatg

SEQ ID NO: 228532 - DNA, 103 bp, Artificial Sequence
  Synthetic Polynucleotide
taatacgactcactatagggacaaactgggtctgctggcctgccaggggcaacagaggagagcccctatgaggccagcaaacctggcggcagcgcaaaagatg

SEQ ID NO: 228533 - DNA, 103 bp, Artificial Sequence
  Synthetic Polynucleotide
taatacgactcactatagggggacactgtcacaaactgggtctgctggccaacagaggagaggccagatgacccagtttaacctggcggcagcgcaaaagatg

SEQ ID NO: 228534 - DNA, 103 bp, Artificial Sequence
  Synthetic Polynucleotide
taatacgactcactatagggggctgccggctgccagcacgcagcggtgtgaacagaggagacacaccatggcgtgctggaacctggcggcagcgcaaaagatg

SEQ ID NO: 228535 - DNA, 103 bp, Artificial Sequence
  Synthetic Polynucleotide
taatacgactcactataggggaccgggctgggacactgtcacaaactgggaacagaggagacccagtatgtgacagtgtaacctggcggcagcgcaaaagatg

SEQ ID NO: 228536 - DNA, 103 bp, Artificial Sequence
  Synthetic Polynucleotide
taatacgactcactatagggaaggtcgacagaccgggctgggacactgtcaacagaggagagacagtatgccagcccggaacctggcggcagcgcaaaagatg

SEQ ID NO: 228537 - DNA, 103 bp, Artificial Sequence
  Synthetic Polynucleotide
taatacgactcactatagggctgtgcagtaaaggtcgacagaccgggctgaacagaggagacagcccatgctgtcgaccaacctggcggcagcgcaaaagatg

SEQ ID NO: 228538 - DNA, 103 bp, Artificial Sequence
  Synthetic Polynucleotide
taatacgactcactataggggcgctggcagctgtgcagtaaaggtcgacaaacagaggagatgtcgaatgttactgcacaacctggcggcagcgcaaaagatg

SEQ ID NO: 228539 - DNA, 103 bp, Artificial Sequence
  Synthetic Polynucleotide
taatacgactcactatagggaggggctgtggcgctggcagctgtgcagtaaacagaggagatactgcatggctgccagcaacctggcggcagcgcaaaagatg

SEQ ID NO: 228540 - DNA, 103 bp, Artificial Sequence
  Synthetic Polynucleotide
taatacgactcactatagggggatgaggccaggggctgtggcgctggcagaacagaggagactgccaatgccacagcccaacctggcggcagcgcaaaagatg

SEQ ID NO: 228541 - DNA, 103 bp, Artificial Sequence
  Synthetic Polynucleotide
taatacgactcactatagggtgtggcctgcggatgaggccaggggctgtgaacagaggagacacagcatgtggcctcataacctggcggcagcgcaaaagatg

SEQ ID NO: 228542 - DNA, 103 bp, Artificial Sequence
  Synthetic Polynucleotide
taatacgactcactatagggctggctgtgctgtggcctgcggatgaggccaacagaggagaggcctcatgcgcaggccaaacctggcggcagcgcaaaagatg

SEQ ID NO: 228543 - DNA, 103 bp, Artificial Sequence
  Synthetic Polynucleotide
taatacgactcactataggggccttgcccactggctgtgctgtggcctgcaacagaggagagcaggcatgagcacagccaacctggcggcagcgcaaaagatg

SEQ ID NO: 228544 - DNA, 103 bp, Artificial Sequence
  Synthetic Polynucleotide
taatacgactcactataggggctttttttcgccttgcccactggctgtgcaacagaggagagcacagatggtgggcaagaacctggcggcagcgcaaaagatg

SEQ ID NO: 228545 - DNA, 103 bp, Artificial Sequence
  Synthetic Polynucleotide
taatacgactcactatagggtggaagaaggggctgccggctgccagcacgaacagaggagacgtgctatgagccggcagaacctggcggcagcgcaaaagatg

SEQ ID NO: 228546 - DNA, 103 bp, Artificial Sequence
  Synthetic Polynucleotide
taatacgactcactatagggcactcataaggctttttttcgccttgcccaaacagaggagatgggcaatgcgaaaaaaaaacctggcggcagcgcaaaagatg

SEQ ID NO: 228547 - DNA, 103 bp, Artificial Sequence
  Synthetic Polynucleotide
taatacgactcactataggggcagagagtgcactcataaggctttttttcaacagaggagagaaaaaatgccttatgagaacctggcggcagcgcaaaagatg

SEQ ID NO: 228548 - DNA, 103 bp, Artificial Sequence
  Synthetic Polynucleotide
taatacgactcactatagggaagtcttgttgcagagagtgcactcataagaacagaggagacttatgatggcactctctaacctggcggcagcgcaaaagatg

SEQ ID NO: 228549 - DNA, 103 bp, Artificial Sequence
  Synthetic Polynucleotide
taatacgactcactatagggttggcggtgaaagtcttgttgcagagagtgaacagaggagacactctatgcaacaagacaacctggcggcagcgcaaaagatg

SEQ ID NO: 228550 - DNA, 103 bp, Artificial Sequence
  Synthetic Polynucleotide
taatacgactcactataggggtagttctgtttggcggtgaaagtcttgttaacagaggagaaacaagatgttcaccgccaacctggcggcagcgcaaaagatg

SEQ ID NO: 228551 - DNA, 103 bp, Artificial Sequence
  Synthetic Polynucleotide
taatacgactcactatagggtgtgcttgacgtagttctgtttggcggtgaaacagaggagatcaccgatgaacagaactaacctggcggcagcgcaaaagatg

SEQ ID NO: 228552 - DNA, 103 bp, Artificial Sequence
  Synthetic Polynucleotide
taatacgactcactatagggtgtacgaacatgtgcttgacgtagttctgtaacagaggagaacagaaatgcgtcaagcaaacctggcggcagcgcaaaagatg

SEQ ID NO: 228553 - DNA, 103 bp, Artificial Sequence
  Synthetic Polynucleotide
taatacgactcactatagggctcacctgtgtgtacgaacatgtgcttgacaacagaggagagtcaagatgatgttcgtaaacctggcggcagcgcaaaagatg

SEQ ID NO: 228554 - DNA, 103 bp, Artificial Sequence
  Synthetic Polynucleotide
taatacgactcactatagggggtggggcttctcacctgtgtgtacgaacaaacagaggagatgttcgatgacacaggtgaacctggcggcagcgcaaaagatg

SEQ ID NO: 228555 - DNA, 103 bp, Artificial Sequence
  Synthetic Polynucleotide
taatacgactcactatagggatgctgcattggtggggcttctcacctgtgaacagaggagacacaggatggaagccccaaacctggcggcagcgcaaaagatg

SEQ ID NO: 228556 - DNA, 103 bp, Artificial Sequence
  Synthetic Polynucleotide
taatacgactcactatagggcagtttgtcctggaagaaggggctgccggcaacagaggagagccggcatgcccttcttcaacctggcggcagcgcaaaagatg

SEQ ID NO: 228557 - DNA, 103 bp, Artificial Sequence
  Synthetic Polynucleotide
taatacgactcactataggggcgccaacagatgctgcattggtggggcttaacagaggagaaagcccatgcaatgcagcaacctggcggcagcgcaaaagatg

SEQ ID NO: 228558 - DNA, 103 bp, Artificial Sequence
  Synthetic Polynucleotide
taatacgactcactatagggaggagaaggagcgccaacagatgctgcattaacagaggagaaatgcaatgtctgttggcaacctggcggcagcgcaaaagatg

SEQ ID NO: 228559 - DNA, 103 bp, Artificial Sequence
  Synthetic Polynucleotide
taatacgactcactatagggtaatcctttaaggagaaggagcgccaacagaacagaggagactgttgatgctccttctcaacctggcggcagcgcaaaagatg

SEQ ID NO: 228560 - DNA, 103 bp, Artificial Sequence
  Synthetic Polynucleotide
taatacgactcactatagggcttgataaggtaatcctttaaggagaaggaaacagaggagatccttcatgttaaaggataacctggcggcagcgcaaaagatg

SEQ ID NO: 228561 - DNA, 103 bp, Artificial Sequence
  Synthetic Polynucleotide
taatacgactcactatagggtcaccatgtgcttgataaggtaatcctttaaacagaggagataaaggatgaccttatcaaacctggcggcagcgcaaaagatg

SEQ ID NO: 228562 - DNA, 103 bp, Artificial Sequence
  Synthetic Polynucleotide
taatacgactcactatagggcctgtgtgtgtcaccatgtgcttgataaggaacagaggagaccttatatggcacatggtaacctggcggcagcgcaaaagatg

SEQ ID NO: 228563 - DNA, 103 bp, Artificial Sequence
  Synthetic Polynucleotide
taatacgactcactatagggtgccctcactcctgtgtgtgtcaccatgtgaacagaggagacacatgatgacacacacaaacctggcggcagcgcaaaagatg

SEQ ID NO: 228564 - DNA, 103 bp, Artificial Sequence
  Synthetic Polynucleotide
taatacgactcactatagggtacactggtatgccctcactcctgtgtgtgaacagaggagacacacaatggagtgagggaacctggcggcagcgcaaaagatg

SEQ ID NO: 228565 - DNA, 103 bp, Artificial Sequence
  Synthetic Polynucleotide
taatacgactcactatagggttgcagatactacactggtatgccctcactaacagaggagaagtgagatgataccagtgaacctggcggcagcgcaaaagatg

SEQ ID NO: 228566 - DNA, 103 bp, Artificial Sequence
  Synthetic Polynucleotide
taatacgactcactataggggaagcgcttgttgcagatactacactggtaaacagaggagataccagatgagtatctgcaacctggcggcagcgcaaaagatg

SEQ ID NO: 228567 - DNA, 103 bp, Artificial Sequence
  Synthetic Polynucleotide
taatacgactcactatagggagccaagcagcagtttgtcctggaagaaggaacagaggagaccttctatgaggacaaacaacctggcggcagcgcaaaagatg

SEQ ID NO: 228568 - DNA, 103 bp, Artificial Sequence
  Synthetic Polynucleotide
taatacgactcactatagggtcttctgggtgaagcgcttgttgcagatacaacagaggagagtatctatgacaagcgctaacctggcggcagcgcaaaagatg

SEQ ID NO: 228569 - DNA, 103 bp, Artificial Sequence
  Synthetic Polynucleotide
taatacgactcactatagggttgagggagctcttctgggtgaagcgcttgaacagaggagacaagcgatgcacccagaaaacctggcggcagcgcaaaagatg

SEQ ID NO: 228570 - DNA, 103 bp, Artificial Sequence
  Synthetic Polynucleotide
taatacgactcactatagggcatgtgcacgttgagggagctcttctgggtaacagaggagaacccagatgagctccctcaacctggcggcagcgcaaaagatg

SEQ ID NO: 228571 - DNA, 103 bp, Artificial Sequence
  Synthetic Polynucleotide
taatacgactcactatagggggtggaggcgcatgtgcacgttgagggagcaacagaggagagctcccatgacgtgcacaaacctggcggcagcgcaaaagatg

SEQ ID NO: 228572 - DNA, 103 bp, Artificial Sequence
  Synthetic Polynucleotide
taatacgactcactatagggttctctccccggtggaggcgcatgtgcacgaacagaggagacgtgcaatggcgcctccaaacctggcggcagcgcaaaagatg

SEQ ID NO: 228573 - DNA, 103 bp, Artificial Sequence
  Synthetic Polynucleotide
taatacgactcactatagggctcgtaggacttctctccccggtggaggcgaacagaggagacgcctcatgcggggagagaacctggcggcagcgcaaaagatg

SEQ ID NO: 228574 - DNA, 103 bp, Artificial Sequence
  Synthetic Polynucleotide
taatacgactcactatagggagatgtagcactcgtaggacttctctccccaacagaggagaggggagatgagtcctacgaacctggcggcagcgcaaaagatg

SEQ ID NO: 228575 - DNA, 103 bp, Artificial Sequence
  Synthetic Polynucleotide
taatacgactcactatagggttctttttgcagatgtagcactcgtaggacaacagaggagagtcctaatggtgctacataacctggcggcagcgcaaaagatg

SEQ ID NO: 228576 - DNA, 103 bp, Artificial Sequence
  Synthetic Polynucleotide
taatacgactcactataggggtgagagaacttctttttgcagatgtagcaaacagaggagatgctacatgtgcaaaaagaacctggcggcagcgcaaaagatg

SEQ ID NO: 228577 - DNA, 103 bp, Artificial Sequence
  Synthetic Polynucleotide
taatacgactcactatagggggagggtcttgtgagagaacttctttttgcaacagaggagagcaaaaatgagttctctcaacctggcggcagcgcaaaagatg

SEQ ID NO: 228578 - DNA, 103 bp, Artificial Sequence
  Synthetic Polynucleotide
taatacgactcactatagggatgtcgctgtagccaagcagcagtttgtccaacagaggagaggacaaatggctgcttggaacctggcggcagcgcaaaagatg

SEQ ID NO: 228579 - DNA, 103 bp, Artificial Sequence
  Synthetic Polynucleotide
taatacgactcactatagggtgtcgctccaggagggtcttgtgagagaacaacagaggagagttctcatgcaagaccctaacctggcggcagcgcaaaagatg

SEQ ID NO: 228580 - DNA, 103 bp, Artificial Sequence
  Synthetic Polynucleotide
taatacgactcactatagggcagggccacgtgtcgctccaggagggtcttaacagaggagaaagaccatgctggagcgaaacctggcggcagcgcaaaagatg

SEQ ID NO: 228581 - DNA, 103 bp, Artificial Sequence
  Synthetic Polynucleotide
taatacgactcactatagggtggcactgtgcagggccacgtgtcgctccaaacagaggagatggagcatgacgtggcccaacctggcggcagcgcaaaagatg

SEQ ID NO: 228582 - DNA, 103 bp, Artificial Sequence
  Synthetic Polynucleotide
taatacgactcactataggggtcccattgctggcactgtgcagggccacgaacagaggagacgtggcatggcacagtgcaacctggcggcagcgcaaaagatg

SEQ ID NO: 228583 - DNA, 103 bp, Artificial Sequence
  Synthetic Polynucleotide
taatacgactcactatagggtgcagggggggtcccattgctggcactgtgaacagaggagacacagtatgagcaatgggaacctggcggcagcgcaaaagatg

SEQ ID NO: 228584 - DNA, 103 bp, Artificial Sequence
  Synthetic Polynucleotide
taatacgactcactatagggggggtgtgcctgcagggggggtcccattgcaacagaggagagcaatgatgccccccctgaacctggcggcagcgcaaaagatg

SEQ ID NO: 228585 - DNA, 103 bp, Artificial Sequence
  Synthetic Polynucleotide
taatacgactcactatagggcgggcacctgggggtgtgcctgcaggggggaacagaggagaccccccatgaggcacaccaacctggcggcagcgcaaaagatg

SEQ ID NO: 228586 - DNA, 103 bp, Artificial Sequence
  Synthetic Polynucleotide
taatacgactcactatagggggggccagcgcgggcacctgggggtgtgccaacagaggagaggcacaatgccaggtgccaacctggcggcagcgcaaaagatg

SEQ ID NO: 228587 - DNA, 103 bp, Artificial Sequence
  Synthetic Polynucleotide
taatacgactcactatagggccacgcctggggggccagcgcgggcacctgaacagaggagacaggtgatggcgctggccaacctggcggcagcgcaaaagatg

SEQ ID NO: 228588 - DNA, 103 bp, Artificial Sequence
  Synthetic Polynucleotide
taatacgactcactataggggtgcaggccaccacgcctggggggccagcgaacagaggagacgctggatgcccaggcgtaacctggcggcagcgcaaaagatg

SEQ ID NO: 228589 - DNA, 103 bp, Artificial Sequence
  Synthetic Polynucleotide
taatacgactcactatagggcgggatctcgatgtcgctgtagccaagcagaacagaggagactgcttatgtacagcgacaacctggcggcagcgcaaaagatg

SEQ ID NO: 228590 - DNA, 103 bp, Artificial Sequence
  Synthetic Polynucleotide
taatacgactcactatagggggtcccctccgtgcaggccaccacgcctggaacagaggagaccaggcatggtggcctgcaacctggcggcagcgcaaaagatg

SEQ ID NO: 228591 - DNA, 103 bp, Artificial Sequence
  Synthetic Polynucleotide
taatacgactcactatagggagacgtaagtggtcccctccgtgcaggccaaacagaggagatggcctatgcggaggggaaacctggcggcagcgcaaaagatg

SEQ ID NO: 228592 - DNA, 103 bp, Artificial Sequence
  Synthetic Polynucleotide
taatacgactcactatagggcagacggagcagacgtaagtggtcccctccaacagaggagaggagggatgcacttacgtaacctggcggcagcgcaaaagatg

SEQ ID NO: 228593 - DNA, 103 bp, Artificial Sequence
  Synthetic Polynucleotide
taatacgactcactatagggctttgctgggcagacggagcagacgtaagtaacagaggagaacttacatgtgctccgtcaacctggcggcagcgcaaaagatg

SEQ ID NO: 228594 - DNA, 103 bp, Artificial Sequence
  Synthetic Polynucleotide
taatacgactcactatagggtttggtcaaactttgctgggcagacggagcaacagaggagagctccgatggcccagcaaaacctggcggcagcgcaaaagatg

SEQ ID NO: 228595 - DNA, 103 bp, Artificial Sequence
  Synthetic Polynucleotide
taatacgactcactatagggaactgctcgatttggtcaaactttgctgggaacagaggagacccagcatggtttgaccaaacctggcggcagcgcaaaagatg

SEQ ID NO: 228596 - DNA, 103 bp, Artificial Sequence
  Synthetic Polynucleotide
taatacgactcactataggggtggtcgttgaactgctcgatttggtcaaaaacagaggagatttgacatgatcgagcagaacctggcggcagcgcaaaagatg

SEQ ID NO: 228597 - DNA, 103 bp, Artificial Sequence
  Synthetic Polynucleotide
taatacgactcactataggggcatcctcatgtggtcgttgaactgctcgaaacagaggagatcgagcatgtcaacgaccaacctggcggcagcgcaaaagatg

SEQ ID NO: 228598 - DNA, 103 bp, Artificial Sequence
  Synthetic Polynucleotide
taatacgactcactatagggtcagacacatgcatcctcatgtggtcgttgaacagaggagacaacgaatgcatgaggataacctggcggcagcgcaaaagatg

SEQ ID NO: 228599 - DNA, 103 bp, Artificial Sequence
  Synthetic Polynucleotide
taatacgactcactatagggtgaagttgtgaaggttgatgctgtgaatgcaacagaggagagcattcatggcatcaaccaacctggcggcagcgcaaaagatg

SEQ ID NO: 228600 - DNA, 103 bp, Artificial Sequence
  Synthetic Polynucleotide
taatacgactcactatagggacaccaccgacgggatctcgatgtcgctgtaacagaggagaacagcgatgtcgagatccaacctggcggcagcgcaaaagatg

SEQ ID NO: 228601 - DNA, 103 bp, Artificial Sequence
  Synthetic Polynucleotide
taatacgactcactataggggactgcactgacaccaccgacgggatctcgaacagaggagacgagatatggtcggtggtaacctggcggcagcgcaaaagatg

SEQ ID NO: 228602 - DNA, 103 bp, Artificial Sequence
  Synthetic Polynucleotide
taatacgactcactatagggcttttgcactgactgcactgacaccaccgaaacagaggagatcggtgatgtcagtgcagaacctggcggcagcgcaaaagatg

SEQ ID NO: 228603 - DNA, 103 bp, Artificial Sequence
  Synthetic Polynucleotide
taatacgactcactatagggagtcaatgagcttttgcactgactgcactgaacagaggagacagtgcatgcagtgcaaaaacctggcggcagcgcaaaagatg

SEQ ID NO: 228604 - DNA, 103 bp, Artificial Sequence
  Synthetic Polynucleotide
taatacgactcactatagggctgtacatgaagtcaatgagcttttgcactaacagaggagaagtgcaatggctcattgaaacctggcggcagcgcaaaagatg

SEQ ID NO: 228605 - DNA, 103 bp, Artificial Sequence
  Synthetic Polynucleotide
taatacgactcactatagggtagcacgccgctgtacatgaagtcaatgagaacagaggagactcattatgttcatgtacaacctggcggcagcgcaaaagatg

SEQ ID NO: 228606 - DNA, 103 bp, Artificial Sequence
  Synthetic Polynucleotide
taatacgactcactataggggcgagacccgtagcacgccgctgtacatgaaacagaggagatcatgtatggcggcgtgcaacctggcggcagcgcaaaagatg

SEQ ID NO: 228607 - DNA, 103 bp, Artificial Sequence
  Synthetic Polynucleotide
taatacgactcactataggggcttccgactgcgagacccgtagcacgccgaacagaggagacggcgtatgacgggtctcaacctggcggcagcgcaaaagatg

SEQ ID NO: 228608 - DNA, 103 bp, Artificial Sequence
  Synthetic Polynucleotide
taatacgactcactataggggatctgcagagcttccgactgcgagacccgaacagaggagacgggtcatgcagtcggaaaacctggcggcagcgcaaaagatg

SEQ ID NO: 228609 - DNA, 103 bp, Artificial Sequence
  Synthetic Polynucleotide
taatacgactcactatagggcggccgtgaggatctgcagagcttccgactaacagaggagaagtcggatgctctgcagaaacctggcggcagcgcaaaagatg

SEQ ID NO: 228610 - DNA, 103 bp, Artificial Sequence
  Synthetic Polynucleotide
taatacgactcactatagggacggaattgctgaagttgtgaaggttgatgaacagaggagacatcaaatgtcacaacttaacctggcggcagcgcaaaagatg

SEQ ID NO: 228611 - DNA, 103 bp, Artificial Sequence
  Synthetic Polynucleotide
taatacgactcactatagggaggatgctggcggccgtgaggatctgcagaaacagaggagatctgcaatgcctcacggcaacctggcggcagcgcaaaagatg

SEQ ID NO: 228612 - DNA, 103 bp, Artificial Sequence
  Synthetic Polynucleotide
taatacgactcactatagggtttgatctgcaggatgctggcggccgtgagaacagaggagactcacgatggccagcatcaacctggcggcagcgcaaaagatg

SEQ ID NO: 228613 - DNA, 103 bp, Artificial Sequence
  Synthetic Polynucleotide
taatacgactcactatagggcgatgactgttttgatctgcaggatgctggaacagaggagaccagcaatgtgcagatcaaacctggcggcagcgcaaaagatg

SEQ ID NO: 228614 - DNA, 103 bp, Artificial Sequence
  Synthetic Polynucleotide
taatacgactcactataggggtgcactcgtcgatgactgttttgatctgcaacagaggagagcagatatgaacagtcataacctggcggcagcgcaaaagatg

SEQ ID NO: 228615 - DNA, 103 bp, Artificial Sequence
  Synthetic Polynucleotide
taatacgactcactatagggcacgatgcgcgtgcactcgtcgatgactgtaacagaggagaacagtcatggacgagtgcaacctggcggcagcgcaaaagatg

SEQ ID NO: 228616 - DNA, 103 bp, Artificial Sequence
  Synthetic Polynucleotide
taatacgactcactatagggcgttctgtgacacgatgcgcgtgcactcgtaacagaggagaacgagtatgcgcgcatcgaacctggcggcagcgcaaaagatg

SEQ ID NO: 228617 - DNA, 103 bp, Artificial Sequence
  Synthetic Polynucleotide
taatacgactcactatagggacatcgcccacgttctgtgacacgatgcgcaacagaggagagcgcatatggtcacagaaaacctggcggcagcgcaaaagatg

SEQ ID NO: 228618 - DNA, 103 bp, Artificial Sequence
  Synthetic Polynucleotide
taatacgactcactatagggccccgggaacacatcgcccacgttctgtgaaacagaggagatcacagatggtgggcgataacctggcggcagcgcaaaagatg

SEQ ID NO: 228619 - DNA, 103 bp, Artificial Sequence
  Synthetic Polynucleotide
taatacgactcactatagggagtcctggatccccgggaacacatcgcccaaacagaggagatgggcgatgtgttcccggaacctggcggcagcgcaaaagatg

SEQ ID NO: 228620 - DNA, 103 bp, Artificial Sequence
  Synthetic Polynucleotide
taatacgactcactatagggtcctggcccgagtcctggatccccgggaacaacagaggagagttcccatggatccaggaaacctggcggcagcgcaaaagatg

SEQ ID NO: 228621 - DNA, 103 bp, Artificial Sequence
  Synthetic Polynucleotide
taatacgactcactatagggggtctcgagcacggaattgctgaagttgtgaacagaggagacacaacatgagcaattccaacctggcggcagcgcaaaagatg

SEQ ID NO: 228622 - DNA, 103 bp, Artificial Sequence
  Synthetic Polynucleotide
taatacgactcactatagggccgcggcgtgtcctggcccgagtcctggataacagaggagaatccagatgtcgggccagaacctggcggcagcgcaaaagatg

SEQ ID NO: 228623 - DNA, 103 bp, Artificial Sequence
  Synthetic Polynucleotide
taatacgactcactatagggcgggagtgccccgcggcgtgtcctggcccgaacagaggagacgggccatgacacgccgcaacctggcggcagcgcaaaagatg

SEQ ID NO: 228624 - DNA, 103 bp, Artificial Sequence
  Synthetic Polynucleotide
taatacgactcactataggggtgcctgactcgggagtgccccgcggcgtgaacagaggagacacgccatggggcactccaacctggcggcagcgcaaaagatg

SEQ ID NO: 228625 - DNA, 103 bp, Artificial Sequence
  Synthetic Polynucleotide
taatacgactcactatagggctggcctgacgtgcctgactcgggagtgccaacagaggagaggcactatggagtcaggcaacctggcggcagcgcaaaagatg

SEQ ID NO: 228626 - DNA, 103 bp, Artificial Sequence
  Synthetic Polynucleotide
taatacgactcactatagggtgtcgctgctctggcctgacgtgcctgactaacagaggagaagtcagatgcgtcaggccaacctggcggcagcgcaaaagatg

SEQ ID NO: 228627 - DNA, 103 bp, Artificial Sequence
  Synthetic Polynucleotide
taatacgactcactatagggcccgactccgtgtcgctgctctggcctgacaacagaggagagtcaggatggagcagcgaaacctggcggcagcgcaaaagatg

SEQ ID NO: 228628 - DNA, 103 bp, Artificial Sequence
  Synthetic Polynucleotide
taatacgactcactatagggctgcaggtagcccgactccgtgtcgctgctaacagaggagaagcagcatgacggagtcgaacctggcggcagcgcaaaagatg

SEQ ID NO: 228629 - DNA, 103 bp, Artificial Sequence
  Synthetic Polynucleotide
taatacgactcactataggggtgggtggctctgcaggtagcccgactccgaacagaggagacggagtatggctacctgcaacctggcggcagcgcaaaagatg

SEQ ID NO: 228630 - DNA, 103 bp, Artificial Sequence
  Synthetic Polynucleotide
taatacgactcactatagggacgctgtgctgtgggtggctctgcaggtagaacagaggagactacctatggagccacccaacctggcggcagcgcaaaagatg

SEQ ID NO: 228631 - DNA, 103 bp, Artificial Sequence
  Synthetic Polynucleotide
taatacgactcactataggggatcctgtccacgctgtgctgtgggtggctaacagaggagaagccacatgcagcacagcaacctggcggcagcgcaaaagatg

SEQ ID NO: 228632 - DNA, 103 bp, Artificial Sequence
  Synthetic Polynucleotide
taatacgactcactataggggctcgttgagggtctcgagcacggaattgcaacagaggagagcaattatgtgctcgagaaacctggcggcagcgcaaaagatg

SEQ ID NO: 228633 - DNA, 103 bp, Artificial Sequence
  Synthetic Polynucleotide
taatacgactcactataggggtgccgagtagatcctgtccacgctgtgctaacagaggagaagcacaatgtggacaggaaacctggcggcagcgcaaaagatg

SEQ ID NO: 228634 - DNA, 103 bp, Artificial Sequence
  Synthetic Polynucleotide
taatacgactcactatagggcacgcgtagagtgccgagtagatcctgtccaacagaggagaggacagatgctactcggcaacctggcggcagcgcaaaagatg

SEQ ID NO: 228635 - DNA, 103 bp, Artificial Sequence
  Synthetic Polynucleotide
taatacgactcactatagggctgcatggagcacgcgtagagtgccgagtaaacagaggagatactcgatgctctacgcgaacctggcggcagcgcaaaagatg

SEQ ID NO: 228636 - DNA, 103 bp, Artificial Sequence
  Synthetic Polynucleotide
taatacgactcactatagggcgctgccattctgcatggagcacgcgtagaaacagaggagatctacgatggctccatgcaacctggcggcagcgcaaaagatg

SEQ ID NO: 228637 - DNA, 103 bp, Artificial Sequence
  Synthetic Polynucleotide
taatacgactcactataggggagcgctcgccgctgccattctgcatggagaacagaggagactccatatggaatggcagaacctggcggcagcgcaaaagatg

SEQ ID NO: 228638 - DNA, 103 bp, Artificial Sequence
  Synthetic Polynucleotide
taatacgactcactataggggctgtaaaaagagcgctcgccgctgccattaacagaggagaaatggcatgggcgagcgcaacctggcggcagcgcaaaagatg

SEQ ID NO: 228639 - DNA, 103 bp, Artificial Sequence
  Synthetic Polynucleotide
taatacgactcactatagggccactgcgccgctgtaaaaagagcgctcgcaacagaggagagcgagcatgctttttacaaacctggcggcagcgcaaaagatg

SEQ ID NO: 228640 - DNA, 103 bp, Artificial Sequence
  Synthetic Polynucleotide
taatacgactcactatagggtggtggctgaccactgcgccgctgtaaaaaaacagaggagatttttaatgcggcgcagtaacctggcggcagcgcaaaagatg

SEQ ID NO: 228641 - DNA, 103 bp, Artificial Sequence
  Synthetic Polynucleotide
taatacgactcactatagggcgcagtctcgtggtggctgaccactgcgccaacagaggagaggcgcaatggtcagccacaacctggcggcagcgcaaaagatg

SEQ ID NO: 228642 - DNA, 103 bp, Artificial Sequence
  Synthetic Polynucleotide
taatacgactcactataggggcaggccgagcgcagtctcgtggtggctgaaacagaggagatcagccatgacgagactgaacctggcggcagcgcaaaagatg

SEQ ID NO: 228643 - DNA, 103 bp, Artificial Sequence
  Synthetic Polynucleotide
taatacgactcactatagggcggttgcgctgctcgttgagggtctcgagcaacagaggagagctcgaatgcctcaacgaaacctggcggcagcgcaaaagatg

SEQ ID NO: 228644 - DNA, 103 bp, Artificial Sequence
  Synthetic Polynucleotide
taatacgactcactatagggtggtcgcggggcaggccgagcgcagtctcgaacagaggagacgagacatggctcggcctaacctggcggcagcgcaaaagatg

SEQ ID NO: 228645 - DNA, 103 bp, Artificial Sequence
  Synthetic Polynucleotide
taatacgactcactatagggttccatgtggtggtcgcggggcaggccgagaacagaggagactcggcatgccccgcgacaacctggcggcagcgcaaaagatg

SEQ ID NO: 228646 - DNA, 103 bp, Artificial Sequence
  Synthetic Polynucleotide
taatacgactcactatagggagctggggtcttccatgtggtggtcgcgggaacagaggagacccgcgatgaccacatggaacctggcggcagcgcaaaagatg

SEQ ID NO: 228647 - DNA, 103 bp, Artificial Sequence
  Synthetic Polynucleotide
taatacgactcactatagggcgtgtgatccagctggggtcttccatgtggaacagaggagaccacatatgagaccccagaacctggcggcagcgcaaaagatg

SEQ ID NO: 228648 - DNA, 103 bp, Artificial Sequence
  Synthetic Polynucleotide
taatacgactcactatagggctcatggatgcgtgtgatccagctggggtcaacagaggagagaccccatgtggatcacaaacctggcggcagcgcaaaagatg

SEQ ID NO: 228649 - DNA, 103 bp, Artificial Sequence
  Synthetic Polynucleotide
taatacgactcactataggggctgcgagcgctcatggatgcgtgtgatccaacagaggagaggatcaatggcatccatgaacctggcggcagcgcaaaagatg

SEQ ID NO: 228650 - DNA, 103 bp, Artificial Sequence
  Synthetic Polynucleotide
taatacgactcactatagggcgctccatctgctgcgagcgctcatggatgaacagaggagacatccaatggcgctcgcaaacctggcggcagcgcaaaagatg

SEQ ID NO: 228651 - DNA, 103 bp, Artificial Sequence
  Synthetic Polynucleotide
taatacgactcactatagggggacaggtagcgctccatctgctgcgagcgaacagaggagacgctcgatgcagatggagaacctggcggcagcgcaaaagatg

SEQ ID NO: 228652 - DNA, 103 bp, Artificial Sequence
  Synthetic Polynucleotide
taatacgactcactatagggcgggggtggtggacaggtagcgctccatctaacagaggagaagatggatggctacctgtaacctggcggcagcgcaaaagatg

SEQ ID NO: 228653 - DNA, 103 bp, Artificial Sequence
  Synthetic Polynucleotide
taatacgactcactatagggtgcgtggtctcgggggtggtggacaggtagaacagaggagactacctatgcaccaccccaacctggcggcagcgcaaaagatg

SEQ ID NO: 228654 - DNA, 103 bp, Artificial Sequence
  Synthetic Polynucleotide
taatacgactcactataggggaagtggccacggttgcgctgctcgttgagaacagaggagactcaacatgcagcgcaacaacctggcggcagcgcaaaagatg

SEQ ID NO: 228655 - DNA, 103 bp, Artificial Sequence
  Synthetic Polynucleotide
taatacgactcactatagggcttgcggcagtgcgtggtctcgggggtggtaacagaggagaaccaccatggagaccacgaacctggcggcagcgcaaaagatg

SEQ ID NO: 228656 - DNA, 103 bp, Artificial Sequence
  Synthetic Polynucleotide
taatacgactcactataggggccggggctgcttgcggcagtgcgtggtctaacagaggagaagaccaatgactgccgcaaacctggcggcagcgcaaaagatg

SEQ ID NO: 228657 - DNA, 103 bp, Artificial Sequence
  Synthetic Polynucleotide
taatacgactcactatagggatgcgcacaggccggggctgcttgcggcagaacagaggagactgccgatggcagccccgaacctggcggcagcgcaaaagatg

SEQ ID NO: 228658 - DNA, 103 bp, Artificial Sequence
  Synthetic Polynucleotide
taatacgactcactatagggtagggtctggatgcgcacaggccggggctgaacagaggagacagcccatgcctgtgcgcaacctggcggcagcgcaaaagatg

SEQ ID NO: 228659 - DNA, 103 bp, Artificial Sequence
  Synthetic Polynucleotide
taatacgactcactatagggtgttgcccactagggtctggatgcgcacagaacagaggagactgtgcatgtccagacccaacctggcggcagcgcaaaagatg

SEQ ID NO: 228660 - DNA, 103 bp, Artificial Sequence
  Synthetic Polynucleotide
taatacgactcactatagggttgatgtggatgttgcccactagggtctggaacagaggagaccagacatgagtgggcaaaacctggcggcagcgcaaaagatg

SEQ ID NO: 228661 - DNA, 103 bp, Artificial Sequence
  Synthetic Polynucleotide
taatacgactcactatagggcatctcctgcttgatgtggatgttgcccacaacagaggagagtgggcatgatccacatcaacctggcggcagcgcaaaagatg

SEQ ID NO: 228662 - DNA, 103 bp, Artificial Sequence
  Synthetic Polynucleotide
taatacgactcactatagggaatcgtcctccatctcctgcttgatgtggaaacagaggagatccacaatgagcaggagaaacctggcggcagcgcaaaagatg

SEQ ID NO: 228663 - DNA, 103 bp, Artificial Sequence
  Synthetic Polynucleotide
taatacgactcactatagggtagtagtcgtaatcgtcctccatctcctgcaacagaggagagcaggaatgggaggacgaaacctggcggcagcgcaaaagatg

SEQ ID NO: 228664 - DNA, 103 bp, Artificial Sequence
  Synthetic Polynucleotide
taatacgactcactatagggttgctgcccgtagtagtcgtaatcgtcctcaacagaggagagaggacatgtacgactacaacctggcggcagcgcaaaagatg

SEQ ID NO: 228665 - DNA, 103 bp, Artificial Sequence
  Synthetic Polynucleotide
taatacgactcactatagggttacgtcacagaagtggccacggttgcgctaacagaggagaagcgcaatggtggccactaacctggcggcagcgcaaaagatg

SEQ ID NO: 228666 - DNA, 103 bp, Artificial Sequence
  Synthetic Polynucleotide
taatacgactcactatagggtctgcaccctttgctgcccgtagtagtcgtaacagaggagaacgactatgacgggcagcaacctggcggcagcgcaaaagatg

SEQ ID NO: 228667 - DNA, 103 bp, Artificial Sequence
  Synthetic Polynucleotide
taatacgactcactatagggcgttccaggatctgcaccctttgctgcccgaacagaggagacgggcaatgaagggtgcaaacctggcggcagcgcaaaagatg

SEQ ID NO: 228668 - DNA, 103 bp, Artificial Sequence
  Synthetic Polynucleotide
taatacgactcactatagggggattcgttgcgttccaggatctgcaccctaacagaggagaagggtgatgatcctggaaaacctggcggcagcgcaaaagatg

SEQ ID NO: 228669 - DNA, 103 bp, Artificial Sequence
  Synthetic Polynucleotide
taatacgactcactatagggtgcactcctcggattcgttgcgttccaggaaacagaggagatcctggatggcaacgaataacctggcggcagcgcaaaagatg

SEQ ID NO: 228670 - DNA, 103 bp, Artificial Sequence
  Synthetic Polynucleotide
taatacgactcactataggggtgtcttccgtgcactcctcggattcgttgaacagaggagacaacgaatgcgaggagtgaacctggcggcagcgcaaaagatg

SEQ ID NO: 228671 - DNA, 103 bp, Artificial Sequence
  Synthetic Polynucleotide
taatacgactcactatagggggcctggtctgtgtcttccgtgcactcctcaacagaggagagaggagatgacggaagacaacctggcggcagcgcaaaagatg

SEQ ID NO: 228672 - DNA, 103 bp, Artificial Sequence
  Synthetic Polynucleotide
taatacgactcactatagggcggtgccctcggcctggtctgtgtcttccgaacagaggagacggaagatgcagaccaggaacctggcggcagcgcaaaagatg

SEQ ID NO: 228673 - DNA, 103 bp, Artificial Sequence
  Synthetic Polynucleotide
taatacgactcactatagggggctcactctcggtgccctcggcctggtctaacagaggagaagaccaatgcgagggcacaacctggcggcagcgcaaaagatg

SEQ ID NO: 228674 - DNA, 103 bp, Artificial Sequence
  Synthetic Polynucleotide
taatacgactcactatagggttcacctttgggctcactctcggtgccctcaacagaggagagagggcatggagagtgagaacctggcggcagcgcaaaagatg

SEQ ID NO: 228675 - DNA, 103 bp, Artificial Sequence
  Synthetic Polynucleotide
taatacgactcactatagggagtcgaagctttcacctttgggctcactctaacagaggagaagagtgatgccaaaggtgaacctggcggcagcgcaaaagatg

SEQ ID NO: 228676 - DNA, 103 bp, Artificial Sequence
  Synthetic Polynucleotide
taatacgactcactatagggatgcgcaccgttacgtcacagaagtggccaaacagaggagatggccaatgctgtgacgtaacctggcggcagcgcaaaagatg

SEQ ID NO: 228677 - DNA, 103 bp, Artificial Sequence
  Synthetic Polynucleotide
taatacgactcactatagggctgacgcccgagtcgaagctttcacctttgaacagaggagacaaaggatgaagcttcgaaacctggcggcagcgcaaaagatg

SEQ ID NO: 228678 - DNA, 103 bp, Artificial Sequence
  Synthetic Polynucleotide
taatacgactcactatagggtatggaggagctgacgcccgagtcgaagctaacagaggagaagcttcatgtcgggcgtcaacctggcggcagcgcaaaagatg

SEQ ID NO: 228679 - DNA, 103 bp, Artificial Sequence
  Synthetic Polynucleotide
taatacgactcactataggggctcggtgcctatggaggagctgacgcccgaacagaggagacgggcgatggctcctccaaacctggcggcagcgcaaaagatg

SEQ ID NO: 228680 - DNA, 103 bp, Artificial Sequence
  Synthetic Polynucleotide
taatacgactcactatagggaccgagtcaggctcggtgcctatggaggagaacagaggagactcctcatgaggcaccgaaacctggcggcagcgcaaaagatg

SEQ ID NO: 228681 - DNA, 103 bp, Artificial Sequence
  Synthetic Polynucleotide
taatacgactcactatagggctgctgctccaccgagtcaggctcggtgccaacagaggagaggcaccatgcctgactcgaacctggcggcagcgcaaaagatg

SEQ ID NO: 228682 - DNA, 103 bp, Artificial Sequence
  Synthetic Polynucleotide
taatacgactcactatagggcaggcccaaactgctgctccaccgagtcagaacagaggagactgactatgtggagcagcaacctggcggcagcgcaaaagatg

SEQ ID NO: 228683 - DNA, 103 bp, Artificial Sequence
  Synthetic Polynucleotide
taatacgactcactatagggcgcgccgccccaggcccaaactgctgctccaacagaggagaggagcaatggtttgggccaacctggcggcagcgcaaaagatg

SEQ ID NO: 228684 - DNA, 103 bp, Artificial Sequence
  Synthetic Polynucleotide
taatacgactcactatagggctggctgtcccgcgccgccccaggcccaaaaacagaggagatttgggatgggggcggcgaacctggcggcagcgcaaaagatg

SEQ ID NO: 228685 - DNA, 103 bp, Artificial Sequence
  Synthetic Polynucleotide
taatacgactcactatagggtgggttcagcctggctgtcccgcgccgcccaacagaggagagggcggatggggacagccaacctggcggcagcgcaaaagatg

SEQ ID NO: 228686 - DNA, 103 bp, Artificial Sequence
  Synthetic Polynucleotide
taatacgactcactatagggtcgggttgggtgggttcagcctggctgtccaacagaggagaggacagatgggctgaaccaacctggcggcagcgcaaaagatg

SEQ ID NO: 228687 - DNA, 103 bp, Artificial Sequence
  Synthetic Polynucleotide
taatacgactcactatagggcccagaaggctctggcgatgtttctgccataacagaggagaatggcaatgacatcgccaaacctggcggcagcgcaaaagatg

SEQ ID NO: 228688 - DNA, 103 bp, Artificial Sequence
  Synthetic Polynucleotide
taatacgactcactatagggagtaatgtcacagaggaagcctttcttcctaacagaggagaaggaagatgggcttcctcaacctggcggcagcgcaaaagatg

SEQ ID NO: 228689 - DNA, 103 bp, Artificial Sequence
  Synthetic Polynucleotide
taatacgactcactataggggtggacctgtagcgagtgcttctgggcaaaaacagaggagatttgccatgaagcactcgaacctggcggcagcgcaaaagatg

SEQ ID NO: 228690 - DNA, 103 bp, Artificial Sequence
  Synthetic Polynucleotide
taatacgactcactataggggcatcctggtgtggacctgtagcgagtgctaacagaggagaagcactatgtacaggtccaacctggcggcagcgcaaaagatg

SEQ ID NO: 228691 - DNA, 103 bp, Artificial Sequence
  Synthetic Polynucleotide
taatacgactcactatagggtcgcctgtgtgcatcctggtgtggacctgtaacagaggagaacaggtatgcaccaggataacctggcggcagcgcaaaagatg

SEQ ID NO: 228692 - DNA, 103 bp, Artificial Sequence
  Synthetic Polynucleotide
taatacgactcactataggggtacggccgctcgcctgtgtgcatcctggtaacagaggagaaccaggatgcacacaggcaacctggcggcagcgcaaaagatg

SEQ ID NO: 228693 - DNA, 103 bp, Artificial Sequence
  Synthetic Polynucleotide
taatacgactcactatagggcggtgcaggtgtacggccgctcgcctgtgtaacagaggagaacacagatgagcggccgtaacctggcggcagcgcaaaagatg

SEQ ID NO: 228694 - DNA, 103 bp, Artificial Sequence
  Synthetic Polynucleotide
taatacgactcactatagggttgctgcacacggtgcaggtgtacggccgcaacagaggagagcggccatgcacctgcacaacctggcggcagcgcaaaagatg

SEQ ID NO: 228695 - DNA, 103 bp, Artificial Sequence
  Synthetic Polynucleotide
taatacgactcactatagggggtcagagccttgctgcacacggtgcaggtaacagaggagaacctgcatggtgtgcagcaacctggcggcagcgcaaaagatg

SEQ ID NO: 228696 - DNA, 103 bp, Artificial Sequence
  Synthetic Polynucleotide
taatacgactcactatagggagtgcttggtggtcagagccttgctgcacaaacagaggagatgtgcaatgaggctctgaaacctggcggcagcgcaaaagatg

SEQ ID NO: 228697 - DNA, 103 bp, Artificial Sequence
  Synthetic Polynucleotide
taatacgactcactatagggtccagcagtgagtgcttggtggtcagagccaacagaggagaggctctatgcaccaagcaaacctggcggcagcgcaaaagatg

SEQ ID NO: 228698 - DNA, 103 bp, Artificial Sequence
  Synthetic Polynucleotide
taatacgactcactataggggctcatgtgctccagcagtgagtgcttggtaacagaggagaaccaagatgtcactgctgaacctggcggcagcgcaaaagatg

SEQ ID NO: 228699 - DNA, 103 bp, Artificial Sequence
  Synthetic Polynucleotide
taatacgactcactatagggccacgattaaagtaatgtcacagaggaagcaacagaggagagcttccatggtgacattaaacctggcggcagcgcaaaagatg

SEQ ID NO: 228700 - DNA, 103 bp, Artificial Sequence
  Synthetic Polynucleotide
taatacgactcactatagggctgagtgcaggctcatgtgctccagcagtgaacagaggagacactgcatgagcacatgaaacctggcggcagcgcaaaagatg

SEQ ID NO: 228701 - DNA, 103 bp, Artificial Sequence
  Synthetic Polynucleotide
taatacgactcactataggggacttctgtcctgagtgcaggctcatgtgcaacagaggagagcacatatgcctgcactcaacctggcggcagcgcaaaagatg

SEQ ID NO: 228702 - DNA, 103 bp, Artificial Sequence
  Synthetic Polynucleotide
taatacgactcactatagggacaggtaaaagacttctgtcctgagtgcagaacagaggagactgcacatgggacagaagaacctggcggcagcgcaaaagatg

SEQ ID NO: 228703 - DNA, 103 bp, Artificial Sequence
  Synthetic Polynucleotide
taatacgactcactatagggcgcattgatcacaggtaaaagacttctgtcaacagaggagagacagaatgcttttacctaacctggcggcagcgcaaaagatg

SEQ ID NO: 228704 - DNA, 103 bp, Artificial Sequence
  Synthetic Polynucleotide
taatacgactcactatagggaaatattttccgcattgatcacaggtaaaaaacagaggagattttacatgtgatcaatgaacctggcggcagcgcaaaagatg

SEQ ID NO: 228705 - DNA, 103 bp, Artificial Sequence
  Synthetic Polynucleotide
taatacgactcactataggggttctggctgaaatattttccgcattgatcaacagaggagagatcaaatgggaaaatataacctggcggcagcgcaaaagatg

SEQ ID NO: 228706 - DNA, 103 bp, Artificial Sequence
  Synthetic Polynucleotide
taatacgactcactatagggttagctgtctgttctggctgaaatattttcaacagaggagagaaaatatgtcagccagaaacctggcggcagcgcaaaagatg

SEQ ID NO: 228707 - DNA, 103 bp, Artificial Sequence
  Synthetic Polynucleotide
taatacgactcactatagggtaatggctctttagctgtctgttctggctgaacagaggagacagccaatgcagacagctaacctggcggcagcgcaaaagatg

SEQ ID NO: 228708 - DNA, 103 bp, Artificial Sequence
  Synthetic Polynucleotide
taatacgactcactatagggatgaactcggtaatggctctttagctgtctaacagaggagaagacagatgaagagccataacctggcggcagcgcaaaagatg

SEQ ID NO: 228709 - DNA, 103 bp, Artificial Sequence
  Synthetic Polynucleotide
taatacgactcactatagggagtggcctgtatgaactcggtaatggctctaacagaggagaagagccatgaccgagttcaacctggcggcagcgcaaaagatg

SEQ ID NO: 228710 - DNA, 103 bp, Artificial Sequence
  Synthetic Polynucleotide
taatacgactcactatagggtgtacattctccacgattaaagtaatgtcaaacagaggagatgacatatgtttaatcgtaacctggcggcagcgcaaaagatg

SEQ ID NO: 228711 - DNA, 103 bp, Artificial Sequence
  Synthetic Polynucleotide
taatacgactcactatagggtccggtaatgagtggcctgtatgaactcggaacagaggagaccgagtatgtacaggccaaacctggcggcagcgcaaaagatg

SEQ ID NO: 228712 - DNA, 103 bp, Artificial Sequence
  Synthetic Polynucleotide
taatacgactcactataggggtctttgcattccggtaatgagtggcctgtaacagaggagaacaggcatgtcattaccgaacctggcggcagcgcaaaagatg

SEQ ID NO: 228713 - DNA, 103 bp, Artificial Sequence
  Synthetic Polynucleotide
taatacgactcactatagggtgcgatggcagtctttgcattccggtaatgaacagaggagacattacatgaatgcaaagaacctggcggcagcgcaaaagatg

SEQ ID NO: 228714 - DNA, 103 bp, Artificial Sequence
  Synthetic Polynucleotide
taatacgactcactatagggtccatgaatttgcgatggcagtctttgcataacagaggagaatgcaaatgctgccatcgaacctggcggcagcgcaaaagatg

SEQ ID NO: 228715 - DNA, 103 bp, Artificial Sequence
  Synthetic Polynucleotide
taatacgactcactatagggctgagacacatccatgaatttgcgatggcaaacagaggagatgccatatgaaattcatgaacctggcggcagcgcaaaagatg

SEQ ID NO: 228716 - DNA, 103 bp, Artificial Sequence
  Synthetic Polynucleotide
taatacgactcactataggggtttctttagctgagacacatccatgaattaacagaggagaaattcaatgatgtgtctcaacctggcggcagcgcaaaagatg

SEQ ID NO: 228717 - DNA, 103 bp, Artificial Sequence
  Synthetic Polynucleotide
taatacgactcactataggggttcgcagatgtttctttagctgagacacaaacagaggagatgtgtcatggctaaagaaaacctggcggcagcgcaaaagatg

SEQ ID NO: 228718 - DNA, 103 bp, Artificial Sequence
  Synthetic Polynucleotide
taatacgactcactatagggacctgtgtgtgttcgcagatgtttctttagaacagaggagactaaagatgcatctgcgaaacctggcggcagcgcaaaagatg

SEQ ID NO: 228719 - DNA, 103 bp, Artificial Sequence
  Synthetic Polynucleotide
taatacgactcactatagggatggcttctcacctgtgtgtgttcgcagataacagaggagaatctgcatgcacacacagaacctggcggcagcgcaaaagatg

SEQ ID NO: 228720 - DNA, 103 bp, Artificial Sequence
  Synthetic Polynucleotide
taatacgactcactatagggtcacaagtaaatggcttctcacctgtgtgtaacagaggagaacacacatgtgagaagccaacctggcggcagcgcaaaagatg

SEQ ID NO: 228721 - DNA, 103 bp, Artificial Sequence
  Synthetic Polynucleotide
taatacgactcactatagggggcccggaaatgtacattctccacgattaaaacagaggagattaatcatggagaatgtaaacctggcggcagcgcaaaagatg

SEQ ID NO: 228722 - DNA, 103 bp, Artificial Sequence
  Synthetic Polynucleotide
taatacgactcactataggggccacagatttcacaagtaaatggcttctcaacagaggagagagaagatgtttacttgtaacctggcggcagcgcaaaagatg

SEQ ID NO: 228723 - DNA, 103 bp, Artificial Sequence
  Synthetic Polynucleotide
taatacgactcactatagggtgaaagatttgccacagatttcacaagtaaaacagaggagattacttatgaaatctgtgaacctggcggcagcgcaaaagatg

SEQ ID NO: 228724 - DNA, 103 bp, Artificial Sequence
  Synthetic Polynucleotide
taatacgactcactatagggctctttgctgtgaaagatttgccacagattaacagaggagaaatctgatgcaaatctttaacctggcggcagcgcaaaagatg

SEQ ID NO: 228725 - DNA, 103 bp, Artificial Sequence
  Synthetic Polynucleotide
taatacgactcactatagggctgaagagaactctttgctgtgaaagatttaacagaggagaaaatctatgacagcaaagaacctggcggcagcgcaaaagatg

SEQ ID NO: 228726 - DNA, 103 bp, Artificial Sequence
  Synthetic Polynucleotide
taatacgactcactatagggtgatgtgggtctgaagagaactctttgctgaacagaggagacagcaaatggttctcttcaacctggcggcagcgcaaaagatg

SEQ ID NO: 228727 - DNA, 103 bp, Artificial Sequence
  Synthetic Polynucleotide
taatacgactcactatagggcgatggattctgatgtgggtctgaagagaaaacagaggagattctctatggacccacataacctggcggcagcgcaaaagatg

SEQ ID NO: 228728 - DNA, 103 bp, Artificial Sequence
  Synthetic Polynucleotide
taatacgactcactatagggcttttctcctcgatggattctgatgtgggtaacagaggagaacccacatgagaatccataacctggcggcagcgcaaaagatg

SEQ ID NO: 228729 - DNA, 103 bp, Artificial Sequence
  Synthetic Polynucleotide
taatacgactcactatagggaggagtatggcttttctcctcgatggattcaacagaggagagaatccatggaggagaaaaacctggcggcagcgcaaaagatg

SEQ ID NO: 228730 - DNA, 103 bp, Artificial Sequence
  Synthetic Polynucleotide
taatacgactcactatagggcaaatgccacaggagtatggcttttctcctaacagaggagaaggagaatggccatactcaacctggcggcagcgcaaaagatg

SEQ ID NO: 228731 - DNA, 103 bp, Artificial Sequence
  Synthetic Polynucleotide
taatacgactcactatagggggatttgccacaaatgccacaggagtatggaacagaggagaccatacatgtgtggcattaacctggcggcagcgcaaaagatg

SEQ ID NO: 228732 - DNA, 103 bp, Artificial Sequence
  Synthetic Polynucleotide
taatacgactcactatagggaggctttgtgggcccggaaatgtacattctaacagaggagaagaatgatgatttccgggaacctggcggcagcgcaaaagatg

SEQ ID NO: 228733 - DNA, 103 bp, Artificial Sequence
  Synthetic Polynucleotide
taatacgactcactatagggagtcagagaaggatttgccacaaatgccacaacagaggagagtggcaatggtggcaaataacctggcggcagcgcaaaagatg

SEQ ID NO: 228734 - DNA, 103 bp, Artificial Sequence
  Synthetic Polynucleotide
taatacgactcactatagggttggcactggagtcagagaaggatttgccaaacagaggagatggcaaatgcttctctgaaacctggcggcagcgcaaaagatg

SEQ ID NO: 228735 - DNA, 103 bp, Artificial Sequence
  Synthetic Polynucleotide
taatacgactcactataggggtgtctccttttggcactggagtcagagaaaacagaggagattctctatgtccagtgccaacctggcggcagcgcaaaagatg

SEQ ID NO: 228736 - DNA, 103 bp, Artificial Sequence
  Synthetic Polynucleotide
taatacgactcactataggggtagaatgcagtgtctccttttggcactggaacagaggagaccagtgatgaaaggagacaacctggcggcagcgcaaaagatg

SEQ ID NO: 228737 - DNA, 103 bp, Artificial Sequence
  Synthetic Polynucleotide
taatacgactcactatagggttgccagtgtgtagaatgcagtgtctccttaacagaggagaaaggagatgctgcattctaacctggcggcagcgcaaaagatg

SEQ ID NO: 228738 - DNA, 103 bp, Artificial Sequence
  Synthetic Polynucleotide
taatacgactcactataggggaaaggcttcttgccagtgtgtagaatgcaaacagaggagatgcattatgcacactggcaacctggcggcagcgcaaaagatg

SEQ ID NO: 228739 - DNA, 103 bp, Artificial Sequence
  Synthetic Polynucleotide
taatacgactcactatagggcagggcaggagaaaggcttcttgccagtgtaacagaggagaacactgatgagaagccttaacctggcggcagcgcaaaagatg

SEQ ID NO: 228740 - DNA, 103 bp, Artificial Sequence
  Synthetic Polynucleotide
taatacgactcactatagggaagttacactcagggcaggagaaaggcttcaacagaggagagaagccatgctcctgcccaacctggcggcagcgcaaaagatg

SEQ ID NO: 228741 - DNA, 103 bp, Artificial Sequence
  Synthetic Polynucleotide
taatacgactcactatagggagcaaactgtaagttacactcagggcaggaaacagaggagatcctgcatggagtgtaacaacctggcggcagcgcaaaagatg

SEQ ID NO: 228742 - DNA, 103 bp, Artificial Sequence
  Synthetic Polynucleotide
taatacgactcactatagggtgtctaagcgagcaaactgtaagttacactaacagaggagaagtgtaatgtacagtttgaacctggcggcagcgcaaaagatg

SEQ ID NO: 228743 - DNA, 103 bp, Artificial Sequence
  Synthetic Polynucleotide
taatacgactcactataggggcagcaagtaaggctttgtgggcccggaaaaacagaggagatttccgatgccacaaagcaacctggcggcagcgcaaaagatg

SEQ ID NO: 228744 - DNA, 103 bp, Artificial Sequence
  Synthetic Polynucleotide
taatacgactcactataggggccttcaagttgtctaagcgagcaaactgtaacagaggagaacagttatgtcgcttagaaacctggcggcagcgcaaaagatg

SEQ ID NO: 228745 - DNA, 103 bp, Artificial Sequence
  Synthetic Polynucleotide
taatacgactcactatagggtttcaagtgagccttcaagttgtctaagcgaacagaggagacgcttaatgaacttgaagaacctggcggcagcgcaaaagatg

SEQ ID NO: 228746 - DNA, 103 bp, Artificial Sequence
  Synthetic Polynucleotide
taatacgactcactatagggtgctatgaattttcaagtgagccttcaagtaacagaggagaacttgaatgctcacttgaaacctggcggcagcgcaaaagatg

SEQ ID NO: 228747 - DNA, 103 bp, Artificial Sequence
  Synthetic Polynucleotide
taatacgactcactatagggtgcttctccttgctatgaattttcaagtgaaacagaggagatcacttatgaattcatagaacctggcggcagcgcaaaagatg

SEQ ID NO: 228748 - DNA, 103 bp, Artificial Sequence
  Synthetic Polynucleotide
taatacgactcactatagggatctgaagcatgcttctccttgctatgaataacagaggagaattcatatgaaggagaagaacctggcggcagcgcaaaagatg

SEQ ID NO: 228749 - DNA, 103 bp, Artificial Sequence
  Synthetic Polynucleotide
taatacgactcactatagggtgctgctggcatctgaagcatgcttctcctaacagaggagaaggagaatgatgcttcagaacctggcggcagcgcaaaagatg

SEQ ID NO: 228750 - DNA, 103 bp, Artificial Sequence
  Synthetic Polynucleotide
taatacgactcactatagggctgccagaaatgctgctggcatctgaagcaaacagaggagatgcttcatgtgccagcagaacctggcggcagcgcaaaagatg

SEQ ID NO: 228751 - DNA, 103 bp, Artificial Sequence
  Synthetic Polynucleotide
taatacgactcactatagggtgtattactactgccagaaatgctgctggcaacagaggagagccagcatgatttctggcaacctggcggcagcgcaaaagatg

SEQ ID NO: 228752 - DNA, 103 bp, Artificial Sequence
  Synthetic Polynucleotide
taatacgactcactatagggtgacctcttctgtattactactgccagaaaaacagaggagatttctgatggtagtaataaacctggcggcagcgcaaaagatg

SEQ ID NO: 228753 - DNA, 103 bp, Artificial Sequence
  Synthetic Polynucleotide
taatacgactcactatagggagaatattcctgacctcttctgtattactaaacagaggagatagtaaatgagaagaggtaacctggcggcagcgcaaaagatg

SEQ ID NO: 228754 - DNA, 103 bp, Artificial Sequence
  Synthetic Polynucleotide
taatacgactcactatagggttcactactggcagcaagtaaggctttgtgaacagaggagacacaaaatgttacttgctaacctggcggcagcgcaaaagatg

SEQ ID NO: 228755 - DNA, 103 bp, Artificial Sequence
  Synthetic Polynucleotide
taatacgactcactatagggctgtagctgaagaatattcctgacctcttcaacagaggagagaagagatgaggaatattaacctggcggcagcgcaaaagatg

SEQ ID NO: 228756 - DNA, 103 bp, Artificial Sequence
  Synthetic Polynucleotide
taatacgactcactataggggttgatatggctgtagctgaagaatattccaacagaggagaggaataatgttcagctacaacctggcggcagcgcaaaagatg

SEQ ID NO: 228757 - DNA, 103 bp, Artificial Sequence
  Synthetic Polynucleotide
taatacgactcactataggggaggtagagagttgatatggctgtagctgaaacagaggagatcagctatggccatatcaaacctggcggcagcgcaaaagatg

SEQ ID NO: 228758 - DNA, 103 bp, Artificial Sequence
  Synthetic Polynucleotide
taatacgactcactatagggctgctctcccgaggtagagagttgatatggaacagaggagaccatatatgctctctaccaacctggcggcagcgcaaaagatg

SEQ ID NO: 228759 - DNA, 103 bp, Artificial Sequence
  Synthetic Polynucleotide
taatacgactcactataggggctgaatttcctgctctcccgaggtagagaaacagaggagatctctaatgcgggagagcaacctggcggcagcgcaaaagatg

SEQ ID NO: 228760 - DNA, 103 bp, Artificial Sequence
  Synthetic Polynucleotide
taatacgactcactataggggttacgagaagctgaatttcctgctctcccaacagaggagagggagaatgggaaattcaaacctggcggcagcgcaaaagatg

SEQ ID NO: 228761 - DNA, 103 bp, Artificial Sequence
  Synthetic Polynucleotide
taatacgactcactatagggtacagaatcggttacgagaagctgaatttcaacagaggagagaaattatgcttctcgtaaacctggcggcagcgcaaaagatg

SEQ ID NO: 228762 - DNA, 103 bp, Artificial Sequence
  Synthetic Polynucleotide
taatacgactcactatagggtgatgttatgtacagaatcggttacgagaaaacagaggagattctcgatgccgattctgaacctggcggcagcgcaaaagatg

SEQ ID NO: 228763 - DNA, 103 bp, Artificial Sequence
  Synthetic Polynucleotide
taatacgactcactatagggggcatgaaattgatgttatgtacagaatcgaacagaggagacgattcatgacataacataacctggcggcagcgcaaaagatg

SEQ ID NO: 228764 - DNA, 103 bp, Artificial Sequence
  Synthetic Polynucleotide
taatacgactcactataggggctaggaccgggcatgaaattgatgttatgaacagaggagacataacatgaatttcatgaacctggcggcagcgcaaaagatg

SEQ ID NO: 228765 - DNA, 103 bp, Artificial Sequence
  Synthetic Polynucleotide
taatacgactcactatagggttgagaagtattcactactggcagcaagtaaacagaggagatacttgatgccagtagtgaacctggcggcagcgcaaaagatg

SEQ ID NO: 228766 - DNA, 103 bp, Artificial Sequence
  Synthetic Polynucleotide
taatacgactcactatagggtgattccctggctaggaccgggcatgaaataacagaggagaatttcaatgccggtcctaaacctggcggcagcgcaaaagatg

SEQ ID NO: 228767 - DNA, 103 bp, Artificial Sequence
  Synthetic Polynucleotide
taatacgactcactataggggtcacaatgctgattccctggctaggaccgaacagaggagacggtccatgccagggaataacctggcggcagcgcaaaagatg

SEQ ID NO: 228768 - DNA, 103 bp, Artificial Sequence
  Synthetic Polynucleotide
taatacgactcactatagggactctctgcagtcacaatgctgattccctgaacagaggagacagggaatgagcattgtgaacctggcggcagcgcaaaagatg

SEQ ID NO: 228769 - DNA, 103 bp, Artificial Sequence
  Synthetic Polynucleotide
taatacgactcactatagggtgttttgggaactctctgcagtcacaatgcaacagaggagagcattgatgctgcagagaaacctggcggcagcgcaaaagatg

SEQ ID NO: 228770 - DNA, 103 bp, Artificial Sequence
  Synthetic Polynucleotide
taatacgactcactatagggtctgcagtcatgttttgggaactctctgcaaacagaggagatgcagaatgttcccaaaaaacctggcggcagcgcaaaagatg

SEQ ID NO: 228771 - DNA, 103 bp, Artificial Sequence
  Synthetic Polynucleotide
taatacgactcactatagggagcagcctggtctgcagtcatgttttgggaaacagaggagatcccaaatgatgactgcaaacctggcggcagcgcaaaagatg

SEQ ID NO: 228772 - DNA, 103 bp, Artificial Sequence
  Synthetic Polynucleotide
taatacgactcactataggggggtaagattagcagcctggtctgcagtcaaacagaggagatgactgatgaccaggctgaacctggcggcagcgcaaaagatg

SEQ ID NO: 228773 - DNA, 103 bp, Artificial Sequence
  Synthetic Polynucleotide
taatacgactcactatagggtgcgtgagcagggtaagattagcagcctggaacagaggagaccaggcatgtaatcttacaacctggcggcagcgcaaaagatg

SEQ ID NO: 228774 - DNA, 103 bp, Artificial Sequence
  Synthetic Polynucleotide
taatacgactcactatagggctctggctgctgcgtgagcagggtaagattaacagaggagaaatcttatgctgctcacgaacctggcggcagcgcaaaagatg

SEQ ID NO: 228775 - DNA, 103 bp, Artificial Sequence
  Synthetic Polynucleotide
taatacgactcactatagggtctgcagttgctctggctgctgcgtgagcaaacagaggagatgctcaatgagcagccagaacctggcggcagcgcaaaagatg

SEQ ID NO: 228776 - DNA, 103 bp, Artificial Sequence
  Synthetic Polynucleotide
taatacgactcactataggggcaaacatcattgagaagtattcactactgaacagaggagacagtagatgatacttctcaacctggcggcagcgcaaaagatg

SEQ ID NO: 228777 - DNA, 103 bp, Artificial Sequence
  Synthetic Polynucleotide
taatacgactcactatagggagaattaaattctgcagttgctctggctgcaacagaggagagcagccatggcaactgcaaacctggcggcagcgcaaaagatg

SEQ ID NO: 228778 - DNA, 103 bp, Artificial Sequence
  Synthetic Polynucleotide
taatacgactcactatagggttgagctgaaagaattaaattctgcagttgaacagaggagacaactgatgaatttaattaacctggcggcagcgcaaaagatg

SEQ ID NO: 228779 - DNA, 103 bp, Artificial Sequence
  Synthetic Polynucleotide
taatacgactcactatagggtttgctcctgttgagctgaaagaattaaataacagaggagaatttaaatgtttcagctcaacctggcggcagcgcaaaagatg

SEQ ID NO: 228780 - DNA, 103 bp, Artificial Sequence
  Synthetic Polynucleotide
taatacgactcactatagggatgtgttctgtttgctcctgttgagctgaaaacagaggagattcagcatgacaggagcaaacctggcggcagcgcaaaagatg

SEQ ID NO: 228781 - DNA, 103 bp, Artificial Sequence
  Synthetic Polynucleotide
taatacgactcactataggggaggctctgaatgtgttctgtttgctcctgaacagaggagacaggagatgacagaacacaacctggcggcagcgcaaaagatg

SEQ ID NO: 228782 - DNA, 103 bp, Artificial Sequence
  Synthetic Polynucleotide
taatacgactcactatagggcaatcatattgaggctctgaatgtgttctgaacagaggagacagaacatgttcagagccaacctggcggcagcgcaaaagatg

SEQ ID NO: 228783 - DNA, 103 bp, Artificial Sequence
  Synthetic Polynucleotide
taatacgactcactatagggatctggctttcaatcatattgaggctctgaaacagaggagatcagagatgcaatatgataacctggcggcagcgcaaaagatg

SEQ ID NO: 228784 - DNA, 103 bp, Artificial Sequence
  Synthetic Polynucleotide
taatacgactcactatagggtgagggccccatctggctttcaatcatattaacagaggagaaatatgatggaaagccagaacctggcggcagcgcaaaagatg

SEQ ID NO: 228785 - DNA, 103 bp, Artificial Sequence
  Synthetic Polynucleotide
taatacgactcactataggggctctgtttgtgagggccccatctggctttaacagaggagaaaagccatgtggggccctaacctggcggcagcgcaaaagatg

SEQ ID NO: 228786 - DNA, 103 bp, Artificial Sequence
  Synthetic Polynucleotide
taatacgactcactatagggacgtgcactggctctgtttgtgagggccccaacagaggagaggggccatgacaaacagaaacctggcggcagcgcaaaagatg

SEQ ID NO: 228787 - DNA, 103 bp, Artificial Sequence
  Synthetic Polynucleotide
taatacgactcactatagggcccctcttctgcaaacatcattgagaagtaaacagaggagatacttcatgatgatgtttaacctggcggcagcgcaaaagatg

SEQ ID NO: 228788 - DNA, 103 bp, Artificial Sequence
  Synthetic Polynucleotide
taatacgactcactatagggcagagtgatcacgtgcactggctctgtttgaacagaggagacaaacaatgccagtgcacaacctggcggcagcgcaaaagatg

SEQ ID NO: 228789 - DNA, 103 bp, Artificial Sequence
  Synthetic Polynucleotide
taatacgactcactatagggtttccttggacagagtgatcacgtgcactgaacagaggagacagtgcatgtgatcactcaacctggcggcagcgcaaaagatg

SEQ ID NO: 228790 - DNA, 103 bp, Artificial Sequence
  Synthetic Polynucleotide
taatacgactcactatagggtgttccagtgtttccttggacagagtgatcaacagaggagagatcacatggtccaaggaaacctggcggcagcgcaaaagatg

SEQ ID NO: 228791 - DNA, 103 bp, Artificial Sequence
  Synthetic Polynucleotide
taatacgactcactatagggggcatgaagatgttccagtgtttccttggaaacagaggagatccaagatgacactggaaaacctggcggcagcgcaaaagatg

SEQ ID NO: 228792 - DNA, 103 bp, Artificial Sequence
  Synthetic Polynucleotide
taatacgactcactataggggctcttgatgggcatgaagatgttccagtgaacagaggagacactggatgatcttcatgaacctggcggcagcgcaaaagatg

SEQ ID NO: 228793 - DNA, 103 bp, Artificial Sequence
  Synthetic Polynucleotide
taatacgactcactatagggtcctctgtttgctcttgatgggcatgaagaaacagaggagatcttcaatgccatcaagaaacctggcggcagcgcaaaagatg

SEQ ID NO: 228794 - DNA, 103 bp, Artificial Sequence
  Synthetic Polynucleotide
taatacgactcactatagggtaaatggagctcctctgtttgctcttgatgaacagaggagacatcaaatgcaaacagagaacctggcggcagcgcaaaagatg

SEQ ID NO: 228795 - DNA, 103 bp, Artificial Sequence
  Synthetic Polynucleotide
taatacgactcactatagggtacttgtagctaaatggagctcctctgtttaacagaggagaaaacagatgagctccattaacctggcggcagcgcaaaagatg

SEQ ID NO: 228796 - DNA, 103 bp, Artificial Sequence
  Synthetic Polynucleotide
taatacgactcactatagggggatctgaagtacttgtagctaaatggagcaacagaggagagctccaatgagctacaagaacctggcggcagcgcaaaagatg

SEQ ID NO: 228797 - DNA, 103 bp, Artificial Sequence
  Synthetic Polynucleotide
taatacgactcactataggggtgctgagctggatctgaagtacttgtagcaacagaggagagctacaatgacttcagataacctggcggcagcgcaaaagatg

SEQ ID NO: 228798 - DNA, 103 bp, Artificial Sequence
  Synthetic Polynucleotide
taatacgactcactatagggcaacaagctgcccagaaggctctggcgatgaacagaggagacatcgcatgagccttctgaacctggcggcagcgcaaaagatg

SEQ ID NO: 228799 - DNA, 103 bp, Artificial Sequence
  Synthetic Polynucleotide
taatacgactcactatagggggccgatttccccctcttctgcaaacatcaaacagaggagatgatgtatgcagaagaggaacctggcggcagcgcaaaagatg

SEQ ID NO: 228800 - DNA, 103 bp, Artificial Sequence
  Synthetic Polynucleotide
taatacgactcactatagggtcagctgcaggtgctgagctggatctgaagaacagaggagacttcagatgcagctcagcaacctggcggcagcgcaaaagatg

SEQ ID NO: 228801 - DNA, 103 bp, Artificial Sequence
  Synthetic Polynucleotide
taatacgactcactatagggggctcctgtgtcagctgcaggtgctgagctaacagaggagaagctcaatgcctgcagctaacctggcggcagcgcaaaagatg

SEQ ID NO: 228802 - DNA, 103 bp, Artificial Sequence
  Synthetic Polynucleotide
taatacgactcactatagggtggcggaccaggctcctgtgtcagctgcagaacagaggagactgcagatgacacaggagaacctggcggcagcgcaaaagatg

SEQ ID NO: 228803 - DNA, 103 bp, Artificial Sequence
  Synthetic Polynucleotide
taatacgactcactataggggagtgggtggtggcggaccaggctcctgtgaacagaggagacacaggatgctggtccgcaacctggcggcagcgcaaaagatg

SEQ ID NO: 228804 - DNA, 103 bp, Artificial Sequence
  Synthetic Polynucleotide
taatacgactcactatagggggcacgtggtgagtgggtggtggcggaccaaacagaggagatggtccatgaccacccacaacctggcggcagcgcaaaagatg

SEQ ID NO: 228805 - DNA, 103 bp, Artificial Sequence
  Synthetic Polynucleotide
taatacgactcactatagggcgttggctggggcacgtggtgagtgggtggaacagaggagaccacccatgcaccacgtgaacctggcggcagcgcaaaagatg

SEQ ID NO: 228806 - DNA, 103 bp, Artificial Sequence
  Synthetic Polynucleotide
taatacgactcactatagggggccaagtggcgttggctggggcacgtggtaacagaggagaaccacgatgcccagccaaaacctggcggcagcgcaaaagatg

SEQ ID NO: 228807 - DNA, 103 bp, Artificial Sequence
  Synthetic Polynucleotide
taatacgactcactatagggctctgctcctggccaagtggcgttggctggaacagaggagaccagccatggccacttggaacctggcggcagcgcaaaagatg

SEQ ID NO: 228808 - DNA, 103 bp, Artificial Sequence
  Synthetic Polynucleotide
taatacgactcactatagggtaaatggattggccgatttccccctcttctaacagaggagaagaagaatgggaaatcggaacctggcggcagcgcaaaagatg

SEQ ID NO: 228809 - DNA, 103 bp, Artificial Sequence
  Synthetic Polynucleotide
taatacgactcactatagggttccagcatataaatggattggccgatttcaacagaggagagaaatcatgcaatccattaacctggcggcagcgcaaaagatg

SEQ ID NO: 228810 - DNA, 103 bp, Artificial Sequence
  Synthetic Polynucleotide
taatacgactcactatagggcaaccatgccttccagcatataaatggattaacagaggagaaatccaatgatatgctggaacctggcggcagcgcaaaagatg

SEQ ID NO: 228811 - DNA, 103 bp, Artificial Sequence
  Synthetic Polynucleotide
taatacgactcactatagggaaggtgtctgcaaccatgccttccagcataaacagaggagatatgctatgaggcatggtaacctggcggcagcgcaaaagatg

SEQ ID NO: 228812 - DNA, 103 bp, Artificial Sequence
  Synthetic Polynucleotide
taatacgactcactatagggcaggataccaaaggtgtctgcaaccatgccaacagaggagaggcatgatggcagacaccaacctggcggcagcgcaaaagatg

SEQ ID NO: 228813 - DNA, 103 bp, Artificial Sequence
  Synthetic Polynucleotide
taatacgactcactatagggtaaattccagcaggataccaaaggtgtctgaacagaggagacagacaatgttggtatccaacctggcggcagcgcaaaagatg

SEQ ID NO: 228814 - DNA, 103 bp, Artificial Sequence
  Synthetic Polynucleotide
taatacgactcactatagggcctgtgtagataaattccagcaggataccaaacagaggagatggtatatggctggaattaacctggcggcagcgcaaaagatg

SEQ ID NO: 228815 - DNA, 103 bp, Artificial Sequence
  Synthetic Polynucleotide
taatacgactcactatagggatggagataacctgtgtagataaattccagaacagaggagactggaaatgatctacacaaacctggcggcagcgcaaaagatg

SEQ ID NO: 228816 - DNA, 103 bp, Artificial Sequence
  Synthetic Polynucleotide
taatacgactcactatagggtctcactggcatggagataacctgtgtagaaacagaggagatctacaatggttatctccaacctggcggcagcgcaaaagatg

SEQ ID NO: 228817 - DNA, 103 bp, Artificial Sequence
  Synthetic Polynucleotide
taatacgactcactatagggtctgagtgtacaacaagctgcccagaaggcaacagaggagagccttcatggcagcttgtaacctggcggcagcgcaaaagatg

SEQ ID NO: 228818 - DNA, 103 bp, Artificial Sequence
  Synthetic Polynucleotide
taatacgactcactatagggtctgtacttttctcactggcatggagataaaacagaggagattatctatgtgccagtgaaacctggcggcagcgcaaaagatg

SEQ ID NO: 228819 - DNA, 103 bp, Artificial Sequence
  Synthetic Polynucleotide
taatacgactcactatagggcaggatttgttctgtacttttctcactggcaacagaggagagccagtatgaaaagtacaaacctggcggcagcgcaaaagatg

SEQ ID NO: 228820 - DNA, 103 bp, Artificial Sequence
  Synthetic Polynucleotide
taatacgactcactataggggagcagtagccaggatttgttctgtactttaacagaggagaaaagtaatgaacaaatccaacctggcggcagcgcaaaagatg

SEQ ID NO: 228821 - DNA, 103 bp, Artificial Sequence
  Synthetic Polynucleotide
taatacgactcactatagggtttaagaactgagcagtagccaggatttgtaacagaggagaacaaatatgggctactgcaacctggcggcagcgcaaaagatg

SEQ ID NO: 228822 - DNA, 103 bp, Artificial Sequence
  Synthetic Polynucleotide
taatacgactcactataggggtcatagacttttaagaactgagcagtagcaacagaggagagctactatgcagttcttaaacctggcggcagcgcaaaagatg

SEQ ID NO: 228823 - DNA, 103 bp, Artificial Sequence
  Synthetic Polynucleotide
taatacgactcactatagggcctttaccaggtcatagacttttaagaactaacagaggagaagttctatgaagtctatgaacctggcggcagcgcaaaagatg

SEQ ID NO: 228824 - DNA, 103 bp, Artificial Sequence
  Synthetic Polynucleotide
taatacgactcactatagggtctgtgtaagcctttaccaggtcatagactaacagaggagaagtctaatgcctggtaaaaacctggcggcagcgcaaaagatg

SEQ ID NO: 228825 - DNA, 103 bp, Artificial Sequence
  Synthetic Polynucleotide
taatacgactcactatagggattttggaagtctgtgtaagcctttaccagaacagaggagactggtaatggcttacacaaacctggcggcagcgcaaaagatg

SEQ ID NO: 228826 - DNA, 103 bp, Artificial Sequence
  Synthetic Polynucleotide
taatacgactcactatagggagctatgattattttggaagtctgtgtaagaacagaggagacttacaatgacttccaaaaacctggcggcagcgcaaaagatg

SEQ ID NO: 228827 - DNA, 103 bp, Artificial Sequence
  Synthetic Polynucleotide
taatacgactcactatagggggctttggggagctatgattattttggaagaacagaggagacttccaatgtaatcatagaacctggcggcagcgcaaaagatg

SEQ ID NO: 228828 - DNA, 103 bp, Artificial Sequence
  Synthetic Polynucleotide
taatacgactcactatagggactgtgagcgtctgagtgtacaacaagctgaacagaggagacagcttatggtacactcaaacctggcggcagcgcaaaagatg

SEQ ID NO: 228829 - DNA, 103 bp, Artificial Sequence
  Synthetic Polynucleotide
taatacgactcactatagggcaaagttgttggctttggggagctatgattaacagaggagaaatcatatgtccccaaagaacctggcggcagcgcaaaagatg

SEQ ID NO: 228830 - DNA, 103 bp, Artificial Sequence
  Synthetic Polynucleotide
taatacgactcactatagggcagcagtgttcaaagttgttggctttggggaacagaggagaccccaaatgcaacaacttaacctggcggcagcgcaaaagatg

SEQ ID NO: 228831 - DNA, 103 bp, Artificial Sequence
  Synthetic Polynucleotide
taatacgactcactatagggactggggcaccagcagtgttcaaagttgttaacagaggagaaacaacatggaacactgcaacctggcggcagcgcaaaagatg

SEQ ID NO: 228832 - DNA, 103 bp, Artificial Sequence
  Synthetic Polynucleotide
taatacgactcactataggggataacaaccactggggcaccagcagtgttaacagaggagaaacactatgggtgccccaaacctggcggcagcgcaaaagatg

SEQ ID NO: 228833 - DNA, 103 bp, Artificial Sequence
  Synthetic Polynucleotide
taatacgactcactatagggtcttattagagataacaaccactggggcacaacagaggagagtgcccatgtggttgttaaacctggcggcagcgcaaaagatg

SEQ ID NO: 228834 - DNA, 103 bp, Artificial Sequence
  Synthetic Polynucleotide
taatacgactcactatagggggatcgtttttcttattagagataacaaccaacagaggagaggttgtatgctctaataaaacctggcggcagcgcaaaagatg

SEQ ID NO: 228835 - DNA, 103 bp, Artificial Sequence
  Synthetic Polynucleotide
taatacgactcactatagggccgctttggaggatcgtttttcttattagaaacagaggagatctaatatgaaaaacgataacctggcggcagcgcaaaagatg

SEQ ID NO: 228836 - DNA, 103 bp, Artificial Sequence
  Synthetic Polynucleotide
taatacgactcactatagggttccccgtttccgctttggaggatcgttttaacagaggagaaaaacgatgctccaaagcaacctggcggcagcgcaaaagatg

SEQ ID NO: 228837 - DNA, 103 bp, Artificial Sequence
  Synthetic Polynucleotide
taatacgactcactatagggttttttggtcttccccgtttccgctttggaaacagaggagatccaaaatggaaacggggaacctggcggcagcgcaaaagatg

SEQ ID NO: 228838 - DNA, 103 bp, Artificial Sequence
  Synthetic Polynucleotide
taatacgactcactatagggtgtattgactttttttggtcttccccgtttaacagaggagaaaacggatgagaccaaaaaacctggcggcagcgcaaaagatg

SEQ ID NO: 228839 - DNA, 103 bp, Artificial Sequence
  Synthetic Polynucleotide
taatacgactcactataggggcacagtgtcactgtgagcgtctgagtgtaaacagaggagatacactatgacgctcacaaacctggcggcagcgcaaaagatg

SEQ ID NO: 228840 - DNA, 103 bp, Artificial Sequence
  Synthetic Polynucleotide
taatacgactcactatagggcctcctgcaatgtattgactttttttggtcaacagaggagagaccaaatgaagtcaataaacctggcggcagcgcaaaagatg

SEQ ID NO: 228841 - DNA, 103 bp, Artificial Sequence
  Synthetic Polynucleotide
taatacgactcactatagggtctgatttctcctcctgcaatgtattgactaacagaggagaagtcaaatgattgcaggaaacctggcggcagcgcaaaagatg

SEQ ID NO: 228842 - DNA, 103 bp, Artificial Sequence
  Synthetic Polynucleotide
taatacgactcactatagggtgcagccagttctgatttctcctcctgcaaaacagaggagattgcagatggagaaatcaaacctggcggcagcgcaaaagatg

SEQ ID NO: 228843 - DNA, 103 bp, Artificial Sequence
  Synthetic Polynucleotide
taatacgactcactatagggtttcttcctctgcagccagttctgatttctaacagaggagaagaaatatgaactggctgaacctggcggcagcgcaaaagatg

SEQ ID NO: 228844 - DNA, 103 bp, Artificial Sequence
  Synthetic Polynucleotide
taatacgactcactatagggcttaactgtatttcttcctctgcagccagtaacagaggagaactggcatgagaggaagaaacctggcggcagcgcaaaagatg

SEQ ID NO: 228845 - DNA, 103 bp, Artificial Sequence
  Synthetic Polynucleotide
taatacgactcactatagggattgttcactcttaactgtatttcttcctcaacagaggagagaggaaatgatacagttaaacctggcggcagcgcaaaagatg

SEQ ID NO: 228846 - DNA, 103 bp, Artificial Sequence
  Synthetic Polynucleotide
taatacgactcactatagggtctgaactgaattgttcactcttaactgtaaacagaggagatacagtatggagtgaacaaacctggcggcagcgcaaaagatg

SEQ ID NO: 228847 - DNA, 103 bp, Artificial Sequence
  Synthetic Polynucleotide
taatacgactcactatagggttttgtctattctgaactgaattgttcactaacagaggagaagtgaaatgttcagttcaaacctggcggcagcgcaaaagatg

SEQ ID NO: 228848 - DNA, 103 bp, Artificial Sequence
  Synthetic Polynucleotide
taatacgactcactatagggaaccacaaagttttgtctattctgaactgaaacagaggagatcagttatgaatagacaaaacctggcggcagcgcaaaagatg

SEQ ID NO: 228849 - DNA, 103 bp, Artificial Sequence
  Synthetic Polynucleotide
taatacgactcactatagggtgtctcctttaaccacaaagttttgtctataacagaggagaatagacatgactttgtggaacctggcggcagcgcaaaagatg

SEQ ID NO: 228850 - DNA, 103 bp, Artificial Sequence
  Synthetic Polynucleotide
taatacgactcactatagggaaactggccagcacagtgtcactgtgagcgaacagaggagacgctcaatgtgacactgtaacctggcggcagcgcaaaagatg

SEQ ID NO: 228851 - DNA, 103 bp, Artificial Sequence
  Synthetic Polynucleotide
taatacgactcactatagggagtacaccactgtctcctttaaccacaaagaacagaggagactttgtatgtaaaggagaaacctggcggcagcgcaaaagatg

SEQ ID NO: 228852 - DNA, 103 bp, Artificial Sequence
  Synthetic Polynucleotide
taatacgactcactatagggttgctcattcagtacaccactgtctcctttaacagaggagaaaaggaatgagtggtgtaaacctggcggcagcgcaaaagatg

SEQ ID NO: 228853 - DNA, 103 bp, Artificial Sequence
  Synthetic Polynucleotide
taatacgactcactatagggttgctgcaatttgctcattcagtacaccacaacagaggagagtggtgatgtgaatgagcaacctggcggcagcgcaaaagatg

SEQ ID NO: 228854 - DNA, 103 bp, Artificial Sequence
  Synthetic Polynucleotide
taatacgactcactatagggtccttttcttttgctgcaatttgctcattcaacagaggagagaatgaatgaattgcagcaacctggcggcagcgcaaaagatg

SEQ ID NO: 228855 - DNA, 103 bp, Artificial Sequence
  Synthetic Polynucleotide
taatacgactcactatagggctccgattcttccttttcttttgctgcaataacagaggagaattgcaatgaaagaaaagaacctggcggcagcgcaaaagatg

SEQ ID NO: 228856 - DNA, 103 bp, Artificial Sequence
  Synthetic Polynucleotide
taatacgactcactatagggcacaagtaggctccgattcttccttttcttaacagaggagaaagaaaatgaagaatcggaacctggcggcagcgcaaaagatg

SEQ ID NO: 228857 - DNA, 103 bp, Artificial Sequence
  Synthetic Polynucleotide
taatacgactcactatagggctacttggctcacaagtaggctccgattctaacagaggagaagaatcatggcctacttgaacctggcggcagcgcaaaagatg

SEQ ID NO: 228858 - DNA, 103 bp, Artificial Sequence
  Synthetic Polynucleotide
taatacgactcactatagggttcctcctctctacttggctcacaagtaggaacagaggagacctactatggagccaagtaacctggcggcagcgcaaaagatg

SEQ ID NO: 228859 - DNA, 103 bp, Artificial Sequence
  Synthetic Polynucleotide
taatacgactcactatagggcaactggcatttcctcctctctacttggctaacagaggagaagccaaatggagaggaggaacctggcggcagcgcaaaagatg

SEQ ID NO: 228860 - DNA, 103 bp, Artificial Sequence
  Synthetic Polynucleotide
taatacgactcactatagggtcatctttttcaactggcatttcctcctctaacagaggagaagaggaatgaatgccagtaacctggcggcagcgcaaaagatg

SEQ ID NO: 228861 - DNA, 103 bp, Artificial Sequence
  Synthetic Polynucleotide
taatacgactcactatagggctgatcctcaaaactggccagcacagtgtcaacagaggagagacactatgctggccagtaacctggcggcagcgcaaaagatg

SEQ ID NO: 228862 - DNA, 103 bp, Artificial Sequence
  Synthetic Polynucleotide
taatacgactcactatagggatcatagttctcatctttttcaactggcataacagaggagaatgccaatggaaaaagataacctggcggcagcgcaaaagatg

SEQ ID NO: 228863 - DNA, 103 bp, Artificial Sequence
  Synthetic Polynucleotide
taatacgactcactatagggcggtcttgggatcatagttctcatctttttaacagaggagaaaaaagatgagaactatgaacctggcggcagcgcaaaagatg

SEQ ID NO: 228864 - DNA, 103 bp, Artificial Sequence
  Synthetic Polynucleotide
taatacgactcactatagggtggccatcctcggtcttgggatcatagttcaacagaggagagaactaatgtcccaagacaacctggcggcagcgcaaaagatg

SEQ ID NO: 228865 - DNA, 103 bp, Artificial Sequence
  Synthetic Polynucleotide
taatacgactcactatagggctggcttgcctggccatcctcggtcttgggaacagaggagacccaagatggaggatggcaacctggcggcagcgcaaaagatg

SEQ ID NO: 228866 - DNA, 103 bp, Artificial Sequence
  Synthetic Polynucleotide
taatacgactcactatagggtgtatcgactctggcttgcctggccatcctaacagaggagaaggatgatgaggcaagccaacctggcggcagcgcaaaagatg

SEQ ID NO: 228867 - DNA, 103 bp, Artificial Sequence
  Synthetic Polynucleotide
taatacgactcactatagggctccgcttgctgtatcgactctggcttgccaacagaggagaggcaagatggagtcgataaacctggcggcagcgcaaaagatg

SEQ ID NO: 228868 - DNA, 103 bp, Artificial Sequence
  Synthetic Polynucleotide
taatacgactcactatagggtctccaaatcctccgcttgctgtatcgactaacagaggagaagtcgaatgagcaagcggaacctggcggcagcgcaaaagatg

SEQ ID NO: 228869 - DNA, 103 bp, Artificial Sequence
  Synthetic Polynucleotide
taatacgactcactataggggtttgacggatctccaaatcctccgcttgcaacagaggagagcaagcatgggatttggaaacctggcggcagcgcaaaagatg

SEQ ID NO: 228870 - DNA, 103 bp, Artificial Sequence
  Synthetic Polynucleotide
taatacgactcactatagggtaatctttaagtttgacggatctccaaatcaacagaggagagatttgatgatccgtcaaaacctggcggcagcgcaaaagatg

SEQ ID NO: 228871 - DNA, 103 bp, Artificial Sequence
  Synthetic Polynucleotide
taatacgactcactatagggaacaagtttgtaatctttaagtttgacggaaacagaggagatccgtcatgcttaaagataacctggcggcagcgcaaaagatg

SEQ ID NO: 228872 - DNA, 103 bp, Artificial Sequence
  Synthetic Polynucleotide
taatacgactcactatagggctttcttcctctgatcctcaaaactggccaaacagaggagatggccaatgttgaggatcaacctggcggcagcgcaaaagatg

SEQ ID NO: 228873 - DNA, 103 bp, Artificial Sequence
  Synthetic Polynucleotide
taatacgactcactatagggcttgatccccaacaagtttgtaatctttaaaacagaggagattaaagatgacaaacttgaacctggcggcagcgcaaaagatg

SEQ ID NO: 228874 - DNA, 103 bp, Artificial Sequence
  Synthetic Polynucleotide
taatacgactcactatagggccatggtcctcttgatccccaacaagtttgaacagaggagacaaactatgtggggatcaaacctggcggcagcgcaaaagatg

SEQ ID NO: 228875 - DNA, 103 bp, Artificial Sequence
  Synthetic Polynucleotide
taatacgactcactatagggcttggctgaaccatggtcctcttgatccccaacagaggagaggggatatggaggaccataacctggcggcagcgcaaaagatg

SEQ ID NO: 228876 - DNA, 103 bp, Artificial Sequence
  Synthetic Polynucleotide
taatacgactcactatagggcacagatcctcttggctgaaccatggtcctaacagaggagaaggaccatggttcagccaaacctggcggcagcgcaaaagatg

SEQ ID NO: 228877 - DNA, 103 bp, Artificial Sequence
  Synthetic Polynucleotide
taatacgactcactatagggtttctccttccacagatcctcttggctgaaaacagaggagattcagcatggaggatctgaacctggcggcagcgcaaaagatg

SEQ ID NO: 228878 - DNA, 103 bp, Artificial Sequence
  Synthetic Polynucleotide
taatacgactcactatagggtccagggcgctttctccttccacagatcctaacagaggagaaggatcatgggaaggagaaacctggcggcagcgcaaaagatg

SEQ ID NO: 228879 - DNA, 103 bp, Artificial Sequence
  Synthetic Polynucleotide
taatacgactcactatagggcctcagggcctccagggcgctttctccttcaacagaggagagaaggaatgagcgccctgaacctggcggcagcgcaaaagatg

SEQ ID NO: 228880 - DNA, 103 bp, Artificial Sequence
  Synthetic Polynucleotide
taatacgactcactatagggttacagcgggcctcagggcctccagggcgcaacagaggagagcgcccatgaggccctgaaacctggcggcagcgcaaaagatg

SEQ ID NO: 228881 - DNA, 103 bp, Artificial Sequence
  Synthetic Polynucleotide
taatacgactcactataggggccacagtctttacagcgggcctcagggccaacagaggagaggccctatggcccgctgtaacctggcggcagcgcaaaagatg

SEQ ID NO: 228882 - DNA, 103 bp, Artificial Sequence
  Synthetic Polynucleotide
taatacgactcactatagggtaaagaccttgccacagtctttacagcgggaacagaggagacccgctatgaagactgtgaacctggcggcagcgcaaaagatg

SEQ ID NO: 228883 - DNA, 103 bp, Artificial Sequence
  Synthetic Polynucleotide
taatacgactcactatagggcagaggaagcctttcttcctctgatcctcaaacagaggagatgaggaatggaggaagaaaacctggcggcagcgcaaaagatg

SEQ ID NO: 228884 - DNA, 103 bp, Artificial Sequence
  Synthetic Polynucleotide
taatacgactcactatagggtgattgtacttaaagaccttgccacagtctaacagaggagaagactgatgcaaggtcttaacctggcggcagcgcaaaagatg

SEQ ID NO: 228885 - DNA, 103 bp, Artificial Sequence
  Synthetic Polynucleotide
taatacgactcactatagggtgctaaaaagtgattgtacttaaagaccttaacagaggagaaaggtcatgaagtacaataacctggcggcagcgcaaaagatg

SEQ ID NO: 228886 - DNA, 103 bp, Artificial Sequence
  Synthetic Polynucleotide
taatacgactcactatagggtctggtggattgctaaaaagtgattgtactaacagaggagaagtacaatgactttttagaacctggcggcagcgcaaaagatg

SEQ ID NO: 228887 - DNA, 103 bp, Artificial Sequence
  Synthetic Polynucleotide
taatacgactcactataggggtgtggctcctctggtggattgctaaaaagaacagaggagactttttatgaatccaccaaacctggcggcagcgcaaaagatg

SEQ ID NO: 228888 - DNA, 103 bp, Artificial Sequence
  Synthetic Polynucleotide
taatacgactcactatagggtcgctcccctgtgtggctcctctggtggataacagaggagaatccacatgaggagccacaacctggcggcagcgcaaaagatg

SEQ ID NO: 228889 - DNA, 103 bp, Artificial Sequence
  Synthetic Polynucleotide
taatacgactcactatagggatttgaaaggtcgctcccctgtgtggctccaacagaggagaggagccatgcaggggagcaacctggcggcagcgcaaaagatg

SEQ ID NO: 228890 - DNA, 103 bp, Artificial Sequence
  Synthetic Polynucleotide
taatacgactcactatagggcactcattacatttgaaaggtcgctcccctaacagaggagaaggggaatgacctttcaaaacctggcggcagcgcaaaagatg

SEQ ID NO: 228891 - DNA, 103 bp, Artificial Sequence
  Synthetic Polynucleotide
taatacgactcactataggggccttttccacactcattacatttgaaaggaacagaggagacctttcatgtgtaatgagaacctggcggcagcgcaaaagatg

SEQ ID NO: 228892 - DNA, 103 bp, Artificial Sequence
  Synthetic Polynucleotide
taatacgactcactatagggtctgggcaaagccttttccacactcattacaacagaggagagtaatgatggtggaaaagaacctggcggcagcgcaaaagatg

SEQ ID NO: 228893 - DNA, 103 bp, Artificial Sequence
  Synthetic Polynucleotide
taatacgactcactatagggagcgagtgcttctgggcaaagccttttccaaacagaggagatggaaaatgctttgcccaaacctggcggcagcgcaaaagatg

SEQ ID NO: 228894 - DNA, 103 bp, Artificial Sequence
  Synthetic Polynucleotide
taatacgactcactatagggcgggtccgtcacctctgcaggggggggcataacagaggagaatgcccatgcctgcagagaacctggcggcagcgcaaaagatg

SEQ ID NO: 228895 - DNA, 103 bp, Artificial Sequence
  Synthetic Polynucleotide
taatacgactcactatagggcttggtgtctccggctatgagggtgacgtcaacagaggagagacgtcatgctcatagccaacctggcggcagcgcaaaagatg

SEQ ID NO: 228896 - DNA, 103 bp, Artificial Sequence
  Synthetic Polynucleotide
taatacgactcactataggggcggcaggggtacttcctccgccacgagtgaacagaggagacactcgatgcggaggaagaacctggcggcagcgcaaaagatg

SEQ ID NO: 228897 - DNA, 103 bp, Artificial Sequence
  Synthetic Polynucleotide
taatacgactcactatagggtctcacaatagcggcaggggtacttcctccaacagaggagaggaggaatgacccctgccaacctggcggcagcgcaaaagatg

SEQ ID NO: 228898 - DNA, 103 bp, Artificial Sequence
  Synthetic Polynucleotide
taatacgactcactataggggcaaacactttctcacaatagcggcaggggaacagaggagacccctgatgctattgtgaaacctggcggcagcgcaaaagatg

SEQ ID NO: 228899 - DNA, 103 bp, Artificial Sequence
  Synthetic Polynucleotide
taatacgactcactatagggctccgccagagcaaacactttctcacaataaacagaggagatattgtatgaaagtgtttaacctggcggcagcgcaaaagatg

SEQ ID NO: 228900 - DNA, 103 bp, Artificial Sequence
  Synthetic Polynucleotide
taatacgactcactatagggtcgtgcggtactccgccagagcaaacacttaacagaggagaaagtgtatgctctggcggaacctggcggcagcgcaaaagatg

SEQ ID NO: 228901 - DNA, 103 bp, Artificial Sequence
  Synthetic Polynucleotide
taatacgactcactatagggacttcatgcttcgtgcggtactccgccagaaacagaggagatctggcatggtaccgcacaacctggcggcagcgcaaaagatg

SEQ ID NO: 228902 - DNA, 103 bp, Artificial Sequence
  Synthetic Polynucleotide
taatacgactcactatagggcgtgtgccacacttcatgcttcgtgcggtaaacagaggagataccgcatgaagcatgaaaacctggcggcagcgcaaaagatg

SEQ ID NO: 228903 - DNA, 103 bp, Artificial Sequence
  Synthetic Polynucleotide
taatacgactcactatagggtgcgctcccccgtgtgccacacttcatgctaacagaggagaagcatgatgtgtggcacaaacctggcggcagcgcaaaagatg

SEQ ID NO: 228904 - DNA, 103 bp, Artificial Sequence
  Synthetic Polynucleotide
taatacgactcactatagggcactggtacctgcgctcccccgtgtgccacaacagaggagagtggcaatggggggagcgaacctggcggcagcgcaaaagatg

SEQ ID NO: 228905 - DNA, 103 bp, Artificial Sequence
  Synthetic Polynucleotide
taatacgactcactatagggacagaagatgcactggtacctgcgctccccaacagaggagaggggagatgaggtaccagaacctggcggcagcgcaaaagatg

SEQ ID NO: 228906 - DNA, 103 bp, Artificial Sequence
  Synthetic Polynucleotide
taatacgactcactataggggagcagggaacttggtgtctccggctatgaaacagaggagatcatagatggagacaccaaacctggcggcagcgcaaaagatg

SEQ ID NO: 228907 - DNA, 103 bp, Artificial Sequence
  Synthetic Polynucleotide
taatacgactcactatagggaggtctcccaacagaagatgcactggtaccaacagaggagaggtaccatggcatcttctaacctggcggcagcgcaaaagatg

SEQ ID NO: 228908 - DNA, 103 bp, Artificial Sequence
  Synthetic Polynucleotide
taatacgactcactatagggtaagtgacaaaggtctcccaacagaagatgaacagaggagacatcttatgttgggagacaacctggcggcagcgcaaaagatg

SEQ ID NO: 228909 - DNA, 103 bp, Artificial Sequence
  Synthetic Polynucleotide
taatacgactcactatagggcaggttatagtaagtgacaaaggtctcccaaacagaggagatgggagatgtttgtcactaacctggcggcagcgcaaaagatg

SEQ ID NO: 228910 - DNA, 103 bp, Artificial Sequence
  Synthetic Polynucleotide
taatacgactcactatagggggtgggtcttcaggttatagtaagtgacaaaacagaggagattgtcaatgactataaccaacctggcggcagcgcaaaagatg

SEQ ID NO: 228911 - DNA, 103 bp, Artificial Sequence
  Synthetic Polynucleotide
taatacgactcactatagggaaggctcgctggtgggtcttcaggttatagaacagaggagactataaatggaagacccaaacctggcggcagcgcaaaagatg

SEQ ID NO: 228912 - DNA, 103 bp, Artificial Sequence
  Synthetic Polynucleotide
taatacgactcactatagggaatgccgtggaaggctcgctggtgggtcttaacagaggagaaagaccatgcagcgagccaacctggcggcagcgcaaaagatg

SEQ ID NO: 228913 - DNA, 103 bp, Artificial Sequence
  Synthetic Polynucleotide
taatacgactcactatagggggcccgggctaatgccgtggaaggctcgctaacagaggagaagcgagatgtccacggcaaacctggcggcagcgcaaaagatg

SEQ ID NO: 228914 - DNA, 103 bp, Artificial Sequence
  Synthetic Polynucleotide
taatacgactcactatagggctggcaaggaggcccgggctaatgccgtggaacagaggagaccacggatgtagcccgggaacctggcggcagcgcaaaagatg

SEQ ID NO: 228915 - DNA, 103 bp, Artificial Sequence
  Synthetic Polynucleotide
taatacgactcactatagggtgtcttctcactggcaaggaggcccgggctaacagaggagaagcccgatgctccttgccaacctggcggcagcgcaaaagatg

SEQ ID NO: 228916 - DNA, 103 bp, Artificial Sequence
  Synthetic Polynucleotide
taatacgactcactatagggctccattgggtgtcttctcactggcaaggaaacagaggagatccttgatggtgagaagaaacctggcggcagcgcaaaagatg

SEQ ID NO: 228917 - DNA, 103 bp, Artificial Sequence
  Synthetic Polynucleotide
taatacgactcactatagggacgctgcggtgagcagggaacttggtgtctaacagaggagaagacacatggttccctgcaacctggcggcagcgcaaaagatg

SEQ ID NO: 228918 - DNA, 103 bp, Artificial Sequence
  Synthetic Polynucleotide
taatacgactcactatagggggcttgtagcctccattgggtgtcttctcaaacagaggagatgagaaatgacccaatggaacctggcggcagcgcaaaagatg

SEQ ID NO: 228919 - DNA, 103 bp, Artificial Sequence
  Synthetic Polynucleotide
taatacgactcactatagggattgagcttgggcttgtagcctccattgggaacagaggagacccaatatgggctacaagaacctggcggcagcgcaaaagatg

SEQ ID NO: 228920 - DNA, 103 bp, Artificial Sequence
  Synthetic Polynucleotide
taatacgactcactataggggcttgagtgtattgagcttgggcttgtagcaacagaggagagctacaatgccaagctcaaacctggcggcagcgcaaaagatg

SEQ ID NO: 228921 - DNA, 103 bp, Artificial Sequence
  Synthetic Polynucleotide
taatacgactcactatagggaggcggtagagcttgagtgtattgagcttgaacagaggagacaagctatgtacactcaaaacctggcggcagcgcaaaagatg

SEQ ID NO: 228922 - DNA, 103 bp, Artificial Sequence
  Synthetic Polynucleotide
taatacgactcactatagggcatggggagcaggcggtagagcttgagtgtaacagaggagaacactcatgctctaccgcaacctggcggcagcgcaaaagatg

SEQ ID NO: 228923 - DNA, 103 bp, Artificial Sequence
  Synthetic Polynucleotide
taatacgactcactatagggtggctgcccgcatggggagcaggcggtagaaacagaggagatctaccatgtgctccccaaacctggcggcagcgcaaaagatg

SEQ ID NO: 228924 - DNA, 103 bp, Artificial Sequence
  Synthetic Polynucleotide
taatacgactcactatagggtagggccgcttggctgcccgcatggggagcaacagaggagagctcccatggcgggcagcaacctggcggcagcgcaaaagatg

SEQ ID NO: 228925 - DNA, 103 bp, Artificial Sequence
  Synthetic Polynucleotide
taatacgactcactataggggtaggtcttgtagggccgcttggctgcccgaacagaggagacgggcaatgaagcggcccaacctggcggcagcgcaaaagatg

SEQ ID NO: 228926 - DNA, 103 bp, Artificial Sequence
  Synthetic Polynucleotide
taatacgactcactatagggctccctggctgtaggtcttgtagggccgctaacagaggagaagcggcatgacaagacctaacctggcggcagcgcaaaagatg

SEQ ID NO: 228927 - DNA, 103 bp, Artificial Sequence
  Synthetic Polynucleotide
taatacgactcactataggggcctccggggctccctggctgtaggtcttgaacagaggagacaagacatgcagccagggaacctggcggcagcgcaaaagatg

SEQ ID NO: 228928 - DNA, 103 bp, Artificial Sequence
  Synthetic Polynucleotide
taatacgactcactatagggagcagccaggacgctgcggtgagcagggaaaacagaggagattccctatgcaccgcagcaacctggcggcagcgcaaaagatg

SEQ ID NO: 228929 - DNA, 103 bp, Artificial Sequence
  Synthetic Polynucleotide
taatacgactcactatagggagaaaggggagcctccggggctccctggctaacagaggagaagccagatggccccggagaacctggcggcagcgcaaaagatg

SEQ ID NO: 228930 - DNA, 103 bp, Artificial Sequence
  Synthetic Polynucleotide
taatacgactcactatagggtgagggttggagaaaggggagcctccggggaacagaggagaccccggatgctcccctttaacctggcggcagcgcaaaagatg

SEQ ID NO: 228931 - DNA, 103 bp, Artificial Sequence
  Synthetic Polynucleotide
taatacgactcactataggggccggtgtgttgagggttggagaaaggggaaacagaggagatcccctatgtccaaccctaacctggcggcagcgcaaaagatg

SEQ ID NO: 228932 - DNA, 103 bp, Artificial Sequence
  Synthetic Polynucleotide
taatacgactcactatagggtgccacaggggccggtgtgttgagggttggaacagaggagaccaaccatgaacacaccgaacctggcggcagcgcaaaagatg

SEQ ID NO: 228933 - DNA, 103 bp, Artificial Sequence
  Synthetic Polynucleotide
taatacgactcactatagggtggctggcattgccacaggggccggtgtgtaacagaggagaacacacatgcccctgtggaacctggcggcagcgcaaaagatg

SEQ ID NO: 228934 - DNA, 103 bp, Artificial Sequence
  Synthetic Polynucleotide
taatacgactcactatagggggcggcgggctggctggcattgccacagggaacagaggagaccctgtatgaatgccagcaacctggcggcagcgcaaaagatg

SEQ ID NO: 228935 - DNA, 103 bp, Artificial Sequence
  Synthetic Polynucleotide
taatacgactcactatagggtggaggcccaggcggcgggctggctggcataacagaggagaatgccaatgagcccgccgaacctggcggcagcgcaaaagatg

SEQ ID NO: 228936 - DNA, 103 bp, Artificial Sequence
  Synthetic Polynucleotide
taatacgactcactatagggctggggcaggtggaggcccaggcggcgggcaacagaggagagcccgcatgctgggcctcaacctggcggcagcgcaaaagatg

SEQ ID NO: 228937 - DNA, 103 bp, Artificial Sequence
  Synthetic Polynucleotide
taatacgactcactataggggggccaggctctggggcaggtggaggcccaaacagaggagatgggccatgacctgccccaacctggcggcagcgcaaaagatg

SEQ ID NO: 228938 - DNA, 103 bp, Artificial Sequence
  Synthetic Polynucleotide
taatacgactcactatagggagagggtggagggccaggctctggggcaggaacagaggagacctgccatggagcctggcaacctggcggcagcgcaaaagatg

SEQ ID NO: 228939 - DNA, 103 bp, Artificial Sequence
  Synthetic Polynucleotide
taatacgactcactatagggagggacttgaagcagccaggacgctgcggtaacagaggagaaccgcaatgtcctggctgaacctggcggcagcgcaaaagatg

SEQ ID NO: 228940 - DNA, 103 bp, Artificial Sequence
  Synthetic Polynucleotide
taatacgactcactatagggaagtgatgacagagggtggagggccaggctaacagaggagaagcctgatgctccaccctaacctggcggcagcgcaaaagatg

SEQ ID NO: 228941 - DNA, 103 bp, Artificial Sequence
  Synthetic Polynucleotide
taatacgactcactataggggggtgggcaaaagtgatgacagagggtggaaacagaggagatccaccatgtgtcatcacaacctggcggcagcgcaaaagatg

SEQ ID NO: 228942 - DNA, 103 bp, Artificial Sequence
  Synthetic Polynucleotide
taatacgactcactatagggagagggggctgggtgggcaaaagtgatgacaacagaggagagtcatcatgtttgcccacaacctggcggcagcgcaaaagatg

SEQ ID NO: 228943 - DNA, 103 bp, Artificial Sequence
  Synthetic Polynucleotide
taatacgactcactatagggggacaatgacagagggggctgggtgggcaaaacagaggagattgcccatgcagccccctaacctggcggcagcgcaaaagatg

SEQ ID NO: 228944 - DNA, 103 bp, Artificial Sequence
  Synthetic Polynucleotide
taatacgactcactatagggctgcccccatggacaatgacagagggggctaacagaggagaagccccatgtgtcattgtaacctggcggcagcgcaaaagatg

SEQ ID NO: 228945 - DNA, 103 bp, Artificial Sequence
  Synthetic Polynucleotide
taatacgactcactatagggaccactgctactgcccccatggacaatgacaacagaggagagtcattatgcatgggggcaacctggcggcagcgcaaaagatg

SEQ ID NO: 228946 - DNA, 103 bp, Artificial Sequence
  Synthetic Polynucleotide
taatacgactcactatagggtcccccctccaccactgctactgcccccataacagaggagaatggggatggtagcagtgaacctggcggcagcgcaaaagatg

SEQ ID NO: 228947 - DNA, 103 bp, Artificial Sequence
  Synthetic Polynucleotide
taatacgactcactataggggccgtcccactcccccctccaccactgctaaacagaggagatagcagatgtggagggggaacctggcggcagcgcaaaagatg

SEQ ID NO: 228948 - DNA, 103 bp, Artificial Sequence
  Synthetic Polynucleotide
taatacgactcactatagggtcctgtgctggccgtcccactcccccctccaacagaggagaggagggatgagtgggacgaacctggcggcagcgcaaaagatg

SEQ ID NO: 228949 - DNA, 103 bp, Artificial Sequence
  Synthetic Polynucleotide
taatacgactcactatagggcttgggaccctcctgtgctggccgtcccacaacagaggagagtgggaatgccagcacagaacctggcggcagcgcaaaagatg

SEQ ID NO: 228950 - DNA, 103 bp, Artificial Sequence
  Synthetic Polynucleotide
taatacgactcactatagggtctctgaagaagggacttgaagcagccaggaacagaggagacctggcatgttcaagtccaacctggcggcagcgcaaaagatg

SEQ ID NO: 228951 - DNA, 103 bp, Artificial Sequence
  Synthetic Polynucleotide
taatacgactcactatagggaccgaggcagcttgggaccctcctgtgctgaacagaggagacagcacatgagggtcccaaacctggcggcagcgcaaaagatg

SEQ ID NO: 228952 - DNA, 103 bp, Artificial Sequence
  Synthetic Polynucleotide
taatacgactcactataggggtaagtgataaccgaggcagcttgggacccaacagaggagagggtccatggctgcctcgaacctggcggcagcgcaaaagatg

SEQ ID NO: 228953 - DNA, 103 bp, Artificial Sequence
  Synthetic Polynucleotide
taatacgactcactatagggggggagcagtgtaagtgataaccgaggcagaacagaggagactgcctatgttatcacttaacctggcggcagcgcaaaagatg

SEQ ID NO: 228954 - DNA, 103 bp, Artificial Sequence
  Synthetic Polynucleotide
taatacgactcactatagggggtggcctcgggggagcagtgtaagtgataaacagaggagatatcacatgcactgctccaacctggcggcagcgcaaaagatg

SEQ ID NO: 228955 - DNA, 103 bp, Artificial Sequence
  Synthetic Polynucleotide
taatacgactcactatagggtcgtttcttgggtggcctcgggggagcagtaacagaggagaactgctatgccgaggccaaacctggcggcagcgcaaaagatg

SEQ ID NO: 228956 - DNA, 103 bp, Artificial Sequence
  Synthetic Polynucleotide
taatacgactcactataggggtgggtattctcgtttcttgggtggcctcgaacagaggagacgaggcatgccaagaaacaacctggcggcagcgcaaaagatg

SEQ ID NO: 228957 - DNA, 103 bp, Artificial Sequence
  Synthetic Polynucleotide
taatacgactcactataggggggggaggaggtgggtattctcgtttcttgaacagaggagacaagaaatgagaatacccaacctggcggcagcgcaaaagatg

SEQ ID NO: 228958 - DNA, 103 bp, Artificial Sequence
  Synthetic Polynucleotide
taatacgactcactatagggtgcaggctcagggggaggaggtgggtattcaacagaggagagaatacatgcctcctcccaacctggcggcagcgcaaaagatg

SEQ ID NO: 228959 - DNA, 103 bp, Artificial Sequence
  Synthetic Polynucleotide
taatacgactcactatagggtgggtgtggctgcaggctcagggggaggagaacagaggagactcctcatgctgagcctgaacctggcggcagcgcaaaagatg

SEQ ID NO: 228960 - DNA, 103 bp, Artificial Sequence
  Synthetic Polynucleotide
taatacgactcactataggggctgggctggtgggtgtggctgcaggctcaaacagaggagatgagccatgagccacaccaacctggcggcagcgcaaaagatg

SEQ ID NO: 228961 - DNA, 103 bp, Artificial Sequence
  Synthetic Polynucleotide
taatacgactcactataggggagcagggcctctctgaagaagggacttgaaacagaggagatcaagtatgttcttcagaaacctggcggcagcgcaaaagatg

SEQ ID NO: 228962 - DNA, 103 bp, Artificial Sequence
  Synthetic Polynucleotide
taatacgactcactataggggactgctgtggctgggctggtgggtgtggcaacagaggagagccacaatgaccagcccaaacctggcggcagcgcaaaagatg

SEQ ID NO: 228963 - DNA, 103 bp, Artificial Sequence
  Synthetic Polynucleotide
taatacgactcactatagggtggctgggctgactgctgtggctgggctggaacagaggagaccagccatgccacagcagaacctggcggcagcgcaaaagatg

SEQ ID NO: 228964 - DNA, 103 bp, Artificial Sequence
  Synthetic Polynucleotide
taatacgactcactatagggcctgcagcggtggctgggctgactgctgtgaacagaggagacacagcatgcagcccagcaacctggcggcagcgcaaaagatg

SEQ ID NO: 228965 - DNA, 103 bp, Artificial Sequence
  Synthetic Polynucleotide
taatacgactcactatagggcatggctggccctgcagcggtggctgggctaacagaggagaagcccaatgaccgctgcaaacctggcggcagcgcaaaagatg

SEQ ID NO: 228966 - DNA, 103 bp, Artificial Sequence
  Synthetic Polynucleotide
taatacgactcactatagggtggtggtggccatggctggccctgcagcggaacagaggagaccgctgatgggccagccaaacctggcggcagcgcaaaagatg

SEQ ID NO: 228967 - DNA, 103 bp, Artificial Sequence
  Synthetic Polynucleotide
taatacgactcactataggggcctcctccgtggtggtggccatggctggcaacagaggagagccagcatgggccaccacaacctggcggcagcgcaaaagatg

SEQ ID NO: 228968 - DNA, 103 bp, Artificial Sequence
  Synthetic Polynucleotide
taatacgactcactatagggccggcccttggcctcctccgtggtggtggcaacagaggagagccaccatgacggaggagaacctggcggcagcgcaaaagatg

SEQ ID NO: 228969 - DNA, 103 bp, Artificial Sequence
  Synthetic Polynucleotide
taatacgactcactatagggcccgtggattccggcccttggcctcctccgaacagaggagacggaggatgccaagggccaacctggcggcagcgcaaaagatg

SEQ ID NO: 228970 - DNA, 103 bp, Artificial Sequence
  Synthetic Polynucleotide
taatacgactcactataggggtccttccagcccgtggattccggcccttgaacagaggagacaagggatggaatccacgaacctggcggcagcgcaaaagatg

SEQ ID NO: 228971 - DNA, 103 bp, Artificial Sequence
  Synthetic Polynucleotide
taatacgactcactataggggtaagtcagagtccttccagcccgtggattaacagaggagaaatccaatggctggaaggaacctggcggcagcgcaaaagatg

SEQ ID NO: 228972 - DNA, 103 bp, Artificial Sequence
  Synthetic Polynucleotide
taatacgactcactataggggggctgaagtgagcagggcctctctgaagaaacagaggagatcttcaatgaggccctgcaacctggcggcagcgcaaaagatg

SEQ ID NO: 228973 - DNA, 103 bp, Artificial Sequence
  Synthetic Polynucleotide
taatacgactcactataggggcttggctgtgtaagtcagagtccttccagaacagaggagactggaaatgctctgacttaacctggcggcagcgcaaaagatg

SEQ ID NO: 228974 - DNA, 103 bp, Artificial Sequence
  Synthetic Polynucleotide
taatacgactcactatagggccgcccactggcttggctgtgtaagtcagaaacagaggagatctgacatgcacagccaaaacctggcggcagcgcaaaagatg

SEQ ID NO: 228975 - DNA, 103 bp, Artificial Sequence
  Synthetic Polynucleotide
taatacgactcactatagggtccaccaatcccgcccactggcttggctgtaacagaggagaacagccatgccagtgggcaacctggcggcagcgcaaaagatg

SEQ ID NO: 228976 - DNA, 103 bp, Artificial Sequence
  Synthetic Polynucleotide
taatacgactcactataggggacccccacctccaccaatcccgcccactgaacagaggagacagtggatgggattggtgaacctggcggcagcgcaaaagatg

SEQ ID NO: 228977 - DNA, 103 bp, Artificial Sequence
  Synthetic Polynucleotide
taatacgactcactatagggcctgtggggggacccccacctccaccaatcaacagaggagagattggatgaggtgggggaacctggcggcagcgcaaaagatg

SEQ ID NO: 228978 - DNA, 103 bp, Artificial Sequence
  Synthetic Polynucleotide
taatacgactcactatagggccggccagcccctgtggggggacccccaccaacagaggagaggtgggatgccccccacaaacctggcggcagcgcaaaagatg

SEQ ID NO: 228979 - DNA, 103 bp, Artificial Sequence
  Synthetic Polynucleotide
taatacgactcactataggggagaggggccccggccagcccctgtgggggaacagaggagacccccaatggggctggccaacctggcggcagcgcaaaagatg

SEQ ID NO: 228980 - DNA, 103 bp, Artificial Sequence
  Synthetic Polynucleotide
taatacgactcactataggggcctgcagctgagaggggccccggccagccaacagaggagaggctggatggggcccctcaacctggcggcagcgcaaaagatg

SEQ ID NO: 228981 - DNA, 103 bp, Artificial Sequence
  Synthetic Polynucleotide
taatacgactcactatagggtggaggtggagcctgcagctgagaggggccaacagaggagaggccccatgcagctgcagaacctggcggcagcgcaaaagatg

SEQ ID NO: 228982 - DNA, 103 bp, Artificial Sequence
  Synthetic Polynucleotide
taatacgactcactatagggtctgacacagtggaggtggagcctgcagctaacagaggagaagctgcatgctccacctcaacctggcggcagcgcaaaagatg

SEQ ID NO: 228983 - DNA, 103 bp, Artificial Sequence
  Synthetic Polynucleotide
taatacgactcactatagggaggggtagtggggctgaagtgagcagggccaacagaggagaggccctatgcacttcagcaacctggcggcagcgcaaaagatg

SEQ ID NO: 228984 - DNA, 103 bp, Artificial Sequence
  Synthetic Polynucleotide
taatacgactcactatagggcgcacagtgatctgacacagtggaggtggaaacagaggagatccaccatgactgtgtcaaacctggcggcagcgcaaaagatg

SEQ ID NO: 228985 - DNA, 103 bp, Artificial Sequence
  Synthetic Polynucleotide
taatacgactcactatagggctcccctattcgcacagtgatctgacacagaacagaggagactgtgtatgatcactgtgaacctggcggcagcgcaaaagatg

SEQ ID NO: 228986 - DNA, 103 bp, Artificial Sequence
  Synthetic Polynucleotide
taatacgactcactatagggcgatggcctcctcccctattcgcacagtgaaacagaggagatcactgatggaataggggaacctggcggcagcgcaaaagatg

SEQ ID NO: 228987 - DNA, 103 bp, Artificial Sequence
  Synthetic Polynucleotide
taatacgactcactatagggcggcgcttgacgatggcctcctcccctattaacagaggagaaataggatgggaggccataacctggcggcagcgcaaaagatg

SEQ ID NO: 228988 - DNA, 103 bp, Artificial Sequence
  Synthetic Polynucleotide
taatacgactcactatagggctctgagatgcggcgcttgacgatggcctcaacagaggagagaggccatggtcaagcgcaacctggcggcagcgcaaaagatg

SEQ ID NO: 228989 - DNA, 103 bp, Artificial Sequence
  Synthetic Polynucleotide
taatacgactcactataggggcaggtcagtctctgagatgcggcgcttgaaacagaggagatcaagcatggcatctcagaacctggcggcagcgcaaaagatg

SEQ ID NO: 228990 - DNA, 103 bp, Artificial Sequence
  Synthetic Polynucleotide
taatacgactcactatagggtccccaggacgcaggtcagtctctgagatgaacagaggagacatctcatggactgacctaacctggcggcagcgcaaaagatg

SEQ ID NO: 228991 - DNA, 103 bp, Artificial Sequence
  Synthetic Polynucleotide
taatacgactcactatagggtccgctcagctccccaggacgcaggtcagtaacagaggagaactgacatgcgtcctgggaacctggcggcagcgcaaaagatg

SEQ ID NO: 228992 - DNA, 103 bp, Artificial Sequence
  Synthetic Polynucleotide
taatacgactcactatagggccatctcctctccgctcagctccccaggacaacagaggagagtcctgatgagctgagcgaacctggcggcagcgcaaaagatg

SEQ ID NO: 228993 - DNA, 103 bp, Artificial Sequence
  Synthetic Polynucleotide
taatacgactcactatagggtcactctcctccatctcctctccgctcagcaacagaggagagctgagatgagaggagataacctggcggcagcgcaaaagatg

SEQ ID NO: 228994 - DNA, 103 bp, Artificial Sequence
  Synthetic Polynucleotide
taatacgactcactatagggagctggtggaaggggtagtggggctgaagtaacagaggagaacttcaatgccactacccaacctggcggcagcgcaaaagatg

SEQ ID NO: 228995 - DNA, 103 bp, Artificial Sequence
  Synthetic Polynucleotide
taatacgactcactatagggttcgtcctcctcactctcctccatctcctcaacagaggagagaggagatggaggagagtaacctggcggcagcgcaaaagatg

SEQ ID NO: 228996 - DNA, 103 bp, Artificial Sequence
  Synthetic Polynucleotide
taatacgactcactatagggcctcctcctcttcgtcctcctcactctcctaacagaggagaaggagaatgaggaggacgaacctggcggcagcgcaaaagatg

SEQ ID NO: 228997 - DNA, 103 bp, Artificial Sequence
  Synthetic Polynucleotide
taatacgactcactatagggtcctcttcgtcctcctcctcttcgtcctccaacagaggagaggaggaatgagaggaggaaacctggcggcagcgcaaaagatg

SEQ ID NO: 228998 - DNA, 103 bp, Artificial Sequence
  Synthetic Polynucleotide
taatacgactcactatagggctcctcctcctcctcttcgtcctcctcctcaacagaggagagaggagatggacgaagagaacctggcggcagcgcaaaagatg

SEQ ID NO: 228999 - DNA, 103 bp, Artificial Sequence
  Synthetic Polynucleotide
taatacgactcactatagggcctcctcatcctcctcctcctcctcttcgtaacagaggagaacgaagatgaggaggaggaacctggcggcagcgcaaaagatg

SEQ ID NO: 229000 - DNA, 103 bp, Artificial Sequence
  Synthetic Polynucleotide
taatacgactcactataggggcctttgattcctcctcatcctcctcctccaacagaggagaggaggaatgggatgaggaaacctggcggcagcgcaaaagatg

SEQ ID NO: 229001 - DNA, 103 bp, Artificial Sequence
  Synthetic Polynucleotide
taatacgactcactatagggctccccaccagcctttgattcctcctcatcaacagaggagagatgagatggaatcaaagaacctggcggcagcgcaaaagatg

SEQ ID NO: 229002 - DNA, 103 bp, Artificial Sequence
  Synthetic Polynucleotide
taatacgactcactatagggagagctggtcctccccaccagcctttgattaacagaggagaaatcaaatgctggtggggaacctggcggcagcgcaaaagatg

SEQ ID NO: 229003 - DNA, 103 bp, Artificial Sequence
  Synthetic Polynucleotide
taatacgactcactatagggtagggcctccagagctggtcctccccaccaaacagaggagatggtggatgggaccagctaacctggcggcagcgcaaaagatg

SEQ ID NO: 229004 - DNA, 103 bp, Artificial Sequence
  Synthetic Polynucleotide
taatacgactcactataggggtaggagtagtagggcctccagagctggtcaacagaggagagaccagatgtggaggcccaacctggcggcagcgcaaaagatg

SEQ ID NO: 229005 - DNA, 103 bp, Artificial Sequence
  Synthetic Polynucleotide
taatacgactcactataggggggcatgggacgggtccgtcacctctgcagaacagaggagactgcagatgtgacggaccaacctggcggcagcgcaaaagatg

SEQ ID NO: 229006 - DNA, 103 bp, Artificial Sequence
  Synthetic Polynucleotide
taatacgactcactatagggcgcccccagtagctggtggaaggggtagtgaacagaggagacactacatgttccaccagaacctggcggcagcgcaaaagatg

SEQ ID NO: 229007 - DNA, 103 bp, Artificial Sequence
  Synthetic Polynucleotide
taatacgactcactataggggcttaggcttgtaggagtagtagggcctccaacagaggagaggaggcatgactactcctaacctggcggcagcgcaaaagatg

SEQ ID NO: 229008 - DNA, 103 bp, Artificial Sequence
  Synthetic Polynucleotide
taatacgactcactatagggccagccttgcgcttaggcttgtaggagtagaacagaggagactactcatgcaagcctaaaacctggcggcagcgcaaaagatg

SEQ ID NO: 229009 - DNA, 103 bp, Artificial Sequence
  Synthetic Polynucleotide
taatacgactcactatagggtccagcagctccagccttgcgcttaggcttaacagaggagaaagcctatgcgcaaggctaacctggcggcagcgcaaaagatg

SEQ ID NO: 229010 - DNA, 103 bp, Artificial Sequence
  Synthetic Polynucleotide
taatacgactcactatagggcactggcacctccagcagctccagccttgcaacagaggagagcaaggatggagctgctgaacctggcggcagcgcaaaagatg

SEQ ID NO: 229011 - DNA, 103 bp, Artificial Sequence
  Synthetic Polynucleotide
taatacgactcactatagggctgccccccacactggcacctccagcagctaacagaggagaagctgcatgaggtgccagaacctggcggcagcgcaaaagatg

SEQ ID NO: 229012 - DNA, 103 bp, Artificial Sequence
  Synthetic Polynucleotide
taatacgactcactataggggggcagcccactgccccccacactggcaccaacagaggagaggtgccatggtggggggcaacctggcggcagcgcaaaagatg

SEQ ID NO: 229013 - DNA, 103 bp, Artificial Sequence
  Synthetic Polynucleotide
taatacgactcactatagggggcggcctcggggcagcccactgccccccaaacagaggagatgggggatggtgggctgcaacctggcggcagcgcaaaagatg

SEQ ID NO: 229014 - DNA, 103 bp, Artificial Sequence
  Synthetic Polynucleotide
taatacgactcactatagggcgtggtggccggcggcctcggggcagcccaaacagaggagatgggctatgccgaggccgaacctggcggcagcgcaaaagatg

SEQ ID NO: 229015 - DNA, 103 bp, Artificial Sequence
  Synthetic Polynucleotide
taatacgactcactatagggctgcctccaacgtggtggccggcggcctcgaacagaggagacgaggcatgcggccaccaaacctggcggcagcgcaaaagatg

SEQ ID NO: 229016 - DNA, 103 bp, Artificial Sequence
  Synthetic Polynucleotide
taatacgactcactataggggttccagcttctgcctccaacgtggtggccaacagaggagaggccacatggttggaggcaacctggcggcagcgcaaaagatg

SEQ ID NO: 229017 - DNA, 103 bp, Artificial Sequence
  Synthetic Polynucleotide
taatacgactcactatagggttgggtgcggcgcccccagtagctggtggaaacagaggagatccaccatgtactgggggaacctggcggcagcgcaaaagatg

SEQ ID NO: 229018 - DNA, 103 bp, Artificial Sequence
  Synthetic Polynucleotide
taatacgactcactatagggcagctcctccgttccagcttctgcctccaaaacagaggagattggagatggaagctggaaacctggcggcagcgcaaaagatg

SEQ ID NO: 229019 - DNA, 103 bp, Artificial Sequence
  Synthetic Polynucleotide
taatacgactcactatagggggtttcctcccagctcctccgttccagcttaacagaggagaaagctgatgcggaggagcaacctggcggcagcgcaaaagatg

SEQ ID NO: 229020 - DNA, 103 bp, Artificial Sequence
  Synthetic Polynucleotide
taatacgactcactatagggcggccgctggggtttcctcccagctcctccaacagaggagaggaggaatggggaggaaaaacctggcggcagcgcaaaagatg

SEQ ID NO: 229021 - DNA, 103 bp, Artificial Sequence
  Synthetic Polynucleotide
taatacgactcactataggggctgggctctcggccgctggggtttcctccaacagaggagaggaggaatgcccagcggcaacctggcggcagcgcaaaagatg

SEQ ID NO: 229022 - DNA, 103 bp, Artificial Sequence
  Synthetic Polynucleotide
taatacgactcactatagggggcacgtcccgctgggctctcggccgctggaacagaggagaccagcgatggagagcccaaacctggcggcagcgcaaaagatg

SEQ ID NO: 229023 - DNA, 103 bp, Artificial Sequence
  Synthetic Polynucleotide
taatacgactcactataggggctctgtgcgggcacgtcccgctgggctctaacagaggagaagagccatgcgggacgtgaacctggcggcagcgcaaaagatg

SEQ ID NO: 229024 - DNA, 103 bp, Artificial Sequence
  Synthetic Polynucleotide
taatacgactcactatagggcggtgcctccgctctgtgcgggcacgtcccaacagaggagagggacgatgccgcacagaaacctggcggcagcgcaaaagatg

SEQ ID NO: 229025 - DNA, 103 bp, Artificial Sequence
  Synthetic Polynucleotide
taatacgactcactataggggtccccgcatcggtgcctccgctctgtgcgaacagaggagacgcacaatgcggaggcacaacctggcggcagcgcaaaagatg

SEQ ID NO: 229026 - DNA, 103 bp, Artificial Sequence
  Synthetic Polynucleotide
taatacgactcactatagggtctgggcacagtccccgcatcggtgcctccaacagaggagaggaggcatggatgcggggaacctggcggcagcgcaaaagatg

SEQ ID NO: 229027 - DNA, 103 bp, Artificial Sequence
  Synthetic Polynucleotide
taatacgactcactataggggtggtgaaggtctgggcacagtccccgcataacagaggagaatgcggatgctgtgcccaaacctggcggcagcgcaaaagatg

SEQ ID NO: 229028 - DNA, 103 bp, Artificial Sequence
  Synthetic Polynucleotide
taatacgactcactatagggggtggcagggttgggtgcggcgcccccagtaacagaggagaactgggatggccgcacccaacctggcggcagcgcaaaagatg

SEQ ID NO: 229029 - DNA, 103 bp, Artificial Sequence
  Synthetic Polynucleotide
taatacgactcactatagggctttctcagggtggtgaaggtctgggcacaaacagaggagatgtgccatgaccttcaccaacctggcggcagcgcaaaagatg

SEQ ID NO: 229030 - DNA, 103 bp, Artificial Sequence
  Synthetic Polynucleotide
taatacgactcactataggggcttccgcagctttctcagggtggtgaaggaacagaggagaccttcaatgccctgagaaaacctggcggcagcgcaaaagatg

SEQ ID NO: 229031 - DNA, 103 bp, Artificial Sequence
  Synthetic Polynucleotide
taatacgactcactataggggcctcttggtgcttccgcagctttctcaggaacagaggagacctgagatggctgcggaaaacctggcggcagcgcaaaagatg

SEQ ID NO: 229032 - DNA, 103 bp, Artificial Sequence
  Synthetic Polynucleotide
taatacgactcactatagggcccaccgtgggcctcttggtgcttccgcagaacagaggagactgcggatgcaccaagagaacctggcggcagcgcaaaagatg

SEQ ID NO: 229033 - DNA, 103 bp, Artificial Sequence
  Synthetic Polynucleotide
taatacgactcactatagggtgtgggagcccccaccgtgggcctcttggtaacagaggagaaccaagatgcccacggtgaacctggcggcagcgcaaaagatg

SEQ ID NO: 229034 - DNA, 103 bp, Artificial Sequence
  Synthetic Polynucleotide
taatacgactcactataggggcccgggagctgtgggagcccccaccgtggaacagaggagaccacggatggggctcccaaacctggcggcagcgcaaaagatg

SEQ ID NO: 229035 - DNA, 103 bp, Artificial Sequence
  Synthetic Polynucleotide
taatacgactcactatagggcctccgtccggcccgggagctgtgggagccaacagaggagaggctccatgagctcccggaacctggcggcagcgcaaaagatg

SEQ ID NO: 229036 - DNA, 103 bp, Artificial Sequence
  Synthetic Polynucleotide
taatacgactcactataggggggtggagggcctccgtccggcccgggagcaacagaggagagctcccatgccggacggaaacctggcggcagcgcaaaagatg

SEQ ID NO: 229037 - DNA, 103 bp, Artificial Sequence
  Synthetic Polynucleotide
taatacgactcactatagggcaggtaaagcgggtggagggcctccgtccgaacagaggagacggacgatggccctccacaacctggcggcagcgcaaaagatg

SEQ ID NO: 229038 - DNA, 103 bp, Artificial Sequence
  Synthetic Polynucleotide
taatacgactcactataggggcagtgggggcaggtaaagcgggtggagggaacagaggagaccctccatgcgctttaccaacctggcggcagcgcaaaagatg

SEQ ID NO: 229039 - DNA, 103 bp, Artificial Sequence
  Synthetic Polynucleotide
taatacgactcactatagggcagctgtggtggtggcagggttgggtgcggaacagaggagaccgcacatgaccctgccaaacctggcggcagcgcaaaagatg

SEQ ID NO: 229040 - DNA, 103 bp, Artificial Sequence
  Synthetic Polynucleotide
taatacgactcactatagggacaccttggcgcagtgggggcaggtaaagcaacagaggagagctttaatggcccccactaacctggcggcagcgcaaaagatg

SEQ ID NO: 229041 - DNA, 103 bp, Artificial Sequence
  Synthetic Polynucleotide
taatacgactcactataggggcggtcttgcacaccttggcgcagtgggggaacagaggagacccccaatgcgccaaggtaacctggcggcagcgcaaaagatg

SEQ ID NO: 229042 - DNA, 103 bp, Artificial Sequence
  Synthetic Polynucleotide
taatacgactcactatagggcagggcagctgcggtcttgcacaccttggcaacagaggagagccaagatgtgcaagaccaacctggcggcagcgcaaaagatg

SEQ ID NO: 229043 - DNA, 103 bp, Artificial Sequence
  Synthetic Polynucleotide
taatacgactcactatagggcgtggcggctcagggcagctgcggtcttgcaacagaggagagcaagaatgcagctgcccaacctggcggcagcgcaaaagatg

SEQ ID NO: 229044 - DNA, 103 bp, Artificial Sequence
  Synthetic Polynucleotide
taatacgactcactatagggtgcctctgcccgtggcggctcagggcagctaacagaggagaagctgcatggagccgccaaacctggcggcagcgcaaaagatg

SEQ ID NO: 229045 - DNA, 103 bp, Artificial Sequence
  Synthetic Polynucleotide
taatacgactcactatagggctcagcagcatgcctctgcccgtggcggctaacagaggagaagccgcatggggcagaggaacctggcggcagcgcaaaagatg

SEQ ID NO: 229046 - DNA, 103 bp, Artificial Sequence
  Synthetic Polynucleotide
taatacgactcactatagggccccgggccgctcagcagcatgcctctgccaacagaggagaggcagaatgatgctgctgaacctggcggcagcgcaaaagatg

SEQ ID NO: 229047 - DNA, 103 bp, Artificial Sequence
  Synthetic Polynucleotide
taatacgactcactataggggttggggtgcccccgggccgctcagcagcaaacagaggagatgctgcatggcggcccggaacctggcggcagcgcaaaagatg

SEQ ID NO: 229048 - DNA, 103 bp, Artificial Sequence
  Synthetic Polynucleotide
taatacgactcactatagggaatgacaggggttggggtgcccccgggccgaacagaggagacggcccatgggcaccccaaacctggcggcagcgcaaaagatg

SEQ ID NO: 229049 - DNA, 103 bp, Artificial Sequence
  Synthetic Polynucleotide
taatacgactcactatagggtggaataggcaatgacaggggttggggtgcaacagaggagagcacccatgcccctgtcaaacctggcggcagcgcaaaagatg

SEQ ID NO: 229050 - DNA, 103 bp, Artificial Sequence
  Synthetic Polynucleotide
taatacgactcactataggggaggaagaggcagctgtggtggtggcagggaacagaggagaccctgcatgcaccacagcaacctggcggcagcgcaaaagatg

SEQ ID NO: 229051 - DNA, 103 bp, Artificial Sequence
  Synthetic Polynucleotide
taatacgactcactataggggcgctgcccttggaataggcaatgacagggaacagaggagaccctgtatgtgcctattcaacctggcggcagcgcaaaagatg

SEQ ID NO: 229052 - DNA, 103 bp, Artificial Sequence
  Synthetic Polynucleotide
taatacgactcactatagggcctggtgccagcgctgcccttggaataggcaacagaggagagcctatatgaagggcagcaacctggcggcagcgcaaaagatg

SEQ ID NO: 229053 - DNA, 103 bp, Artificial Sequence
  Synthetic Polynucleotide
taatacgactcactatagggcatccccgggcctggtgccagcgctgccctaacagaggagaagggcaatgctggcaccaaacctggcggcagcgcaaaagatg

SEQ ID NO: 229054 - DNA, 103 bp, Artificial Sequence
  Synthetic Polynucleotide
taatacgactcactatagggtcctccttgacatccccgggcctggtgccaaacagaggagatggcacatggcccggggaaacctggcggcagcgcaaaagatg

SEQ ID NO: 229055 - DNA, 103 bp, Artificial Sequence
  Synthetic Polynucleotide
taatacgactcactatagggttggggggcttcctccttgacatccccgggaacagaggagacccgggatggtcaaggagaacctggcggcagcgcaaaagatg

SEQ ID NO: 229056 - DNA, 103 bp, Artificial Sequence
  Synthetic Polynucleotide
taatacgactcactatagggcttgcatctcttggggggcttcctccttgaaacagaggagatcaaggatgaagccccccaacctggcggcagcgcaaaagatg

SEQ ID NO: 229057 - DNA, 103 bp, Artificial Sequence
  Synthetic Polynucleotide
taatacgactcactataggggatgaggagacttgcatctcttggggggctaacagaggagaagccccatgagagatgcaaacctggcggcagcgcaaaagatg

SEQ ID NO: 229058 - DNA, 103 bp, Artificial Sequence
  Synthetic Polynucleotide
taatacgactcactatagggctcaccgctggatgaggagacttgcatctcaacagaggagagagatgatggtctcctcaaacctggcggcagcgcaaaagatg

SEQ ID NO: 229059 - DNA, 103 bp, Artificial Sequence
  Synthetic Polynucleotide
taatacgactcactatagggcgccacctgcctcaccgctggatgaggagaaacagaggagatctcctatgccagcggtgaacctggcggcagcgcaaaagatg

SEQ ID NO: 229060 - DNA, 103 bp, Artificial Sequence
  Synthetic Polynucleotide
taatacgactcactataggggcagtgctcccgccacctgcctcaccgctgaacagaggagacagcggatgggcaggtggaacctggcggcagcgcaaaagatg

SEQ ID NO: 229061 - DNA, 103 bp, Artificial Sequence
  Synthetic Polynucleotide
taatacgactcactatagggagaggaggaggaggaagaggcagctgtggtaacagaggagaaccacaatggcctcttccaacctggcggcagcgcaaaagatg

SEQ ID NO: 229062 - DNA, 103 bp, Artificial Sequence
  Synthetic Polynucleotide
taatacgactcactatagggttcctcagcagcagtgctcccgccacctgcaacagaggagagcaggtatggggagcactaacctggcggcagcgcaaaagatg

SEQ ID NO: 229063 - DNA, 103 bp, Artificial Sequence
  Synthetic Polynucleotide
taatacgactcactatagggtctcggaagcttcctcagcagcagtgctccaacagaggagaggagcaatgctgctgaggaacctggcggcagcgcaaaagatg

SEQ ID NO: 229064 - DNA, 103 bp, Artificial Sequence
  Synthetic Polynucleotide
taatacgactcactatagggagtgaggcggtctcggaagcttcctcagcaaacagaggagatgctgaatgagcttccgaaacctggcggcagcgcaaaagatg

SEQ ID NO: 229065 - DNA, 103 bp, Artificial Sequence
  Synthetic Polynucleotide
taatacgactcactatagggagggtcctggagtgaggcggtctcggaagcaacagaggagagcttccatgaccgcctcaaacctggcggcagcgcaaaagatg

SEQ ID NO: 229066 - DNA, 103 bp, Artificial Sequence
  Synthetic Polynucleotide
taatacgactcactatagggctgaaatgatagggtcctggagtgaggcggaacagaggagaccgcctatgtccaggaccaacctggcggcagcgcaaaagatg

SEQ ID NO: 229067 - DNA, 103 bp, Artificial Sequence
  Synthetic Polynucleotide
taatacgactcactatagggtcctcaccccctgaaatgatagggtcctggaacagaggagaccaggaatgtatcatttcaacctggcggcagcgcaaaagatg

SEQ ID NO: 229068 - DNA, 103 bp, Artificial Sequence
  Synthetic Polynucleotide
taatacgactcactatagggtactgggggctcctcaccccctgaaatgataacagaggagaatcattatggggggtgagaacctggcggcagcgcaaaagatg

SEQ ID NO: 229069 - DNA, 103 bp, Artificial Sequence
  Synthetic Polynucleotide
taatacgactcactatagggcgcttgccactactgggggctcctcaccccaacagaggagaggggtgatgagcccccagaacctggcggcagcgcaaaagatg

SEQ ID NO: 229070 - DNA, 103 bp, Artificial Sequence
  Synthetic Polynucleotide
taatacgactcactatagggtagctgcccccgcttgccactactgggggcaacagaggagagcccccatgagtggcaagaacctggcggcagcgcaaaagatg

SEQ ID NO: 229071 - DNA, 103 bp, Artificial Sequence
  Synthetic Polynucleotide
taatacgactcactatagggtgggtatacatagctgcccccgcttgccacaacagaggagagtggcaatggggggcagcaacctggcggcagcgcaaaagatg

SEQ ID NO: 229072 - DNA, 103 bp, Artificial Sequence
  Synthetic Polynucleotide
taatacgactcactatagggaagacgaggaagaggaggaggaggaagaggaacagaggagacctcttatgcctcctcctaacctggcggcagcgcaaaagatg

SEQ ID NO: 229073 - DNA, 103 bp, Artificial Sequence
  Synthetic Polynucleotide
taatacgactcactatagggcctgcacaggtgggtatacatagctgccccaacagaggagaggggcaatgatgtataccaacctggcggcagcgcaaaagatg

SEQ ID NO: 229074 - DNA, 103 bp, Artificial Sequence
  Synthetic Polynucleotide
taatacgactcactatagggagtggaaattcctgcacaggtgggtatacaaacagaggagatgtataatgacctgtgcaaacctggcggcagcgcaaaagatg

SEQ ID NO: 229075 - DNA, 103 bp, Artificial Sequence
  Synthetic Polynucleotide
taatacgactcactatagggaatcaaggccagtggaaattcctgcacaggaacagaggagacctgtgatggaatttccaaacctggcggcagcgcaaaagatg

SEQ ID NO: 229076 - DNA, 103 bp, Artificial Sequence
  Synthetic Polynucleotide
taatacgactcactatagggggccgcccccaatcaaggccagtggaaattaacagaggagaaatttcatgtggccttgaaacctggcggcagcgcaaaagatg

SEQ ID NO: 229077 - DNA, 103 bp, Artificial Sequence
  Synthetic Polynucleotide
taatacgactcactatagggccaggttcccggccgcccccaatcaaggccaacagaggagaggccttatgtgggggcggaacctggcggcagcgcaaaagatg

SEQ ID NO: 229078 - DNA, 103 bp, Artificial Sequence
  Synthetic Polynucleotide
taatacgactcactatagggcctgccaccgccaggttcccggccgcccccaacagaggagagggggcatgcgggaacctaacctggcggcagcgcaaaagatg

SEQ ID NO: 229079 - DNA, 103 bp, Artificial Sequence
  Synthetic Polynucleotide
taatacgactcactatagggcagattttcccctgccaccgccaggttcccaacagaggagagggaacatggcggtggcaaacctggcggcagcgcaaaagatg

SEQ ID NO: 229080 - DNA, 103 bp, Artificial Sequence
  Synthetic Polynucleotide
taatacgactcactatagggccttcactcccagattttcccctgccaccgaacagaggagacggtggatggggaaaatcaacctggcggcagcgcaaaagatg

SEQ ID NO: 229081 - DNA, 103 bp, Artificial Sequence
  Synthetic Polynucleotide
taatacgactcactatagggccccactggcccttcactcccagattttccaacagaggagaggaaaaatggggagtgaaaacctggcggcagcgcaaaagatg

SEQ ID NO: 229082 - DNA, 103 bp, Artificial Sequence
  Synthetic Polynucleotide
taatacgactcactatagggcctcaccagcccccactggcccttcactccaacagaggagaggagtgatgggccagtggaacctggcggcagcgcaaaagatg

SEQ ID NO: 229083 - DNA, 103 bp, Artificial Sequence
  Synthetic Polynucleotide
taatacgactcactataggggaagaggaagaagacgaggaagaggaggagaacagaggagactcctcatgttcctcgtcaacctggcggcagcgcaaaagatg

SEQ ID NO: 229084 - DNA, 103 bp, Artificial Sequence
  Synthetic Polynucleotide
taatacgactcactatagggatccggtccccctcaccagcccccactggcaacagaggagagccagtatgggctggtgaaacctggcggcagcgcaaaagatg

SEQ ID NO: 229085 - DNA, 103 bp, Artificial Sequence
  Synthetic Polynucleotide
taatacgactcactatagggtatcccctccatccggtccccctcaccagcaacagaggagagctggtatgggggaccggaacctggcggcagcgcaaaagatg

SEQ ID NO: 229086 - DNA, 103 bp, Artificial Sequence
  Synthetic Polynucleotide
taatacgactcactatagggtggcagcccctatcccctccatccggtcccaacagaggagagggaccatgtggaggggaaacctggcggcagcgcaaaagatg

SEQ ID NO: 229087 - DNA, 103 bp, Artificial Sequence
  Synthetic Polynucleotide
taatacgactcactatagggaaagtgactttggcagcccctatcccctccaacagaggagaggagggatgaggggctgcaacctggcggcagcgcaaaagatg

SEQ ID NO: 229088 - DNA, 103 bp, Artificial Sequence
  Synthetic Polynucleotide
taatacgactcactatagggctcagggtagaaagtgactttggcagccccaacagaggagaggggctatgaaagtcactaacctggcggcagcgcaaaagatg

SEQ ID NO: 229089 - DNA, 103 bp, Artificial Sequence
  Synthetic Polynucleotide
taatacgactcactataggggcgggtagggctcagggtagaaagtgacttaacagaggagaaagtcaatgtctaccctgaacctggcggcagcgcaaaagatg

SEQ ID NO: 229090 - DNA, 103 bp, Artificial Sequence
  Synthetic Polynucleotide
taatacgactcactatagggccatagacgagcgggtagggctcagggtagaacagaggagactacccatggccctacccaacctggcggcagcgcaaaagatg

SEQ ID NO: 229091 - DNA, 103 bp, Artificial Sequence
  Synthetic Polynucleotide
taatacgactcactataggggagctgggggccatagacgagcgggtagggaacagaggagaccctacatgctcgtctataacctggcggcagcgcaaaagatg

SEQ ID NO: 229092 - DNA, 103 bp, Artificial Sequence
  Synthetic Polynucleotide
taatacgactcactatagggaggcggcaaggagctgggggccatagacgaaacagaggagatcgtctatggcccccagcaacctggcggcagcgcaaaagatg

SEQ ID NO: 229093 - DNA, 103 bp, Artificial Sequence
  Synthetic Polynucleotide
taatacgactcactatagggttgtaagggtaggcggcaaggagctgggggaacagaggagacccccaatgccttgccgcaacctggcggcagcgcaaaagatg

SEQ ID NO: 229094 - DNA, 103 bp, Artificial Sequence
  Synthetic Polynucleotide
taatacgactcactatagggagaggaggaagaagaggaagaagacgaggaaacagaggagatcctcgatgtcttcctctaacctggcggcagcgcaaaagatg

SEQ ID NO: 229095 - DNA, 103 bp, Artificial Sequence
  Synthetic Polynucleotide
taatacgactcactataggggttactgaagttgtaagggtaggcggcaagaacagaggagacttgccatgtacccttacaacctggcggcagcgcaaaagatg

SEQ ID NO: 229096 - DNA, 103 bp, Artificial Sequence
  Synthetic Polynucleotide
taatacgactcactataggggagcggccaagttactgaagttgtaagggtaacagaggagaacccttatgacttcagtaaacctggcggcagcgcaaaagatg

SEQ ID NO: 229097 - DNA, 103 bp, Artificial Sequence
  Synthetic Polynucleotide
taatacgactcactataggggcaaccgggagagcggccaagttactgaagaacagaggagacttcagatgcttggccgcaacctggcggcagcgcaaaagatg

SEQ ID NO: 229098 - DNA, 103 bp, Artificial Sequence
  Synthetic Polynucleotide
taatacgactcactatagggcatgttgagagcaaccgggagagcggccaaaacagaggagattggccatgctcccggttaacctggcggcagcgcaaaagatg

SEQ ID NO: 229099 - DNA, 103 bp, Artificial Sequence
  Synthetic Polynucleotide
taatacgactcactatagggcaggtaggaccatgttgagagcaaccgggaaacagaggagatcccggatgctctcaacaaacctggcggcagcgcaaaagatg

SEQ ID NO: 229100 - DNA, 103 bp, Artificial Sequence
  Synthetic Polynucleotide
taatacgactcactatagggcccttctcatcaggtaggaccatgttgagaaacagaggagatctcaaatgggtcctaccaacctggcggcagcgcaaaagatg

SEQ ID NO: 229101 - DNA, 103 bp, Artificial Sequence
  Synthetic Polynucleotide
taatacgactcactatagggggcccccgcacccttctcatcaggtaggacaacagaggagagtcctaatggatgagaagaacctggcggcagcgcaaaagatg

SEQ ID NO: 229102 - DNA, 103 bp, Artificial Sequence
  Synthetic Polynucleotide
taatacgactcactatagggggaagggaagggcccccgcacccttctcataacagaggagaatgagaatggtgcgggggaacctggcggcagcgcaaaagatg

SEQ ID NO: 229103 - DNA, 103 bp, Artificial Sequence
  Synthetic Polynucleotide
taatacgactcactatagggacccctggtaggaagggaagggcccccgcaaacagaggagatgcgggatgccttcccttaacctggcggcagcgcaaaagatg

SEQ ID NO: 229104 - DNA, 103 bp, Artificial Sequence
  Synthetic Polynucleotide
taatacgactcactataggggtagccaaagacccctggtaggaagggaagaacagaggagacttcccatgctaccagggaacctggcggcagcgcaaaagatg

SEQ ID NO: 229105 - DNA, 103 bp, Artificial Sequence
  Synthetic Polynucleotide
taatacgactcactatagggaagaagaagcagaggaggaagaagaggaagaacagaggagacttcctatgcttcctcctaacctggcggcagcgcaaaagatg

SEQ ID NO: 229106 - DNA, 103 bp, Artificial Sequence
  Synthetic Polynucleotide
taatacgactcactataggggattcactgcgtagccaaagacccctggtaaacagaggagataccagatgtctttggctaacctggcggcagcgcaaaagatg

SEQ ID NO: 229107 - DNA, 103 bp, Artificial Sequence
  Synthetic Polynucleotide
taatacgactcactataggggctgcttgaggattcactgcgtagccaaagaacagaggagactttggatgcgcagtgaaaacctggcggcagcgcaaaagatg

SEQ ID NO: 229108 - DNA, 103 bp, Artificial Sequence
  Synthetic Polynucleotide
taatacgactcactatagggggcagggggtgctgcttgaggattcactgcaacagaggagagcagtgatgcctcaagcaaacctggcggcagcgcaaaagatg

SEQ ID NO: 229109 - DNA, 103 bp, Artificial Sequence
  Synthetic Polynucleotide
taatacgactcactataggggtgttggtggggcagggggtgctgcttgagaacagaggagactcaagatgcaccccctgaacctggcggcagcgcaaaagatg

SEQ ID NO: 229110 - DNA, 103 bp, Artificial Sequence
  Synthetic Polynucleotide
taatacgactcactataggggggggaggtggtgttggtggggcagggggtaacagaggagaacccccatgcccaccaacaacctggcggcagcgcaaaagatg

SEQ ID NO: 229111 - DNA, 103 bp, Artificial Sequence
  Synthetic Polynucleotide
taatacgactcactatagggaggaagagttgggggaggtggtgttggtggaacagaggagaccaccaatgccacctcccaacctggcggcagcgcaaaagatg

SEQ ID NO: 229112 - DNA, 103 bp, Artificial Sequence
  Synthetic Polynucleotide
taatacgactcactataggggaattggtggaggaagagttgggggaggtgaacagaggagacacctcatgcaactcttcaacctggcggcagcgcaaaagatg

SEQ ID NO: 229113 - DNA, 103 bp, Artificial Sequence
  Synthetic Polynucleotide
taatacgactcactatagggcccttagggggaattggtggaggaagagttaacagaggagaaactctatgtccaccaataacctggcggcagcgcaaaagatg

SEQ ID NO: 229114 - DNA, 103 bp, Artificial Sequence
  Synthetic Polynucleotide
taatacgactcactatagggttccccttctcccttagggggaattggtggaacagaggagaccaccaatgccccctaagaacctggcggcagcgcaaaagatg

SEQ ID NO: 229115 - DNA, 103 bp, Artificial Sequence
  Synthetic Polynucleotide
taatacgactcactatagggcccctgccctttccccttctcccttaggggaacagaggagacccctaatggagaaggggaacctggcggcagcgcaaaagatg

SEQ ID NO: 229116 - DNA, 103 bp, Artificial Sequence
  Synthetic Polynucleotide
taatacgactcactatagggaggacggcgggggcatgggacgggtccgtcaacagaggagagacggaatggtcccatgcaacctggcggcagcgcaaaagatg

SEQ ID NO: 229117 - DNA, 103 bp, Artificial Sequence
  Synthetic Polynucleotide
taatacgactcactataggggaggaagaagaagaagaagcagaggaggaaaacagaggagattcctcatgtgcttcttcaacctggcggcagcgcaaaagatg

SEQ ID NO: 229118 - DNA, 103 bp, Artificial Sequence
  Synthetic Polynucleotide
taatacgactcactataggggttctctcaacccctgccctttccccttctaacagaggagaagaaggatgaagggcaggaacctggcggcagcgcaaaagatg

SEQ ID NO: 229119 - DNA, 103 bp, Artificial Sequence
  Synthetic Polynucleotide
taatacgactcactataggggcccttctgggttctctcaacccctgccctaacagaggagaagggcaatggttgagagaaacctggcggcagcgcaaaagatg

SEQ ID NO: 229120 - DNA, 103 bp, Artificial Sequence
  Synthetic Polynucleotide
taatacgactcactatagggaccccacatcgcccttctgggttctctcaaaacagaggagattgagaatgcccagaaggaacctggcggcagcgcaaaagatg

SEQ ID NO: 229121 - DNA, 103 bp, Artificial Sequence
  Synthetic Polynucleotide
taatacgactcactatagggggaagaggaagaggaagaagaagaagaagcaacagaggagagcttctatgtcttcttccaacctggcggcagcgcaaaagatg

SEQ ID NO: 229122 - DNA, 103 bp, Artificial Sequence
  Synthetic Polynucleotide
taatacgactcactataggggagggggagaggaagaggaagaggaagaagaacagaggagacttcttatgcttcctcttaacctggcggcagcgcaaaagatg

SEQ ID NO: 229123 - DNA, 103 bp, Artificial Sequence
  Synthetic Polynucleotide
taatacgactcactatagggggagaggctggagggggagaggaagaggaaaacagaggagattcctcatgctctcccccaacctggcggcagcgcaaaagatg

SEQ ID NO: 229124 - DNA, 103 bp, Artificial Sequence
  Synthetic Polynucleotide
taatacgactcactatagggagaagcagggggagaggctggagggggagaaacagaggagatctcccatgccagcctctaacctggcggcagcgcaaaagatg

SEQ ID NO: 229125 - DNA, 103 bp, Artificial Sequence
  Synthetic Polynucleotide
taatacgactcactatagggggggtggggaagaagcagggggagaggctgaacagaggagacagcctatgcccctgcttaacctggcggcagcgcaaaagatg

SEQ ID NO: 229126 - DNA, 103 bp, Artificial Sequence
  Synthetic Polynucleotide
taatacgactcactatagggtccaggacccggggtggggaagaagcagggaacagaggagaccctgcatgttccccaccaacctggcggcagcgcaaaagatg

SEQ ID NO: 229127 - DNA, 103 bp, Artificial Sequence
  Synthetic Polynucleotide
taatacgactcactatagggtcctggcaactccaggacccggggtggggaaacagaggagatccccaatgcgggtcctgaacctggcggcagcgcaaaagatg

SEQ ID NO: 229128 - DNA, 103 bp, Artificial Sequence
  Synthetic Polynucleotide
taatacgactcactatagggctgctgggactcctggcaactccaggacccaacagaggagagggtccatgagttgccagaacctggcggcagcgcaaaagatg

SEQ ID NO: 229129 - DNA, 103 bp, Artificial Sequence
  Synthetic Polynucleotide
taatacgactcactataggggaaaacgcagctgctgggactcctggcaacaacagaggagagttgccatgagtcccagcaacctggcggcagcgcaaaagatg

SEQ ID NO: 229130 - DNA, 103 bp, Artificial Sequence
  Synthetic Polynucleotide
taatacgactcactataggggagctggcgcaggacggcgggggcatgggaaacagaggagatcccatatgcccgccgtcaacctggcggcagcgcaaaagatg

SEQ ID NO: 229131 - DNA, 103 bp, Artificial Sequence
  Synthetic Polynucleotide
taatacgactcactataggggaggacatcagaaaacgcagctgctgggacaacagaggagagtcccaatggctgcgtttaacctggcggcagcgcaaaagatg

SEQ ID NO: 229132 - DNA, 103 bp, Artificial Sequence
  Synthetic Polynucleotide
taatacgactcactatagggagatgaagttgaggacatcagaaaacgcagaacagaggagactgcgtatgctgatgtccaacctggcggcagcgcaaaagatg

SEQ ID NO: 229133 - DNA, 103 bp, Artificial Sequence
  Synthetic Polynucleotide
taatacgactcactatagggcgggcgctgtagatgaagttgaggacatcaaacagaggagatgatgtatgcaacttcataacctggcggcagcgcaaaagatg

SEQ ID NO: 229134 - DNA, 103 bp, Artificial Sequence
  Synthetic Polynucleotide
taatacgactcactatagggcagtgcgagccgggcgctgtagatgaagttaacagaggagaaacttcatgtacagcgccaacctggcggcagcgcaaaagatg

SEQ ID NO: 229135 - DNA, 103 bp, Artificial Sequence
  Synthetic Polynucleotide
taatacgactcactatagggcaccaccaggcagtgcgagccgggcgctgtaacagaggagaacagcgatgggctcgcacaacctggcggcagcgcaaaagatg

SEQ ID NO: 229136 - DNA, 103 bp, Artificial Sequence
  Synthetic Polynucleotide
taatacgactcactatagggccgtcccctccaccaccaggcagtgcgagcaacagaggagagctcgcatggcctggtggaacctggcggcagcgcaaaagatg

SEQ ID NO: 229137 - DNA, 103 bp, Artificial Sequence
  Synthetic Polynucleotide
taatacgactcactatagggtacagctgccccgtcccctccaccaccaggaacagaggagacctggtatgggaggggacaacctggcggcagcgcaaaagatg

SEQ ID NO: 229138 - DNA, 103 bp, Artificial Sequence
  Synthetic Polynucleotide
taatacgactcactatagggcaatctctgctacagctgccccgtcccctcaacagaggagagaggggatggggcagctgaacctggcggcagcgcaaaagatg

SEQ ID NO: 229139 - DNA, 103 bp, Artificial Sequence
  Synthetic Polynucleotide
taatacgactcactatagggcccaaagctccaatctctgctacagctgccaacagaggagaggcagcatgagcagagataacctggcggcagcgcaaaagatg

SEQ ID NO: 229140 - DNA, 103 bp, Artificial Sequence
  Synthetic Polynucleotide
taatacgactcactatagggcagacggcgccccaaagctccaatctctgcaacagaggagagcagagatgggagctttgaacctggcggcagcgcaaaagatg

SEQ ID NO: 229141 - DNA, 103 bp, Artificial Sequence
  Synthetic Polynucleotide
taatacgactcactataggggctgttcattgagctggcgcaggacggcggaacagaggagaccgccgatgtgcgccagcaacctggcggcagcgcaaaagatg

SEQ ID NO: 229142 - DNA, 103 bp, Artificial Sequence
  Synthetic Polynucleotide
taatacgactcactataggggggagatgcccagacggcgccccaaagctcaacagaggagagagcttatgggcgccgtcaacctggcggcagcgcaaaagatg

SEQ ID NO: 229143 - DNA, 103 bp, Artificial Sequence
  Synthetic Polynucleotide
taatacgactcactatagggccctgaaggcgggagatgcccagacggcgcaacagaggagagcgccgatggggcatctcaacctggcggcagcgcaaaagatg

SEQ ID NO: 229144 - DNA, 103 bp, Artificial Sequence
  Synthetic Polynucleotide
taatacgactcactatagggctcccccaggccctgaaggcgggagatgccaacagaggagaggcatcatgcgccttcagaacctggcggcagcgcaaaagatg

SEQ ID NO: 229145 - DNA, 103 bp, Artificial Sequence
  Synthetic Polynucleotide
taatacgactcactatagggcatcacctccctcccccaggccctgaaggcaacagaggagagccttcatggcctgggggaacctggcggcagcgcaaaagatg

SEQ ID NO: 229146 - DNA, 103 bp, Artificial Sequence
  Synthetic Polynucleotide
taatacgactcactatagggggtacccaggcatcacctccctcccccaggaacagaggagacctgggatggggaggtgaaacctggcggcagcgcaaaagatg

SEQ ID NO: 229147 - DNA, 103 bp, Artificial Sequence
  Synthetic Polynucleotide
taatacgactcactatagggtggggtaggaggtacccaggcatcacctccaacagaggagaggaggtatggcctgggtaaacctggcggcagcgcaaaagatg

SEQ ID NO: 229148 - DNA, 103 bp, Artificial Sequence
  Synthetic Polynucleotide
taatacgactcactatagggccatgggggctggggtaggaggtacccaggaacagaggagacctgggatgctcctacccaacctggcggcagcgcaaaagatg

SEQ ID NO: 229149 - DNA, 103 bp, Artificial Sequence
  Synthetic Polynucleotide
taatacgactcactatagggtgcgaggtggccatgggggctggggtaggaaacagaggagatcctacatgagcccccataacctggcggcagcgcaaaagatg

SEQ ID NO: 229150 - DNA, 103 bp, Artificial Sequence
  Synthetic Polynucleotide
taatacgactcactatagggctcttcaggctgcgaggtggccatgggggcaacagaggagagcccccatggccacctcgaacctggcggcagcgcaaaagatg

SEQ ID NO: 229151 - DNA, 103 bp, Artificial Sequence
  Synthetic Polynucleotide
taatacgactcactatagggcaaagctgtcctcttcaggctgcgaggtggaacagaggagaccacctatgagcctgaagaacctggcggcagcgcaaaagatg

SEQ ID NO: 229152 - DNA, 103 bp, Artificial Sequence
  Synthetic Polynucleotide
taatacgactcactatagggccacggagccgctgttcattgagctggcgcaacagaggagagcgccaatgcaatgaacaaacctggcggcagcgcaaaagatg

SEQ ID NO: 229153 - DNA, 103 bp, Artificial Sequence
  Synthetic Polynucleotide
taatacgactcactatagggggcccgggcccaaagctgtcctcttcaggcaacagaggagagcctgaatgggacagcttaacctggcggcagcgcaaaagatg

SEQ ID NO: 229154 - DNA, 103 bp, Artificial Sequence
  Synthetic Polynucleotide
taatacgactcactatagggagctggcctgggcccgggcccaaagctgtcaacagaggagagacagcatggggcccgggaacctggcggcagcgcaaaagatg

SEQ ID NO: 229155 - DNA, 103 bp, Artificial Sequence
  Synthetic Polynucleotide
taatacgactcactatagggcccactccccagctggcctgggcccgggccaacagaggagaggcccgatgccaggccagaacctggcggcagcgcaaaagatg

SEQ ID NO: 229156 - DNA, 103 bp, Artificial Sequence
  Synthetic Polynucleotide
taatacgactcactatagggctgtcaccctcccactccccagctggcctgaacagaggagacaggccatgtggggagtgaacctggcggcagcgcaaaagatg

SEQ ID NO: 229157 - DNA, 103 bp, Artificial Sequence
  Synthetic Polynucleotide
taatacgactcactatagggggcctcagccctgtcaccctcccactccccaacagaggagaggggagatggagggtgacaacctggcggcagcgcaaaagatg

SEQ ID NO: 229158 - DNA, 103 bp, Artificial Sequence
  Synthetic Polynucleotide
taatacgactcactatagggcaggggcctgggcctcagccctgtcaccctaacagaggagaagggtgatggggctgaggaacctggcggcagcgcaaaagatg

SEQ ID NO: 229159 - DNA, 103 bp, Artificial Sequence
  Synthetic Polynucleotide
taatacgactcactatagggcactgcaagtcaggggcctgggcctcagccaacagaggagaggctgaatgccaggccccaacctggcggcagcgcaaaagatg

SEQ ID NO: 229160 - DNA, 103 bp, Artificial Sequence
  Synthetic Polynucleotide
taatacgactcactataggggggcagggagcactgcaagtcaggggcctgaacagaggagacaggccatggacttgcagaacctggcggcagcgcaaaagatg

SEQ ID NO: 229161 - DNA, 103 bp, Artificial Sequence
  Synthetic Polynucleotide
taatacgactcactatagggggggccgccggggcagggagcactgcaagtaacagaggagaacttgcatggctccctgcaacctggcggcagcgcaaaagatg

SEQ ID NO: 229162 - DNA, 103 bp, Artificial Sequence
  Synthetic Polynucleotide
taatacgactcactataggggggcaggggaggggccgccggggcagggagaacagaggagactccctatgccggcggccaacctggcggcagcgcaaaagatg

SEQ ID NO: 229163 - DNA, 103 bp, Artificial Sequence
  Synthetic Polynucleotide
taatacgactcactatagggacagaagaggccacggagccgctgttcattaacagaggagaaatgaaatgcggctccgtaacctggcggcagcgcaaaagatg

SEQ ID NO: 229164 - DNA, 103 bp, Artificial Sequence
  Synthetic Polynucleotide
taatacgactcactatagggtccacactgggggcaggggaggggccgccgaacagaggagacggcggatgctcccctgcaacctggcggcagcgcaaaagatg

SEQ ID NO: 229165 - DNA, 103 bp, Artificial Sequence
  Synthetic Polynucleotide
taatacgactcactatagggtgaagctttttccacactgggggcaggggaaacagaggagatcccctatgcccagtgtgaacctggcggcagcgcaaaagatg

SEQ ID NO: 229166 - DNA, 103 bp, Artificial Sequence
  Synthetic Polynucleotide
taatacgactcactatagggttgggatggatgaagctttttccacactggaacagaggagaccagtgatgaaaaagcttaacctggcggcagcgcaaaagatg

SEQ ID NO: 229167 - DNA, 103 bp, Artificial Sequence
  Synthetic Polynucleotide
taatacgactcactatagggctgcagccgtttgggatggatgaagcttttaacagaggagaaaaagcatgatccatcccaacctggcggcagcgcaaaagatg

SEQ ID NO: 229168 - DNA, 103 bp, Artificial Sequence
  Synthetic Polynucleotide
taatacgactcactatagggcctcatgggtctgcagccgtttgggatggaaacagaggagatccatcatgaacggctgcaacctggcggcagcgcaaaagatg

SEQ ID NO: 229169 - DNA, 103 bp, Artificial Sequence
  Synthetic Polynucleotide
taatacgactcactatagggcggcactgggcctcatgggtctgcagccgtaacagaggagaacggctatggacccatgaaacctggcggcagcgcaaaagatg

SEQ ID NO: 229170 - DNA, 103 bp, Artificial Sequence
  Synthetic Polynucleotide
taatacgactcactatagggggcccctcgtcggcactgggcctcatgggtaacagaggagaacccatatggcccagtgcaacctggcggcagcgcaaaagatg

SEQ ID NO: 229171 - DNA, 103 bp, Artificial Sequence
  Synthetic Polynucleotide
taatacgactcactatagggcccgcgtgctggcccctcgtcggcactgggaacagaggagacccagtatggacgaggggaacctggcggcagcgcaaaagatg

SEQ ID NO: 229172 - DNA, 103 bp, Artificial Sequence
  Synthetic Polynucleotide
taatacgactcactatagggcctgtagacccccgcgtgctggcccctcgtaacagaggagaacgaggatgcagcacgcgaacctggcggcagcgcaaaagatg

SEQ ID NO: 229173 - DNA, 103 bp, Artificial Sequence
  Synthetic Polynucleotide
taatacgactcactatagggagctcccagccctgtagacccccgcgtgctaacagaggagaagcacgatggggtctacaaacctggcggcagcgcaaaagatg

SEQ ID NO: 229174 - DNA, 103 bp, Artificial Sequence
  Synthetic Polynucleotide
taatacgactcactataggggggtgacgtcacagaagaggccacggagccaacagaggagaggctccatggcctcttctaacctggcggcagcgcaaaagatg

SEQ ID NO: 229175 - DNA, 103 bp, Artificial Sequence
  Synthetic Polynucleotide
taatacgactcactatagggcagcgcccccagctcccagccctgtagaccaacagaggagaggtctaatgggctgggagaacctggcggcagcgcaaaagatg

SEQ ID NO: 229176 - DNA, 103 bp, Artificial Sequence
  Synthetic Polynucleotide
taatacgactcactatagggccaccagggccagcgcccccagctcccagcaacagaggagagctgggatgtgggggcgcaacctggcggcagcgcaaaagatg

SEQ ID NO: 229177 - DNA, 103 bp, Artificial Sequence
  Synthetic Polynucleotide
taatacgactcactatagggccctgcaggaccaccagggccagcgcccccaacagaggagagggggcatgggccctggtaacctggcggcagcgcaaaagatg

SEQ ID NO: 229178 - DNA, 103 bp, Artificial Sequence
  Synthetic Polynucleotide
taatacgactcactatagggaggcgtccacccctgcaggaccaccagggcaacagaggagagccctgatggtcctgcagaacctggcggcagcgcaaaagatg

SEQ ID NO: 229179 - DNA, 103 bp, Artificial Sequence
  Synthetic Polynucleotide
taatacgactcactatagggggcagggctgaggcgtccacccctgcaggaaacagaggagatcctgcatgggtggacgcaacctggcggcagcgcaaaagatg

SEQ ID NO: 229180 - DNA, 103 bp, Artificial Sequence
  Synthetic Polynucleotide
taatacgactcactatagggcactggtggaggcagggctgaggcgtccacaacagaggagagtggacatgtcagccctgaacctggcggcagcgcaaaagatg

SEQ ID NO: 229181 - DNA, 103 bp, Artificial Sequence
  Synthetic Polynucleotide
taatacgactcactatagggctcggaagcccactggtggaggcagggctgaacagaggagacagcccatgctccaccagaacctggcggcagcgcaaaagatg

SEQ ID NO: 229182 - DNA, 103 bp, Artificial Sequence
  Synthetic Polynucleotide
taatacgactcactatagggtcggggccccctcggaagcccactggtggaaacagaggagatccaccatggggcttccgaacctggcggcagcgcaaaagatg

SEQ ID NO: 229183 - DNA, 103 bp, Artificial Sequence
  Synthetic Polynucleotide
taatacgactcactatagggcaccacgtgctcggggccccctcggaagccaacagaggagaggcttcatggggggccccaacctggcggcagcgcaaaagatg

SEQ ID NO: 229184 - DNA, 103 bp, Artificial Sequence
  Synthetic Polynucleotide
taatacgactcactatagggccaccaccttcaccacgtgctcggggccccaacagaggagaggggccatgagcacgtggaacctggcggcagcgcaaaagatg

SEQ ID NO: 229185 - DNA, 103 bp, Artificial Sequence
  Synthetic Polynucleotide
taatacgactcactatagggccggctatgagggtgacgtcacagaagaggaacagaggagacctcttatgtgacgtcacaacctggcggcagcgcaaaagatg

SEQ ID NO: 229186 - DNA, 103 bp, Artificial Sequence
  Synthetic Polynucleotide
taatacgactcactatagggacgtggccgcccaccaccttcaccacgtgcaacagaggagagcacgtatggaaggtggtaacctggcggcagcgcaaaagatg

SEQ ID NO: 229187 - DNA, 103 bp, Artificial Sequence
  Synthetic Polynucleotide
taatacgactcactatagggcacatacagcacgtggccgcccaccaccttaacagaggagaaaggtgatgggcggccacaacctggcggcagcgcaaaagatg

SEQ ID NO: 229188 - DNA, 103 bp, Artificial Sequence
  Synthetic Polynucleotide
taatacgactcactatagggaggccgcgcacacatacagcacgtggccgcaacagaggagagcggccatgtgctgtatgaacctggcggcagcgcaaaagatg

SEQ ID NO: 229189 - DNA, 103 bp, Artificial Sequence
  Synthetic Polynucleotide
taatacgactcactataggggaacgctcgcaggccgcgcacacatacagcaacagaggagagctgtaatggtgcgcggcaacctggcggcagcgcaaaagatg

SEQ ID NO: 229190 - DNA, 103 bp, Artificial Sequence
  Synthetic Polynucleotide
taatacgactcactatagggggtcacgtaggaacgctcgcaggccgcgcaaacagaggagatgcgcgatgtgcgagcgtaacctggcggcagcgcaaaagatg

SEQ ID NO: 229191 - DNA, 103 bp, Artificial Sequence
  Synthetic Polynucleotide
taatacgactcactataggggactggacagggtcacgtaggaacgctcgcaacagaggagagcgagcatgcctacgtgaaacctggcggcagcgcaaaagatg

SEQ ID NO: 229192 - DNA, 103 bp, Artificial Sequence
  Synthetic Polynucleotide
taatacgactcactatagggtgtctcttcagactggacagggtcacgtagaacagaggagactacgtatgcctgtccagaacctggcggcagcgcaaaagatg

SEQ ID NO: 229193 - DNA, 103 bp, Artificial Sequence
  Synthetic Polynucleotide
taatacgactcactatagggtacattgctgtgtctcttcagactggacagaacagaggagactgtccatgctgaagagaaacctggcggcagcgcaaaagatg

SEQ ID NO: 229194 - DNA, 103 bp, Artificial Sequence
  Synthetic Polynucleotide
taatacgactcactataggggccacgagtgtacattgctgtgtctcttcaaacagaggagatgaagaatgacagcaatgaacctggcggcagcgcaaaagatg

SEQ ID NO: 229195 - DNA, 103 bp, Artificial Sequence
  Synthetic Polynucleotide
taatacgactcactatagggtacttcctccgccacgagtgtacattgctgaacagaggagacagcaaatgacactcgtgaacctggcggcagcgcaaaagatg

SEQ ID NO: 229196 - DNA, 103 bp, Artificial Sequence
  Synthetic Polynucleotide
taatacgactcactatagggcacactgtgctggacgaaggagccgtccataacagaggagaatggacatgtccttcgtcaacctggcggcagcgcaaaagatg

SEQ ID NO: 229197 - DNA, 103 bp, Artificial Sequence
  Synthetic Polynucleotide
taatacgactcactataggggtgtgccttaaacaccaggccccccacgtcaacagaggagagacgtgatgggcctggtgaacctggcggcagcgcaaaagatg

SEQ ID NO: 229198 - DNA, 103 bp, Artificial Sequence
  Synthetic Polynucleotide
taatacgactcactatagggccgggcttcatgctccaggaggttctccttaacagaggagaaaggagatgctcctggagaacctggcggcagcgcaaaagatg

SEQ ID NO: 229199 - DNA, 103 bp, Artificial Sequence
  Synthetic Polynucleotide
taatacgactcactatagggtcatgcaattccgggcttcatgctccaggaaacagaggagatcctggatgatgaagcccaacctggcggcagcgcaaaagatg

SEQ ID NO: 229200 - DNA, 103 bp, Artificial Sequence
  Synthetic Polynucleotide
taatacgactcactatagggtccgagcggttcatgcaattccgggcttcaaacagaggagatgaagcatggaattgcataacctggcggcagcgcaaaagatg

SEQ ID NO: 229201 - DNA, 103 bp, Artificial Sequence
  Synthetic Polynucleotide
taatacgactcactataggggaagacctgttccgagcggttcatgcaattaacagaggagaaattgcatgaaccgctcgaacctggcggcagcgcaaaagatg

SEQ ID NO: 229202 - DNA, 103 bp, Artificial Sequence
  Synthetic Polynucleotide
taatacgactcactatagggcagagcacgtgaagacctgttccgagcggtaacagaggagaaccgctatgaacaggtctaacctggcggcagcgcaaaagatg

SEQ ID NO: 229203 - DNA, 103 bp, Artificial Sequence
  Synthetic Polynucleotide
taatacgactcactatagggtcctggcacacagagcacgtgaagacctgtaacagaggagaacaggtatgcacgtgctcaacctggcggcagcgcaaaagatg

SEQ ID NO: 229204 - DNA, 103 bp, Artificial Sequence
  Synthetic Polynucleotide
taatacgactcactataggggcggaatgtctcctggcacacagagcacgtaacagaggagaacgtgcatggtgtgccagaacctggcggcagcgcaaaagatg

SEQ ID NO: 229205 - DNA, 103 bp, Artificial Sequence
  Synthetic Polynucleotide
taatacgactcactatagggccatccttcggcggaatgtctcctggcacaaacagaggagatgtgccatgagacattccaacctggcggcagcgcaaaagatg

SEQ ID NO: 229206 - DNA, 103 bp, Artificial Sequence
  Synthetic Polynucleotide
taatacgactcactatagggacccgcagctccatccttcggcggaatgtcaacagaggagagacattatgccgaaggataacctggcggcagcgcaaaagatg

SEQ ID NO: 229207 - DNA, 103 bp, Artificial Sequence
  Synthetic Polynucleotide
taatacgactcactatagggcaccatgtgcacccgcagctccatccttcgaacagaggagacgaaggatggagctgcggaacctggcggcagcgcaaaagatg

SEQ ID NO: 229208 - DNA, 103 bp, Artificial Sequence
  Synthetic Polynucleotide
taatacgactcactatagggggacactccagtgtgccttaaacaccaggcaacagaggagagcctggatgttaaggcacaacctggcggcagcgcaaaagatg

SEQ ID NO: 229209 - DNA, 103 bp, Artificial Sequence
  Synthetic Polynucleotide
taatacgactcactatagggctgtgtgagacaccatgtgcacccgcagctaacagaggagaagctgcatgtgcacatggaacctggcggcagcgcaaaagatg

SEQ ID NO: 229210 - DNA, 103 bp, Artificial Sequence
  Synthetic Polynucleotide
taatacgactcactatagggggcatctcccctgtgtgagacaccatgtgcaacagaggagagcacatatggtctcacacaacctggcggcagcgcaaaagatg

SEQ ID NO: 229211 - DNA, 103 bp, Artificial Sequence
  Synthetic Polynucleotide
taatacgactcactatagggacacttgtagggcatctcccctgtgtgagaaacagaggagatctcacatgggggagatgaacctggcggcagcgcaaaagatg

SEQ ID NO: 229212 - DNA, 103 bp, Artificial Sequence
  Synthetic Polynucleotide
taatacgactcactatagggagcaggaggaacacttgtagggcatctcccaacagaggagagggagaatgcctacaagtaacctggcggcagcgcaaaagatg

SEQ ID NO: 229213 - DNA, 103 bp, Artificial Sequence
  Synthetic Polynucleotide
taatacgactcactatagggaactgctgggagcaggaggaacacttgtagaacagaggagactacaaatgttcctcctgaacctggcggcagcgcaaaagatg

SEQ ID NO: 229214 - DNA, 103 bp, Artificial Sequence
  Synthetic Polynucleotide
taatacgactcactatagggcttctgcatgaactgctgggagcaggaggaaacagaggagatcctccatgtcccagcagaacctggcggcagcgcaaaagatg

SEQ ID NO: 229215 - DNA, 103 bp, Artificial Sequence
  Synthetic Polynucleotide
taatacgactcactataggggcaagtccttcttctgcatgaactgctgggaacagaggagacccagcatgtcatgcagaaacctggcggcagcgcaaaagatg

SEQ ID NO: 229216 - DNA, 103 bp, Artificial Sequence
  Synthetic Polynucleotide
taatacgactcactatagggatgtggctctgcaagtccttcttctgcatgaacagaggagacatgcaatggaaggacttaacctggcggcagcgcaaaagatg

SEQ ID NO: 229217 - DNA, 103 bp, Artificial Sequence
  Synthetic Polynucleotide
taatacgactcactatagggaagtttgatcatgtggctctgcaagtccttaacagaggagaaaggacatgcagagccacaacctggcggcagcgcaaaagatg

SEQ ID NO: 229218 - DNA, 103 bp, Artificial Sequence
  Synthetic Polynucleotide
taatacgactcactataggggggctccatgaagtttgatcatgtggctctaacagaggagaagagccatgtgatcaaacaacctggcggcagcgcaaaagatg

SEQ ID NO: 229219 - DNA, 103 bp, Artificial Sequence
  Synthetic Polynucleotide
taatacgactcactatagggcagcaggcaaggacactccagtgtgccttaaacagaggagataaggcatgctggagtgtaacctggcggcagcgcaaaagatg

SEQ ID NO: 229220 - DNA, 103 bp, Artificial Sequence
  Synthetic Polynucleotide
taatacgactcactatagggtggggcttgggggctccatgaagtttgatcaacagaggagagatcaaatgtcatggagcaacctggcggcagcgcaaaagatg

SEQ ID NO: 229221 - DNA, 103 bp, Artificial Sequence
  Synthetic Polynucleotide
taatacgactcactatagggggggcatgcatggggcttgggggctccatgaacagaggagacatggaatgcccaagcccaacctggcggcagcgcaaaagatg

SEQ ID NO: 229222 - DNA, 103 bp, Artificial Sequence
  Synthetic Polynucleotide
taatacgactcactatagggtggcacaggtggggcatgcatggggcttggaacagaggagaccaagcatgatgcatgccaacctggcggcagcgcaaaagatg

SEQ ID NO: 229223 - DNA, 103 bp, Artificial Sequence
  Synthetic Polynucleotide
taatacgactcactatagggaggaagcacttggcacaggtggggcatgcaaacagaggagatgcatgatgcacctgtgcaacctggcggcagcgcaaaagatg

SEQ ID NO: 229224 - DNA, 103 bp, Artificial Sequence
  Synthetic Polynucleotide
taatacgactcactatagggtgtccgagacaggaagcacttggcacaggtaacagaggagaacctgtatgaagtgcttcaacctggcggcagcgcaaaagatg

SEQ ID NO: 229225 - DNA, 103 bp, Artificial Sequence
  Synthetic Polynucleotide
taatacgactcactataggggctgcagctctgtccgagacaggaagcactaacagaggagaagtgctatgtgtctcggaaacctggcggcagcgcaaaagatg

SEQ ID NO: 229226 - DNA, 103 bp, Artificial Sequence
  Synthetic Polynucleotide
taatacgactcactataggggcttcatgcagctgcagctctgtccgagacaacagaggagagtctcgatgagagctgcaaacctggcggcagcgcaaaagatg

SEQ ID NO: 229227 - DNA, 103 bp, Artificial Sequence
  Synthetic Polynucleotide
taatacgactcactataggggtgcttgaaagcttcatgcagctgcagctcaacagaggagagagctgatgctgcatgaaaacctggcggcagcgcaaaagatg

SEQ ID NO: 229228 - DNA, 103 bp, Artificial Sequence
  Synthetic Polynucleotide
taatacgactcactatagggtctcaccacggtgcttgaaagcttcatgcaaacagaggagatgcatgatgctttcaagcaacctggcggcagcgcaaaagatg

SEQ ID NO: 229229 - DNA, 103 bp, Artificial Sequence
  Synthetic Polynucleotide
taatacgactcactatagggacaaacagcttctcaccacggtgcttgaaaaacagaggagatttcaaatgccgtggtgaaacctggcggcagcgcaaaagatg

SEQ ID NO: 229230 - DNA, 103 bp, Artificial Sequence
  Synthetic Polynucleotide
taatacgactcactatagggaaagtgactgcagcaggcaaggacactccaaacagaggagatggagtatgcttgcctgcaacctggcggcagcgcaaaagatg

SEQ ID NO: 229231 - DNA, 103 bp, Artificial Sequence
  Synthetic Polynucleotide
taatacgactcactatagggctcctcacacacaaacagcttctcaccacgaacagaggagacgtggtatgaagctgtttaacctggcggcagcgcaaaagatg

SEQ ID NO: 229232 - DNA, 103 bp, Artificial Sequence
  Synthetic Polynucleotide
taatacgactcactatagggggtgcccacactcctcacacacaaacagctaacagaggagaagctgtatgtgtgtgaggaacctggcggcagcgcaaaagatg

SEQ ID NO: 229233 - DNA, 103 bp, Artificial Sequence
  Synthetic Polynucleotide
taatacgactcactatagggctcgaggcccggtgcccacactcctcacacaacagaggagagtgtgaatggtgtgggcaaacctggcggcagcgcaaaagatg

SEQ ID NO: 229234 - DNA, 103 bp, Artificial Sequence
  Synthetic Polynucleotide
taatacgactcactataggggccattccggctcgaggcccggtgcccacaaacagaggagatgtgggatgcgggcctcgaacctggcggcagcgcaaaagatg

SEQ ID NO: 229235 - DNA, 103 bp, Artificial Sequence
  Synthetic Polynucleotide
taatacgactcactataggggcatctgcaggccattccggctcgaggcccaacagaggagagggcctatggccggaatgaacctggcggcagcgcaaaagatg

SEQ ID NO: 229236 - DNA, 103 bp, Artificial Sequence
  Synthetic Polynucleotide
taatacgactcactataggggccttgatgtgcatctgcaggccattccggaacagaggagaccggaaatgcctgcagataacctggcggcagcgcaaaagatg

SEQ ID NO: 229237 - DNA, 103 bp, Artificial Sequence
  Synthetic Polynucleotide
taatacgactcactatagggcctgtgcttggccttgatgtgcatctgcagaacagaggagactgcagatgcacatcaagaacctggcggcagcgcaaaagatg

SEQ ID NO: 229238 - DNA, 103 bp, Artificial Sequence
  Synthetic Polynucleotide
taatacgactcactataggggcctctcattcctgtgcttggccttgatgtaacagaggagaacatcaatgccaagcacaaacctggcggcagcgcaaaagatg

SEQ ID NO: 229239 - DNA, 103 bp, Artificial Sequence
  Synthetic Polynucleotide
taatacgactcactatagggcatacgtgtggcctctcattcctgtgcttgaacagaggagacaagcaatggaatgagagaacctggcggcagcgcaaaagatg

SEQ ID NO: 229240 - DNA, 103 bp, Artificial Sequence
  Synthetic Polynucleotide
taatacgactcactataggggcagaactcacatacgtgtggcctctcattaacagaggagaaatgagatgccacacgtaaacctggcggcagcgcaaaagatg

SEQ ID NO: 229241 - DNA, 103 bp, Artificial Sequence
  Synthetic Polynucleotide
taatacgactcactatagggggctctggaaaaagtgactgcagcaggcaaaacagaggagattgcctatggcagtcactaacctggcggcagcgcaaaagatg

SEQ ID NO: 229242 - DNA, 103 bp, Artificial Sequence
  Synthetic Polynucleotide
taatacgactcactatagggaggcgtggctgcagaactcacatacgtgtgaacagaggagacacacgatggtgagttctaacctggcggcagcgcaaaagatg

SEQ ID NO: 229243 - DNA, 103 bp, Artificial Sequence
  Synthetic Polynucleotide
taatacgactcactatagggttttgggtgaaggcgtggctgcagaactcaaacagaggagatgagttatgcagccacgcaacctggcggcagcgcaaaagatg

SEQ ID NO: 229244 - DNA, 103 bp, Artificial Sequence
  Synthetic Polynucleotide
taatacgactcactataggggagattggccttttgggtgaaggcgtggctaacagaggagaagccacatgttcacccaaaacctggcggcagcgcaaaagatg

SEQ ID NO: 229245 - DNA, 103 bp, Artificial Sequence
  Synthetic Polynucleotide
taatacgactcactatagggggtgcatgttgagattggccttttgggtgaaacagaggagatcacccatgaggccaatcaacctggcggcagcgcaaaagatg

SEQ ID NO: 229246 - DNA, 103 bp, Artificial Sequence
  Synthetic Polynucleotide
taatacgactcactatagggtgtgtgcgcaggtgcatgttgagattggccaacagaggagaggccaaatgcaacatgcaaacctggcggcagcgcaaaagatg

SEQ ID NO: 229247 - DNA, 103 bp, Artificial Sequence
  Synthetic Polynucleotide
taatacgactcactatagggctcacccgtgtgtgtgcgcaggtgcatgttaacagaggagaaacatgatgctgcgcacaaacctggcggcagcgcaaaagatg

SEQ ID NO: 229248 - DNA, 103 bp, Artificial Sequence
  Synthetic Polynucleotide
taatacgactcactatagggggaagggcttctcacccgtgtgtgtgcgcaaacagaggagatgcgcaatgacacgggtgaacctggcggcagcgcaaaagatg

SEQ ID NO: 229249 - DNA, 103 bp, Artificial Sequence
  Synthetic Polynucleotide
taatacgactcactatagggaggtggcactggaagggcttctcacccgtgaacagaggagacacgggatggaagcccttaacctggcggcagcgcaaaagatg

SEQ ID NO: 229250 - DNA, 103 bp, Artificial Sequence
  Synthetic Polynucleotide
taatacgactcactatagggcttgccacagaggtggcactggaagggcttaacagaggagaaagcccatgcagtgccacaacctggcggcagcgcaaaagatg

SEQ ID NO: 229251 - DNA, 103 bp, Artificial Sequence
  Synthetic Polynucleotide
taatacgactcactatagggttcggaaggtcttgccacagaggtggcactaacagaggagaagtgccatgtctgtggcaaacctggcggcagcgcaaaagatg

SEQ ID NO: 229252 - DNA, 103 bp, Artificial Sequence
  Synthetic Polynucleotide
taatacgactcactatagggtccccgtagaggctctggaaaaagtgactgaacagaggagacagtcaatgtttccagagaacctggcggcagcgcaaaagatg

SEQ ID NO: 229253 - DNA, 103 bp, Artificial Sequence
  Synthetic Polynucleotide
taatacgactcactatagggctggcttgggttcggaaggtcttgccacagaacagaggagactgtggatggaccttccgaacctggcggcagcgcaaaagatg

SEQ ID NO: 229254 - DNA, 103 bp, Artificial Sequence
  Synthetic Polynucleotide
taatacgactcactatagggcttgtccaggctggcttgggttcggaaggtaacagaggagaaccttcatgacccaagccaacctggcggcagcgcaaaagatg

SEQ ID NO: 229255 - DNA, 103 bp, Artificial Sequence
  Synthetic Polynucleotide
taatacgactcactatagggtgcggttgtgcttgtccaggctggcttgggaacagaggagacccaagatggcctggacaaacctggcggcagcgcaaaagatg

SEQ ID NO: 229256 - DNA, 103 bp, Artificial Sequence
  Synthetic Polynucleotide
taatacgactcactatagggccggtgtgggtgcggttgtgcttgtccaggaacagaggagacctggaatggcacaaccgaacctggcggcagcgcaaaagatg

SEQ ID NO: 229257 - DNA, 103 bp, Artificial Sequence
  Synthetic Polynucleotide
taatacgactcactataggggggcctttccccggtgtgggtgcggttgtgaacagaggagacacaacatgacccacaccaacctggcggcagcgcaaaagatg

SEQ ID NO: 229258 - DNA, 103 bp, Artificial Sequence
  Synthetic Polynucleotide
taatacgactcactatagggcgcaactgaagggcctttccccggtgtgggaacagaggagacccacaatggggaaaggcaacctggcggcagcgcaaaagatg

SEQ ID NO: 229259 - DNA, 103 bp, Artificial Sequence
  Synthetic Polynucleotide
taatacgactcactatagggtcacagaactcgcaactgaagggcctttccaacagaggagaggaaagatgcttcagttgaacctggcggcagcgcaaaagatg

SEQ ID NO: 229260 - DNA, 103 bp, Artificial Sequence
  Synthetic Polynucleotide
taatacgactcactataggggaagcgctgttcacagaactcgcaactgaaaacagaggagattcagtatggagttctgtaacctggcggcagcgcaaaagatg

SEQ ID NO: 229261 - DNA, 103 bp, Artificial Sequence
  Synthetic Polynucleotide
taatacgactcactatagggccttctcagtgaagcgctgttcacagaactaacagaggagaagttctatgaacagcgctaacctggcggcagcgcaaaagatg

SEQ ID NO: 229262 - DNA, 103 bp, Artificial Sequence
  Synthetic Polynucleotide
taatacgactcactatagggaggaggggccccttctcagtgaagcgctgtaacagaggagaacagcgatgcactgagaaaacctggcggcagcgcaaaagatg

SEQ ID NO: 229263 - DNA, 103 bp, Artificial Sequence
  Synthetic Polynucleotide
taatacgactcactatagggccctgagccatccccgtagaggctctggaaaacagaggagattccagatgctctacgggaacctggcggcagcgcaaaagatg

SEQ ID NO: 229264 - DNA, 103 bp, Artificial Sequence
  Synthetic Polynucleotide
taatacgactcactatagggcacgtgcctcaggaggggccccttctcagtaacagaggagaactgagatggggcccctcaacctggcggcagcgcaaaagatg

SEQ ID NO: 229265 - DNA, 103 bp, Artificial Sequence
  Synthetic Polynucleotide
taatacgactcactatagggggcggctggccacgtgcctcaggaggggccaacagaggagaggccccatgtgaggcacgaacctggcggcagcgcaaaagatg

SEQ ID NO: 229266 - DNA, 103 bp, Artificial Sequence
  Synthetic Polynucleotide
taatacgactcactatagggccctcctgatggcggctggccacgtgcctcaacagaggagagaggcaatgggccagccgaacctggcggcagcgcaaaagatg

SEQ ID NO: 229267 - DNA, 103 bp, Artificial Sequence
  Synthetic Polynucleotide
taatacgactcactataggggtggggccggccctcctgatggcggctggcaacagaggagagccagcatgcatcaggagaacctggcggcagcgcaaaagatg

SEQ ID NO: 229268 - DNA, 103 bp, Artificial Sequence
  Synthetic Polynucleotide
taatacgactcactatagggtctggcagaagtggggccggccctcctgataacagaggagaatcaggatggccggccccaacctggcggcagcgcaaaagatg

SEQ ID NO: 229269 - DNA, 103 bp, Artificial Sequence
  Synthetic Polynucleotide
taatacgactcactatagggttgccgcatatctggcagaagtggggccggaacagaggagaccggccatgcttctgccaaacctggcggcagcgcaaaagatg

SEQ ID NO: 229270 - DNA, 103 bp, Artificial Sequence
  Synthetic Polynucleotide
taatacgactcactatagggtttgaaggtcttgccgcatatctggcagaaaacagaggagattctgcatgatatgcggcaacctggcggcagcgcaaaagatg

SEQ ID NO: 229271 - DNA, 103 bp, Artificial Sequence
  Synthetic Polynucleotide
taatacgactcactataggggctccacggctttgaaggtcttgccgcataaacagaggagatatgcgatgagaccttcaaacctggcggcagcgcaaaagatg

SEQ ID NO: 229272 - DNA, 103 bp, Artificial Sequence
  Synthetic Polynucleotide
taatacgactcactatagggacacgcagttgctccacggctttgaaggtcaacagaggagagaccttatgagccgtggaaacctggcggcagcgcaaaagatg

SEQ ID NO: 229273 - DNA, 103 bp, Artificial Sequence
  Synthetic Polynucleotide
taatacgactcactatagggtctgacgtgcacacgcagttgctccacggcaacagaggagagccgtgatgcaactgcgtaacctggcggcagcgcaaaagatg

SEQ ID NO: 229274 - DNA, 103 bp, Artificial Sequence
  Synthetic Polynucleotide
taatacgactcactatagggcgacactgccccctgagccatccccgtagaaacagaggagatctacgatgatggctcagaacctggcggcagcgcaaaagatg

SEQ ID NO: 229275 - DNA, 103 bp, Artificial Sequence
  Synthetic Polynucleotide
taatacgactcactatagggccttgtgccgtctgacgtgcacacgcagttaacagaggagaaactgcatgtgcacgtcaaacctggcggcagcgcaaaagatg

SEQ ID NO: 229276 - DNA, 103 bp, Artificial Sequence
  Synthetic Polynucleotide
taatacgactcactatagggttcctcacccccttgtgccgtctgacgtgcaacagaggagagcacgtatgacggcacaaaacctggcggcagcgcaaaagatg

SEQ ID NO: 229277 - DNA, 103 bp, Artificial Sequence
  Synthetic Polynucleotide
taatacgactcactataggggcactcaaacttcctcacccccttgtgccgaacagaggagacggcacatgggggtgaggaacctggcggcagcgcaaaagatg

SEQ ID NO: 229278 - DNA, 103 bp, Artificial Sequence
  Synthetic Polynucleotide
taatacgactcactatagggcacactcggtgcactcaaacttcctcacccaacagaggagagggtgaatgagtttgagtaacctggcggcagcgcaaaagatg

SEQ ID NO: 229279 - DNA, 103 bp, Artificial Sequence
  Synthetic Polynucleotide
taatacgactcactatagggaacttgtagccacactcggtgcactcaaacaacagaggagagtttgaatgcaccgagtgaacctggcggcagcgcaaaagatg

SEQ ID NO: 229280 - DNA, 103 bp, Artificial Sequence
  Synthetic Polynucleotide
taatacgactcactatagggctgtcgggtaaacttgtagccacactcggtaacagaggagaaccgagatgggctacaagaacctggcggcagcgcaaaagatg

SEQ ID NO: 229281 - DNA, 103 bp, Artificial Sequence
  Synthetic Polynucleotide
taatacgactcactataggggcaggtgggcctgtcgggtaaacttgtagcaacagaggagagctacaatgttacccgacaacctggcggcagcgcaaaagatg

SEQ ID NO: 229282 - DNA, 103 bp, Artificial Sequence
  Synthetic Polynucleotide
taatacgactcactatagggatgtgcctccgcaggtgggcctgtcgggtaaacagaggagatacccgatgggcccacctaacctggcggcagcgcaaaagatg

SEQ ID NO: 229283 - DNA, 103 bp, Artificial Sequence
  Synthetic Polynucleotide
taatacgactcactataggggtggatctccatgtgcctccgcaggtgggcaacagaggagagcccacatgcggaggcacaacctggcggcagcgcaaaagatg

SEQ ID NO: 229284 - DNA, 103 bp, Artificial Sequence
  Synthetic Polynucleotide
taatacgactcactatagggctacccggtcgtggatctccatgtgcctccaacagaggagaggaggcatgtggagatccaacctggcggcagcgcaaaagatg

SEQ ID NO: 229285 - DNA, 103 bp, Artificial Sequence
  Synthetic Polynucleotide
taatacgactcactataggggcagggaggacgacactgccccctgagccaaacagaggagatggctcatggggcagtgtaacctggcggcagcgcaaaagatg

SEQ ID NO: 229286 - DNA, 103 bp, Artificial Sequence
  Synthetic Polynucleotide
taatacgactcactatagggttgtagttctctacccggtcgtggatctccaacagaggagaggagatatgcgaccgggtaacctggcggcagcgcaaaagatg

SEQ ID NO: 229287 - DNA, 103 bp, Artificial Sequence
  Synthetic Polynucleotide
taatacgactcactatagggctgccgcgggttgtagttctctacccggtcaacagaggagagaccggatggagaactacaacctggcggcagcgcaaaagatg

SEQ ID NO: 229288 - DNA, 103 bp, Artificial Sequence
  Synthetic Polynucleotide
taatacgactcactatagggggagcttgcgctgccgcgggttgtagttctaacagaggagaagaactatgacccgcggcaacctggcggcagcgcaaaagatg

SEQ ID NO: 229289 - DNA, 103 bp, Artificial Sequence
  Synthetic Polynucleotide
taatacgactcactatagggatcaggttgcggagcttgcgctgccgcgggaacagaggagacccgcgatggcgcaagctaacctggcggcagcgcaaaagatg

SEQ ID NO: 229290 - DNA, 103 bp, Artificial Sequence
  Synthetic Polynucleotide
taatacgactcactataggggtcctcgatgatcaggttgcggagcttgcgaacagaggagacgcaagatgcgcaacctgaacctggcggcagcgcaaaagatg

SEQ ID NO: 229291 - DNA, 103 bp, Artificial Sequence
  Synthetic Polynucleotide
taatacgactcactatagggccatcttctcgtcctcgatgatcaggttgcaacagaggagagcaaccatgtcatcgaggaacctggcggcagcgcaaaagatg

SEQ ID NO: 229292 - DNA, 103 bp, Artificial Sequence
  Synthetic Polynucleotide
taatacgactcactataggggccaccaccaccatcttctcgtcctcgatgaacagaggagacatcgaatgcgagaagataacctggcggcagcgcaaaagatg

SEQ ID NO: 229293 - DNA, 103 bp, Artificial Sequence
  Synthetic Polynucleotide
taatacgactcactatagggcggctgcagcgccaccaccaccatcttctcaacagaggagagagaagatggtggtggtgaacctggcggcagcgcaaaagatg

SEQ ID NO: 229294 - DNA, 103 bp, Artificial Sequence
  Synthetic Polynucleotide
taatacgactcactataggggctctgcaggcggctgcagcgccaccaccaaacagaggagatggtggatgcgctgcagcaacctggcggcagcgcaaaagatg

SEQ ID NO: 229295 - DNA, 103 bp, Artificial Sequence
  Synthetic Polynucleotide
taatacgactcactatagggcccacctccagctctgcaggcggctgcagcaacagaggagagctgcaatggcctgcagaaacctggcggcagcgcaaaagatg

SEQ ID NO: 229296 - DNA, 103 bp, Artificial Sequence
  Synthetic Polynucleotide
taatacgactcactatagggagcgaagccagcagggaggacgacactgccaacagaggagaggcagtatggtcctccctaacctggcggcagcgcaaaagatg

SEQ ID NO: 229297 - DNA, 103 bp, Artificial Sequence
  Synthetic Polynucleotide
taatacgactcactatagggctccgccgagcccacctccagctctgcaggaacagaggagacctgcaatgctggaggtgaacctggcggcagcgcaaaagatg

SEQ ID NO: 229298 - DNA, 103 bp, Artificial Sequence
  Synthetic Polynucleotide
taatacgactcactatagggccacaatgacctccgccgagcccacctccaaacagaggagatggaggatggctcggcggaacctggcggcagcgcaaaagatg

SEQ ID NO: 229299 - DNA, 103 bp, Artificial Sequence
  Synthetic Polynucleotide
taatacgactcactataggggccagggactccacaatgacctccgccgagaacagaggagactcggcatgggtcattgtaacctggcggcagcgcaaaagatg

SEQ ID NO: 229300 - DNA, 103 bp, Artificial Sequence
  Synthetic Polynucleotide
taatacgactcactataggggccgccctgggccagggactccacaatgacaacagaggagagtcattatggagtccctgaacctggcggcagcgcaaaagatg

SEQ ID NO: 229301 - DNA, 103 bp, Artificial Sequence
  Synthetic Polynucleotide
taatacgactcactataggggggaggccaggccgccctgggccagggactaacagaggagaagtcccatgcccagggcgaacctggcggcagcgcaaaagatg

SEQ ID NO: 229302 - DNA, 103 bp, Artificial Sequence
  Synthetic Polynucleotide
taatacgactcactatagggccggggagctgggaggccaggccgccctggaacagaggagaccagggatgcctggcctcaacctggcggcagcgcaaaagatg

SEQ ID NO: 229303 - DNA, 103 bp, Artificial Sequence
  Synthetic Polynucleotide
taatacgactcactatagggcagtctctggccggggagctgggaggccagaacagaggagactggccatgcagctccccaacctggcggcagcgcaaaagatg

SEQ ID NO: 229304 - DNA, 103 bp, Artificial Sequence
  Synthetic Polynucleotide
taatacgactcactatagggcctctgcacacagtctctggccggggagctaacagaggagaagctccatggccagagacaacctggcggcagcgcaaaagatg

SEQ ID NO: 229305 - DNA, 103 bp, Artificial Sequence
  Synthetic Polynucleotide
taatacgactcactataggggtgaagctctcctctgcacacagtctctggaacagaggagaccagagatggtgtgcagaaacctggcggcagcgcaaaagatg

SEQ ID NO: 229306 - DNA, 103 bp, Artificial Sequence
  Synthetic Polynucleotide
taatacgactcactatagggacctgggccggtgaagctctcctctgcacaaacagaggagatgtgcaatggagagcttcaacctggcggcagcgcaaaagatg

SEQ ID NO: 229307 - DNA, 103 bp, Artificial Sequence
  Synthetic Polynucleotide
taatacgactcactataggggcagaaccctcacactgtgctggacgaaggaacagaggagaccttcgatgagcacagtgaacctggcggcagcgcaaaagatg

SEQ ID NO: 229308 - DNA, 103 bp, Artificial Sequence
  Synthetic Polynucleotide
taatacgactcactatagggcaaagatctcagcgaagccagcagggaggaaacagaggagatcctccatgctggcttcgaacctggcggcagcgcaaaagatg

SEQ ID NO: 229309 - DNA, 103 bp, Artificial Sequence
  Synthetic Polynucleotide
taatacgactcactataggggctccaggacacctgggccggtgaagctctaacagaggagaagagctatgccggcccagaacctggcggcagcgcaaaagatg

SEQ ID NO: 229310 - DNA, 103 bp, Artificial Sequence
  Synthetic Polynucleotide
taatacgactcactatagggatgagggagggctccaggacacctgggccgaacagaggagacggcccatgtgtcctggaaacctggcggcagcgcaaaagatg

SEQ ID NO: 229311 - DNA, 103 bp, Artificial Sequence
  Synthetic Polynucleotide
taatacgactcactatagggagctgtgatgatgagggagggctccaggacaacagaggagagtcctgatgccctccctcaacctggcggcagcgcaaaagatg

SEQ ID NO: 229312 - DNA, 103 bp, Artificial Sequence
  Synthetic Polynucleotide
taatacgactcactatagggcggggacagcagctgtgatgatgagggaggaacagaggagacctcccatgtcatcacagaacctggcggcagcgcaaaagatg

SEQ ID NO: 229313 - DNA, 103 bp, Artificial Sequence
  Synthetic Polynucleotide
taatacgactcactatagggtcacagtcctcggggacagcagctgtgatgaacagaggagacatcacatgtgctgtcccaacctggcggcagcgcaaaagatg

SEQ ID NO: 229314 - DNA, 103 bp, Artificial Sequence
  Synthetic Polynucleotide
taatacgactcactatagggaacaagaggccaaagatctcagcgaagccaaacagaggagatggcttatgtgagatcttaacctggcggcagcgcaaaagatg

SEQ ID NO: 229315 - DNA, 103 bp, Artificial Sequence
  Synthetic Polynucleotide
taatacgactcactataggggaaaaagtccaacaagaggccaaagatctcaacagaggagagagatcatgggcctcttgaacctggcggcagcgcaaaagatg

SEQ ID NO: 229316 - DNA, 103 bp, Artificial Sequence
  Synthetic Polynucleotide
taatacgactcactataggggaccagtgtagaaaaagtccaacaagaggcaacagaggagagcctctatgtggacttttaacctggcggcagcgcaaaagatg

SEQ ID NO: 229317 - DNA, 103 bp, Artificial Sequence
  Synthetic Polynucleotide
taatacgactcactatagggagagcgaggtgaccagtgtagaaaaagtccaacagaggagaggacttatgctacactggaacctggcggcagcgcaaaagatg

SEQ ID NO: 229318 - DNA, 103 bp, Artificial Sequence
  Synthetic Polynucleotide
taatacgactcactatagggccctgaggtgagagcgaggtgaccagtgtaaacagaggagatacactatgcacctcgctaacctggcggcagcgcaaaagatg

SEQ ID NO: 229319 - DNA, 103 bp, Artificial Sequence
  Synthetic Polynucleotide
taatacgactcactataggggatcccggttccctgaggtgagagcgaggtaacagaggagaacctcgatgtcacctcagaacctggcggcagcgcaaaagatg

SEQ ID NO: 229320 - DNA, 103 bp, Artificial Sequence
  Synthetic Polynucleotide
taatacgactcactatagggaggagcacctgatcccggttccctgaggtgaacagaggagacacctcatggaaccgggaaacctggcggcagcgcaaaagatg

SEQ ID NO: 229321 - DNA, 103 bp, Artificial Sequence
  Synthetic Polynucleotide
taatacgactcactatagggcctggctgccaggagcacctgatcccggttaacagaggagaaaccggatgcaggtgctcaacctggcggcagcgcaaaagatg

SEQ ID NO: 229322 - DNA, 103 bp, Artificial Sequence
  Synthetic Polynucleotide
taatacgactcactatagggctcgcaactccctggctgccaggagcacctaacagaggagaaggtgcatgtggcagccaaacctggcggcagcgcaaaagatg

SEQ ID NO: 229323 - DNA, 103 bp, Artificial Sequence
  Synthetic Polynucleotide
taatacgactcactatagggttgagctcctgcagaaccctcacactgtgcaacagaggagagcacagatggagggttctaacctggcggcagcgcaaaagatg

SEQ ID NO: 229324 - DNA, 103 bp, Artificial Sequence
  Synthetic Polynucleotide
taatacgactcactataggggcctctggcactcgcaactccctggctgccaacagaggagaggcagcatgggagttgcgaacctggcggcagcgcaaaagatg

SEQ ID NO: 229325 - DNA, 103 bp, Artificial Sequence
  Synthetic Polynucleotide
taatacgactcactatagggcagctctacggcctctggcactcgcaactcaacagaggagagagttgatggtgccagagaacctggcggcagcgcaaaagatg

SEQ ID NO: 229326 - DNA, 103 bp, Artificial Sequence
  Synthetic Polynucleotide
taatacgactcactatagggagctctggcacagctctacggcctctggcaaacagaggagatgccagatgccgtagagcaacctggcggcagcgcaaaagatg

SEQ ID NO: 229327 - DNA, 103 bp, Artificial Sequence
  Synthetic Polynucleotide
taatacgactcactatagggttgggcttgaagctctggcacagctctacgaacagaggagacgtagaatggtgccagagaacctggcggcagcgcaaaagatg

SEQ ID NO: 229328 - DNA, 103 bp, Artificial Sequence
  Synthetic Polynucleotide
taatacgactcactatagggcactgaagttttgggcttgaagctctggcaaacagaggagatgccagatgttcaagcccaacctggcggcagcgcaaaagatg

SEQ ID NO: 229329 - DNA, 103 bp, Artificial Sequence
  Synthetic Polynucleotide
taatacgactcactatagggctgcctgtcccactgaagttttgggcttgaaacagaggagatcaagcatgaaacttcagaacctggcggcagcgcaaaagatg

SEQ ID NO: 229330 - DNA, 103 bp, Artificial Sequence
  Synthetic Polynucleotide
taatacgactcactatagggtggccacctgctgcctgtcccactgaagttaacagaggagaaacttcatggggacaggcaacctggcggcagcgcaaaagatg

SEQ ID NO: 229331 - DNA, 103 bp, Artificial Sequence
  Synthetic Polynucleotide
taatacgactcactatagggcagcccactctggccacctgctgcctgtccaacagaggagaggacagatggcaggtggcaacctggcggcagcgcaaaagatg

SEQ ID NO: 229332 - DNA, 103 bp, Artificial Sequence
  Synthetic Polynucleotide
taatacgactcactatagggcagggggccccagcccactctggccacctgaacagaggagacaggtgatgagagtgggcaacctggcggcagcgcaaaagatg

SEQ ID NO: 229333 - DNA, 103 bp, Artificial Sequence
  Synthetic Polynucleotide
taatacgactcactatagggttctgggaggcagggggccccagcccactcaacagaggagagagtggatgggggcccccaacctggcggcagcgcaaaagatg

SEQ ID NO: 229334 - DNA, 103 bp, Artificial Sequence
  Synthetic Polynucleotide
taatacgactcactatagggccgctgcttgttgagctcctgcagaaccctaacagaggagaagggttatgcaggagctcaacctggcggcagcgcaaaagatg

SEQ ID NO: 229335 - DNA, 103 bp, Artificial Sequence
  Synthetic Polynucleotide
taatacgactcactataggggctgttcacattctgggaggcagggggcccaacagaggagagggcccatggcctcccagaacctggcggcagcgcaaaagatg

SEQ ID NO: 229336 - DNA, 103 bp, Artificial Sequence
  Synthetic Polynucleotide
taatacgactcactatagggccttgacgtggctgttcacattctgggaggaacagaggagacctcccatgatgtgaacaaacctggcggcagcgcaaaagatg

SEQ ID NO: 229337 - DNA, 103 bp, Artificial Sequence
  Synthetic Polynucleotide
taatacgactcactatagggcctgccggctccttgacgtggctgttcacaaacagaggagatgtgaaatgccacgtcaaaacctggcggcagcgcaaaagatg

SEQ ID NO: 229338 - DNA, 103 bp, Artificial Sequence
  Synthetic Polynucleotide
taatacgactcactatagggttcttccaagcctgccggctccttgacgtgaacagaggagacacgtcatggagccggcaaacctggcggcagcgcaaaagatg

SEQ ID NO: 229339 - DNA, 103 bp, Artificial Sequence
  Synthetic Polynucleotide
taatacgactcactatagggaaacttcctcttcttccaagcctgccggctaacagaggagaagccggatggcttggaagaacctggcggcagcgcaaaagatg

SEQ ID NO: 229340 - DNA, 103 bp, Artificial Sequence
  Synthetic Polynucleotide
taatacgactcactatagggagagtcctcgaaacttcctcttcttccaagaacagaggagacttggaatgagaggaagtaacctggcggcagcgcaaaagatg

SEQ ID NO: 229341 - DNA, 103 bp, Artificial Sequence
  Synthetic Polynucleotide
taatacgactcactataggggactagacccagagtcctcgaaacttcctcaacagaggagagaggaaatgtcgaggactaacctggcggcagcgcaaaagatg

SEQ ID NO: 229342 - DNA, 103 bp, Artificial Sequence
  Synthetic Polynucleotide
taatacgactcactataggggatccctggggactagacccagagtcctcgaacagaggagacgaggaatgtgggtctagaacctggcggcagcgcaaaagatg

SEQ ID NO: 229343 - DNA, 103 bp, Artificial Sequence
  Synthetic Polynucleotide
taatacgactcactatagggctgggctcctgatccctggggactagacccaacagaggagagggtctatgccccagggaaacctggcggcagcgcaaaagatg

SEQ ID NO: 229344 - DNA, 103 bp, Artificial Sequence
  Synthetic Polynucleotide
taatacgactcactatagggatgactgcctctgggctcctgatccctgggaacagaggagacccaggatgcaggagcccaacctggcggcagcgcaaaagatg

SEQ ID NO: 229345 - DNA, 103 bp, Artificial Sequence
  Synthetic Polynucleotide
taatacgactcactatagggggcccttctcccgctgcttgttgagctcctaacagaggagaaggagcatgacaagcagcaacctggcggcagcgcaaaagatg

SEQ ID NO: 229346 - DNA, 103 bp, Artificial Sequence
  Synthetic Polynucleotide
taatacgactcactatagggtctgaggactatgactgcctctgggctcctaacagaggagaaggagcatggaggcagtcaacctggcggcagcgcaaaagatg

SEQ ID NO: 229347 - DNA, 103 bp, Artificial Sequence
  Synthetic Polynucleotide
taatacgactcactatagggagctggggcctctgaggactatgactgcctaacagaggagaaggcagatgtagtcctcaaacctggcggcagcgcaaaagatg

SEQ ID NO: 229348 - DNA, 103 bp, Artificial Sequence
  Synthetic Polynucleotide
taatacgactcactatagggtggggaatggagctggggcctctgaggactaacagaggagaagtcctatgaggccccagaacctggcggcagcgcaaaagatg

SEQ ID NO: 229349 - DNA, 103 bp, Artificial Sequence
  Synthetic Polynucleotide
taatacgactcactatagggcactctgagctggggaatggagctggggccaacagaggagaggccccatgtccattcccaacctggcggcagcgcaaaagatg

SEQ ID NO: 229350 - DNA, 103 bp, Artificial Sequence
  Synthetic Polynucleotide
taatacgactcactataggggaggggccctcactctgagctggggaatggaacagaggagaccattcatgagctcagagaacctggcggcagcgcaaaagatg

SEQ ID NO: 229351 - DNA, 103 bp, Artificial Sequence
  Synthetic Polynucleotide
taatacgactcactatagggacagagggaggaggggccctcactctgagcaacagaggagagctcagatggagggccccaacctggcggcagcgcaaaagatg

SEQ ID NO: 229352 - DNA, 103 bp, Artificial Sequence
  Synthetic Polynucleotide
taatacgactcactatagggtcagtttcccacagagggaggaggggccctaacagaggagaagggccatgcctccctctaacctggcggcagcgcaaaagatg

SEQ ID NO: 229353 - DNA, 103 bp, Artificial Sequence
  Synthetic Polynucleotide
taatacgactcactatagggaaggcctgcttcagtttcccacagagggagaacagaggagactccctatgtgggaaactaacctggcggcagcgcaaaagatg

SEQ ID NO: 229354 - DNA, 103 bp, Artificial Sequence
  Synthetic Polynucleotide
taatacgactcactatagggacaaggcttcaaggcctgcttcagtttcccaacagaggagagggaaaatgaagcaggccaacctggcggcagcgcaaaagatg

SEQ ID NO: 229355 - DNA, 103 bp, Artificial Sequence
  Synthetic Polynucleotide
taatacgactcactatagggcctcaaggggacaaggcttcaaggcctgctaacagaggagaagcaggatgtgaagccttaacctggcggcagcgcaaaagatg

SEQ ID NO: 229356 - DNA, 103 bp, Artificial Sequence
  Synthetic Polynucleotide
taatacgactcactatagggtcgcagtactggcccttctcccgctgcttgaacagaggagacaagcaatgggagaagggaacctggcggcagcgcaaaagatg

SEQ ID NO: 229357 - DNA, 103 bp, Artificial Sequence
  Synthetic Polynucleotide
taatacgactcactatagggggtttcttgtcctcaaggggacaaggcttcaacagaggagagaagccatgtccccttgaaacctggcggcagcgcaaaagatg

SEQ ID NO: 229358 - DNA, 103 bp, Artificial Sequence
  Synthetic Polynucleotide
taatacgactcactataggggcagtcctcgggtttcttgtcctcaaggggaacagaggagaccccttatggacaagaaaaacctggcggcagcgcaaaagatg

SEQ ID NO: 229359 - DNA, 103 bp, Artificial Sequence
  Synthetic Polynucleotide
taatacgactcactatagggggggcactttgcagtcctcgggtttcttgtaacagaggagaacaagaatgccgaggactaacctggcggcagcgcaaaagatg

SEQ ID NO: 229360 - DNA, 103 bp, Artificial Sequence
  Synthetic Polynucleotide
taatacgactcactatagggaagggccttgggggcactttgcagtcctcgaacagaggagacgaggaatgcaaagtgccaacctggcggcagcgcaaaagatg

SEQ ID NO: 229361 - DNA, 103 bp, Artificial Sequence
  Synthetic Polynucleotide
taatacgactcactatagggttcagcctctaagggccttgggggcactttaacagaggagaaaagtgatgccaaggcccaacctggcggcagcgcaaaagatg

SEQ ID NO: 229362 - DNA, 103 bp, Artificial Sequence
  Synthetic Polynucleotide
taatacgactcactataggggctgggcaccttcagcctctaagggccttgaacagaggagacaaggcatgtagaggctgaacctggcggcagcgcaaaagatg

SEQ ID NO: 229363 - DNA, 103 bp, Artificial Sequence
  Synthetic Polynucleotide
taatacgactcactatagggccgccctgcagctgggcaccttcagcctctaacagaggagaagaggcatgaggtgcccaaacctggcggcagcgcaaaagatg

SEQ ID NO: 229364 - DNA, 103 bp, Artificial Sequence
  Synthetic Polynucleotide
taatacgactcactatagggctcattactgccgccctgcagctgggcaccaacagaggagaggtgccatgctgcagggcaacctggcggcagcgcaaaagatg

SEQ ID NO: 229365 - DNA, 103 bp, Artificial Sequence
  Synthetic Polynucleotide
taatacgactcactatagggccacttcccactcattactgccgccctgcaaacagaggagatgcaggatggcagtaatgaacctggcggcagcgcaaaagatg

SEQ ID NO: 229366 - DNA, 103 bp, Artificial Sequence
  Synthetic Polynucleotide
taatacgactcactatagggacttgaaccaccacttcccactcattactgaacagaggagacagtaaatggtgggaagtaacctggcggcagcgcaaaagatg

SEQ ID NO: 229367 - DNA, 103 bp, Artificial Sequence
  Synthetic Polynucleotide
taatacgactcactatagggcagagtggcgtcgcagtactggcccttctcaacagaggagagagaagatgcagtactgcaacctggcggcagcgcaaaagatg

SEQ ID NO: 229368 - DNA, 103 bp, Artificial Sequence
  Synthetic Polynucleotide
taatacgactcactatagggatcatcctccacttgaaccaccacttcccaaacagaggagatgggaaatggtggttcaaaacctggcggcagcgcaaaagatg

SEQ ID NO: 229369 - DNA, 103 bp, Artificial Sequence
  Synthetic Polynucleotide
taatacgactcactatagggcgccatccccatcatcctccacttgaaccaaacagaggagatggttcatgtggaggatgaacctggcggcagcgcaaaagatg

SEQ ID NO: 229370 - DNA, 103 bp, Artificial Sequence
  Synthetic Polynucleotide
taatacgactcactataggggacatgtaatcgccatccccatcatcctccaacagaggagaggaggaatgtggggatggaacctggcggcagcgcaaaagatg

SEQ ID NO: 229371 - DNA, 103 bp, Artificial Sequence
  Synthetic Polynucleotide
taatacgactcactatagggctcaggctcagacatgtaatcgccatccccaacagaggagaggggatatggattacatgaacctggcggcagcgcaaaagatg

SEQ ID NO: 229372 - DNA, 103 bp, Artificial Sequence
  Synthetic Polynucleotide
taatacgactcactatagggtcagcacagcctcaggctcagacatgtaataacagaggagaattacaatgctgagcctgaacctggcggcagcgcaaaagatg

SEQ ID NO: 229373 - DNA, 103 bp, Artificial Sequence
  Synthetic Polynucleotide
taatacgactcactatagggttcctcctggtcagcacagcctcaggctcaaacagaggagatgagccatgggctgtgctaacctggcggcagcgcaaaagatg

SEQ ID NO: 229374 - DNA, 103 bp, Artificial Sequence
  Synthetic Polynucleotide
taatacgactcactatagggtacatttgacttcctcctggtcagcacagcaacagaggagagctgtgatgaccaggaggaacctggcggcagcgcaaaagatg

SEQ ID NO: 229375 - DNA, 103 bp, Artificial Sequence
  Synthetic Polynucleotide
taatacgactcactataggggctttcggattacatttgacttcctcctggaacagaggagaccaggaatgagtcaaatgaacctggcggcagcgcaaaagatg

SEQ ID NO: 229376 - DNA, 103 bp, Artificial Sequence
  Synthetic Polynucleotide
taatacgactcactataggggctgcacagggctttcggattacatttgacaacagaggagagtcaaaatgaatccgaaaaacctggcggcagcgcaaaagatg

SEQ ID NO: 229377 - DNA, 103 bp, Artificial Sequence
  Synthetic Polynucleotide
taatacgactcactatagggggctggctcagctgcacagggctttcggataacagaggagaatccgaatgccctgtgcaaacctggcggcagcgcaaaagatg

SEQ ID NO: 229378 - DNA, 103 bp, Artificial Sequence
  Synthetic Polynucleotide
taatacgactcactatagggcccccacgtccagagtggcgtcgcagtactaacagaggagaagtactatgacgccactcaacctggcggcagcgcaaaagatg

SEQ ID NO: 229379 - DNA, 103 bp, Artificial Sequence
  Synthetic Polynucleotide
taatacgactcactatagggccgcgctcagggctggctcagctgcacaggaacagaggagacctgtgatgctgagccagaacctggcggcagcgcaaaagatg

SEQ ID NO: 229380 - DNA, 103 bp, Artificial Sequence
  Synthetic Polynucleotide
taatacgactcactataggggctagggagcccgcgctcagggctggctcaaacagaggagatgagccatgcctgagcgcaacctggcggcagcgcaaaagatg

SEQ ID NO: 229381 - DNA, 103 bp, Artificial Sequence
  Synthetic Polynucleotide
taatacgactcactatagggaggctcagctgctagggagcccgcgctcagaacagaggagactgagcatgggctccctaaacctggcggcagcgcaaaagatg

SEQ ID NO: 229382 - DNA, 103 bp, Artificial Sequence
  Synthetic Polynucleotide
taatacgactcactatagggtgttctcagcaggctcagctgctagggagcaacagaggagagctcccatgcagctgagcaacctggcggcagcgcaaaagatg

SEQ ID NO: 229383 - DNA, 103 bp, Artificial Sequence
  Synthetic Polynucleotide
taatacgactcactataggggtaccttttctgttctcagcaggctcagctaacagaggagaagctgaatgtgctgagaaaacctggcggcagcgcaaaagatg

SEQ ID NO: 229384 - DNA, 103 bp, Artificial Sequence
  Synthetic Polynucleotide
taatacgactcactatagggcggcaccgctgtaccttttctgttctcagcaacagaggagagctgagatgagaaaaggtaacctggcggcagcgcaaaagatg

SEQ ID NO: 229385 - DNA, 103 bp, Artificial Sequence
  Synthetic Polynucleotide
taatacgactcactatagggggcattcgaccggcaccgctgtaccttttcaacagaggagagaaaagatgcagcggtgcaacctggcggcagcgcaaaagatg

SEQ ID NO: 229386 - DNA, 103 bp, Artificial Sequence
  Synthetic Polynucleotide
taatacgactcactatagggtgacatgtggggcattcgaccggcaccgctaacagaggagaagcggtatgggtcgaatgaacctggcggcagcgcaaaagatg

SEQ ID NO: 229387 - DNA, 103 bp, Artificial Sequence
  Synthetic Polynucleotide
taatacgactcactataggggaactttttatgacatgtggggcattcgacaacagaggagagtcgaaatgcccacatgtaacctggcggcagcgcaaaagatg

SEQ ID NO: 229388 - DNA, 103 bp, Artificial Sequence
  Synthetic Polynucleotide
taatacgactcactatagggatttgctgaggaactttttatgacatgtggaacagaggagaccacatatgataaaaagtaacctggcggcagcgcaaaagatg

SEQ ID NO: 229389 - DNA, 103 bp, Artificial Sequence
  Synthetic Polynucleotide
taatacgactcactatagggaacaccaggccccccacgtccagagtggcgaacagaggagacgccacatgggacgtgggaacctggcggcagcgcaaaagatg

SEQ ID NO: 229390 - DNA, 103 bp, Artificial Sequence
  Synthetic Polynucleotide
taatacgactcactatagggtttagataatatttgctgaggaactttttaaacagaggagataaaaaatgcctcagcaaaacctggcggcagcgcaaaagatg

SEQ ID NO: 229391 - DNA, 103 bp, Artificial Sequence
  Synthetic Polynucleotide
taatacgactcactataggggttgtggacttttagataatatttgctgagaacagaggagactcagcatgtattatctaaacctggcggcagcgcaaaagatg

SEQ ID NO: 229392 - DNA, 103 bp, Artificial Sequence
  Synthetic Polynucleotide
taatacgactcactatagggtatgtttcctgttgtggacttttagataataacagaggagaattatcatgaagtccacaaacctggcggcagcgcaaaagatg

SEQ ID NO: 229393 - DNA, 103 bp, Artificial Sequence
  Synthetic Polynucleotide
taatacgactcactatagggttctccccagtatgtttcctgttgtggactaacagaggagaagtccaatgcaggaaacaaacctggcggcagcgcaaaagatg

SEQ ID NO: 229394 - DNA, 103 bp, Artificial Sequence
  Synthetic Polynucleotide
taatacgactcactatagggctcaaagggtttctccccagtatgtttcctaacagaggagaaggaaaatgactggggagaacctggcggcagcgcaaaagatg

SEQ ID NO: 229395 - DNA, 103 bp, Artificial Sequence
  Synthetic Polynucleotide
taatacgactcactatagggatttgggacactcaaagggtttctccccagaacagaggagactggggatgaaccctttgaacctggcggcagcgcaaaagatg

SEQ ID NO: 229396 - DNA, 103 bp, Artificial Sequence
  Synthetic Polynucleotide
taatacgactcactatagggcacttcccacatttgggacactcaaagggtaacagaggagaacccttatggtgtcccaaaacctggcggcagcgcaaaagatg

SEQ ID NO: 229397 - DNA, 103 bp, Artificial Sequence
  Synthetic Polynucleotide
taatacgactcactatagggccgaaagtaacacttcccacatttgggacaaacagaggagatgtcccatgtgtgggaagaacctggcggcagcgcaaaagatg

SEQ ID NO: 229398 - DNA, 103 bp, Artificial Sequence
  Synthetic Polynucleotide
taatacgactcactatagggggttctccttccgaaagtaacacttcccacaacagaggagagtgggaatggttactttcaacctggcggcagcgcaaaagatg

SEQ ID NO: 229399 - DNA, 103 bp, Artificial Sequence
  Synthetic Polynucleotide
taatacgactcactatagggtgctccaggaggttctccttccgaaagtaaaacagaggagattacttatggaaggagaaaacctggcggcagcgcaaaagatg

SEQ ID NO: 229400 - DNA, 103 bp, Artificial Sequence
  Synthetic Polynucleotide
taatacgactcactataggggatttgttcaaagtgaccaggaaaatccataacagaggagaatggatatgcctggtcacaacctggcggcagcgcaaaagatg

SEQ ID NO: 229401 - DNA, 103 bp, Artificial Sequence
  Synthetic Polynucleotide
taatacgactcactatagggggagcggtgggctttaaagtgtctattcccaacagaggagagggaatatgcactttaaaaacctggcggcagcgcaaaagatg

SEQ ID NO: 229402 - DNA, 103 bp, Artificial Sequence
  Synthetic Polynucleotide
taatacgactcactatagggctgaggctcaggtgagctcaggggctcagaaacagaggagatctgagatgctgagctcaaacctggcggcagcgcaaaagatg

SEQ ID NO: 229403 - DNA, 103 bp, Artificial Sequence
  Synthetic Polynucleotide
taatacgactcactatagggtcacttcatcctgaggctcaggtgagctcaaacagaggagatgagctatgctgagcctcaacctggcggcagcgcaaaagatg

SEQ ID NO: 229404 - DNA, 103 bp, Artificial Sequence
  Synthetic Polynucleotide
taatacgactcactataggggtcacatcgctcacttcatcctgaggctcaaacagaggagatgagccatgggatgaagtaacctggcggcagcgcaaaagatg

SEQ ID NO: 229405 - DNA, 103 bp, Artificial Sequence
  Synthetic Polynucleotide
taatacgactcactatagggtgcttgtgaggtcacatcgctcacttcatcaacagaggagagatgaaatgagcgatgtgaacctggcggcagcgcaaaagatg

SEQ ID NO: 229406 - DNA, 103 bp, Artificial Sequence
  Synthetic Polynucleotide
taatacgactcactatagggcgctgccttctgcttgtgaggtcacatcgcaacagaggagagcgatgatgcctcacaagaacctggcggcagcgcaaaagatg

SEQ ID NO: 229407 - DNA, 103 bp, Artificial Sequence
  Synthetic Polynucleotide
taatacgactcactatagggtccacagactcgctgccttctgcttgtgagaacagaggagactcacaatgagaaggcagaacctggcggcagcgcaaaagatg

SEQ ID NO: 229408 - DNA, 103 bp, Artificial Sequence
  Synthetic Polynucleotide
taatacgactcactatagggtccttccacttccacagactcgctgccttcaacagaggagagaaggcatggagtctgtgaacctggcggcagcgcaaaagatg

SEQ ID NO: 229409 - DNA, 103 bp, Artificial Sequence
  Synthetic Polynucleotide
taatacgactcactatagggtgaccacaactccttccacttccacagactaacagaggagaagtctgatgaagtggaagaacctggcggcagcgcaaaagatg

SEQ ID NO: 229410 - DNA, 103 bp, Artificial Sequence
  Synthetic Polynucleotide
taatacgactcactatagggttctcggcactgaccacaactccttccactaacagaggagaagtggaatgagttgtggtaacctggcggcagcgcaaaagatg

SEQ ID NO: 229411 - DNA, 103 bp, Artificial Sequence
  Synthetic Polynucleotide
taatacgactcactataggggaggtctatcttctcggcactgaccacaacaacagaggagagttgtgatgagtgccgagaacctggcggcagcgcaaaagatg

SEQ ID NO: 229412 - DNA, 103 bp, Artificial Sequence
  Synthetic Polynucleotide
taatacgactcactatagggctgccagcacggagcggtgggctttaaagtaacagaggagaactttaatgcccaccgctaacctggcggcagcgcaaaagatg

SEQ ID NO: 229413 - DNA, 103 bp, Artificial Sequence
  Synthetic Polynucleotide
taatacgactcactatagggtttcagggctgaggtctatcttctcggcacaacagaggagagtgccgatgagatagaccaacctggcggcagcgcaaaagatg

SEQ ID NO: 229414 - DNA, 103 bp, Artificial Sequence
  Synthetic Polynucleotide
taatacgactcactatagggcgatcactgctttcagggctgaggtctatcaacagaggagagatagaatgcagccctgaaacctggcggcagcgcaaaagatg

SEQ ID NO: 229415 - DNA, 103 bp, Artificial Sequence
  Synthetic Polynucleotide
taatacgactcactatagggtgaaaaactccgatcactgctttcagggctaacagaggagaagccctatgagcagtgataacctggcggcagcgcaaaagatg

SEQ ID NO: 229416 - DNA, 103 bp, Artificial Sequence
  Synthetic Polynucleotide
taatacgactcactatagggactggggatctgaaaaactccgatcactgcaacagaggagagcagtgatgggagtttttaacctggcggcagcgcaaaagatg

SEQ ID NO: 229417 - DNA, 103 bp, Artificial Sequence
  Synthetic Polynucleotide
taatacgactcactatagggtctgtgctagactggggatctgaaaaactcaacagaggagagagtttatgagatccccaaacctggcggcagcgcaaaagatg

SEQ ID NO: 229418 - DNA, 103 bp, Artificial Sequence
  Synthetic Polynucleotide
taatacgactcactatagggacctaccctgtctgtgctagactggggatcaacagaggagagatcccatgtctagcacaaacctggcggcagcgcaaaagatg

SEQ ID NO: 229419 - DNA, 103 bp, Artificial Sequence
  Synthetic Polynucleotide
taatacgactcactatagggtatggatatcacctaccctgtctgtgctagaacagaggagactagcaatgacagggtagaacctggcggcagcgcaaaagatg

SEQ ID NO: 229420 - DNA, 103 bp, Artificial Sequence
  Synthetic Polynucleotide
taatacgactcactatagggacttccaaaatatggatatcacctaccctgaacagaggagacagggtatgtgatatccaaacctggcggcagcgcaaaagatg

SEQ ID NO: 229421 - DNA, 103 bp, Artificial Sequence
  Synthetic Polynucleotide
taatacgactcactataggggttatttgtgacttccaaaatatggatatcaacagaggagagatatcatgattttggaaaacctggcggcagcgcaaaagatg

SEQ ID NO: 229422 - DNA, 103 bp, Artificial Sequence
  Synthetic Polynucleotide
taatacgactcactatagggtatgctctaggttatttgtgacttccaaaaaacagaggagattttggatgtcacaaataaacctggcggcagcgcaaaagatg

SEQ ID NO: 229423 - DNA, 103 bp, Artificial Sequence
  Synthetic Polynucleotide
taatacgactcactataggggtgctgcatgctgccagcacggagcggtggaacagaggagaccaccgatgcgtgctggcaacctggcggcagcgcaaaagatg

SEQ ID NO: 229424 - DNA, 103 bp, Artificial Sequence
  Synthetic Polynucleotide
taatacgactcactatagggaaagtggacttatgctctaggttatttgtgaacagaggagacacaaaatgcctagagcaaacctggcggcagcgcaaaagatg

SEQ ID NO: 229425 - DNA, 103 bp, Artificial Sequence
  Synthetic Polynucleotide
taatacgactcactatagggcgaaatactaaaagtggacttatgctctagaacagaggagactagagatgaagtccactaacctggcggcagcgcaaaagatg

SEQ ID NO: 229426 - DNA, 103 bp, Artificial Sequence
  Synthetic Polynucleotide
taatacgactcactatagggtaagaaaattcgaaatactaaaagtggactaacagaggagaagtccaatgttagtatttaacctggcggcagcgcaaaagatg

SEQ ID NO: 229427 - DNA, 103 bp, Artificial Sequence
  Synthetic Polynucleotide
taatacgactcactatagggctgctcttgttaagaaaattcgaaatactaaacagaggagatagtatatggaattttctaacctggcggcagcgcaaaagatg

SEQ ID NO: 229428 - DNA, 103 bp, Artificial Sequence
  Synthetic Polynucleotide
taatacgactcactataggggttatttcctctgctcttgttaagaaaattaacagaggagaaattttatgaacaagagcaacctggcggcagcgcaaaagatg

SEQ ID NO: 229429 - DNA, 103 bp, Artificial Sequence
  Synthetic Polynucleotide
taatacgactcactatagggttgcagtaaagttatttcctctgctcttgtaacagaggagaacaagaatggaggaaataaacctggcggcagcgcaaaagatg

SEQ ID NO: 229430 - DNA, 103 bp, Artificial Sequence
  Synthetic Polynucleotide
taatacgactcactatagggttgttctgatttgcagtaaagttatttcctaacagaggagaaggaaaatgctttactgcaacctggcggcagcgcaaaagatg

SEQ ID NO: 229431 - DNA, 103 bp, Artificial Sequence
  Synthetic Polynucleotide
taatacgactcactatagggattatcatcattgttctgatttgcagtaaaaacagaggagatttactatgaatcagaacaacctggcggcagcgcaaaagatg

SEQ ID NO: 229432 - DNA, 103 bp, Artificial Sequence
  Synthetic Polynucleotide
taatacgactcactatagggtgtttggaatattatcatcattgttctgataacagaggagaatcagaatgatgatgataaacctggcggcagcgcaaaagatg

SEQ ID NO: 229433 - DNA, 103 bp, Artificial Sequence
  Synthetic Polynucleotide
taatacgactcactatagggtcactagtggtgtttggaatattatcatcaaacagaggagatgatgaatgtattccaaaaacctggcggcagcgcaaaagatg

SEQ ID NO: 229434 - DNA, 103 bp, Artificial Sequence
  Synthetic Polynucleotide
taatacgactcactatagggtcggaaatgcgtgctgcatgctgccagcacaacagaggagagtgctgatggcatgcagcaacctggcggcagcgcaaaagatg

SEQ ID NO: 229435 - DNA, 103 bp, Artificial Sequence
  Synthetic Polynucleotide
taatacgactcactatagggcagcctgcagtcactagtggtgtttggaataacagaggagaattccaatgaccactagtaacctggcggcagcgcaaaagatg

SEQ ID NO: 229436 - DNA, 103 bp, Artificial Sequence
  Synthetic Polynucleotide
taatacgactcactatagggcctcactctccagcctgcagtcactagtggaacagaggagaccactaatgactgcaggcaacctggcggcagcgcaaaagatg

SEQ ID NO: 229437 - DNA, 103 bp, Artificial Sequence
  Synthetic Polynucleotide
taatacgactcactatagggaaatagggggcctcactctccagcctgcagaacagaggagactgcagatgggagagtgaaacctggcggcagcgcaaaagatg

SEQ ID NO: 229438 - DNA, 103 bp, Artificial Sequence
  Synthetic Polynucleotide
taatacgactcactatagggtggactcaacaaatagggggcctcactctcaacagaggagagagagtatggccccctataacctggcggcagcgcaaaagatg

SEQ ID NO: 229439 - DNA, 103 bp, Artificial Sequence
  Synthetic Polynucleotide
taatacgactcactataggggcccagcctctggactcaacaaatagggggaacagaggagaccccctatgtgttgagtcaacctggcggcagcgcaaaagatg

SEQ ID NO: 229440 - DNA, 103 bp, Artificial Sequence
  Synthetic Polynucleotide
taatacgactcactatagggccacctgcaggcccagcctctggactcaacaacagaggagagttgagatgagaggctggaacctggcggcagcgcaaaagatg

SEQ ID NO: 229441 - DNA, 103 bp, Artificial Sequence
  Synthetic Polynucleotide
taatacgactcactatagggagaggagggcccacctgcaggcccagcctcaacagaggagagaggctatgcctgcaggtaacctggcggcagcgcaaaagatg

SEQ ID NO: 229442 - DNA, 103 bp, Artificial Sequence
  Synthetic Polynucleotide
taatacgactcactatagggagccaggggcagaggagggcccacctgcagaacagaggagactgcagatgggccctcctaacctggcggcagcgcaaaagatg

SEQ ID NO: 229443 - DNA, 103 bp, Artificial Sequence
  Synthetic Polynucleotide
taatacgactcactatagggtctacatgggagccaggggcagaggagggcaacagaggagagccctcatgtgcccctggaacctggcggcagcgcaaaagatg

SEQ ID NO: 229444 - DNA, 103 bp, Artificial Sequence
  Synthetic Polynucleotide
taatacgactcactatagggaaatgggttctctacatgggagccaggggcaacagaggagagcccctatgtcccatgtaaacctggcggcagcgcaaaagatg

SEQ ID NO: 229445 - DNA, 103 bp, Artificial Sequence
  Synthetic Polynucleotide
taatacgactcactatagggagaacagggctcggaaatgcgtgctgcatgaacagaggagacatgcaatgcgcatttccaacctggcggcagcgcaaaagatg

SEQ ID NO: 229446 - DNA, 103 bp, Artificial Sequence
  Synthetic Polynucleotide
taatacgactcactatagggcaggttcactaaatgggttctctacatgggaacagaggagacccatgatgagaacccataacctggcggcagcgcaaaagatg

SEQ ID NO: 229447 - DNA, 103 bp, Artificial Sequence
  Synthetic Polynucleotide
taatacgactcactatagggtgggagtctgcaggttcactaaatgggttcaacagaggagagaacccatgtagtgaaccaacctggcggcagcgcaaaagatg

SEQ ID NO: 229448 - DNA, 103 bp, Artificial Sequence
  Synthetic Polynucleotide
taatacgactcactatagggcctgacgaagtgggagtctgcaggttcactaacagaggagaagtgaaatggcagactccaacctggcggcagcgcaaaagatg

SEQ ID NO: 229449 - DNA, 103 bp, Artificial Sequence
  Synthetic Polynucleotide
taatacgactcactatagggcctgcataggcctgacgaagtgggagtctgaacagaggagacagactatgacttcgtcaaacctggcggcagcgcaaaagatg

SEQ ID NO: 229450 - DNA, 103 bp, Artificial Sequence
  Synthetic Polynucleotide
taatacgactcactatagggcccatcacctcctgcataggcctgacgaagaacagaggagacttcgtatggcctatgcaaacctggcggcagcgcaaaagatg

SEQ ID NO: 229451 - DNA, 103 bp, Artificial Sequence
  Synthetic Polynucleotide
taatacgactcactatagggacacggcaggcccatcacctcctgcataggaacagaggagacctatgatggaggtgatgaacctggcggcagcgcaaaagatg

SEQ ID NO: 229452 - DNA, 103 bp, Artificial Sequence
  Synthetic Polynucleotide
taatacgactcactatagggaagtctgcacacacggcaggcccatcacctaacagaggagaaggtgaatggcctgccgtaacctggcggcagcgcaaaagatg

SEQ ID NO: 229453 - DNA, 103 bp, Artificial Sequence
  Synthetic Polynucleotide
taatacgactcactatagggtggtagcctgaagtctgcacacacggcaggaacagaggagacctgccatgtgtgcagacaacctggcggcagcgcaaaagatg

SEQ ID NO: 229454 - DNA, 103 bp, Artificial Sequence
  Synthetic Polynucleotide
taatacgactcactatagggttctcctccttggtagcctgaagtctgcacaacagaggagagtgcagatgtcaggctacaacctggcggcagcgcaaaagatg

SEQ ID NO: 229455 - DNA, 103 bp, Artificial Sequence
  Synthetic Polynucleotide
taatacgactcactatagggtcccaaactgttctcctccttggtagcctgaacagaggagacaggctatgaaggaggagaacctggcggcagcgcaaaagatg

SEQ ID NO: 229456 - DNA, 103 bp, Artificial Sequence
  Synthetic Polynucleotide
taatacgactcactatagggtctgccactgagaacagggctcggaaatgcaacagaggagagcatttatgagccctgttaacctggcggcagcgcaaaagatg

SEQ ID NO: 229457 - DNA, 103 bp, Artificial Sequence
  Synthetic Polynucleotide
taatacgactcactataggggaaaagtccatcccaaactgttctcctcctaacagaggagaaggaggatgacagtttggaacctggcggcagcgcaaaagatg

SEQ ID NO: 229458 - DNA, 103 bp, Artificial Sequence
  Synthetic Polynucleotide
taatacgactcactatagggaccagacctggaaaagtccatcccaaactgaacagaggagacagtttatgatggactttaacctggcggcagcgcaaaagatg

SEQ ID NO: 229459 - DNA, 103 bp, Artificial Sequence
  Synthetic Polynucleotide
taatacgactcactatagggggaggcccaaaccagacctggaaaagtccaaacagaggagatggactatgccaggtctgaacctggcggcagcgcaaaagatg

SEQ ID NO: 229460 - DNA, 103 bp, Artificial Sequence
  Synthetic Polynucleotide
taatacgactcactatagggaaggaggagtggaggcccaaaccagacctgaacagaggagacaggtcatgtttgggcctaacctggcggcagcgcaaaagatg

SEQ ID NO: 229461 - DNA, 103 bp, Artificial Sequence
  Synthetic Polynucleotide
taatacgactcactatagggtaccctggagaaggaggagtggaggcccaaaacagaggagattgggcatgcactcctccaacctggcggcagcgcaaaagatg

SEQ ID NO: 229462 - DNA, 103 bp, Artificial Sequence
  Synthetic Polynucleotide
taatacgactcactatagggaacctatcattaccctggagaaggaggagtaacagaggagaactcctatgtctccagggaacctggcggcagcgcaaaagatg

SEQ ID NO: 229463 - DNA, 103 bp, Artificial Sequence
  Synthetic Polynucleotide
taatacgactcactatagggccccttggggaacctatcattaccctggagaacagaggagactccagatgaatgataggaacctggcggcagcgcaaaagatg

SEQ ID NO: 229464 - DNA, 103 bp, Artificial Sequence
  Synthetic Polynucleotide
taatacgactcactatagggactggctcctccccttggggaacctatcataacagaggagaatgataatgtccccaaggaacctggcggcagcgcaaaagatg

SEQ ID NO: 229465 - DNA, 103 bp, Artificial Sequence
  Synthetic Polynucleotide
taatacgactcactatagggaaggaaagttactggctcctccccttggggaacagaggagaccccaaatggaggagccaaacctggcggcagcgcaaaagatg

SEQ ID NO: 229466 - DNA, 103 bp, Artificial Sequence
  Synthetic Polynucleotide
taatacgactcactatagggcggcggtagtaaggaaagttactggctcctaacagaggagaaggagcatgtaactttccaacctggcggcagcgcaaaagatg

SEQ ID NO: 229467 - DNA, 103 bp, Artificial Sequence
  Synthetic Polynucleotide
taatacgactcactatagggctgatctccttctgccactgagaacagggcaacagaggagagccctgatgtcagtggcaaacctggcggcagcgcaaaagatg

SEQ ID NO: 229468 - DNA, 103 bp, Artificial Sequence
  Synthetic Polynucleotide
taatacgactcactataggggggagctatgcggcggtagtaaggaaagttaacagaggagaaactttatgtactaccgcaacctggcggcagcgcaaaagatg

SEQ ID NO: 229469 - DNA, 103 bp, Artificial Sequence
  Synthetic Polynucleotide
taatacgactcactatagggctggcattttgggagctatgcggcggtagtaacagaggagaactaccatggcatagctcaacctggcggcagcgcaaaagatg

SEQ ID NO: 229470 - DNA, 103 bp, Artificial Sequence
  Synthetic Polynucleotide
taatacgactcactataggggaagttacaactggcattttgggagctatgaacagaggagacatagcatgcaaaatgccaacctggcggcagcgcaaaagatg

SEQ ID NO: 229471 - DNA, 103 bp, Artificial Sequence
  Synthetic Polynucleotide
taatacgactcactataggggctcctgacggaagttacaactggcattttaacagaggagaaaaatgatggttgtaactaacctggcggcagcgcaaaagatg

SEQ ID NO: 229472 - DNA, 103 bp, Artificial Sequence
  Synthetic Polynucleotide
taatacgactcactatagggggatctgtgagctcctgacggaagttacaaaacagaggagattgtaaatgccgtcaggaaacctggcggcagcgcaaaagatg

SEQ ID NO: 229473 - DNA, 103 bp, Artificial Sequence
  Synthetic Polynucleotide
taatacgactcactataggggagttttctgggatctgtgagctcctgacgaacagaggagacgtcagatgctcacagataacctggcggcagcgcaaaagatg

SEQ ID NO: 229474 - DNA, 103 bp, Artificial Sequence
  Synthetic Polynucleotide
taatacgactcactatagggagaactggtagagttttctgggatctgtgaaacagaggagatcacagatgccagaaaacaacctggcggcagcgcaaaagatg

SEQ ID NO: 229475 - DNA, 103 bp, Artificial Sequence
  Synthetic Polynucleotide
taatacgactcactatagggtcattagctgagaactggtagagttttctgaacagaggagacagaaaatgctaccagttaacctggcggcagcgcaaaagatg

SEQ ID NO: 229476 - DNA, 103 bp, Artificial Sequence
  Synthetic Polynucleotide
taatacgactcactataggggctccattcatcattagctgagaactggtaaacagaggagataccagatgtcagctaataacctggcggcagcgcaaaagatg

SEQ ID NO: 229477 - DNA, 103 bp, Artificial Sequence
  Synthetic Polynucleotide
taatacgactcactatagggtgaggacgtagctccattcatcattagctgaacagaggagacagctaatgatgaatggaaacctggcggcagcgcaaaagatg

SEQ ID NO: 229478 - DNA, 103 bp, Artificial Sequence
  Synthetic Polynucleotide
taatacgactcactatagggtgttcatggtctgatctccttctgccactgaacagaggagacagtggatgaaggagatcaacctggcggcagcgcaaaagatg

SEQ ID NO: 229479 - DNA, 103 bp, Artificial Sequence
  Synthetic Polynucleotide
taatacgactcactatagggcattttcaaatgaggacgtagctccattcaaacagaggagatgaatgatgctacgtcctaacctggcggcagcgcaaaagatg

SEQ ID NO: 229480 - DNA, 103 bp, Artificial Sequence
  Synthetic Polynucleotide
taatacgactcactataggggaaggatggccattttcaaatgaggacgtaaacagaggagatacgtcatgatttgaaaaaacctggcggcagcgcaaaagatg

SEQ ID NO: 229481 - DNA, 103 bp, Artificial Sequence
  Synthetic Polynucleotide
taatacgactcactataggggccaggctgggaaggatggccattttcaaaaacagaggagatttgaaatgggccatcctaacctggcggcagcgcaaaagatg

SEQ ID NO: 229482 - DNA, 103 bp, Artificial Sequence
  Synthetic Polynucleotide
taatacgactcactatagggactgtggagggccaggctgggaaggatggcaacagaggagagccatcatgcccagcctgaacctggcggcagcgcaaaagatg

SEQ ID NO: 229483 - DNA, 103 bp, Artificial Sequence
  Synthetic Polynucleotide
taatacgactcactataggggccctggtcaactgtggagggccaggctggaacagaggagaccagccatgccctccacaaacctggcggcagcgcaaaagatg

SEQ ID NO: 229484 - DNA, 103 bp, Artificial Sequence
  Synthetic Polynucleotide
taatacgactcactatagggatctgcagatgccctggtcaactgtggaggaacagaggagacctccaatgttgaccaggaacctggcggcagcgcaaaagatg

SEQ ID NO: 229485 - DNA, 103 bp, Artificial Sequence
  Synthetic Polynucleotide
taatacgactcactatagggttgacagaacatctgcagatgccctggtcaaacagaggagatgaccaatgcatctgcagaacctggcggcagcgcaaaagatg

SEQ ID NO: 229486 - DNA, 103 bp, Artificial Sequence
  Synthetic Polynucleotide
taatacgactcactatagggttcttgcactttgacagaacatctgcagataacagaggagaatctgcatgtgttctgtcaacctggcggcagcgcaaaagatg

SEQ ID NO: 229487 - DNA, 103 bp, Artificial Sequence
  Synthetic Polynucleotide
taatacgactcactatagggtgataaggccttcttgcactttgacagaacaacagaggagagttctgatgaagtgcaagaacctggcggcagcgcaaaagatg

SEQ ID NO: 229488 - DNA, 103 bp, Artificial Sequence
  Synthetic Polynucleotide
taatacgactcactatagggcattgtgctctgataaggccttcttgcactaacagaggagaagtgcaatgaggccttataacctggcggcagcgcaaaagatg

SEQ ID NO: 229489 - DNA, 103 bp, Artificial Sequence
  Synthetic Polynucleotide
taatacgactcactatagggagctggatcatgttcatggtctgatctcctaacagaggagaaggagaatggaccatgaaaacctggcggcagcgcaaaagatg

SEQ ID NO: 229490 - DNA, 103 bp, Artificial Sequence
  Synthetic Polynucleotide
taatacgactcactatagggacaaccaaaacattgtgctctgataaggccaacagaggagaggccttatgagagcacaaaacctggcggcagcgcaaaagatg

SEQ ID NO: 229491 - DNA, 103 bp, Artificial Sequence
  Synthetic Polynucleotide
taatacgactcactatagggagctccctctacaaccaaaacattgtgctcaacagaggagagagcacatggttttggttaacctggcggcagcgcaaaagatg

SEQ ID NO: 229492 - DNA, 103 bp, Artificial Sequence
  Synthetic Polynucleotide
taatacgactcactatagggcatacttgcgagctccctctacaaccaaaaaacagaggagattttggatgtagagggagaacctggcggcagcgcaaaagatg

SEQ ID NO: 229493 - DNA, 103 bp, Artificial Sequence
  Synthetic Polynucleotide
taatacgactcactatagggattttgcaggcatacttgcgagctccctctaacagaggagaagagggatgtcgcaagtaaacctggcggcagcgcaaaagatg

SEQ ID NO: 229494 - DNA, 103 bp, Artificial Sequence
  Synthetic Polynucleotide
taatacgactcactatagggtttgcagcagattttgcaggcatacttgcgaacagaggagacgcaagatggcctgcaaaaacctggcggcagcgcaaaagatg

SEQ ID NO: 229495 - DNA, 103 bp, Artificial Sequence
  Synthetic Polynucleotide
taatacgactcactatagggtcagaaaagttttgcagcagattttgcaggaacagaggagacctgcaatgtctgctgcaaacctggcggcagcgcaaaagatg

SEQ ID NO: 229496 - DNA, 103 bp, Artificial Sequence
  Synthetic Polynucleotide
taatacgactcactatagggtctgtcaaagtcagaaaagttttgcagcagaacagaggagactgctgatgaacttttctaacctggcggcagcgcaaaagatg

SEQ ID NO: 229497 - DNA, 103 bp, Artificial Sequence
  Synthetic Polynucleotide
taatacgactcactatagggcttcttgcaatctgtcaaagtcagaaaagtaacagaggagaacttttatgactttgacaaacctggcggcagcgcaaaagatg

SEQ ID NO: 229498 - DNA, 103 bp, Artificial Sequence
  Synthetic Polynucleotide
taatacgactcactatagggcacggatgtgcttcttgcaatctgtcaaagaacagaggagactttgaatgattgcaagaaacctggcggcagcgcaaaagatg

SEQ ID NO: 229499 - DNA, 103 bp, Artificial Sequence
  Synthetic Polynucleotide
taatacgactcactatagggcctgtgtgaacacggatgtgcttcttgcaaaacagaggagattgcaaatggcacatccgaacctggcggcagcgcaaaagatg

SEQ ID NO: 229500 - DNA, 103 bp, Artificial Sequence
  Synthetic Polynucleotide
taatacgactcactatagggctcgctatccagctggatcatgttcatggtaacagaggagaaccatgatgatgatccagaacctggcggcagcgcaaaagatg

SEQ ID NO: 229501 - DNA, 103 bp, Artificial Sequence
  Synthetic Polynucleotide
taatacgactcactatagggaggcttttcacctgtgtgaacacggatgtgaacagaggagacacatcatggttcacacaaacctggcggcagcgcaaaagatg

SEQ ID NO: 229502 - DNA, 103 bp, Artificial Sequence
  Synthetic Polynucleotide
taatacgactcactatagggggcaggcgtaaggcttttcacctgtgtgaaaacagaggagattcacaatggtgaaaagcaacctggcggcagcgcaaaagatg

SEQ ID NO: 229503 - DNA, 103 bp, Artificial Sequence
  Synthetic Polynucleotide
taatacgactcactatagggccacacttcaggcaggcgtaaggcttttcaaacagaggagatgaaaaatgttacgcctgaacctggcggcagcgcaaaagatg

SEQ ID NO: 229504 - DNA, 103 bp, Artificial Sequence
  Synthetic Polynucleotide
taatacgactcactatagggaaacctcttgccacacttcaggcaggcgtaaacagaggagatacgccatgctgaagtgtaacctggcggcagcgcaaaagatg

SEQ ID NO: 229505 - DNA, 103 bp, Artificial Sequence
  Synthetic Polynucleotide
taatacgactcactatagggtggactgactaaacctcttgccacacttcaaacagaggagatgaagtatggcaagaggtaacctggcggcagcgcaaaagatg

SEQ ID NO: 229506 - DNA, 103 bp, Artificial Sequence
  Synthetic Polynucleotide
taatacgactcactatagggtacaggtggctggactgactaaacctcttgaacagaggagacaagagatgtagtcagtcaacctggcggcagcgcaaaagatg

SEQ ID NO: 229507 - DNA, 103 bp, Artificial Sequence
  Synthetic Polynucleotide
taatacgactcactatagggtgagtgcttatacaggtggctggactgactaacagaggagaagtcagatgagccacctgaacctggcggcagcgcaaaagatg

SEQ ID NO: 229508 - DNA, 103 bp, Artificial Sequence
  Synthetic Polynucleotide
taatacgactcactatagggaggtagtctttgagtgcttatacaggtggcaacagaggagagccaccatgataagcactaacctggcggcagcgcaaaagatg

SEQ ID NO: 229509 - DNA, 103 bp, Artificial Sequence
  Synthetic Polynucleotide
taatacgactcactatagggcagcgcaggcaggtagtctttgagtgcttaaacagaggagataagcaatgaaagactacaacctggcggcagcgcaaaagatg

SEQ ID NO: 229510 - DNA, 103 bp, Artificial Sequence
  Synthetic Polynucleotide
taatacgactcactataggggctgctctgccagcgcaggcaggtagtcttaacagaggagaaagactatgtgcctgcgcaacctggcggcagcgcaaaagatg

SEQ ID NO: 229511 - DNA, 103 bp, Artificial Sequence
  Synthetic Polynucleotide
taatacgactcactataggggctgctggaagatttgttcaaagtgaccagaacagaggagactggtcatgttgaacaaaaacctggcggcagcgcaaaagatg

SEQ ID NO: 229512 - DNA, 103 bp, Artificial Sequence
  Synthetic Polynucleotide
taatacgactcactatagggctgtcaccacctcgctatccagctggatcaaacagaggagatgatccatgtggatagcgaacctggcggcagcgcaaaagatg

SEQ ID NO: 229513 - DNA, 103 bp, Artificial Sequence
  Synthetic Polynucleotide
taatacgactcactatagggtgggaagattgctgctctgccagcgcaggcaacagaggagagcctgcatgggcagagcaaacctggcggcagcgcaaaagatg

SEQ ID NO: 229514 - DNA, 103 bp, Artificial Sequence
  Synthetic Polynucleotide
taatacgactcactatagggagcaaagtgctgggaagattgctgctctgcaacagaggagagcagagatgcaatcttccaacctggcggcagcgcaaaagatg

SEQ ID NO: 229515 - DNA, 103 bp, Artificial Sequence
  Synthetic Polynucleotide
taatacgactcactatagggaaggcctctgctgtcaccacctcgctatccaacagaggagaggatagatgggtggtgacaacctggcggcagcgcaaaagatg

SEQ ID NO: 229516 - DNA, 103 bp, Artificial Sequence
  Synthetic Polynucleotide
taatacgactcactatagggcagtgcagcaaaggcctctgctgtcaccacaacagaggagagtggtgatggcagaggccaacctggcggcagcgcaaaagatg

SEQ ID NO: 229517 - DNA, 103 bp, Artificial Sequence
  Synthetic Polynucleotide
taatacgactcactatagggtcatgtcaatcagtgcagcaaaggcctctgaacagaggagacagaggatgttgctgcacaacctggcggcagcgcaaaagatg

SEQ ID NO: 229518 - DNA, 103 bp, Artificial Sequence
  Synthetic Polynucleotide
taatacgactcactataggggaggtatacatcatgtcaatcagtgcagcaaacagaggagatgctgcatggattgacataacctggcggcagcgcaaaagatg

SEQ ID NO: 229519 - DNA, 103 bp, Artificial Sequence
  Synthetic Polynucleotide
taatacgactcactatagggcatgagggtggaggtatacatcatgtcaataacagaggagaattgacatgatgtataccaacctggcggcagcgcaaaagatg

SEQ ID NO: 229520 - DNA, 103 bp, Artificial Sequence
  Synthetic Polynucleotide
taatacgactcactatagggtctcccccagcatgagggtggaggtatacaaacagaggagatgtataatgccaccctcaaacctggcggcagcgcaaaagatg

SEQ ID NO: 229521 - DNA, 103 bp, Artificial Sequence
  Synthetic Polynucleotide
taatacgactcactatagggattacattgctctcccccagcatgagggtgaacagaggagacaccctatggctgggggaaacctggcggcagcgcaaaagatg

SEQ ID NO: 229522 - DNA, 103 bp, Artificial Sequence
  Synthetic Polynucleotide
taatacgactcactatagggtaagacatccattacattgctctcccccagaacagaggagactggggatgagcaatgtaaacctggcggcagcgcaaaagatg

SEQ ID NO: 229523 - DNA, 103 bp, Artificial Sequence
  Synthetic Polynucleotide
taatacgactcactatagggaggctgccaataagacatccattacattgcaacagaggagagcaatgatgtggatgtctaacctggcggcagcgcaaaagatg

SEQ ID NO: 229524 - DNA, 103 bp, Artificial Sequence
  Synthetic Polynucleotide
taatacgactcactatagggtggtagttcagctgctggaagatttgttcaaacagaggagatgaacaatgcttccagcaaacctggcggcagcgcaaaagatg

SEQ ID NO: 229525 - DNA, 103 bp, Artificial Sequence
  Synthetic Polynucleotide
taatacgactcactatagggtgcaggtgagaggctgccaataagacatccaacagaggagaggatgtatgattggcagcaacctggcggcagcgcaaaagatg

SEQ ID NO: 229526 - DNA, 103 bp, Artificial Sequence
  Synthetic Polynucleotide
taatacgactcactatagggagagttcaaatgcaggtgagaggctgccaaaacagaggagattggcaatgtctcacctgaacctggcggcagcgcaaaagatg

SEQ ID NO: 229527 - DNA, 103 bp, Artificial Sequence
  Synthetic Polynucleotide
taatacgactcactatagggccttaacaacagagttcaaatgcaggtgagaacagaggagactcaccatgatttgaactaacctggcggcagcgcaaaagatg

SEQ ID NO: 229528 - DNA, 103 bp, Artificial Sequence
  Synthetic Polynucleotide
taatacgactcactatagggtgtttacatgccttaacaacagagttcaaaaacagaggagatttgaaatgtgttgttaaaacctggcggcagcgcaaaagatg

SEQ ID NO: 229529 - DNA, 103 bp, Artificial Sequence
  Synthetic Polynucleotide
taatacgactcactatagggcgttaagtaatgtttacatgccttaacaacaacagaggagagttgttatggcatgtaaaaacctggcggcagcgcaaaagatg

SEQ ID NO: 229530 - DNA, 103 bp, Artificial Sequence
  Synthetic Polynucleotide
taatacgactcactataggggcgtccttgtcgttaagtaatgtttacatgaacagaggagacatgtaatgattacttaaaacctggcggcagcgcaaaagatg

SEQ ID NO: 229531 - DNA, 103 bp, Artificial Sequence
  Synthetic Polynucleotide
taatacgactcactataggggacatgggcagcgtccttgtcgttaagtaaaacagaggagattacttatggacaaggacaacctggcggcagcgcaaaagatg

SEQ ID NO: 229532 - DNA, 103 bp, Artificial Sequence
  Synthetic Polynucleotide
taatacgactcactatagggactggggggagacatgggcagcgtccttgtaacagaggagaacaaggatgctgcccatgaacctggcggcagcgcaaaagatg

SEQ ID NO: 229533 - DNA, 103 bp, Artificial Sequence
  Synthetic Polynucleotide
taatacgactcactataggggaacgcgctcactggggggagacatgggcaaacagaggagatgcccaatgctccccccaaacctggcggcagcgcaaaagatg

SEQ ID NO: 229534 - DNA, 103 bp, Artificial Sequence
  Synthetic Polynucleotide
taatacgactcactatagggctctgctcctgaacgcgctcactggggggaaacagaggagatcccccatgtgagcgcgtaacctggcggcagcgcaaaagatg

SEQ ID NO: 229535 - DNA, 103 bp, Artificial Sequence
  Synthetic Polynucleotide
taatacgactcactatagggatgaagtctctggtagttcagctgctggaaaacagaggagattccagatgctgaactacaacctggcggcagcgcaaaagatg

SEQ ID NO: 229536 - DNA, 103 bp, Artificial Sequence
  Synthetic Polynucleotide
taatacgactcactatagggcatgcgggcgctctgctcctgaacgcgctcaacagaggagagagcgcatgcaggagcagaacctggcggcagcgcaaaagatg

SEQ ID NO: 229537 - DNA, 103 bp, Artificial Sequence
  Synthetic Polynucleotide
taatacgactcactatagggaggagcgctgcatgcgggcgctctgctcctaacagaggagaaggagcatggcgcccgcaaacctggcggcagcgcaaaagatg

SEQ ID NO: 229538 - DNA, 103 bp, Artificial Sequence
  Synthetic Polynucleotide
taatacgactcactatagggtgtagcataaaggagcgctgcatgcgggcgaacagaggagacgcccgatggcagcgctcaacctggcggcagcgcaaaagatg

SEQ ID NO: 229539 - DNA, 103 bp, Artificial Sequence
  Synthetic Polynucleotide
taatacgactcactatagggtcccagctgctgtagcataaaggagcgctgaacagaggagacagcgcatgtttatgctaaacctggcggcagcgcaaaagatg

SEQ ID NO: 229540 - DNA, 103 bp, Artificial Sequence
  Synthetic Polynucleotide
taatacgactcactatagggcgatgcttagtcccagctgctgtagcataaaacagaggagattatgcatgagcagctggaacctggcggcagcgcaaaagatg

SEQ ID NO: 229541 - DNA, 103 bp, Artificial Sequence
  Synthetic Polynucleotide
taatacgactcactataggggctgagctcacgatgcttagtcccagctgcaacagaggagagcagctatgactaagcataacctggcggcagcgcaaaagatg

SEQ ID NO: 229542 - DNA, 103 bp, Artificial Sequence
  Synthetic Polynucleotide
taatacgactcactatagggggaattgagggctgagctcacgatgcttagaacagaggagactaagcatggtgagctcaaacctggcggcagcgcaaaagatg

SEQ ID NO: 229543 - DNA, 103 bp, Artificial Sequence
  Synthetic Polynucleotide
taatacgactcactatagggcattctggctggaattgagggctgagctcaaacagaggagatgagctatgccctcaattaacctggcggcagcgcaaaagatg

SEQ ID NO: 229544 - DNA, 103 bp, Artificial Sequence
  Synthetic Polynucleotide
taatacgactcactatagggtgctcctcgccattctggctggaattgaggaacagaggagacctcaaatgcagccagaaaacctggcggcagcgcaaaagatg

SEQ ID NO: 229545 - DNA, 103 bp, Artificial Sequence
  Synthetic Polynucleotide
taatacgactcactataggggggggctggctgctcctcgccattctggctaacagaggagaagccagatgggcgaggagaacctggcggcagcgcaaaagatg

SEQ ID NO: 229546 - DNA, 103 bp, Artificial Sequence
  Synthetic Polynucleotide
taatacgactcactatagggagagctggccatgaagtctctggtagttcaaacagaggagatgaactatgagagacttcaacctggcggcagcgcaaaagatg

SEQ ID NO: 229547 - DNA, 103 bp, Artificial Sequence
  Synthetic Polynucleotide
taatacgactcactatagggaagagctcatgggggctggctgctcctcgcaacagaggagagcgaggatgagccagcccaacctggcggcagcgcaaaagatg

SEQ ID NO: 229548 - DNA, 103 bp, Artificial Sequence
  Synthetic Polynucleotide
taatacgactcactatagggctgcgcatggaagagctcatgggggctggcaacagaggagagccagcatgcatgagctcaacctggcggcagcgcaaaagatg

SEQ ID NO: 229549 - DNA, 103 bp, Artificial Sequence
  Synthetic Polynucleotide
taatacgactcactatagggatccaggttactgcgcatggaagagctcataacagaggagaatgagcatgtccatgcgcaacctggcggcagcgcaaaagatg

SEQ ID NO: 229550 - DNA, 103 bp, Artificial Sequence
  Synthetic Polynucleotide
taatacgactcactataggggcgtgcgctgatccaggttactgcgcatggaacagaggagaccatgcatggtaacctggaacctggcggcagcgcaaaagatg

SEQ ID NO: 229551 - DNA, 103 bp, Artificial Sequence
  Synthetic Polynucleotide
taatacgactcactatagggatggggaagggcgtgcgctgatccaggttaaacagaggagataacctatgtcagcgcacaacctggcggcagcgcaaaagatg

SEQ ID NO: 229552 - DNA, 103 bp, Artificial Sequence
  Synthetic Polynucleotide
taatacgactcactatagggaaggcgtctcatggggaagggcgtgcgctgaacagaggagacagcgcatgcccttccccaacctggcggcagcgcaaaagatg

SEQ ID NO: 229553 - DNA, 103 bp, Artificial Sequence
  Synthetic Polynucleotide
taatacgactcactatagggtgcgcttatgaaggcgtctcatggggaaggaacagaggagaccttccatgtgagacgccaacctggcggcagcgcaaaagatg

SEQ ID NO: 229554 - DNA, 103 bp, Artificial Sequence
  Synthetic Polynucleotide
taatacgactcactataggggcagactgcttgcgcttatgaaggcgtctcaacagaggagagagacgatgtcataagcgaacctggcggcagcgcaaaagatg

SEQ ID NO: 229555 - DNA, 103 bp, Artificial Sequence
  Synthetic Polynucleotide
taatacgactcactatagggccgctcctctgcagactgcttgcgcttatgaacagaggagacataagatgaagcagtctaacctggcggcagcgcaaaagatg

SEQ ID NO: 229556 - DNA, 103 bp, Artificial Sequence
  Synthetic Polynucleotide
taatacgactcactataggggctgcctggcccgctcctctgcagactgctaacagaggagaagcagtatgcagaggagcaacctggcggcagcgcaaaagatg

SEQ ID NO: 229557 - DNA, 103 bp, Artificial Sequence
  Synthetic Polynucleotide
taatacgactcactatagggacacaatcacagagctggccatgaagtctcaacagaggagagagactatgtggccagctaacctggcggcagcgcaaaagatg

SEQ ID NO: 229558 - DNA, 103 bp, Artificial Sequence
  Synthetic Polynucleotide
taatacgactcactatagggggtcggaggcgctgcctggcccgctcctctaacagaggagaagaggaatgggccaggcaaacctggcggcagcgcaaaagatg

SEQ ID NO: 229559 - DNA, 103 bp, Artificial Sequence
  Synthetic Polynucleotide
taatacgactcactatagggatctatggagggtcggaggcgctgcctggcaacagaggagagccaggatgcgcctccgaaacctggcggcagcgcaaaagatg

SEQ ID NO: 229560 - DNA, 103 bp, Artificial Sequence
  Synthetic Polynucleotide
taatacgactcactatagggtggcagactcatctatggagggtcggaggcaacagaggagagcctccatgcctccatagaacctggcggcagcgcaaaagatg

SEQ ID NO: 229561 - DNA, 103 bp, Artificial Sequence
  Synthetic Polynucleotide
taatacgactcactatagggacatctgaaatggcagactcatctatggagaacagaggagactccatatgtgagtctgcaacctggcggcagcgcaaaagatg

SEQ ID NO: 229562 - DNA, 103 bp, Artificial Sequence
  Synthetic Polynucleotide
taatacgactcactatagggctccggtgtaacatctgaaatggcagactcaacagaggagagagtctatgatttcagataacctggcggcagcgcaaaagatg

SEQ ID NO: 229563 - DNA, 103 bp, Artificial Sequence
  Synthetic Polynucleotide
taatacgactcactatagggaaggcccattctccggtgtaacatctgaaaaacagaggagatttcagatgttacaccggaacctggcggcagcgcaaaagatg

SEQ ID NO: 229564 - DNA, 103 bp, Artificial Sequence
  Synthetic Polynucleotide
taatacgactcactatagggtgaacccctgaaggcccattctccggtgtaaacagaggagatacaccatggaatgggccaacctggcggcagcgcaaaagatg

SEQ ID NO: 229565 - DNA, 103 bp, Artificial Sequence
  Synthetic Polynucleotide
taatacgactcactatagggctcccgagaatgaacccctgaaggcccattaacagaggagaaatgggatgtcaggggttaacctggcggcagcgcaaaagatg

SEQ ID NO: 229566 - DNA, 103 bp, Artificial Sequence
  Synthetic Polynucleotide
taatacgactcactatagggaaaagaactcctcccgagaatgaacccctgaacagaggagacaggggatgattctcgggaacctggcggcagcgcaaaagatg

SEQ ID NO: 229567 - DNA, 103 bp, Artificial Sequence
  Synthetic Polynucleotide
taatacgactcactataggggaatctggtgaaaagaactcctcccgagaaaacagaggagattctcgatgggagttcttaacctggcggcagcgcaaaagatg

SEQ ID NO: 229568 - DNA, 103 bp, Artificial Sequence
  Synthetic Polynucleotide
taatacgactcactatagggcactacaatgacacaatcacagagctggccaacagaggagaggccagatgtgtgattgtaacctggcggcagcgcaaaagatg

SEQ ID NO: 229569 - DNA, 103 bp, Artificial Sequence
  Synthetic Polynucleotide
taatacgactcactatagggaattttcagagaatctggtgaaaagaactcaacagaggagagagttcatgtcaccagataacctggcggcagcgcaaaagatg

SEQ ID NO: 229570 - DNA, 103 bp, Artificial Sequence
  Synthetic Polynucleotide
taatacgactcactataggggattatccacaattttcagagaatctggtgaacagaggagacaccagatgctctgaaaaaacctggcggcagcgcaaaagatg

SEQ ID NO: 229571 - DNA, 103 bp, Artificial Sequence
  Synthetic Polynucleotide
taatacgactcactatagggtcagctttaggattatccacaattttcagaaacagaggagatctgaaatgtgtggataaaacctggcggcagcgcaaaagatg

SEQ ID NO: 229572 - DNA, 103 bp, Artificial Sequence
  Synthetic Polynucleotide
taatacgactcactatagggagtcattccatcagctttaggattatccacaacagaggagagtggatatgcctaaagctaacctggcggcagcgcaaaagatg

SEQ ID NO: 229573 - DNA, 103 bp, Artificial Sequence
  Synthetic Polynucleotide
taatacgactcactatagggcctggttatcagtcattccatcagctttagaacagaggagactaaagatgatggaatgaaacctggcggcagcgcaaaagatg

SEQ ID NO: 229574 - DNA, 103 bp, Artificial Sequence
  Synthetic Polynucleotide
taatacgactcactataggggcactatcttcctggttatcagtcattccaaacagaggagatggaatatgtgataaccaaacctggcggcagcgcaaaagatg

SEQ ID NO: 229575 - DNA, 103 bp, Artificial Sequence
  Synthetic Polynucleotide
taatacgactcactatagggaaacatgatcgcactatcttcctggttatcaacagaggagagataacatggaagatagtaacctggcggcagcgcaaaagatg

SEQ ID NO: 229576 - DNA, 103 bp, Artificial Sequence
  Synthetic Polynucleotide
taatacgactcactatagggaagactgatcaaacatgatcgcactatcttaacagaggagaaagataatgcgatcatgtaacctggcggcagcgcaaaagatg

SEQ ID NO: 229577 - DNA, 103 bp, Artificial Sequence
  Synthetic Polynucleotide
taatacgactcactatagggtgagtgccaaaagactgatcaaacatgatcaacagaggagagatcatatgtgatcagtcaacctggcggcagcgcaaaagatg

SEQ ID NO: 229578 - DNA, 103 bp, Artificial Sequence
  Synthetic Polynucleotide
taatacgactcactatagggggcatcttcttgagtgccaaaagactgatcaacagaggagagatcagatgtttggcactaacctggcggcagcgcaaaagatg

SEQ ID NO: 229579 - DNA, 103 bp, Artificial Sequence
  Synthetic Polynucleotide
taatacgactcactataggggtctattccccactacaatgacacaatcacaacagaggagagtgattatgtcattgtagaacctggcggcagcgcaaaagatg

SEQ ID NO: 229580 - DNA, 103 bp, Artificial Sequence
  Synthetic Polynucleotide
taatacgactcactatagggtgggcacctgggcatcttcttgagtgccaaaacagaggagattggcaatgaagaagatgaacctggcggcagcgcaaaagatg

SEQ ID NO: 229581 - DNA, 103 bp, Artificial Sequence
  Synthetic Polynucleotide
taatacgactcactatagggtcagactggctgggcacctgggcatcttctaacagaggagaagaagaatgccaggtgccaacctggcggcagcgcaaaagatg

SEQ ID NO: 229582 - DNA, 103 bp, Artificial Sequence
  Synthetic Polynucleotide
taatacgactcactatagggagcactgttatcagactggctgggcacctgaacagaggagacaggtgatgagccagtctaacctggcggcagcgcaaaagatg

SEQ ID NO: 229583 - DNA, 103 bp, Artificial Sequence
  Synthetic Polynucleotide
taatacgactcactatagggccatgttgccagcactgttatcagactggcaacagaggagagccagtatgataacagtgaacctggcggcagcgcaaaagatg

SEQ ID NO: 229584 - DNA, 103 bp, Artificial Sequence
  Synthetic Polynucleotide
taatacgactcactataggggacaactgtgccatgttgccagcactgttaaacagaggagataacagatgtggcaacataacctggcggcagcgcaaaagatg

SEQ ID NO: 229585 - DNA, 103 bp, Artificial Sequence
  Synthetic Polynucleotide
taatacgactcactatagggagaggccatggacaactgtgccatgttgccaacagaggagaggcaacatggcacagttgaacctggcggcagcgcaaaagatg

SEQ ID NO: 229586 - DNA, 103 bp, Artificial Sequence
  Synthetic Polynucleotide
taatacgactcactataggggagttgcacgagaggccatggacaactgtgaacagaggagacacagtatgccatggcctaacctggcggcagcgcaaaagatg

SEQ ID NO: 229587 - DNA, 103 bp, Artificial Sequence
  Synthetic Polynucleotide
taatacgactcactataggggtctcaacctgagttgcacgagaggccatgaacagaggagacatggcatgtcgtgcaacaacctggcggcagcgcaaaagatg

SEQ ID NO: 229588 - DNA, 103 bp, Artificial Sequence
  Synthetic Polynucleotide
taatacgactcactatagggatcaaaactagtctcaacctgagttgcacgaacagaggagacgtgcaatgcaggttgagaacctggcggcagcgcaaaagatg

SEQ ID NO: 229589 - DNA, 103 bp, Artificial Sequence
  Synthetic Polynucleotide
taatacgactcactatagggcagcttcctgatcaaaactagtctcaacctaacagaggagaaggttgatgctagttttgaacctggcggcagcgcaaaagatg

SEQ ID NO: 229590 - DNA, 103 bp, Artificial Sequence
  Synthetic Polynucleotide
taatacgactcactataggggctttaaagtgtctattccccactacaatgaacagaggagacattgtatgggggaatagaacctggcggcagcgcaaaagatg

SEQ ID NO: 229591 - DNA, 103 bp, Artificial Sequence
  Synthetic Polynucleotide
taatacgactcactatagggttctcaggtgcagcttcctgatcaaaactaaacagaggagatagtttatgtcaggaagcaacctggcggcagcgcaaaagatg

SEQ ID NO: 229592 - DNA, 103 bp, Artificial Sequence
  Synthetic Polynucleotide
taatacgactcactatagggaaaactacttttctcaggtgcagcttcctgaacagaggagacaggaaatggcacctgagaacctggcggcagcgcaaaagatg

SEQ ID NO: 229593 - DNA, 103 bp, Artificial Sequence
  Synthetic Polynucleotide
taatacgactcactatagggtttcacactgaaaactacttttctcaggtgaacagaggagacacctgatgaaagtagttaacctggcggcagcgcaaaagatg

SEQ ID NO: 229594 - DNA, 103 bp, Artificial Sequence
  Synthetic Polynucleotide
taatacgactcactatagggacctcagggttttcacactgaaaactacttaacagaggagaaagtagatgtcagtgtgaaacctggcggcagcgcaaaagatg

SEQ ID NO: 229595 - DNA, 103 bp, Artificial Sequence
  Synthetic Polynucleotide
taatacgactcactatagggaccaaggccaacctcagggttttcacactgaacagaggagacagtgtatgaaccctgagaacctggcggcagcgcaaaagatg

SEQ ID NO: 229596 - DNA, 103 bp, Artificial Sequence
  Synthetic Polynucleotide
taatacgactcactataggggctccttctcaccaaggccaacctcagggtaacagaggagaaccctgatgttggccttgaacctggcggcagcgcaaaagatg

SEQ ID NO: 229597 - DNA, 103 bp, Artificial Sequence
  Synthetic Polynucleotide
taatacgactcactatagggactctcatgtgctccttctcaccaaggccaaacagaggagatggcctatgtgagaaggaaacctggcggcagcgcaaaagatg

SEQ ID NO: 229598 - DNA, 103 bp, Artificial Sequence
  Synthetic Polynucleotide
taatacgactcactatagggtttaaccaccactctcatgtgctccttctcaacagaggagagagaagatgcacatgagaaacctggcggcagcgcaaaagatg

SEQ ID NO: 229599 - DNA, 103 bp, Artificial Sequence
  Synthetic Polynucleotide
taatacgactcactatagggggggctcagatttaaccaccactctcatgtaacagaggagaacatgaatgtggtggttaaacctggcggcagcgcaaaagatg

SEQ ID NO: 229600 - DNA, 103 bp, Artificial Sequence
  Synthetic Polynucleotide
taatacgactcactatagggggtgagctcaggggctcagatttaaccaccaacagaggagaggtggtatgatctgagccaacctggcggcagcgcaaaagatg

SEQ ID NO: 229601 - DNA, 103 bp, Artificial Sequence
  Synthetic Polynucleotide
taatacgactcactatagggcccgatggggccgtccacgccgccggccataacagaggagaatggccatgggcgtggacaacctggcggcagcgcaaaagatg

SEQ ID NO: 229602 - DNA, 103 bp, Artificial Sequence
  Synthetic Polynucleotide
taatacgactcactatagggcaccaggatcaccacgtcgcacagcaggccaacagaggagaggcctgatgtgcgacgtgaacctggcggcagcgcaaaagatg

SEQ ID NO: 229603 - DNA, 103 bp, Artificial Sequence
  Synthetic Polynucleotide
taatacgactcactatagggctcctcgtcgctgtcccccgccgcggccccaacagaggagaggggccatggcgggggacaacctggcggcagcgcaaaagatg

SEQ ID NO: 229604 - DNA, 103 bp, Artificial Sequence
  Synthetic Polynucleotide
taatacgactcactatagggcggcccgcgactcctcgtcgctgtcccccgaacagaggagacgggggatggcgacgaggaacctggcggcagcgcaaaagatg

SEQ ID NO: 229605 - DNA, 103 bp, Artificial Sequence
  Synthetic Polynucleotide
taatacgactcactatagggcccttgtcgtcggcccgcgactcctcgtcgaacagaggagacgacgaatggtcgcgggcaacctggcggcagcgcaaaagatg

SEQ ID NO: 229606 - DNA, 103 bp, Artificial Sequence
  Synthetic Polynucleotide
taatacgactcactataggggtccatgacgcccttgtcgtcggcccgcgaaacagaggagatcgcggatggacgacaagaacctggcggcagcgcaaaagatg

SEQ ID NO: 229607 - DNA, 103 bp, Artificial Sequence
  Synthetic Polynucleotide
taatacgactcactatagggtcaggtagtagtccatgacgcccttgtcgtaacagaggagaacgacaatggcgtcatggaacctggcggcagcgcaaaagatg

SEQ ID NO: 229608 - DNA, 103 bp, Artificial Sequence
  Synthetic Polynucleotide
taatacgactcactatagggctgaagtacttcaggtagtagtccatgacgaacagaggagacgtcatatgctactacctaacctggcggcagcgcaaaagatg

SEQ ID NO: 229609 - DNA, 103 bp, Artificial Sequence
  Synthetic Polynucleotide
taatacgactcactataggggtgggcgccgctgaagtacttcaggtagtaaacagaggagatactacatgaagtacttcaacctggcggcagcgcaaaagatg

SEQ ID NO: 229610 - DNA, 103 bp, Artificial Sequence
  Synthetic Polynucleotide
taatacgactcactatagggcgtcgccgtcgtgggcgccgctgaagtactaacagaggagaagtactatggcggcgcccaacctggcggcagcgcaaaagatg

SEQ ID NO: 229611 - DNA, 103 bp, Artificial Sequence
  Synthetic Polynucleotide
taatacgactcactataggggccgggtagacgtcgccgtcgtgggcgccgaacagaggagacggcgcatgcgacggcgaaacctggcggcagcgcaaaagatg

SEQ ID NO: 229612 - DNA, 103 bp, Artificial Sequence
  Synthetic Polynucleotide
taatacgactcactatagggctgcgaccaggccgggtagacgtcgccgtcaacagaggagagacggcatggtctacccgaacctggcggcagcgcaaaagatg

SEQ ID NO: 229613 - DNA, 103 bp, Artificial Sequence
  Synthetic Polynucleotide
taatacgactcactatagggcgcggccctccaccaggatcaccacgtcgcaacagaggagagcgacgatgtgatcctggaacctggcggcagcgcaaaagatg

SEQ ID NO: 229614 - DNA, 103 bp, Artificial Sequence
  Synthetic Polynucleotide
taatacgactcactatagggtctccaccttctgcgaccaggccgggtagaaacagaggagatctaccatgcctggtcgcaacctggcggcagcgcaaaagatg

SEQ ID NO: 229615 - DNA, 103 bp, Artificial Sequence
  Synthetic Polynucleotide
taatacgactcactatagggcggatcttcttctccaccttctgcgaccagaacagaggagactggtcatggaaggtggaaacctggcggcagcgcaaaagatg

SEQ ID NO: 229616 - DNA, 103 bp, Artificial Sequence
  Synthetic Polynucleotide
taatacgactcactatagggggccttggctcggatcttcttctccaccttaacagaggagaaaggtgatgaagaagatcaacctggcggcagcgcaaaagatg

SEQ ID NO: 229617 - DNA, 103 bp, Artificial Sequence
  Synthetic Polynucleotide
taatacgactcactatagggacttctggaaggccttggctcggatcttctaacagaggagaagaagaatggagccaaggaacctggcggcagcgcaaaagatg

SEQ ID NO: 229618 - DNA, 103 bp, Artificial Sequence
  Synthetic Polynucleotide
taatacgactcactatagggcagatggggcacttctggaaggccttggctaacagaggagaagccaaatgcttccagaaaacctggcggcagcgcaaaagatg

SEQ ID NO: 229619 - DNA, 103 bp, Artificial Sequence
  Synthetic Polynucleotide
taatacgactcactataggggaccttctcgcagatggggcacttctggaaaacagaggagattccagatgtgccccatcaacctggcggcagcgcaaaagatg

SEQ ID NO: 229620 - DNA, 103 bp, Artificial Sequence
  Synthetic Polynucleotide
taatacgactcactatagggcgccctggatgaccttctcgcagatggggcaacagaggagagccccaatggcgagaaggaacctggcggcagcgcaaaagatg

SEQ ID NO: 229621 - DNA, 103 bp, Artificial Sequence
  Synthetic Polynucleotide
taatacgactcactatagggagcttgccggcgccctggatgaccttctcgaacagaggagacgagaaatgcatccagggaacctggcggcagcgcaaaagatg

SEQ ID NO: 229622 - DNA, 103 bp, Artificial Sequence
  Synthetic Polynucleotide
taatacgactcactataggggtgtcgcggcagcttgccggcgccctggataacagaggagaatccagatggccggcaagaacctggcggcagcgcaaaagatg

SEQ ID NO: 229623 - DNA, 103 bp, Artificial Sequence
  Synthetic Polynucleotide
taatacgactcactataggggggtgcggatgtgtcgcggcagcttgccggaacagaggagaccggcaatgtgccgcgacaacctggcggcagcgcaaaagatg

SEQ ID NO: 229624 - DNA, 103 bp, Artificial Sequence
  Synthetic Polynucleotide
taatacgactcactataggggtggggaactcgcggccctccaccaggatcaacagaggagagatcctatgggagggccgaacctggcggcagcgcaaaagatg

SEQ ID NO: 229625 - DNA, 103 bp, Artificial Sequence
  Synthetic Polynucleotide
taatacgactcactatagggtcgcccgtgtgggtgcggatgtgtcgcggcaacagaggagagccgcgatgcatccgcacaacctggcggcagcgcaaaagatg

SEQ ID NO: 229626 - DNA, 103 bp, Artificial Sequence
  Synthetic Polynucleotide
taatacgactcactataggggtagggcttctcgcccgtgtgggtgcggataacagaggagaatccgcatgcacacgggcaacctggcggcagcgcaaaagatg

SEQ ID NO: 229627 - DNA, 103 bp, Artificial Sequence
  Synthetic Polynucleotide
taatacgactcactatagggtgttgcactcgtagggcttctcgcccgtgtaacagaggagaacacggatgagaagccctaacctggcggcagcgcaaaagatg

SEQ ID NO: 229628 - DNA, 103 bp, Artificial Sequence
  Synthetic Polynucleotide
taatacgactcactatagggaccttgcagatgttgcactcgtagggcttcaacagaggagagaagccatgcgagtgcaaaacctggcggcagcgcaaaagatg

SEQ ID NO: 229629 - DNA, 103 bp, Artificial Sequence
  Synthetic Polynucleotide
taatacgactcactatagggggtgaagcggaccttgcagatgttgcactcaacagaggagagagtgcatgatctgcaagaacctggcggcagcgcaaaagatg

SEQ ID NO: 229630 - DNA, 103 bp, Artificial Sequence
  Synthetic Polynucleotide
taatacgactcactatagggtgtcctgcctggtgaagcggaccttgcagaaacagaggagatctgcaatgtccgcttcaaacctggcggcagcgcaaaagatg

SEQ ID NO: 229631 - DNA, 103 bp, Artificial Sequence
  Synthetic Polynucleotide
taatacgactcactatagggaccttcagcttgtcctgcctggtgaagcggaacagaggagaccgcttatgcaggcaggaaacctggcggcagcgcaaaagatg

SEQ ID NO: 229632 - DNA, 103 bp, Artificial Sequence
  Synthetic Polynucleotide
taatacgactcactatagggccgcatgtgcaccttcagcttgtcctgcctaacagaggagaaggcagatgaagctgaagaacctggcggcagcgcaaaagatg

SEQ ID NO: 229633 - DNA, 103 bp, Artificial Sequence
  Synthetic Polynucleotide
taatacgactcactatagggccgtgtgcttccgcatgtgcaccttcagctaacagaggagaagctgaatgtgcacatgcaacctggcggcagcgcaaaagatg

SEQ ID NO: 229634 - DNA, 103 bp, Artificial Sequence
  Synthetic Polynucleotide
taatacgactcactatagggggcttctcgcccgtgtgcttccgcatgtgcaacagaggagagcacatatggaagcacacaacctggcggcagcgcaaaagatg

SEQ ID NO: 229635 - DNA, 103 bp, Artificial Sequence
  Synthetic Polynucleotide
taatacgactcactatagggcgagcggtgcgtggggaactcgcggccctcaacagaggagagagggcatggagttccccaacctggcggcagcgcaaaagatg

SEQ ID NO: 229636 - DNA, 103 bp, Artificial Sequence
  Synthetic Polynucleotide
taatacgactcactataggggcacaggtacggcttctcgcccgtgtgcttaacagaggagaaagcacatgggcgagaagaacctggcggcagcgcaaaagatg

SEQ ID NO: 229637 - DNA, 103 bp, Artificial Sequence
  Synthetic Polynucleotide
taatacgactcactatagggcgcactgctggcacaggtacggcttctcgcaacagaggagagcgagaatgcgtacctgtaacctggcggcagcgcaaaagatg

SEQ ID NO: 229638 - DNA, 103 bp, Artificial Sequence
  Synthetic Polynucleotide
taatacgactcactatagggaaggcggcgccgcactgctggcacaggtacaacagaggagagtacctatgccagcagtgaacctggcggcagcgcaaaagatg

SEQ ID NO: 229639 - DNA, 103 bp, Artificial Sequence
  Synthetic Polynucleotide
taatacgactcactataggggttgtgggcaaaggcggcgccgcactgctgaacagaggagacagcagatgggcgccgccaacctggcggcagcgcaaaagatg

SEQ ID NO: 229640 - DNA, 103 bp, Artificial Sequence
  Synthetic Polynucleotide
taatacgactcactatagggtcaggtcgtagttgtgggcaaaggcggcgcaacagaggagagcgccgatgttgcccacaaacctggcggcagcgcaaaagatg

SEQ ID NO: 229641 - DNA, 103 bp, Artificial Sequence
  Synthetic Polynucleotide
taatacgactcactatagggatgtggttcttcaggtcgtagttgtgggcaaacagaggagatgcccaatgctacgacctaacctggcggcagcgcaaaagatg

SEQ ID NO: 229642 - DNA, 103 bp, Artificial Sequence
  Synthetic Polynucleotide
taatacgactcactataggggtgcacgcgcatgtggttcttcaggtcgtaaacagaggagatacgacatgaagaaccacaacctggcggcagcgcaaaagatg

SEQ ID NO: 229643 - DNA, 103 bp, Artificial Sequence
  Synthetic Polynucleotide
taatacgactcactataggggcaggcccgtgtgcacgcgcatgtggttctaacagaggagaagaaccatgtgcgcgtgcaacctggcggcagcgcaaaagatg

SEQ ID NO: 229644 - DNA, 103 bp, Artificial Sequence
  Synthetic Polynucleotide
taatacgactcactatagggtggtaggggcgcaggcccgtgtgcacgcgcaacagaggagagcgcgtatgcacgggcctaacctggcggcagcgcaaaagatg

SEQ ID NO: 229645 - DNA, 103 bp, Artificial Sequence
  Synthetic Polynucleotide
taatacgactcactataggggctgtcgcactggtaggggcgcaggcccgtaacagaggagaacgggcatgcgcccctacaacctggcggcagcgcaaaagatg

SEQ ID NO: 229646 - DNA, 103 bp, Artificial Sequence
  Synthetic Polynucleotide
taatacgactcactatagggcggccagcaccgagcggtgcgtggggaactaacagaggagaagttccatgcgcaccgctaacctggcggcagcgcaaaagatg

SEQ ID NO: 229647 - DNA, 103 bp, Artificial Sequence
  Synthetic Polynucleotide
taatacgactcactatagggtcttgcagcagctgtcgcactggtaggggcaacagaggagagcccctatgagtgcgacaaacctggcggcagcgcaaaagatg

SEQ ID NO: 229648 - DNA, 103 bp, Artificial Sequence
  Synthetic Polynucleotide
taatacgactcactatagggcggacgaaggtcttgcagcagctgtcgcacaacagaggagagtgcgaatgctgctgcaaaacctggcggcagcgcaaaagatg

SEQ ID NO: 229649 - DNA, 103 bp, Artificial Sequence
  Synthetic Polynucleotide
taatacgactcactataggggtggtcggagcggacgaaggtcttgcagcaaacagaggagatgctgcatgaccttcgtcaacctggcggcagcgcaaaagatg

SEQ ID NO: 229650 - DNA, 103 bp, Artificial Sequence
  Synthetic Polynucleotide
taatacgactcactataggggtctgtgcaggtggtcggagcggacgaaggaacagaggagaccttcgatggctccgaccaacctggcggcagcgcaaaagatg

SEQ ID NO: 229651 - DNA, 103 bp, Artificial Sequence
  Synthetic Polynucleotide
taatacgactcactatagggttcttgaggtgtctgtgcaggtggtcggagaacagaggagactccgaatgcctgcacagaacctggcggcagcgcaaaagatg

SEQ ID NO: 229652 - DNA, 103 bp, Artificial Sequence
  Synthetic Polynucleotide
taatacgactcactataggggcagccgtctttcttgaggtgtctgtgcagaacagaggagactgcacatgcacctcaagaacctggcggcagcgcaaaagatg

SEQ ID NO: 229653 - DNA, 103 bp, Artificial Sequence
  Synthetic Polynucleotide
taatacgactcactatagggggacgccgttgcagccgtctttcttgaggtaacagaggagaacctcaatgaagacggctaacctggcggcagcgcaaaagatg

SEQ ID NO: 229654 - DNA, 103 bp, Artificial Sequence
  Synthetic Polynucleotide
taatacgactcactatagggcggcgcgaggggacgccgttgcagccgtctaacagaggagaagacggatgcaacggcgtaacctggcggcagcgcaaaagatg

SEQ ID NO: 229655 - DNA, 103 bp, Artificial Sequence
  Synthetic Polynucleotide
taatacgactcactatagggcttgcggccgcggcgcgaggggacgccgttaacagaggagaaacggcatgccctcgcgcaacctggcggcagcgcaaaagatg

SEQ ID NO: 229656 - DNA, 103 bp, Artificial Sequence
  Synthetic Polynucleotide
taatacgactcactatagggggacgcggggcttgcggccgcggcgcgaggaacagaggagacctcgcatggcggccgcaaacctggcggcagcgcaaaagatg

SEQ ID NO: 229657 - DNA, 103 bp, Artificial Sequence
  Synthetic Polynucleotide
taatacgactcactatagggtggctgcaggcggccagcaccgagcggtgcaacagaggagagcaccgatgggtgctggcaacctggcggcagcgcaaaagatg

SEQ ID NO: 229658 - DNA, 103 bp, Artificial Sequence
  Synthetic Polynucleotide
taatacgactcactataggggccccgccccggacgcggggcttgcggccgaacagaggagacggccgatggccccgcgtaacctggcggcagcgcaaaagatg

SEQ ID NO: 229659 - DNA, 103 bp, Artificial Sequence
  Synthetic Polynucleotide
taatacgactcactatagggggggtcgggcgccccgccccggacgcggggaacagaggagaccccgcatgcggggcgggaacctggcggcagcgcaaaagatg

SEQ ID NO: 229660 - DNA, 103 bp, Artificial Sequence
  Synthetic Polynucleotide
taatacgactcactatagggcccccgggctggggtcgggcgccccgccccaacagaggagaggggcgatgcgcccgaccaacctggcggcagcgcaaaagatg

SEQ ID NO: 229661 - DNA, 103 bp, Artificial Sequence
  Synthetic Polynucleotide
taatacgactcactataggggtcgcggtggcccccgggctggggtcgggcaacagaggagagcccgaatgcagcccgggaacctggcggcagcgcaaaagatg

SEQ ID NO: 229662 - DNA, 103 bp, Artificial Sequence
  Synthetic Polynucleotide
taatacgactcactatagggggcgccgggggtcgcggtggcccccgggctaacagaggagaagcccgatggccaccgcgaacctggcggcagcgcaaaagatg

SEQ ID NO: 229663 - DNA, 103 bp, Artificial Sequence
  Synthetic Polynucleotide
taatacgactcactataggggctgggcgggggcgccgggggtcgcggtggaacagaggagaccaccgatgcccccggcgaacctggcggcagcgcaaaagatg

SEQ ID NO: 229664 - DNA, 103 bp, Artificial Sequence
  Synthetic Polynucleotide
taatacgactcactatagggggggagctgggctgggcgggggcgccggggaacagaggagaccccggatgccccgcccaaacctggcggcagcgcaaaagatg

SEQ ID NO: 229665 - DNA, 103 bp, Artificial Sequence
  Synthetic Polynucleotide
taatacgactcactatagggccgggcgtcgggggagctgggctgggcgggaacagaggagacccgccatgcccagctccaacctggcggcagcgcaaaagatg

SEQ ID NO: 229666 - DNA, 103 bp, Artificial Sequence
  Synthetic Polynucleotide
taatacgactcactatagggggccgttgcgccgggcgtcgggggagctggaacagaggagaccagctatgccgacgcccaacctggcggcagcgcaaaagatg

SEQ ID NO: 229667 - DNA, 103 bp, Artificial Sequence
  Synthetic Polynucleotide
taatacgactcactatagggtgcttctcctggccgttgcgccgggcgtcgaacagaggagacgacgcatggcgcaacggaacctggcggcagcgcaaaagatg

SEQ ID NO: 229668 - DNA, 103 bp, Artificial Sequence
  Synthetic Polynucleotide
taatacgactcactatagggcttgaagtactggctgcaggcggccagcacaacagaggagagtgctgatggcctgcagcaacctggcggcagcgcaaaagatg

SEQ ID NO: 229669 - DNA, 103 bp, Artificial Sequence
  Synthetic Polynucleotide
taatacgactcactataggggtccttaaagtgcttctcctggccgttgcgaacagaggagacgcaacatgcaggagaagaacctggcggcagcgcaaaagatg

SEQ ID NO: 229670 - DNA, 103 bp, Artificial Sequence
  Synthetic Polynucleotide
taatacgactcactatagggcctcgtcctcgtccttaaagtgcttctcctaacagaggagaaggagaatgactttaaggaacctggcggcagcgcaaaagatg

SEQ ID NO: 229671 - DNA, 103 bp, Artificial Sequence
  Synthetic Polynucleotide
taatacgactcactatagggacgtcctcgtcctcgtcctcgtccttaaagaacagaggagactttaaatgcgaggacgaaacctggcggcagcgcaaaagatg

SEQ ID NO: 229672 - DNA, 103 bp, Artificial Sequence
  Synthetic Polynucleotide
taatacgactcactatagggggggctggccacgtcctcgtcctcgtcctcaacagaggagagaggacatggacgaggacaacctggcggcagcgcaaaagatg

SEQ ID NO: 229673 - DNA, 103 bp, Artificial Sequence
  Synthetic Polynucleotide
taatacgactcactatagggccaagccgtcggggctggccacgtcctcgtaacagaggagaacgaggatgtggccagccaacctggcggcagcgcaaaagatg

SEQ ID NO: 229674 - DNA, 103 bp, Artificial Sequence
  Synthetic Polynucleotide
taatacgactcactatagggttcaaccggcccaagccgtcggggctggccaacagaggagaggccagatgcgacggcttaacctggcggcagcgcaaaagatg

SEQ ID NO: 229675 - DNA, 103 bp, Artificial Sequence
  Synthetic Polynucleotide
taatacgactcactataggggcccgctacattcaaccggcccaagccgtcaacagaggagagacggcatgggccggttgaacctggcggcagcgcaaaagatg

SEQ ID NO: 229676 - DNA, 103 bp, Artificial Sequence
  Synthetic Polynucleotide
taatacgactcactatagggctccaccggcgcccgctacattcaaccggcaacagaggagagccggtatgatgtagcggaacctggcggcagcgcaaaagatg

SEQ ID NO: 229677 - DNA, 103 bp, Artificial Sequence
  Synthetic Polynucleotide
taatacgactcactatagggctgtcacctcctccaccggcgcccgctacaaacagaggagatgtagcatgcgccggtggaacctggcggcagcgcaaaagatg

SEQ ID NO: 229678 - DNA, 103 bp, Artificial Sequence
  Synthetic Polynucleotide
taatacgactcactataggggccacctccgctgtcacctcctccaccggcaacagaggagagccggtatgggaggtgacaacctggcggcagcgcaaaagatg

SEQ ID NO: 229679 - DNA, 103 bp, Artificial Sequence
  Synthetic Polynucleotide
taatacgactcactatagggtgaacagcttcttgaagtactggctgcaggaacagaggagacctgcaatgagtacttcaaacctggcggcagcgcaaaagatg

SEQ ID NO: 229680 - DNA, 103 bp, Artificial Sequence
  Synthetic Polynucleotide
taatacgactcactatagggcggccccggggccacctccgctgtcacctcaacagaggagagaggtgatggcggaggtgaacctggcggcagcgcaaaagatg

SEQ ID NO: 229681 - DNA, 103 bp, Artificial Sequence
  Synthetic Polynucleotide
taatacgactcactatagggccgtcggtggcggccccggggccacctccgaacagaggagacggaggatgccccggggcaacctggcggcagcgcaaaagatg

SEQ ID NO: 229682 - DNA, 103 bp, Artificial Sequence
  Synthetic Polynucleotide
taatacgactcactatagggtgtgaagttaccgtcggtggcggccccgggaacagaggagacccgggatggccaccgacaacctggcggcagcgcaaaagatg

SEQ ID NO: 229683 - DNA, 103 bp, Artificial Sequence
  Synthetic Polynucleotide
taatacgactcactatagggcgagtccggctgtgaagttaccgtcggtggaacagaggagaccaccgatggtaacttcaaacctggcggcagcgcaaaagatg

SEQ ID NO: 229684 - DNA, 103 bp, Artificial Sequence
  Synthetic Polynucleotide
taatacgactcactataggggcgcccgacgtgaacagcttcttgaagtacaacagaggagagtacttatggaagctgttaacctggcggcagcgcaaaagatg

SEQ ID NO: 229685 - DNA, 103 bp, Artificial Sequence
  Synthetic Polynucleotide
taatacgactcactataggggtccaccacggcgcccgacgtgaacagcttaacagaggagaaagctgatgacgtcgggcaacctggcggcagcgcaaaagatg

SEQ ID NO: 229686 - DNA, 103 bp, Artificial Sequence
  Synthetic Polynucleotide
taatacgactcactatagggggaacgggatcccgatggggccgtccacgcaacagaggagagcgtggatggccccatcgaacctggcggcagcgcaaaagatg

SEQ ID NO: 229687 - DNA, 103 bp, Artificial Sequence
  Synthetic Polynucleotide
taatacgactcactatagggcgttctgctggtccaccacggcgcccgacgaacagaggagacgtcggatgccgtggtggaacctggcggcagcgcaaaagatg

SEQ ID NO: 229688 - DNA, 103 bp, Artificial Sequence
  Synthetic Polynucleotide
taatacgactcactatagggatctcgtacacgttctgctggtccaccacgaacagaggagacgtggtatgccagcagaaaacctggcggcagcgcaaaagatg

SEQ ID NO: 229689 - DNA, 103 bp, Artificial Sequence
  Synthetic Polynucleotide
taatacgactcactataggggacgaagtcgatctcgtacacgttctgctgaacagaggagacagcagatggtgtacgagaacctggcggcagcgcaaaagatg

SEQ ID NO: 229690 - DNA, 103 bp, Artificial Sequence
  Synthetic Polynucleotide
taatacgactcactatagggcctcggcgctgacgaagtcgatctcgtacaaacagaggagatgtacgatgtcgacttcgaacctggcggcagcgcaaaagatg

SEQ ID NO: 229691 - DNA, 103 bp, Artificial Sequence
  Synthetic Polynucleotide
taatacgactcactataggggcggtgagcgcctcggcgctgacgaagtcgaacagaggagacgacttatgcagcgccgaaacctggcggcagcgcaaaagatg

SEQ ID NO: 229692 - DNA, 103 bp, Artificial Sequence
  Synthetic Polynucleotide
taatacgactcactataggggtccatgagcgcggtgagcgcctcggcgctaacagaggagaagcgccatggcgctcaccaacctggcggcagcgcaaaagatg

SEQ ID NO: 229693 - DNA, 103 bp, Artificial Sequence
  Synthetic Polynucleotide
taatacgactcactatagggtgtaggcgaagtccatgagcgcggtgagcgaacagaggagacgctcaatgcgctcatggaacctggcggcagcgcaaaagatg

SEQ ID NO: 229694 - DNA, 103 bp, Artificial Sequence
  Synthetic Polynucleotide
taatacgactcactatagggagcgtggccgtgtaggcgaagtccatgagcaacagaggagagctcatatgcttcgcctaaacctggcggcagcgcaaaagatg

SEQ ID NO: 229695 - DNA, 103 bp, Artificial Sequence
  Synthetic Polynucleotide
taatacgactcactataggggctgacggtgagcgtggccgtgtaggcgaaaacagaggagattcgccatgacggccacgaacctggcggcagcgcaaaagatg

SEQ ID NO: 229696 - DNA, 103 bp, Artificial Sequence
  Synthetic Polynucleotide
taatacgactcactatagggcgttggctgtgctgacggtgagcgtggccgaacagaggagacggccaatgtcaccgtcaaacctggcggcagcgcaaaagatg

SEQ ID NO: 229697 - DNA, 103 bp, Artificial Sequence
  Synthetic Polynucleotide
taatacgactcactatagggctgtggtcggggaacgggatcccgatggggaacagaggagaccccatatggatcccgttaacctggcggcagcgcaaaagatg

SEQ ID NO: 229698 - DNA, 103 bp, Artificial Sequence
  Synthetic Polynucleotide
taatacgactcactatagggatgtcacccacgttggctgtgctgacggtgaacagaggagacaccgtatgcacagccaaaacctggcggcagcgcaaaagatg

SEQ ID NO: 229699 - DNA, 103 bp, Artificial Sequence
  Synthetic Polynucleotide
taatacgactcactatagggggcgctgaggatgtcacccacgttggctgtaacagaggagaacagccatggtgggtgacaacctggcggcagcgcaaaagatg

SEQ ID NO: 229700 - DNA, 103 bp, Artificial Sequence
  Synthetic Polynucleotide
taatacgactcactataggggcaggcgggcggcgctgaggatgtcacccaaacagaggagatgggtgatgtcctcagcgaacctggcggcagcgcaaaagatg

SEQ ID NO: 229701 - DNA, 103 bp, Artificial Sequence
  Synthetic Polynucleotide
taatacgactcactataggggggatctccagcaggcgggcggcgctgaggaacagaggagacctcagatgcgcccgcctaacctggcggcagcgcaaaagatg

SEQ ID NO: 229702 - DNA, 103 bp, Artificial Sequence
  Synthetic Polynucleotide
taatacgactcactataggggctcacggcggggatctccagcaggcgggcaacagaggagagcccgcatgctggagatcaacctggcggcagcgcaaaagatg

SEQ ID NO: 229703 - DNA, 103 bp, Artificial Sequence
  Synthetic Polynucleotide
taatacgactcactatagggcgcacacgtggctcacggcggggatctccaaacagaggagatggagaatgccgccgtgaaacctggcggcagcgcaaaagatg

SEQ ID NO: 229704 - DNA, 103 bp, Artificial Sequence
  Synthetic Polynucleotide
taatacgactcactatagggaggaggtcggcgcacacgtggctcacggcgaacagaggagacgccgtatgccacgtgtgaacctggcggcagcgcaaaagatg

SEQ ID NO: 229705 - DNA, 103 bp, Artificial Sequence
  Synthetic Polynucleotide
taatacgactcactatagggctgccggtccaggaggtcggcgcacacgtgaacagaggagacacgtgatggccgacctcaacctggcggcagcgcaaaagatg

SEQ ID NO: 229706 - DNA, 103 bp, Artificial Sequence
  Synthetic Polynucleotide
taatacgactcactatagggccgccaggatctgccggtccaggaggtcggaacagaggagaccgaccatgtggaccggcaacctggcggcagcgcaaaagatg

SEQ ID NO: 229707 - DNA, 103 bp, Artificial Sequence
  Synthetic Polynucleotide
taatacgactcactatagggcccgcgtcggccgccaggatctgccggtccaacagaggagaggaccgatggatcctggcaacctggcggcagcgcaaaagatg

SEQ ID NO: 229708 - DNA, 103 bp, Artificial Sequence
  Synthetic Polynucleotide
taatacgactcactataggggatgtcgctgctgtggtcggggaacgggataacagaggagaatcccgatgcccgaccacaacctggcggcagcgcaaaagatg

SEQ ID NO: 229709 - DNA, 103 bp, Artificial Sequence
  Synthetic Polynucleotide
taatacgactcactatagggggcgtcggcgcccgcgtcggccgccaggataacagaggagaatcctgatggccgacgcgaacctggcggcagcgcaaaagatg

SEQ ID NO: 229710 - DNA, 103 bp, Artificial Sequence
  Synthetic Polynucleotide
taatacgactcactatagggccagctgcccggcgtcggcgcccgcgtcggaacagaggagaccgacgatggcgccgacgaacctggcggcagcgcaaaagatg

SEQ ID NO: 229711 - DNA, 103 bp, Artificial Sequence
  Synthetic Polynucleotide
taatacgactcactatagggtctacaaggtccagctgcccggcgtcggcgaacagaggagacgccgaatgcgggcagctaacctggcggcagcgcaaaagatg

SEQ ID NO: 229712 - DNA, 103 bp, Artificial Sequence
  Synthetic Polynucleotide
taatacgactcactatagggatcaatttgatctacaaggtccagctgcccaacagaggagagggcagatggaccttgtaaacctggcggcagcgcaaaagatg

SEQ ID NO: 229713 - DNA, 103 bp, Artificial Sequence
  Synthetic Polynucleotide
taatacgactcactatagggggttgcgctgatcaatttgatctacaaggtaacagaggagaaccttgatgatcaaattgaacctggcggcagcgcaaaagatg

SEQ ID NO: 229714 - DNA, 103 bp, Artificial Sequence
  Synthetic Polynucleotide
taatacgactcactataggggcgcggaggaggttgcgctgatcaatttgaaacagaggagatcaaatatgtcagcgcaaaacctggcggcagcgcaaaagatg

SEQ ID NO: 229715 - DNA, 103 bp, Artificial Sequence
  Synthetic Polynucleotide
taatacgactcactataggggtactccttggcgcggaggaggttgcgctgaacagaggagacagcgcatgctcctccgcaacctggcggcagcgcaaaagatg

SEQ ID NO: 229716 - DNA, 103 bp, Artificial Sequence
  Synthetic Polynucleotide
taatacgactcactatagggagaactcgaggtactccttggcgcggaggaaacagaggagatcctccatgccaaggagtaacctggcggcagcgcaaaagatg

SEQ ID NO: 229717 - DNA, 103 bp, Artificial Sequence
  Synthetic Polynucleotide
taatacgactcactatagggttgctctggaagaactcgaggtactccttgaacagaggagacaaggaatgcctcgagttaacctggcggcagcgcaaaagatg

SEQ ID NO: 229718 - DNA, 103 bp, Artificial Sequence
  Synthetic Polynucleotide
taatacgactcactataggggttcatggggttgctctggaagaactcgagaacagaggagactcgagatgttccagagcaacctggcggcagcgcaaaagatg

SEQ ID NO: 229719 - DNA, 103 bp, Artificial Sequence
  Synthetic Polynucleotide
taatacgactcactataggggcccactcaggatgtcgctgctgtggtcggaacagaggagaccgaccatggcagcgacaaacctggcggcagcgcaaaagatg

SEQ ID NO: 229720 - DNA, 103 bp, Artificial Sequence
  Synthetic Polynucleotide
taatacgactcactatagggggggcaggctgttcatggggttgctctggaaacagaggagatccagaatgaccccatgaaacctggcggcagcgcaaaagatg

SEQ ID NO: 229721 - DNA, 103 bp, Artificial Sequence
  Synthetic Polynucleotide
taatacgactcactataggggcggccgcggggggcaggctgttcatggggaacagaggagaccccatatgcagcctgccaacctggcggcagcgcaaaagatg

SEQ ID NO: 229722 - DNA, 103 bp, Artificial Sequence
  Synthetic Polynucleotide
taatacgactcactatagggagcggcggcggcggccgcggggggcaggctaacagaggagaagcctgatgcccgcggccaacctggcggcagcgcaaaagatg

SEQ ID NO: 229723 - DNA, 103 bp, Artificial Sequence
  Synthetic Polynucleotide
taatacgactcactatagggggaagctggcagcggcggcggcggccgcggaacagaggagaccgcggatgccgccgccgaacctggcggcagcgcaaaagatg

SEQ ID NO: 229724 - DNA, 103 bp, Artificial Sequence
  Synthetic Polynucleotide
taatacgactcactataggggcggaccacgggaagctggcagcggcggcgaacagaggagacgccgcatgtgccagcttaacctggcggcagcgcaaaagatg

SEQ ID NO: 229725 - DNA, 103 bp, Artificial Sequence
  Synthetic Polynucleotide
taatacgactcactatagggcgccccaaaggcggaccacgggaagctggcaacagaggagagccagcatgccgtggtccaacctggcggcagcgcaaaagatg

SEQ ID NO: 229726 - DNA, 103 bp, Artificial Sequence
  Synthetic Polynucleotide
taatacgactcactatagggcatcatcggacgccccaaaggcggaccacgaacagaggagacgtggtatgcctttggggaacctggcggcagcgcaaaagatg

SEQ ID NO: 229727 - DNA, 103 bp, Artificial Sequence
  Synthetic Polynucleotide
taatacgactcactataggggcatccaggtcatcatcggacgccccaaagaacagaggagactttggatggtccgatgaaacctggcggcagcgcaaaagatg

SEQ ID NO: 229728 - DNA, 103 bp, Artificial Sequence
  Synthetic Polynucleotide
taatacgactcactatagggctccttggtggcatccaggtcatcatcggaaacagaggagatccgatatggacctggataacctggcggcagcgcaaaagatg

SEQ ID NO: 229729 - DNA, 103 bp, Artificial Sequence
  Synthetic Polynucleotide
taatacgactcactatagggcggccacggcctccttggtggcatccaggtaacagaggagaacctggatgccaccaaggaacctggcggcagcgcaaaagatg

SEQ ID NO: 229730 - DNA, 103 bp, Artificial Sequence
  Synthetic Polynucleotide
taatacgactcactatagggtgctcgttcagcccactcaggatgtcgctgaacagaggagacagcgaatgcctgagtggaacctggcggcagcgcaaaagatg

SEQ ID NO: 229731 - DNA, 103 bp, Artificial Sequence
  Synthetic Polynucleotide
taatacgactcactataggggccacagcggcggccacggcctccttggtgaacagaggagacaccaaatgggccgtggcaacctggcggcagcgcaaaagatg

SEQ ID NO: 229732 - DNA, 103 bp, Artificial Sequence
  Synthetic Polynucleotide
taatacgactcactatagggggccacggcggccacagcggcggccacggcaacagaggagagccgtgatggccgctgtgaacctggcggcagcgcaaaagatg

SEQ ID NO: 229733 - DNA, 103 bp, Artificial Sequence
  Synthetic Polynucleotide
taatacgactcactatagggagtcgcccgcggccacggcggccacagcggaacagaggagaccgctgatgccgccgtggaacctggcggcagcgcaaaagatg

SEQ ID NO: 229734 - DNA, 103 bp, Artificial Sequence
  Synthetic Polynucleotide
taatacgactcactatagggaagccgttgcagtcgcccgcggccacggcgaacagaggagacgccgtatgcgcgggcgaaacctggcggcagcgcaaaagatg

SEQ ID NO: 229735 - DNA, 103 bp, Artificial Sequence
  Synthetic Polynucleotide
taatacgactcactatagggatagaagtctaagccgttgcagtcgcccgcaacagaggagagcgggcatgtgcaacggcaacctggcggcagcgcaaaagatg

SEQ ID NO: 229736 - DNA, 103 bp, Artificial Sequence
  Synthetic Polynucleotide
taatacgactcactatagggggcccggcccatagaagtctaagccgttgcaacagaggagagcaacgatgtagacttctaacctggcggcagcgcaaaagatg

SEQ ID NO: 229737 - DNA, 103 bp, Artificial Sequence
  Synthetic Polynucleotide
taatacgactcactatagggtcggccggggggcccggcccatagaagtctaacagaggagaagacttatgtgggccgggaacctggcggcagcgcaaaagatg

SEQ ID NO: 229738 - DNA, 103 bp, Artificial Sequence
  Synthetic Polynucleotide
taatacgactcactatagggcgggggccgctcggccggggggcccggcccaacagaggagagggccgatgcccccggccaacctggcggcagcgcaaaagatg

SEQ ID NO: 229739 - DNA, 103 bp, Artificial Sequence
  Synthetic Polynucleotide
taatacgactcactatagggcgtcccccgtcgggggccgctcggccggggaacagaggagaccccggatgagcggccccaacctggcggcagcgcaaaagatg

SEQ ID NO: 229740 - DNA, 103 bp, Artificial Sequence
  Synthetic Polynucleotide
taatacgactcactatagggccctcgtccccgtcccccgtcgggggccgcaacagaggagagcggccatggacgggggaaacctggcggcagcgcaaaagatg

SEQ ID NO: 229741 - DNA, 103 bp, Artificial Sequence
  Synthetic Polynucleotide
taatacgactcactatagggctgcgtccgctgctcgttcagcccactcagaacagaggagactgagtatgctgaacgagaacctggcggcagcgcaaaagatg

SEQ ID NO: 229742 - DNA, 103 bp, Artificial Sequence
  Synthetic Polynucleotide
taatacgactcactataggggttgctgtcgccctcgtccccgtcccccgtaacagaggagaacggggatgggggacgagaacctggcggcagcgcaaaagatg

SEQ ID NO: 229743 - DNA, 103 bp, Artificial Sequence
  Synthetic Polynucleotide
taatacgactcactatagggacagacccgggttgctgtcgccctcgtcccaacagaggagagggacgatggcgacagcaaacctggcggcagcgcaaaagatg

SEQ ID NO: 229744 - DNA, 103 bp, Artificial Sequence
  Synthetic Polynucleotide
taatacgactcactatagggcgctctggccacagacccgggttgctgtcgaacagaggagacgacagatgcccgggtctaacctggcggcagcgcaaaagatg

SEQ ID NO: 229745 - DNA, 103 bp, Artificial Sequence
  Synthetic Polynucleotide
taatacgactcactataggggtcctcatcccgctctggccacagacccggaacagaggagaccgggtatgtggccagagaacctggcggcagcgcaaaagatg

SEQ ID NO: 229746 - DNA, 103 bp, Artificial Sequence
  Synthetic Polynucleotide
taatacgactcactatagggcggtgggggcgtcctcatcccgctctggccaacagaggagaggccagatggggatgaggaacctggcggcagcgcaaaagatg

SEQ ID NO: 229747 - DNA, 103 bp, Artificial Sequence
  Synthetic Polynucleotide
taatacgactcactatagggaagagacccccggtgggggcgtcctcatccaacagaggagaggatgaatgcgcccccacaacctggcggcagcgcaaaagatg

SEQ ID NO: 229748 - DNA, 103 bp, Artificial Sequence
  Synthetic Polynucleotide
taatacgactcactatagggcggcggcggaaagagacccccggtgggggcaacagaggagagcccccatggggggtctcaacctggcggcagcgcaaaagatg

SEQ ID NO: 229749 - DNA, 103 bp, Artificial Sequence
  Synthetic Polynucleotide
taatacgactcactataggggcggggccaccggcggcggaaagagaccccaacagaggagaggggtcatgttccgccgcaacctggcggcagcgcaaaagatg

SEQ ID NO: 229750 - DNA, 103 bp, Artificial Sequence
  Synthetic Polynucleotide
taatacgactcactataggggtggcggccggcggggccaccggcggcggaaacagaggagatccgccatgggtggccccaacctggcggcagcgcaaaagatg

SEQ ID NO: 229751 - DNA, 103 bp, Artificial Sequence
  Synthetic Polynucleotide
taatacgactcactataggggccgttctgcgtggcggccggcggggccacaacagaggagagtggccatgccggccgccaacctggcggcagcgcaaaagatg

SEQ ID NO: 229752 - DNA, 103 bp, Artificial Sequence
  Synthetic Polynucleotide
taatacgactcactatagggacagcaggccctgcgtccgctgctcgttcaaacagaggagatgaacgatgagcggacgcaacctggcggcagcgcaaaagatg

SEQ ID NO: 229753 - DNA, 103 bp, Artificial Sequence
  Synthetic Polynucleotide
taatacgactcactatagggggccgtagtggccgttctgcgtggcggccgaacagaggagacggccgatgcgcagaacgaacctggcggcagcgcaaaagatg

SEQ ID NO: 229754 - DNA, 103 bp, Artificial Sequence
  Synthetic Polynucleotide
taatacgactcactatagggtctccgccgcggccgtagtggccgttctgcaacagaggagagcagaaatgccactacggaacctggcggcagcgcaaaagatg

SEQ ID NO: 229755 - DNA, 103 bp, Artificial Sequence
  Synthetic Polynucleotide
taatacgactcactatagggggcctcctcctctccgccgcggccgtagtgaacagaggagacactacatgcgcggcggaaacctggcggcagcgcaaaagatg

SEQ ID NO: 229756 - DNA, 103 bp, Artificial Sequence
  Synthetic Polynucleotide
taatacgactcactatagggacagcgaggcggcctcctcctctccgccgcaacagaggagagcggcgatgaggaggaggaacctggcggcagcgcaaaagatg

SEQ ID NO: 229757 - DNA, 103 bp, Artificial Sequence
  Synthetic Polynucleotide
taatacgactcactataggggccgcctccgacagcgaggcggcctcctccaacagaggagaggaggaatgcgcctcgctaacctggcggcagcgcaaaagatg

SEQ ID NO: 229758 - DNA, 103 bp, Artificial Sequence
  Synthetic Polynucleotide
taatacgactcactatagggcggctcgggggccgcctccgacagcgaggcaacagaggagagcctcgatgtcggaggcgaacctggcggcagcgcaaaagatg

SEQ ID NO: 229759 - DNA, 103 bp, Artificial Sequence
  Synthetic Polynucleotide
taatacgactcactataggggagagtcgcccggctcgggggccgcctccgaacagaggagacggaggatgcccccgagcaacctggcggcagcgcaaaagatg

SEQ ID NO: 229760 - DNA, 103 bp, Artificial Sequence
  Synthetic Polynucleotide
taatacgactcactatagggaggaagcccggagagtcgcccggctcggggaacagaggagaccccgaatggggcgactcaacctggcggcagcgcaaaagatg

SEQ ID NO: 229761 - DNA, 103 bp, Artificial Sequence
  Synthetic Polynucleotide
taatacgactcactatagggcgctcccgacaggaagcccggagagtcgccaacagaggagaggcgacatgccgggcttcaacctggcggcagcgcaaaagatg

SEQ ID NO: 229762 - DNA, 103 bp, Artificial Sequence
  Synthetic Polynucleotide
taatacgactcactatagggcgccctcggccgctcccgacaggaagcccgaacagaggagacgggctatgtgtcgggagaacctggcggcagcgcaaaagatg

SEQ ID NO: 229763 - DNA, 103 bp, Artificial Sequence
  Synthetic Polynucleotide
taatacgactcactatagggaccacgtcgcacagcaggccctgcgtccgcaacagaggagagcggacatggggcctgctaacctggcggcagcgcaaaagatg

SEQ ID NO: 229764 - DNA, 103 bp, Artificial Sequence
  Synthetic Polynucleotide
taatacgactcactatagggtccccgtcctcgccctcggccgctcccgacaacagaggagagtcgggatgggccgagggaacctggcggcagcgcaaaagatg

SEQ ID NO: 229765 - DNA, 103 bp, Artificial Sequence
  Synthetic Polynucleotide
taatacgactcactataggggtcgggcccgtccccgtcctcgccctcggcaacagaggagagccgagatggaggacgggaacctggcggcagcgcaaaagatg

SEQ ID NO: 229766 - DNA, 103 bp, Artificial Sequence
  Synthetic Polynucleotide
taatacgactcactataggggcccgtccacgtcgggcccgtccccgtcctaacagaggagaaggacgatgacgggcccgaacctggcggcagcgcaaaagatg

SEQ ID NO: 229767 - DNA, 103 bp, Artificial Sequence
  Synthetic Polynucleotide
taatacgactcactatagggctggccgccagcccgtccacgtcgggcccgaacagaggagacgggccatgcgtggacggaacctggcggcagcgcaaaagatg

SEQ ID NO: 229768 - DNA, 103 bp, Artificial Sequence
  Synthetic Polynucleotide
taatacgactcactatagggcagcagcgtgctggccgccagcccgtccacaacagaggagagtggacatgctggcggccaacctggcggcagcgcaaaagatg

SEQ ID NO: 229769 - DNA, 103 bp, Artificial Sequence
  Synthetic Polynucleotide
taatacgactcactatagggtcatctgctgcagcagcgtgctggccgccaaacagaggagatggcggatggcacgctgcaacctggcggcagcgcaaaagatg

SEQ ID NO: 229770 - DNA, 103 bp, Artificial Sequence
  Synthetic Polynucleotide
taatacgactcactatagggaccgatgacatcatctgctgcagcagcgtgaacagaggagacacgctatggcagcagataacctggcggcagcgcaaaagatg

SEQ ID NO: 229771 - DNA, 103 bp, Artificial Sequence
  Synthetic Polynucleotide
taatacgactcactatagggcgcccggcccaccgatgacatcatctgctgaacagaggagacagcagatgatgtcatcgaacctggcggcagcgcaaaagatg

SEQ ID NO: 229772 - DNA, 103 bp, Artificial Sequence
  Synthetic Polynucleotide
taatacgactcactatagggccgcggcccccgcccggcccaccgatgacaaacagaggagatgtcatatgtgggccgggaacctggcggcagcgcaaaagatg

SEQ ID NO: 229773 - DNA, 103 bp, Artificial Sequence
  Synthetic Polynucleotide
taatacgactcactatagggctgtcccccgccgcggcccccgcccggcccaacagaggagagggccgatggggggccgcaacctggcggcagcgcaaaagatg

SEQ ID NO: 229774 - DNA, 103 bp, Artificial Sequence
  Synthetic Polynucleotide
taatacgactcactatagggcccaatcaggtcatcctcggggctccccataacagaggagaatggggatgcccgaggataacctggcggcagcgcaaaagatg

SEQ ID NO: 229775 - DNA, 103 bp, Artificial Sequence
  Synthetic Polynucleotide
taatacgactcactatagggcgtccggatggtgaggtcacataggtggccaacagaggagaggccacatgtgtgacctcaacctggcggcagcgcaaaagatg

SEQ ID NO: 229776 - DNA, 103 bp, Artificial Sequence
  Synthetic Polynucleotide
taatacgactcactataggggcgtttgcgcaccagcttgtcttggctgtcaacagaggagagacagcatggacaagctgaacctggcggcagcgcaaaagatg

SEQ ID NO: 229777 - DNA, 103 bp, Artificial Sequence
  Synthetic Polynucleotide
taatacgactcactatagggtctgggagcggcgtttgcgcaccagcttgtaacagaggagaacaagcatgtgcgcaaacaacctggcggcagcgcaaaagatg

SEQ ID NO: 229778 - DNA, 103 bp, Artificial Sequence
  Synthetic Polynucleotide
taatacgactcactatagggtcctgaggcatctgggagcggcgtttgcgcaacagaggagagcgcaaatgccgctcccaaacctggcggcagcgcaaaagatg

SEQ ID NO: 229779 - DNA, 103 bp, Artificial Sequence
  Synthetic Polynucleotide
taatacgactcactataggggacagggcactcctgaggcatctgggagcgaacagaggagacgctccatgatgcctcagaacctggcggcagcgcaaaagatg

SEQ ID NO: 229780 - DNA, 103 bp, Artificial Sequence
  Synthetic Polynucleotide
taatacgactcactatagggtcttgtggcagacagggcactcctgaggcaaacagaggagatgcctcatgagtgccctgaacctggcggcagcgcaaaagatg

SEQ ID NO: 229781 - DNA, 103 bp, Artificial Sequence
  Synthetic Polynucleotide
taatacgactcactatagggccatggatgatcttgtggcagacagggcacaacagaggagagtgcccatgctgccacaaaacctggcggcagcgcaaaagatg

SEQ ID NO: 229782 - DNA, 103 bp, Artificial Sequence
  Synthetic Polynucleotide
taatacgactcactatagggtttgcctgccccatggatgatcttgtggcaaacagaggagatgccacatgatcatccataacctggcggcagcgcaaaagatg

SEQ ID NO: 229783 - DNA, 103 bp, Artificial Sequence
  Synthetic Polynucleotide
taatacgactcactatagggggcgaggcagtttgcctgccccatggatgaaacagaggagatcatccatggggcaggcaaacctggcggcagcgcaaaagatg

SEQ ID NO: 229784 - DNA, 103 bp, Artificial Sequence
  Synthetic Polynucleotide
taatacgactcactataggggtcctcatgtggcgaggcagtttgcctgccaacagaggagaggcaggatgactgcctcgaacctggcggcagcgcaaaagatg

SEQ ID NO: 229785 - DNA, 103 bp, Artificial Sequence
  Synthetic Polynucleotide
taatacgactcactataggggcctgtgtgggtcctcatgtggcgaggcagaacagaggagactgcctatgcacatgaggaacctggcggcagcgcaaaagatg

SEQ ID NO: 229786 - DNA, 103 bp, Artificial Sequence
  Synthetic Polynucleotide
taatacgactcactatagggcaaggccctgcgtccggatggtgaggtcacaacagaggagagtgaccatgccatccggaaacctggcggcagcgcaaaagatg

SEQ ID NO: 229787 - DNA, 103 bp, Artificial Sequence
  Synthetic Polynucleotide
taatacgactcactatagggagggcttctcgcctgtgtgggtcctcatgtaacagaggagaacatgaatgcccacacagaacctggcggcagcgcaaaagatg

SEQ ID NO: 229788 - DNA, 103 bp, Artificial Sequence
  Synthetic Polynucleotide
taatacgactcactatagggtcgcaggcaaagggcttctcgcctgtgtggaacagaggagaccacacatgcgagaagccaacctggcggcagcgcaaaagatg

SEQ ID NO: 229789 - DNA, 103 bp, Artificial Sequence
  Synthetic Polynucleotide
taatacgactcactatagggaccgcagacctcgcaggcaaagggcttctcaacagaggagagagaagatgtttgcctgcaacctggcggcagcgcaaaagatg

SEQ ID NO: 229790 - DNA, 103 bp, Artificial Sequence
  Synthetic Polynucleotide
taatacgactcactatagggtgaatcgaacaccgcagacctcgcaggcaaaacagaggagattgcctatgaggtctgcgaacctggcggcagcgcaaaagatg

SEQ ID NO: 229791 - DNA, 103 bp, Artificial Sequence
  Synthetic Polynucleotide
taatacgactcactatagggtcgttcctggtgaatcgaacaccgcagaccaacagaggagaggtctgatgtgttcgattaacctggcggcagcgcaaaagatg

SEQ ID NO: 229792 - DNA, 103 bp, Artificial Sequence
  Synthetic Polynucleotide
taatacgactcactatagggcttcagcttgtcgttcctggtgaatcgaacaacagaggagagttcgaatgaccaggaacaacctggcggcagcgcaaaagatg

SEQ ID NO: 229793 - DNA, 103 bp, Artificial Sequence
  Synthetic Polynucleotide
taatacgactcactataggggcatgtggatcttcagcttgtcgttcctggaacagaggagaccaggaatgacaagctgaaacctggcggcagcgcaaaagatg

SEQ ID NO: 229794 - DNA, 103 bp, Artificial Sequence
  Synthetic Polynucleotide
taatacgactcactataggggtgtgcttccgcatgtggatcttcagcttgaacagaggagacaagctatggatccacataacctggcggcagcgcaaaagatg

SEQ ID NO: 229795 - DNA, 103 bp, Artificial Sequence
  Synthetic Polynucleotide
taatacgactcactataggggcgctctcccgtgtgcttccgcatgtggataacagaggagaatccacatgcggaagcacaacctggcggcagcgcaaaagatg

SEQ ID NO: 229796 - DNA, 103 bp, Artificial Sequence
  Synthetic Polynucleotide
taatacgactcactatagggatgagtaggggcgctctcccgtgtgcttccaacagaggagaggaagcatgcgggagagcaacctggcggcagcgcaaaagatg

SEQ ID NO: 229797 - DNA, 103 bp, Artificial Sequence
  Synthetic Polynucleotide
taatacgactcactataggggtgcggtattcaaggccctgcgtccggatgaacagaggagacatccgatggcagggcctaacctggcggcagcgcaaaagatg

SEQ ID NO: 229798 - DNA, 103 bp, Artificial Sequence
  Synthetic Polynucleotide
taatacgactcactatagggcagtgcgggcatgagtaggggcgctctcccaacagaggagagggagaatgcccctactcaacctggcggcagcgcaaaagatg

SEQ ID NO: 229799 - DNA, 103 bp, Artificial Sequence
  Synthetic Polynucleotide
taatacgactcactataggggcgggctgggcagtgcgggcatgagtagggaacagaggagaccctacatgtgcccgcacaacctggcggcagcgcaaaagatg

SEQ ID NO: 229800 - DNA, 103 bp, Artificial Sequence
  Synthetic Polynucleotide
taatacgactcactatagggtgtgcaggaagcgggctgggcagtgcgggcaacagaggagagcccgcatggcccagcccaacctggcggcagcgcaaaagatg

SEQ ID NO: 229801 - DNA, 103 bp, Artificial Sequence
  Synthetic Polynucleotide
taatacgactcactatagggaggtcgtagctgtgcaggaagcgggctgggaacagaggagacccagcatgcttcctgcaaacctggcggcagcgcaaaagatg

SEQ ID NO: 229802 - DNA, 103 bp, Artificial Sequence
  Synthetic Polynucleotide
taatacgactcactataggggtggttcttgaggtcgtagctgtgcaggaaaacagaggagattcctgatgagctacgacaacctggcggcagcgcaaaagatg

SEQ ID NO: 229803 - DNA, 103 bp, Artificial Sequence
  Synthetic Polynucleotide
taatacgactcactataggggcaggtgcatgtggttcttgaggtcgtagcaacagaggagagctacgatgtcaagaaccaacctggcggcagcgcaaaagatg

SEQ ID NO: 229804 - DNA, 103 bp, Artificial Sequence
  Synthetic Polynucleotide
taatacgactcactatagggtcccctgtgtgcaggtgcatgtggttcttgaacagaggagacaagaaatgcatgcacctaacctggcggcagcgcaaaagatg

SEQ ID NO: 229805 - DNA, 103 bp, Artificial Sequence
  Synthetic Polynucleotide
taatacgactcactatagggatagggccggtcccctgtgtgcaggtgcataacagaggagaatgcacatgcacacagggaacctggcggcagcgcaaaagatg

SEQ ID NO: 229806 - DNA, 103 bp, Artificial Sequence
  Synthetic Polynucleotide
taatacgactcactatagggggtggcactcatagggccggtcccctgtgtaacagaggagaacacagatgaccggccctaacctggcggcagcgcaaaagatg

SEQ ID NO: 229807 - DNA, 103 bp, Artificial Sequence
  Synthetic Polynucleotide
taatacgactcactatagggttgtggcacaggtggcactcatagggccggaacagaggagaccggccatgtgagtgccaaacctggcggcagcgcaaaagatg

SEQ ID NO: 229808 - DNA, 103 bp, Artificial Sequence
  Synthetic Polynucleotide
taatacgactcactatagggagccctgtgggtgcggtattcaaggccctgaacagaggagacagggcatggaataccgcaacctggcggcagcgcaaaagatg

SEQ ID NO: 229809 - DNA, 103 bp, Artificial Sequence
  Synthetic Polynucleotide
taatacgactcactatagggggcgaaagccttgtggcacaggtggcactcaacagaggagagagtgcatgctgtgccacaacctggcggcagcgcaaaagatg

SEQ ID NO: 229810 - DNA, 103 bp, Artificial Sequence
  Synthetic Polynucleotide
taatacgactcactatagggggtcctccttggcgaaagccttgtggcacaaacagaggagatgtgccatgaggctttcgaacctggcggcagcgcaaaagatg

SEQ ID NO: 229811 - DNA, 103 bp, Artificial Sequence
  Synthetic Polynucleotide
taatacgactcactatagggcgctgcaggtggtcctccttggcgaaagccaacagaggagaggctttatgcaaggaggaaacctggcggcagcgcaaaagatg

SEQ ID NO: 229812 - DNA, 103 bp, Artificial Sequence
  Synthetic Polynucleotide
taatacgactcactatagggtttgaggtggcgctgcaggtggtcctccttaacagaggagaaaggagatgcacctgcagaacctggcggcagcgcaaaagatg

SEQ ID NO: 229813 - DNA, 103 bp, Artificial Sequence
  Synthetic Polynucleotide
taatacgactcactatagggagttctggcctttgaggtggcgctgcaggtaacagaggagaacctgcatggccacctcaaacctggcggcagcgcaaaagatg

SEQ ID NO: 229814 - DNA, 103 bp, Artificial Sequence
  Synthetic Polynucleotide
taatacgactcactatagggacctccaggcagttctggcctttgaggtggaacagaggagaccacctatgaggccagaaaacctggcggcagcgcaaaagatg

SEQ ID NO: 229815 - DNA, 103 bp, Artificial Sequence
  Synthetic Polynucleotide
taatacgactcactatagggtcgggtgcgcacctccaggcagttctggccaacagaggagaggccagatgtgcctggagaacctggcggcagcgcaaaagatg

SEQ ID NO: 229816 - DNA, 103 bp, Artificial Sequence
  Synthetic Polynucleotide
taatacgactcactatagggtgcggcgccgtcgggtgcgcacctccaggcaacagaggagagcctggatgtgcgcacccaacctggcggcagcgcaaaagatg

SEQ ID NO: 229817 - DNA, 103 bp, Artificial Sequence
  Synthetic Polynucleotide
taatacgactcactataggggcatcgtccttgcggcgccgtcgggtgcgcaacagaggagagcgcacatgacggcgccgaacctggcggcagcgcaaaagatg

SEQ ID NO: 229818 - DNA, 103 bp, Artificial Sequence
  Synthetic Polynucleotide
taatacgactcactataggggtggggtggtgcatcgtccttgcggcgccgaacagaggagacggcgcatgaaggacgataacctggcggcagcgcaaaagatg

SEQ ID NO: 229819 - DNA, 103 bp, Artificial Sequence
  Synthetic Polynucleotide
taatacgactcactatagggcagctagcacagccctgtgggtgcggtattaacagaggagaaataccatgcccacagggaacctggcggcagcgcaaaagatg

SEQ ID NO: 229820 - DNA, 103 bp, Artificial Sequence
  Synthetic Polynucleotide
taatacgactcactataggggtggtgggtagtggggtggtgcatcgtcctaacagaggagaaggacgatgcaccaccccaacctggcggcagcgcaaaagatg

SEQ ID NO: 229821 - DNA, 103 bp, Artificial Sequence
  Synthetic Polynucleotide
taatacgactcactataggggcggtagagggtggtgggtagtggggtggtaacagaggagaaccaccatgctacccaccaacctggcggcagcgcaaaagatg

SEQ ID NO: 229822 - DNA, 103 bp, Artificial Sequence
  Synthetic Polynucleotide
taatacgactcactatagggggatgcagcagcggtagagggtggtgggtaaacagaggagatacccaatgccctctaccaacctggcggcagcgcaaaagatg

SEQ ID NO: 229823 - DNA, 103 bp, Artificial Sequence
  Synthetic Polynucleotide
taatacgactcactatagggggccagcgggggatgcagcagcggtagaggaacagaggagacctctaatgctgctgcataacctggcggcagcgcaaaagatg

SEQ ID NO: 229824 - DNA, 103 bp, Artificial Sequence
  Synthetic Polynucleotide
taatacgactcactataggggagaggtcgaggccagcgggggatgcagcaaacagaggagatgctgcatgccccgctggaacctggcggcagcgcaaaagatg

SEQ ID NO: 229825 - DNA, 103 bp, Artificial Sequence
  Synthetic Polynucleotide
taatacgactcactataggggtggccattggagaggtcgaggccagcgggaacagaggagacccgctatgctcgacctcaacctggcggcagcgcaaaagatg

SEQ ID NO: 229826 - DNA, 103 bp, Artificial Sequence
  Synthetic Polynucleotide
taatacgactcactatagggaggtgtccaggtggccattggagaggtcgaaacagaggagatcgaccatgccaatggccaacctggcggcagcgcaaaagatg

SEQ ID NO: 229827 - DNA, 103 bp, Artificial Sequence
  Synthetic Polynucleotide
taatacgactcactataggggagaggcggaaggtgtccaggtggccattgaacagaggagacaatggatgcctggacacaacctggcggcagcgcaaaagatg

SEQ ID NO: 229828 - DNA, 103 bp, Artificial Sequence
  Synthetic Polynucleotide
taatacgactcactatagggtcgagctagagagaggcggaaggtgtccagaacagaggagactggacatgttccgcctcaacctggcggcagcgcaaaagatg

SEQ ID NO: 229829 - DNA, 103 bp, Artificial Sequence
  Synthetic Polynucleotide
taatacgactcactataggggctcccagaatcgagctagagagaggcggaaacagaggagatccgccatgctctagctcaacctggcggcagcgcaaaagatg

SEQ ID NO: 229830 - DNA, 103 bp, Artificial Sequence
  Synthetic Polynucleotide
taatacgactcactatagggtggctacaggcagctagcacagccctgtggaacagaggagaccacagatgtgtgctagcaacctggcggcagcgcaaaagatg

SEQ ID NO: 229831 - DNA, 103 bp, Artificial Sequence
  Synthetic Polynucleotide
taatacgactcactatagggggggctgactgctcccagaatcgagctagaaacagaggagatctagcatgattctgggaaacctggcggcagcgcaaaagatg

SEQ ID NO: 229832 - DNA, 103 bp, Artificial Sequence
  Synthetic Polynucleotide
taatacgactcactataggggggcccagtgggggctgactgctcccagaaaacagaggagattctggatgcagtcagccaacctggcggcagcgcaaaagatg

SEQ ID NO: 229833 - DNA, 103 bp, Artificial Sequence
  Synthetic Polynucleotide
taatacgactcactatagggtagagaccgggggcccagtgggggctgactaacagaggagaagtcagatgccactgggcaacctggcggcagcgcaaaagatg

SEQ ID NO: 229834 - DNA, 103 bp, Artificial Sequence
  Synthetic Polynucleotide
taatacgactcactatagggggccctggggtagagaccgggggcccagtgaacagaggagacactggatgcccggtctcaacctggcggcagcgcaaaagatg

SEQ ID NO: 229835 - DNA, 103 bp, Artificial Sequence
  Synthetic Polynucleotide
taatacgactcactataggggtcatcagggggccctggggtagagaccggaacagaggagaccggtcatgaccccagggaacctggcggcagcgcaaaagatg

SEQ ID NO: 229836 - DNA, 103 bp, Artificial Sequence
  Synthetic Polynucleotide
taatacgactcactatagggcctcctcatcgtcatcagggggccctggggaacagaggagaccccagatgcccctgatgaacctggcggcagcgcaaaagatg

SEQ ID NO: 229837 - DNA, 103 bp, Artificial Sequence
  Synthetic Polynucleotide
taatacgactcactatagggggtgccccttcctcctcatcgtcatcagggaacagaggagaccctgaatgcgatgaggaaacctggcggcagcgcaaaagatg

SEQ ID NO: 229838 - DNA, 103 bp, Artificial Sequence
  Synthetic Polynucleotide
taatacgactcactataggggggtgtggtgggtgccccttcctcctcatcaacagaggagagatgagatggaaggggcaaacctggcggcagcgcaaaagatg

SEQ ID NO: 229839 - DNA, 103 bp, Artificial Sequence
  Synthetic Polynucleotide
taatacgactcactatagggcttcagcctggggtgtggtgggtgccccttaacagaggagaaaggggatgccaccacacaacctggcggcagcgcaaaagatg

SEQ ID NO: 229840 - DNA, 103 bp, Artificial Sequence
  Synthetic Polynucleotide
taatacgactcactatagggtccatggcaccttcagcctggggtgtggtgaacagaggagacaccacatgccaggctgaaacctggcggcagcgcaaaagatg

SEQ ID NO: 229841 - DNA, 103 bp, Artificial Sequence
  Synthetic Polynucleotide
taatacgactcactatagggcttgaagtagtggctacaggcagctagcacaacagaggagagtgctaatggcctgtagcaacctggcggcagcgcaaaagatg

SEQ ID NO: 229842 - DNA, 103 bp, Artificial Sequence
  Synthetic Polynucleotide
taatacgactcactatagggttaagaggactccatggcaccttcagcctgaacagaggagacaggctatgggtgccatgaacctggcggcagcgcaaaagatg

SEQ ID NO: 229843 - DNA, 103 bp, Artificial Sequence
  Synthetic Polynucleotide
taatacgactcactatagggtgaaaagcttcttgaagtagtggctacaggaacagaggagacctgtaatgactacttcaaacctggcggcagcgcaaaagatg

SEQ ID NO: 229844 - DNA, 103 bp, Artificial Sequence
  Synthetic Polynucleotide
taatacgactcactatagggccgccctcagtgaaaagcttcttgaagtagaacagaggagactacttatggaagcttttaacctggcggcagcgcaaaagatg

SEQ ID NO: 229845 - DNA, 103 bp, Artificial Sequence
  Synthetic Polynucleotide
taatacgactcactatagggagctccgccaccgccctcagtgaaaagcttaacagaggagaaagcttatgactgagggcaacctggcggcagcgcaaaagatg

SEQ ID NO: 229846 - DNA, 103 bp, Artificial Sequence
  Synthetic Polynucleotide
taatacgactcactatagggggaatggaatcccaatcaggtcatcctcggaacagaggagaccgaggatgacctgattgaacctggcggcagcgcaaaagatg

SEQ ID NO: 229847 - DNA, 103 bp, Artificial Sequence
  Synthetic Polynucleotide
taatacgactcactatagggcccccatgacagctccgccaccgccctcagaacagaggagactgaggatggtggcggagaacctggcggcagcgcaaaagatg

SEQ ID NO: 229848 - DNA, 103 bp, Artificial Sequence
  Synthetic Polynucleotide
taatacgactcactatagggctacccccggcccccatgacagctccgccaaacagaggagatggcggatgtgtcatgggaacctggcggcagcgcaaaagatg

SEQ ID NO: 229849 - DNA, 103 bp, Artificial Sequence
  Synthetic Polynucleotide
taatacgactcactatagggggccgtcccgctacccccggcccccatgacaacagaggagagtcatgatggccgggggtaacctggcggcagcgcaaaagatg

SEQ ID NO: 229850 - DNA, 103 bp, Artificial Sequence
  Synthetic Polynucleotide
taatacgactcactatagggctcccccagtggccgtcccgctacccccggaacagaggagaccggggatggcgggacggaacctggcggcagcgcaaaagatg

SEQ ID NO: 229851 - DNA, 103 bp, Artificial Sequence
  Synthetic Polynucleotide
taatacgactcactatagggccggcccctgctcccccagtggccgtcccgaacagaggagacgggacatgcactgggggaacctggcggcagcgcaaaagatg

SEQ ID NO: 229852 - DNA, 103 bp, Artificial Sequence
  Synthetic Polynucleotide
taatacgactcactatagggctcacacacaccggcccctgctcccccagtaacagaggagaactgggatggcaggggccaacctggcggcagcgcaaaagatg

SEQ ID NO: 229853 - DNA, 103 bp, Artificial Sequence
  Synthetic Polynucleotide
taatacgactcactatagggcaaagtccagctcacacacaccggcccctgaacagaggagacaggggatggtgtgtgtgaacctggcggcagcgcaaaagatg

SEQ ID NO: 229854 - DNA, 103 bp, Artificial Sequence
  Synthetic Polynucleotide
taatacgactcactatagggtctggccctacaaagtccagctcacacacaaacagaggagatgtgtgatggctggacttaacctggcggcagcgcaaaagatg

SEQ ID NO: 229855 - DNA, 103 bp, Artificial Sequence
  Synthetic Polynucleotide
taatacgactcactataggggcctagtgcctctggccctacaaagtccagaacagaggagactggacatggtagggccaaacctggcggcagcgcaaaagatg

SEQ ID NO: 229856 - DNA, 103 bp, Artificial Sequence
  Synthetic Polynucleotide
taatacgactcactatagggcaaggagggcgcctagtgcctctggccctaaacagaggagatagggcatgaggcactagaacctggcggcagcgcaaaagatg

SEQ ID NO: 229857 - DNA, 103 bp, Artificial Sequence
  Synthetic Polynucleotide
taatacgactcactatagggctgtggtccgggaatggaatcccaatcaggaacagaggagacctgatatggattccattaacctggcggcagcgcaaaagatg

SEQ ID NO: 229858 - DNA, 103 bp, Artificial Sequence
  Synthetic Polynucleotide
taatacgactcactatagggtaggcaaattcaaggagggcgcctagtgccaacagaggagaggcactatgcgccctcctaacctggcggcagcgcaaaagatg

SEQ ID NO: 229859 - DNA, 103 bp, Artificial Sequence
  Synthetic Polynucleotide
taatacgactcactatagggtgtggctgtataggcaaattcaaggagggcaacagaggagagccctcatggaatttgccaacctggcggcagcgcaaaagatg

SEQ ID NO: 229860 - DNA, 103 bp, Artificial Sequence
  Synthetic Polynucleotide
taatacgactcactatagggtggtggtcagtgtggctgtataggcaaattaacagaggagaaatttgatgatacagccaaacctggcggcagcgcaaaagatg

SEQ ID NO: 229861 - DNA, 103 bp, Artificial Sequence
  Synthetic Polynucleotide
taatacgactcactatagggttggcgctgctggtggtcagtgtggctgtaaacagaggagatacagcatgactgaccacaacctggcggcagcgcaaaagatg

SEQ ID NO: 229862 - DNA, 103 bp, Artificial Sequence
  Synthetic Polynucleotide
taatacgactcactatagggagctggcatgttggcgctgctggtggtcagaacagaggagactgaccatgagcagcgccaacctggcggcagcgcaaaagatg

SEQ ID NO: 229863 - DNA, 103 bp, Artificial Sequence
  Synthetic Polynucleotide
taatacgactcactatagggcctggagcacagctggcatgttggcgctgcaacagaggagagcagcgatgacatgccagaacctggcggcagcgcaaaagatg

SEQ ID NO: 229864 - DNA, 103 bp, Artificial Sequence
  Synthetic Polynucleotide
taatacgactcactatagggaggcgggcagcctggagcacagctggcatgaacagaggagacatgccatgtgtgctccaaacctggcggcagcgcaaaagatg

SEQ ID NO: 229865 - DNA, 103 bp, Artificial Sequence
  Synthetic Polynucleotide
taatacgactcactataggggatctccagcaggcgggcagcctggagcacaacagaggagagtgctcatggctgcccgcaacctggcggcagcgcaaaagatg

SEQ ID NO: 229866 - DNA, 103 bp, Artificial Sequence
  Synthetic Polynucleotide
taatacgactcactatagggtgacacacgggatctccagcaggcgggcagaacagaggagactgcccatgtgctggagaaacctggcggcagcgcaaaagatg

SEQ ID NO: 229867 - DNA, 103 bp, Artificial Sequence
  Synthetic Polynucleotide
taatacgactcactatagggcaagcagcgatgacacacgggatctccagcaacagaggagagctggaatgcccgtgtgtaacctggcggcagcgcaaaagatg

SEQ ID NO: 229868 - DNA, 103 bp, Artificial Sequence
  Synthetic Polynucleotide
taatacgactcactataggggagctcactgctgtggtccgggaatggaataacagaggagaattccaatgccggaccacaacctggcggcagcgcaaaagatg

SEQ ID NO: 229869 - DNA, 103 bp, Artificial Sequence
  Synthetic Polynucleotide
taatacgactcactatagggaatctccatgcaagcagcgatgacacacggaacagaggagaccgtgtatgatcgctgctaacctggcggcagcgcaaaagatg

SEQ ID NO: 229870 - DNA, 103 bp, Artificial Sequence
  Synthetic Polynucleotide
taatacgactcactatagggtgccctgcagaatctccatgcaagcagcgaaacagaggagatcgctgatggcatggagaaacctggcggcagcgcaaaagatg

SEQ ID NO: 229871 - DNA, 103 bp, Artificial Sequence
  Synthetic Polynucleotide
taatacgactcactatagggtctagcccactgccctgcagaatctccatgaacagaggagacatggaatgtctgcagggaacctggcggcagcgcaaaagatg

SEQ ID NO: 229872 - DNA, 103 bp, Artificial Sequence
  Synthetic Polynucleotide
taatacgactcactataggggctgggagcttctagcccactgccctgcagaacagaggagactgcagatgagtgggctaaacctggcggcagcgcaaaagatg

SEQ ID NO: 229873 - DNA, 103 bp, Artificial Sequence
  Synthetic Polynucleotide
taatacgactcactatagggcctcgtccgggctgggagcttctagcccacaacagaggagagtgggcatgaagctcccaaacctggcggcagcgcaaaagatg

SEQ ID NO: 229874 - DNA, 103 bp, Artificial Sequence
  Synthetic Polynucleotide
taatacgactcactatagggtcacagtcatcctcgtccgggctgggagctaacagaggagaagctccatgcccggacgaaacctggcggcagcgcaaaagatg

SEQ ID NO: 229875 - DNA, 103 bp, Artificial Sequence
  Synthetic Polynucleotide
taatacgactcactataggggcgggctcgctcacagtcatcctcgtccggaacagaggagaccggacatggatgactgtaacctggcggcagcgcaaaagatg

SEQ ID NO: 229876 - DNA, 103 bp, Artificial Sequence
  Synthetic Polynucleotide
taatacgactcactatagggccagatactggcgggctcgctcacagtcataacagaggagaatgactatgagcgagcccaacctggcggcagcgcaaaagatg

SEQ ID NO: 229877 - DNA, 103 bp, Artificial Sequence
  Synthetic Polynucleotide
taatacgactcactataggggcaaaggcctccagatactggcgggctcgcaacagaggagagcgagcatgccagtatctaacctggcggcagcgcaaaagatg

SEQ ID NO: 229878 - DNA, 103 bp, Artificial Sequence
  Synthetic Polynucleotide
taatacgactcactatagggcgtggctgtggcaaaggcctccagatactgaacagaggagacagtatatggaggcctttaacctggcggcagcgcaaaagatg

SEQ ID NO: 229879 - DNA, 103 bp, Artificial Sequence
  Synthetic Polynucleotide
taatacgactcactatagggggcagctcaggagctcactgctgtggtccgaacagaggagacggaccatggcagtgagcaacctggcggcagcgcaaaagatg

SEQ ID NO: 229880 - DNA, 103 bp, Artificial Sequence
  Synthetic Polynucleotide
taatacgactcactatagggctccagaggccgtggctgtggcaaaggcctaacagaggagaaggcctatgccacagccaaacctggcggcagcgcaaaagatg

SEQ ID NO: 229881 - DNA, 103 bp, Artificial Sequence
  Synthetic Polynucleotide
taatacgactcactatagggccattgggaactccagaggccgtggctgtgaacagaggagacacagcatgggcctctggaacctggcggcagcgcaaaagatg

SEQ ID NO: 229882 - DNA, 103 bp, Artificial Sequence
  Synthetic Polynucleotide
taatacgactcactatagggactgtcttcaccattgggaactccagaggcaacagaggagagcctctatggttcccaataacctggcggcagcgcaaaagatg

SEQ ID NO: 229883 - DNA, 103 bp, Artificial Sequence
  Synthetic Polynucleotide
taatacgactcactatagggcctgtggaggactgtcttcaccattgggaaaacagaggagattcccaatggtgaagacaaacctggcggcagcgcaaaagatg

SEQ ID NO: 229884 - DNA, 103 bp, Artificial Sequence
  Synthetic Polynucleotide
taatacgactcactataggggggaggggcacctgtggaggactgtcttcaaacagaggagatgaagaatgtcctccacaaacctggcggcagcgcaaaagatg

SEQ ID NO: 229885 - DNA, 103 bp, Artificial Sequence
  Synthetic Polynucleotide
taatacgactcactatagggcggaggtggtgggaggggcacctgtggaggaacagaggagacctccaatggtgcccctcaacctggcggcagcgcaaaagatg

SEQ ID NO: 229886 - DNA, 103 bp, Artificial Sequence
  Synthetic Polynucleotide
taatacgactcactataggggtggcggtggcggaggtggtgggaggggcaaacagaggagatgccccatgcaccacctcaacctggcggcagcgcaaaagatg

SEQ ID NO: 229887 - DNA, 103 bp, Artificial Sequence
  Synthetic Polynucleotide
taatacgactcactatagggacaggccgaggtggcggtggcggaggtggtaacagaggagaaccaccatggccaccgccaacctggcggcagcgcaaaagatg

SEQ ID NO: 229888 - DNA, 103 bp, Artificial Sequence
  Synthetic Polynucleotide
taatacgactcactataggggcggcgggcaacaggccgaggtggcggtggaacagaggagaccaccgatgcctcggcctaacctggcggcagcgcaaaagatg

SEQ ID NO: 229889 - DNA, 103 bp, Artificial Sequence
  Synthetic Polynucleotide
taatacgactcactataggggcttgcggctgcggcgggcaacaggccgagaacagaggagactcggcatgttgcccgccaacctggcggcagcgcaaaagatg

SEQ ID NO: 229890 - DNA, 103 bp, Artificial Sequence
  Synthetic Polynucleotide
taatacgactcactatagggtgctcattgaggcagctcaggagctcactgaacagaggagacagtgaatgcctgagctgaacctggcggcagcgcaaaagatg

SEQ ID NO: 229891 - DNA, 103 bp, Artificial Sequence
  Synthetic Polynucleotide
taatacgactcactataggggctttccggggcttgcggctgcggcgggcaaacagaggagatgcccgatgcagccgcaaaacctggcggcagcgcaaaagatg

SEQ ID NO: 229892 - DNA, 103 bp, Artificial Sequence
  Synthetic Polynucleotide
taatacgactcactatagggttgcaggaaagctttccggggcttgcggctaacagaggagaagccgcatgccccggaaaaacctggcggcagcgcaaaagatg

SEQ ID NO: 229893 - DNA, 103 bp, Artificial Sequence
  Synthetic Polynucleotide
taatacgactcactatagggcccccttggtttgcaggaaagctttccgggaacagaggagacccggaatgctttcctgcaacctggcggcagcgcaaaagatg

SEQ ID NO: 229894 - DNA, 103 bp, Artificial Sequence
  Synthetic Polynucleotide
taatacgactcactatagggtttgctctggcccccttggtttgcaggaaaaacagaggagatttcctatgaaccaagggaacctggcggcagcgcaaaagatg

SEQ ID NO: 229895 - DNA, 103 bp, Artificial Sequence
  Synthetic Polynucleotide
taatacgactcactataggggactaggtggtttgctctggcccccttggtaacagaggagaaccaagatggccagagcaaacctggcggcagcgcaaaagatg

SEQ ID NO: 229896 - DNA, 103 bp, Artificial Sequence
  Synthetic Polynucleotide
taatacgactcactataggggcacctcagggactaggtggtttgctctggaacagaggagaccagagatgaccacctagaacctggcggcagcgcaaaagatg

SEQ ID NO: 229897 - DNA, 103 bp, Artificial Sequence
  Synthetic Polynucleotide
taatacgactcactatagggggcactgtgggcacctcagggactaggtggaacagaggagaccacctatgccctgaggtaacctggcggcagcgcaaaagatg

SEQ ID NO: 229898 - DNA, 103 bp, Artificial Sequence
  Synthetic Polynucleotide
taatacgactcactataggggggatgggcgggcactgtgggcacctcaggaacagaggagacctgagatgcccacagtgaacctggcggcagcgcaaaagatg

SEQ ID NO: 229899 - DNA, 103 bp, Artificial Sequence
  Synthetic Polynucleotide
taatacgactcactatagggcataggtcaagggatgggcgggcactgtggaacagaggagaccacagatgccgcccatcaacctggcggcagcgcaaaagatg

SEQ ID NO: 229900 - DNA, 103 bp, Artificial Sequence
  Synthetic Polynucleotide
taatacgactcactatagggtcctcctcctcataggtcaagggatgggcgaacagaggagacgcccaatgcttgacctaaacctggcggcagcgcaaaagatg

SEQ ID NO: 229901 - DNA, 103 bp, Artificial Sequence
  Synthetic Polynucleotide
taatacgactcactatagggcagctggcgctgctcattgaggcagctcagaacagaggagactgagcatgctcaatgagaacctggcggcagcgcaaaagatg

SEQ ID NO: 229902 - DNA, 103 bp, Artificial Sequence
  Synthetic Polynucleotide
taatacgactcactataggggcccgccacctcctcctcctcataggtcaaaacagaggagattgaccatggaggaggagaacctggcggcagcgcaaaagatg

SEQ ID NO: 229903 - DNA, 103 bp, Artificial Sequence
  Synthetic Polynucleotide
taatacgactcactatagggtgcccactctgcccgccacctcctcctcctaacagaggagaaggaggatgaggtggcggaacctggcggcagcgcaaaagatg

SEQ ID NO: 229904 - DNA, 103 bp, Artificial Sequence
  Synthetic Polynucleotide
taatacgactcactatagggcccccactgctgcccactctgcccgccaccaacagaggagaggtggcatgcagagtgggaacctggcggcagcgcaaaagatg

SEQ ID NO: 229905 - DNA, 103 bp, Artificial Sequence
  Synthetic Polynucleotide
taatacgactcactatagggcggcccactgcccccactgctgcccactctaacagaggagaagagtgatgagcagtgggaacctggcggcagcgcaaaagatg

SEQ ID NO: 229906 - DNA, 103 bp, Artificial Sequence
  Synthetic Polynucleotide
taatacgactcactatagggagctgtcccccggcccactgcccccactgcaacagaggagagcagtgatggcagtgggcaacctggcggcagcgcaaaagatg

SEQ ID NO: 229907 - DNA, 103 bp, Artificial Sequence
  Synthetic Polynucleotide
taatacgactcactatagggggagggctgtagctgtcccccggcccactgaacagaggagacagtggatggggggacagaacctggcggcagcgcaaaagatg

SEQ ID NO: 229908 - DNA, 103 bp, Artificial Sequence
  Synthetic Polynucleotide
taatacgactcactatagggagttcctgtgggagggctgtagctgtccccaacagaggagaggggacatgtacagccctaacctggcggcagcgcaaaagatg

SEQ ID NO: 229909 - DNA, 103 bp, Artificial Sequence
  Synthetic Polynucleotide
taatacgactcactataggggaggggaggcagttcctgtgggagggctgtaacagaggagaacagccatgccacaggaaaacctggcggcagcgcaaaagatg

SEQ ID NO: 229910 - DNA, 103 bp, Artificial Sequence
  Synthetic Polynucleotide
taatacgactcactatagggggaccctcaggaggggaggcagttcctgtgaacagaggagacacaggatgtgcctccccaacctggcggcagcgcaaaagatg

SEQ ID NO: 229911 - DNA, 103 bp, Artificial Sequence
  Synthetic Polynucleotide
taatacgactcactataggggtagctctggggaccctcaggaggggaggcaacagaggagagcctccatgcctgagggtaacctggcggcagcgcaaaagatg

SEQ ID NO: 229912 - DNA, 103 bp, Artificial Sequence
  Synthetic Polynucleotide
taatacgactcactatagggataggtggcccagctggcgctgctcattgaaacagaggagatcaatgatgagcgccagcaacctggcggcagcgcaaaagatg

SEQ ID NO: 229913 - DNA, 103 bp, Artificial Sequence
  Synthetic Polynucleotide
taatacgactcactatagggcatagggttcgtagctctggggaccctcagaacagaggagactgaggatgcccagagctaacctggcggcagcgcaaaagatg

SEQ ID NO: 229914 - DNA, 103 bp, Artificial Sequence
  Synthetic Polynucleotide
taatacgactcactatagggtcctcaccctcatagggttcgtagctctggaacagaggagaccagagatgcgaaccctaaacctggcggcagcgcaaaagatg

SEQ ID NO: 229915 - DNA, 103 bp, Artificial Sequence
  Synthetic Polynucleotide
taatacgactcactatagggctcttcttcttcctcaccctcatagggttcaacagaggagagaacccatggagggtgagaacctggcggcagcgcaaaagatg

SEQ ID NO: 229916 - DNA, 103 bp, Artificial Sequence
  Synthetic Polynucleotide
taatacgactcactatagggataccagctcctcttcttcttcctcaccctaacagaggagaagggtgatgaagaagaagaacctggcggcagcgcaaaagatg

SEQ ID NO: 229917 - DNA, 103 bp, Artificial Sequence
  Synthetic Polynucleotide
taatacgactcactataggggctgggggatataccagctcctcttcttctaacagaggagaagaagaatgggagctggtaacctggcggcagcgcaaaagatg

SEQ ID NO: 229918 - DNA, 103 bp, Artificial Sequence
  Synthetic Polynucleotide
taatacgactcactatagggcagcccataggctgggggatataccagctcaacagaggagagagctgatgtatcccccaaacctggcggcagcgcaaaagatg

SEQ ID NO: 229919 - DNA, 103 bp, Artificial Sequence
  Synthetic Polynucleotide
taatacgactcactatagggcaccctgcgccagcccataggctgggggataacagaggagaatccccatgcctatgggcaacctggcggcagcgcaaaagatg

SEQ ID NO: 229920 - DNA, 103 bp, Artificial Sequence
  Synthetic Polynucleotide
taatacgactcactataggggggggcccgccaccctgcgccagcccatagaacagaggagactatggatgggcgcagggaacctggcggcagcgcaaaagatg

SEQ ID NO: 229921 - DNA, 103 bp, Artificial Sequence
  Synthetic Polynucleotide
taatacgactcactatagggtggggacagcgggggcccgccaccctgcgcaacagaggagagcgcagatgggcgggcccaacctggcggcagcgcaaaagatg

SEQ ID NO: 229922 - DNA, 103 bp, Artificial Sequence
  Synthetic Polynucleotide
taatacgactcactatagggccagctcctctggggacagcgggggcccgcaacagaggagagcgggcatgcgctgtcccaacctggcggcagcgcaaaagatg

SEQ ID NO: 229923 - DNA, 103 bp, Artificial Sequence
  Synthetic Polynucleotide
taatacgactcactataggggtgaggtcacataggtggcccagctggcgcaacagaggagagcgccaatggggccacctaacctggcggcagcgcaaaagatg

SEQ ID NO: 229924 - DNA, 103 bp, Artificial Sequence
  Synthetic Polynucleotide
taatacgactcactatagggtcatctgagcccagctcctctggggacagcaacagaggagagctgtcatgagaggagctaacctggcggcagcgcaaaagatg

SEQ ID NO: 229925 - DNA, 103 bp, Artificial Sequence
  Synthetic Polynucleotide
taatacgactcactataggggatggcatcctcatctgagcccagctcctcaacagaggagagaggagatgggctcagataacctggcggcagcgcaaaagatg

SEQ ID NO: 229926 - DNA, 103 bp, Artificial Sequence
  Synthetic Polynucleotide
taatacgactcactatagggggtcaggatcgatggcatcctcatctgagcaacagaggagagctcagatgaggatgccaaacctggcggcagcgcaaaagatg

SEQ ID NO: 229927 - DNA, 103 bp, Artificial Sequence
  Synthetic Polynucleotide
taatacgactcactatagggtaggccatcaggtcaggatcgatggcatccaacagaggagaggatgcatgcgatcctgaaacctggcggcagcgcaaaagatg

SEQ ID NO: 229928 - DNA, 103 bp, Artificial Sequence
  Synthetic Polynucleotide
taatacgactcactatagggggagcttaggtaggccatcaggtcaggatcaacagaggagagatcctatgctgatggccaacctggcggcagcgcaaaagatg

SEQ ID NO: 229929 - DNA, 103 bp, Artificial Sequence
  Synthetic Polynucleotide
taatacgactcactatagggcctggtgcagggagcttaggtaggccatcaaacagaggagatgatggatgacctaagctaacctggcggcagcgcaaaagatg

SEQ ID NO: 229930 - DNA, 103 bp, Artificial Sequence
  Synthetic Polynucleotide
taatacgactcactataggggccaggttgtcctggtgcagggagcttaggaacagaggagacctaagatgcctgcaccaaacctggcggcagcgcaaaagatg

SEQ ID NO: 229931 - DNA, 103 bp, Artificial Sequence
  Synthetic Polynucleotide
taatacgactcactatagggcaggcctggtgccaggttgtcctggtgcagaacagaggagactgcacatggacaacctgaacctggcggcagcgcaaaagatg

SEQ ID NO: 229932 - DNA, 103 bp, Artificial Sequence
  Synthetic Polynucleotide
taatacgactcactatagggcttggctgtccaggcctggtgccaggttgtaacagaggagaacaaccatgcaccaggccaacctggcggcagcgcaaaagatg

SEQ ID NO: 229933 - DNA, 103 bp, Artificial Sequence
  Synthetic Polynucleotide
taatacgactcactatagggaccagcttgtcttggctgtccaggcctggtaacagaggagaaccaggatgggacagccaaacctggcggcagcgcaaaagatg

SEQ ID NO: 229934 - DNA, 103 bp, Artificial Sequence
  Synthetic Polynucleotide
taatacgactcactatagggcggcgggggggtcccgggcgcggcctccataacagaggagaatggagatggcgcccgggaacctggcggcagcgcaaaagatg

SEQ ID NO: 229935 - DNA, 103 bp, Artificial Sequence
  Synthetic Polynucleotide
taatacgactcactatagggggtggccgggcgggcgtcgggggaacacggaacagaggagaccgtgtatgcccgacgccaacctggcggcagcgcaaaagatg

SEQ ID NO: 229936 - DNA, 103 bp, Artificial Sequence
  Synthetic Polynucleotide
taatacgactcactatagggacccattcctttccctcgacctcgggagccaacagaggagaggctccatgggtcgagggaacctggcggcagcgcaaaagatg

SEQ ID NO: 229937 - DNA, 103 bp, Artificial Sequence
  Synthetic Polynucleotide
taatacgactcactatagggctcggccccgacccattcctttccctcgacaacagaggagagtcgagatgaaggaatggaacctggcggcagcgcaaaagatg

SEQ ID NO: 229938 - DNA, 103 bp, Artificial Sequence
  Synthetic Polynucleotide
taatacgactcactatagggccacctcggcctcggccccgacccattcctaacagaggagaaggaatatgtcggggccgaacctggcggcagcgcaaaagatg

SEQ ID NO: 229939 - DNA, 103 bp, Artificial Sequence
  Synthetic Polynucleotide
taatacgactcactatagggtcctcggctgccacctcggcctcggccccgaacagaggagacggggcatgggccgaggtaacctggcggcagcgcaaaagatg

SEQ ID NO: 229940 - DNA, 103 bp, Artificial Sequence
  Synthetic Polynucleotide
taatacgactcactatagggtgttcatccctcctcggctgccacctcggcaacagaggagagccgagatggcagccgagaacctggcggcagcgcaaaagatg

SEQ ID NO: 229941 - DNA, 103 bp, Artificial Sequence
  Synthetic Polynucleotide
taatacgactcactatagggattccgcccttgttcatccctcctcggctgaacagaggagacagccgatgagggatgaaaacctggcggcagcgcaaaagatg

SEQ ID NO: 229942 - DNA, 103 bp, Artificial Sequence
  Synthetic Polynucleotide
taatacgactcactataggggtcatcgttcattccgcccttgttcatcccaacagaggagagggatgatgaagggcggaaacctggcggcagcgcaaaagatg

SEQ ID NO: 229943 - DNA, 103 bp, Artificial Sequence
  Synthetic Polynucleotide
taatacgactcactatagggagaagtcttcgtcatcgttcattccgccctaacagaggagaagggcgatgtgaacgatgaacctggcggcagcgcaaaagatg

SEQ ID NO: 229944 - DNA, 103 bp, Artificial Sequence
  Synthetic Polynucleotide
taatacgactcactatagggtcctcgtcatagaagtcttcgtcatcgttcaacagaggagagaacgaatgcgaagacttaacctggcggcagcgcaaaagatg

SEQ ID NO: 229945 - DNA, 103 bp, Artificial Sequence
  Synthetic Polynucleotide
taatacgactcactataggggtcgcccatgtcctcgtcatagaagtcttcaacagaggagagaagacatgtatgacgagaacctggcggcagcgcaaaagatg

SEQ ID NO: 229946 - DNA, 103 bp, Artificial Sequence
  Synthetic Polynucleotide
taatacgactcactatagggggaggtgcggggtggccgggcgggcgtcggaacagaggagaccgacgatggcccggccaaacctggcggcagcgcaaaagatg

SEQ ID NO: 229947 - DNA, 103 bp, Artificial Sequence
  Synthetic Polynucleotide
taatacgactcactatagggcaccaccaccgtcgcccatgtcctcgtcataacagaggagaatgacgatgacatgggcgaacctggcggcagcgcaaaagatg

SEQ ID NO: 229948 - DNA, 103 bp, Artificial Sequence
  Synthetic Polynucleotide
taatacgactcactatagggcggtagcttccaccaccaccgtcgcccatgaacagaggagacatgggatgcggtggtggaacctggcggcagcgcaaaagatg

SEQ ID NO: 229949 - DNA, 103 bp, Artificial Sequence
  Synthetic Polynucleotide
taatacgactcactataggggtcacgactccggtagcttccaccaccaccaacagaggagaggtggtatgggaagctacaacctggcggcagcgcaaaagatg

SEQ ID NO: 229950 - DNA, 103 bp, Artificial Sequence
  Synthetic Polynucleotide
taatacgactcactataggggcttgtcatggtcacgactccggtagcttcaacagaggagagaagctatgggagtcgtgaacctggcggcagcgcaaaagatg

SEQ ID NO: 229951 - DNA, 103 bp, Artificial Sequence
  Synthetic Polynucleotide
taatacgactcactatagggtgctggtggggcttgtcatggtcacgactcaacagaggagagagtcgatgccatgacaaaacctggcggcagcgcaaaagatg

SEQ ID NO: 229952 - DNA, 103 bp, Artificial Sequence
  Synthetic Polynucleotide
taatacgactcactatagggcttgtccgactgctggtggggcttgtcatgaacagaggagacatgacatgccccaccagaacctggcggcagcgcaaaagatg

SEQ ID NO: 229953 - DNA, 103 bp, Artificial Sequence
  Synthetic Polynucleotide
taatacgactcactatagggctttgcctttcttgtccgactgctggtgggaacagaggagacccaccatgagtcggacaaacctggcggcagcgcaaaagatg

SEQ ID NO: 229954 - DNA, 103 bp, Artificial Sequence
  Synthetic Polynucleotide
taatacgactcactatagggttgcaaatgactttgcctttcttgtccgacaacagaggagagtcggaatggaaaggcaaaacctggcggcagcgcaaaagatg

SEQ ID NO: 229955 - DNA, 103 bp, Artificial Sequence
  Synthetic Polynucleotide
taatacgactcactatagggcacgaagtacttgcaaatgactttgcctttaacagaggagaaaaggcatggtcatttgcaacctggcggcagcgcaaaagatg

SEQ ID NO: 229956 - DNA, 103 bp, Artificial Sequence
  Synthetic Polynucleotide
taatacgactcactatagggagcgcccttccacgaagtacttgcaaatgaaacagaggagatcatttatgagtacttcgaacctggcggcagcgcaaaagatg

SEQ ID NO: 229957 - DNA, 103 bp, Artificial Sequence
  Synthetic Polynucleotide
taatacgactcactatagggcggtggtggaggaggtgcggggtggccgggaacagaggagacccggcatgcccgcacctaacctggcggcagcgcaaaagatg

SEQ ID NO: 229958 - DNA, 103 bp, Artificial Sequence
  Synthetic Polynucleotide
taatacgactcactatagggccccaggtgcagcgcccttccacgaagtacaacagaggagagtacttatgggaagggcgaacctggcggcagcgcaaaagatg

SEQ ID NO: 229959 - DNA, 103 bp, Artificial Sequence
  Synthetic Polynucleotide
taatacgactcactatagggacagtggtctccccaggtgcagcgcccttcaacagaggagagaagggatgtgcacctggaacctggcggcagcgcaaaagatg

SEQ ID NO: 229960 - DNA, 103 bp, Artificial Sequence
  Synthetic Polynucleotide
taatacgactcactatagggggctaaaattacagtggtctccccaggtgcaacagaggagagcacctatggagaccactaacctggcggcagcgcaaaagatg

SEQ ID NO: 229961 - DNA, 103 bp, Artificial Sequence
  Synthetic Polynucleotide
taatacgactcactatagggtcgatgtcatggctaaaattacagtggtctaacagaggagaagaccaatgtaattttagaacctggcggcagcgcaaaagatg

SEQ ID NO: 229962 - DNA, 103 bp, Artificial Sequence
  Synthetic Polynucleotide
taatacgactcactatagggctttgggagttcgatgtcatggctaaaattaacagaggagaaattttatgcatgacatcaacctggcggcagcgcaaaagatg

SEQ ID NO: 229963 - DNA, 103 bp, Artificial Sequence
  Synthetic Polynucleotide
taatacgactcactataggggttctcgcttctttgggagttcgatgtcataacagaggagaatgacaatgaactcccaaaacctggcggcagcgcaaaagatg

SEQ ID NO: 229964 - DNA, 103 bp, Artificial Sequence
  Synthetic Polynucleotide
taatacgactcactatagggaacttgcacagttctcgcttctttgggagtaacagaggagaactcccatggaagcgagaaacctggcggcagcgcaaaagatg

SEQ ID NO: 229965 - DNA, 103 bp, Artificial Sequence
  Synthetic Polynucleotide
taatacgactcactatagggagtgatgtaaaacttgcacagttctcgcttaacagaggagaaagcgaatgctgtgcaagaacctggcggcagcgcaaaagatg

SEQ ID NO: 229966 - DNA, 103 bp, Artificial Sequence
  Synthetic Polynucleotide
taatacgactcactatagggcgcaaaatccagtgatgtaaaacttgcacaaacagaggagatgtgcaatgtttacatcaaacctggcggcagcgcaaaagatg

SEQ ID NO: 229967 - DNA, 103 bp, Artificial Sequence
  Synthetic Polynucleotide
taatacgactcactatagggtcagctctggcgcaaaatccagtgatgtaaaacagaggagattacatatgtggattttgaacctggcggcagcgcaaaagatg

SEQ ID NO: 229968 - DNA, 103 bp, Artificial Sequence
  Synthetic Polynucleotide
taatacgactcactataggggagcgggaggcggtggtggaggaggtgcggaacagaggagaccgcacatgctccaccacaacctggcggcagcgcaaaagatg

SEQ ID NO: 229969 - DNA, 103 bp, Artificial Sequence
  Synthetic Polynucleotide
taatacgactcactatagggagggcagttctcagctctggcgcaaaatccaacagaggagaggatttatggccagagctaacctggcggcagcgcaaaagatg

SEQ ID NO: 229970 - DNA, 103 bp, Artificial Sequence
  Synthetic Polynucleotide
taatacgactcactatagggcgtgcatataagggcagttctcagctctggaacagaggagaccagagatgagaactgccaacctggcggcagcgcaaaagatg

SEQ ID NO: 229971 - DNA, 103 bp, Artificial Sequence
  Synthetic Polynucleotide
taatacgactcactataggggggaaatcaccgtgcatataagggcagttcaacagaggagagaactgatgttatatgcaaacctggcggcagcgcaaaagatg

SEQ ID NO: 229972 - DNA, 103 bp, Artificial Sequence
  Synthetic Polynucleotide
taatacgactcactatagggcagcttacacgggaaatcaccgtgcatataaacagaggagatatatgatgggtgatttcaacctggcggcagcgcaaaagatg

SEQ ID NO: 229973 - DNA, 103 bp, Artificial Sequence
  Synthetic Polynucleotide
taatacgactcactatagggtggtgtggtacagcttacacgggaaatcacaacagaggagagtgattatgcgtgtaagcaacctggcggcagcgcaaaagatg

SEQ ID NO: 229974 - DNA, 103 bp, Artificial Sequence
  Synthetic Polynucleotide
taatacgactcactatagggcagttcccagtggtgtggtacagcttacacaacagaggagagtgtaaatggtaccacacaacctggcggcagcgcaaaagatg

SEQ ID NO: 229975 - DNA, 103 bp, Artificial Sequence
  Synthetic Polynucleotide
taatacgactcactatagggaccattgatgcagttcccagtggtgtggtaaacagaggagataccacatgactgggaacaacctggcggcagcgcaaaagatg

SEQ ID NO: 229976 - DNA, 103 bp, Artificial Sequence
  Synthetic Polynucleotide
taatacgactcactatagggtgcagtcgtcaccattgatgcagttcccagaacagaggagactgggaatggcatcaatgaacctggcggcagcgcaaaagatg

SEQ ID NO: 229977 - DNA, 103 bp, Artificial Sequence
  Synthetic Polynucleotide
taatacgactcactatagggtgggaaaacatgcagtcgtcaccattgatgaacagaggagacatcaaatgtgacgactgaacctggcggcagcgcaaaagatg

SEQ ID NO: 229978 - DNA, 103 bp, Artificial Sequence
  Synthetic Polynucleotide
taatacgactcactatagggcagagggtcgtgggaaaacatgcagtcgtcaacagaggagagacgacatgatgttttccaacctggcggcagcgcaaaagatg

SEQ ID NO: 229979 - DNA, 103 bp, Artificial Sequence
  Synthetic Polynucleotide
taatacgactcactatagggtgtcgtcagggagcgggaggcggtggtggaaacagaggagatccaccatggcctcccgcaacctggcggcagcgcaaaagatg

SEQ ID NO: 229980 - DNA, 103 bp, Artificial Sequence
  Synthetic Polynucleotide
taatacgactcactatagggtctcttcggtcagagggtcgtgggaaaacaaacagaggagatgttttatgacgaccctcaacctggcggcagcgcaaaagatg

SEQ ID NO: 229981 - DNA, 103 bp, Artificial Sequence
  Synthetic Polynucleotide
taatacgactcactatagggagctccctcgtctcttcggtcagagggtcgaacagaggagacgacccatggaccgaagaaacctggcggcagcgcaaaagatg

SEQ ID NO: 229982 - DNA, 103 bp, Artificial Sequence
  Synthetic Polynucleotide
taatacgactcactatagggcttatccaagagctccctcgtctcttcggtaacagaggagaaccgaaatgacgagggagaacctggcggcagcgcaaaagatg

SEQ ID NO: 229983 - DNA, 103 bp, Artificial Sequence
  Synthetic Polynucleotide
taatacgactcactatagggcggccaacatcttatccaagagctccctcgaacagaggagacgagggatgtcttggataaacctggcggcagcgcaaaagatg

SEQ ID NO: 229984 - DNA, 103 bp, Artificial Sequence
  Synthetic Polynucleotide
taatacgactcactatagggtctgcatcatcggccaacatcttatccaagaacagaggagacttggaatggatgttggcaacctggcggcagcgcaaaagatg

SEQ ID NO: 229985 - DNA, 103 bp, Artificial Sequence
  Synthetic Polynucleotide
taatacgactcactatagggggcacctgcttctgcatcatcggccaacataacagaggagaatgttgatggatgatgcaaacctggcggcagcgcaaaagatg

SEQ ID NO: 229986 - DNA, 103 bp, Artificial Sequence
  Synthetic Polynucleotide
taatacgactcactatagggtctcatcctcggcacctgcttctgcatcataacagaggagaatgatgatgaagcaggtgaacctggcggcagcgcaaaagatg

SEQ ID NO: 229987 - DNA, 103 bp, Artificial Sequence
  Synthetic Polynucleotide
taatacgactcactatagggtccacctccttctcatcctcggcacctgctaacagaggagaagcaggatgcgaggatgaaacctggcggcagcgcaaaagatg

SEQ ID NO: 229988 - DNA, 103 bp, Artificial Sequence
  Synthetic Polynucleotide
taatacgactcactatagggcttcagttcctccacctccttctcatcctcaacagaggagagaggatatgaaggaggtgaacctggcggcagcgcaaaagatg

SEQ ID NO: 229989 - DNA, 103 bp, Artificial Sequence
  Synthetic Polynucleotide
taatacgactcactatagggtgccctgcttcttcagttcctccacctcctaacagaggagaaggaggatgaggaactgaaacctggcggcagcgcaaaagatg

SEQ ID NO: 229990 - DNA, 103 bp, Artificial Sequence
  Synthetic Polynucleotide
taatacgactcactatagggccatcttccctgtcgtcagggagcgggaggaacagaggagacctcccatgccctgacgaaacctggcggcagcgcaaaagatg

SEQ ID NO: 229991 - DNA, 103 bp, Artificial Sequence
  Synthetic Polynucleotide
taatacgactcactatagggagggggttgatgccctgcttcttcagttccaacagaggagaggaactatggaagcagggaacctggcggcagcgcaaaagatg

SEQ ID NO: 229992 - DNA, 103 bp, Artificial Sequence
  Synthetic Polynucleotide
taatacgactcactatagggcggtttgggcagggggttgatgccctgcttaacagaggagaaagcagatgatcaaccccaacctggcggcagcgcaaaagatg

SEQ ID NO: 229993 - DNA, 103 bp, Artificial Sequence
  Synthetic Polynucleotide
taatacgactcactatagggcaccagggggcggtttgggcagggggttgaaacagaggagatcaaccatgtgcccaaacaacctggcggcagcgcaaaagatg

SEQ ID NO: 229994 - DNA, 103 bp, Artificial Sequence
  Synthetic Polynucleotide
taatacgactcactatagggaggaggcccacaccagggggcggtttgggcaacagaggagagcccaaatggccccctggaacctggcggcagcgcaaaagatg

SEQ ID NO: 229995 - DNA, 103 bp, Artificial Sequence
  Synthetic Polynucleotide
taatacgactcactatagggaggggtgggcaggaggcccacaccagggggaacagaggagaccccctatggtgggcctcaacctggcggcagcgcaaaagatg

SEQ ID NO: 229996 - DNA, 103 bp, Artificial Sequence
  Synthetic Polynucleotide
taatacgactcactatagggggggccgaggaggggtgggcaggaggcccaaacagaggagatgggccatgtgcccacccaacctggcggcagcgcaaaagatg

SEQ ID NO: 229997 - DNA, 103 bp, Artificial Sequence
  Synthetic Polynucleotide
taatacgactcactatagggtgcgggccagggggccgaggaggggtgggcaacagaggagagcccacatgtcctcggccaacctggcggcagcgcaaaagatg

SEQ ID NO: 229998 - DNA, 103 bp, Artificial Sequence
  Synthetic Polynucleotide
taatacgactcactatagggggttggagcctgcgggccagggggccgaggaacagaggagacctcggatgcctggcccgaacctggcggcagcgcaaaagatg

SEQ ID NO: 229999 - DNA, 103 bp, Artificial Sequence
  Synthetic Polynucleotide
taatacgactcactatagggcgttgggagaggttggagcctgcgggccagaacagaggagactggccatgaggctccaaaacctggcggcagcgcaaaagatg

SEQ ID NO: 230000 - DNA, 103 bp, Artificial Sequence
  Synthetic Polynucleotide
taatacgactcactatagggatgggcctgccgttgggagaggttggagccaacagaggagaggctccatgctctcccaaaacctggcggcagcgcaaaagatg

SEQ ID NO: 230001 - DNA, 103 bp, Artificial Sequence
  Synthetic Polynucleotide
taatacgactcactatagggttccaactctccatcttccctgtcgtcaggaacagaggagacctgacatgagggaagataacctggcggcagcgcaaaagatg

SEQ ID NO: 230002 - DNA, 103 bp, Artificial Sequence
  Synthetic Polynucleotide
taatacgactcactataggggccaccctgcatgggcctgccgttgggagaaacagaggagatctcccatgggcaggcccaacctggcggcagcgcaaaagatg

SEQ ID NO: 230003 - DNA, 103 bp, Artificial Sequence
  Synthetic Polynucleotide
taatacgactcactatagggggggcggggggccaccctgcatgggcctgcaacagaggagagcaggcatgtgcagggtgaacctggcggcagcgcaaaagatg

SEQ ID NO: 230004 - DNA, 103 bp, Artificial Sequence
  Synthetic Polynucleotide
taatacgactcactatagggggagggggcgggggcggggggccaccctgcaacagaggagagcagggatgccccccgccaacctggcggcagcgcaaaagatg

SEQ ID NO: 230005 - DNA, 103 bp, Artificial Sequence
  Synthetic Polynucleotide
taatacgactcactatagggtgggggagggggagggggcgggggcgggggaacagaggagacccccgatgccgccccctaacctggcggcagcgcaaaagatg

SEQ ID NO: 230006 - DNA, 103 bp, Artificial Sequence
  Synthetic Polynucleotide
taatacgactcactataggggcccgggcggtgggggagggggagggggcgaacagaggagacgccccatgcccctccccaacctggcggcagcgcaaaagatg

SEQ ID NO: 230007 - DNA, 103 bp, Artificial Sequence
  Synthetic Polynucleotide
taatacgactcactatagggatctgagggggcccgggcggtgggggagggaacagaggagaccctccatgaccgcccggaacctggcggcagcgcaaaagatg

SEQ ID NO: 230008 - DNA, 103 bp, Artificial Sequence
  Synthetic Polynucleotide
taatacgactcactatagggcggcatgggcatctgagggggcccgggcggaacagaggagaccgcccatgccccctcagaacctggcggcagcgcaaaagatg

SEQ ID NO: 230009 - DNA, 103 bp, Artificial Sequence
  Synthetic Polynucleotide
taatacgactcactataggggctcatgcaccggcatgggcatctgaggggaacagaggagacccctcatgtgcccatgcaacctggcggcagcgcaaaagatg

SEQ ID NO: 230010 - DNA, 103 bp, Artificial Sequence
  Synthetic Polynucleotide
taatacgactcactatagggggggacagtggctcatgcaccggcatgggcaacagaggagagcccatatgggtgcatgaaacctggcggcagcgcaaaagatg

SEQ ID NO: 230011 - DNA, 103 bp, Artificial Sequence
  Synthetic Polynucleotide
taatacgactcactatagggcagctgctgcggggacagtggctcatgcacaacagaggagagtgcatatgccactgtccaacctggcggcagcgcaaaagatg

SEQ ID NO: 230012 - DNA, 103 bp, Artificial Sequence
  Synthetic Polynucleotide
taatacgactcactatagggattcaccttcttccaactctccatcttcccaacagaggagagggaagatggagagttggaacctggcggcagcgcaaaagatg

SEQ ID NO: 230013 - DNA, 103 bp, Artificial Sequence
  Synthetic Polynucleotide
taatacgactcactatagggcctgctgctgcagctgctgcggggacagtgaacagaggagacactgtatgcgcagcagcaacctggcggcagcgcaaaagatg

SEQ ID NO: 230014 - DNA, 103 bp, Artificial Sequence
  Synthetic Polynucleotide
taatacgactcactatagggttgtacatgtcctgctgctgcagctgctgcaacagaggagagcagcaatggcagcagcaaacctggcggcagcgcaaaagatg

SEQ ID NO: 230015 - DNA, 103 bp, Artificial Sequence
  Synthetic Polynucleotide
taatacgactcactataggggatcttcttgttgtacatgtcctgctgctgaacagaggagacagcagatggacatgtacaacctggcggcagcgcaaaagatg

SEQ ID NO: 230016 - DNA, 103 bp, Artificial Sequence
  Synthetic Polynucleotide
taatacgactcactatagggacaaggaggggatcttcttgttgtacatgtaacagaggagaacatgtatgacaagaagaaacctggcggcagcgcaaaagatg

SEQ ID NO: 230017 - DNA, 103 bp, Artificial Sequence
  Synthetic Polynucleotide
taatacgactcactatagggacgatctcaaacaaggaggggatcttcttgaacagaggagacaagaaatgcccctccttaacctggcggcagcgcaaaagatg

SEQ ID NO: 230018 - DNA, 103 bp, Artificial Sequence
  Synthetic Polynucleotide
taatacgactcactataggggggccgcaccacgatctcaaacaaggagggaacagaggagaccctccatgtttgagatcaacctggcggcagcgcaaaagatg

SEQ ID NO: 230019 - DNA, 103 bp, Artificial Sequence
  Synthetic Polynucleotide
taatacgactcactataggggctgtcccgtgggccgcaccacgatctcaaaacagaggagattgagaatgtggtgcggcaacctggcggcagcgcaaaagatg

SEQ ID NO: 230020 - DNA, 103 bp, Artificial Sequence
  Synthetic Polynucleotide
taatacgactcactatagggttctcagccagctgtcccgtgggccgcaccaacagaggagaggtgcgatgcacgggacaaacctggcggcagcgcaaaagatg

SEQ ID NO: 230021 - DNA, 103 bp, Artificial Sequence
  Synthetic Polynucleotide
taatacgactcactatagggcacacccagcttctcagccagctgtcccgtaacagaggagaacgggaatgctggctgagaacctggcggcagcgcaaaagatg

SEQ ID NO: 230022 - DNA, 103 bp, Artificial Sequence
  Synthetic Polynucleotide
taatacgactcactatagggcagggaacctcacacccagcttctcagccaaacagaggagatggctgatgagctgggtgaacctggcggcagcgcaaaagatg

SEQ ID NO: 230023 - DNA, 103 bp, Artificial Sequence
  Synthetic Polynucleotide
taatacgactcactatagggtcatcttccaattcaccttcttccaactctaacagaggagaagagttatgagaaggtgaaacctggcggcagcgcaaaagatg

SEQ ID NO: 230024 - DNA, 103 bp, Artificial Sequence
  Synthetic Polynucleotide
taatacgactcactatagggccaccgggtccagggaacctcacacccagcaacagaggagagctgggatggaggttcccaacctggcggcagcgcaaaagatg

SEQ ID NO: 230025 - DNA, 103 bp, Artificial Sequence
  Synthetic Polynucleotide
taatacgactcactatagggccctgggggtccaccgggtccagggaacctaacagaggagaaggttcatgggacccggtaacctggcggcagcgcaaaagatg

SEQ ID NO: 230026 - DNA, 103 bp, Artificial Sequence
  Synthetic Polynucleotide
taatacgactcactatagggggcccattggccctgggggtccaccgggtcaacagaggagagacccgatggacccccagaacctggcggcagcgcaaaagatg

SEQ ID NO: 230027 - DNA, 103 bp, Artificial Sequence
  Synthetic Polynucleotide
taatacgactcactatagggttgggcccagggcccattggccctgggggtaacagaggagaacccccatggccaatgggaacctggcggcagcgcaaaagatg

SEQ ID NO: 230028 - DNA, 103 bp, Artificial Sequence
  Synthetic Polynucleotide
taatacgactcactataggggggtcccatgttgggcccagggcccattggaacagaggagaccaatgatgcctgggcccaacctggcggcagcgcaaaagatg

SEQ ID NO: 230029 - DNA, 103 bp, Artificial Sequence
  Synthetic Polynucleotide
taatacgactcactatagggttggccctgggggtcccatgttgggcccagaacagaggagactgggcatgacatgggacaacctggcggcagcgcaaaagatg

SEQ ID NO: 230030 - DNA, 103 bp, Artificial Sequence
  Synthetic Polynucleotide
taatacgactcactatagggggaccgcccattggccctgggggtcccatgaacagaggagacatgggatgcccagggccaacctggcggcagcgcaaaagatg

SEQ ID NO: 230031 - DNA, 103 bp, Artificial Sequence
  Synthetic Polynucleotide
taatacgactcactatagggaggatgcattggaccgcccattggccctggaacagaggagaccagggatgatgggcggtaacctggcggcagcgcaaaagatg

SEQ ID NO: 230032 - DNA, 103 bp, Artificial Sequence
  Synthetic Polynucleotide
taatacgactcactatagggggtgcatgtcaggatgcattggaccgcccaaacagaggagatgggcgatgcaatgcatcaacctggcggcagcgcaaaagatg

SEQ ID NO: 230033 - DNA, 103 bp, Artificial Sequence
  Synthetic Polynucleotide
taatacgactcactatagggtgcatgtcggggtgcatgtcaggatgcattaacagaggagaaatgcaatgtgacatgcaaacctggcggcagcgcaaaagatg

SEQ ID NO: 230034 - DNA, 103 bp, Artificial Sequence
  Synthetic Polynucleotide
taatacgactcactatagggctctgccccatcatcttccaattcaccttcaacagaggagagaaggtatgttggaagataacctggcggcagcgcaaaagatg

SEQ ID NO: 230035 - DNA, 103 bp, Artificial Sequence
  Synthetic Polynucleotide
taatacgactcactatagggcatgtccgggtgcatgtcggggtgcatgtcaacagaggagagacatgatgcccgacatgaacctggcggcagcgcaaaagatg

SEQ ID NO: 230036 - DNA, 103 bp, Artificial Sequence
  Synthetic Polynucleotide
taatacgactcactatagggtgtcagggtgcatgtccgggtgcatgtcggaacagaggagaccgacaatgacccggacaaacctggcggcagcgcaaaagatg

SEQ ID NO: 230037 - DNA, 103 bp, Artificial Sequence
  Synthetic Polynucleotide
taatacgactcactatagggtctgcgtgcatgtcagggtgcatgtccgggaacagaggagacccggaatggcaccctgaaacctggcggcagcgcaaaagatg

SEQ ID NO: 230038 - DNA, 103 bp, Artificial Sequence
  Synthetic Polynucleotide
taatacgactcactatagggtgcgtgcatgtctgcgtgcatgtcagggtgaacagaggagacaccctatgatgcacgcaaacctggcggcagcgcaaaagatg

SEQ ID NO: 230039 - DNA, 103 bp, Artificial Sequence
  Synthetic Polynucleotide
taatacgactcactatagggtcggcatgtctgcgtgcatgtctgcgtgcaaacagaggagatgcacgatgacatgcacgaacctggcggcagcgcaaaagatg

SEQ ID NO: 230040 - DNA, 103 bp, Artificial Sequence
  Synthetic Polynucleotide
taatacgactcactatagggccagggcccatcggcatgtctgcgtgcatgaacagaggagacatgcaatgagacatgccaacctggcggcagcgcaaaagatg

SEQ ID NO: 230041 - DNA, 103 bp, Artificial Sequence
  Synthetic Polynucleotide
taatacgactcactatagggaggattcatgccagggcccatcggcatgtcaacagaggagagacatgatgatgggccctaacctggcggcagcgcaaaagatg

SEQ ID NO: 230042 - DNA, 103 bp, Artificial Sequence
  Synthetic Polynucleotide
taatacgactcactatagggtgggtgggccaggattcatgccagggcccaaacagaggagatgggccatggcatgaatcaacctggcggcagcgcaaaagatg

SEQ ID NO: 230043 - DNA, 103 bp, Artificial Sequence
  Synthetic Polynucleotide
taatacgactcactatagggccagggcccatgggtgggccaggattcatgaacagaggagacatgaaatgtggcccaccaacctggcggcagcgcaaaagatg

SEQ ID NO: 230044 - DNA, 103 bp, Artificial Sequence
  Synthetic Polynucleotide
taatacgactcactatagggtggagggccgccagggcccatgggtgggccaacagaggagaggcccaatgatgggccctaacctggcggcagcgcaaaagatg

SEQ ID NO: 230045 - DNA, 103 bp, Artificial Sequence
  Synthetic Polynucleotide
taatacgactcactatagggctgatggcggcggcgggggggtcccgggcgaacagaggagacgcccgatgcccccccgcaacctggcggcagcgcaaaagatg

SEQ ID NO: 230046 - DNA, 103 bp, Artificial Sequence
  Synthetic Polynucleotide
taatacgactcactatagggcctgggtctcctctgccccatcatcttccaaacagaggagatggaagatgatggggcagaacctggcggcagcgcaaaagatg

SEQ ID NO: 230047 - DNA, 103 bp, Artificial Sequence
  Synthetic Polynucleotide
taatacgactcactatagggagggcatcattggagggccgccagggcccaaacagaggagatgggccatggcggccctcaacctggcggcagcgcaaaagatg

SEQ ID NO: 230048 - DNA, 103 bp, Artificial Sequence
  Synthetic Polynucleotide
taatacgactcactatagggccagggccgtagggcatcattggagggccgaacagaggagacggcccatgaatgatgccaacctggcggcagcgcaaaagatg

SEQ ID NO: 230049 - DNA, 103 bp, Artificial Sequence
  Synthetic Polynucleotide
taatacgactcactatagggtggggagtctccagggccgtagggcatcataacagaggagaatgatgatgtacggccctaacctggcggcagcgcaaaagatg

SEQ ID NO: 230050 - DNA, 103 bp, Artificial Sequence
  Synthetic Polynucleotide
taatacgactcactatagggttccagaatgtggggagtctccagggccgtaacagaggagaacggccatggagactcccaacctggcggcagcgcaaaagatg

SEQ ID NO: 230051 - DNA, 103 bp, Artificial Sequence
  Synthetic Polynucleotide
taatacgactcactataggggggggcatcattccagaatgtggggagtctaacagaggagaagactcatgacattctggaacctggcggcagcgcaaaagatg

SEQ ID NO: 230052 - DNA, 103 bp, Artificial Sequence
  Synthetic Polynucleotide
taatacgactcactatagggtggcgggatagggggcatcattccagaatgaacagaggagacattctatgatgatgcccaacctggcggcagcgcaaaagatg

SEQ ID NO: 230053 - DNA, 103 bp, Artificial Sequence
  Synthetic Polynucleotide
taatacgactcactatagggagttctgggctggcgggatagggggcatcaaacagaggagatgatgcatgctatcccgcaacctggcggcagcgcaaaagatg

SEQ ID NO: 230054 - DNA, 103 bp, Artificial Sequence
  Synthetic Polynucleotide
taatacgactcactatagggttttcatagaagttctgggctggcgggataaacagaggagatatcccatgagcccagaaaacctggcggcagcgcaaaagatg

SEQ ID NO: 230055 - DNA, 103 bp, Artificial Sequence
  Synthetic Polynucleotide
taatacgactcactatagggctggtagaagttttcatagaagttctgggcaacagaggagagcccagatgttctatgaaaacctggcggcagcgcaaaagatg

SEQ ID NO: 230056 - DNA, 103 bp, Artificial Sequence
  Synthetic Polynucleotide
taatacgactcactatagggcctcctgctgctggtagaagttttcatagaaacagaggagatctatgatgacttctaccaacctggcggcagcgcaaaagatg

SEQ ID NO: 230057 - DNA, 103 bp, Artificial Sequence
  Synthetic Polynucleotide
taatacgactcactatagggccggaggtatcctgggtctcctctgccccaaacagaggagatggggcatgggagacccaaacctggcggcagcgcaaaagatg

SEQ ID NO: 230058 - DNA, 103 bp, Artificial Sequence
  Synthetic Polynucleotide
taatacgactcactatagggatctccatgccctcctgctgctggtagaagaacagaggagacttctaatggcagcaggaaacctggcggcagcgcaaaagatg

SEQ ID NO: 230059 - DNA, 103 bp, Artificial Sequence
  Synthetic Polynucleotide
taatacgactcactatagggtccgggctccatctccatgccctcctgctgaacagaggagacagcagatgggcatggagaacctggcggcagcgcaaaagatg

SEQ ID NO: 230060 - DNA, 103 bp, Artificial Sequence
  Synthetic Polynucleotide
taatacgactcactatagggcccccaggagtccgggctccatctccatgcaacagaggagagcatggatgtggagcccgaacctggcggcagcgcaaaagatg

SEQ ID NO: 230061 - DNA, 103 bp, Artificial Sequence
  Synthetic Polynucleotide
taatacgactcactatagggtcctctgcatcccccaggagtccgggctccaacagaggagaggagccatgactcctgggaacctggcggcagcgcaaaagatg

SEQ ID NO: 230062 - DNA, 103 bp, Artificial Sequence
  Synthetic Polynucleotide
taatacgactcactataggggtgcccgtagtcctctgcatcccccaggagaacagaggagactcctgatggatgcagagaacctggcggcagcgcaaaagatg

SEQ ID NO: 230063 - DNA, 103 bp, Artificial Sequence
  Synthetic Polynucleotide
taatacgactcactataggggctcttcgtagtgcccgtagtcctctgcataacagaggagaatgcagatgactacgggcaacctggcggcagcgcaaaagatg

SEQ ID NO: 230064 - DNA, 103 bp, Artificial Sequence
  Synthetic Polynucleotide
taatacgactcactatagggtcccctggcagctcttcgtagtgcccgtagaacagaggagactacggatgctacgaagaaacctggcggcagcgcaaaagatg

SEQ ID NO: 230065 - DNA, 103 bp, Artificial Sequence
  Synthetic Polynucleotide
taatacgactcactatagggctccccaggctcccctggcagctcttcgtaaacagaggagatacgaaatgctgccagggaacctggcggcagcgcaaaagatg

SEQ ID NO: 230066 - DNA, 103 bp, Artificial Sequence
  Synthetic Polynucleotide
taatacgactcactatagggggaagaggtgctccccaggctcccctggcaaacagaggagatgccagatgagcctggggaacctggcggcagcgcaaaagatg

SEQ ID NO: 230067 - DNA, 103 bp, Artificial Sequence
  Synthetic Polynucleotide
taatacgactcactataggggggtgctcagggaagaggtgctccccaggcaacagaggagagcctggatggcacctcttaacctggcggcagcgcaaaagatg

SEQ ID NO: 230068 - DNA, 103 bp, Artificial Sequence
  Synthetic Polynucleotide
taatacgactcactatagggctcaggccctccggaggtatcctgggtctcaacagaggagagagaccatggatacctccaacctggcggcagcgcaaaagatg

SEQ ID NO: 230069 - DNA, 103 bp, Artificial Sequence
  Synthetic Polynucleotide
taatacgactcactataggggggctccagagggtgctcagggaagaggtgaacagaggagacacctcatgcctgagcacaacctggcggcagcgcaaaagatg

SEQ ID NO: 230070 - DNA, 103 bp, Artificial Sequence
  Synthetic Polynucleotide
taatacgactcactatagggagaagctgtcgggctccagagggtgctcagaacagaggagactgagcatgctctggagcaacctggcggcagcgcaaaagatg

SEQ ID NO: 230071 - DNA, 103 bp, Artificial Sequence
  Synthetic Polynucleotide
taatacgactcactatagggcctccctcagagaagctgtcgggctccagaaacagaggagatctggaatgcgacagcttaacctggcggcagcgcaaaagatg

SEQ ID NO: 230072 - DNA, 103 bp, Artificial Sequence
  Synthetic Polynucleotide
taatacgactcactataggggcctgggggccctccctcagagaagctgtcaacagaggagagacagcatgtctgagggaaacctggcggcagcgcaaaagatg

SEQ ID NO: 230073 - DNA, 103 bp, Artificial Sequence
  Synthetic Polynucleotide
taatacgactcactataggggcttcggccggcctgggggccctccctcagaacagaggagactgaggatgggcccccagaacctggcggcagcgcaaaagatg

SEQ ID NO: 230074 - DNA, 103 bp, Artificial Sequence
  Synthetic Polynucleotide
taatacgactcactatagggccggcgcctggcttcggccggcctgggggcaacagaggagagcccccatgccggccgaaaacctggcggcagcgcaaaagatg

SEQ ID NO: 230075 - DNA, 103 bp, Artificial Sequence
  Synthetic Polynucleotide
taatacgactcactataggggtcagggacaccggcgcctggcttcggccgaacagaggagacggccgatgccaggcgccaacctggcggcagcgcaaaagatg

SEQ ID NO: 230076 - DNA, 103 bp, Artificial Sequence
  Synthetic Polynucleotide
taatacgactcactatagggagggcaggaagtcagggacaccggcgcctgaacagaggagacaggcgatggtgtccctgaacctggcggcagcgcaaaagatg

SEQ ID NO: 230077 - DNA, 103 bp, Artificial Sequence
  Synthetic Polynucleotide
taatacgactcactatagggctctgggctgagggcaggaagtcagggacaaacagaggagatgtcccatgcttcctgccaacctggcggcagcgcaaaagatg

SEQ ID NO: 230078 - DNA, 103 bp, Artificial Sequence
  Synthetic Polynucleotide
taatacgactcactataggggtacagggccctctgggctgagggcaggaaaacagaggagattcctgatgtcagcccagaacctggcggcagcgcaaaagatg

SEQ ID NO: 230079 - DNA, 103 bp, Artificial Sequence
  Synthetic Polynucleotide
taatacgactcactatagggtccggcttctctcaggccctccggaggtataacagaggagaatacctatggagggcctgaacctggcggcagcgcaaaagatg

SEQ ID NO: 230080 - DNA, 103 bp, Artificial Sequence
  Synthetic Polynucleotide
taatacgactcactatagggggatcctcaggtacagggccctctgggctgaacagaggagacagcccatggggccctgtaacctggcggcagcgcaaaagatg

SEQ ID NO: 230081 - DNA, 103 bp, Artificial Sequence
  Synthetic Polynucleotide
taatacgactcactatagggtgcttctgctggatcctcaggtacagggccaacagaggagaggccctatgcctgaggataacctggcggcagcgcaaaagatg

SEQ ID NO: 230082 - DNA, 103 bp, Artificial Sequence
  Synthetic Polynucleotide
taatacgactcactatagggctcctcctgctgcttctgctggatcctcagaacagaggagactgaggatgcagcagaagaacctggcggcagcgcaaaagatg

SEQ ID NO: 230083 - DNA, 103 bp, Artificial Sequence
  Synthetic Polynucleotide
taatacgactcactatagggctctctcctcctcctcctgctgcttctgctaacagaggagaagcagaatgagcaggaggaacctggcggcagcgcaaaagatg

SEQ ID NO: 230084 - DNA, 103 bp, Artificial Sequence
  Synthetic Polynucleotide
taatacgactcactatagggagcctcctcgctctctcctcctcctcctgcaacagaggagagcaggaatgggaggagagaacctggcggcagcgcaaaagatg

SEQ ID NO: 230085 - DNA, 103 bp, Artificial Sequence
  Synthetic Polynucleotide
taatacgactcactataggggctctcagccagcctcctcgctctctcctcaacagaggagagaggagatggcgaggaggaacctggcggcagcgcaaaagatg

SEQ ID NO: 230086 - DNA, 103 bp, Artificial Sequence
  Synthetic Polynucleotide
taatacgactcactatagggcctgcttgctgctctcagccagcctcctcgaacagaggagacgaggaatgtggctgagaaacctggcggcagcgcaaaagatg

SEQ ID NO: 230087 - DNA, 103 bp, Artificial Sequence
  Synthetic Polynucleotide
taatacgactcactatagggttctcccggtcctgcttgctgctctcagccaacagaggagaggctgaatgcagcaagcaaacctggcggcagcgcaaaagatg

SEQ ID NO: 230088 - DNA, 103 bp, Artificial Sequence
  Synthetic Polynucleotide
taatacgactcactatagggaccttcctcattctcccggtcctgcttgctaacagaggagaagcaagatggaccgggagaacctggcggcagcgcaaaagatg

SEQ ID NO: 230089 - DNA, 103 bp, Artificial Sequence
  Synthetic Polynucleotide
taatacgactcactatagggttccggtgtcaccttcctcattctcccggtaacagaggagaaccgggatgatgaggaagaacctggcggcagcgcaaaagatg

SEQ ID NO: 230090 - DNA, 103 bp, Artificial Sequence
  Synthetic Polynucleotide
taatacgactcactatagggcccttttctttccggcttctctcaggccctaacagaggagaagggccatggagaagccgaacctggcggcagcgcaaaagatg

SEQ ID NO: 230091 - DNA, 103 bp, Artificial Sequence
  Synthetic Polynucleotide
taatacgactcactataggggagtaccagtttccggtgtcaccttcctcaaacagaggagatgaggaatgtgacaccggaacctggcggcagcgcaaaagatg

SEQ ID NO: 230092 - DNA, 103 bp, Artificial Sequence
  Synthetic Polynucleotide
taatacgactcactatagggctcatcacttgagtaccagtttccggtgtcaacagaggagagacaccatgaactggtacaacctggcggcagcgcaaaagatg

SEQ ID NO: 230093 - DNA, 103 bp, Artificial Sequence
  Synthetic Polynucleotide
taatacgactcactatagggcaccctcatcctcatcacttgagtaccagtaacagaggagaactggtatgcaagtgatgaacctggcggcagcgcaaaagatg

SEQ ID NO: 230094 - DNA, 103 bp, Artificial Sequence
  Synthetic Polynucleotide
taatacgactcactatagggacactgcttccaccctcatcctcatcacttaacagaggagaaagtgaatgggatgagggaacctggcggcagcgcaaaagatg

SEQ ID NO: 230095 - DNA, 103 bp, Artificial Sequence
  Synthetic Polynucleotide
taatacgactcactataggggatggaggtgacactgcttccaccctcatcaacagaggagagatgagatgggaagcagtaacctggcggcagcgcaaaagatg

SEQ ID NO: 230096 - DNA, 103 bp, Artificial Sequence
  Synthetic Polynucleotide
taatacgactcactatagggaggtcttcaggatggaggtgacactgcttcaacagaggagagaagcaatgtcacctccaaacctggcggcagcgcaaaagatg

SEQ ID NO: 230097 - DNA, 103 bp, Artificial Sequence
  Synthetic Polynucleotide
taatacgactcactatagggtgctgcctcaaggtcttcaggatggaggtgaacagaggagacacctcatgcctgaagacaacctggcggcagcgcaaaagatg

SEQ ID NO: 230098 - DNA, 103 bp, Artificial Sequence
  Synthetic Polynucleotide
taatacgactcactataggggctggacgtctgctgcctcaaggtcttcagaacagaggagactgaagatgttgaggcagaacctggcggcagcgcaaaagatg

SEQ ID NO: 230099 - DNA, 103 bp, Artificial Sequence
  Synthetic Polynucleotide
taatacgactcactatagggccgggggtcggctggacgtctgctgcctcaaacagaggagatgaggcatgagacgtccaaacctggcggcagcgcaaaagatg

SEQ ID NO: 230100 - DNA, 103 bp, Artificial Sequence
  Synthetic Polynucleotide
taatacgactcactatagggccaactgaagccgggggtcggctggacgtcaacagaggagagacgtcatgccgacccccaacctggcggcagcgcaaaagatg

SEQ ID NO: 230101 - DNA, 103 bp, Artificial Sequence
  Synthetic Polynucleotide
taatacgactcactatagggatgcttctcccccttttctttccggcttctaacagaggagaagaagcatgaaagaaaagaacctggcggcagcgcaaaagatg

SEQ ID NO: 230102 - DNA, 103 bp, Artificial Sequence
  Synthetic Polynucleotide
taatacgactcactataggggctcagctccccaactgaagccgggggtcgaacagaggagacgacccatggcttcagttaacctggcggcagcgcaaaagatg

SEQ ID NO: 230103 - DNA, 103 bp, Artificial Sequence
  Synthetic Polynucleotide
taatacgactcactataggggcccactgctgctcagctccccaactgaagaacagaggagacttcagatggggagctgaaacctggcggcagcgcaaaagatg

SEQ ID NO: 230104 - DNA, 103 bp, Artificial Sequence
  Synthetic Polynucleotide
taatacgactcactataggggggtcccccagcccactgctgctcagctccaacagaggagaggagctatgcagcagtggaacctggcggcagcgcaaaagatg

SEQ ID NO: 230105 - DNA, 103 bp, Artificial Sequence
  Synthetic Polynucleotide
taatacgactcactatagggctggaggcgggggtcccccagcccactgctaacagaggagaagcagtatgctgggggacaacctggcggcagcgcaaaagatg

SEQ ID NO: 230106 - DNA, 103 bp, Artificial Sequence
  Synthetic Polynucleotide
taatacgactcactatagggggtgtcccttctggaggcgggggtcccccaaacagaggagatgggggatgcccgcctccaacctggcggcagcgcaaaagatg

SEQ ID NO: 230107 - DNA, 103 bp, Artificial Sequence
  Synthetic Polynucleotide
taatacgactcactatagggcttcctgtggggtgtcccttctggaggcggaacagaggagaccgcctatggaagggacaaacctggcggcagcgcaaaagatg

SEQ ID NO: 230108 - DNA, 103 bp, Artificial Sequence
  Synthetic Polynucleotide
taatacgactcactatagggagccagccggcttcctgtggggtgtcccttaacagaggagaaagggaatgcccacaggaaacctggcggcagcgcaaaagatg

SEQ ID NO: 230109 - DNA, 103 bp, Artificial Sequence
  Synthetic Polynucleotide
taatacgactcactatagggggcgagggtcagccagccggcttcctgtggaacagaggagaccacagatggccggctggaacctggcggcagcgcaaaagatg

SEQ ID NO: 230110 - DNA, 103 bp, Artificial Sequence
  Synthetic Polynucleotide
taatacgactcactatagggtcccggctgaggcgagggtcagccagccggaacagaggagaccggctatgtgaccctcgaacctggcggcagcgcaaaagatg

SEQ ID NO: 230111 - DNA, 103 bp, Artificial Sequence
  Synthetic Polynucleotide
taatacgactcactataggggagtctggggtcccggctgaggcgagggtcaacagaggagagaccctatgctcagccggaacctggcggcagcgcaaaagatg

SEQ ID NO: 230112 - DNA, 103 bp, Artificial Sequence
  Synthetic Polynucleotide
taatacgactcactatagggaatcactgtgatgcttctcccccttttcttaacagaggagaaagaaaatggggagaagcaacctggcggcagcgcaaaagatg

SEQ ID NO: 230113 - DNA, 103 bp, Artificial Sequence
  Synthetic Polynucleotide
taatacgactcactatagggcatggcgggtgagtctggggtcccggctgaaacagaggagatcagccatgaccccagacaacctggcggcagcgcaaaagatg

SEQ ID NO: 230114 - DNA, 103 bp, Artificial Sequence
  Synthetic Polynucleotide
taatacgactcactataggggaagcctccacatggcgggtgagtctggggaacagaggagaccccagatgcacccgccaaacctggcggcagcgcaaaagatg

SEQ ID NO: 230115 - DNA, 103 bp, Artificial Sequence
  Synthetic Polynucleotide
taatacgactcactatagggagacccgccagaagcctccacatggcgggtaacagaggagaacccgcatggtggaggctaacctggcggcagcgcaaaagatg

SEQ ID NO: 230116 - DNA, 103 bp, Artificial Sequence
  Synthetic Polynucleotide
taatacgactcactatagggcacctgggccagacccgccagaagcctccaaacagaggagatggaggatgctggcgggtaacctggcggcagcgcaaaagatg

SEQ ID NO: 230117 - DNA, 103 bp, Artificial Sequence
  Synthetic Polynucleotide
taatacgactcactatagggggtcccgaatcacctgggccagacccgccaaacagaggagatggcggatgtggcccaggaacctggcggcagcgcaaaagatg

SEQ ID NO: 230118 - DNA, 103 bp, Artificial Sequence
  Synthetic Polynucleotide
taatacgactcactatagggaggatcggagggtcccgaatcacctgggccaacagaggagaggcccaatggattcgggaaacctggcggcagcgcaaaagatg

SEQ ID NO: 230119 - DNA, 103 bp, Artificial Sequence
  Synthetic Polynucleotide
taatacgactcactataggggagccagccgaggatcggagggtcccgaataacagaggagaattcggatgcctccgatcaacctggcggcagcgcaaaagatg

SEQ ID NO: 230120 - DNA, 103 bp, Artificial Sequence
  Synthetic Polynucleotide
taatacgactcactatagggggcagggcgcgagccagccgaggatcggagaacagaggagactccgaatgtcggctggcaacctggcggcagcgcaaaagatg

SEQ ID NO: 230121 - DNA, 103 bp, Artificial Sequence
  Synthetic Polynucleotide
taatacgactcactatagggcttggaggtgggcagggcgcgagccagccgaacagaggagacggctgatgcgcgccctgaacctggcggcagcgcaaaagatg

SEQ ID NO: 230122 - DNA, 103 bp, Artificial Sequence
  Synthetic Polynucleotide
taatacgactcactatagggtgccttcgggcttggaggtgggcagggcgcaacagaggagagcgcccatgccacctccaaacctggcggcagcgcaaaagatg

SEQ ID NO: 230123 - DNA, 103 bp, Artificial Sequence
  Synthetic Polynucleotide
taatacgactcactatagggtcctcatccgaatcactgtgatgcttctccaacagaggagaggagaaatgtcacagtgaaacctggcggcagcgcaaaagatg

SEQ ID NO: 230124 - DNA, 103 bp, Artificial Sequence
  Synthetic Polynucleotide
taatacgactcactataggggaatgaaggctgccttcgggcttggaggtgaacagaggagacacctcatggcccgaaggaacctggcggcagcgcaaaagatg

SEQ ID NO: 230125 - DNA, 103 bp, Artificial Sequence
  Synthetic Polynucleotide
taatacgactcactatagggcacagggctggaatgaaggctgccttcgggaacagaggagacccgaaatgagccttcataacctggcggcagcgcaaaagatg

SEQ ID NO: 230126 - DNA, 103 bp, Artificial Sequence
  Synthetic Polynucleotide
taatacgactcactatagggtgctggggcccacagggctggaatgaaggcaacagaggagagccttcatgccagccctgaacctggcggcagcgcaaaagatg

SEQ ID NO: 230127 - DNA, 103 bp, Artificial Sequence
  Synthetic Polynucleotide
taatacgactcactatagggcccttggaactgctggggcccacagggctgaacagaggagacagcccatggggccccagaacctggcggcagcgcaaaagatg

SEQ ID NO: 230128 - DNA, 103 bp, Artificial Sequence
  Synthetic Polynucleotide
taatacgactcactatagggcggcccagaccccttggaactgctggggccaacagaggagaggccccatgagttccaagaacctggcggcagcgcaaaagatg

SEQ ID NO: 230129 - DNA, 103 bp, Artificial Sequence
  Synthetic Polynucleotide
taatacgactcactatagggccgttgggggcggcccagaccccttggaacaacagaggagagttccaatgggtctgggcaacctggcggcagcgcaaaagatg

SEQ ID NO: 230130 - DNA, 103 bp, Artificial Sequence
  Synthetic Polynucleotide
taatacgactcactatagggtcctcctcctccgttgggggcggcccagacaacagaggagagtctggatggcccccaacaacctggcggcagcgcaaaagatg

SEQ ID NO: 230131 - DNA, 103 bp, Artificial Sequence
  Synthetic Polynucleotide
taatacgactcactatagggccgctccccttcctcctcctccgttgggggaacagaggagacccccaatggaggaggagaacctggcggcagcgcaaaagatg

SEQ ID NO: 230132 - DNA, 103 bp, Artificial Sequence
  Synthetic Polynucleotide
taatacgactcactatagggcccgcagggcccgctccccttcctcctcctaacagaggagaaggaggatgaaggggagcaacctggcggcagcgcaaaagatg

SEQ ID NO: 230133 - DNA, 103 bp, Artificial Sequence
  Synthetic Polynucleotide
taatacgactcactatagggacggccttctcccgcagggcccgctcccctaacagaggagaaggggaatgggccctgcgaacctggcggcagcgcaaaagatg

SEQ ID NO: 230134 - DNA, 103 bp, Artificial Sequence
  Synthetic Polynucleotide
taatacgactcactataggggtgggacttctcctcatccgaatcactgtgaacagaggagacacagtatgtcggatgagaacctggcggcagcgcaaaagatg

SEQ ID NO: 230135 - DNA, 103 bp, Artificial Sequence
  Synthetic Polynucleotide
taatacgactcactataggggggaatgttcacggccttctcccgcagggcaacagaggagagccctgatggagaaggccaacctggcggcagcgcaaaagatg

SEQ ID NO: 230136 - DNA, 103 bp, Artificial Sequence
  Synthetic Polynucleotide
taatacgactcactataggggtgggtccaggggaatgttcacggccttctaacagaggagaagaaggatgtgaacattcaacctggcggcagcgcaaaagatg

SEQ ID NO: 230137 - DNA, 103 bp, Artificial Sequence
  Synthetic Polynucleotide
taatacgactcactatagggtgcccggggagtgggtccaggggaatgttcaacagaggagagaacatatgcctggacccaacctggcggcagcgcaaaagatg

SEQ ID NO: 230138 - DNA, 103 bp, Artificial Sequence
  Synthetic Polynucleotide
taatacgactcactatagggccgcagagggtgcccggggagtgggtccagaacagaggagactggacatgctccccgggaacctggcggcagcgcaaaagatg

SEQ ID NO: 230139 - DNA, 103 bp, Artificial Sequence
  Synthetic Polynucleotide
taatacgactcactatagggaccgtgggtcccgcagagggtgcccggggaaacagaggagatccccgatgaccctctgcaacctggcggcagcgcaaaagatg

SEQ ID NO: 230140 - DNA, 103 bp, Artificial Sequence
  Synthetic Polynucleotide
taatacgactcactatagggtgcagctgtgaccgtgggtcccgcagagggaacagaggagaccctctatgggacccacgaacctggcggcagcgcaaaagatg

SEQ ID NO: 230141 - DNA, 103 bp, Artificial Sequence
  Synthetic Polynucleotide
taatacgactcactataggggctgaactgctgcagctgtgaccgtgggtcaacagaggagagacccaatgtcacagctgaacctggcggcagcgcaaaagatg

SEQ ID NO: 230142 - DNA, 103 bp, Artificial Sequence
  Synthetic Polynucleotide
taatacgactcactatagggtcttgatgtggctgaactgctgcagctgtgaacagaggagacacagcatgagcagttcaaacctggcggcagcgcaaaagatg

SEQ ID NO: 230143 - DNA, 103 bp, Artificial Sequence
  Synthetic Polynucleotide
taatacgactcactataggggtcacgtccttcttgatgtggctgaactgcaacagaggagagcagttatgccacatcaaaacctggcggcagcgcaaaagatg

SEQ ID NO: 230144 - DNA, 103 bp, Artificial Sequence
  Synthetic Polynucleotide
taatacgactcactatagggcttgctcagggtcacgtccttcttgatgtgaacagaggagacacatcatgaaggacgtgaacctggcggcagcgcaaaagatg

SEQ ID NO: 230145 - DNA, 103 bp, Artificial Sequence
  Synthetic Polynucleotide
taatacgactcactatagggtcagtctcctgtgggacttctcctcatccgaacagaggagacggatgatgagaagtcccaacctggcggcagcgcaaaagatg

SEQ ID NO: 230146 - DNA, 103 bp, Artificial Sequence
  Synthetic Polynucleotide
taatacgactcactatagggcgaagctgggcttgctcagggtcacgtcctaacagaggagaaggacgatgccctgagcaaacctggcggcagcgcaaaagatg

SEQ ID NO: 230147 - DNA, 103 bp, Artificial Sequence
  Synthetic Polynucleotide
taatacgactcactatagggacggtgcgggcgaagctgggcttgctcaggaacagaggagacctgagatggcccagcttaacctggcggcagcgcaaaagatg

SEQ ID NO: 230148 - DNA, 103 bp, Artificial Sequence
  Synthetic Polynucleotide
taatacgactcactatagggattccagagcacggtgcgggcgaagctgggaacagaggagacccagcatggcccgcaccaacctggcggcagcgcaaaagatg

SEQ ID NO: 230149 - DNA, 103 bp, Artificial Sequence
  Synthetic Polynucleotide
taatacgactcactatagggggtcctcgggattccagagcacggtgcgggaacagaggagacccgcaatgtgctctggaaacctggcggcagcgcaaaagatg

SEQ ID NO: 230150 - DNA, 103 bp, Artificial Sequence
  Synthetic Polynucleotide
taatacgactcactatagggagggggatcaggtcctcgggattccagagcaacagaggagagctctgatgtcccgaggaaacctggcggcagcgcaaaagatg

SEQ ID NO: 230151 - DNA, 103 bp, Artificial Sequence
  Synthetic Polynucleotide
taatacgactcactatagggggggatgggtagggggatcaggtcctcgggaacagaggagacccgagatgctgatccccaacctggcggcagcgcaaaagatg

SEQ ID NO: 230152 - DNA, 103 bp, Artificial Sequence
  Synthetic Polynucleotide
taatacgactcactatagggcgtcctgcttggggatgggtagggggatcaaacagaggagatgatccatgtacccatccaacctggcggcagcgcaaaagatg

SEQ ID NO: 230153 - DNA, 103 bp, Artificial Sequence
  Synthetic Polynucleotide
taatacgactcactataggggggggcactgcgtcctgcttggggatgggtaacagaggagaacccatatgcaagcaggaaacctggcggcagcgcaaaagatg

SEQ ID NO: 230154 - DNA, 103 bp, Artificial Sequence
  Synthetic Polynucleotide
taatacgactcactatagggcgcgggcacggggggcactgcgtcctgcttaacagaggagaaagcagatggcagtgcccaacctggcggcagcgcaaaagatg

SEQ ID NO: 230155 - DNA, 103 bp, Artificial Sequence
  Synthetic Polynucleotide
taatacgactcactatagggattgcagggccgcgggcacggggggcactgaacagaggagacagtgcatgccgtgcccgaacctggcggcagcgcaaaagatg

SEQ ID NO: 230156 - DNA, 103 bp, Artificial Sequence
  Synthetic Polynucleotide
taatacgactcactatagggggcggcgactctgatggcggcggcggggggaacagaggagaccccccatggccgccatcaacctggcggcagcgcaaaagatg

SEQ ID NO: 230157 - DNA, 103 bp, Artificial Sequence
  Synthetic Polynucleotide
taatacgactcactatagggcgtttccgcttcagtctcctgtgggacttcaacagaggagagaagtcatgcaggagactaacctggcggcagcgcaaaagatg

SEQ ID NO: 230158 - DNA, 103 bp, Artificial Sequence
  Synthetic Polynucleotide
taatacgactcactataggggtgggcatggattgcagggccgcgggcacgaacagaggagacgtgccatgggccctgcaaacctggcggcagcgcaaaagatg

SEQ ID NO: 230159 - DNA, 103 bp, Artificial Sequence
  Synthetic Polynucleotide
taatacgactcactatagggggggtccagggtgggcatggattgcagggcaacagaggagagccctgatgtccatgcccaacctggcggcagcgcaaaagatg

SEQ ID NO: 230160 - DNA, 103 bp, Artificial Sequence
  Synthetic Polynucleotide
taatacgactcactatagggggtgcagccgggggtccagggtgggcatggaacagaggagaccatgcatgccctggaccaacctggcggcagcgcaaaagatg

SEQ ID NO: 230161 - DNA, 103 bp, Artificial Sequence
  Synthetic Polynucleotide
taatacgactcactataggggtggcagcgcggtgcagccgggggtccaggaacagaggagacctggaatgccggctgcaaacctggcggcagcgcaaaagatg

SEQ ID NO: 230162 - DNA, 103 bp, Artificial Sequence
  Synthetic Polynucleotide
taatacgactcactataggggggccctgccgtggcagcgcggtgcagccgaacagaggagacggctgatgcgcgctgccaacctggcggcagcgcaaaagatg

SEQ ID NO: 230163 - DNA, 103 bp, Artificial Sequence
  Synthetic Polynucleotide
taatacgactcactataggggggcgttggggggccctgccgtggcagcgcaacagaggagagcgctgatgcggcagggcaacctggcggcagcgcaaaagatg

SEQ ID NO: 230164 - DNA, 103 bp, Artificial Sequence
  Synthetic Polynucleotide
taatacgactcactataggggggcgctgccgggcgttggggggccctgccaacagaggagaggcaggatgccccaacgcaacctggcggcagcgcaaaagatg

SEQ ID NO: 230165 - DNA, 103 bp, Artificial Sequence
  Synthetic Polynucleotide
taatacgactcactatagggggaggcgcccgggcgctgccgggcgttgggaacagaggagacccaacatgcggcagcgcaacctggcggcagcgcaaaagatg

SEQ ID NO: 230166 - DNA, 103 bp, Artificial Sequence
  Synthetic Polynucleotide
taatacgactcactatagggtggaatccgtggaggcgcccgggcgctgccaacagaggagaggcagcatgcgggcgcctaacctggcggcagcgcaaaagatg

SEQ ID NO: 230167 - DNA, 103 bp, Artificial Sequence
  Synthetic Polynucleotide
taatacgactcactatagggccctgtgtgctggaatccgtggaggcgcccaacagaggagagggcgcatgcacggattcaacctggcggcagcgcaaaagatg

SEQ ID NO: 230168 - DNA, 103 bp, Artificial Sequence
  Synthetic Polynucleotide
taatacgactcactatagggctctttcttccgtttccgcttcagtctcctaacagaggagaaggagaatgaagcggaaaaacctggcggcagcgcaaaagatg

SEQ ID NO: 230169 - DNA, 103 bp, Artificial Sequence
  Synthetic Polynucleotide
taatacgactcactataggggaggttggcgccctgtgtgctggaatccgtaacagaggagaacggatatgagcacacagaacctggcggcagcgcaaaagatg

SEQ ID NO: 230170 - DNA, 103 bp, Artificial Sequence
  Synthetic Polynucleotide
taatacgactcactatagggcaaagtcggggaggttggcgccctgtgtgcaacagaggagagcacacatggcgccaaccaacctggcggcagcgcaaaagatg

SEQ ID NO: 230171 - DNA, 103 bp, Artificial Sequence
  Synthetic Polynucleotide
taatacgactcactataggggacagaagttcaaagtcggggaggttggcgaacagaggagacgccaaatgccccgacttaacctggcggcagcgcaaaagatg

SEQ ID NO: 230172 - DNA, 103 bp, Artificial Sequence
  Synthetic Polynucleotide
taatacgactcactataggggaggatgcgagacagaagttcaaagtcgggaacagaggagacccgacatggaacttctgaacctggcggcagcgcaaaagatg

SEQ ID NO: 230173 - DNA, 103 bp, Artificial Sequence
  Synthetic Polynucleotide
taatacgactcactatagggtgactgtcttgaggatgcgagacagaagttaacagaggagaaacttcatgctcgcatccaacctggcggcagcgcaaaagatg

SEQ ID NO: 230174 - DNA, 103 bp, Artificial Sequence
  Synthetic Polynucleotide
taatacgactcactatagggccggtggcattgactgtcttgaggatgcgaaacagaggagatcgcatatgcaagacagtaacctggcggcagcgcaaaagatg

SEQ ID NO: 230175 - DNA, 103 bp, Artificial Sequence
  Synthetic Polynucleotide
taatacgactcactatagggggccgaggagccggtggcattgactgtcttaacagaggagaaagacaatgaatgccaccaacctggcggcagcgcaaaagatg

SEQ ID NO: 230176 - DNA, 103 bp, Artificial Sequence
  Synthetic Polynucleotide
taatacgactcactatagggaaccgggggcggccgaggagccggtggcataacagaggagaatgccaatggctcctcggaacctggcggcagcgcaaaagatg

SEQ ID NO: 230177 - DNA, 103 bp, Artificial Sequence
  Synthetic Polynucleotide
taatacgactcactatagggttgtcgctggaaccgggggcggccgaggagaacagaggagactcctcatgcgcccccggaacctggcggcagcgcaaaagatg

SEQ ID NO: 230178 - DNA, 103 bp, Artificial Sequence
  Synthetic Polynucleotide
taatacgactcactataggggtcactgggtttgtcgctggaaccgggggcaacagaggagagcccccatgtccagcgacaacctggcggcagcgcaaaagatg

SEQ ID NO: 230179 - DNA, 103 bp, Artificial Sequence
  Synthetic Polynucleotide
taatacgactcactatagggctttctcccgctctttcttccgtttccgctaacagaggagaagcggaatgggaagaaagaacctggcggcagcgcaaaagatg

SEQ ID NO: 230180 - DNA, 103 bp, Artificial Sequence
  Synthetic Polynucleotide
taatacgactcactataggggcacccgggggtcactgggtttgtcgctggaacagaggagaccagcgatgaacccagtgaacctggcggcagcgcaaaagatg

SEQ ID NO: 230181 - DNA, 103 bp, Artificial Sequence
  Synthetic Polynucleotide
taatacgactcactatagggggggccttccgcacccgggggtcactgggtaacagaggagaacccagatgcccccgggtaacctggcggcagcgcaaaagatg

SEQ ID NO: 230182 - DNA, 103 bp, Artificial Sequence
  Synthetic Polynucleotide
taatacgactcactatagggagggtcggtgggggccttccgcacccggggaacagaggagaccccggatgcggaaggccaacctggcggcagcgcaaaagatg

SEQ ID NO: 230183 - DNA, 103 bp, Artificial Sequence
  Synthetic Polynucleotide
taatacgactcactatagggtctgcagccgagggtcggtgggggccttccaacagaggagaggaaggatgccaccgaccaacctggcggcagcgcaaaagatg

SEQ ID NO: 230184 - DNA, 103 bp, Artificial Sequence
  Synthetic Polynucleotide
taatacgactcactatagggtctgtgggtttctgcagccgagggtcggtgaacagaggagacaccgaatgtcggctgcaaacctggcggcagcgcaaaagatg

SEQ ID NO: 230185 - DNA, 103 bp, Artificial Sequence
  Synthetic Polynucleotide
taatacgactcactatagggggccgtagagtctgtgggtttctgcagccgaacagaggagacggctgatgaaacccacaaacctggcggcagcgcaaaagatg

SEQ ID NO: 230186 - DNA, 103 bp, Artificial Sequence
  Synthetic Polynucleotide
taatacgactcactatagggcccgggaggaggccgtagagtctgtgggttaacagaggagaaacccaatgactctacggaacctggcggcagcgcaaaagatg

SEQ ID NO: 230187 - DNA, 103 bp, Artificial Sequence
  Synthetic Polynucleotide
taatacgactcactatagggggcttggcagcccgggaggaggccgtagagaacagaggagactctacatgctcctcccgaacctggcggcagcgcaaaagatg

SEQ ID NO: 230188 - DNA, 103 bp, Artificial Sequence
  Synthetic Polynucleotide
taatacgactcactatagggagcagggccgggcttggcagcccgggaggaaacagaggagatcctccatggctgccaagaacctggcggcagcgcaaaagatg

SEQ ID NO: 230189 - DNA, 103 bp, Artificial Sequence
  Synthetic Polynucleotide
taatacgactcactatagggagggcgcctcagcagggccgggcttggcagaacagaggagactgccaatgccggccctgaacctggcggcagcgcaaaagatg

SEQ ID NO: 230190 - DNA, 103 bp, Artificial Sequence
  Synthetic Polynucleotide
taatacgactcactatagggctccttttctctttctcccgctctttcttcaacagaggagagaagaaatggcgggagaaaacctggcggcagcgcaaaagatg

SEQ ID NO: 230191 - DNA, 103 bp, Artificial Sequence
  Synthetic Polynucleotide
taatacgactcactataggggcggtgggagagggcgcctcagcagggccgaacagaggagacggcccatgtgaggcgccaacctggcggcagcgcaaaagatg

SEQ ID NO: 230192 - DNA, 103 bp, Artificial Sequence
  Synthetic Polynucleotide
taatacgactcactatagggactcgggctggcggtgggagagggcgcctcaacagaggagagaggcgatgtctcccaccaacctggcggcagcgcaaaagatg

SEQ ID NO: 230193 - DNA, 103 bp, Artificial Sequence
  Synthetic Polynucleotide
taatacgactcactatagggaggcatccccactcgggctggcggtgggagaacagaggagactcccaatgccagcccgaaacctggcggcagcgcaaaagatg

SEQ ID NO: 230194 - DNA, 103 bp, Artificial Sequence
  Synthetic Polynucleotide
taatacgactcactataggggctggtggggaggcatccccactcgggctgaacagaggagacagcccatgtggggatgcaacctggcggcagcgcaaaagatg

SEQ ID NO: 230195 - DNA, 103 bp, Artificial Sequence
  Synthetic Polynucleotide
taatacgactcactataggggggagcggtggctggtggggaggcatccccaacagaggagaggggatatgtccccaccaaacctggcggcagcgcaaaagatg

SEQ ID NO: 230196 - DNA, 103 bp, Artificial Sequence
  Synthetic Polynucleotide
taatacgactcactataggggggggtcgtagggagcggtggctggtggggaacagaggagaccccacatgccaccgctcaacctggcggcagcgcaaaagatg

SEQ ID NO: 230197 - DNA, 103 bp, Artificial Sequence
  Synthetic Polynucleotide
taatacgactcactataggggccagcacgcgggggtcgtagggagcggtgaacagaggagacaccgcatgctacgacccaacctggcggcagcgcaaaagatg

SEQ ID NO: 230198 - DNA, 103 bp, Artificial Sequence
  Synthetic Polynucleotide
taatacgactcactatagggtccaccggccgccagcacgcgggggtcgtaaacagaggagatacgacatgcgcgtgctgaacctggcggcagcgcaaaagatg

SEQ ID NO: 230199 - DNA, 103 bp, Artificial Sequence
  Synthetic Polynucleotide
taatacgactcactatagggcctggcccagtccaccggccgccagcacgcaacagaggagagcgtgcatgcggccggtgaacctggcggcagcgcaaaagatg

SEQ ID NO: 230200 - DNA, 103 bp, Artificial Sequence
  Synthetic Polynucleotide
taatacgactcactatagggccccctccgccctggcccagtccaccggccaacagaggagaggccggatgactgggccaaacctggcggcagcgcaaaagatg

SEQ ID NO: 230201 - DNA, 103 bp, Artificial Sequence
  Synthetic Polynucleotide
taatacgactcactatagggcttcttcgacctccttttctctttctcccgaacagaggagacgggagatggagaaaaggaacctggcggcagcgcaaaagatg

SEQ ID NO: 230202 - DNA, 103 bp, Artificial Sequence
  Synthetic Polynucleotide
taatacgactcactataggggctctgcccgccccctccgccctggcccagaacagaggagactgggcatgggcggagggaacctggcggcagcgcaaaagatg

SEQ ID NO: 230203 - DNA, 103 bp, Artificial Sequence
  Synthetic Polynucleotide
taatacgactcactatagggtcagcacactgctctgcccgccccctccgcaacagaggagagcggagatggcgggcagaaacctggcggcagcgcaaaagatg

SEQ ID NO: 230204 - DNA, 103 bp, Artificial Sequence
  Synthetic Polynucleotide
taatacgactcactatagggctgataccgctcagcacactgctctgcccgaacagaggagacgggcaatgcagtgtgctaacctggcggcagcgcaaaagatg

SEQ ID NO: 230205 - DNA, 103 bp, Artificial Sequence
  Synthetic Polynucleotide
taatacgactcactataggggtcgtagaggctgataccgctcagcacactaacagaggagaagtgtgatgagcggtatcaacctggcggcagcgcaaaagatg

SEQ ID NO: 230206 - DNA, 103 bp, Artificial Sequence
  Synthetic Polynucleotide
taatacgactcactataggggagtcctcgggtcgtagaggctgataccgcaacagaggagagcggtaatggcctctacgaacctggcggcagcgcaaaagatg

SEQ ID NO: 230207 - DNA, 103 bp, Artificial Sequence
  Synthetic Polynucleotide
taatacgactcactatagggcccgcgttgggagtcctcgggtcgtagaggaacagaggagacctctaatgcccgaggacaacctggcggcagcgcaaaagatg

SEQ ID NO: 230208 - DNA, 103 bp, Artificial Sequence
  Synthetic Polynucleotide
taatacgactcactatagggggctttgccccccgcgttgggagtcctcggaacagaggagaccgaggatgcccaacgcgaacctggcggcagcgcaaaagatg

SEQ ID NO: 230209 - DNA, 103 bp, Artificial Sequence
  Synthetic Polynucleotide
taatacgactcactatagggccggctctgtggctttgccccccgcgttggaacagaggagaccaacgatgggggcaaagaacctggcggcagcgcaaaagatg

SEQ ID NO: 230210 - DNA, 103 bp, Artificial Sequence
  Synthetic Polynucleotide
taatacgactcactataggggtgtcagcagccggctctgtggctttgcccaacagaggagagggcaaatgcacagagccaacctggcggcagcgcaaaagatg

SEQ ID NO: 230211 - DNA, 103 bp, Artificial Sequence
  Synthetic Polynucleotide
taatacgactcactatagggctgggcacccgtgtcagcagccggctctgtaacagaggagaacagagatggctgctgacaacctggcggcagcgcaaaagatg

SEQ ID NO: 230212 - DNA, 103 bp, Artificial Sequence
  Synthetic Polynucleotide
taatacgactcactatagggatttcctcctcttcttcgacctccttttctaacagaggagaagaaaaatgggtcgaagaaacctggcggcagcgcaaaagatg

SEQ ID NO: 230213 - DNA, 103 bp, Artificial Sequence
  Synthetic Polynucleotide
taatacgactcactatagggcacccttgggctgggcacccgtgtcagcagaacagaggagactgctgatgcgggtgcccaacctggcggcagcgcaaaagatg

SEQ ID NO: 230214 - DNA, 103 bp, Artificial Sequence
  Synthetic Polynucleotide
taatacgactcactatagggttgccctcagcacccttgggctgggcacccaacagaggagagggtgcatggcccaagggaacctggcggcagcgcaaaagatg

SEQ ID NO: 230215 - DNA, 103 bp, Artificial Sequence
  Synthetic Polynucleotide
taatacgactcactataggggctcttgccattgccctcagcacccttgggaacagaggagacccaagatggctgagggcaacctggcggcagcgcaaaagatg

SEQ ID NO: 230216 - DNA, 103 bp, Artificial Sequence
  Synthetic Polynucleotide
taatacgactcactatagggtggaggccgagctcttgccattgccctcagaacagaggagactgaggatgatggcaagaaacctggcggcagcgcaaaagatg

SEQ ID NO: 230217 - DNA, 103 bp, Artificial Sequence
  Synthetic Polynucleotide
taatacgactcactatagggtccttagccttggaggccgagctcttgccaaacagaggagatggcaaatgctcggcctcaacctggcggcagcgcaaaagatg

SEQ ID NO: 230218 - DNA, 103 bp, Artificial Sequence
  Synthetic Polynucleotide
taatacgactcactataggggaacgggggctccttagccttggaggccgaaacagaggagatcggccatgaaggctaagaacctggcggcagcgcaaaagatg

SEQ ID NO: 230219 - DNA, 103 bp, Artificial Sequence
  Synthetic Polynucleotide
taatacgactcactatagggacttgcggacgaacgggggctccttagcctaacagaggagaaggctaatgagcccccgtaacctggcggcagcgcaaaagatg

SEQ ID NO: 230220 - DNA, 103 bp, Artificial Sequence
  Synthetic Polynucleotide
taatacgactcactatagggtccagggcagacttgcggacgaacgggggcaacagaggagagcccccatgcgtccgcaaaacctggcggcagcgcaaaagatg

SEQ ID NO: 230221 - DNA, 103 bp, Artificial Sequence
  Synthetic Polynucleotide
taatacgactcactatagggctctggctgttccagggcagacttgcggacaacagaggagagtccgcatgtctgccctgaacctggcggcagcgcaaaagatg

SEQ ID NO: 230222 - DNA, 103 bp, Artificial Sequence
  Synthetic Polynucleotide
taatacgactcactatagggccttccctgtctctggctgttccagggcagaacagaggagactgcccatgaacagccagaacctggcggcagcgcaaaagatg

SEQ ID NO: 230223 - DNA, 103 bp, Artificial Sequence
  Synthetic Polynucleotide
taatacgactcactatagggttgtgcttggatttcctcctcttcttcgacaacagaggagagtcgaaatggaggaggaaaacctggcggcagcgcaaaagatg

SEQ ID NO: 230224 - DNA, 103 bp, Artificial Sequence
  Synthetic Polynucleotide
taatacgactcactatagggtcagcaccggccttccctgtctctggctgtaacagaggagaacagccatggacagggaaaacctggcggcagcgcaaaagatg

SEQ ID NO: 230225 - DNA, 103 bp, Artificial Sequence
  Synthetic Polynucleotide
taatacgactcactatagggggtgcccccatcagcaccggccttccctgtaacagaggagaacagggatggccggtgctaacctggcggcagcgcaaaagatg

SEQ ID NO: 230226 - DNA, 103 bp, Artificial Sequence
  Synthetic Polynucleotide
taatacgactcactatagggtgtccgtgggggtgcccccatcagcaccggaacagaggagaccggtgatgatgggggcaaacctggcggcagcgcaaaagatg

SEQ ID NO: 230227 - DNA, 103 bp, Artificial Sequence
  Synthetic Polynucleotide
taatacgactcactatagggctgttgtatctgtccgtgggggtgcccccaaacagaggagatgggggatgccccacggaaacctggcggcagcgcaaaagatg

SEQ ID NO: 230228 - DNA, 103 bp, Artificial Sequence
  Synthetic Polynucleotide
taatacgactcactatagggccggttgtagctgttgtatctgtccgtgggaacagaggagacccacgatgagatacaacaacctggcggcagcgcaaaagatg

SEQ ID NO: 230229 - DNA, 103 bp, Artificial Sequence
  Synthetic Polynucleotide
taatacgactcactatagggtgggccggggccggttgtagctgttgtatcaacagaggagagatacaatggctacaaccaacctggcggcagcgcaaaagatg

SEQ ID NO: 230230 - DNA, 103 bp, Artificial Sequence
  Synthetic Polynucleotide
taatacgactcactataggggcagcagccttgggccggggccggttgtagaacagaggagactacaaatggccccggccaacctggcggcagcgcaaaagatg

SEQ ID NO: 230231 - DNA, 103 bp, Artificial Sequence
  Synthetic Polynucleotide
taatacgactcactatagggagcgggggctgcagcagccttgggccggggaacagaggagaccccggatgaaggctgctaacctggcggcagcgcaaaagatg

SEQ ID NO: 230232 - DNA, 103 bp, Artificial Sequence
  Synthetic Polynucleotide
taatacgactcactatagggcggtggtggcagcgggggctgcagcagcctaacagaggagaaggctgatgcagcccccgaacctggcggcagcgcaaaagatg

SEQ ID NO: 230233 - DNA, 103 bp, Artificial Sequence
  Synthetic Polynucleotide
taatacgactcactatagggggtggggtggcggtggtggcagcgggggctaacagaggagaagccccatgtgccaccacaacctggcggcagcgcaaaagatg

SEQ ID NO: 230234 - DNA, 103 bp, Artificial Sequence
  Synthetic Polynucleotide
taatacgactcactatagggagcatggcgtttgtgcttggatttcctcctaacagaggagaaggaggatgtccaagcacaacctggcggcagcgcaaaagatg

SEQ ID NO: 230235 - DNA, 103 bp, Artificial Sequence
  Synthetic Polynucleotide
taatacgactcactatagggaccctcggggggtggggtggcggtggtggcaacagaggagagccaccatggccaccccaaacctggcggcagcgcaaaagatg

SEQ ID NO: 230236 - DNA, 103 bp, Artificial Sequence
  Synthetic Polynucleotide
taatacgactcactatagggggggtggggcaccctcggggggtggggtggaacagaggagaccacccatgcccccgaggaacctggcggcagcgcaaaagatg

SEQ ID NO: 230237 - DNA, 103 bp, Artificial Sequence
  Synthetic Polynucleotide
taatacgactcactatagggaccccgggctggggtggggcaccctcggggaacagaggagaccccgaatgtgccccaccaacctggcggcagcgcaaaagatg

SEQ ID NO: 230238 - DNA, 103 bp, Artificial Sequence
  Synthetic Polynucleotide
taatacgactcactatagggcaggttgtgcaccccgggctggggtggggcaacagaggagagccccaatgcagcccgggaacctggcggcagcgcaaaagatg

SEQ ID NO: 230239 - DNA, 103 bp, Artificial Sequence
  Synthetic Polynucleotide
taatacgactcactatagggtgggcacgggcaggttgtgcaccccgggctaacagaggagaagcccgatgtgcacaaccaacctggcggcagcgcaaaagatg

SEQ ID NO: 230240 - DNA, 103 bp, Artificial Sequence
  Synthetic Polynucleotide
taatacgactcactatagggccgaagagggtgggcacgggcaggttgtgcaacagaggagagcacaaatggcccgtgccaacctggcggcagcgcaaaagatg

SEQ ID NO: 230241 - DNA, 103 bp, Artificial Sequence
  Synthetic Polynucleotide
taatacgactcactatagggcttcaccgtcccgaagagggtgggcacgggaacagaggagacccgtgatgaccctcttcaacctggcggcagcgcaaaagatg

SEQ ID NO: 230242 - DNA, 103 bp, Artificial Sequence
  Synthetic Polynucleotide
taatacgactcactatagggtgggtgtctgcttcaccgtcccgaagagggaacagaggagaccctctatgggacggtgaaacctggcggcagcgcaaaagatg

SEQ ID NO: 230243 - DNA, 103 bp, Artificial Sequence
  Synthetic Polynucleotide
taatacgactcactataggggagcccgtcttgggtgtctgcttcaccgtcaacagaggagagacggtatggcagacaccaacctggcggcagcgcaaaagatg

SEQ ID NO: 230244 - DNA, 103 bp, Artificial Sequence
  Synthetic Polynucleotide
taatacgactcactatagggtgggcttcctgagcccgtcttgggtgtctgaacagaggagacagacaatgaagacgggcaacctggcggcagcgcaaaagatg

SEQ ID NO: 230245 - DNA, 103 bp, Artificial Sequence
  Synthetic Polynucleotide
taatacgactcactatagggcgctagaagaagcatggcgtttgtgcttggaacagaggagaccaagcatgaacgccatgaacctggcggcagcgcaaaagatg

SEQ ID NO: 230246 - DNA, 103 bp, Artificial Sequence
  Synthetic Polynucleotide
taatacgactcactatagggtcccagcaaatgggcttcctgagcccgtctaacagaggagaagacggatgcaggaagccaacctggcggcagcgcaaaagatg

SEQ ID NO: 230247 - DNA, 103 bp, Artificial Sequence
  Synthetic Polynucleotide
taatacgactcactataggggccggactgttcccagcaaatgggcttcctaacagaggagaaggaagatgatttgctggaacctggcggcagcgcaaaagatg

SEQ ID NO: 230248 - DNA, 103 bp, Artificial Sequence
  Synthetic Polynucleotide
taatacgactcactatagggaccctcgcgggccggactgttcccagcaaaaacagaggagatttgctatgaacagtccgaacctggcggcagcgcaaaagatg

SEQ ID NO: 230249 - DNA, 103 bp, Artificial Sequence
  Synthetic Polynucleotide
taatacgactcactatagggcatcctgctcaccctcgcgggccggactgtaacagaggagaacagtcatgcccgcgaggaacctggcggcagcgcaaaagatg

SEQ ID NO: 230250 - DNA, 103 bp, Artificial Sequence
  Synthetic Polynucleotide
taatacgactcactatagggagggatgccgcatcctgctcaccctcgcggaacagaggagaccgcgaatgtgagcaggaaacctggcggcagcgcaaaagatg

SEQ ID NO: 230251 - DNA, 103 bp, Artificial Sequence
  Synthetic Polynucleotide
taatacgactcactatagggaacatccttcagggatgccgcatcctgctcaacagaggagagagcagatggcggcatccaacctggcggcagcgcaaaagatg

SEQ ID NO: 230252 - DNA, 103 bp, Artificial Sequence
  Synthetic Polynucleotide
taatacgactcactatagggagcctttaaaaacatccttcagggatgccgaacagaggagacggcatatgtgaaggatgaacctggcggcagcgcaaaagatg

SEQ ID NO: 230253 - DNA, 103 bp, Artificial Sequence
  Synthetic Polynucleotide
taatacgactcactataggggtggggtcgaagcctttaaaaacatccttcaacagaggagagaaggaatgttttaaaggaacctggcggcagcgcaaaagatg

SEQ ID NO: 230254 - DNA, 103 bp, Artificial Sequence
  Synthetic Polynucleotide
taatacgactcactataggggggggaggccgtggggtcgaagcctttaaaaacagaggagatttaaaatgttcgaccccaacctggcggcagcgcaaaagatg

SEQ ID NO: 230255 - DNA, 103 bp, Artificial Sequence
  Synthetic Polynucleotide
taatacgactcactatagggactggcaaaagggggaggccgtggggtcgaaacagaggagatcgaccatgcggcctcccaacctggcggcagcgcaaaagatg

SEQ ID NO: 230256 - DNA, 103 bp, Artificial Sequence
  Synthetic Polynucleotide
taatacgactcactataggggagaagtcatcgctagaagaagcatggcgtaacagaggagaacgccaatgttcttctagaacctggcggcagcgcaaaagatg

SEQ ID NO: 230257 - DNA, 103 bp, Artificial Sequence
  Synthetic Polynucleotide
taatacgactcactatagggcgatggcggcggcggcgactctgatggcggaacagaggagaccgccaatggagtcgccgaacctggcggcagcgcaaaagatg

SEQ ID NO: 230258 - DNA, 103 bp, Artificial Sequence
  Synthetic Polynucleotide
taatacgactcactatagggtgagaagtcagagaagtcatcgctagaagaaacagaggagatcttctatggatgacttcaacctggcggcagcgcaaaagatg

SEQ ID NO: 230259 - DNA, 103 bp, Artificial Sequence
  Synthetic Polynucleotide
taatacgactcactatagggccgagtcatctgagaagtcagagaagtcataacagaggagaatgactatgctgacttctaacctggcggcagcgcaaaagatg

SEQ ID NO: 230260 - DNA, 103 bp, Artificial Sequence
  Synthetic Polynucleotide
taatacgactcactataggggggctgaaatccgagtcatctgagaagtcaaacagaggagatgacttatgagatgactcaacctggcggcagcgcaaaagatg

SEQ ID NO: 230261 - DNA, 103 bp, Artificial Sequence
  Synthetic Polynucleotide
taatacgactcactatagggtttctcactggggctgaaatccgagtcatcaacagaggagagatgacatggatttcagcaacctggcggcagcgcaaaagatg

SEQ ID NO: 230262 - DNA, 103 bp, Artificial Sequence
  Synthetic Polynucleotide
taatacgactcactatagggtgcggtgacctttctcactggggctgaaataacagaggagaatttcaatgccagtgagaaacctggcggcagcgcaaaagatg

SEQ ID NO: 230263 - DNA, 103 bp, Artificial Sequence
  Synthetic Polynucleotide
taatacgactcactatagggtctctgtacttgcggtgacctttctcactgaacagaggagacagtgaatgaggtcaccgaacctggcggcagcgcaaaagatg

SEQ ID NO: 230264 - DNA, 103 bp, Artificial Sequence
  Synthetic Polynucleotide
taatacgactcactatagggggggctgtactctctgtacttgcggtgaccaacagaggagaggtcacatgaagtacagaaacctggcggcagcgcaaaagatg

SEQ ID NO: 230265 - DNA, 103 bp, Artificial Sequence
  Synthetic Polynucleotide
taatacgactcactataggggcgcatatggggggctgtactctctgtactaacagaggagaagtacaatgagtacagccaacctggcggcagcgcaaaagatg

SEQ ID NO: 230266 - DNA, 103 bp, Artificial Sequence
  Synthetic Polynucleotide
taatacgactcactatagggtggtgggacggcgcatatggggggctgtacaacagaggagagtacagatgcccatatgcaacctggcggcagcgcaaaagatg

SEQ ID NO: 230267 - DNA, 103 bp, Artificial Sequence
  Synthetic Polynucleotide
taatacgactcactatagggggggtactgctggtgggacggcgcatatggaacagaggagaccatatatgccgtcccacaacctggcggcagcgcaaaagatg

SEQ ID NO: 230268 - DNA, 103 bp, Artificial Sequence
  Synthetic Polynucleotide
taatacgactcactataggggcggcggcggcgatggcggcggcggcgactaacagaggagaagtcgcatgcgccgccataacctggcggcagcgcaaaagatg

SEQ ID NO: 230269 - DNA, 103 bp, Artificial Sequence
  Synthetic Polynucleotide
taatacgactcactatagggcatgcgatggggggtactgctggtgggacgaacagaggagacgtcccatgagcagtaccaacctggcggcagcgcaaaagatg

SEQ ID NO: 230270 - DNA, 103 bp, Artificial Sequence
  Synthetic Polynucleotide
taatacgactcactatagggaggggcgtggcatgcgatggggggtactgcaacagaggagagcagtaatgcccatcgcaaacctggcggcagcgcaaaagatg

SEQ ID NO: 230271 - DNA, 103 bp, Artificial Sequence
  Synthetic Polynucleotide
taatacgactcactatagggcttcttgggcaggggcgtggcatgcgatggaacagaggagaccatcgatggccacgcccaacctggcggcagcgcaaaagatg

SEQ ID NO: 230272 - DNA, 103 bp, Artificial Sequence
  Synthetic Polynucleotide
taatacgactcactatagggtggagtatgccttcttgggcaggggcgtggaacagaggagaccacgcatgtgcccaagaaacctggcggcagcgcaaaagatg

SEQ ID NO: 230273 - DNA, 103 bp, Artificial Sequence
  Synthetic Polynucleotide
taatacgactcactatagggctgtccatcttggagtatgccttcttgggcaacagaggagagcccaaatgggcatactcaacctggcggcagcgcaaaagatg

SEQ ID NO: 230274 - DNA, 103 bp, Artificial Sequence
  Synthetic Polynucleotide
taatacgactcactatagggataactcttgctgtccatcttggagtatgcaacagaggagagcatacatgaagatggacaacctggcggcagcgcaaaagatg

SEQ ID NO: 230275 - DNA, 103 bp, Artificial Sequence
  Synthetic Polynucleotide
taatacgactcactatagggcgtacatgccataactcttgctgtccatctaacagaggagaagatggatggcaagagttaacctggcggcagcgcaaaagatg

SEQ ID NO: 230276 - DNA, 103 bp, Artificial Sequence
  Synthetic Polynucleotide
taatacgactcactatagggtcgtagtcctcgtacatgccataactcttgaacagaggagacaagagatgtggcatgtaaacctggcggcagcgcaaaagatg

SEQ ID NO: 230277 - DNA, 103 bp, Artificial Sequence
  Synthetic Polynucleotide
taatacgactcactatagggctgctcattctcgtagtcctcgtacatgccaacagaggagaggcatgatggaggactacaacctggcggcagcgcaaaagatg

SEQ ID NO: 230278 - DNA, 103 bp, Artificial Sequence
  Synthetic Polynucleotide
taatacgactcactatagggattccccatactgctcattctcgtagtcctaacagaggagaaggactatgagaatgagcaacctggcggcagcgcaaaagatg

SEQ ID NO: 230279 - DNA, 103 bp, Artificial Sequence
  Synthetic Polynucleotide
taatacgactcactatagggggcgttgatggcggcggcggcgatggcggcaacagaggagagccgccatggccgccgccaacctggcggcagcgcaaaagatg

SEQ ID NO: 230280 - DNA, 103 bp, Artificial Sequence
  Synthetic Polynucleotide
taatacgactcactatagggtcgccctcatattccccatactgctcattcaacagaggagagaatgaatggtatggggaaacctggcggcagcgcaaaagatg

SEQ ID NO: 230281 - DNA, 103 bp, Artificial Sequence
  Synthetic Polynucleotide
taatacgactcactatagggctcctcctcgtcgccctcatattccccataaacagaggagatatgggatgtatgagggcaacctggcggcagcgcaaaagatg

SEQ ID NO: 230282 - DNA, 103 bp, Artificial Sequence
  Synthetic Polynucleotide
taatacgactcactatagggtgcccatgtcctcctcctcgtcgccctcataacagaggagaatgaggatgacgaggaggaacctggcggcagcgcaaaagatg

SEQ ID NO: 230283 - DNA, 103 bp, Artificial Sequence
  Synthetic Polynucleotide
taatacgactcactatagggtagtcctccttgcccatgtcctcctcctcgaacagaggagacgaggaatgggacatgggaacctggcggcagcgcaaaagatg

SEQ ID NO: 230284 - DNA, 103 bp, Artificial Sequence
  Synthetic Polynucleotide
taatacgactcactataggggaagtcgtcatagtcctccttgcccatgtcaacagaggagagacatgatgaaggaggacaacctggcggcagcgcaaaagatg

SEQ ID NO: 230285 - DNA, 103 bp, Artificial Sequence
  Synthetic Polynucleotide
taatacgactcactataggggctctttggtgaagtcgtcatagtcctcctaacagaggagaaggaggatgatgacgactaacctggcggcagcgcaaaagatg

SEQ ID NO: 230286 - DNA, 103 bp, Artificial Sequence
  Synthetic Polynucleotide
taatacgactcactatagggtactggttcagctctttggtgaagtcgtcaaacagaggagatgacgaatgcaccaaagaaacctggcggcagcgcaaaagatg

SEQ ID NO: 230287 - DNA, 103 bp, Artificial Sequence
  Synthetic Polynucleotide
taatacgactcactatagggggcacgccggtactggttcagctctttggtaacagaggagaaccaaaatgctgaaccagaacctggcggcagcgcaaaagatg

SEQ ID NO: 230288 - DNA, 103 bp, Artificial Sequence
  Synthetic Polynucleotide
taatacgactcactatagggtgccctccttggcacgccggtactggttcaaacagaggagatgaaccatgaccggcgtgaacctggcggcagcgcaaaagatg

SEQ ID NO: 230289 - DNA, 103 bp, Artificial Sequence
  Synthetic Polynucleotide
taatacgactcactatagggccgcggctgctgccctccttggcacgccggaacagaggagaccggcgatgcaaggagggaacctggcggcagcgcaaaagatg

SEQ ID NO: 230290 - DNA, 103 bp, Artificial Sequence
  Synthetic Polynucleotide
taatacgactcactatagggaggaggcgaaggcgttgatggcggcggcggaacagaggagaccgccgatgccatcaacgaacctggcggcagcgcaaaagatg

SEQ ID NO: 230291 - DNA, 103 bp, Artificial Sequence
  Synthetic Polynucleotide
taatacgactcactataggggctgcctcggccgcggctgctgccctccttaacagaggagaaaggagatgagcagccgcaacctggcggcagcgcaaaagatg

SEQ ID NO: 230292 - DNA, 103 bp, Artificial Sequence
  Synthetic Polynucleotide
taatacgactcactatagggcccggcctcggctgcctcggccgcggctgcaacagaggagagcagccatggccgaggcaaacctggcggcagcgcaaaagatg

SEQ ID NO: 230293 - DNA, 103 bp, Artificial Sequence
  Synthetic Polynucleotide
taatacgactcactatagggtagccccggccccggcctcggctgcctcggaacagaggagaccgaggatgccgaggccgaacctggcggcagcgcaaaagatg

SEQ ID NO: 230294 - DNA, 103 bp, Artificial Sequence
  Synthetic Polynucleotide
taatacgactcactatagggtcggcccctgtagccccggccccggcctcgaacagaggagacgaggcatgggccggggcaacctggcggcagcgcaaaagatg

SEQ ID NO: 230295 - DNA, 103 bp, Artificial Sequence
  Synthetic Polynucleotide
taatacgactcactatagggcacggcttcctcggcccctgtagccccggcaacagaggagagccgggatgacaggggccaacctggcggcagcgcaaaagatg

SEQ ID NO: 230296 - DNA, 103 bp, Artificial Sequence
  Synthetic Polynucleotide
taatacgactcactatagggcgcgatcctccacggcttcctcggcccctgaacagaggagacaggggatgaggaagccgaacctggcggcagcgcaaaagatg

SEQ ID NO: 230297 - DNA, 103 bp, Artificial Sequence
  Synthetic Polynucleotide
taatacgactcactataggggccgcggcctcgcgatcctccacggcttccaacagaggagaggaagcatgggaggatcgaacctggcggcagcgcaaaagatg

SEQ ID NO: 230298 - DNA, 103 bp, Artificial Sequence
  Synthetic Polynucleotide
taatacgactcactatagggccctgcccatgccgcggcctcgcgatcctcaacagaggagagaggatatggaggccgcgaacctggcggcagcgcaaaagatg

SEQ ID NO: 230299 - DNA, 103 bp, Artificial Sequence
  Synthetic Polynucleotide
taatacgactcactatagggcctcggctgcccctgcccatgccgcggcctaacagaggagaaggccgatgcatgggcagaacctggcggcagcgcaaaagatg

SEQ ID NO: 230300 - DNA, 103 bp, Artificial Sequence
  Synthetic Polynucleotide
taatacgactcactatagggtctgcccctgcctcggctgcccctgcccataacagaggagaatgggcatgggcagccgaaacctggcggcagcgcaaaagatg

SEQ ID NO: 230301 - DNA, 103 bp, Artificial Sequence
  Synthetic Polynucleotide
taatacgactcactataggggggaacacggaggaggcgaaggcgttgatgaacagaggagacatcaaatgcttcgcctcaacctggcggcagcgcaaaagatg

SEQ ID NO: 230302 - DNA, 103 bp, Artificial Sequence
  Synthetic Polynucleotide
taatacgactcactatagggccatagagcctctgcccctgcctcggctgcaacagaggagagcagccatggcaggggcaaacctggcggcagcgcaaaagatg

SEQ ID NO: 230303 - DNA, 103 bp, Artificial Sequence
  Synthetic Polynucleotide
taatacgactcactatagggtggtctcctcccatagagcctctgcccctgaacagaggagacaggggatgaggctctataacctggcggcagcgcaaaagatg

SEQ ID NO: 230304 - DNA, 103 bp, Artificial Sequence
  Synthetic Polynucleotide
taatacgactcactatagggatcctccgggtggtctcctcccatagagccaacagaggagaggctctatgggaggagacaacctggcggcagcgcaaaagatg

SEQ ID NO: 230305 - DNA, 103 bp, Artificial Sequence
  Synthetic Polynucleotide
taatacgactcactatagggaatcctcttcatcctccgggtggtctcctcaacagaggagagaggagatgacccggaggaacctggcggcagcgcaaaagatg

SEQ ID NO: 230306 - DNA, 103 bp, Artificial Sequence
  Synthetic Polynucleotide
taatacgactcactatagggtcctcgtagaaatcctcttcatcctccgggaacagaggagacccggaatgtgaagaggaaacctggcggcagcgcaaaagatg

SEQ ID NO: 230307 - DNA, 103 bp, Artificial Sequence
  Synthetic Polynucleotide
taatacgactcactataggggtccatctcttcctcgtagaaatcctcttcaacagaggagagaagagatgttctacgagaacctggcggcagcgcaaaagatg

SEQ ID NO: 230308 - DNA, 103 bp, Artificial Sequence
  Synthetic Polynucleotide
taatacgactcactatagggtctctccatagtccatctcttcctcgtagaaacagaggagatctacgatgaagagatggaacctggcggcagcgcaaaagatg

SEQ ID NO: 230309 - DNA, 103 bp, Artificial Sequence
  Synthetic Polynucleotide
taatacgactcactatagggggctcctcactctctccatagtccatctctaacagaggagaagagatatgctatggagaaacctggcggcagcgcaaaagatg

SEQ ID NO: 230310 - DNA, 103 bp, Artificial Sequence
  Synthetic Polynucleotide
taatacgactcactataggggtctcccattggctcctcactctctccataaacagaggagatatggaatgagtgaggagaacctggcggcagcgcaaaagatg

SEQ ID NO: 230311 - DNA, 103 bp, Artificial Sequence
  Synthetic Polynucleotide
taatacgactcactatagggcatagtcgtcgtctcccattggctcctcacaacagaggagagtgaggatgcaatgggagaacctggcggcagcgcaaaagatg

SEQ ID NO: 230312 - DNA, 103 bp, Artificial Sequence
  Synthetic Polynucleotide
taatacgactcactatagggcgggcgtcgggggaacacggaggaggcgaaaacagaggagattcgccatgtccgtgttcaacctggcggcagcgcaaaagatg

SEQ ID NO: 230313 - DNA, 103 bp, Artificial Sequence
  Synthetic Polynucleotide
taatacgactcactataggggagtactcgtcatagtcgtcgtctcccattaacagaggagaaatgggatgcgacgactaaacctggcggcagcgcaaaagatg

SEQ ID NO: 230314 - DNA, 103 bp, Artificial Sequence
  Synthetic Polynucleotide
taatacgactcactatagggcagctccttggagtactcgtcatagtcgtcaacagaggagagacgacatggacgagtacaacctggcggcagcgcaaaagatg

SEQ ID NO: 230315 - DNA, 103 bp, Artificial Sequence
  Synthetic Polynucleotide
taatacgactcactatagggggtactggttcagctccttggagtactcgtaacagaggagaacgagtatgccaaggagcaacctggcggcagcgcaaaagatg

SEQ ID NO: 230316 - DNA, 103 bp, Artificial Sequence
  Synthetic Polynucleotide
taatacgactcactatagggttggagcggcggtactggttcagctccttgaacagaggagacaaggaatggaaccagtaaacctggcggcagcgcaaaagatg

SEQ ID NO: 230317 - DNA, 103 bp, Artificial Sequence
  Synthetic Polynucleotide
taatacgactcactatagggtcggctgtccttggagcggcggtactggttaacagaggagaaaccagatgcgccgctccaacctggcggcagcgcaaaagatg

SEQ ID NO: 230318 - DNA, 103 bp, Artificial Sequence
  Synthetic Polynucleotide
taatacgactcactataggggccctcggcctcggctgtccttggagcggcaacagaggagagccgctatgaggacagccaacctggcggcagcgcaaaagatg

SEQ ID NO: 230319 - DNA, 103 bp, Artificial Sequence
  Synthetic Polynucleotide
taatacgactcactatagggcctcgacttagccctcggcctcggctgtccaacagaggagaggacagatgaggccgaggaacctggcggcagcgcaaaagatg

SEQ ID NO: 230320 - DNA, 103 bp, Artificial Sequence
  Synthetic Polynucleotide
taatacgactcactatagggcctgccacggcctcgacttagccctcggccaacagaggagaggccgaatgctaagtcgaaacctggcggcagcgcaaaagatg

SEQ ID NO: 230321 - DNA, 103 bp, Artificial Sequence
  Synthetic Polynucleotide
taatacgactcactatagggctcgggagcccctgccacggcctcgacttaaacagaggagataagtcatggccgtggcaaacctggcggcagcgcaaaagatg

SEQ ID NO: 230322 - DNA, 103 bp, Artificial Sequence
  Synthetic Polynucleotide
taatacgactcactatagggttccctcgacctcgggagcccctgccacggaacagaggagaccgtggatggggctcccgaacctggcggcagcgcaaaagatg

SEQ ID NO: 230323 - DNA, 103 bp, Artificial Sequence
  Synthetic Polynucleotide
taatacgactcactataggggtcgtgccctgcatgttcagagtctgtcataacagaggagaatgacaatgtctgaacataacctggcggcagcgcaaaagatg

SEQ ID NO: 230324 - DNA, 103 bp, Artificial Sequence
  Synthetic Polynucleotide
taatacgactcactatagggctgcttttcattctcttttgcttctttttcaacagaggagagaaaaaatggcaaaagagaacctggcggcagcgcaaaagatg

SEQ ID NO: 230325 - DNA, 103 bp, Artificial Sequence
  Synthetic Polynucleotide
taatacgactcactataggggtaacattttgctccactatgatagaacttaacagaggagaaagttcatgcatagtggaaacctggcggcagcgcaaaagatg

SEQ ID NO: 230326 - DNA, 103 bp, Artificial Sequence
  Synthetic Polynucleotide
taatacgactcactatagggtgtctccctggtaacattttgctccactataacagaggagaatagtgatgcaaaatgttaacctggcggcagcgcaaaagatg

SEQ ID NO: 230327 - DNA, 103 bp, Artificial Sequence
  Synthetic Polynucleotide
taatacgactcactatagggaatttacagttgtctccctggtaacattttaacagaggagaaaaatgatgccagggagaaacctggcggcagcgcaaaagatg

SEQ ID NO: 230328 - DNA, 103 bp, Artificial Sequence
  Synthetic Polynucleotide
taatacgactcactatagggatcatgggaaaatttacagttgtctccctgaacagaggagacagggaatgaactgtaaaaacctggcggcagcgcaaaagatg

SEQ ID NO: 230329 - DNA, 103 bp, Artificial Sequence
  Synthetic Polynucleotide
taatacgactcactatagggtagttagatcatcatgggaaaatttacagtaacagaggagaactgtaatgtttcccatgaacctggcggcagcgcaaaagatg

SEQ ID NO: 230330 - DNA, 103 bp, Artificial Sequence
  Synthetic Polynucleotide
taatacgactcactatagggtttgtttctttagttagatcatcatgggaaaacagaggagattcccaatgtgatctaacaacctggcggcagcgcaaaagatg

SEQ ID NO: 230331 - DNA, 103 bp, Artificial Sequence
  Synthetic Polynucleotide
taatacgactcactatagggcaaaagtttctttgtttctttagttagatcaacagaggagagatctaatgaaagaaacaaacctggcggcagcgcaaaagatg

SEQ ID NO: 230332 - DNA, 103 bp, Artificial Sequence
  Synthetic Polynucleotide
taatacgactcactatagggacactttgtccaaaagtttctttgtttcttaacagaggagaaagaaaatgagaaactttaacctggcggcagcgcaaaagatg

SEQ ID NO: 230333 - DNA, 103 bp, Artificial Sequence
  Synthetic Polynucleotide
taatacgactcactatagggtcagtattcaacactttgtccaaaagtttcaacagaggagagaaactatgggacaaagtaacctggcggcagcgcaaaagatg

SEQ ID NO: 230334 - DNA, 103 bp, Artificial Sequence
  Synthetic Polynucleotide
taatacgactcactataggggagttcttcatcagtattcaacactttgtcaacagaggagagacaaaatgttgaatactaacctggcggcagcgcaaaagatg

SEQ ID NO: 230335 - DNA, 103 bp, Artificial Sequence
  Synthetic Polynucleotide
taatacgactcactatagggtctcacttttctgcttttcattctcttttgaacagaggagacaaaagatgatgaaaagcaacctggcggcagcgcaaaagatg

SEQ ID NO: 230336 - DNA, 103 bp, Artificial Sequence
  Synthetic Polynucleotide
taatacgactcactatagggcttcatttatgagttcttcatcagtattcaaacagaggagatgaataatgatgaagaacaacctggcggcagcgcaaaagatg

SEQ ID NO: 230337 - DNA, 103 bp, Artificial Sequence
  Synthetic Polynucleotide
taatacgactcactatagggtctctttcatcttcatttatgagttcttcaaacagaggagatgaagaatgcataaatgaaacctggcggcagcgcaaaagatg

SEQ ID NO: 230338 - DNA, 103 bp, Artificial Sequence
  Synthetic Polynucleotide
taatacgactcactatagggttcctctaattctctttcatcttcatttataacagaggagaataaatatggatgaaagaaacctggcggcagcgcaaaagatg

SEQ ID NO: 230339 - DNA, 103 bp, Artificial Sequence
  Synthetic Polynucleotide
taatacgactcactataggggctttctaagttcctctaattctctttcataacagaggagaatgaaaatgaattagaggaacctggcggcagcgcaaaagatg

SEQ ID NO: 230340 - DNA, 103 bp, Artificial Sequence
  Synthetic Polynucleotide
taatacgactcactataggggttatgccacgctttctaagttcctctaataacagaggagaattagaatgacttagaaaaacctggcggcagcgcaaaagatg

SEQ ID NO: 230341 - DNA, 103 bp, Artificial Sequence
  Synthetic Polynucleotide
taatacgactcactataggggggaagaggagttatgccacgctttctaagaacagaggagacttagaatgcgtggcataaacctggcggcagcgcaaaagatg

SEQ ID NO: 230342 - DNA, 103 bp, Artificial Sequence
  Synthetic Polynucleotide
taatacgactcactataggggaggtggtttgggaagaggagttatgccacaacagaggagagtggcaatgctcctcttcaacctggcggcagcgcaaaagatg

SEQ ID NO: 230343 - DNA, 103 bp, Artificial Sequence
  Synthetic Polynucleotide
taatacgactcactatagggccaacccctggaggtggtttgggaagaggaaacagaggagatcctctatgcaaaccaccaacctggcggcagcgcaaaagatg

SEQ ID NO: 230344 - DNA, 103 bp, Artificial Sequence
  Synthetic Polynucleotide
taatacgactcactatagggtggcagaagcccaacccctggaggtggtttaacagaggagaaaaccaatgccaggggttaacctggcggcagcgcaaaagatg

SEQ ID NO: 230345 - DNA, 103 bp, Artificial Sequence
  Synthetic Polynucleotide
taatacgactcactatagggctggaggggttggcagaagcccaacccctgaacagaggagacaggggatgggcttctgcaacctggcggcagcgcaaaagatg

SEQ ID NO: 230346 - DNA, 103 bp, Artificial Sequence
  Synthetic Polynucleotide
taatacgactcactatagggctgtaggctttctcacttttctgcttttcaaacagaggagatgaaaaatggaaaagtgaaacctggcggcagcgcaaaagatg

SEQ ID NO: 230347 - DNA, 103 bp, Artificial Sequence
  Synthetic Polynucleotide
taatacgactcactatagggggaaaatgctctggaggggttggcagaagcaacagaggagagcttctatgaacccctccaacctggcggcagcgcaaaagatg

SEQ ID NO: 230348 - DNA, 103 bp, Artificial Sequence
  Synthetic Polynucleotide
taatacgactcactatagggatcagaaaagggaaaatgctctggaggggtaacagaggagaacccctatggagcattttaacctggcggcagcgcaaaagatg

SEQ ID NO: 230349 - DNA, 103 bp, Artificial Sequence
  Synthetic Polynucleotide
taatacgactcactatagggcgtcttcaggatcagaaaagggaaaatgctaacagaggagaagcattatgccttttctgaacctggcggcagcgcaaaagatg

SEQ ID NO: 230350 - DNA, 103 bp, Artificial Sequence
  Synthetic Polynucleotide
taatacgactcactataggggtctgaaaatcgtcttcaggatcagaaaagaacagaggagacttttcatgtcctgaagaaacctggcggcagcgcaaaagatg

SEQ ID NO: 230351 - DNA, 103 bp, Artificial Sequence
  Synthetic Polynucleotide
taatacgactcactatagggagagaaatctgtctgaaaatcgtcttcaggaacagaggagacctgaaatggattttcagaacctggcggcagcgcaaaagatg

SEQ ID NO: 230352 - DNA, 103 bp, Artificial Sequence
  Synthetic Polynucleotide
taatacgactcactatagggtaaaatcatcagagaaatctgtctgaaaataacagaggagaattttcatgcagatttctaacctggcggcagcgcaaaagatg

SEQ ID NO: 230353 - DNA, 103 bp, Artificial Sequence
  Synthetic Polynucleotide
taatacgactcactatagggggaattttcctaaaatcatcagagaaatctaacagaggagaagatttatgtgatgatttaacctggcggcagcgcaaaagatg

SEQ ID NO: 230354 - DNA, 103 bp, Artificial Sequence
  Synthetic Polynucleotide
taatacgactcactatagggaaaaagagatggaattttcctaaaatcatcaacagaggagagatgatatgaggaaaattaacctggcggcagcgcaaaagatg

SEQ ID NO: 230355 - DNA, 103 bp, Artificial Sequence
  Synthetic Polynucleotide
taatacgactcactatagggcaactatttcaaaaagagatggaattttccaacagaggagaggaaaaatgcatctctttaacctggcggcagcgcaaaagatg

SEQ ID NO: 230356 - DNA, 103 bp, Artificial Sequence
  Synthetic Polynucleotide
taatacgactcactataggggtaggttttacaactatttcaaaaagagataacagaggagaatctctatgtgaaatagtaacctggcggcagcgcaaaagatg

SEQ ID NO: 230357 - DNA, 103 bp, Artificial Sequence
  Synthetic Polynucleotide
taatacgactcactatagggtcttgattttctgtaggctttctcacttttaacagaggagaaaaagtatgaaagcctacaacctggcggcagcgcaaaagatg

SEQ ID NO: 230358 - DNA, 103 bp, Artificial Sequence
  Synthetic Polynucleotide
taatacgactcactatagggtaaatccacagtaggttttacaactatttcaacagaggagagaaataatggtaaaacctaacctggcggcagcgcaaaagatg

SEQ ID NO: 230359 - DNA, 103 bp, Artificial Sequence
  Synthetic Polynucleotide
taatacgactcactatagggttttatgcgctaaatccacagtaggttttaaacagaggagataaaacatgctgtggattaacctggcggcagcgcaaaagatg

SEQ ID NO: 230360 - DNA, 103 bp, Artificial Sequence
  Synthetic Polynucleotide
taatacgactcactatagggttcctcccaattttatgcgctaaatccacaaacagaggagatgtggaatgagcgcataaaacctggcggcagcgcaaaagatg

SEQ ID NO: 230361 - DNA, 103 bp, Artificial Sequence
  Synthetic Polynucleotide
taatacgactcactatagggtgctggtggcttcctcccaattttatgcgcaacagaggagagcgcatatgattgggaggaacctggcggcagcgcaaaagatg

SEQ ID NO: 230362 - DNA, 103 bp, Artificial Sequence
  Synthetic Polynucleotide
taatacgactcactatagggtggtataaaatgctggtggcttcctcccaaaacagaggagattgggaatgagccaccagaacctggcggcagcgcaaaagatg

SEQ ID NO: 230363 - DNA, 103 bp, Artificial Sequence
  Synthetic Polynucleotide
taatacgactcactatagggggtgaggcactggtataaaatgctggtggcaacagaggagagccaccatgattttatacaacctggcggcagcgcaaaagatg

SEQ ID NO: 230364 - DNA, 103 bp, Artificial Sequence
  Synthetic Polynucleotide
taatacgactcactatagggtggtcctggtggtgaggcactggtataaaaaacagaggagattttatatgagtgcctcaaacctggcggcagcgcaaaagatg

SEQ ID NO: 230365 - DNA, 103 bp, Artificial Sequence
  Synthetic Polynucleotide
taatacgactcactatagggcctgaaattgtggtcctggtggtgaggcacaacagaggagagtgcctatgcaccaggacaacctggcggcagcgcaaaagatg

SEQ ID NO: 230366 - DNA, 103 bp, Artificial Sequence
  Synthetic Polynucleotide
taatacgactcactatagggggactgcttccctgaaattgtggtcctggtaacagaggagaaccaggatgacaatttcaaacctggcggcagcgcaaaagatg

SEQ ID NO: 230367 - DNA, 103 bp, Artificial Sequence
  Synthetic Polynucleotide
taatacgactcactatagggttgagggtgtggactgcttccctgaaattgaacagaggagacaatttatgggaagcagtaacctggcggcagcgcaaaagatg

SEQ ID NO: 230368 - DNA, 103 bp, Artificial Sequence
  Synthetic Polynucleotide
taatacgactcactatagggtatgtttttttcttgattttctgtaggcttaacagaggagaaagcctatggaaaatcaaaacctggcggcagcgcaaaagatg

SEQ ID NO: 230369 - DNA, 103 bp, Artificial Sequence
  Synthetic Polynucleotide
taatacgactcactatagggtatagatatgttgagggtgtggactgcttcaacagaggagagaagcaatgcacaccctcaacctggcggcagcgcaaaagatg

SEQ ID NO: 230370 - DNA, 103 bp, Artificial Sequence
  Synthetic Polynucleotide
taatacgactcactataggggacccagaactatagatatgttgagggtgtaacagaggagaacacccatgacatatctaaacctggcggcagcgcaaaagatg

SEQ ID NO: 230371 - DNA, 103 bp, Artificial Sequence
  Synthetic Polynucleotide
taatacgactcactatagggacctggacttgacccagaactatagatatgaacagaggagacatatcatgagttctgggaacctggcggcagcgcaaaagatg

SEQ ID NO: 230372 - DNA, 103 bp, Artificial Sequence
  Synthetic Polynucleotide
taatacgactcactatagggtaggtccaggacctggacttgacccagaacaacagaggagagttctgatgcaagtccagaacctggcggcagcgcaaaagatg

SEQ ID NO: 230373 - DNA, 103 bp, Artificial Sequence
  Synthetic Polynucleotide
taatacgactcactatagggtgagacatgttaggtccaggacctggacttaacagaggagaaagtccatgtcctggaccaacctggcggcagcgcaaaagatg

SEQ ID NO: 230374 - DNA, 103 bp, Artificial Sequence
  Synthetic Polynucleotide
taatacgactcactatagggactgtgtccctgagacatgttaggtccaggaacagaggagacctggaatgaacatgtctaacctggcggcagcgcaaaagatg

SEQ ID NO: 230375 - DNA, 103 bp, Artificial Sequence
  Synthetic Polynucleotide
taatacgactcactatagggtcacaggactactgtgtccctgagacatgtaacagaggagaacatgtatgagggacacaaacctggcggcagcgcaaaagatg

SEQ ID NO: 230376 - DNA, 103 bp, Artificial Sequence
  Synthetic Polynucleotide
taatacgactcactatagggcctgggtgcatcacaggactactgtgtcccaacagaggagagggacaatgtagtcctgtaacctggcggcagcgcaaaagatg

SEQ ID NO: 230377 - DNA, 103 bp, Artificial Sequence
  Synthetic Polynucleotide
taatacgactcactatagggtccaggggagcctgggtgcatcacaggactaacagaggagaagtcctatgatgcacccaaacctggcggcagcgcaaaagatg

SEQ ID NO: 230378 - DNA, 103 bp, Artificial Sequence
  Synthetic Polynucleotide
taatacgactcactatagggatgggtgatgtccaggggagcctgggtgcaaacagaggagatgcaccatggctcccctgaacctggcggcagcgcaaaagatg

SEQ ID NO: 230379 - DNA, 103 bp, Artificial Sequence
  Synthetic Polynucleotide
taatacgactcactatagggctctctttcttatgtttttttcttgattttaacagaggagaaaaatcatgaaaaaaacaaacctggcggcagcgcaaaagatg

SEQ ID NO: 230380 - DNA, 103 bp, Artificial Sequence
  Synthetic Polynucleotide
taatacgactcactatagggggtcctgcacatgggtgatgtccaggggagaacagaggagactccccatgacatcacccaacctggcggcagcgcaaaagatg

SEQ ID NO: 230381 - DNA, 103 bp, Artificial Sequence
  Synthetic Polynucleotide
taatacgactcactatagggtagaccaggaggtcctgcacatgggtgatgaacagaggagacatcacatgtgtgcaggaaacctggcggcagcgcaaaagatg

SEQ ID NO: 230382 - DNA, 103 bp, Artificial Sequence
  Synthetic Polynucleotide
taatacgactcactataggggtggcactggtagaccaggaggtcctgcacaacagaggagagtgcagatgctcctggtcaacctggcggcagcgcaaaagatg

SEQ ID NO: 230383 - DNA, 103 bp, Artificial Sequence
  Synthetic Polynucleotide
taatacgactcactatagggggtgggctctgtggcactggtagaccaggaaacagaggagatcctggatgaccagtgccaacctggcggcagcgcaaaagatg

SEQ ID NO: 230384 - DNA, 103 bp, Artificial Sequence
  Synthetic Polynucleotide
taatacgactcactatagggaggtggtaaaggtgggctctgtggcactggaacagaggagaccagtgatgcagagcccaaacctggcggcagcgcaaaagatg

SEQ ID NO: 230385 - DNA, 103 bp, Artificial Sequence
  Synthetic Polynucleotide
taatacgactcactatagggcaggtggaccaggtggtaaaggtgggctctaacagaggagaagagccatgctttaccacaacctggcggcagcgcaaaagatg

SEQ ID NO: 230386 - DNA, 103 bp, Artificial Sequence
  Synthetic Polynucleotide
taatacgactcactatagggcctacaatttcaggtggaccaggtggtaaaaacagaggagatttaccatgtggtccaccaacctggcggcagcgcaaaagatg

SEQ ID NO: 230387 - DNA, 103 bp, Artificial Sequence
  Synthetic Polynucleotide
taatacgactcactatagggattttgaggacctacaatttcaggtggaccaacagaggagaggtccaatggaaattgtaaacctggcggcagcgcaaaagatg

SEQ ID NO: 230388 - DNA, 103 bp, Artificial Sequence
  Synthetic Polynucleotide
taatacgactcactatagggctccagcttgattttgaggacctacaatttaacagaggagaaaattgatggtcctcaaaaacctggcggcagcgcaaaagatg

SEQ ID NO: 230389 - DNA, 103 bp, Artificial Sequence
  Synthetic Polynucleotide
taatacgactcactatagggtgaacaagcactccagcttgattttgaggaaacagaggagatcctcaatgtcaagctggaacctggcggcagcgcaaaagatg

SEQ ID NO: 230390 - DNA, 103 bp, Artificial Sequence
  Synthetic Polynucleotide
taatacgactcactatagggtttcttctctctctctttcttatgttttttaacagaggagaaaaaaaatgaagaaagagaacctggcggcagcgcaaaagatg

SEQ ID NO: 230391 - DNA, 103 bp, Artificial Sequence
  Synthetic Polynucleotide
taatacgactcactatagggtgtgtctggttgaacaagcactccagcttgaacagaggagacaagctatggtgcttgttaacctggcggcagcgcaaaagatg

SEQ ID NO: 230392 - DNA, 103 bp, Artificial Sequence
  Synthetic Polynucleotide
taatacgactcactataggggtgtcaaagatgtgtctggttgaacaagcaaacagaggagatgcttgatgaaccagacaaacctggcggcagcgcaaaagatg

SEQ ID NO: 230393 - DNA, 103 bp, Artificial Sequence
  Synthetic Polynucleotide
taatacgactcactatagggatacttggtggtgtcaaagatgtgtctggtaacagaggagaaccagaatgatctttgacaacctggcggcagcgcaaaagatg

SEQ ID NO: 230394 - DNA, 103 bp, Artificial Sequence
  Synthetic Polynucleotide
taatacgactcactatagggagccccacccatacttggtggtgtcaaagaaacagaggagatctttgatgccaccaagtaacctggcggcagcgcaaaagatg

SEQ ID NO: 230395 - DNA, 103 bp, Artificial Sequence
  Synthetic Polynucleotide
taatacgactcactataggggggagtggtaagccccacccatacttggtgaacagaggagacaccaaatgtgggtggggaacctggcggcagcgcaaaagatg

SEQ ID NO: 230396 - DNA, 103 bp, Artificial Sequence
  Synthetic Polynucleotide
taatacgactcactatagggggaaagcctggggagtggtaagccccacccaacagaggagagggtggatgttaccactcaacctggcggcagcgcaaaagatg

SEQ ID NO: 230397 - DNA, 103 bp, Artificial Sequence
  Synthetic Polynucleotide
taatacgactcactatagggcacatgtcctggaaagcctggggagtggtaaacagaggagataccacatgccaggctttaacctggcggcagcgcaaaagatg

SEQ ID NO: 230398 - DNA, 103 bp, Artificial Sequence
  Synthetic Polynucleotide
taatacgactcactataggggtactttcatcacatgtcctggaaagcctgaacagaggagacaggctatgcaggacatgaacctggcggcagcgcaaaagatg

SEQ ID NO: 230399 - DNA, 103 bp, Artificial Sequence
  Synthetic Polynucleotide
taatacgactcactatagggttctctctgggtactttcatcacatgtcctaacagaggagaaggacaatggatgaaagtaacctggcggcagcgcaaaagatg

SEQ ID NO: 230400 - DNA, 103 bp, Artificial Sequence
  Synthetic Polynucleotide
taatacgactcactatagggagaacagtgattctctctgggtactttcataacagaggagaatgaaaatgcccagagagaacctggcggcagcgcaaaagatg

SEQ ID NO: 230401 - DNA, 103 bp, Artificial Sequence
  Synthetic Polynucleotide
taatacgactcactatagggttttggattttttcttctctctctctttctaacagaggagaagaaagatggagagaagaaacctggcggcagcgcaaaagatg

SEQ ID NO: 230402 - DNA, 103 bp, Artificial Sequence
  Synthetic Polynucleotide
taatacgactcactatagggatgaacctggagaacagtgattctctctggaacagaggagaccagagatgatcactgttaacctggcggcagcgcaaaagatg

SEQ ID NO: 230403 - DNA, 103 bp, Artificial Sequence
  Synthetic Polynucleotide
taatacgactcactatagggtgctggtatgatgaacctggagaacagtgaaacagaggagatcactgatgtccaggttcaacctggcggcagcgcaaaagatg

SEQ ID NO: 230404 - DNA, 103 bp, Artificial Sequence
  Synthetic Polynucleotide
taatacgactcactatagggaccaggactttgctggtatgatgaacctggaacagaggagaccaggtatgtcataccagaacctggcggcagcgcaaaagatg

SEQ ID NO: 230405 - DNA, 103 bp, Artificial Sequence
  Synthetic Polynucleotide
taatacgactcactataggggctgcatttcaccaggactttgctggtatgaacagaggagacataccatgaaagtcctgaacctggcggcagcgcaaaagatg

SEQ ID NO: 230406 - DNA, 103 bp, Artificial Sequence
  Synthetic Polynucleotide
taatacgactcactatagggttggtgttgagctgcatttcaccaggacttaacagaggagaaagtccatgtgaaatgcaaacctggcggcagcgcaaaagatg

SEQ ID NO: 230407 - DNA, 103 bp, Artificial Sequence
  Synthetic Polynucleotide
taatacgactcactatagggggactcataattggtgttgagctgcatttcaacagaggagagaaatgatgctcaacaccaacctggcggcagcgcaaaagatg

SEQ ID NO: 230408 - DNA, 103 bp, Artificial Sequence
  Synthetic Polynucleotide
taatacgactcactatagggggttttgcagggactcataattggtgttgaaacagaggagatcaacaatgattatgagtaacctggcggcagcgcaaaagatg

SEQ ID NO: 230409 - DNA, 103 bp, Artificial Sequence
  Synthetic Polynucleotide
taatacgactcactatagggaactcagctgggttttgcagggactcataaaacagaggagattatgaatgcctgcaaaaaacctggcggcagcgcaaaagatg

SEQ ID NO: 230410 - DNA, 103 bp, Artificial Sequence
  Synthetic Polynucleotide
taatacgactcactatagggattatcgtaaaactcagctgggttttgcagaacagaggagactgcaaatgccagctgagaacctggcggcagcgcaaaagatg

SEQ ID NO: 230411 - DNA, 103 bp, Artificial Sequence
  Synthetic Polynucleotide
taatacgactcactataggggtgcatagtaattatcgtaaaactcagctgaacagaggagacagctgatgtttacgataaacctggcggcagcgcaaaagatg

SEQ ID NO: 230412 - DNA, 103 bp, Artificial Sequence
  Synthetic Polynucleotide
taatacgactcactatagggcgttttctccttttggattttttcttctctaacagaggagaagagaaatgaaaatccaaaacctggcggcagcgcaaaagatg

SEQ ID NO: 230413 - DNA, 103 bp, Artificial Sequence
  Synthetic Polynucleotide
taatacgactcactatagggatagaatgctgtgcatagtaattatcgtaaaacagaggagattacgaatgttactatgcaacctggcggcagcgcaaaagatg

SEQ ID NO: 230414 - DNA, 103 bp, Artificial Sequence
  Synthetic Polynucleotide
taatacgactcactatagggaaaattatgtatagaatgctgtgcatagtaaacagaggagatactatatgcagcattctaacctggcggcagcgcaaaagatg

SEQ ID NO: 230415 - DNA, 103 bp, Artificial Sequence
  Synthetic Polynucleotide
taatacgactcactatagggtgggtggctgaaaattatgtatagaatgctaacagaggagaagcattatgtacataattaacctggcggcagcgcaaaagatg

SEQ ID NO: 230416 - DNA, 103 bp, Artificial Sequence
  Synthetic Polynucleotide
taatacgactcactatagggccagagttattgggtggctgaaaattatgtaacagaggagaacataaatgtcagccaccaacctggcggcagcgcaaaagatg

SEQ ID NO: 230417 - DNA, 103 bp, Artificial Sequence
  Synthetic Polynucleotide
taatacgactcactatagggcatcccatcaccagagttattgggtggctgaacagaggagacagccaatgaataactctaacctggcggcagcgcaaaagatg

SEQ ID NO: 230418 - DNA, 103 bp, Artificial Sequence
  Synthetic Polynucleotide
taatacgactcactatagggcaccatgccacatcccatcaccagagttataacagaggagaataactatggtgatgggaaacctggcggcagcgcaaaagatg

SEQ ID NO: 230419 - DNA, 103 bp, Artificial Sequence
  Synthetic Polynucleotide
taatacgactcactatagggtgggcaaattcaccatgccacatcccatcaaacagaggagatgatggatggtggcatggaacctggcggcagcgcaaaagatg

SEQ ID NO: 230420 - DNA, 103 bp, Artificial Sequence
  Synthetic Polynucleotide
taatacgactcactatagggaggctgctgctgggcaaattcaccatgccaaacagaggagatggcatatggaatttgccaacctggcggcagcgcaaaagatg

SEQ ID NO: 230421 - DNA, 103 bp, Artificial Sequence
  Synthetic Polynucleotide
taatacgactcactataggggaacaacaggaggctgctgctgggcaaattaacagaggagaaatttgatgagcagcagcaacctggcggcagcgcaaaagatg

SEQ ID NO: 230422 - DNA, 103 bp, Artificial Sequence
  Synthetic Polynucleotide
taatacgactcactatagggggtgagtcttgaacaacaggaggctgctgcaacagaggagagcagcaatgtcctgttgtaacctggcggcagcgcaaaagatg

SEQ ID NO: 230423 - DNA, 103 bp, Artificial Sequence
  Synthetic Polynucleotide
taatacgactcactatagggatgtttctcacgttttctccttttggatttaacagaggagaaaatccatgaggagaaaaaacctggcggcagcgcaaaagatg

SEQ ID NO: 230424 - DNA, 103 bp, Artificial Sequence
  Synthetic Polynucleotide
taatacgactcactatagggcccatggttaggtgagtcttgaacaacaggaacagaggagacctgttatgcaagactcaaacctggcggcagcgcaaaagatg

SEQ ID NO: 230425 - DNA, 103 bp, Artificial Sequence
  Synthetic Polynucleotide
taatacgactcactatagggcagacccactcccatggttaggtgagtcttaacagaggagaaagactatgctaaccatgaacctggcggcagcgcaaaagatg

SEQ ID NO: 230426 - DNA, 103 bp, Artificial Sequence
  Synthetic Polynucleotide
taatacgactcactatagggctgctgccatcagacccactcccatggttaaacagaggagataaccaatggagtgggtcaacctggcggcagcgcaaaagatg

SEQ ID NO: 230427 - DNA, 103 bp, Artificial Sequence
  Synthetic Polynucleotide
taatacgactcactatagggtgtcctagtgctgctgccatcagacccactaacagaggagaagtgggatggatggcagcaacctggcggcagcgcaaaagatg

SEQ ID NO: 230428 - DNA, 103 bp, Artificial Sequence
  Synthetic Polynucleotide
taatacgactcactatagggggccatggcctgtcctagtgctgctgccataacagaggagaatggcaatggcactaggaaacctggcggcagcgcaaaagatg

SEQ ID NO: 230429 - DNA, 103 bp, Artificial Sequence
  Synthetic Polynucleotide
taatacgactcactatagggacaggcagagggccatggcctgtcctagtgaacagaggagacactagatgaggccatggaacctggcggcagcgcaaaagatg

SEQ ID NO: 230430 - DNA, 103 bp, Artificial Sequence
  Synthetic Polynucleotide
taatacgactcactataggggaggcctggtacaggcagagggccatggccaacagaggagaggccatatgcctctgcctaacctggcggcagcgcaaaagatg

SEQ ID NO: 230431 - DNA, 103 bp, Artificial Sequence
  Synthetic Polynucleotide
taatacgactcactatagggctgcagggaggaggcctggtacaggcagagaacagaggagactctgcatgtaccaggccaacctggcggcagcgcaaaagatg

SEQ ID NO: 230432 - DNA, 103 bp, Artificial Sequence
  Synthetic Polynucleotide
taatacgactcactataggggctctttgcactgcagggaggaggcctggtaacagaggagaaccaggatgcctccctgcaacctggcggcagcgcaaaagatg

SEQ ID NO: 230433 - DNA, 103 bp, Artificial Sequence
  Synthetic Polynucleotide
taatacgactcactatagggtacaaaaagagctctttgcactgcagggagaacagaggagactccctatggtgcaaagaaacctggcggcagcgcaaaagatg

SEQ ID NO: 230434 - DNA, 103 bp, Artificial Sequence
  Synthetic Polynucleotide
taatacgactcactatagggcatcttctctgtcgtgccctgcatgttcagaacagaggagactgaacatgcagggcacgaacctggcggcagcgcaaaagatg

SEQ ID NO: 230435 - DNA, 103 bp, Artificial Sequence
  Synthetic Polynucleotide
taatacgactcactatagggaattatgcttatgtttctcacgttttctccaacagaggagaggagaaatggtgagaaacaacctggcggcagcgcaaaagatg

SEQ ID NO: 230436 - DNA, 103 bp, Artificial Sequence
  Synthetic Polynucleotide
taatacgactcactataggggagtaagtcttacaaaaagagctctttgcaaacagaggagatgcaaaatgctctttttgaacctggcggcagcgcaaaagatg

SEQ ID NO: 230437 - DNA, 103 bp, Artificial Sequence
  Synthetic Polynucleotide
taatacgactcactatagggtggtatctctgagtaagtcttacaaaaagaaacagaggagatcttttatgaagacttacaacctggcggcagcgcaaaagatg

SEQ ID NO: 230438 - DNA, 103 bp, Artificial Sequence
  Synthetic Polynucleotide
taatacgactcactatagggttcatcttcttggtatctctgagtaagtctaacagaggagaagacttatgcagagatacaacctggcggcagcgcaaaagatg

SEQ ID NO: 230439 - DNA, 103 bp, Artificial Sequence
  Synthetic Polynucleotide
taatacgactcactatagggtggtttgttcttcatcttcttggtatctctaacagaggagaagagatatgaagaagatgaacctggcggcagcgcaaaagatg

SEQ ID NO: 230440 - DNA, 103 bp, Artificial Sequence
  Synthetic Polynucleotide
taatacgactcactatagggggttgggtgctggtttgttcttcatcttctaacagaggagaagaagaatgagaacaaacaacctggcggcagcgcaaaagatg

SEQ ID NO: 230441 - DNA, 103 bp, Artificial Sequence
  Synthetic Polynucleotide
taatacgactcactatagggtgccctatgaggttgggtgctggtttgttcaacagaggagagaacaaatgagcacccaaaacctggcggcagcgcaaaagatg

SEQ ID NO: 230442 - DNA, 103 bp, Artificial Sequence
  Synthetic Polynucleotide
taatacgactcactatagggccttgcttggtgccctatgaggttgggtgcaacagaggagagcacccatgctcatagggaacctggcggcagcgcaaaagatg

SEQ ID NO: 230443 - DNA, 103 bp, Artificial Sequence
  Synthetic Polynucleotide
taatacgactcactatagggtcatcttcttccttgcttggtgccctatgaaacagaggagatcatagatgaccaagcaaaacctggcggcagcgcaaaagatg

SEQ ID NO: 230444 - DNA, 103 bp, Artificial Sequence
  Synthetic Polynucleotide
taatacgactcactataggggttaactgtatcatcttcttccttgcttggaacagaggagaccaagcatggaagaagataacctggcggcagcgcaaaagatg

SEQ ID NO: 230445 - DNA, 103 bp, Artificial Sequence
  Synthetic Polynucleotide
taatacgactcactatagggtggaataccagttaactgtatcatcttcttaacagaggagaaagaagatgatacagttaaacctggcggcagcgcaaaagatg

SEQ ID NO: 230446 - DNA, 103 bp, Artificial Sequence
  Synthetic Polynucleotide
taatacgactcactatagggctagatggggaattatgcttatgtttctcaaacagaggagatgagaaatgtaagcataaaacctggcggcagcgcaaaagatg

SEQ ID NO: 230447 - DNA, 103 bp, Artificial Sequence
  Synthetic Polynucleotide
taatacgactcactatagggtcttcactactggaataccagttaactgtaaacagaggagatacagtatgctggtattcaacctggcggcagcgcaaaagatg

SEQ ID NO: 230448 - DNA, 103 bp, Artificial Sequence
  Synthetic Polynucleotide
taatacgactcactatagggtccttcttcctcttcactactggaataccaaacagaggagatggtatatgagtagtgaaaacctggcggcagcgcaaaagatg

SEQ ID NO: 230449 - DNA, 103 bp, Artificial Sequence
  Synthetic Polynucleotide
taatacgactcactatagggtgacactgcttccttcttcctcttcactacaacagaggagagtagtgatgaggaagaagaacctggcggcagcgcaaaagatg

SEQ ID NO: 230450 - DNA, 103 bp, Artificial Sequence
  Synthetic Polynucleotide
taatacgactcactatagggagtattgatttgacactgcttccttcttccaacagaggagaggaagaatgaagcagtgtaacctggcggcagcgcaaaagatg

SEQ ID NO: 230451 - DNA, 103 bp, Artificial Sequence
  Synthetic Polynucleotide
taatacgactcactatagggtaatgttttcagtattgatttgacactgctaacagaggagaagcagtatgaaatcaataaacctggcggcagcgcaaaagatg

SEQ ID NO: 230452 - DNA, 103 bp, Artificial Sequence
  Synthetic Polynucleotide
taatacgactcactatagggtttgtttctgtaatgttttcagtattgattaacagaggagaaatcaaatgtgaaaacataacctggcggcagcgcaaaagatg

SEQ ID NO: 230453 - DNA, 103 bp, Artificial Sequence
  Synthetic Polynucleotide
taatacgactcactatagggaaagtttctgtttgtttctgtaatgttttcaacagaggagagaaaacatgacagaaacaaacctggcggcagcgcaaaagatg

SEQ ID NO: 230454 - DNA, 103 bp, Artificial Sequence
  Synthetic Polynucleotide
taatacgactcactatagggctgattccttaaagtttctgtttgtttctgaacagaggagacagaaaatgacagaaactaacctggcggcagcgcaaaagatg

SEQ ID NO: 230455 - DNA, 103 bp, Artificial Sequence
  Synthetic Polynucleotide
taatacgactcactatagggaaggttgttgctgattccttaaagtttctgaacagaggagacagaaaatgtaaggaatcaacctggcggcagcgcaaaagatg

SEQ ID NO: 230456 - DNA, 103 bp, Artificial Sequence
  Synthetic Polynucleotide
taatacgactcactatagggagttctgtggaaggttgttgctgattccttaacagaggagaaaggaaatggcaacaaccaacctggcggcagcgcaaaagatg

SEQ ID NO: 230457 - DNA, 103 bp, Artificial Sequence
  Synthetic Polynucleotide
taatacgactcactatagggactatcatcactagatggggaattatgcttaacagaggagaaagcatatgtccccatctaacctggcggcagcgcaaaagatg

SEQ ID NO: 230458 - DNA, 103 bp, Artificial Sequence
  Synthetic Polynucleotide
taatacgactcactatagggaggagtgctgagttctgtggaaggttgttgaacagaggagacaacaaatgtccacagaaaacctggcggcagcgcaaaagatg

SEQ ID NO: 230459 - DNA, 103 bp, Artificial Sequence
  Synthetic Polynucleotide
taatacgactcactatagggttggatcagtaggagtgctgagttctgtggaacagaggagaccacagatgtcagcactcaacctggcggcagcgcaaaagatg

SEQ ID NO: 230460 - DNA, 103 bp, Artificial Sequence
  Synthetic Polynucleotide
taatacgactcactatagggttagcaagtcttggatcagtaggagtgctgaacagaggagacagcacatgtactgatccaacctggcggcagcgcaaaagatg

SEQ ID NO: 230461 - DNA, 103 bp, Artificial Sequence
  Synthetic Polynucleotide
taatacgactcactatagggacttttctctttagcaagtcttggatcagtaacagaggagaactgatatgagacttgctaacctggcggcagcgcaaaagatg

SEQ ID NO: 230462 - DNA, 103 bp, Artificial Sequence
  Synthetic Polynucleotide
taatacgactcactatagggggtttcctttacttttctctttagcaagtcaacagaggagagacttgatgaagagaaaaaacctggcggcagcgcaaaagatg

SEQ ID NO: 230463 - DNA, 103 bp, Artificial Sequence
  Synthetic Polynucleotide
taatacgactcactatagggtcaaccacttggtttcctttacttttctctaacagaggagaagagaaatgtaaaggaaaaacctggcggcagcgcaaaagatg

SEQ ID NO: 230464 - DNA, 103 bp, Artificial Sequence
  Synthetic Polynucleotide
taatacgactcactatagggaagcctagggtcaaccacttggtttcctttaacagaggagaaaaggaatgcaagtggttaacctggcggcagcgcaaaagatg

SEQ ID NO: 230465 - DNA, 103 bp, Artificial Sequence
  Synthetic Polynucleotide
taatacgactcactatagggggatagtcctaagcctagggtcaaccacttaacagaggagaaagtggatgaccctaggcaacctggcggcagcgcaaaagatg

SEQ ID NO: 230466 - DNA, 103 bp, Artificial Sequence
  Synthetic Polynucleotide
taatacgactcactatagggtcttgccttgggatagtcctaagcctagggaacagaggagaccctagatgtaggactataacctggcggcagcgcaaaagatg

SEQ ID NO: 230467 - DNA, 103 bp, Artificial Sequence
  Synthetic Polynucleotide
taatacgactcactatagggctttctaatgtcttgccttgggatagtcctaacagaggagaaggactatgccaaggcaaaacctggcggcagcgcaaaagatg

SEQ ID NO: 230468 - DNA, 103 bp, Artificial Sequence
  Synthetic Polynucleotide
taatacgactcactatagggtgtagtccgaactatcatcactagatggggaacagaggagaccccatatggtgatgataaacctggcggcagcgcaaaagatg

SEQ ID NO: 230469 - DNA, 103 bp, Artificial Sequence
  Synthetic Polynucleotide
taatacgactcactatagggactcagaaggctttctaatgtcttgccttgaacagaggagacaaggcatgacattagaaaacctggcggcagcgcaaaagatg

SEQ ID NO: 230470 - DNA, 103 bp, Artificial Sequence
  Synthetic Polynucleotide
taatacgactcactatagggagtggggcagactcagaaggctttctaatgaacagaggagacattagatggccttctgaaacctggcggcagcgcaaaagatg

SEQ ID NO: 230471 - DNA, 103 bp, Artificial Sequence
  Synthetic Polynucleotide
taatacgactcactatagggtctaagatccagtggggcagactcagaaggaacagaggagaccttctatgtctgccccaaacctggcggcagcgcaaaagatg

SEQ ID NO: 230472 - DNA, 103 bp, Artificial Sequence
  Synthetic Polynucleotide
taatacgactcactatagggcccacgcaagtctaagatccagtggggcagaacagaggagactgcccatgtggatcttaaacctggcggcagcgcaaaagatg

SEQ ID NO: 230473 - DNA, 103 bp, Artificial Sequence
  Synthetic Polynucleotide
taatacgactcactatagggttcctgggatcccacgcaagtctaagatccaacagaggagaggatctatgacttgcgtgaacctggcggcagcgcaaaagatg

SEQ ID NO: 230474 - DNA, 103 bp, Artificial Sequence
  Synthetic Polynucleotide
taatacgactcactatagggccctctcaatttcctgggatcccacgcaagaacagaggagacttgcgatggatcccaggaacctggcggcagcgcaaaagatg

SEQ ID NO: 230475 - DNA, 103 bp, Artificial Sequence
  Synthetic Polynucleotide
taatacgactcactatagggcacttccattccctctcaatttcctgggataacagaggagaatcccaatgaattgagagaacctggcggcagcgcaaaagatg

SEQ ID NO: 230476 - DNA, 103 bp, Artificial Sequence
  Synthetic Polynucleotide
taatacgactcactatagggcctatgtgaccacttccattccctctcaataacagaggagaattgagatggaatggaagaacctggcggcagcgcaaaagatg

SEQ ID NO: 230477 - DNA, 103 bp, Artificial Sequence
  Synthetic Polynucleotide
taatacgactcactatagggaacagaagagcctatgtgaccacttccattaacagaggagaaatggaatgggtcacataaacctggcggcagcgcaaaagatg

SEQ ID NO: 230478 - DNA, 103 bp, Artificial Sequence
  Synthetic Polynucleotide
taatacgactcactatagggttgctccaccaacagaagagcctatgtgacaacagaggagagtcacaatggctcttctgaacctggcggcagcgcaaaagatg

SEQ ID NO: 230479 - DNA, 103 bp, Artificial Sequence
  Synthetic Polynucleotide
taatacgactcactataggggaatcaaggctgtagtccgaactatcatcaaacagaggagatgatgaatgttcggactaaacctggcggcagcgcaaaagatg

SEQ ID NO: 230480 - DNA, 103 bp, Artificial Sequence
  Synthetic Polynucleotide
taatacgactcactatagggaaatcaaactttgctccaccaacagaagagaacagaggagactcttcatgtggtggagcaacctggcggcagcgcaaaagatg

SEQ ID NO: 230481 - DNA, 103 bp, Artificial Sequence
  Synthetic Polynucleotide
taatacgactcactatagggtgcatgatgcaaatcaaactttgctccaccaacagaggagaggtggaatgaagtttgataacctggcggcagcgcaaaagatg

SEQ ID NO: 230482 - DNA, 103 bp, Artificial Sequence
  Synthetic Polynucleotide
taatacgactcactatagggtgccagcatttgcatgatgcaaatcaaactaacagaggagaagtttgatgtgcatcatgaacctggcggcagcgcaaaagatg

SEQ ID NO: 230483 - DNA, 103 bp, Artificial Sequence
  Synthetic Polynucleotide
taatacgactcactatagggttgacattagtgccagcatttgcatgatgcaacagaggagagcatcaatgaaatgctggaacctggcggcagcgcaaaagatg

SEQ ID NO: 230484 - DNA, 103 bp, Artificial Sequence
  Synthetic Polynucleotide
taatacgactcactatagggtcttttgtgtttgacattagtgccagcattaacagaggagaaatgctatgactaatgtcaacctggcggcagcgcaaaagatg

SEQ ID NO: 230485 - DNA, 103 bp, Artificial Sequence
  Synthetic Polynucleotide
taatacgactcactatagggcatcatcgcctcttttgtgtttgacattagaacagaggagactaatgatgaacacaaaaaacctggcggcagcgcaaaagatg

SEQ ID NO: 230486 - DNA, 103 bp, Artificial Sequence
  Synthetic Polynucleotide
taatacgactcactatagggtcttcatcatcatcatcgcctcttttgtgtaacagaggagaacacaaatgaggcgatgaaacctggcggcagcgcaaaagatg

SEQ ID NO: 230487 - DNA, 103 bp, Artificial Sequence
  Synthetic Polynucleotide
taatacgactcactatagggtctttctgtatcttcatcatcatcatcgccaacagaggagaggcgatatggatgatgaaaacctggcggcagcgcaaaagatg

SEQ ID NO: 230488 - DNA, 103 bp, Artificial Sequence
  Synthetic Polynucleotide
taatacgactcactatagggctctcagttctctttctgtatcttcatcataacagaggagaatgatgatgatacagaaaaacctggcggcagcgcaaaagatg

SEQ ID NO: 230489 - DNA, 103 bp, Artificial Sequence
  Synthetic Polynucleotide
taatacgactcactatagggaaagctttttctctcagttctctttctgtaaacagaggagatacagaatgagaactgagaacctggcggcagcgcaaaagatg

SEQ ID NO: 230490 - DNA, 103 bp, Artificial Sequence
  Synthetic Polynucleotide
taatacgactcactatagggttcaacatctgaatcaaggctgtagtccgaaacagaggagatcggacatgagccttgataacctggcggcagcgcaaaagatg

SEQ ID NO: 230491 - DNA, 103 bp, Artificial Sequence
  Synthetic Polynucleotide
taatacgactcactatagggaggtattaagaaagctttttctctcagttcaacagaggagagaactgatggaaaaagctaacctggcggcagcgcaaaagatg

SEQ ID NO: 230492 - DNA, 103 bp, Artificial Sequence
  Synthetic Polynucleotide
taatacgactcactatagggaggcatccaaaggtattaagaaagctttttaacagaggagaaaaaagatgtcttaatacaacctggcggcagcgcaaaagatg

SEQ ID NO: 230493 - DNA, 103 bp, Artificial Sequence
  Synthetic Polynucleotide
taatacgactcactatagggatgccaggtgaggcatccaaaggtattaagaacagaggagacttaatatgtttggatgcaacctggcggcagcgcaaaagatg

SEQ ID NO: 230494 - DNA, 103 bp, Artificial Sequence
  Synthetic Polynucleotide
taatacgactcactatagggctggagcattatgccaggtgaggcatccaaaacagaggagattggatatgtcacctggcaacctggcggcagcgcaaaagatg

SEQ ID NO: 230495 - DNA, 103 bp, Artificial Sequence
  Synthetic Polynucleotide
taatacgactcactatagggaccttggatcctggagcattatgccaggtgaacagaggagacacctgatgtaatgctccaacctggcggcagcgcaaaagatg

SEQ ID NO: 230496 - DNA, 103 bp, Artificial Sequence
  Synthetic Polynucleotide
taatacgactcactatagggctcaattgtgaccttggatcctggagcattaacagaggagaaatgctatgggatccaagaacctggcggcagcgcaaaagatg

SEQ ID NO: 230497 - DNA, 103 bp, Artificial Sequence
  Synthetic Polynucleotide
taatacgactcactatagggactgaactgtctcaattgtgaccttggatcaacagaggagagatccaatgtcacaattgaacctggcggcagcgcaaaagatg

SEQ ID NO: 230498 - DNA, 103 bp, Artificial Sequence
  Synthetic Polynucleotide
taatacgactcactatagggttttaatgtgactgaactgtctcaattgtgaacagaggagacacaatatggacagttcaaacctggcggcagcgcaaaagatg

SEQ ID NO: 230499 - DNA, 103 bp, Artificial Sequence
  Synthetic Polynucleotide
taatacgactcactataggggtaatgtccattttaatgtgactgaactgtaacagaggagaacagttatgtcacattaaaacctggcggcagcgcaaaagatg

SEQ ID NO: 230500 - DNA, 103 bp, Artificial Sequence
  Synthetic Polynucleotide
taatacgactcactatagggtttggttagagtaatgtccattttaatgtgaacagaggagacacattatgatggacattaacctggcggcagcgcaaaagatg

SEQ ID NO: 230501 - DNA, 103 bp, Artificial Sequence
  Synthetic Polynucleotide
taatacgactcactatagggtttctgtatgttcaacatctgaatcaaggcaacagaggagagccttgatgcagatgttgaacctggcggcagcgcaaaagatg

SEQ ID NO: 230502 - DNA, 103 bp, Artificial Sequence
  Synthetic Polynucleotide
taatacgactcactatagggcaaagttgggtttggttagagtaatgtccaaacagaggagatggacaatgctctaaccaaacctggcggcagcgcaaaagatg

SEQ ID NO: 230503 - DNA, 103 bp, Artificial Sequence
  Synthetic Polynucleotide
taatacgactcactatagggatgtgttttgcaaagttgggtttggttagaaacagaggagatctaacatgacccaacttaacctggcggcagcgcaaaagatg

SEQ ID NO: 230504 - DNA, 103 bp, Artificial Sequence
  Synthetic Polynucleotide
taatacgactcactatagggagcccacacgatgtgttttgcaaagttgggaacagaggagacccaacatggcaaaacacaacctggcggcagcgcaaaagatg

SEQ ID NO: 230505 - DNA, 103 bp, Artificial Sequence
  Synthetic Polynucleotide
taatacgactcactatagggagtcttcgggagcccacacgatgtgttttgaacagaggagacaaaacatgtcgtgtgggaacctggcggcagcgcaaaagatg

SEQ ID NO: 230506 - DNA, 103 bp, Artificial Sequence
  Synthetic Polynucleotide
taatacgactcactatagggactggaagtaagtcttcgggagcccacacgaacagaggagacgtgtgatgtcccgaagaaacctggcggcagcgcaaaagatg

SEQ ID NO: 230507 - DNA, 103 bp, Artificial Sequence
  Synthetic Polynucleotide
taatacgactcactatagggaggtaaaggtactggaagtaagtcttcgggaacagaggagacccgaaatgttacttccaaacctggcggcagcgcaaaagatg

SEQ ID NO: 230508 - DNA, 103 bp, Artificial Sequence
  Synthetic Polynucleotide
taatacgactcactataggggatcaggtttaggtaaaggtactggaagtaaacagaggagatacttcatgtacctttacaacctggcggcagcgcaaaagatg

SEQ ID NO: 230509 - DNA, 103 bp, Artificial Sequence
  Synthetic Polynucleotide
taatacgactcactataggggaagacactggatcaggtttaggtaaaggtaacagaggagaacctttatgtaaacctgaaacctggcggcagcgcaaaagatg

SEQ ID NO: 230510 - DNA, 103 bp, Artificial Sequence
  Synthetic Polynucleotide
taatacgactcactatagggtaaattgattgaagacactggatcaggtttaacagaggagaaaacctatgccagtgtctaacctggcggcagcgcaaaagatg

SEQ ID NO: 230511 - DNA, 103 bp, Artificial Sequence
  Synthetic Polynucleotide
taatacgactcactatagggggggcagaggtaaattgattgaagacactgaacagaggagacagtgtatgcaatcaattaacctggcggcagcgcaaaagatg

SEQ ID NO: 230512 - DNA, 103 bp, Artificial Sequence
  Synthetic Polynucleotide
taatacgactcactatagggttatgggaactttctgtatgttcaacatctaacagaggagaagatgtatgacatacagaaacctggcggcagcgcaaaagatg

SEQ ID NO: 230513 - DNA, 103 bp, Artificial Sequence
  Synthetic Polynucleotide
taatacgactcactataggggctataagtgggggcagaggtaaattgattaacagaggagaaatcaaatgacctctgccaacctggcggcagcgcaaaagatg

SEQ ID NO: 230514 - DNA, 103 bp, Artificial Sequence
  Synthetic Polynucleotide
taatacgactcactatagggcctctggtcagctataagtgggggcagaggaacagaggagacctctgatgccacttataaacctggcggcagcgcaaaagatg

SEQ ID NO: 230515 - DNA, 103 bp, Artificial Sequence
  Synthetic Polynucleotide
taatacgactcactatagggatctatttagcctctggtcagctataagtgaacagaggagacacttaatgctgaccagaaacctggcggcagcgcaaaagatg

SEQ ID NO: 230516 - DNA, 103 bp, Artificial Sequence
  Synthetic Polynucleotide
taatacgactcactataggggtattccataatctatttagcctctggtcaaacagaggagatgaccaatggctaaatagaacctggcggcagcgcaaaagatg

SEQ ID NO: 230517 - DNA, 103 bp, Artificial Sequence
  Synthetic Polynucleotide
taatacgactcactatagggatcactttttgtattccataatctatttagaacagaggagactaaatatgttatggaataacctggcggcagcgcaaaagatg

SEQ ID NO: 230518 - DNA, 103 bp, Artificial Sequence
  Synthetic Polynucleotide
taatacgactcactatagggtttgatgaagatcactttttgtattccataaacagaggagatatggaatgcaaaaagtgaacctggcggcagcgcaaaagatg

SEQ ID NO: 230519 - DNA, 103 bp, Artificial Sequence
  Synthetic Polynucleotide
taatacgactcactataggggacactgtattttgatgaagatcactttttaacagaggagaaaaaagatgtcttcatcaaacctggcggcagcgcaaaagatg

SEQ ID NO: 230520 - DNA, 103 bp, Artificial Sequence
  Synthetic Polynucleotide
taatacgactcactatagggtggatcaatggacactgtattttgatgaagaacagaggagacttcatatgaatacagtgaacctggcggcagcgcaaaagatg

SEQ ID NO: 230521 - DNA, 103 bp, Artificial Sequence
  Synthetic Polynucleotide
taatacgactcactatagggctgctaattttggatcaatggacactgtataacagaggagaatacagatgccattgatcaacctggcggcagcgcaaaagatg

SEQ ID NO: 230522 - DNA, 103 bp, Artificial Sequence
  Synthetic Polynucleotide
taatacgactcactatagggttggctttggctgctaattttggatcaatgaacagaggagacattgaatgaaaattagcaacctggcggcagcgcaaaagatg

SEQ ID NO: 230523 - DNA, 103 bp, Artificial Sequence
  Synthetic Polynucleotide
taatacgactcactatagggagttctttttttatgggaactttctgtatgaacagaggagacatacaatgagttcccataacctggcggcagcgcaaaagatg

SEQ ID NO: 230524 - DNA, 103 bp, Artificial Sequence
  Synthetic Polynucleotide
taatacgactcactatagggtgtgttaattttggctttggctgctaatttaacagaggagaaaattaatggccaaagccaacctggcggcagcgcaaaagatg

SEQ ID NO: 230525 - DNA, 103 bp, Artificial Sequence
  Synthetic Polynucleotide
taatacgactcactatagggctctgtttgttgtgttaattttggctttggaacagaggagaccaaagatgaaattaacaaacctggcggcagcgcaaaagatg

SEQ ID NO: 230526 - DNA, 103 bp, Artificial Sequence
  Synthetic Polynucleotide
taatacgactcactatagggaggtagccttctctgtttgttgtgttaattaacagaggagaaattaaatgaacaaacagaacctggcggcagcgcaaaagatg

SEQ ID NO: 230527 - DNA, 103 bp, Artificial Sequence
  Synthetic Polynucleotide
taatacgactcactatagggaaattgttctaggtagccttctctgtttgtaacagaggagaacaaacatggaaggctacaacctggcggcagcgcaaaagatg

SEQ ID NO: 230528 - DNA, 103 bp, Artificial Sequence
  Synthetic Polynucleotide
taatacgactcactataggggtgagtctccaaattgttctaggtagccttaacagaggagaaaggctatgtagaacaataacctggcggcagcgcaaaagatg

SEQ ID NO: 230529 - DNA, 103 bp, Artificial Sequence
  Synthetic Polynucleotide
taatacgactcactatagggcctgaaccgtgtgagtctccaaattgttctaacagaggagaagaacaatgtggagactcaacctggcggcagcgcaaaagatg

SEQ ID NO: 230530 - DNA, 103 bp, Artificial Sequence
  Synthetic Polynucleotide
taatacgactcactatagggtaatttagctcctgaaccgtgtgagtctccaacagaggagaggagacatgcacggttcaaacctggcggcagcgcaaaagatg

SEQ ID NO: 230531 - DNA, 103 bp, Artificial Sequence
  Synthetic Polynucleotide
taatacgactcactatagggtaggatctcctaatttagctcctgaaccgtaacagaggagaacggttatggagctaaataacctggcggcagcgcaaaagatg

SEQ ID NO: 230532 - DNA, 103 bp, Artificial Sequence
  Synthetic Polynucleotide
taatacgactcactatagggttttgtagtctaggatctcctaatttagctaacagaggagaagctaaatgaggagatccaacctggcggcagcgcaaaagatg

SEQ ID NO: 230533 - DNA, 103 bp, Artificial Sequence
  Synthetic Polynucleotide
taatacgactcactatagggatcaaaatttttttgtagtctaggatctccaacagaggagaggagatatgagactacaaaacctggcggcagcgcaaaagatg

SEQ ID NO: 230534 - DNA, 103 bp, Artificial Sequence
  Synthetic Polynucleotide
taatacgactcactatagggtgtagaaaccagttctttttttatgggaacaacagaggagagttcccatgaaaaaagaaaacctggcggcagcgcaaaagatg

SEQ ID NO: 230535 - DNA, 103 bp, Artificial Sequence
  Synthetic Polynucleotide
taatacgactcactataggggaagcctaggatcaaaatttttttgtagtcaacagaggagagactacatgaaaattttgaacctggcggcagcgcaaaagatg

SEQ ID NO: 230536 - DNA, 103 bp, Artificial Sequence
  Synthetic Polynucleotide
taatacgactcactatagggggcagtctgtgaagcctaggatcaaaatttaacagaggagaaaatttatgtcctaggctaacctggcggcagcgcaaaagatg

SEQ ID NO: 230537 - DNA, 103 bp, Artificial Sequence
  Synthetic Polynucleotide
taatacgactcactatagggctctgtattgggcagtctgtgaagcctaggaacagaggagacctaggatgcacagactgaacctggcggcagcgcaaaagatg

SEQ ID NO: 230538 - DNA, 103 bp, Artificial Sequence
  Synthetic Polynucleotide
taatacgactcactatagggcttgatgagactctgtattgggcagtctgtaacagaggagaacagacatgccaatacagaacctggcggcagcgcaaaagatg

SEQ ID NO: 230539 - DNA, 103 bp, Artificial Sequence
  Synthetic Polynucleotide
taatacgactcactatagggttcataaccacttgatgagactctgtattgaacagaggagacaatacatggtctcatcaaacctggcggcagcgcaaaagatg

SEQ ID NO: 230540 - DNA, 103 bp, Artificial Sequence
  Synthetic Polynucleotide
taatacgactcactatagggatgtgaatccttcataaccacttgatgagaaacagaggagatctcatatggtggttatgaacctggcggcagcgcaaaagatg

SEQ ID NO: 230541 - DNA, 103 bp, Artificial Sequence
  Synthetic Polynucleotide
taatacgactcactatagggcctttgatgcatgtgaatccttcataaccaaacagaggagatggttaatgaggattcacaacctggcggcagcgcaaaagatg

SEQ ID NO: 230542 - DNA, 103 bp, Artificial Sequence
  Synthetic Polynucleotide
taatacgactcactatagggtgaggggcaccctttgatgcatgtgaatccaacagaggagaggattcatgtgcatcaaaaacctggcggcagcgcaaaagatg

SEQ ID NO: 230543 - DNA, 103 bp, Artificial Sequence
  Synthetic Polynucleotide
taatacgactcactatagggtctgggtaagtgaggggcaccctttgatgcaacagaggagagcatcaatgggtgcccctaacctggcggcagcgcaaaagatg

SEQ ID NO: 230544 - DNA, 103 bp, Artificial Sequence
  Synthetic Polynucleotide
taatacgactcactatagggcagggtttgatctgggtaagtgaggggcacaacagaggagagtgcccatgacttacccaaacctggcggcagcgcaaaagatg

SEQ ID NO: 230545 - DNA, 103 bp, Artificial Sequence
  Synthetic Polynucleotide
taatacgactcactatagggtctaattcgccatcttctctgtcgtgccctaacagaggagaagggcaatgcagagaagaaacctggcggcagcgcaaaagatg

SEQ ID NO: 230546 - DNA, 103 bp, Artificial Sequence
  Synthetic Polynucleotide
taatacgactcactatagggtcataatccctgtagaaaccagttctttttaacagaggagaaaaaagatgtggtttctaaacctggcggcagcgcaaaagatg

SEQ ID NO: 230547 - DNA, 103 bp, Artificial Sequence
  Synthetic Polynucleotide
taatacgactcactatagggtgtgatgaaccagggtttgatctgggtaagaacagaggagacttaccatgatcaaacccaacctggcggcagcgcaaaagatg

SEQ ID NO: 230548 - DNA, 103 bp, Artificial Sequence
  Synthetic Polynucleotide
taatacgactcactatagggccctgagggctgtgatgaaccagggtttgaaacagaggagatcaaacatgggttcatcaaacctggcggcagcgcaaaagatg

SEQ ID NO: 230549 - DNA, 103 bp, Artificial Sequence
  Synthetic Polynucleotide
taatacgactcactatagggtagttcctgcccctgagggctgtgatgaacaacagaggagagttcatatgagccctcagaacctggcggcagcgcaaaagatg

SEQ ID NO: 230550 - DNA, 103 bp, Artificial Sequence
  Synthetic Polynucleotide
taatacgactcactatagggccagaattgctagttcctgcccctgagggcaacagaggagagccctcatgggcaggaacaacctggcggcagcgcaaaagatg

SEQ ID NO: 230551 - DNA, 103 bp, Artificial Sequence
  Synthetic Polynucleotide
taatacgactcactatagggagccccggaaccagaattgctagttcctgcaacagaggagagcaggaatgagcaattctaacctggcggcagcgcaaaagatg

SEQ ID NO: 230552 - DNA, 103 bp, Artificial Sequence
  Synthetic Polynucleotide
taatacgactcactatagggatggaggcagagccccggaaccagaattgcaacagaggagagcaattatggttccggggaacctggcggcagcgcaaaagatg

SEQ ID NO: 230553 - DNA, 103 bp, Artificial Sequence
  Synthetic Polynucleotide
taatacgactcactatagggttaggggcatatggaggcagagccccggaaaacagaggagattccggatgtctgcctccaacctggcggcagcgcaaaagatg

SEQ ID NO: 230554 - DNA, 103 bp, Artificial Sequence
  Synthetic Polynucleotide
taatacgactcactatagggggaagagagtttaggggcatatggaggcagaacagaggagactgcctatgtatgcccctaacctggcggcagcgcaaaagatg

SEQ ID NO: 230555 - DNA, 103 bp, Artificial Sequence
  Synthetic Polynucleotide
taatacgactcactatagggggccagctgaggaagagagtttaggggcataacagaggagaatgcccatgaactctcttaacctggcggcagcgcaaaagatg

SEQ ID NO: 230556 - DNA, 103 bp, Artificial Sequence
  Synthetic Polynucleotide
taatacgactcactatagggcccagtggaaggccagctgaggaagagagtaacagaggagaactctcatgctcagctggaacctggcggcagcgcaaaagatg

SEQ ID NO: 230557 - DNA, 103 bp, Artificial Sequence
  Synthetic Polynucleotide
taatacgactcactatagggaaatggaatgtcataatccctgtagaaaccaacagaggagaggtttcatgagggattataacctggcggcagcgcaaaagatg

SEQ ID NO: 230558 - DNA, 103 bp, Artificial Sequence
  Synthetic Polynucleotide
taatacgactcactatagggagtggaagttcccagtggaaggccagctgaaacagaggagatcagctatgcttccactgaacctggcggcagcgcaaaagatg

SEQ ID NO: 230559 - DNA, 103 bp, Artificial Sequence
  Synthetic Polynucleotide
taatacgactcactatagggtaagaactgaagtggaagttcccagtggaaaacagaggagattccacatggaacttccaaacctggcggcagcgcaaaagatg

SEQ ID NO: 230560 - DNA, 103 bp, Artificial Sequence
  Synthetic Polynucleotide
taatacgactcactatagggctaataccactaagaactgaagtggaagttaacagaggagaaacttcatgttcagttctaacctggcggcagcgcaaaagatg

SEQ ID NO: 230561 - DNA, 103 bp, Artificial Sequence
  Synthetic Polynucleotide
taatacgactcactataggggtcatacaaactaataccactaagaactgaaacagaggagatcagttatgagtggtattaacctggcggcagcgcaaaagatg

SEQ ID NO: 230562 - DNA, 103 bp, Artificial Sequence
  Synthetic Polynucleotide
taatacgactcactataggggatccctagggtcatacaaactaataccacaacagaggagagtggtaatggtttgtatgaacctggcggcagcgcaaaagatg

SEQ ID NO: 230563 - DNA, 103 bp, Artificial Sequence
  Synthetic Polynucleotide
taatacgactcactataggggatgaaccgtgatccctagggtcatacaaaaacagaggagatttgtaatgccctagggaaacctggcggcagcgcaaaagatg

SEQ ID NO: 230564 - DNA, 103 bp, Artificial Sequence
  Synthetic Polynucleotide
taatacgactcactatagggtgatgtggatgatgaaccgtgatccctaggaacagaggagacctaggatgcacggttcaaacctggcggcagcgcaaaagatg

SEQ ID NO: 230565 - DNA, 103 bp, Artificial Sequence
  Synthetic Polynucleotide
taatacgactcactatagggttgctagctctgatgtggatgatgaaccgtaacagaggagaacggttatgcatccacataacctggcggcagcgcaaaagatg

SEQ ID NO: 230566 - DNA, 103 bp, Artificial Sequence
  Synthetic Polynucleotide
taatacgactcactataggggaagaagctgttgctagctctgatgtggataacagaggagaatccacatgagagctagcaacctggcggcagcgcaaaagatg

SEQ ID NO: 230567 - DNA, 103 bp, Artificial Sequence
  Synthetic Polynucleotide
taatacgactcactataggggttttctcctgaagaagctgttgctagctcaacagaggagagagctaatgacagcttctaacctggcggcagcgcaaaagatg

SEQ ID NO: 230568 - DNA, 103 bp, Artificial Sequence
  Synthetic Polynucleotide
taatacgactcactatagggcacgctgagtaaatggaatgtcataatcccaacagaggagagggattatgacattccataacctggcggcagcgcaaaagatg

SEQ ID NO: 230569 - DNA, 103 bp, Artificial Sequence
  Synthetic Polynucleotide
taatacgactcactatagggggttctttgagttttctcctgaagaagctgaacagaggagacagcttatgcaggagaaaaacctggcggcagcgcaaaagatg

SEQ ID NO: 230570 - DNA, 103 bp, Artificial Sequence
  Synthetic Polynucleotide
taatacgactcactatagggctttttttctggttctttgagttttctcctaacagaggagaaggagaatgctcaaagaaaacctggcggcagcgcaaaagatg

SEQ ID NO: 230571 - DNA, 103 bp, Artificial Sequence
  Synthetic Polynucleotide
taatacgactcactatagggtaagccaccactttttttctggttctttgaaacagaggagatcaaagatgcagaaaaaaaacctggcggcagcgcaaaagatg

SEQ ID NO: 230572 - DNA, 103 bp, Artificial Sequence
  Synthetic Polynucleotide
taatacgactcactatagggcactactttttaagccaccactttttttctaacagaggagaagaaaaatggtggtggctaacctggcggcagcgcaaaagatg

SEQ ID NO: 230573 - DNA, 103 bp, Artificial Sequence
  Synthetic Polynucleotide
taatacgactcactatagggtcagttttgtcactactttttaagccaccaaacagaggagatggtggatgaaaaagtagaacctggcggcagcgcaaaagatg

SEQ ID NO: 230574 - DNA, 103 bp, Artificial Sequence
  Synthetic Polynucleotide
taatacgactcactatagggaggagaaggttcagttttgtcactacttttaacagaggagaaaaagtatggacaaaactaacctggcggcagcgcaaaagatg

SEQ ID NO: 230575 - DNA, 103 bp, Artificial Sequence
  Synthetic Polynucleotide
taatacgactcactatagggtggcttctccaggagaaggttcagttttgtaacagaggagaacaaaaatgaaccttctcaacctggcggcagcgcaaaagatg

SEQ ID NO: 230576 - DNA, 103 bp, Artificial Sequence
  Synthetic Polynucleotide
taatacgactcactatagggtgtggaaggatggcttctccaggagaaggtaacagaggagaaccttcatgtggagaagcaacctggcggcagcgcaaaagatg

SEQ ID NO: 230577 - DNA, 103 bp, Artificial Sequence
  Synthetic Polynucleotide
taatacgactcactatagggactgggtttttgtggaaggatggcttctccaacagaggagaggagaaatgatccttccaaacctggcggcagcgcaaaagatg

SEQ ID NO: 230578 - DNA, 103 bp, Artificial Sequence
  Synthetic Polynucleotide
taatacgactcactatagggccacgtttggactgggtttttgtggaaggaaacagaggagatccttcatgaaaaacccaaacctggcggcagcgcaaaagatg

SEQ ID NO: 230579 - DNA, 103 bp, Artificial Sequence
  Synthetic Polynucleotide
taatacgactcactataggggatatatgtccacgctgagtaaatggaatgaacagaggagacattccatgtactcagcgaacctggcggcagcgcaaaagatg

SEQ ID NO: 230580 - DNA, 103 bp, Artificial Sequence
  Synthetic Polynucleotide
taatacgactcactatagggagagtgactcccacgtttggactgggttttaacagaggagaaaaaccatgtccaaacgtaacctggcggcagcgcaaaagatg

SEQ ID NO: 230581 - DNA, 103 bp, Artificial Sequence
  Synthetic Polynucleotide
taatacgactcactatagggtggcccctcaagagtgactcccacgtttggaacagaggagaccaaacatgggagtcactaacctggcggcagcgcaaaagatg

SEQ ID NO: 230582 - DNA, 103 bp, Artificial Sequence
  Synthetic Polynucleotide
taatacgactcactataggggtgggtcagctggcccctcaagagtgactcaacagaggagagagtcaatgttgaggggcaacctggcggcagcgcaaaagatg

SEQ ID NO: 230583 - DNA, 103 bp, Artificial Sequence
  Synthetic Polynucleotide
taatacgactcactatagggacgtccgcctgtgggtcagctggcccctcaaacagaggagatgagggatgagctgacccaacctggcggcagcgcaaaagatg

SEQ ID NO: 230584 - DNA, 103 bp, Artificial Sequence
  Synthetic Polynucleotide
taatacgactcactatagggactcctgggaacgtccgcctgtgggtcagcaacagaggagagctgacatgcaggcggacaacctggcggcagcgcaaaagatg

SEQ ID NO: 230585 - DNA, 103 bp, Artificial Sequence
  Synthetic Polynucleotide
taatacgactcactatagggccttaccagaactcctgggaacgtccgcctaacagaggagaaggcggatgttcccaggaaacctggcggcagcgcaaaagatg

SEQ ID NO: 230586 - DNA, 103 bp, Artificial Sequence
  Synthetic Polynucleotide
taatacgactcactataggggggacctgaaccttaccagaactcctgggaaacagaggagatcccagatgttctggtaaaacctggcggcagcgcaaaagatg

SEQ ID NO: 230587 - DNA, 103 bp, Artificial Sequence
  Synthetic Polynucleotide
taatacgactcactataggggtgcactgctgggacctgaaccttaccagaaacagaggagatctggtatggttcaggtcaacctggcggcagcgcaaaagatg

SEQ ID NO: 230588 - DNA, 103 bp, Artificial Sequence
  Synthetic Polynucleotide
taatacgactcactatagggcaggaaggctgtgcactgctgggacctgaaaacagaggagattcaggatgcagcagtgcaacctggcggcagcgcaaaagatg

SEQ ID NO: 230589 - DNA, 103 bp, Artificial Sequence
  Synthetic Polynucleotide
taatacgactcactatagggaatgcctgaacaggaaggctgtgcactgctaacagaggagaagcagtatgcagccttccaacctggcggcagcgcaaaagatg

SEQ ID NO: 230590 - DNA, 103 bp, Artificial Sequence
  Synthetic Polynucleotide
taatacgactcactataggggtagcttcctgatatatgtccacgctgagtaacagaggagaactcagatgggacatataaacctggcggcagcgcaaaagatg

SEQ ID NO: 230591 - DNA, 103 bp, Artificial Sequence
  Synthetic Polynucleotide
taatacgactcactatagggtaagcctgttaatgcctgaacaggaaggctaacagaggagaagccttatggttcaggcaaacctggcggcagcgcaaaagatg

SEQ ID NO: 230592 - DNA, 103 bp, Artificial Sequence
  Synthetic Polynucleotide
taatacgactcactataggggtggcctaattaagcctgttaatgcctgaaaacagaggagattcaggatgtaacaggctaacctggcggcagcgcaaaagatg

SEQ ID NO: 230593 - DNA, 103 bp, Artificial Sequence
  Synthetic Polynucleotide
taatacgactcactatagggtcactgtactgtggcctaattaagcctgttaacagaggagaaacaggatgaattaggccaacctggcggcagcgcaaaagatg

SEQ ID NO: 230594 - DNA, 103 bp, Artificial Sequence
  Synthetic Polynucleotide
taatacgactcactatagggctgccttggatcactgtactgtggcctaataacagaggagaattaggatgcagtacagtaacctggcggcagcgcaaaagatg

SEQ ID NO: 230595 - DNA, 103 bp, Artificial Sequence
  Synthetic Polynucleotide
taatacgactcactataggggctgccttgcctgccttggatcactgtactaacagaggagaagtacaatgatccaaggcaacctggcggcagcgcaaaagatg

SEQ ID NO: 230596 - DNA, 103 bp, Artificial Sequence
  Synthetic Polynucleotide
taatacgactcactatagggccctgtcctggctgccttgcctgccttggaaacagaggagatccaagatgggcaaggcaaacctggcggcagcgcaaaagatg

SEQ ID NO: 230597 - DNA, 103 bp, Artificial Sequence
  Synthetic Polynucleotide
taatacgactcactatagggggtcgggctcccctgtcctggctgccttgcaacagaggagagcaaggatgccaggacagaacctggcggcagcgcaaaagatg

SEQ ID NO: 230598 - DNA, 103 bp, Artificial Sequence
  Synthetic Polynucleotide
taatacgactcactatagggcattatctggggtcgggctcccctgtcctgaacagaggagacaggacatgggagcccgaaacctggcggcagcgcaaaagatg

SEQ ID NO: 230599 - DNA, 103 bp, Artificial Sequence
  Synthetic Polynucleotide
taatacgactcactatagggctaccgggatcattatctggggtcgggctcaacagaggagagagcccatgcccagataaaacctggcggcagcgcaaaagatg

SEQ ID NO: 230600 - DNA, 103 bp, Artificial Sequence
  Synthetic Polynucleotide
taatacgactcactatagggatctgtttctctaccgggatcattatctggaacagaggagaccagatatggatcccggtaacctggcggcagcgcaaaagatg

SEQ ID NO: 230601 - DNA, 103 bp, Artificial Sequence
  Synthetic Polynucleotide
taatacgactcactatagggttgatgttatgtagcttcctgatatatgtcaacagaggagagacataatgcaggaagctaacctggcggcagcgcaaaagatg

SEQ ID NO: 230602 - DNA, 103 bp, Artificial Sequence
  Synthetic Polynucleotide
taatacgactcactataggggagatttgtcatctgtttctctaccgggataacagaggagaatcccgatggagaaacagaacctggcggcagcgcaaaagatg

SEQ ID NO: 230603 - DNA, 103 bp, Artificial Sequence
  Synthetic Polynucleotide
taatacgactcactatagggacctctttcagagatttgtcatctgtttctaacagaggagaagaaacatgtgacaaatcaacctggcggcagcgcaaaagatg

SEQ ID NO: 230604 - DNA, 103 bp, Artificial Sequence
  Synthetic Polynucleotide
taatacgactcactatagggagttttaaaaacctctttcagagatttgtcaacagaggagagacaaaatgctgaaagagaacctggcggcagcgcaaaagatg

SEQ ID NO: 230605 - DNA, 103 bp, Artificial Sequence
  Synthetic Polynucleotide
taatacgactcactatagggttggatcaaaagttttaaaaacctctttcaaacagaggagatgaaagatgtttttaaaaaacctggcggcagcgcaaaagatg

SEQ ID NO: 230606 - DNA, 103 bp, Artificial Sequence
  Synthetic Polynucleotide
taatacgactcactatagggggtgaagcagttggatcaaaagttttaaaaaacagaggagattttaaatgttttgatccaacctggcggcagcgcaaaagatg

SEQ ID NO: 230607 - DNA, 103 bp, Artificial Sequence
  Synthetic Polynucleotide
taatacgactcactatagggctaacaaaatggtgaagcagttggatcaaaaacagaggagatttgatatgactgcttcaaacctggcggcagcgcaaaagatg

SEQ ID NO: 230608 - DNA, 103 bp, Artificial Sequence
  Synthetic Polynucleotide
taatacgactcactatagggtgacccttctttgatgttatgtagcttcctaacagaggagaaggaagatgcataacatcaacctggcggcagcgcaaaagatg

SEQ ID NO: 230609 - DNA, 103 bp, Artificial Sequence
  Synthetic Polynucleotide
taatacgactcactatagggtttgttatgttgacccttctttgatgttataacagaggagaataacaatgaagaagggtaacctggcggcagcgcaaaagatg

SEQ ID NO: 230610 - DNA, 103 bp, Artificial Sequence
  Synthetic Polynucleotide
taatacgactcactatagggttttaaattttttgttatgttgacccttctaacagaggagaagaaggatgaacataacaaacctggcggcagcgcaaaagatg

SEQ ID NO: 230611 - DNA, 103 bp, Artificial Sequence
  Synthetic Polynucleotide
taatacgactcactatagggtattctttacttttaaattttttgttatgtaacagaggagaacataaatgaaaatttaaaacctggcggcagcgcaaaagatg

SEQ ID NO: 230612 - DNA, 103 bp, Artificial Sequence
  Synthetic Polynucleotide
taatacgactcactatagggttcaccatcttctaattcgccatcttctctaacagaggagaagagaaatgggcgaattaaacctggcggcagcgcaaaagatg

SEQ ID NO: 230613 - DNA, 103 bp, Artificial Sequence
  Synthetic Polynucleotide
taatacgactcactataggggtactcatcatattctttacttttaaatttaacagaggagaaaatttatgagtaaagaaaacctggcggcagcgcaaaagatg

SEQ ID NO: 230614 - DNA, 103 bp, Artificial Sequence
  Synthetic Polynucleotide
taatacgactcactatagggtgtaggtgctgtactcatcatattctttacaacagaggagagtaaagatgatgatgagtaacctggcggcagcgcaaaagatg

SEQ ID NO: 230615 - DNA, 103 bp, Artificial Sequence
  Synthetic Polynucleotide
taatacgactcactatagggttgtcatcactgtaggtgctgtactcatcaaacagaggagatgatgaatgcagcacctaaacctggcggcagcgcaaaagatg

SEQ ID NO: 230616 - DNA, 103 bp, Artificial Sequence
  Synthetic Polynucleotide
taatacgactcactataggggttaccgaagttgtcatcactgtaggtgctaacagaggagaagcaccatgagtgatgacaacctggcggcagcgcaaaagatg

SEQ ID NO: 230617 - DNA, 103 bp, Artificial Sequence
  Synthetic Polynucleotide
taatacgactcactatagggcatcactgtagttaccgaagttgtcatcacaacagaggagagtgatgatgacttcggtaaacctggcggcagcgcaaaagatg

SEQ ID NO: 230618 - DNA, 103 bp, Artificial Sequence
  Synthetic Polynucleotide
taatacgactcactatagggccaaagttgtcatcactgtagttaccgaagaacagaggagacttcggatgctacagtgaaacctggcggcagcgcaaaagatg

SEQ ID NO: 230619 - DNA, 103 bp, Artificial Sequence
  Synthetic Polynucleotide
taatacgactcactatagggaccgtagttaccaaagttgtcatcactgtaaacagaggagatacagtatggacaactttaacctggcggcagcgcaaaagatg

SEQ ID NO: 230620 - DNA, 103 bp, Artificial Sequence
  Synthetic Polynucleotide
taatacgactcactatagggctgtttcctgaccgtagttaccaaagttgtaacagaggagaacaactatggtaactacgaacctggcggcagcgcaaaagatg

SEQ ID NO: 230621 - DNA, 103 bp, Artificial Sequence
  Synthetic Polynucleotide
taatacgactcactatagggaaatcttcctctgtttcctgaccgtagttaaacagaggagataactaatgtcaggaaacaacctggcggcagcgcaaaagatg

SEQ ID NO: 230622 - DNA, 103 bp, Artificial Sequence
  Synthetic Polynucleotide
taatacgactcactatagggctgattggcaaaatcttcctctgtttcctgaacagaggagacaggaaatggaggaagataacctggcggcagcgcaaaagatg

SEQ ID NO: 230623 - DNA, 103 bp, Artificial Sequence
  Synthetic Polynucleotide
taatacgactcactatagggcatcgtctatttcaccatcttctaattcgcaacagaggagagcgaatatgaagatggtgaacctggcggcagcgcaaaagatg

SEQ ID NO: 230624 - DNA, 103 bp, Artificial Sequence
  Synthetic Polynucleotide
taatacgactcactatagggattgtttcagctgattggcaaaatcttcctaacagaggagaaggaagatgttgccaatcaacctggcggcagcgcaaaagatg

SEQ ID NO: 230625 - DNA, 103 bp, Artificial Sequence
  Synthetic Polynucleotide
taatacgactcactataggggcttgcctgtattgtttcagctgattggcaaacagaggagatgccaaatggctgaaacaaacctggcggcagcgcaaaagatg

SEQ ID NO: 230626 - DNA, 103 bp, Artificial Sequence
  Synthetic Polynucleotide
taatacgactcactatagggggtttctttagcttgcctgtattgtttcagaacagaggagactgaaaatgtacaggcaaaacctggcggcagcgcaaaagatg

SEQ ID NO: 230627 - DNA, 103 bp, Artificial Sequence
  Synthetic Polynucleotide
taatacgactcactatagggcaatatttgaggtttctttagcttgcctgtaacagaggagaacaggcatgctaaagaaaaacctggcggcagcgcaaaagatg

SEQ ID NO: 230628 - DNA, 103 bp, Artificial Sequence
  Synthetic Polynucleotide
taatacgactcactataggggaccctaaagcaatatttgaggtttctttaaacagaggagataaagaatgctcaaatataacctggcggcagcgcaaaagatg

SEQ ID NO: 230629 - DNA, 103 bp, Artificial Sequence
  Synthetic Polynucleotide
taatacgactcactatagggagaaaatgatgaccctaaagcaatatttgaaacagaggagatcaaatatggctttagggaacctggcggcagcgcaaaagatg

SEQ ID NO: 230630 - DNA, 103 bp, Artificial Sequence
  Synthetic Polynucleotide
taatacgactcactatagggctgattctttagaaaatgatgaccctaaagaacagaggagactttagatgcatcattttaacctggcggcagcgcaaaagatg

SEQ ID NO: 230631 - DNA, 103 bp, Artificial Sequence
  Synthetic Polynucleotide
taatacgactcactatagggtgtttttttcctgattctttagaaaatgataacagaggagaatcattatgtaaagaatcaacctggcggcagcgcaaaagatg

SEQ ID NO: 230632 - DNA, 103 bp, Artificial Sequence
  Synthetic Polynucleotide
taatacgactcactatagggtttcattctctgtttttttcctgattctttaacagaggagaaaagaaatgggaaaaaaaaacctggcggcagcgcaaaagatg

SEQ ID NO: 230633 - DNA, 103 bp, Artificial Sequence
  Synthetic Polynucleotide
taatacgactcactataggggctgaactcctttcattctctgtttttttcaacagaggagagaaaaaatgagagaatgaaacctggcggcagcgcaaaagatg

SEQ ID NO: 230634 - DNA, 103 bp, Artificial Sequence
  Synthetic Polynucleotide
taatacgactcactatagggtcaaatcctgcatcgtctatttcaccatctaacagaggagaagatggatgaatagacgaaacctggcggcagcgcaaaagatg

SEQ ID NO: 230635 - DNA, 103 bp, Artificial Sequence
  Synthetic Polynucleotide
taatacgactcactatagggtcaataccttgctgaactcctttcattctcaacagaggagagagaatatgaggagttcaaacctggcggcagcgcaaaagatg

SEQ ID NO: 230636 - DNA, 103 bp, Artificial Sequence
  Synthetic Polynucleotide
taatacgactcactatagggaactctctgttcaataccttgctgaactccaacagaggagaggagttatgcaaggtattaacctggcggcagcgcaaaagatg

SEQ ID NO: 230637 - DNA, 103 bp, Artificial Sequence
  Synthetic Polynucleotide
taatacgactcactatagggtaaaacttttaactctctgttcaataccttaacagaggagaaaggtaatgaacagagagaacctggcggcagcgcaaaagatg

SEQ ID NO: 230638 - DNA, 103 bp, Artificial Sequence
  Synthetic Polynucleotide
taatacgactcactatagggcgaccaacattaaaacttttaactctctgtaacagaggagaacagagatgtaaaagtttaacctggcggcagcgcaaaagatg

SEQ ID NO: 230639 - DNA, 103 bp, Artificial Sequence
  Synthetic Polynucleotide
taatacgactcactataggggccacgtccacgaccaacattaaaacttttaacagaggagaaaaagtatgaatgttggtaacctggcggcagcgcaaaagatg

SEQ ID NO: 230640 - DNA, 103 bp, Artificial Sequence
  Synthetic Polynucleotide
taatacgactcactatagggtcttcggcaagccacgtccacgaccaacataacagaggagaatgttgatggtggacgtgaacctggcggcagcgcaaaagatg

SEQ ID NO: 230641 - DNA, 103 bp, Artificial Sequence
  Synthetic Polynucleotide
taatacgactcactatagggcgtttgattttcttcggcaagccacgtccaaacagaggagatggacgatgcttgccgaaaacctggcggcagcgcaaaagatg

SEQ ID NO: 230642 - DNA, 103 bp, Artificial Sequence
  Synthetic Polynucleotide
taatacgactcactatagggacgttcttttcgtttgattttcttcggcaaaacagaggagattgccgatgaaaatcaaaaacctggcggcagcgcaaaagatg

SEQ ID NO: 230643 - DNA, 103 bp, Artificial Sequence
  Synthetic Polynucleotide
taatacgactcactatagggttcttcccccacgttcttttcgtttgatttaacagaggagaaaatcaatggaaaagaacaacctggcggcagcgcaaaagatg

SEQ ID NO: 230644 - DNA, 103 bp, Artificial Sequence
  Synthetic Polynucleotide
taatacgactcactatagggcctttattggttcttcccccacgttcttttaacagaggagaaaaagaatgtgggggaagaacctggcggcagcgcaaaagatg

SEQ ID NO: 230645 - DNA, 103 bp, Artificial Sequence
  Synthetic Polynucleotide
taatacgactcactatagggttgtatttcttcaaatcctgcatcgtctataacagaggagaatagacatggcaggatttaacctggcggcagcgcaaaagatg

SEQ ID NO: 230646 - DNA, 103 bp, Artificial Sequence
  Synthetic Polynucleotide
taatacgactcactatagggcacattaggccctttattggttcttcccccaacagaggagagggggaatgaccaataaaaacctggcggcagcgcaaaagatg

SEQ ID NO: 230647 - DNA, 103 bp, Artificial Sequence
  Synthetic Polynucleotide
taatacgactcactatagggatactgaaaacacattaggccctttattggaacagaggagaccaataatgggcctaatgaacctggcggcagcgcaaaagatg

SEQ ID NO: 230648 - DNA, 103 bp, Artificial Sequence
  Synthetic Polynucleotide
taatacgactcactatagggaagtcatccgatactgaaaacacattaggcaacagaggagagcctaaatggttttcagtaacctggcggcagcgcaaaagatg

SEQ ID NO: 230649 - DNA, 103 bp, Artificial Sequence
  Synthetic Polynucleotide
taatacgactcactatagggatactcttgaaagtcatccgatactgaaaaaacagaggagattttcaatgtcggatgacaacctggcggcagcgcaaaagatg

SEQ ID NO: 230650 - DNA, 103 bp, Artificial Sequence
  Synthetic Polynucleotide
taatacgactcactatagggctggtttattatactcttgaaagtcatccgaacagaggagacggatgatgttcaagagtaacctggcggcagcgcaaaagatg

SEQ ID NO: 230651 - DNA, 103 bp, Artificial Sequence
  Synthetic Polynucleotide
taatacgactcactatagggcattttttccctggtttattatactcttgaaacagaggagatcaagaatgtaataaaccaacctggcggcagcgcaaaagatg

SEQ ID NO: 230652 - DNA, 103 bp, Artificial Sequence
  Synthetic Polynucleotide
taatacgactcactatagggcataaccttccattttttccctggtttattaacagaggagaaataaaatggggaaaaaaaacctggcggcagcgcaaaagatg

SEQ ID NO: 230653 - DNA, 103 bp, Artificial Sequence
  Synthetic Polynucleotide
taatacgactcactatagggattcctgagtcataaccttccattttttccaacagaggagaggaaaaatgggaaggttaaacctggcggcagcgcaaaagatg

SEQ ID NO: 230654 - DNA, 103 bp, Artificial Sequence
  Synthetic Polynucleotide
taatacgactcactatagggtgattaataaattcctgagtcataaccttcaacagaggagagaaggtatggactcaggaaacctggcggcagcgcaaaagatg

SEQ ID NO: 230655 - DNA, 103 bp, Artificial Sequence
  Synthetic Polynucleotide
taatacgactcactatagggcactgtgtgctgattaataaattcctgagtaacagaggagaactcagatgtttattaataacctggcggcagcgcaaaagatg

SEQ ID NO: 230656 - DNA, 103 bp, Artificial Sequence
  Synthetic Polynucleotide
taatacgactcactatagggcttctttttcttgtatttcttcaaatcctgaacagaggagacaggatatgaagaaatacaacctggcggcagcgcaaaagatg

SEQ ID NO: 230657 - DNA, 103 bp, Artificial Sequence
  Synthetic Polynucleotide
taatacgactcactatagggctttgtgttccactgtgtgctgattaataaaacagaggagattattaatgagcacacagaacctggcggcagcgcaaaagatg

SEQ ID NO: 230658 - DNA, 103 bp, Artificial Sequence
  Synthetic Polynucleotide
taatacgactcactatagggatttgttttcctttgtgttccactgtgtgcaacagaggagagcacacatgggaacacaaaacctggcggcagcgcaaaagatg

SEQ ID NO: 230659 - DNA, 103 bp, Artificial Sequence
  Synthetic Polynucleotide
taatacgactcactataggggtatttacagatttgttttcctttgtgttcaacagaggagagaacacatgggaaaacaaaacctggcggcagcgcaaaagatg

SEQ ID NO: 230660 - DNA, 103 bp, Artificial Sequence
  Synthetic Polynucleotide
taatacgactcactatagggcttccaggaagtatttacagatttgttttcaacagaggagagaaaacatgtctgtaaataacctggcggcagcgcaaaagatg

SEQ ID NO: 230661 - DNA, 103 bp, Artificial Sequence
  Synthetic Polynucleotide
taatacgactcactatagggatacacctcccttccaggaagtatttacagaacagaggagactgtaaatgcttcctggaaacctggcggcagcgcaaaagatg

SEQ ID NO: 230662 - DNA, 103 bp, Artificial Sequence
  Synthetic Polynucleotide
taatacgactcactatagggatctcccttaatacacctcccttccaggaaaacagaggagattcctgatggggaggtgtaacctggcggcagcgcaaaagatg

SEQ ID NO: 230663 - DNA, 103 bp, Artificial Sequence
  Synthetic Polynucleotide
taatacgactcactatagggatttacactgatctcccttaatacacctccaacagaggagaggaggtatgttaagggagaacctggcggcagcgcaaaagatg

SEQ ID NO: 230664 - DNA, 103 bp, Artificial Sequence
  Synthetic Polynucleotide
taatacgactcactatagggtcatgatcaaatttacactgatctcccttaaacagaggagataagggatgtcagtgtaaaacctggcggcagcgcaaaagatg

SEQ ID NO: 230665 - DNA, 103 bp, Artificial Sequence
  Synthetic Polynucleotide
taatacgactcactatagggcaactctgcatcatgatcaaatttacactgaacagaggagacagtgtatgtttgatcataacctggcggcagcgcaaaagatg

SEQ ID NO: 230666 - DNA, 103 bp, Artificial Sequence
  Synthetic Polynucleotide
taatacgactcactatagggttcttttctccaactctgcatcatgatcaaaacagaggagattgatcatgatgcagagtaacctggcggcagcgcaaaagatg

SEQ ID NO: 230667 - DNA, 103 bp, Artificial Sequence
  Synthetic Polynucleotide
taatacgactcactatagggttctcttttgcttctttttcttgtatttctaacagaggagaagaaatatgagaaaaagaaacctggcggcagcgcaaaagatg

SEQ ID NO: 230668 - DNA, 103 bp, Artificial Sequence
  Synthetic Polynucleotide
taatacgactcactatagggcagatctcttttcttttctccaactctgcaaacagaggagatgcagaatgggagaaaagaacctggcggcagcgcaaaagatg

SEQ ID NO: 230669 - DNA, 103 bp, Artificial Sequence
  Synthetic Polynucleotide
taatacgactcactatagggataaaatttgcagatctcttttcttttctcaacagaggagagagaaaatgaaagagatcaacctggcggcagcgcaaaagatg

SEQ ID NO: 230670 - DNA, 103 bp, Artificial Sequence
  Synthetic Polynucleotide
taatacgactcactatagggatccttgtaaataaaatttgcagatctcttaacagaggagaaagagaatggcaaattttaacctggcggcagcgcaaaagatg

SEQ ID NO: 230671 - DNA, 103 bp, Artificial Sequence
  Synthetic Polynucleotide
taatacgactcactatagggttggtacaatatccttgtaaataaaatttgaacagaggagacaaattatgtttacaaggaacctggcggcagcgcaaaagatg

SEQ ID NO: 230672 - DNA, 103 bp, Artificial Sequence
  Synthetic Polynucleotide
taatacgactcactataggggttctctcctttggtacaatatccttgtaaaacagaggagattacaaatgtattgtaccaacctggcggcagcgcaaaagatg

SEQ ID NO: 230673 - DNA, 103 bp, Artificial Sequence
  Synthetic Polynucleotide
taatacgactcactatagggtataaatgcagttctctcctttggtacaataacagaggagaattgtaatgaaggagagaaacctggcggcagcgcaaaagatg

SEQ ID NO: 230674 - DNA, 103 bp, Artificial Sequence
  Synthetic Polynucleotide
taatacgactcactatagggtcattatgcatataaatgcagttctctcctaacagaggagaaggagaatgctgcatttaaacctggcggcagcgcaaaagatg

SEQ ID NO: 230675 - DNA, 103 bp, Artificial Sequence
  Synthetic Polynucleotide
taatacgactcactataggggcatggaaattcattatgcatataaatgcaaacagaggagatgcattatgatgcataataacctggcggcagcgcaaaagatg

SEQ ID NO: 230676 - DNA, 103 bp, Artificial Sequence
  Synthetic Polynucleotide
taatacgactcactataggggatagaacttgcatggaaattcattatgcaaacagaggagatgcataatgaatttccataacctggcggcagcgcaaaagatg

SEQ ID NO: 230677 - DNA, 103 bp, Artificial Sequence
  Synthetic Polynucleotide
taatacgactcactataggggctccactatgatagaacttgcatggaaataacagaggagaatttccatgcaagttctaaacctggcggcagcgcaaaagatg

SEQ ID NO: 230678 - DNA, 103 bp, Artificial Sequence
  Synthetic Polynucleotide
taatacgactcactataggggggttttgagaaaagattctcaaaatccataacagaggagaatggatatggagaatcttaacctggcggcagcgcaaaagatg

SEQ ID NO: 230679 - DNA, 103 bp, Artificial Sequence
  Synthetic Polynucleotide
taatacgactcactatagggctcttcttgtgtttcttcaacttctgtatcaacagaggagagatacaatggttgaagaaaacctggcggcagcgcaaaagatg

SEQ ID NO: 230680 - DNA, 103 bp, Artificial Sequence
  Synthetic Polynucleotide
taatacgactcactataggggtttaattttctcttcttgtgtttcttcaaaacagaggagattgaagatgcacaagaagaacctggcggcagcgcaaaagatg

SEQ ID NO: 230681 - DNA, 103 bp, Artificial Sequence
  Synthetic Polynucleotide
taatacgactcactatagggtcgcactccagtttaattttctcttcttgtaacagaggagaacaagaatggaaaattaaaacctggcggcagcgcaaaagatg

SEQ ID NO: 230682 - DNA, 103 bp, Artificial Sequence
  Synthetic Polynucleotide
taatacgactcactataggggggaatttgctcgcactccagtttaattttaacagaggagaaaaattatgctggagtgcaacctggcggcagcgcaaaagatg

SEQ ID NO: 230683 - DNA, 103 bp, Artificial Sequence
  Synthetic Polynucleotide
taatacgactcactatagggtaaattttttgggaatttgctcgcactccaaacagaggagatggagtatgagcaaattcaacctggcggcagcgcaaaagatg

SEQ ID NO: 230684 - DNA, 103 bp, Artificial Sequence
  Synthetic Polynucleotide
taatacgactcactataggggcagagtgtctaaattttttgggaatttgcaacagaggagagcaaatatgcaaaaaattaacctggcggcagcgcaaaagatg

SEQ ID NO: 230685 - DNA, 103 bp, Artificial Sequence
  Synthetic Polynucleotide
taatacgactcactatagggtggtgatattgcagagtgtctaaattttttaacagaggagaaaaaaaatgagacactctaacctggcggcagcgcaaaagatg

SEQ ID NO: 230686 - DNA, 103 bp, Artificial Sequence
  Synthetic Polynucleotide
taatacgactcactataggggcgaactttttggtgatattgcagagtgtcaacagaggagagacactatgcaatatcacaacctggcggcagcgcaaaagatg

SEQ ID NO: 230687 - DNA, 103 bp, Artificial Sequence
  Synthetic Polynucleotide
taatacgactcactatagggtttctatgcagcgaactttttggtgatattaacagaggagaaatatcatgaaaaagttcaacctggcggcagcgcaaaagatg

SEQ ID NO: 230688 - DNA, 103 bp, Artificial Sequence
  Synthetic Polynucleotide
taatacgactcactatagggacttcttgattttctatgcagcgaacttttaacagaggagaaaaagtatgctgcatagaaacctggcggcagcgcaaaagatg

SEQ ID NO: 230689 - DNA, 103 bp, Artificial Sequence
  Synthetic Polynucleotide
taatacgactcactatagggccgggttggggggttttgagaaaagattctaacagaggagaagaatcatgtctcaaaacaacctggcggcagcgcaaaagatg

SEQ ID NO: 230690 - DNA, 103 bp, Artificial Sequence
  Synthetic Polynucleotide
taatacgactcactatagggcatagtccttacttcttgattttctatgcaaacagaggagatgcataatgaatcaagaaaacctggcggcagcgcaaaagatg

SEQ ID NO: 230691 - DNA, 103 bp, Artificial Sequence
  Synthetic Polynucleotide
taatacgactcactatagggctatatacatcatagtccttacttcttgataacagaggagaatcaagatgtaaggactaaacctggcggcagcgcaaaagatg

SEQ ID NO: 230692 - DNA, 103 bp, Artificial Sequence
  Synthetic Polynucleotide
taatacgactcactatagggatcattatcactatatacatcatagtccttaacagaggagaaaggacatggatgtatataacctggcggcagcgcaaaagatg

SEQ ID NO: 230693 - DNA, 103 bp, Artificial Sequence
  Synthetic Polynucleotide
taatacgactcactataggggactgcagatatcattatcactatatacataacagaggagaatgtatatggtgataatgaacctggcggcagcgcaaaagatg

SEQ ID NO: 230694 - DNA, 103 bp, Artificial Sequence
  Synthetic Polynucleotide
taatacgactcactatagggtctgattcctgactgcagatatcattatcaaacagaggagatgataaatgtatctgcagaacctggcggcagcgcaaaagatg

SEQ ID NO: 230695 - DNA, 103 bp, Artificial Sequence
  Synthetic Polynucleotide
taatacgactcactatagggaaaattatcttctgattcctgactgcagataacagaggagaatctgcatgcaggaatcaaacctggcggcagcgcaaaagatg

SEQ ID NO: 230696 - DNA, 103 bp, Artificial Sequence
  Synthetic Polynucleotide
taatacgactcactataggggctctttggcaaaattatcttctgattcctaacagaggagaaggaatatgaagataattaacctggcggcagcgcaaaagatg

SEQ ID NO: 230697 - DNA, 103 bp, Artificial Sequence
  Synthetic Polynucleotide
taatacgactcactatagggtactgttgaagctctttggcaaaattatctaacagaggagaagataaatgtgccaaagaaacctggcggcagcgcaaaagatg

SEQ ID NO: 230698 - DNA, 103 bp, Artificial Sequence
  Synthetic Polynucleotide
taatacgactcactatagggggcttgtatgtactgttgaagctctttggcaacagaggagagccaaaatgcttcaacagaacctggcggcagcgcaaaagatg

SEQ ID NO: 230699 - DNA, 103 bp, Artificial Sequence
  Synthetic Polynucleotide
taatacgactcactatagggccatttctctggcttgtatgtactgttgaaaacagaggagattcaacatgacatacaagaacctggcggcagcgcaaaagatg

SEQ ID NO: 230700 - DNA, 103 bp, Artificial Sequence
  Synthetic Polynucleotide
taatacgactcactatagggttgccgagggccgggttggggggttttgagaacagaggagactcaaaatgccccaacccaacctggcggcagcgcaaaagatg

SEQ ID NO: 230701 - DNA, 103 bp, Artificial Sequence
  Synthetic Polynucleotide
taatacgactcactataggggcagcatttgccatttctctggcttgtatgaacagaggagacatacaatgcagagaaataacctggcggcagcgcaaaagatg

SEQ ID NO: 230702 - DNA, 103 bp, Artificial Sequence
  Synthetic Polynucleotide
taatacgactcactatagggttcaggttgagcagcatttgccatttctctaacagaggagaagagaaatggcaaatgctaacctggcggcagcgcaaaagatg

SEQ ID NO: 230703 - DNA, 103 bp, Artificial Sequence
  Synthetic Polynucleotide
taatacgactcactatagggttgtagattcttcaggttgagcagcatttgaacagaggagacaaatgatgctcaacctgaacctggcggcagcgcaaaagatg

SEQ ID NO: 230704 - DNA, 103 bp, Artificial Sequence
  Synthetic Polynucleotide
taatacgactcactatagggccttctttctttgtagattcttcaggttgaaacagaggagatcaaccatgagaatctacaacctggcggcagcgcaaaagatg

SEQ ID NO: 230705 - DNA, 103 bp, Artificial Sequence
  Synthetic Polynucleotide
taatacgactcactatagggatcttttactccttctttctttgtagattcaacagaggagagaatctatgaagaaagaaaacctggcggcagcgcaaaagatg

SEQ ID NO: 230706 - DNA, 103 bp, Artificial Sequence
  Synthetic Polynucleotide
taatacgactcactatagggcctgtggggtatcttttactccttctttctaacagaggagaagaaagatggagtaaaagaacctggcggcagcgcaaaagatg

SEQ ID NO: 230707 - DNA, 103 bp, Artificial Sequence
  Synthetic Polynucleotide
taatacgactcactatagggtgtttagcagcctgtggggtatcttttactaacagaggagaagtaaaatgtaccccacaaacctggcggcagcgcaaaagatg

SEQ ID NO: 230708 - DNA, 103 bp, Artificial Sequence
  Synthetic Polynucleotide
taatacgactcactatagggtttatttttttgtttagcagcctgtggggtaacagaggagaaccccaatggctgctaaaaacctggcggcagcgcaaaagatg

SEQ ID NO: 230709 - DNA, 103 bp, Artificial Sequence
  Synthetic Polynucleotide
taatacgactcactatagggctttaagatttttatttttttgtttagcagaacagaggagactgctaatgaaaaaaataaacctggcggcagcgcaaaagatg

SEQ ID NO: 230710 - DNA, 103 bp, Artificial Sequence
  Synthetic Polynucleotide
taatacgactcactatagggttgtgaccagctttaagatttttattttttaacagaggagaaaaaaaatgaaatcttaaaacctggcggcagcgcaaaagatg

SEQ ID NO: 230711 - DNA, 103 bp, Artificial Sequence
  Synthetic Polynucleotide
taatacgactcactatagggcgtggccgttttgccgagggccgggttgggaacagaggagacccaacatggccctcggcaacctggcggcagcgcaaaagatg

SEQ ID NO: 230712 - DNA, 103 bp, Artificial Sequence
  Synthetic Polynucleotide
taatacgactcactatagggtttgccattcttgtgaccagctttaagattaacagaggagaaatcttatggctggtcacaacctggcggcagcgcaaaagatg

SEQ ID NO: 230713 - DNA, 103 bp, Artificial Sequence
  Synthetic Polynucleotide
taatacgactcactatagggttttcttctgtttgccattcttgtgaccagaacagaggagactggtcatgagaatggcaaacctggcggcagcgcaaaagatg

SEQ ID NO: 230714 - DNA, 103 bp, Artificial Sequence
  Synthetic Polynucleotide
taatacgactcactatagggtttcgcttcattttcttctgtttgccattcaacagaggagagaatggatgacagaagaaaacctggcggcagcgcaaaagatg

SEQ ID NO: 230715 - DNA, 103 bp, Artificial Sequence
  Synthetic Polynucleotide
taatacgactcactataggggccaggccattttcgcttcattttcttctgaacagaggagacagaagatgatgaagcgaaacctggcggcagcgcaaaagatg

SEQ ID NO: 230716 - DNA, 103 bp, Artificial Sequence
  Synthetic Polynucleotide
taatacgactcactatagggtgtttccagggccaggccattttcgcttcaaacagaggagatgaagcatgaatggcctgaacctggcggcagcgcaaaagatg

SEQ ID NO: 230717 - DNA, 103 bp, Artificial Sequence
  Synthetic Polynucleotide
taatacgactcactatagggtttgatcctttgtttccagggccaggccataacagaggagaatggccatgccctggaaaaacctggcggcagcgcaaaagatg

SEQ ID NO: 230718 - DNA, 103 bp, Artificial Sequence
  Synthetic Polynucleotide
taatacgactcactatagggcagcaaagcatttgatcctttgtttccaggaacagaggagacctggaatgaaaggatcaaacctggcggcagcgcaaaagatg

SEQ ID NO: 230719 - DNA, 103 bp, Artificial Sequence
  Synthetic Polynucleotide
taatacgactcactatagggcgctgttcctcagcaaagcatttgatccttaacagaggagaaaggatatgatgctttgcaacctggcggcagcgcaaaagatg

SEQ ID NO: 230720 - DNA, 103 bp, Artificial Sequence
  Synthetic Polynucleotide
taatacgactcactatagggtcctgtgagccgctgttcctcagcaaagcaaacagaggagatgctttatggaggaacagaacctggcggcagcgcaaaagatg

SEQ ID NO: 230721 - DNA, 103 bp, Artificial Sequence
  Synthetic Polynucleotide
taatacgactcactatagggaccatcctcttcctgtgagccgctgttcctaacagaggagaaggaacatgggctcacagaacctggcggcagcgcaaaagatg

SEQ ID NO: 230722 - DNA, 103 bp, Artificial Sequence
  Synthetic Polynucleotide
taatacgactcactatagggcgtcagagtccgtggccgttttgccgagggaacagaggagaccctcgatgaaacggccaaacctggcggcagcgcaaaagatg

SEQ ID NO: 230723 - DNA, 103 bp, Artificial Sequence
  Synthetic Polynucleotide
taatacgactcactatagggctttaggtttaccatcctcttcctgtgagcaacagaggagagctcacatgaagaggatgaacctggcggcagcgcaaaagatg

SEQ ID NO: 230724 - DNA, 103 bp, Artificial Sequence
  Synthetic Polynucleotide
taatacgactcactatagggtgctgcttctctttaggtttaccatcctctaacagaggagaagaggaatgtaaacctaaaacctggcggcagcgcaaaagatg

SEQ ID NO: 230725 - DNA, 103 bp, Artificial Sequence
  Synthetic Polynucleotide
taatacgactcactatagggactcaaatgctgctgcttctctttaggtttaacagaggagaaaacctatggagaagcagaacctggcggcagcgcaaaagatg

SEQ ID NO: 230726 - DNA, 103 bp, Artificial Sequence
  Synthetic Polynucleotide
taatacgactcactatagggtgaatgcctgactcaaatgctgctgcttctaacagaggagaagaagcatgagcatttgaaacctggcggcagcgcaaaagatg

SEQ ID NO: 230727 - DNA, 103 bp, Artificial Sequence
  Synthetic Polynucleotide
taatacgactcactatagggtgttggttgatgaatgcctgactcaaatgcaacagaggagagcatttatgtcaggcattaacctggcggcagcgcaaaagatg

SEQ ID NO: 230728 - DNA, 103 bp, Artificial Sequence
  Synthetic Polynucleotide
taatacgactcactatagggttccactgtatgttggttgatgaatgcctgaacagaggagacaggcaatgatcaaccaaaacctggcggcagcgcaaaagatg

SEQ ID NO: 230729 - DNA, 103 bp, Artificial Sequence
  Synthetic Polynucleotide
taatacgactcactatagggttcccttgcgttccactgtatgttggttgaaacagaggagatcaaccatgatacagtggaacctggcggcagcgcaaaagatg

SEQ ID NO: 230730 - DNA, 103 bp, Artificial Sequence
  Synthetic Polynucleotide
taatacgactcactatagggcaaatttgttttcccttgcgttccactgtaaacagaggagatacagtatgacgcaagggaacctggcggcagcgcaaaagatg

SEQ ID NO: 230731 - DNA, 103 bp, Artificial Sequence
  Synthetic Polynucleotide
taatacgactcactatagggaaaatatttacaaatttgttttcccttgcgaacagaggagacgcaagatgaaacaaattaacctggcggcagcgcaaaagatg

SEQ ID NO: 230732 - DNA, 103 bp, Artificial Sequence
  Synthetic Polynucleotide
taatacgactcactatagggtcctttcaagaaaatatttacaaatttgttaacagaggagaaacaaaatggtaaatattaacctggcggcagcgcaaaagatg

SEQ ID NO: 230733 - DNA, 103 bp, Artificial Sequence
  Synthetic Polynucleotide
taatacgactcactatagggtcgattctttcgtcagagtccgtggccgttaacagaggagaaacggcatgggactctgaaacctggcggcagcgcaaaagatg

SEQ ID NO: 230734 - DNA, 103 bp, Artificial Sequence
  Synthetic Polynucleotide
taatacgactcactatagggttaatacatttcctttcaagaaaatatttaaacagaggagataaataatgtcttgaaagaacctggcggcagcgcaaaagatg

SEQ ID NO: 230735 - DNA, 103 bp, Artificial Sequence
  Synthetic Polynucleotide
taatacgactcactatagggctggtctcccttaatacatttcctttcaagaacagaggagacttgaaatgaaatgtattaacctggcggcagcgcaaaagatg

SEQ ID NO: 230736 - DNA, 103 bp, Artificial Sequence
  Synthetic Polynucleotide
taatacgactcactatagggcaaatttacactggtctcccttaatacattaacagaggagaaatgtaatgagggagaccaacctggcggcagcgcaaaagatg

SEQ ID NO: 230737 - DNA, 103 bp, Artificial Sequence
  Synthetic Polynucleotide
taatacgactcactataggggcatcatgatcaaatttacactggtctcccaacagaggagagggagaatggtgtaaattaacctggcggcagcgcaaaagatg

SEQ ID NO: 230738 - DNA, 103 bp, Artificial Sequence
  Synthetic Polynucleotide
taatacgactcactatagggttctatctctgcatcatgatcaaatttacaaacagaggagatgtaaaatggatcatgataacctggcggcagcgcaaaagatg

SEQ ID NO: 230739 - DNA, 103 bp, Artificial Sequence
  Synthetic Polynucleotide
taatacgactcactatagggcctttttcttttctatctctgcatcatgataacagaggagaatcatgatgcagagatagaacctggcggcagcgcaaaagatg

SEQ ID NO: 230740 - DNA, 103 bp, Artificial Sequence
  Synthetic Polynucleotide
taatacgactcactatagggttacacatttcctttttcttttctatctctaacagaggagaagagatatgaaagaaaaaaacctggcggcagcgcaaaagatg

SEQ ID NO: 230741 - DNA, 103 bp, Artificial Sequence
  Synthetic Polynucleotide
taatacgactcactatagggtacataaaacttacacatttcctttttcttaacagaggagaaagaaaatggaaatgtgtaacctggcggcagcgcaaaagatg

SEQ ID NO: 230742 - DNA, 103 bp, Artificial Sequence
  Synthetic Polynucleotide
taatacgactcactatagggaatatccttgtacataaaacttacacatttaacagaggagaaaatgtatgagttttatgaacctggcggcagcgcaaaagatg

SEQ ID NO: 230743 - DNA, 103 bp, Artificial Sequence
  Synthetic Polynucleotide
taatacgactcactatagggcctctggtacaatatccttgtacataaaacaacagaggagagttttaatgacaaggataaacctggcggcagcgcaaaagatg

SEQ ID NO: 230744 - DNA, 103 bp, Artificial Sequence
  Synthetic Polynucleotide
taatacgactcactatagggtatttcatcatcgattctttcgtcagagtcaacagaggagagactctatggaaagaatcaacctggcggcagcgcaaaagatg

SEQ ID NO: 230745 - DNA, 103 bp, Artificial Sequence
  Synthetic Polynucleotide
taatacgactcactatagggacagttttcacctctggtacaatatccttgaacagaggagacaaggaatgtgtaccagaaacctggcggcagcgcaaaagatg

SEQ ID NO: 230746 - DNA, 103 bp, Artificial Sequence
  Synthetic Polynucleotide
taatacgactcactataggggcaaatacagacagttttcacctctggtacaacagaggagagtaccaatggtgaaaactaacctggcggcagcgcaaaagatg

SEQ ID NO: 230747 - DNA, 103 bp, Artificial Sequence
  Synthetic Polynucleotide
taatacgactcactatagggtattcattatgcaaatacagacagttttcaaacagaggagatgaaaaatgtctgtatttaacctggcggcagcgcaaaagatg

SEQ ID NO: 230748 - DNA, 103 bp, Artificial Sequence
  Synthetic Polynucleotide
taatacgactcactatagggcttacaaggatattcattatgcaaatacagaacagaggagactgtatatgcataatgaaaacctggcggcagcgcaaaagatg

SEQ ID NO: 230749 - DNA, 103 bp, Artificial Sequence
  Synthetic Polynucleotide
taatacgactcactatagggtatggtaaaacttacaaggatattcattataacagaggagaataatgatgatccttgtaaacctggcggcagcgcaaaagatg

SEQ ID NO: 230750 - DNA, 103 bp, Artificial Sequence
  Synthetic Polynucleotide
taatacgactcactatagggtttgttcctgtatggtaaaacttacaaggaaacagaggagatccttgatggttttaccaaacctggcggcagcgcaaaagatg

SEQ ID NO: 230751 - DNA, 103 bp, Artificial Sequence
  Synthetic Polynucleotide
taatacgactcactatagggctgataacattttgttcctgtatggtaaaaaacagaggagattttacatgacaggaacaaacctggcggcagcgcaaaagatg

SEQ ID NO: 230752 - DNA, 103 bp, Artificial Sequence
  Synthetic Polynucleotide
taatacgactcactatagggagtattctccctgataacattttgttcctgaacagaggagacaggaaatgaatgttatcaacctggcggcagcgcaaaagatg

SEQ ID NO: 230753 - DNA, 103 bp, Artificial Sequence
  Synthetic Polynucleotide
taatacgactcactataggggaaaacttgcagtattctccctgataacataacagaggagaatgttaatggggagaataaacctggcggcagcgcaaaagatg

SEQ ID NO: 230754 - DNA, 103 bp, Artificial Sequence
  Synthetic Polynucleotide
taatacgactcactatagggtggagcatgagaaaacttgcagtattctccaacagaggagaggagaaatgtgcaagtttaacctggcggcagcgcaaaagatg

SEQ ID NO: 230755 - DNA, 103 bp, Artificial Sequence
  Synthetic Polynucleotide
taatacgactcactatagggcttctgtatctatttcatcatcgattctttaacagaggagaaaagaaatgatgatgaaaaacctggcggcagcgcaaaagatg

SEQ ID NO: 230756 - DNA, 103 bp, Artificial Sequence
  Synthetic Polynucleotide
taatacgactcactatagggcaggagtcagtggagcatgagaaaacttgcaacagaggagagcaagtatgctcatgctcaacctggcggcagcgcaaaagatg

SEQ ID NO: 230757 - DNA, 103 bp, Artificial Sequence
  Synthetic Polynucleotide
taatacgactcactatagggtcttgtgtttcaggagtcagtggagcatgaaacagaggagatcatgcatgactgactccaacctggcggcagcgcaaaagatg

SEQ ID NO: 230758 - DNA, 103 bp, Artificial Sequence
  Synthetic Polynucleotide
taatacgactcactatagggagccaacaattcttgtgtttcaggagtcagaacagaggagactgactatggaaacacaaaacctggcggcagcgcaaaagatg

SEQ ID NO: 230759 - DNA, 103 bp, Artificial Sequence
  Synthetic Polynucleotide
taatacgactcactatagggccaaaactttagccaacaattcttgtgtttaacagaggagaaaacacatgaattgttggaacctggcggcagcgcaaaagatg

SEQ ID NO: 230760 - DNA, 103 bp, Artificial Sequence
  Synthetic Polynucleotide
taatacgactcactatagggttttcagtatccaaaactttagccaacaataacagaggagaattgttatgtaaagttttaacctggcggcagcgcaaaagatg

SEQ ID NO: 230761 - DNA, 103 bp, Artificial Sequence
  Synthetic Polynucleotide
taatacgactcactatagggacatgacttcttttcagtatccaaaactttaacagaggagaaaagttatggatactgaaaacctggcggcagcgcaaaagatg

SEQ ID NO: 230762 - DNA, 103 bp, Artificial Sequence
  Synthetic Polynucleotide
taatacgactcactataggggtttcttcaacttctgtatctatttcatcaaacagaggagatgatgaatgagatacagaaacctggcggcagcgcaaaagatg

SEQ ID NO: 230763 - DNA, 103 bp, Artificial Sequence
  Synthetic Polynucleotide
taatacgactcactatagggtctgcgcttacacctggggccatccgccataacagaggagaatggcgatgggccccaggaacctggcggcagcgcaaaagatg

SEQ ID NO: 230764 - DNA, 103 bp, Artificial Sequence
  Synthetic Polynucleotide
taatacgactcactatagggatgcagtttgtcttcatcatctgaatctgaaacagaggagatcagatatggatgatgaaaacctggcggcagcgcaaaagatg

SEQ ID NO: 230765 - DNA, 103 bp, Artificial Sequence
  Synthetic Polynucleotide
taatacgactcactatagggttgttcttgaaggggtttattctctatcttaacagaggagaaagataatgaataaacccaacctggcggcagcgcaaaagatg

SEQ ID NO: 230766 - DNA, 103 bp, Artificial Sequence
  Synthetic Polynucleotide
taatacgactcactatagggtaacagaaagttgttcttgaaggggtttataacagaggagaataaacatgttcaagaacaacctggcggcagcgcaaaagatg

SEQ ID NO: 230767 - DNA, 103 bp, Artificial Sequence
  Synthetic Polynucleotide
taatacgactcactatagggttaatttggttaacagaaagttgttcttgaaacagaggagatcaagaatgactttctgtaacctggcggcagcgcaaaagatg

SEQ ID NO: 230768 - DNA, 103 bp, Artificial Sequence
  Synthetic Polynucleotide
taatacgactcactatagggaggttcagttttaatttggttaacagaaagaacagaggagactttctatgaaccaaattaacctggcggcagcgcaaaagatg

SEQ ID NO: 230769 - DNA, 103 bp, Artificial Sequence
  Synthetic Polynucleotide
taatacgactcactatagggcataatccacaggttcagttttaatttggtaacagaggagaaccaaaatgaaactgaacaacctggcggcagcgcaaaagatg

SEQ ID NO: 230770 - DNA, 103 bp, Artificial Sequence
  Synthetic Polynucleotide
taatacgactcactatagggggtttgaattcataatccacaggttcagttaacagaggagaaactgaatgtgtggattaaacctggcggcagcgcaaaagatg

SEQ ID NO: 230771 - DNA, 103 bp, Artificial Sequence
  Synthetic Polynucleotide
taatacgactcactatagggaaccactatgggtttgaattcataatccacaacagaggagagtggatatggaattcaaaaacctggcggcagcgcaaaagatg

SEQ ID NO: 230772 - DNA, 103 bp, Artificial Sequence
  Synthetic Polynucleotide
taatacgactcactatagggttcctgaagcaaccactatgggtttgaattaacagaggagaaattcaatgccatagtggaacctggcggcagcgcaaaagatg

SEQ ID NO: 230773 - DNA, 103 bp, Artificial Sequence
  Synthetic Polynucleotide
taatacgactcactataggggaacagttgattcctgaagcaaccactatgaacagaggagacatagtatgtgcttcaggaacctggcggcagcgcaaaagatg

SEQ ID NO: 230774 - DNA, 103 bp, Artificial Sequence
  Synthetic Polynucleotide
taatacgactcactatagggtaaaggggttgaacagttgattcctgaagcaacagaggagagcttcaatgatcaactgtaacctggcggcagcgcaaaagatg

SEQ ID NO: 230775 - DNA, 103 bp, Artificial Sequence
  Synthetic Polynucleotide
taatacgactcactatagggcttccacaatatgcagtttgtcttcatcataacagaggagaatgatgatgacaaactgcaacctggcggcagcgcaaaagatg

SEQ ID NO: 230776 - DNA, 103 bp, Artificial Sequence
  Synthetic Polynucleotide
taatacgactcactatagggccccattttgtaaaggggttgaacagttgaaacagaggagatcaactatgcaaccccttaacctggcggcagcgcaaaagatg

SEQ ID NO: 230777 - DNA, 103 bp, Artificial Sequence
  Synthetic Polynucleotide
taatacgactcactatagggccagtgaaaaccccattttgtaaaggggttaacagaggagaaaccccatgacaaaatggaacctggcggcagcgcaaaagatg

SEQ ID NO: 230778 - DNA, 103 bp, Artificial Sequence
  Synthetic Polynucleotide
taatacgactcactatagggtgggccaccaccagtgaaaaccccattttgaacagaggagacaaaatatggttttcactaacctggcggcagcgcaaaagatg

SEQ ID NO: 230779 - DNA, 103 bp, Artificial Sequence
  Synthetic Polynucleotide
taatacgactcactatagggttgcctgtaatgggccaccaccagtgaaaaaacagaggagattttcaatggtggtggccaacctggcggcagcgcaaaagatg

SEQ ID NO: 230780 - DNA, 103 bp, Artificial Sequence
  Synthetic Polynucleotide
taatacgactcactatagggggagaactggttgcctgtaatgggccaccaaacagaggagatggtggatgattacaggcaacctggcggcagcgcaaaagatg

SEQ ID NO: 230781 - DNA, 103 bp, Artificial Sequence
  Synthetic Polynucleotide
taatacgactcactatagggcatgccctgaggagaactggttgcctgtaaaacagaggagattacagatgaccagttctaacctggcggcagcgcaaaagatg

SEQ ID NO: 230782 - DNA, 103 bp, Artificial Sequence
  Synthetic Polynucleotide
taatacgactcactatagggcagcttgcaccatgccctgaggagaactggaacagaggagaccagttatgctcagggcaaacctggcggcagcgcaaaagatg

SEQ ID NO: 230783 - DNA, 103 bp, Artificial Sequence
  Synthetic Polynucleotide
taatacgactcactatagggggcagaacaacagcttgcaccatgccctgaaacagaggagatcagggatgggtgcaagcaacctggcggcagcgcaaaagatg

SEQ ID NO: 230784 - DNA, 103 bp, Artificial Sequence
  Synthetic Polynucleotide
taatacgactcactatagggaccaactgttggcagaacaacagcttgcacaacagaggagagtgcaaatggttgttctgaacctggcggcagcgcaaaagatg

SEQ ID NO: 230785 - DNA, 103 bp, Artificial Sequence
  Synthetic Polynucleotide
taatacgactcactataggggagacaccaaaccaactgttggcagaacaaaacagaggagattgttcatgcaacagttgaacctggcggcagcgcaaaagatg

SEQ ID NO: 230786 - DNA, 103 bp, Artificial Sequence
  Synthetic Polynucleotide
taatacgactcactatagggacactttcttcttccacaatatgcagtttgaacagaggagacaaactatgtattgtggaaacctggcggcagcgcaaaagatg

SEQ ID NO: 230787 - DNA, 103 bp, Artificial Sequence
  Synthetic Polynucleotide
taatacgactcactatagggatacttatgggagacaccaaaccaactgttaacagaggagaaacagtatgtttggtgtcaacctggcggcagcgcaaaagatg

SEQ ID NO: 230788 - DNA, 103 bp, Artificial Sequence
  Synthetic Polynucleotide
taatacgactcactatagggacttaaattgatacttatgggagacaccaaaacagaggagattggtgatgcccataagtaacctggcggcagcgcaaaagatg

SEQ ID NO: 230789 - DNA, 103 bp, Artificial Sequence
  Synthetic Polynucleotide
taatacgactcactatagggtctgaatatcacttaaattgatacttatggaacagaggagaccataaatgtcaatttaaaacctggcggcagcgcaaaagatg

SEQ ID NO: 230790 - DNA, 103 bp, Artificial Sequence
  Synthetic Polynucleotide
taatacgactcactatagggttaagtacattctgaatatcacttaaattgaacagaggagacaatttatgtgatattcaaacctggcggcagcgcaaaagatg

SEQ ID NO: 230791 - DNA, 103 bp, Artificial Sequence
  Synthetic Polynucleotide
taatacgactcactatagggtaccgccactttaagtacattctgaatatcaacagaggagagatattatgaatgtacttaacctggcggcagcgcaaaagatg

SEQ ID NO: 230792 - DNA, 103 bp, Artificial Sequence
  Synthetic Polynucleotide
taatacgactcactatagggcattaccatctaccgccactttaagtacataacagaggagaatgtacatgaagtggcggaacctggcggcagcgcaaaagatg

SEQ ID NO: 230793 - DNA, 103 bp, Artificial Sequence
  Synthetic Polynucleotide
taatacgactcactatagggtgccttattacattaccatctaccgccactaacagaggagaagtggcatgagatggtaaaacctggcggcagcgcaaaagatg

SEQ ID NO: 230794 - DNA, 103 bp, Artificial Sequence
  Synthetic Polynucleotide
taatacgactcactatagggctccaacacttgccttattacattaccatcaacagaggagagatggtatggtaataaggaacctggcggcagcgcaaaagatg

SEQ ID NO: 230795 - DNA, 103 bp, Artificial Sequence
  Synthetic Polynucleotide
taatacgactcactatagggcttgattattctccaacacttgccttattaaacagaggagataataaatgaagtgttggaacctggcggcagcgcaaaagatg

SEQ ID NO: 230796 - DNA, 103 bp, Artificial Sequence
  Synthetic Polynucleotide
taatacgactcactataggggcaagattggcttgattattctccaacactaacagaggagaagtgttatggaataatcaaacctggcggcagcgcaaaagatg

SEQ ID NO: 230797 - DNA, 103 bp, Artificial Sequence
  Synthetic Polynucleotide
taatacgactcactatagggtgcatctgtaacactttcttcttccacaataacagaggagaattgtgatggaagaaagtaacctggcggcagcgcaaaagatg

SEQ ID NO: 230798 - DNA, 103 bp, Artificial Sequence
  Synthetic Polynucleotide
taatacgactcactatagggttctttggatgcaagattggcttgattattaacagaggagaaataatatggccaatcttaacctggcggcagcgcaaaagatg

SEQ ID NO: 230799 - DNA, 103 bp, Artificial Sequence
  Synthetic Polynucleotide
taatacgactcactatagggttgtttcttgttctttggatgcaagattggaacagaggagaccaatcatgcatccaaagaacctggcggcagcgcaaaagatg

SEQ ID NO: 230800 - DNA, 103 bp, Artificial Sequence
  Synthetic Polynucleotide
taatacgactcactataggggaagcattgattgtttcttgttctttggataacagaggagaatccaaatgacaagaaacaacctggcggcagcgcaaaagatg

SEQ ID NO: 230801 - DNA, 103 bp, Artificial Sequence
  Synthetic Polynucleotide
taatacgactcactatagggttgtatgggtgaagcattgattgtttcttgaacagaggagacaagaaatgatcaatgctaacctggcggcagcgcaaaagatg

SEQ ID NO: 230802 - DNA, 103 bp, Artificial Sequence
  Synthetic Polynucleotide
taatacgactcactatagggggccaccttgttgtatgggtgaagcattgaaacagaggagatcaatgatgcacccatacaacctggcggcagcgcaaaagatg

SEQ ID NO: 230803 - DNA, 103 bp, Artificial Sequence
  Synthetic Polynucleotide
taatacgactcactatagggataacagaatggccaccttgttgtatgggtaacagaggagaacccatatgacaaggtggaacctggcggcagcgcaaaagatg

SEQ ID NO: 230804 - DNA, 103 bp, Artificial Sequence
  Synthetic Polynucleotide
taatacgactcactataggggatggctgaaataacagaatggccaccttgaacagaggagacaaggtatgcattctgttaacctggcggcagcgcaaaagatg

SEQ ID NO: 230805 - DNA, 103 bp, Artificial Sequence
  Synthetic Polynucleotide
taatacgactcactatagggaaggaagactgatggctgaaataacagaataacagaggagaattctgatgtttcagccaaacctggcggcagcgcaaaagatg

SEQ ID NO: 230806 - DNA, 103 bp, Artificial Sequence
  Synthetic Polynucleotide
taatacgactcactatagggtgatcaaccaaaggaagactgatggctgaaaacagaggagattcagcatgcagtcttccaacctggcggcagcgcaaaagatg

SEQ ID NO: 230807 - DNA, 103 bp, Artificial Sequence
  Synthetic Polynucleotide
taatacgactcactatagggtgttccatcttgatcaaccaaaggaagactaacagaggagaagtcttatgttggttgataacctggcggcagcgcaaaagatg

SEQ ID NO: 230808 - DNA, 103 bp, Artificial Sequence
  Synthetic Polynucleotide
taatacgactcactatagggcacagtcagctgcatctgtaacactttcttaacagaggagaaagaaaatgttacagatgaacctggcggcagcgcaaaagatg

SEQ ID NO: 230809 - DNA, 103 bp, Artificial Sequence
  Synthetic Polynucleotide
taatacgactcactatagggtaattttggttgttccatcttgatcaaccaaacagaggagatggttgatgaagatggaaaacctggcggcagcgcaaaagatg

SEQ ID NO: 230810 - DNA, 103 bp, Artificial Sequence
  Synthetic Polynucleotide
taatacgactcactatagggtagttgatgataattttggttgttccatctaacagaggagaagatggatgaaccaaaataacctggcggcagcgcaaaagatg

SEQ ID NO: 230811 - DNA, 103 bp, Artificial Sequence
  Synthetic Polynucleotide
taatacgactcactatagggctcaagactgtagttgatgataattttggtaacagaggagaaccaaaatgatcatcaacaacctggcggcagcgcaaaagatg

SEQ ID NO: 230812 - DNA, 103 bp, Artificial Sequence
  Synthetic Polynucleotide
taatacgactcactatagggggctaggctgctcaagactgtagttgatgaaacagaggagatcatcaatgacagtcttgaacctggcggcagcgcaaaagatg

SEQ ID NO: 230813 - DNA, 103 bp, Artificial Sequence
  Synthetic Polynucleotide
taatacgactcactatagggacttgaagttggctaggctgctcaagactgaacagaggagacagtctatggcagcctagaacctggcggcagcgcaaaagatg

SEQ ID NO: 230814 - DNA, 103 bp, Artificial Sequence
  Synthetic Polynucleotide
taatacgactcactatagggttgaggaacaacttgaagttggctaggctgaacagaggagacagcctatgcaacttcaaaacctggcggcagcgcaaaagatg

SEQ ID NO: 230815 - DNA, 103 bp, Artificial Sequence
  Synthetic Polynucleotide
taatacgactcactatagggtttttaaattttgaggaacaacttgaagttaacagaggagaaacttcatgttgttcctcaacctggcggcagcgcaaaagatg

SEQ ID NO: 230816 - DNA, 103 bp, Artificial Sequence
  Synthetic Polynucleotide
taatacgactcactatagggggattttctttttttaaattttgaggaacaaacagaggagatgttccatgaaatttaaaaacctggcggcagcgcaaaagatg

SEQ ID NO: 230817 - DNA, 103 bp, Artificial Sequence
  Synthetic Polynucleotide
taatacgactcactatagggtgtagcgactggattttctttttttaaattaacagaggagaaatttaatgaaagaaaataacctggcggcagcgcaaaagatg

SEQ ID NO: 230818 - DNA, 103 bp, Artificial Sequence
  Synthetic Polynucleotide
taatacgactcactatagggtacaactgtttgtagcgactggattttcttaacagaggagaaagaaaatgcagtcgctaaacctggcggcagcgcaaaagatg

SEQ ID NO: 230819 - DNA, 103 bp, Artificial Sequence
  Synthetic Polynucleotide
taatacgactcactatagggggtacaccttcacagtcagctgcatctgtaaacagaggagatacagaatgagctgactgaacctggcggcagcgcaaaagatg

SEQ ID NO: 230820 - DNA, 103 bp, Artificial Sequence
  Synthetic Polynucleotide
taatacgactcactatagggttttcacttttacaactgtttgtagcgactaacagaggagaagtcgcatgaaacagttgaacctggcggcagcgcaaaagatg

SEQ ID NO: 230821 - DNA, 103 bp, Artificial Sequence
  Synthetic Polynucleotide
taatacgactcactatagggttctggtaacttttcacttttacaactgttaacagaggagaaacagtatgaaaagtgaaaacctggcggcagcgcaaaagatg

SEQ ID NO: 230822 - DNA, 103 bp, Artificial Sequence
  Synthetic Polynucleotide
taatacgactcactatagggcagtaagatcttctggtaacttttcactttaacagaggagaaaagtgatgagttaccagaacctggcggcagcgcaaaagatg

SEQ ID NO: 230823 - DNA, 103 bp, Artificial Sequence
  Synthetic Polynucleotide
taatacgactcactatagggtcagacttaacagtaagatcttctggtaacaacagaggagagttaccatgagatcttacaacctggcggcagcgcaaaagatg

SEQ ID NO: 230824 - DNA, 103 bp, Artificial Sequence
  Synthetic Polynucleotide
taatacgactcactatagggtttgtccttctcagacttaacagtaagatcaacagaggagagatcttatggttaagtctaacctggcggcagcgcaaaagatg

SEQ ID NO: 230825 - DNA, 103 bp, Artificial Sequence
  Synthetic Polynucleotide
taatacgactcactatagggcttcaaagcttttgtccttctcagacttaaaacagaggagattaagtatgagaaggacaaacctggcggcagcgcaaaagatg

SEQ ID NO: 230826 - DNA, 103 bp, Artificial Sequence
  Synthetic Polynucleotide
taatacgactcactatagggttcacccccccttcaaagcttttgtccttcaacagaggagagaaggaatgaagctttgaaacctggcggcagcgcaaaagatg

SEQ ID NO: 230827 - DNA, 103 bp, Artificial Sequence
  Synthetic Polynucleotide
taatacgactcactatagggagtgctatcattcacccccccttcaaagctaacagaggagaagctttatggggggggtgaacctggcggcagcgcaaaagatg

SEQ ID NO: 230828 - DNA, 103 bp, Artificial Sequence
  Synthetic Polynucleotide
taatacgactcactatagggacagaagacaagtgctatcattcaccccccaacagaggagaggggggatgatgatagcaaacctggcggcagcgcaaaagatg

SEQ ID NO: 230829 - DNA, 103 bp, Artificial Sequence
  Synthetic Polynucleotide
taatacgactcactatagggcaatcatcacacagaagacaagtgctatcaaacagaggagatgatagatgttgtcttctaacctggcggcagcgcaaaagatg

SEQ ID NO: 230830 - DNA, 103 bp, Artificial Sequence
  Synthetic Polynucleotide
taatacgactcactataggggtcatcctctggtacaccttcacagtcagcaacagaggagagctgacatggaaggtgtaaacctggcggcagcgcaaaagatg

SEQ ID NO: 230831 - DNA, 103 bp, Artificial Sequence
  Synthetic Polynucleotide
taatacgactcactatagggatctcctggacaatcatcacacagaagacaaacagaggagatgtcttatgtgtgatgataacctggcggcagcgcaaaagatg

SEQ ID NO: 230832 - DNA, 103 bp, Artificial Sequence
  Synthetic Polynucleotide
taatacgactcactataggggtgcattaatatctcctggacaatcatcacaacagaggagagtgatgatggtccaggagaacctggcggcagcgcaaaagatg

SEQ ID NO: 230833 - DNA, 103 bp, Artificial Sequence
  Synthetic Polynucleotide
taatacgactcactatagggaattctggaagtgcattaatatctcctggaaacagaggagatccaggatgtattaatgcaacctggcggcagcgcaaaagatg

SEQ ID NO: 230834 - DNA, 103 bp, Artificial Sequence
  Synthetic Polynucleotide
taatacgactcactatagggatagtgctttaattctggaagtgcattaataacagaggagaattaatatgcttccagaaaacctggcggcagcgcaaaagatg

SEQ ID NO: 230835 - DNA, 103 bp, Artificial Sequence
  Synthetic Polynucleotide
taatacgactcactataggggctttaggtcatagtgctttaattctggaaaacagaggagattccagatgtaaagcactaacctggcggcagcgcaaaagatg

SEQ ID NO: 230836 - DNA, 103 bp, Artificial Sequence
  Synthetic Polynucleotide
taatacgactcactatagggtgagtaggctgctttaggtcatagtgctttaacagaggagaaaagcaatgtgacctaaaaacctggcggcagcgcaaaagatg

SEQ ID NO: 230837 - DNA, 103 bp, Artificial Sequence
  Synthetic Polynucleotide
taatacgactcactatagggtggaggaggctgagtaggctgctttaggtcaacagaggagagacctaatgcagcctactaacctggcggcagcgcaaaagatg

SEQ ID NO: 230838 - DNA, 103 bp, Artificial Sequence
  Synthetic Polynucleotide
taatacgactcactatagggctgcagggagtggaggaggctgagtaggctaacagaggagaagcctaatgagcctcctcaacctggcggcagcgcaaaagatg

SEQ ID NO: 230839 - DNA, 103 bp, Artificial Sequence
  Synthetic Polynucleotide
taatacgactcactatagggtcagcttctgctgcagggagtggaggaggcaacagaggagagcctccatgactccctgcaacctggcggcagcgcaaaagatg

SEQ ID NO: 230840 - DNA, 103 bp, Artificial Sequence
  Synthetic Polynucleotide
taatacgactcactatagggctcaggcttctcagcttctgctgcagggagaacagaggagactccctatggcagaagctaacctggcggcagcgcaaaagatg

SEQ ID NO: 230841 - DNA, 103 bp, Artificial Sequence
  Synthetic Polynucleotide
taatacgactcactatagggctgttggcaggtcatcctctggtacaccttaacagaggagaaaggtgatgcagaggatgaacctggcggcagcgcaaaagatg

SEQ ID NO: 230842 - DNA, 103 bp, Artificial Sequence
  Synthetic Polynucleotide
taatacgactcactatagggaaacagaggactcaggcttctcagcttctgaacagaggagacagaagatgagaagcctgaacctggcggcagcgcaaaagatg

SEQ ID NO: 230843 - DNA, 103 bp, Artificial Sequence
  Synthetic Polynucleotide
taatacgactcactataggggtagctgatgaaacagaggactcaggcttcaacagaggagagaagccatggtcctctgtaacctggcggcagcgcaaaagatg

SEQ ID NO: 230844 - DNA, 103 bp, Artificial Sequence
  Synthetic Polynucleotide
taatacgactcactataggggccatctccagtagctgatgaaacagaggaaacagaggagatcctctatgtcatcagctaacctggcggcagcgcaaaagatg

SEQ ID NO: 230845 - DNA, 103 bp, Artificial Sequence
  Synthetic Polynucleotide
taatacgactcactataggggagacaaattgccatctccagtagctgatgaacagaggagacatcagatgctggagatgaacctggcggcagcgcaaaagatg

SEQ ID NO: 230846 - DNA, 103 bp, Artificial Sequence
  Synthetic Polynucleotide
taatacgactcactatagggggctgactaggagacaaattgccatctccaaacagaggagatggagaatgcaatttgtcaacctggcggcagcgcaaaagatg

SEQ ID NO: 230847 - DNA, 103 bp, Artificial Sequence
  Synthetic Polynucleotide
taatacgactcactatagggctttaaaggtggctgactaggagacaaattaacagaggagaaatttgatgcctagtcagaacctggcggcagcgcaaaagatg

SEQ ID NO: 230848 - DNA, 103 bp, Artificial Sequence
  Synthetic Polynucleotide
taatacgactcactatagggacaagaggttctttaaaggtggctgactagaacagaggagactagtcatgcacctttaaaacctggcggcagcgcaaaagatg

SEQ ID NO: 230849 - DNA, 103 bp, Artificial Sequence
  Synthetic Polynucleotide
taatacgactcactatagggtttaggagagacaagaggttctttaaaggtaacagaggagaacctttatggaacctcttaacctggcggcagcgcaaaagatg

SEQ ID NO: 230850 - DNA, 103 bp, Artificial Sequence
  Synthetic Polynucleotide
taatacgactcactatagggataatatgcttttaggagagacaagaggttaacagaggagaaacctcatgtctctcctaaacctggcggcagcgcaaaagatg

SEQ ID NO: 230851 - DNA, 103 bp, Artificial Sequence
  Synthetic Polynucleotide
taatacgactcactatagggcattcaaagcataatatgcttttaggagagaacagaggagactctccatgaagcatattaacctggcggcagcgcaaaagatg

SEQ ID NO: 230852 - DNA, 103 bp, Artificial Sequence
  Synthetic Polynucleotide
taatacgactcactatagggactgtctggtctgttggcaggtcatcctctaacagaggagaagaggaatgcctgccaacaacctggcggcagcgcaaaagatg

SEQ ID NO: 230853 - DNA, 103 bp, Artificial Sequence
  Synthetic Polynucleotide
taatacgactcactatagggcttggttgtgcattcaaagcataatatgctaacagaggagaagcataatgtgctttgaaaacctggcggcagcgcaaaagatg

SEQ ID NO: 230854 - DNA, 103 bp, Artificial Sequence
  Synthetic Polynucleotide
taatacgactcactatagggctcttctgcacttggttgtgcattcaaagcaacagaggagagctttgatggcacaaccaaacctggcggcagcgcaaaagatg

SEQ ID NO: 230855 - DNA, 103 bp, Artificial Sequence
  Synthetic Polynucleotide
taatacgactcactatagggtttttgagagctcttctgcacttggttgtgaacagaggagacacaacatggtgcagaagaacctggcggcagcgcaaaagatg

SEQ ID NO: 230856 - DNA, 103 bp, Artificial Sequence
  Synthetic Polynucleotide
taatacgactcactataggggaatcagcaatttttgagagctcttctgcaaacagaggagatgcagaatggctctcaaaaacctggcggcagcgcaaaagatg

SEQ ID NO: 230857 - DNA, 103 bp, Artificial Sequence
  Synthetic Polynucleotide
taatacgactcactatagggtaggtttactgaatcagcaatttttgagagaacagaggagactctcaatgattgctgataacctggcggcagcgcaaaagatg

SEQ ID NO: 230858 - DNA, 103 bp, Artificial Sequence
  Synthetic Polynucleotide
taatacgactcactatagggcatccagtggtaggtttactgaatcagcaaaacagaggagattgctgatgcagtaaaccaacctggcggcagcgcaaaagatg

SEQ ID NO: 230859 - DNA, 103 bp, Artificial Sequence
  Synthetic Polynucleotide
taatacgactcactatagggttttttactacatccagtggtaggtttactaacagaggagaagtaaaatgaccactggaaacctggcggcagcgcaaaagatg

SEQ ID NO: 230860 - DNA, 103 bp, Artificial Sequence
  Synthetic Polynucleotide
taatacgactcactatagggttcaaaccacttttttactacatccagtggaacagaggagaccactgatggtagtaaaaaacctggcggcagcgcaaaagatg

SEQ ID NO: 230861 - DNA, 103 bp, Artificial Sequence
  Synthetic Polynucleotide
taatacgactcactatagggcttgcatcttttcaaaccacttttttactaaacagaggagatagtaaatgagtggtttgaacctggcggcagcgcaaaagatg

SEQ ID NO: 230862 - DNA, 103 bp, Artificial Sequence
  Synthetic Polynucleotide
taatacgactcactatagggatctgtccagcttgcatcttttcaaaccacaacagaggagagtggttatgaaagatgcaaacctggcggcagcgcaaaagatg

SEQ ID NO: 230863 - DNA, 103 bp, Artificial Sequence
  Synthetic Polynucleotide
taatacgactcactatagggccctggtaacactgtctggtctgttggcagaacagaggagactgccaatggaccagacaaacctggcggcagcgcaaaagatg

SEQ ID NO: 230864 - DNA, 103 bp, Artificial Sequence
  Synthetic Polynucleotide
taatacgactcactatagggctgcactgaaatctgtccagcttgcatcttaacagaggagaaagatgatggctggacagaacctggcggcagcgcaaaagatg

SEQ ID NO: 230865 - DNA, 103 bp, Artificial Sequence
  Synthetic Polynucleotide
taatacgactcactataggggttcagaagactgcactgaaatctgtccagaacagaggagactggacatgtttcagtgcaacctggcggcagcgcaaaagatg

SEQ ID NO: 230866 - DNA, 103 bp, Artificial Sequence
  Synthetic Polynucleotide
taatacgactcactatagggggagaagatggttcagaagactgcactgaaaacagaggagattcagtatggtcttctgaaacctggcggcagcgcaaaagatg

SEQ ID NO: 230867 - DNA, 103 bp, Artificial Sequence
  Synthetic Polynucleotide
taatacgactcactataggggcctggttcaggagaagatggttcagaagaaacagaggagatcttctatgccatcttctaacctggcggcagcgcaaaagatg

SEQ ID NO: 230868 - DNA, 103 bp, Artificial Sequence
  Synthetic Polynucleotide
taatacgactcactatagggtatttactttgcctggttcaggagaagatgaacagaggagacatcttatgctgaaccagaacctggcggcagcgcaaaagatg

SEQ ID NO: 230869 - DNA, 103 bp, Artificial Sequence
  Synthetic Polynucleotide
taatacgactcactatagggttggcagggatatttactttgcctggttcaaacagaggagatgaaccatgcaaagtaaaaacctggcggcagcgcaaaagatg

SEQ ID NO: 230870 - DNA, 103 bp, Artificial Sequence
  Synthetic Polynucleotide
taatacgactcactatagggatcattgttcttggcagggatatttactttaacagaggagaaaagtaatgatccctgccaacctggcggcagcgcaaaagatg

SEQ ID NO: 230871 - DNA, 103 bp, Artificial Sequence
  Synthetic Polynucleotide
taatacgactcactatagggattgaggctgatcattgttcttggcagggaaacagaggagatccctgatgagaacaatgaacctggcggcagcgcaaaagatg

SEQ ID NO: 230872 - DNA, 103 bp, Artificial Sequence
  Synthetic Polynucleotide
taatacgactcactataggggcatttgcagattgaggctgatcattgttcaacagaggagagaacaaatgtcagcctcaaacctggcggcagcgcaaaagatg

SEQ ID NO: 230873 - DNA, 103 bp, Artificial Sequence
  Synthetic Polynucleotide
taatacgactcactataggggggttcatttgcatttgcagattgaggctgaacagaggagacagcctatgtctgcaaataacctggcggcagcgcaaaagatg

SEQ ID NO: 230874 - DNA, 103 bp, Artificial Sequence
  Synthetic Polynucleotide
taatacgactcactatagggtcgcctgctttctgcgcttacacctggggcaacagaggagagccccaatggtaagcgcaaacctggcggcagcgcaaaagatg

SEQ ID NO: 230875 - DNA, 103 bp, Artificial Sequence
  Synthetic Polynucleotide
taatacgactcactatagggcactgctcctccctggtaacactgtctggtaacagaggagaaccagaatgtgttaccagaacctggcggcagcgcaaaagatg

SEQ ID NO: 230876 - DNA, 103 bp, Artificial Sequence
  Synthetic Polynucleotide
taatacgactcactatagggtgctgtcctggggttcatttgcatttgcagaacagaggagactgcaaatgcaaatgaacaacctggcggcagcgcaaaagatg

SEQ ID NO: 230877 - DNA, 103 bp, Artificial Sequence
  Synthetic Polynucleotide
taatacgactcactatagggagatttactgtgctgtcctggggttcatttaacagaggagaaaatgaatgccaggacagaacctggcggcagcgcaaaagatg

SEQ ID NO: 230878 - DNA, 103 bp, Artificial Sequence
  Synthetic Polynucleotide
taatacgactcactatagggaggactttgtagatttactgtgctgtcctgaacagaggagacaggacatgacagtaaataacctggcggcagcgcaaaagatg

SEQ ID NO: 230879 - DNA, 103 bp, Artificial Sequence
  Synthetic Polynucleotide
taatacgactcactatagggtcatcttcaaaggactttgtagatttactgaacagaggagacagtaaatgtacaaagtcaacctggcggcagcgcaaaagatg

SEQ ID NO: 230880 - DNA, 103 bp, Artificial Sequence
  Synthetic Polynucleotide
taatacgactcactatagggggggagttagtcatcttcaaaggactttgtaacagaggagaacaaagatgtttgaagataacctggcggcagcgcaaaagatg

SEQ ID NO: 230881 - DNA, 103 bp, Artificial Sequence
  Synthetic Polynucleotide
taatacgactcactatagggtggtaaaactggggagttagtcatcttcaaaacagaggagattgaagatgactaactccaacctggcggcagcgcaaaagatg

SEQ ID NO: 230882 - DNA, 103 bp, Artificial Sequence
  Synthetic Polynucleotide
taatacgactcactatagggttgatcccactggtaaaactggggagttagaacagaggagactaactatgcagttttacaacctggcggcagcgcaaaagatg

SEQ ID NO: 230883 - DNA, 103 bp, Artificial Sequence
  Synthetic Polynucleotide
taatacgactcactatagggccattggtggttgatcccactggtaaaactaacagaggagaagttttatgagtgggatcaacctggcggcagcgcaaaagatg

SEQ ID NO: 230884 - DNA, 103 bp, Artificial Sequence
  Synthetic Polynucleotide
taatacgactcactatagggacttctggaaccattggtggttgatcccacaacagaggagagtgggaatgaccaccaataacctggcggcagcgcaaaagatg

SEQ ID NO: 230885 - DNA, 103 bp, Artificial Sequence
  Synthetic Polynucleotide
taatacgactcactatagggatggtgtactacttctggaaccattggtggaacagaggagaccaccaatggttccagaaaacctggcggcagcgcaaaagatg

SEQ ID NO: 230886 - DNA, 103 bp, Artificial Sequence
  Synthetic Polynucleotide
taatacgactcactatagggccttctctttcactgctcctccctggtaacaacagaggagagttaccatggaggagcagaacctggcggcagcgcaaaagatg

SEQ ID NO: 230887 - DNA, 103 bp, Artificial Sequence
  Synthetic Polynucleotide
taatacgactcactatagggggtgatggggatggtgtactacttctggaaaacagaggagattccagatgtagtacaccaacctggcggcagcgcaaaagatg

SEQ ID NO: 230888 - DNA, 103 bp, Artificial Sequence
  Synthetic Polynucleotide
taatacgactcactatagggaaggtttagaggtgatggggatggtgtactaacagaggagaagtacaatgtccccatcaaacctggcggcagcgcaaaagatg

SEQ ID NO: 230889 - DNA, 103 bp, Artificial Sequence
  Synthetic Polynucleotide
taatacgactcactatagggtggatgaggaaaggtttagaggtgatggggaacagaggagaccccatatgctctaaaccaacctggcggcagcgcaaaagatg

SEQ ID NO: 230890 - DNA, 103 bp, Artificial Sequence
  Synthetic Polynucleotide
taatacgactcactatagggtgtgtatttctggatgaggaaaggtttagaaacagaggagatctaaaatgttcctcatcaacctggcggcagcgcaaaagatg

SEQ ID NO: 230891 - DNA, 103 bp, Artificial Sequence
  Synthetic Polynucleotide
taatacgactcactatagggcaagtaaccctgtgtatttctggatgaggaaacagaggagatcctcaatgagaaatacaaacctggcggcagcgcaaaagatg

SEQ ID NO: 230892 - DNA, 103 bp, Artificial Sequence
  Synthetic Polynucleotide
taatacgactcactatagggcagctgtgtacaagtaaccctgtgtatttcaacagaggagagaaataatgagggttactaacctggcggcagcgcaaaagatg

SEQ ID NO: 230893 - DNA, 103 bp, Artificial Sequence
  Synthetic Polynucleotide
taatacgactcactatagggtgtgcaccctcagctgtgtacaagtaacccaacagaggagagggttaatggtacacagcaacctggcggcagcgcaaaagatg

SEQ ID NO: 230894 - DNA, 103 bp, Artificial Sequence
  Synthetic Polynucleotide
taatacgactcactatagggtggctcttcttgtgcaccctcagctgtgtaaacagaggagatacacaatggagggtgcaaacctggcggcagcgcaaaagatg

SEQ ID NO: 230895 - DNA, 103 bp, Artificial Sequence
  Synthetic Polynucleotide
taatacgactcactataggggttctacttgtggctcttcttgtgcaccctaacagaggagaagggtgatgaagaagagcaacctggcggcagcgcaaaagatg

SEQ ID NO: 230896 - DNA, 103 bp, Artificial Sequence
  Synthetic Polynucleotide
taatacgactcactatagggagatcaagaggttctacttgtggctcttctaacagaggagaagaagaatgacaagtagaaacctggcggcagcgcaaaagatg

SEQ ID NO: 230897 - DNA, 103 bp, Artificial Sequence
  Synthetic Polynucleotide
taatacgactcactatagggcttagcattcccttctctttcactgctcctaacagaggagaaggagcatggaaagagaaaacctggcggcagcgcaaaagatg

SEQ ID NO: 230898 - DNA, 103 bp, Artificial Sequence
  Synthetic Polynucleotide
taatacgactcactatagggtggtagtgaaagatcaagaggttctacttgaacagaggagacaagtaatgcctcttgataacctggcggcagcgcaaaagatg

SEQ ID NO: 230899 - DNA, 103 bp, Artificial Sequence
  Synthetic Polynucleotide
taatacgactcactatagggcctgttgctttggtagtgaaagatcaagagaacagaggagactcttgatgtttcactacaacctggcggcagcgcaaaagatg

SEQ ID NO: 230900 - DNA, 103 bp, Artificial Sequence
  Synthetic Polynucleotide
taatacgactcactatagggaataattctccctgttgctttggtagtgaaaacagaggagattcactatgaaagcaacaaacctggcggcagcgcaaaagatg

SEQ ID NO: 230901 - DNA, 103 bp, Artificial Sequence
  Synthetic Polynucleotide
taatacgactcactatagggtgacctttctaataattctccctgttgcttaacagaggagaaagcaaatgggagaattaaacctggcggcagcgcaaaagatg

SEQ ID NO: 230902 - DNA, 103 bp, Artificial Sequence
  Synthetic Polynucleotide
taatacgactcactatagggtagtgatagttgacctttctaataattctcaacagaggagagagaatatgtagaaaggtaacctggcggcagcgcaaaagatg

SEQ ID NO: 230903 - DNA, 103 bp, Artificial Sequence
  Synthetic Polynucleotide
taatacgactcactatagggtggtaaacactagtgatagttgacctttctaacagaggagaagaaagatgaactatcacaacctggcggcagcgcaaaagatg

SEQ ID NO: 230904 - DNA, 103 bp, Artificial Sequence
  Synthetic Polynucleotide
taatacgactcactatagggaacactgttctggtaaacactagtgatagtaacagaggagaactatcatgagtgtttacaacctggcggcagcgcaaaagatg

SEQ ID NO: 230905 - DNA, 103 bp, Artificial Sequence
  Synthetic Polynucleotide
taatacgactcactatagggggacagaataaacactgttctggtaaacacaacagaggagagtgtttatgagaacagtgaacctggcggcagcgcaaaagatg

SEQ ID NO: 230906 - DNA, 103 bp, Artificial Sequence
  Synthetic Polynucleotide
taatacgactcactatagggggttcttcctggacagaataaacactgttcaacagaggagagaacagatgttattctgtaacctggcggcagcgcaaaagatg

SEQ ID NO: 230907 - DNA, 103 bp, Artificial Sequence
  Synthetic Polynucleotide
taatacgactcactatagggcaagttcaagggttcttcctggacagaataaacagaggagatattctatgcaggaagaaaacctggcggcagcgcaaaagatg

SEQ ID NO: 230908 - DNA, 103 bp, Artificial Sequence
  Synthetic Polynucleotide
taatacgactcactatagggcccagcagttcttagcattcccttctctttaacagaggagaaaagagatgggaatgctaaacctggcggcagcgcaaaagatg

SEQ ID NO: 230909 - DNA, 103 bp, Artificial Sequence
  Synthetic Polynucleotide
taatacgactcactatagggttgcgcaagacaagttcaagggttcttcctaacagaggagaaggaagatgccttgaactaacctggcggcagcgcaaaagatg

SEQ ID NO: 230910 - DNA, 103 bp, Artificial Sequence
  Synthetic Polynucleotide
taatacgactcactatagggggctccttttttgcgcaagacaagttcaagaacagaggagacttgaaatggtcttgcgcaacctggcggcagcgcaaaagatg

SEQ ID NO: 230911 - DNA, 103 bp, Artificial Sequence
  Synthetic Polynucleotide
taatacgactcactataggggtccttttgtggctccttttttgcgcaagaaacagaggagatcttgcatgaaaaaggagaacctggcggcagcgcaaaagatg

SEQ ID NO: 230912 - DNA, 103 bp, Artificial Sequence
  Synthetic Polynucleotide
taatacgactcactatagggtaacacaactgtccttttgtggctccttttaacagaggagaaaaaggatgcacaaaaggaacctggcggcagcgcaaaagatg

SEQ ID NO: 230913 - DNA, 103 bp, Artificial Sequence
  Synthetic Polynucleotide
taatacgactcactatagggtctgagtctgtaacacaactgtccttttgtaacagaggagaacaaaaatgcagttgtgtaacctggcggcagcgcaaaagatg

SEQ ID NO: 230914 - DNA, 103 bp, Artificial Sequence
  Synthetic Polynucleotide
taatacgactcactatagggtacaactggttctgagtctgtaacacaactaacagaggagaagttgtatgacagactcaaacctggcggcagcgcaaaagatg

SEQ ID NO: 230915 - DNA, 103 bp, Artificial Sequence
  Synthetic Polynucleotide
taatacgactcactatagggggattacatttacaactggttctgagtctgaacagaggagacagactatgaaccagttgaacctggcggcagcgcaaaagatg

SEQ ID NO: 230916 - DNA, 103 bp, Artificial Sequence
  Synthetic Polynucleotide
taatacgactcactataggggcacttggtgggattacatttacaactggtaacagaggagaaccagtatgaaatgtaataacctggcggcagcgcaaaagatg

SEQ ID NO: 230917 - DNA, 103 bp, Artificial Sequence
  Synthetic Polynucleotide
taatacgactcactatagggtatggggttggcacttggtgggattacattaacagaggagaaatgtaatgccaccaagtaacctggcggcagcgcaaaagatg

SEQ ID NO: 230918 - DNA, 103 bp, Artificial Sequence
  Synthetic Polynucleotide
taatacgactcactatagggtagcgatatttatggggttggcacttggtgaacagaggagacaccaaatgccaaccccaaacctggcggcagcgcaaaagatg

SEQ ID NO: 230919 - DNA, 103 bp, Artificial Sequence
  Synthetic Polynucleotide
taatacgactcactatagggctgtcatcctcccagcagttcttagcattcaacagaggagagaatgcatggaactgctgaacctggcggcagcgcaaaagatg

SEQ ID NO: 230920 - DNA, 103 bp, Artificial Sequence
  Synthetic Polynucleotide
taatacgactcactatagggactgtaggtatagcgatatttatggggttgaacagaggagacaacccatgaaatatcgcaacctggcggcagcgcaaaagatg

SEQ ID NO: 230921 - DNA, 103 bp, Artificial Sequence
  Synthetic Polynucleotide
taatacgactcactatagggctgggcagtgactgtaggtatagcgatattaacagaggagaaatatcatgatacctacaaacctggcggcagcgcaaaagatg

SEQ ID NO: 230922 - DNA, 103 bp, Artificial Sequence
  Synthetic Polynucleotide
taatacgactcactatagggttgtgggtaactgggcagtgactgtaggtaaacagaggagatacctaatgtcactgcccaacctggcggcagcgcaaaagatg

SEQ ID NO: 230923 - DNA, 103 bp, Artificial Sequence
  Synthetic Polynucleotide
taatacgactcactatagggatggccacgattgtgggtaactgggcagtgaacagaggagacactgcatggttacccacaacctggcggcagcgcaaaagatg

SEQ ID NO: 230924 - DNA, 103 bp, Artificial Sequence
  Synthetic Polynucleotide
taatacgactcactatagggctggtcagcaatggccacgattgtgggtaaaacagaggagattacccatgatcgtggccaacctggcggcagcgcaaaagatg

SEQ ID NO: 230925 - DNA, 103 bp, Artificial Sequence
  Synthetic Polynucleotide
taatacgactcactataggggaacactgttctggtcagcaatggccacgaaacagaggagatcgtggatgttgctgaccaacctggcggcagcgcaaaagatg

SEQ ID NO: 230926 - DNA, 103 bp, Artificial Sequence
  Synthetic Polynucleotide
taatacgactcactatagggcttaagcatggaacactgttctggtcagcaaacagaggagatgctgaatggaacagtgtaacctggcggcagcgcaaaagatg

SEQ ID NO: 230927 - DNA, 103 bp, Artificial Sequence
  Synthetic Polynucleotide
taatacgactcactatagggagctagcgctcttaagcatggaacactgttaacagaggagaaacagtatgccatgcttaaacctggcggcagcgcaaaagatg

SEQ ID NO: 230928 - DNA, 103 bp, Artificial Sequence
  Synthetic Polynucleotide
taatacgactcactataggggcttattggcagctagcgctcttaagcatgaacagaggagacatgctatggagcgctagaacctggcggcagcgcaaaagatg

SEQ ID NO: 230929 - DNA, 103 bp, Artificial Sequence
  Synthetic Polynucleotide
taatacgactcactatagggagaatcgtttgcttattggcagctagcgctaacagaggagaagcgctatgtgccaataaaacctggcggcagcgcaaaagatg

SEQ ID NO: 230930 - DNA, 103 bp, Artificial Sequence
  Synthetic Polynucleotide
taatacgactcactatagggcccttcctttctgtcatcctcccagcagttaacagaggagaaactgcatggaggatgacaacctggcggcagcgcaaaagatg

SEQ ID NO: 230931 - DNA, 103 bp, Artificial Sequence
  Synthetic Polynucleotide
taatacgactcactatagggctggggaatcagaatcgtttgcttattggcaacagaggagagccaatatgcaaacgattaacctggcggcagcgcaaaagatg

SEQ ID NO: 230932 - DNA, 103 bp, Artificial Sequence
  Synthetic Polynucleotide
taatacgactcactatagggtgtatgccacctggggaatcagaatcgtttaacagaggagaaaacgaatgtgattccccaacctggcggcagcgcaaaagatg

SEQ ID NO: 230933 - DNA, 103 bp, Artificial Sequence
  Synthetic Polynucleotide
taatacgactcactataggggttgagtaggtgtatgccacctggggaatcaacagaggagagattccatgggtggcataaacctggcggcagcgcaaaagatg

SEQ ID NO: 230934 - DNA, 103 bp, Artificial Sequence
  Synthetic Polynucleotide
taatacgactcactataggggctgaccgtagttgagtaggtgtatgccacaacagaggagagtggcaatgacctactcaaacctggcggcagcgcaaaagatg

SEQ ID NO: 230935 - DNA, 103 bp, Artificial Sequence
  Synthetic Polynucleotide
taatacgactcactatagggggactgcagggctgaccgtagttgagtaggaacagaggagacctactatgctacggtcaaacctggcggcagcgcaaaagatg

SEQ ID NO: 230936 - DNA, 103 bp, Artificial Sequence
  Synthetic Polynucleotide
taatacgactcactatagggggtggttcttggactgcagggctgaccgtaaacagaggagatacggtatgccctgcagtaacctggcggcagcgcaaaagatg

SEQ ID NO: 230937 - DNA, 103 bp, Artificial Sequence
  Synthetic Polynucleotide
taatacgactcactatagggcactttcaagggtggttcttggactgcaggaacagaggagacctgcaatgcaagaaccaaacctggcggcagcgcaaaagatg

SEQ ID NO: 230938 - DNA, 103 bp, Artificial Sequence
  Synthetic Polynucleotide
taatacgactcactatagggttggctggatcactttcaagggtggttcttaacagaggagaaagaacatgccttgaaagaacctggcggcagcgcaaaagatg

SEQ ID NO: 230939 - DNA, 103 bp, Artificial Sequence
  Synthetic Polynucleotide
taatacgactcactatagggtgatttccatttggctggatcactttcaagaacagaggagacttgaaatggatccagccaacctggcggcagcgcaaaagatg

SEQ ID NO: 230940 - DNA, 103 bp, Artificial Sequence
  Synthetic Polynucleotide
taatacgactcactatagggtctttcatcctgatttccatttggctggataacagaggagaatccagatgaatggaaataacctggcggcagcgcaaaagatg

SEQ ID NO: 230941 - DNA, 103 bp, Artificial Sequence
  Synthetic Polynucleotide
taatacgactcactatagggggatttcttgcccttcctttctgtcatcctaacagaggagaaggatgatggaaaggaagaacctggcggcagcgcaaaagatg

SEQ ID NO: 230942 - DNA, 103 bp, Artificial Sequence
  Synthetic Polynucleotide
taatacgactcactatagggtagtatcttgtctttcatcctgatttccataacagaggagaatggaaatgaggatgaaaaacctggcggcagcgcaaaagatg

SEQ ID NO: 230943 - DNA, 103 bp, Artificial Sequence
  Synthetic Polynucleotide
taatacgactcactatagggccttctgagctagtatcttgtctttcatccaacagaggagaggatgaatgacaagatacaacctggcggcagcgcaaaagatg

SEQ ID NO: 230944 - DNA, 103 bp, Artificial Sequence
  Synthetic Polynucleotide
taatacgactcactatagggatttgatactccttctgagctagtatcttgaacagaggagacaagatatgagctcagaaaacctggcggcagcgcaaaagatg

SEQ ID NO: 230945 - DNA, 103 bp, Artificial Sequence
  Synthetic Polynucleotide
taatacgactcactataggggatcctctacatttgatactccttctgagcaacagaggagagctcagatggagtatcaaaacctggcggcagcgcaaaagatg

SEQ ID NO: 230946 - DNA, 103 bp, Artificial Sequence
  Synthetic Polynucleotide
taatacgactcactataggggagtcattctgatcctctacatttgatactaacagaggagaagtatcatgtgtagaggaaacctggcggcagcgcaaaagatg

SEQ ID NO: 230947 - DNA, 103 bp, Artificial Sequence
  Synthetic Polynucleotide
taatacgactcactatagggtgtagaatcagagtcattctgatcctctacaacagaggagagtagagatgcagaatgacaacctggcggcagcgcaaaagatg

SEQ ID NO: 230948 - DNA, 103 bp, Artificial Sequence
  Synthetic Polynucleotide
taatacgactcactatagggttttgggcggtgtagaatcagagtcattctaacagaggagaagaatgatgctgattctaaacctggcggcagcgcaaaagatg

SEQ ID NO: 230949 - DNA, 103 bp, Artificial Sequence
  Synthetic Polynucleotide
taatacgactcactatagggcgcattttctttttgggcggtgtagaatcaaacagaggagatgattcatgaccgcccaaaacctggcggcagcgcaaaagatg

SEQ ID NO: 230950 - DNA, 103 bp, Artificial Sequence
  Synthetic Polynucleotide
taatacgactcactatagggttctgtcttccgcattttctttttgggcggaacagaggagaccgcccatgaagaaaatgaacctggcggcagcgcaaaagatg

SEQ ID NO: 230951 - DNA, 103 bp, Artificial Sequence
  Synthetic Polynucleotide
taatacgactcactatagggacattccattttctgtcttccgcattttctaacagaggagaagaaaaatgggaagacagaacctggcggcagcgcaaaagatg

SEQ ID NO: 230952 - DNA, 103 bp, Artificial Sequence
  Synthetic Polynucleotide
taatacgactcactatagggtcaggccccaggatttcttgcccttcctttaacagaggagaaaaggaatggcaagaaataacctggcggcagcgcaaaagatg

SEQ ID NO: 230953 - DNA, 103 bp, Artificial Sequence
  Synthetic Polynucleotide
taatacgactcactatagggtcacaagcatacattccattttctgtcttcaacagaggagagaagacatgaaatggaataacctggcggcagcgcaaaagatg

SEQ ID NO: 230954 - DNA, 103 bp, Artificial Sequence
  Synthetic Polynucleotide
taatacgactcactataggggtcacacaaatcacaagcatacattccattaacagaggagaaatggaatgtatgcttgtaacctggcggcagcgcaaaagatg

SEQ ID NO: 230955 - DNA, 103 bp, Artificial Sequence
  Synthetic Polynucleotide
taatacgactcactatagggggaatatcttgtcacacaaatcacaagcataacagaggagaatgcttatgatttgtgtgaacctggcggcagcgcaaaagatg

SEQ ID NO: 230956 - DNA, 103 bp, Artificial Sequence
  Synthetic Polynucleotide
taatacgactcactatagggctactcttttggaatatcttgtcacacaaaaacagaggagatttgtgatgcaagatattaacctggcggcagcgcaaaagatg

SEQ ID NO: 230957 - DNA, 103 bp, Artificial Sequence
  Synthetic Polynucleotide
taatacgactcactatagggcaataatgaactactcttttggaatatcttaacagaggagaaagataatgcaaaagagtaacctggcggcagcgcaaaagatg

SEQ ID NO: 230958 - DNA, 103 bp, Artificial Sequence
  Synthetic Polynucleotide
taatacgactcactatagggatttatgtctcaataatgaactactcttttaacagaggagaaaaagaatggttcattataacctggcggcagcgcaaaagatg

SEQ ID NO: 230959 - DNA, 103 bp, Artificial Sequence
  Synthetic Polynucleotide
taatacgactcactataggggtgtgttcatatttatgtctcaataatgaaaacagaggagattcattatggagacataaaacctggcggcagcgcaaaagatg

SEQ ID NO: 230960 - DNA, 103 bp, Artificial Sequence
  Synthetic Polynucleotide
taatacgactcactatagggtcttttacctgtgtgttcatatttatgtctaacagaggagaagacatatgtatgaacacaacctggcggcagcgcaaaagatg

SEQ ID NO: 230961 - DNA, 103 bp, Artificial Sequence
  Synthetic Polynucleotide
taatacgactcactatagggactcatgaggtcttttacctgtgtgttcataacagaggagaatgaacatgcaggtaaaaaacctggcggcagcgcaaaagatg

SEQ ID NO: 230962 - DNA, 103 bp, Artificial Sequence
  Synthetic Polynucleotide
taatacgactcactatagggcagattccacactcatgaggtcttttacctaacagaggagaaggtaaatgacctcatgaaacctggcggcagcgcaaaagatg

SEQ ID NO: 230963 - DNA, 103 bp, Artificial Sequence
  Synthetic Polynucleotide
taatacgactcactatagggtgcctgagcttcaggccccaggatttcttgaacagaggagacaagaaatgctggggcctaacctggcggcagcgcaaaagatg

SEQ ID NO: 230964 - DNA, 103 bp, Artificial Sequence
  Synthetic Polynucleotide
taatacgactcactatagggtgcctttttacagattccacactcatgaggaacagaggagacctcatatgtgtggaatcaacctggcggcagcgcaaaagatg

SEQ ID NO: 230965 - DNA, 103 bp, Artificial Sequence
  Synthetic Polynucleotide
taatacgactcactatagggtgtgtttaaatgcctttttacagattccacaacagaggagagtggaaatggtaaaaaggaacctggcggcagcgcaaaagatg

SEQ ID NO: 230966 - DNA, 103 bp, Artificial Sequence
  Synthetic Polynucleotide
taatacgactcactatagggaaatgatgtttgtgtttaaatgcctttttaaacagaggagataaaaaatgatttaaacaaacctggcggcagcgcaaaagatg

SEQ ID NO: 230967 - DNA, 103 bp, Artificial Sequence
  Synthetic Polynucleotide
taatacgactcactataggggtgttcaatcaaatgatgtttgtgtttaaaaacagaggagatttaaaatgaaacatcataacctggcggcagcgcaaaagatg

SEQ ID NO: 230968 - DNA, 103 bp, Artificial Sequence
  Synthetic Polynucleotide
taatacgactcactataggggtaatcgcatgtgttcaatcaaatgatgttaacagaggagaaacatcatgtgattgaacaacctggcggcagcgcaaaagatg

SEQ ID NO: 230969 - DNA, 103 bp, Artificial Sequence
  Synthetic Polynucleotide
taatacgactcactatagggtctccagaatgtaatcgcatgtgttcaatcaacagaggagagattgaatgcatgcgattaacctggcggcagcgcaaaagatg

SEQ ID NO: 230970 - DNA, 103 bp, Artificial Sequence
  Synthetic Polynucleotide
taatacgactcactatagggatagggcttttctccagaatgtaatcgcataacagaggagaatgcgaatgcattctggaaacctggcggcagcgcaaaagatg

SEQ ID NO: 230971 - DNA, 103 bp, Artificial Sequence
  Synthetic Polynucleotide
taatacgactcactatagggtgtcacattgatagggcttttctccagaataacagaggagaattctgatgaaaagccctaacctggcggcagcgcaaaagatg

SEQ ID NO: 230972 - DNA, 103 bp, Artificial Sequence
  Synthetic Polynucleotide
taatacgactcactatagggtttccacatttgtcacattgatagggctttaacagaggagaaaagccatgtcaatgtgaaacctggcggcagcgcaaaagatg

SEQ ID NO: 230973 - DNA, 103 bp, Artificial Sequence
  Synthetic Polynucleotide
taatacgactcactatagggtgagaagcgctttccacatttgtcacattgaacagaggagacaatgtatgaaatgtggaaacctggcggcagcgcaaaagatg

SEQ ID NO: 230974 - DNA, 103 bp, Artificial Sequence
  Synthetic Polynucleotide
taatacgactcactatagggctgcttcatctgcctgagcttcaggccccaaacagaggagatggggcatgaagctcaggaacctggcggcagcgcaaaagatg

SEQ ID NO: 230975 - DNA, 103 bp, Artificial Sequence
  Synthetic Polynucleotide
taatacgactcactatagggacccagagtgtgagaagcgctttccacattaacagaggagaaatgtgatgagcgcttctaacctggcggcagcgcaaaagatg

SEQ ID NO: 230976 - DNA, 103 bp, Artificial Sequence
  Synthetic Polynucleotide
taatacgactcactatagggtgagaataagacccagagtgtgagaagcgcaacagaggagagcgcttatgacactctggaacctggcggcagcgcaaaagatg

SEQ ID NO: 230977 - DNA, 103 bp, Artificial Sequence
  Synthetic Polynucleotide
taatacgactcactatagggattcatgtgttgagaataagacccagagtgaacagaggagacactctatgtcttattctaacctggcggcagcgcaaaagatg

SEQ ID NO: 230978 - DNA, 103 bp, Artificial Sequence
  Synthetic Polynucleotide
taatacgactcactatagggagtagcgatgattcatgtgttgagaataagaacagaggagacttattatgaacacatgaaacctggcggcagcgcaaaagatg

SEQ ID NO: 230979 - DNA, 103 bp, Artificial Sequence
  Synthetic Polynucleotide
taatacgactcactatagggttacagtaggagtagcgatgattcatgtgtaacagaggagaacacatatgtcatcgctaaacctggcggcagcgcaaaagatg

SEQ ID NO: 230980 - DNA, 103 bp, Artificial Sequence
  Synthetic Polynucleotide
taatacgactcactatagggcgcttctctcttacagtaggagtagcgatgaacagaggagacatcgcatgtcctactgtaacctggcggcagcgcaaaagatg

SEQ ID NO: 230981 - DNA, 103 bp, Artificial Sequence
  Synthetic Polynucleotide
taatacgactcactatagggcacgttcttccgcttctctcttacagtaggaacagaggagacctactatgagagagaagaacctggcggcagcgcaaaagatg

SEQ ID NO: 230982 - DNA, 103 bp, Artificial Sequence
  Synthetic Polynucleotide
taatacgactcactatagggtctgtgctgtcacgttcttccgcttctctcaacagaggagagagagaatgggaagaacgaacctggcggcagcgcaaaagatg

SEQ ID NO: 230983 - DNA, 103 bp, Artificial Sequence
  Synthetic Polynucleotide
taatacgactcactatagggctcttcctgctctgtgctgtcacgttcttcaacagaggagagaagaaatggacagcacaaacctggcggcagcgcaaaagatg

SEQ ID NO: 230984 - DNA, 103 bp, Artificial Sequence
  Synthetic Polynucleotide
taatacgactcactatagggcaggccctgcctcttcctgctctgtgctgtaacagaggagaacagcaatgagcaggaagaacctggcggcagcgcaaaagatg

SEQ ID NO: 230985 - DNA, 103 bp, Artificial Sequence
  Synthetic Polynucleotide
taatacgactcactatagggcgccgcgggttcgcctgctttctgcgcttaaacagaggagataagcgatgaaagcaggcaacctggcggcagcgcaaaagatg

SEQ ID NO: 230986 - DNA, 103 bp, Artificial Sequence
  Synthetic Polynucleotide
taatacgactcactatagggactgtacatcctgcttcatctgcctgagctaacagaggagaagctcaatgagatgaagcaacctggcggcagcgcaaaagatg

SEQ ID NO: 230987 - DNA, 103 bp, Artificial Sequence
  Synthetic Polynucleotide
taatacgactcactataggggagaggatttcaggccctgcctcttcctgcaacagaggagagcaggaatgggcagggccaacctggcggcagcgcaaaagatg

SEQ ID NO: 230988 - DNA, 103 bp, Artificial Sequence
  Synthetic Polynucleotide
taatacgactcactataggggtgctcattcgagaggatttcaggccctgcaacagaggagagcagggatggaaatcctcaacctggcggcagcgcaaaagatg

SEQ ID NO: 230989 - DNA, 103 bp, Artificial Sequence
  Synthetic Polynucleotide
taatacgactcactatagggtggcacccacgtgctcattcgagaggatttaacagaggagaaaatccatgcgaatgagcaacctggcggcagcgcaaaagatg

SEQ ID NO: 230990 - DNA, 103 bp, Artificial Sequence
  Synthetic Polynucleotide
taatacgactcactatagggggagacgccctggcacccacgtgctcattcaacagaggagagaatgaatgcgtgggtgcaacctggcggcagcgcaaaagatg

SEQ ID NO: 230991 - DNA, 103 bp, Artificial Sequence
  Synthetic Polynucleotide
taatacgactcactataggggccctgtgagggagacgccctggcacccacaacagaggagagtgggtatgagggcgtctaacctggcggcagcgcaaaagatg

SEQ ID NO: 230992 - DNA, 103 bp, Artificial Sequence
  Synthetic Polynucleotide
taatacgactcactatagggcgtccgagtcgccctgtgagggagacgcccaacagaggagagggcgtatgcctcacaggaacctggcggcagcgcaaaagatg

SEQ ID NO: 230993 - DNA, 103 bp, Artificial Sequence
  Synthetic Polynucleotide
taatacgactcactatagggctctctctctcgtccgagtcgccctgtgagaacagaggagactcacaatgcgactcggaaacctggcggcagcgcaaaagatg

SEQ ID NO: 230994 - DNA, 103 bp, Artificial Sequence
  Synthetic Polynucleotide
taatacgactcactatagggccttgtcaaactctctctctcgtccgagtcaacagaggagagactcgatggagagagagaacctggcggcagcgcaaaagatg

SEQ ID NO: 230995 - DNA, 103 bp, Artificial Sequence
  Synthetic Polynucleotide
taatacgactcactatagggcatcctcttcccttgtcaaactctctctctaacagaggagaagagagatggtttgacaaaacctggcggcagcgcaaaagatg

SEQ ID NO: 230996 - DNA, 103 bp, Artificial Sequence
  Synthetic Polynucleotide
taatacgactcactatagggtcactgtcttcatcctcttcccttgtcaaaaacagaggagatttgacatgggaagaggaaacctggcggcagcgcaaaagatg

SEQ ID NO: 230997 - DNA, 103 bp, Artificial Sequence
  Synthetic Polynucleotide
taatacgactcactatagggatcatcttttactgtacatcctgcttcatcaacagaggagagatgaaatgggatgtacaaacctggcggcagcgcaaaagatg

SEQ ID NO: 230998 - DNA, 103 bp, Artificial Sequence
  Synthetic Polynucleotide
taatacgactcactatagggttcctctttttcactgtcttcatcctcttcaacagaggagagaagagatggaagacagtaacctggcggcagcgcaaaagatg

SEQ ID NO: 230999 - DNA, 103 bp, Artificial Sequence
  Synthetic Polynucleotide
taatacgactcactatagggcctcctcctcttcctctttttcactgtcttaacagaggagaaagacaatgaaaaagaggaacctggcggcagcgcaaaagatg

SEQ ID NO: 231000 - DNA, 103 bp, Artificial Sequence
  Synthetic Polynucleotide
taatacgactcactatagggatctctttatcctcctcctcttcctcttttaacagaggagaaaaagaatgagaggaggaaacctggcggcagcgcaaaagatg

SEQ ID NO: 231001 - DNA, 103 bp, Artificial Sequence
  Synthetic Polynucleotide
taatacgactcactatagggcaattcttccatctctttatcctcctcctcaacagaggagagaggagatggataaagagaacctggcggcagcgcaaaagatg

SEQ ID NO: 231002 - DNA, 103 bp, Artificial Sequence
  Synthetic Polynucleotide
taatacgactcactatagggtttcttcctgcaattcttccatctctttataacagaggagaataaagatgtggaagaataacctggcggcagcgcaaaagatg

SEQ ID NO: 231003 - DNA, 103 bp, Artificial Sequence
  Synthetic Polynucleotide
taatacgactcactatagggtcacattctttttcttcctgcaattcttccaacagaggagaggaagaatggcaggaagaaacctggcggcagcgcaaaagatg

SEQ ID NO: 231004 - DNA, 103 bp, Artificial Sequence
  Synthetic Polynucleotide
taatacgactcactatagggttgtggtttttcacattctttttcttcctgaacagaggagacaggaaatgaaagaatgtaacctggcggcagcgcaaaagatg

SEQ ID NO: 231005 - DNA, 103 bp, Artificial Sequence
  Synthetic Polynucleotide
taatacgactcactatagggcctcatccccttgtggtttttcacattcttaacagaggagaaagaatatgaaaaaccacaacctggcggcagcgcaaaagatg

SEQ ID NO: 231006 - DNA, 103 bp, Artificial Sequence
  Synthetic Polynucleotide
taatacgactcactatagggtcctcctcttcctcatccccttgtggttttaacagaggagaaaaaccatgaggggatgaaacctggcggcagcgcaaaagatg

SEQ ID NO: 231007 - DNA, 103 bp, Artificial Sequence
  Synthetic Polynucleotide
taatacgactcactatagggttcctcctcctcctcctcttcctcatccccaacagaggagaggggatatggaagaggagaacctggcggcagcgcaaaagatg

SEQ ID NO: 231008 - DNA, 103 bp, Artificial Sequence
  Synthetic Polynucleotide
taatacgactcactatagggactcgcattcatcatcttttactgtacatcaacagaggagagatgtaatgtaaaagatgaacctggcggcagcgcaaaagatg

SEQ ID NO: 231009 - DNA, 103 bp, Artificial Sequence
  Synthetic Polynucleotide
taatacgactcactatagggcttccacttcttcctcctcctcctcctcttaacagaggagaaagaggatgaggaggaggaacctggcggcagcgcaaaagatg

SEQ ID NO: 231010 - DNA, 103 bp, Artificial Sequence
  Synthetic Polynucleotide
taatacgactcactatagggacctcttcttcttccacttcttcctcctccaacagaggagaggaggaatgagaagtggaaacctggcggcagcgcaaaagatg

SEQ ID NO: 231011 - DNA, 103 bp, Artificial Sequence
  Synthetic Polynucleotide
taatacgactcactatagggtgcctcttctacctcttcttcttccacttcaacagaggagagaagtgatggaagaagagaacctggcggcagcgcaaaagatg

SEQ ID NO: 231012 - DNA, 103 bp, Artificial Sequence
  Synthetic Polynucleotide
taatacgactcactatagggcctcattctctgcctcttctacctcttcttaacagaggagaaagaagatgtagaagaggaacctggcggcagcgcaaaagatg

SEQ ID NO: 231013 - DNA, 103 bp, Artificial Sequence
  Synthetic Polynucleotide
taatacgactcactataggggcttcttctccctcattctctgcctcttctaacagaggagaagaagaatgagagaatgaaacctggcggcagcgcaaaagatg

SEQ ID NO: 231014 - DNA, 103 bp, Artificial Sequence
  Synthetic Polynucleotide
taatacgactcactatagggttcagtttttgcttcttctccctcattctcaacagaggagagagaatatgggagaagaaaacctggcggcagcgcaaaagatg

SEQ ID NO: 231015 - DNA, 103 bp, Artificial Sequence
  Synthetic Polynucleotide
taatacgactcactatagggtcatcagaccttcagtttttgcttcttctcaacagaggagagagaagatgcaaaaactgaacctggcggcagcgcaaaagatg

SEQ ID NO: 231016 - DNA, 103 bp, Artificial Sequence
  Synthetic Polynucleotide
taatacgactcactatagggctgtcatccttcatcagaccttcagtttttaacagaggagaaaaaacatgaggtctgataacctggcggcagcgcaaaagatg

SEQ ID NO: 231017 - DNA, 103 bp, Artificial Sequence
  Synthetic Polynucleotide
taatacgactcactatagggactttcagccctgtcatccttcatcagaccaacagaggagaggtctgatgaaggatgacaacctggcggcagcgcaaaagatg

SEQ ID NO: 231018 - DNA, 103 bp, Artificial Sequence
  Synthetic Polynucleotide
taatacgactcactatagggtgcttgcttgactttcagccctgtcatcctaacagaggagaaggatgatggggctgaaaaacctggcggcagcgcaaaagatg

SEQ ID NO: 231019 - DNA, 103 bp, Artificial Sequence
  Synthetic Polynucleotide
taatacgactcactatagggtctgcatctgactcgcattcatcatcttttaacagaggagaaaaagaatgtgaatgcgaaacctggcggcagcgcaaaagatg

SEQ ID NO: 231020 - DNA, 103 bp, Artificial Sequence
  Synthetic Polynucleotide
taatacgactcactatagggtgtcctaagctgcttgcttgactttcagccaacagaggagaggctgaatgtcaagcaagaacctggcggcagcgcaaaagatg

SEQ ID NO: 231021 - DNA, 103 bp, Artificial Sequence
  Synthetic Polynucleotide
taatacgactcactataggggcctactttttgtcctaagctgcttgcttgaacagaggagacaagcaatgagcttaggaaacctggcggcagcgcaaaagatg

SEQ ID NO: 231022 - DNA, 103 bp, Artificial Sequence
  Synthetic Polynucleotide
taatacgactcactatagggcactactctcgcctactttttgtcctaagcaacagaggagagcttagatgaaaaagtagaacctggcggcagcgcaaaagatg

SEQ ID NO: 231023 - DNA, 103 bp, Artificial Sequence
  Synthetic Polynucleotide
taatacgactcactataggggacacttgctcactactctcgcctacttttaacagaggagaaaaagtatgcgagagtagaacctggcggcagcgcaaaagatg

SEQ ID NO: 231024 - DNA, 103 bp, Artificial Sequence
  Synthetic Polynucleotide
taatacgactcactatagggcttttcttcagacacttgctcactactctcaacagaggagagagagtatggagcaagtgaacctggcggcagcgcaaaagatg

SEQ ID NO: 231025 - DNA, 103 bp, Artificial Sequence
  Synthetic Polynucleotide
taatacgactcactatagggcttcatttgtcttttcttcagacacttgctaacagaggagaagcaagatgctgaagaaaaacctggcggcagcgcaaaagatg

SEQ ID NO: 231026 - DNA, 103 bp, Artificial Sequence
  Synthetic Polynucleotide
taatacgactcactatagggttgctcattttctgcatctgactcgcattcaacagaggagagaatgcatgtcagatgcaaacctggcggcagcgcaaaagatg

SEQ ID NO: 231027 - DNA, 103 bp, Artificial Sequence
  Synthetic Polynucleotide
taatacgactcactataggggatcatggttttgctcattttctgcatctgaacagaggagacagatgatgaaaatgagcaacctggcggcagcgcaaaagatg

SEQ ID NO: 231028 - DNA, 103 bp, Artificial Sequence
  Synthetic Polynucleotide
taatacgactcactatagggtcaacattaggatcatggttttgctcatttaacagaggagaaaatgaatgaaaccatgaaacctggcggcagcgcaaaagatg

SEQ ID NO: 231029 - DNA, 103 bp, Artificial Sequence
  Synthetic Polynucleotide
taatacgactcactatagggtagaaactcttcaacattaggatcatggttaacagaggagaaaccatatgcctaatgttaacctggcggcagcgcaaaagatg

SEQ ID NO: 231030 - DNA, 103 bp, Artificial Sequence
  Synthetic Polynucleotide
taatacgactcactatagggcttgttgttgtagaaactcttcaacattagaacagaggagactaatgatgaagagtttcaacctggcggcagcgcaaaagatg

SEQ ID NO: 231031 - DNA, 103 bp, Artificial Sequence
  Synthetic Polynucleotide
taatacgactcactatagggacagcagtgtcttgttgttgtagaaactctaacagaggagaagagttatgacaacaacaaacctggcggcagcgcaaaagatg

SEQ ID NO: 231032 - DNA, 103 bp, Artificial Sequence
  Synthetic Polynucleotide
taatacgactcactatagggaacgttattgcgccgcgggttcgcctgcttaacagaggagaaagcagatgaacccgcggaacctggcggcagcgcaaaagatg

SEQ ID NO: 231033 - DNA, 103 bp, Artificial Sequence
  Synthetic Polynucleotide
taatacgactcactatagggaggaaaaatgacagcagtgtcttgttgttgaacagaggagacaacaaatggacactgctaacctggcggcagcgcaaaagatg

SEQ ID NO: 231034 - DNA, 103 bp, Artificial Sequence
  Synthetic Polynucleotide
taatacgactcactatagggcaggtgcctcaggaaaaatgacagcagtgtaacagaggagaacactgatgtcatttttcaacctggcggcagcgcaaaagatg

SEQ ID NO: 231035 - DNA, 103 bp, Artificial Sequence
  Synthetic Polynucleotide
taatacgactcactatagggtggtcctcttcaggtgcctcaggaaaaatgaacagaggagacattttatgtgaggcaccaacctggcggcagcgcaaaagatg

SEQ ID NO: 231036 - DNA, 103 bp, Artificial Sequence
  Synthetic Polynucleotide
taatacgactcactataggggccctgcctctggtcctcttcaggtgcctcaacagaggagagaggcaatggaagaggacaacctggcggcagcgcaaaagatg

SEQ ID NO: 231037 - DNA, 103 bp, Artificial Sequence
  Synthetic Polynucleotide
taatacgactcactatagggcttctggtgtgccctgcctctggtcctcttaacagaggagaaagaggatgagaggcaggaacctggcggcagcgcaaaagatg

SEQ ID NO: 231038 - DNA, 103 bp, Artificial Sequence
  Synthetic Polynucleotide
taatacgactcactatagggtgaccactggcttctggtgtgccctgcctcaacagaggagagaggcaatgcacaccagaaacctggcggcagcgcaaaagatg

SEQ ID NO: 231039 - DNA, 103 bp, Artificial Sequence
  Synthetic Polynucleotide
taatacgactcactatagggattttcatcatgaccactggcttctggtgtaacagaggagaacaccaatggccagtggtaacctggcggcagcgcaaaagatg

SEQ ID NO: 231040 - DNA, 103 bp, Artificial Sequence
  Synthetic Polynucleotide
taatacgactcactatagggctggtgttccattttcatcatgaccactggaacagaggagaccagtgatgatgatgaaaaacctggcggcagcgcaaaagatg

SEQ ID NO: 231041 - DNA, 103 bp, Artificial Sequence
  Synthetic Polynucleotide
taatacgactcactataggggaaaatgcatctggtgttccattttcatcaaacagaggagatgatgaatgtggaacaccaacctggcggcagcgcaaaagatg

SEQ ID NO: 231042 - DNA, 103 bp, Artificial Sequence
  Synthetic Polynucleotide
taatacgactcactataggggagtaattgtgaaaatgcatctggtgttccaacagaggagaggaacaatggatgcatttaacctggcggcagcgcaaaagatg

SEQ ID NO: 231043 - DNA, 103 bp, Artificial Sequence
  Synthetic Polynucleotide
taatacgactcactatagggtataatttgtaacgttattgcgccgcgggtaacagaggagaacccgcatggcaataacgaacctggcggcagcgcaaaagatg

SEQ ID NO: 231044 - DNA, 103 bp, Artificial Sequence
  Synthetic Polynucleotide
taatacgactcactatagggatggacaggtgagtaattgtgaaaatgcataacagaggagaatgcatatgcacaattacaacctggcggcagcgcaaaagatg

SEQ ID NO: 231045 - DNA, 103 bp, Artificial Sequence
  Synthetic Polynucleotide
taatacgactcactatagggctatcacaatatggacaggtgagtaattgtaacagaggagaacaattatgcacctgtccaacctggcggcagcgcaaaagatg

SEQ ID NO: 231046 - DNA, 103 bp, Artificial Sequence
  Synthetic Polynucleotide
taatacgactcactatagggtttatagcctctatcacaatatggacaggtaacagaggagaacctgtatgtattgtgataacctggcggcagcgcaaaagatg

SEQ ID NO: 231047 - DNA, 103 bp, Artificial Sequence
  Synthetic Polynucleotide
taatacgactcactatagggaggtaaagcgtttatagcctctatcacaataacagaggagaattgtgatggaggctataaacctggcggcagcgcaaaagatg

SEQ ID NO: 231048 - DNA, 103 bp, Artificial Sequence
  Synthetic Polynucleotide
taatacgactcactatagggtctttcagagaggtaaagcgtttatagcctaacagaggagaaggctaatgacgctttacaacctggcggcagcgcaaaagatg

SEQ ID NO: 231049 - DNA, 103 bp, Artificial Sequence
  Synthetic Polynucleotide
taatacgactcactatagggtttaatgtgttctttcagagaggtaaagcgaacagaggagacgctttatgtctctgaaaaacctggcggcagcgcaaaagatg

SEQ ID NO: 231050 - DNA, 103 bp, Artificial Sequence
  Synthetic Polynucleotide
taatacgactcactatagggcatgacgatatttaatgtgttctttcagagaacagaggagactctgaatgaacacattaaacctggcggcagcgcaaaagatg

SEQ ID NO: 231051 - DNA, 103 bp, Artificial Sequence
  Synthetic Polynucleotide
taatacgactcactatagggtcattcttttcatgacgatatttaatgtgtaacagaggagaacacatatgatatcgtcaaacctggcggcagcgcaaaagatg

SEQ ID NO: 231052 - DNA, 103 bp, Artificial Sequence
  Synthetic Polynucleotide
taatacgactcactatagggaaagttatcttcattcttttcatgacgataaacagaggagatatcgtatggaaaagaataacctggcggcagcgcaaaagatg

SEQ ID NO: 231053 - DNA, 103 bp, Artificial Sequence
  Synthetic Polynucleotide
taatacgactcactataggggggagcaactaaagttatcttcattcttttaacagaggagaaaaagaatgaagataactaacctggcggcagcgcaaaagatg

SEQ ID NO: 231054 - DNA, 103 bp, Artificial Sequence
  Synthetic Polynucleotide
taatacgactcactatagggaccacagtattataatttgtaacgttattgaacagaggagacaataaatgtacaaattaaacctggcggcagcgcaaaagatg

SEQ ID NO: 231055 - DNA, 103 bp, Artificial Sequence
  Synthetic Polynucleotide
taatacgactcactatagggtaactgcacagggagcaactaaagttatctaacagaggagaagataaatgtagttgctcaacctggcggcagcgcaaaagatg

SEQ ID NO: 231056 - DNA, 103 bp, Artificial Sequence
  Synthetic Polynucleotide
taatacgactcactatagggtgcaaaggtgtaactgcacagggagcaactaacagaggagaagttgcatgctgtgcagtaacctggcggcagcgcaaaagatg

SEQ ID NO: 231057 - DNA, 103 bp, Artificial Sequence
  Synthetic Polynucleotide
taatacgactcactataggggggttctgtatgcaaaggtgtaactgcacaaacagaggagatgtgcaatgacacctttgaacctggcggcagcgcaaaagatg

SEQ ID NO: 231058 - DNA, 103 bp, Artificial Sequence
  Synthetic Polynucleotide
taatacgactcactatagggcgttcaagttgggttctgtatgcaaaggtgaacagaggagacaccttatgatacagaacaacctggcggcagcgcaaaagatg

SEQ ID NO: 231059 - DNA, 103 bp, Artificial Sequence
  Synthetic Polynucleotide
taatacgactcactatagggtgtcatgtgacgttcaagttgggttctgtaaacagaggagatacagaatgcaacttgaaaacctggcggcagcgcaaaagatg

SEQ ID NO: 231060 - DNA, 103 bp, Artificial Sequence
  Synthetic Polynucleotide
taatacgactcactatagggatttatgtgatgtcatgtgacgttcaagttaacagaggagaaacttgatggtcacatgaaacctggcggcagcgcaaaagatg

SEQ ID NO: 231061 - DNA, 103 bp, Artificial Sequence
  Synthetic Polynucleotide
taatacgactcactatagggtctcttcctgatttatgtgatgtcatgtgaaacagaggagatcacatatgatcacataaaacctggcggcagcgcaaaagatg

SEQ ID NO: 231062 - DNA, 103 bp, Artificial Sequence
  Synthetic Polynucleotide
taatacgactcactatagggatgtctttgatctcttcctgatttatgtgaaacagaggagatcacatatgtcaggaagaaacctggcggcagcgcaaaagatg

SEQ ID NO: 231063 - DNA, 103 bp, Artificial Sequence
  Synthetic Polynucleotide
taatacgactcactatagggactgcgtcacatgtctttgatctcttcctgaacagaggagacaggaaatgatcaaagacaacctggcggcagcgcaaaagatg

SEQ ID NO: 231064 - DNA, 103 bp, Artificial Sequence
  Synthetic Polynucleotide
taatacgactcactatagggttacacccagactgcgtcacatgtctttgaaacagaggagatcaaagatgtgtgacgcaaacctggcggcagcgcaaaagatg

SEQ ID NO: 231065 - DNA, 103 bp, Artificial Sequence
  Synthetic Polynucleotide
taatacgactcactatagggatttgtttctaccacagtattataatttgtaacagaggagaacaaatatgaatactgtgaacctggcggcagcgcaaaagatg

SEQ ID NO: 231066 - DNA, 103 bp, Artificial Sequence
  Synthetic Polynucleotide
taatacgactcactataggggaatttacgattacacccagactgcgtcacaacagaggagagtgacgatgtctgggtgtaacctggcggcagcgcaaaagatg

SEQ ID NO: 231067 - DNA, 103 bp, Artificial Sequence
  Synthetic Polynucleotide
taatacgactcactatagggcagtgcatttgaatttacgattacacccagaacagaggagactgggtatgatcgtaaataacctggcggcagcgcaaaagatg

SEQ ID NO: 231068 - DNA, 103 bp, Artificial Sequence
  Synthetic Polynucleotide
taatacgactcactatagggtttccacactcagtgcatttgaatttacgaaacagaggagatcgtaaatgcaaatgcacaacctggcggcagcgcaaaagatg

SEQ ID NO: 231069 - DNA, 103 bp, Artificial Sequence
  Synthetic Polynucleotide
taatacgactcactatagggtttgaaagcttttccacactcagtgcatttaacagaggagaaaatgcatggagtgtggaaacctggcggcagcgcaaaagatg

SEQ ID NO: 231070 - DNA, 103 bp, Artificial Sequence
  Synthetic Polynucleotide
taatacgactcactataggggatgtttgtatttgaaagcttttccacactaacagaggagaagtgtgatgaagctttcaaacctggcggcagcgcaaaagatg

SEQ ID NO: 231071 - DNA, 103 bp, Artificial Sequence
  Synthetic Polynucleotide
taatacgactcactatagggtcttttaggtgatgtttgtatttgaaagctaacagaggagaagctttatgatacaaacaaacctggcggcagcgcaaaagatg

SEQ ID NO: 231072 - DNA, 103 bp, Artificial Sequence
  Synthetic Polynucleotide
taatacgactcactatagggtcttaagtgctcttttaggtgatgtttgtaaacagaggagatacaaaatgcacctaaaaaacctggcggcagcgcaaaagatg

SEQ ID NO: 231073 - DNA, 103 bp, Artificial Sequence
  Synthetic Polynucleotide
taatacgactcactatagggcactgtgaattcttaagtgctcttttaggtaacagaggagaacctaaatgagcacttaaaacctggcggcagcgcaaaagatg

SEQ ID NO: 231074 - DNA, 103 bp, Artificial Sequence
  Synthetic Polynucleotide
taatacgactcactatagggggcttctctccactgtgaattcttaagtgcaacagaggagagcacttatgaattcacagaacctggcggcagcgcaaaagatg

SEQ ID NO: 231075 - DNA, 103 bp, Artificial Sequence
  Synthetic Polynucleotide
taatacgactcactataggggcattcatatggcttctctccactgtgaataacagaggagaattcacatgggagagaagaacctggcggcagcgcaaaagatg

SEQ ID NO: 231076 - DNA, 103 bp, Artificial Sequence
  Synthetic Polynucleotide
taatacgactcactatagggctgaatctgaatttgtttctaccacagtataacagaggagaatactgatgtagaaacaaaacctggcggcagcgcaaaagatg

SEQ ID NO: 231077 - DNA, 103 bp, Artificial Sequence
  Synthetic Polynucleotide
taatacgactcactatagggtgcagtttgggcattcatatggcttctctcaacagaggagagagagaatgcatatgaataacctggcggcagcgcaaaagatg

SEQ ID NO: 231078 - DNA, 103 bp, Artificial Sequence
  Synthetic Polynucleotide
taatacgactcactatagggaagcgtttcttgcagtttgggcattcatataacagaggagaatatgaatgcccaaactgaacctggcggcagcgcaaaagatg

SEQ ID NO: 231079 - DNA, 103 bp, Artificial Sequence
  Synthetic Polynucleotide
taatacgactcactatagggagaatgggaaaagcgtttcttgcagtttggaacagaggagaccaaacatgaagaaacgcaacctggcggcagcgcaaaagatg

SEQ ID NO: 231080 - DNA, 103 bp, Artificial Sequence
  Synthetic Polynucleotide
taatacgactcactatagggtataggagccagaatgggaaaagcgtttctaacagaggagaagaaacatgtttcccattaacctggcggcagcgcaaaagatg

SEQ ID NO: 231081 - DNA, 103 bp, Artificial Sequence
  Synthetic Polynucleotide
taatacgactcactatagggatgtgtgagctataggagccagaatgggaaaacagaggagattcccaatgtggctcctaaacctggcggcagcgcaaaagatg

SEQ ID NO: 231082 - DNA, 103 bp, Artificial Sequence
  Synthetic Polynucleotide
taatacgactcactatagggcttactgcttatgtgtgagctataggagccaacagaggagaggctccatgagctcacacaacctggcggcagcgcaaaagatg

SEQ ID NO: 231083 - DNA, 103 bp, Artificial Sequence
  Synthetic Polynucleotide
taatacgactcactatagggtgatacatttcttactgcttatgtgtgagcaacagaggagagctcacatgtaagcagtaaacctggcggcagcgcaaaagatg

SEQ ID NO: 231084 - DNA, 103 bp, Artificial Sequence
  Synthetic Polynucleotide
taatacgactcactatagggggtatcaagctgatacatttcttactgcttaacagaggagaaagcagatggaaatgtataacctggcggcagcgcaaaagatg

SEQ ID NO: 231085 - DNA, 103 bp, Artificial Sequence
  Synthetic Polynucleotide
taatacgactcactatagggcccattcacaggtatcaagctgatacatttaacagaggagaaaatgtatgagcttgataaacctggcggcagcgcaaaagatg

SEQ ID NO: 231086 - DNA, 103 bp, Artificial Sequence
  Synthetic Polynucleotide
taatacgactcactatagggttcttggtcgcccattcacaggtatcaagcaacagaggagagcttgaatgctgtgaatgaacctggcggcagcgcaaaagatg

SEQ ID NO: 231087 - DNA, 103 bp, Artificial Sequence
  Synthetic Polynucleotide
taatacgactcactatagggtcttcatcatctgaatctgaatttgtttctaacagaggagaagaaacatgttcagattcaacctggcggcagcgcaaaagatg

SEQ ID NO: 231088 - DNA, 103 bp, Artificial Sequence
  Synthetic Polynucleotide
taatacgactcactatagggttgagtcctgttcttggtcgcccattcacaaacagaggagatgtgaaatggcgaccaagaacctggcggcagcgcaaaagatg

SEQ ID NO: 231089 - DNA, 103 bp, Artificial Sequence
  Synthetic Polynucleotide
taatacgactcactatagggctgagatgtcttgagtcctgttcttggtcgaacagaggagacgaccaatgacaggactcaacctggcggcagcgcaaaagatg

SEQ ID NO: 231090 - DNA, 103 bp, Artificial Sequence
  Synthetic Polynucleotide
taatacgactcactataggggtgaagaacactgagatgtcttgagtcctgaacagaggagacaggacatgagacatctcaacctggcggcagcgcaaaagatg

SEQ ID NO: 231091 - DNA, 103 bp, Artificial Sequence
  Synthetic Polynucleotide
taatacgactcactataggggaaagagacggtgaagaacactgagatgtcaacagaggagagacatcatggtgttcttcaacctggcggcagcgcaaaagatg

SEQ ID NO: 231092 - DNA, 103 bp, Artificial Sequence
  Synthetic Polynucleotide
taatacgactcactatagggtggtgatgctgaaagagacggtgaagaacaaacagaggagatgttctatgccgtctcttaacctggcggcagcgcaaaagatg

SEQ ID NO: 231093 - DNA, 103 bp, Artificial Sequence
  Synthetic Polynucleotide
taatacgactcactatagggtgggactgcctggtgatgctgaaagagacgaacagaggagacgtctcatgcagcatcacaacctggcggcagcgcaaaagatg

SEQ ID NO: 231094 - DNA, 103 bp, Artificial Sequence
  Synthetic Polynucleotide
taatacgactcactatagggtgtggtcgtgtgggactgcctggtgatgctaacagaggagaagcatcatgaggcagtccaacctggcggcagcgcaaaagatg

SEQ ID NO: 231095 - DNA, 103 bp, Artificial Sequence
  Synthetic Polynucleotide
taatacgactcactatagggttgccgtatctgtggtcgtgtgggactgccaacagaggagaggcagtatgacacgaccaaacctggcggcagcgcaaaagatg

SEQ ID NO: 231096 - DNA, 103 bp, Artificial Sequence
  Synthetic Polynucleotide
taatacgactcactatagggtctctatcttttgccgtatctgtggtcgtgaacagaggagacacgacatgagatacggcaacctggcggcagcgcaaaagatg

SEQ ID NO: 231097 - DNA, 103 bp, Artificial Sequence
  Synthetic Polynucleotide
taatacgactcactatagggaggggtttattctctatcttttgccgtatcaacagaggagagatacgatgaaagatagaaacctggcggcagcgcaaaagatg

SEQ ID NO: 231098 - DNA, 103 bp, Artificial Sequence
  Synthetic Polynucleotide
taatacgactcactatagggagtggtagaggctgagttaagggtggccataacagaggagaatggccatgcttaactcaaacctggcggcagcgcaaaagatg

SEQ ID NO: 231099 - DNA, 103 bp, Artificial Sequence
  Synthetic Polynucleotide
taatacgactcactatagggatctttggtgacaggatcagagggggtgctaacagaggagaagcaccatgtctgatcctaacctggcggcagcgcaaaagatg

SEQ ID NO: 231100 - DNA, 103 bp, Artificial Sequence
  Synthetic Polynucleotide
taatacgactcactatagggaacttcttcatccaggaggataagggcctgaacagaggagacaggccatgatcctcctgaacctggcggcagcgcaaaagatg

SEQ ID NO: 231101 - DNA, 103 bp, Artificial Sequence
  Synthetic Polynucleotide
taatacgactcactatagggtgagggccataacttcttcatccaggaggaaacagaggagatcctccatgatgaagaagaacctggcggcagcgcaaaagatg

SEQ ID NO: 231102 - DNA, 103 bp, Artificial Sequence
  Synthetic Polynucleotide
taatacgactcactataggggagggtgggctgagggccataacttcttcaaacagaggagatgaagaatgtatggccctaacctggcggcagcgcaaaagatg

SEQ ID NO: 231103 - DNA, 103 bp, Artificial Sequence
  Synthetic Polynucleotide
taatacgactcactatagggtgtgggtggagagggtgggctgagggccataacagaggagaatggccatgagcccacccaacctggcggcagcgcaaaagatg

SEQ ID NO: 231104 - DNA, 103 bp, Artificial Sequence
  Synthetic Polynucleotide
taatacgactcactatagggcccaggtggctgtgggtggagagggtgggcaacagaggagagcccacatgctccacccaaacctggcggcagcgcaaaagatg

SEQ ID NO: 231105 - DNA, 103 bp, Artificial Sequence
  Synthetic Polynucleotide
taatacgactcactataggggggctggggtcccaggtggctgtgggtggaaacagaggagatccaccatgagccacctgaacctggcggcagcgcaaaagatg

SEQ ID NO: 231106 - DNA, 103 bp, Artificial Sequence
  Synthetic Polynucleotide
taatacgactcactatagggggcttgggttgggctggggtcccaggtggcaacagaggagagccaccatggaccccagcaacctggcggcagcgcaaaagatg

SEQ ID NO: 231107 - DNA, 103 bp, Artificial Sequence
  Synthetic Polynucleotide
taatacgactcactataggggcgattctttggcttgggttgggctggggtaacagaggagaaccccaatgcaacccaagaacctggcggcagcgcaaaagatg

SEQ ID NO: 231108 - DNA, 103 bp, Artificial Sequence
  Synthetic Polynucleotide
taatacgactcactataggggctgctactggcgattctttggcttgggttaacagaggagaaacccaatgcaaagaatcaacctggcggcagcgcaaaagatg

SEQ ID NO: 231109 - DNA, 103 bp, Artificial Sequence
  Synthetic Polynucleotide
taatacgactcactatagggtgcctcgcctgctgctactggcgattctttaacagaggagaaaagaaatgccagtagcaaacctggcggcagcgcaaaagatg

SEQ ID NO: 231110 - DNA, 103 bp, Artificial Sequence
  Synthetic Polynucleotide
taatacgactcactatagggcagcagggggatctttggtgacaggatcagaacagaggagactgatcatgtcaccaaagaacctggcggcagcgcaaaagatg

SEQ ID NO: 231111 - DNA, 103 bp, Artificial Sequence
  Synthetic Polynucleotide
taatacgactcactatagggaatctggccctgcctcgcctgctgctactgaacagaggagacagtagatgcaggcgaggaacctggcggcagcgcaaaagatg

SEQ ID NO: 231112 - DNA, 103 bp, Artificial Sequence
  Synthetic Polynucleotide
taatacgactcactatagggtcagggaaccaatctggccctgcctcgcctaacagaggagaaggcgaatgagggccagaaacctggcggcagcgcaaaagatg

SEQ ID NO: 231113 - DNA, 103 bp, Artificial Sequence
  Synthetic Polynucleotide
taatacgactcactatagggttcttgcccctcagggaaccaatctggcccaacagaggagagggccaatgtggttccctaacctggcggcagcgcaaaagatg

SEQ ID NO: 231114 - DNA, 103 bp, Artificial Sequence
  Synthetic Polynucleotide
taatacgactcactatagggctccatcctcttcttgcccctcagggaaccaacagaggagaggttccatgaggggcaagaacctggcggcagcgcaaaagatg

SEQ ID NO: 231115 - DNA, 103 bp, Artificial Sequence
  Synthetic Polynucleotide
taatacgactcactataggggggcagagccctccatcctcttcttgccccaacagaggagaggggcaatgagaggatggaacctggcggcagcgcaaaagatg

SEQ ID NO: 231116 - DNA, 103 bp, Artificial Sequence
  Synthetic Polynucleotide
taatacgactcactataggggttgagtggggggcagagccctccatcctcaacagaggagagaggatatggggctctgcaacctggcggcagcgcaaaagatg

SEQ ID NO: 231117 - DNA, 103 bp, Artificial Sequence
  Synthetic Polynucleotide
taatacgactcactataggggtgagctttggttgagtggggggcagagccaacagaggagaggctctatgccccactcaaacctggcggcagcgcaaaagatg

SEQ ID NO: 231118 - DNA, 103 bp, Artificial Sequence
  Synthetic Polynucleotide
taatacgactcactatagggttggaggtgggtgagctttggttgagtgggaacagaggagacccactatgccaaagctcaacctggcggcagcgcaaaagatg

SEQ ID NO: 231119 - DNA, 103 bp, Artificial Sequence
  Synthetic Polynucleotide
taatacgactcactataggggcccccctccttggaggtgggtgagctttgaacagaggagacaaagcatgcccacctccaacctggcggcagcgcaaaagatg

SEQ ID NO: 231120 - DNA, 103 bp, Artificial Sequence
  Synthetic Polynucleotide
taatacgactcactatagggcagggagagtgcccccctccttggaggtggaacagaggagaccacctatgaggagggggaacctggcggcagcgcaaaagatg

SEQ ID NO: 231121 - DNA, 103 bp, Artificial Sequence
  Synthetic Polynucleotide
taatacgactcactataggggtggaggaggcagcagggggatctttggtgaacagaggagacaccaaatgtccccctgcaacctggcggcagcgcaaaagatg

SEQ ID NO: 231122 - DNA, 103 bp, Artificial Sequence
  Synthetic Polynucleotide
taatacgactcactatagggcccactggggcagggagagtgcccccctccaacagaggagaggagggatgcactctcccaacctggcggcagcgcaaaagatg

SEQ ID NO: 231123 - DNA, 103 bp, Artificial Sequence
  Synthetic Polynucleotide
taatacgactcactatagggttcgggggagcccactggggcagggagagtaacagaggagaactctcatggccccagtgaacctggcggcagcgcaaaagatg

SEQ ID NO: 231124 - DNA, 103 bp, Artificial Sequence
  Synthetic Polynucleotide
taatacgactcactatagggcactggggtcttcgggggagcccactggggaacagaggagaccccagatggctcccccgaacctggcggcagcgcaaaagatg

SEQ ID NO: 231125 - DNA, 103 bp, Artificial Sequence
  Synthetic Polynucleotide
taatacgactcactatagggtggggtgggtcactggggtcttcgggggagaacagaggagactccccatgagaccccagaacctggcggcagcgcaaaagatg

SEQ ID NO: 231126 - DNA, 103 bp, Artificial Sequence
  Synthetic Polynucleotide
taatacgactcactataggggcgatagggctggggtgggtcactggggtcaacagaggagagaccccatggacccacccaacctggcggcagcgcaaaagatg

SEQ ID NO: 231127 - DNA, 103 bp, Artificial Sequence
  Synthetic Polynucleotide
taatacgactcactatagggcatcagctaggcgatagggctggggtgggtaacagaggagaacccacatgagccctatcaacctggcggcagcgcaaaagatg

SEQ ID NO: 231128 - DNA, 103 bp, Artificial Sequence
  Synthetic Polynucleotide
taatacgactcactatagggggggtgtagtcatcagctaggcgatagggcaacagaggagagccctaatgcctagctgaaacctggcggcagcgcaaaagatg

SEQ ID NO: 231129 - DNA, 103 bp, Artificial Sequence
  Synthetic Polynucleotide
taatacgactcactatagggtgcaggggctggggtgtagtcatcagctagaacagaggagactagctatggactacaccaacctggcggcagcgcaaaagatg

SEQ ID NO: 231130 - DNA, 103 bp, Artificial Sequence
  Synthetic Polynucleotide
taatacgactcactatagggcctggaaggctgcaggggctggggtgtagtaacagaggagaactacaatgcagcccctgaacctggcggcagcgcaaaagatg

SEQ ID NO: 231131 - DNA, 103 bp, Artificial Sequence
  Synthetic Polynucleotide
taatacgactcactatagggaggctgaggccctggaaggctgcaggggctaacagaggagaagccccatgagccttccaaacctggcggcagcgcaaaagatg

SEQ ID NO: 231132 - DNA, 103 bp, Artificial Sequence
  Synthetic Polynucleotide
taatacgactcactataggggttctcagaggtggaggaggcagcagggggaacagaggagaccccctatggcctcctccaacctggcggcagcgcaaaagatg

SEQ ID NO: 231133 - DNA, 103 bp, Artificial Sequence
  Synthetic Polynucleotide
taatacgactcactataggggtggctggacaggctgaggccctggaaggcaacagaggagagccttcatgggcctcagcaacctggcggcagcgcaaaagatg

SEQ ID NO: 231134 - DNA, 103 bp, Artificial Sequence
  Synthetic Polynucleotide
taatacgactcactataggggcagggacatgtggctggacaggctgaggcaacagaggagagcctcaatgtgtccagccaacctggcggcagcgcaaaagatg

SEQ ID NO: 231135 - DNA, 103 bp, Artificial Sequence
  Synthetic Polynucleotide
taatacgactcactatagggcgtgagtggagcagggacatgtggctggacaacagaggagagtccagatgcatgtccctaacctggcggcagcgcaaaagatg

SEQ ID NO: 231136 - DNA, 103 bp, Artificial Sequence
  Synthetic Polynucleotide
taatacgactcactataggggcaggagttgcgtgagtggagcagggacataacagaggagaatgtccatgctccactcaaacctggcggcagcgcaaaagatg

SEQ ID NO: 231137 - DNA, 103 bp, Artificial Sequence
  Synthetic Polynucleotide
taatacgactcactatagggtgagtgtcttgcaggagttgcgtgagtggaaacagaggagatccactatggcaactcctaacctggcggcagcgcaaaagatg

SEQ ID NO: 231138 - DNA, 103 bp, Artificial Sequence
  Synthetic Polynucleotide
taatacgactcactatagggttgggacacttgagtgtcttgcaggagttgaacagaggagacaactcatgcaagacactaacctggcggcagcgcaaaagatg

SEQ ID NO: 231139 - DNA, 103 bp, Artificial Sequence
  Synthetic Polynucleotide
taatacgactcactatagggccagttgcacttgggacacttgagtgtcttaacagaggagaaagacaatgaagtgtcccaacctggcggcagcgcaaaagatg

SEQ ID NO: 231140 - DNA, 103 bp, Artificial Sequence
  Synthetic Polynucleotide
taatacgactcactatagggacttgtagtgccagttgcacttgggacactaacagaggagaagtgtcatgagtgcaactaacctggcggcagcgcaaaagatg

SEQ ID NO: 231141 - DNA, 103 bp, Artificial Sequence
  Synthetic Polynucleotide
taatacgactcactataggggtctgctggtacttgtagtgccagttgcacaacagaggagagtgcaaatggcactacaaaacctggcggcagcgcaaaagatg

SEQ ID NO: 231142 - DNA, 103 bp, Artificial Sequence
  Synthetic Polynucleotide
taatacgactcactatagggcacatccagggtctgctggtacttgtagtgaacagaggagacactacatgtaccagcagaacctggcggcagcgcaaaagatg

SEQ ID NO: 231143 - DNA, 103 bp, Artificial Sequence
  Synthetic Polynucleotide
taatacgactcactatagggaggacctcatgttctcagaggtggaggaggaacagaggagacctcctatgcctctgagaaacctggcggcagcgcaaaagatg

SEQ ID NO: 231144 - DNA, 103 bp, Artificial Sequence
  Synthetic Polynucleotide
taatacgactcactatagggctcgcatgtgcacatccagggtctgctggtaacagaggagaaccagcatgccctggatgaacctggcggcagcgcaaaagatg

SEQ ID NO: 231145 - DNA, 103 bp, Artificial Sequence
  Synthetic Polynucleotide
taatacgactcactataggggggtgcttctctcgcatgtgcacatccaggaacagaggagacctggaatggcacatgcgaacctggcggcagcgcaaaagatg

SEQ ID NO: 231146 - DNA, 103 bp, Artificial Sequence
  Synthetic Polynucleotide
taatacgactcactataggggttgctctcagggtgcttctctcgcatgtgaacagaggagacacatgatggagaagcacaacctggcggcagcgcaaaagatg

SEQ ID NO: 231147 - DNA, 103 bp, Artificial Sequence
  Synthetic Polynucleotide
taatacgactcactatagggtgcagtgactgttgctctcagggtgcttctaacagaggagaagaagcatgctgagagcaaacctggcggcagcgcaaaagatg

SEQ ID NO: 231148 - DNA, 103 bp, Artificial Sequence
  Synthetic Polynucleotide
taatacgactcactatagggctgcagtagctgcagtgactgttgctctcaaacagaggagatgagagatgcagtcactgaacctggcggcagcgcaaaagatg

SEQ ID NO: 231149 - DNA, 103 bp, Artificial Sequence
  Synthetic Polynucleotide
taatacgactcactataggggcccccagcactgcagtagctgcagtgactaacagaggagaagtcacatgagctactgcaacctggcggcagcgcaaaagatg

SEQ ID NO: 231150 - DNA, 103 bp, Artificial Sequence
  Synthetic Polynucleotide
taatacgactcactataggggggggtgggcgcccccagcactgcagtagcaacagaggagagctactatggtgctggggaacctggcggcagcgcaaaagatg

SEQ ID NO: 231151 - DNA, 103 bp, Artificial Sequence
  Synthetic Polynucleotide
taatacgactcactatagggcgagcaaggcgggggtgggcgcccccagcaaacagaggagatgctggatgcgcccacccaacctggcggcagcgcaaaagatg

SEQ ID NO: 231152 - DNA, 103 bp, Artificial Sequence
  Synthetic Polynucleotide
taatacgactcactataggggctctctccacgagcaaggcgggggtgggcaacagaggagagcccacatgcgccttgctaacctggcggcagcgcaaaagatg

SEQ ID NO: 231153 - DNA, 103 bp, Artificial Sequence
  Synthetic Polynucleotide
taatacgactcactatagggcacagttgtagctctctccacgagcaaggcaacagaggagagccttgatggtggagagaaacctggcggcagcgcaaaagatg

SEQ ID NO: 231154 - DNA, 103 bp, Artificial Sequence
  Synthetic Polynucleotide
taatacgactcactatagggcctggctctgaggacctcatgttctcagagaacagaggagactctgaatgcatgaggtcaacctggcggcagcgcaaaagatg

SEQ ID NO: 231155 - DNA, 103 bp, Artificial Sequence
  Synthetic Polynucleotide
taatacgactcactatagggggtttgtagccacagttgtagctctctccaaacagaggagatggagaatgctacaactgaacctggcggcagcgcaaaagatg

SEQ ID NO: 231156 - DNA, 103 bp, Artificial Sequence
  Synthetic Polynucleotide
taatacgactcactatagggacagcggtagggtttgtagccacagttgtaaacagaggagatacaacatgggctacaaaaacctggcggcagcgcaaaagatg

SEQ ID NO: 231157 - DNA, 103 bp, Artificial Sequence
  Synthetic Polynucleotide
taatacgactcactatagggtgcagacgtcacagcggtagggtttgtagcaacagaggagagctacaatgcctaccgctaacctggcggcagcgcaaaagatg

SEQ ID NO: 231158 - DNA, 103 bp, Artificial Sequence
  Synthetic Polynucleotide
taatacgactcactataggggtagagtagttgcagacgtcacagcggtagaacagaggagactaccgatgtgacgtctgaacctggcggcagcgcaaaagatg

SEQ ID NO: 231159 - DNA, 103 bp, Artificial Sequence
  Synthetic Polynucleotide
taatacgactcactatagggtttggtggttgtagagtagttgcagacgtcaacagaggagagacgtcatgaactactctaacctggcggcagcgcaaaagatg

SEQ ID NO: 231160 - DNA, 103 bp, Artificial Sequence
  Synthetic Polynucleotide
taatacgactcactatagggtgaggttgcctttggtggttgtagagtagtaacagaggagaactactatgcaaccaccaaacctggcggcagcgcaaaagatg

SEQ ID NO: 231161 - DNA, 103 bp, Artificial Sequence
  Synthetic Polynucleotide
taatacgactcactatagggatatggatgctgaggttgcctttggtggttaacagaggagaaaccacatgaggcaacctaacctggcggcagcgcaaaagatg

SEQ ID NO: 231162 - DNA, 103 bp, Artificial Sequence
  Synthetic Polynucleotide
taatacgactcactataggggtcagactgcatatggatgctgaggttgccaacagaggagaggcaacatgagcatccataacctggcggcagcgcaaaagatg

SEQ ID NO: 231163 - DNA, 103 bp, Artificial Sequence
  Synthetic Polynucleotide
taatacgactcactatagggccaggtgcttgtcagactgcatatggatgcaacagaggagagcatccatgtgcagtctgaacctggcggcagcgcaaaagatg

SEQ ID NO: 231164 - DNA, 103 bp, Artificial Sequence
  Synthetic Polynucleotide
taatacgactcactatagggtgtaggttggccaggtgcttgtcagactgcaacagaggagagcagtcatgcaagcacctaacctggcggcagcgcaaaagatg

SEQ ID NO: 231165 - DNA, 103 bp, Artificial Sequence
  Synthetic Polynucleotide
taatacgactcactataggggagctgtccccctggctctgaggacctcataacagaggagaatgaggatgtcagagccaaacctggcggcagcgcaaaagatg

SEQ ID NO: 231166 - DNA, 103 bp, Artificial Sequence
  Synthetic Polynucleotide
taatacgactcactatagggctggaagccctgtaggttggccaggtgcttaacagaggagaaagcacatggccaacctaaacctggcggcagcgcaaaagatg

SEQ ID NO: 231167 - DNA, 103 bp, Artificial Sequence
  Synthetic Polynucleotide
taatacgactcactatagggcagggcccgcctggaagccctgtaggttggaacagaggagaccaaccatgagggcttccaacctggcggcagcgcaaaagatg

SEQ ID NO: 231168 - DNA, 103 bp, Artificial Sequence
  Synthetic Polynucleotide
taatacgactcactatagggccctgcccaccagggcccgcctggaagcccaacagaggagagggcttatgggcgggcccaacctggcggcagcgcaaaagatg

SEQ ID NO: 231169 - DNA, 103 bp, Artificial Sequence
  Synthetic Polynucleotide
taatacgactcactatagggtggtggacttccctgcccaccagggcccgcaacagaggagagcgggcatgggtgggcagaacctggcggcagcgcaaaagatg

SEQ ID NO: 231170 - DNA, 103 bp, Artificial Sequence
  Synthetic Polynucleotide
taatacgactcactataggggtgatgcctctggtggacttccctgcccacaacagaggagagtgggcatggaagtccacaacctggcggcagcgcaaaagatg

SEQ ID NO: 231171 - DNA, 103 bp, Artificial Sequence
  Synthetic Polynucleotide
taatacgactcactataggggagggtgggagtgatgcctctggtggacttaacagaggagaaagtccatgagaggcatcaacctggcggcagcgcaaaagatg

SEQ ID NO: 231172 - DNA, 103 bp, Artificial Sequence
  Synthetic Polynucleotide
taatacgactcactataggggtctcccgcggagggtgggagtgatgcctcaacagaggagagaggcaatgctcccacccaacctggcggcagcgcaaaagatg

SEQ ID NO: 231173 - DNA, 103 bp, Artificial Sequence
  Synthetic Polynucleotide
taatacgactcactatagggtaggctctttgtctcccgcggagggtgggaaacagaggagatcccacatgccgcgggagaacctggcggcagcgcaaaagatg

SEQ ID NO: 231174 - DNA, 103 bp, Artificial Sequence
  Synthetic Polynucleotide
taatacgactcactataggggatttggtcttaggctctttgtctcccgcgaacagaggagacgcgggatgcaaagagccaacctggcggcagcgcaaaagatg

SEQ ID NO: 231175 - DNA, 103 bp, Artificial Sequence
  Synthetic Polynucleotide
taatacgactcactatagggctgccaggatgatttggtcttaggctctttaacagaggagaaaagagatgaagaccaaaaacctggcggcagcgcaaaagatg

SEQ ID NO: 231176 - DNA, 103 bp, Artificial Sequence
  Synthetic Polynucleotide
taatacgactcactatagggccgactccaggagctgtccccctggctctgaacagaggagacagagcatgggggacagcaacctggcggcagcgcaaaagatg

SEQ ID NO: 231177 - DNA, 103 bp, Artificial Sequence
  Synthetic Polynucleotide
taatacgactcactatagggacaccttgcactgccaggatgatttggtctaacagaggagaagaccaatgcatcctggcaacctggcggcagcgcaaaagatg

SEQ ID NO: 231178 - DNA, 103 bp, Artificial Sequence
  Synthetic Polynucleotide
taatacgactcactatagggtcgtagctgcacaccttgcactgccaggataacagaggagaatcctgatggtgcaaggtaacctggcggcagcgcaaaagatg

SEQ ID NO: 231179 - DNA, 103 bp, Artificial Sequence
  Synthetic Polynucleotide
taatacgactcactataggggatgtttgtctcgtagctgcacaccttgcaaacagaggagatgcaagatgtgcagctacaacctggcggcagcgcaaaagatg

SEQ ID NO: 231180 - DNA, 103 bp, Artificial Sequence
  Synthetic Polynucleotide
taatacgactcactatagggggttacgggagatgtttgtctcgtagctgcaacagaggagagcagctatgagacaaacaaacctggcggcagcgcaaaagatg

SEQ ID NO: 231181 - DNA, 103 bp, Artificial Sequence
  Synthetic Polynucleotide
taatacgactcactatagggtggatgcgcaggttacgggagatgtttgtcaacagaggagagacaaaatgctcccgtaaaacctggcggcagcgcaaaagatg

SEQ ID NO: 231182 - DNA, 103 bp, Artificial Sequence
  Synthetic Polynucleotide
taatacgactcactatagggagaggtcatatggatgcgcaggttacgggaaacagaggagatcccgtatgctgcgcatcaacctggcggcagcgcaaaagatg

SEQ ID NO: 231183 - DNA, 103 bp, Artificial Sequence
  Synthetic Polynucleotide
taatacgactcactatagggtgtgcttctcagaggtcatatggatgcgcaaacagaggagatgcgcaatgatatgacctaacctggcggcagcgcaaaagatg

SEQ ID NO: 231184 - DNA, 103 bp, Artificial Sequence
  Synthetic Polynucleotide
taatacgactcactatagggacattctgcatgtgcttctcagaggtcataaacagaggagatatgacatgtgagaagcaaacctggcggcagcgcaaaagatg

SEQ ID NO: 231185 - DNA, 103 bp, Artificial Sequence
  Synthetic Polynucleotide
taatacgactcactatagggcagcattaggacattctgcatgtgcttctcaacagaggagagagaagatgatgcagaataacctggcggcagcgcaaaagatg

SEQ ID NO: 231186 - DNA, 103 bp, Artificial Sequence
  Synthetic Polynucleotide
taatacgactcactataggggcccctggtgcagcattaggacattctgcaaacagaggagatgcagaatgtcctaatgcaacctggcggcagcgcaaaagatg

SEQ ID NO: 231187 - DNA, 103 bp, Artificial Sequence
  Synthetic Polynucleotide
taatacgactcactatagggaggccacagcccgactccaggagctgtcccaacagaggagagggacaatgcctggagtcaacctggcggcagcgcaaaagatg

SEQ ID NO: 231188 - DNA, 103 bp, Artificial Sequence
  Synthetic Polynucleotide
taatacgactcactatagggcccagcggcagcccctggtgcagcattaggaacagaggagacctaatatggcaccagggaacctggcggcagcgcaaaagatg

SEQ ID NO: 231189 - DNA, 103 bp, Artificial Sequence
  Synthetic Polynucleotide
taatacgactcactatagggaggtggcaggcccagcggcagcccctggtgaacagaggagacaccagatgctgccgctgaacctggcggcagcgcaaaagatg

SEQ ID NO: 231190 - DNA, 103 bp, Artificial Sequence
  Synthetic Polynucleotide
taatacgactcactatagggccatcaatccaggtggcaggcccagcggcaaacagaggagatgccgcatggcctgccacaacctggcggcagcgcaaaagatg

SEQ ID NO: 231191 - DNA, 103 bp, Artificial Sequence
  Synthetic Polynucleotide
taatacgactcactataggggggcctggccccatcaatccaggtggcaggaacagaggagacctgccatgtggattgataacctggcggcagcgcaaaagatg

SEQ ID NO: 231192 - DNA, 103 bp, Artificial Sequence
  Synthetic Polynucleotide
taatacgactcactatagggtgggggaggagggcctggccccatcaatccaacagaggagaggattgatggggccaggcaacctggcggcagcgcaaaagatg

SEQ ID NO: 231193 - DNA, 103 bp, Artificial Sequence
  Synthetic Polynucleotide
taatacgactcactatagggtagcccctggtgggggaggagggcctggccaacagaggagaggccagatgctcctccccaacctggcggcagcgcaaaagatg

SEQ ID NO: 231194 - DNA, 103 bp, Artificial Sequence
  Synthetic Polynucleotide
taatacgactcactatagggctagtgggggtagcccctggtgggggaggaaacagaggagatcctccatgaccaggggcaacctggcggcagcgcaaaagatg

SEQ ID NO: 231195 - DNA, 103 bp, Artificial Sequence
  Synthetic Polynucleotide
taatacgactcactatagggttcaggggggctagtgggggtagcccctggaacagaggagaccagggatgacccccactaacctggcggcagcgcaaaagatg

SEQ ID NO: 231196 - DNA, 103 bp, Artificial Sequence
  Synthetic Polynucleotide
taatacgactcactatagggactggaagagttcaggggggctagtgggggaacagaggagacccccaatggcccccctgaacctggcggcagcgcaaaagatg

SEQ ID NO: 231197 - DNA, 103 bp, Artificial Sequence
  Synthetic Polynucleotide
taatacgactcactatagggggcccaaagtactggaagagttcaggggggaacagaggagaccccccatgactcttccaaacctggcggcagcgcaaaagatg

SEQ ID NO: 231198 - DNA, 103 bp, Artificial Sequence
  Synthetic Polynucleotide
taatacgactcactatagggtggtgggacgaggccacagcccgactccagaacagaggagactggagatgggctgtggcaacctggcggcagcgcaaaagatg

SEQ ID NO: 231199 - DNA, 103 bp, Artificial Sequence
  Synthetic Polynucleotide
taatacgactcactatagggtagggcctggggcccaaagtactggaagagaacagaggagactcttcatgtactttgggaacctggcggcagcgcaaaagatg

SEQ ID NO: 231200 - DNA, 103 bp, Artificial Sequence
  Synthetic Polynucleotide
taatacgactcactataggggaggctgccctagggcctggggcccaaagtaacagaggagaactttgatgcccaggcccaacctggcggcagcgcaaaagatg

SEQ ID NO: 231201 - DNA, 103 bp, Artificial Sequence
  Synthetic Polynucleotide
taatacgactcactatagggaagggagtctgaggctgccctagggcctggaacagaggagaccaggcatgagggcagccaacctggcggcagcgcaaaagatg

SEQ ID NO: 231202 - DNA, 103 bp, Artificial Sequence
  Synthetic Polynucleotide
taatacgactcactatagggcgggccagccaagggagtctgaggctgcccaacagaggagagggcagatgcagactcccaacctggcggcagcgcaaaagatg

SEQ ID NO: 231203 - DNA, 103 bp, Artificial Sequence
  Synthetic Polynucleotide
taatacgactcactataggggcctcagccccgggccagccaagggagtctaacagaggagaagactcatgtggctggccaacctggcggcagcgcaaaagatg

SEQ ID NO: 231204 - DNA, 103 bp, Artificial Sequence
  Synthetic Polynucleotide
taatacgactcactatagggggcttgtctggcctcagccccgggccagccaacagaggagaggctggatgggggctgagaacctggcggcagcgcaaaagatg

SEQ ID NO: 231205 - DNA, 103 bp, Artificial Sequence
  Synthetic Polynucleotide
taatacgactcactatagggggcttccaggggcttgtctggcctcagcccaacagaggagagggctgatgccagacaagaacctggcggcagcgcaaaagatg

SEQ ID NO: 231206 - DNA, 103 bp, Artificial Sequence
  Synthetic Polynucleotide
taatacgactcactataggggaagtagctgggcttccaggggcttgtctgaacagaggagacagacaatgccctggaagaacctggcggcagcgcaaaagatg

SEQ ID NO: 231207 - DNA, 103 bp, Artificial Sequence
  Synthetic Polynucleotide
taatacgactcactatagggaaaccattgagaagtagctgggcttccaggaacagaggagacctggaatgccagctactaacctggcggcagcgcaaaagatg

SEQ ID NO: 231208 - DNA, 103 bp, Artificial Sequence
  Synthetic Polynucleotide
taatacgactcactatagggtacgtggtggaaaccattgagaagtagctgaacagaggagacagctaatgctcaatggtaacctggcggcagcgcaaaagatg

SEQ ID NO: 231209 - DNA, 103 bp, Artificial Sequence
  Synthetic Polynucleotide
taatacgactcactataggggggtggtaccagtggtagaggctgagttaaaacagaggagattaactatgcctctaccaaacctggcggcagcgcaaaagatg

SEQ ID NO: 231210 - DNA, 103 bp, Artificial Sequence
  Synthetic Polynucleotide
taatacgactcactatagggcaatctcctttggtgggacgaggccacagcaacagaggagagctgtgatgtcgtcccacaacctggcggcagcgcaaaagatg

SEQ ID NO: 231211 - DNA, 103 bp, Artificial Sequence
  Synthetic Polynucleotide
taatacgactcactatagggcaggtgctcctacgtggtggaaaccattgaaacagaggagatcaatgatgtccaccacgaacctggcggcagcgcaaaagatg

SEQ ID NO: 231212 - DNA, 103 bp, Artificial Sequence
  Synthetic Polynucleotide
taatacgactcactatagggaacttgcgggcaggtgctcctacgtggtggaacagaggagaccaccaatgaggagcaccaacctggcggcagcgcaaaagatg

SEQ ID NO: 231213 - DNA, 103 bp, Artificial Sequence
  Synthetic Polynucleotide
taatacgactcactatagggggatgtggggaacttgcgggcaggtgctccaacagaggagaggagcaatggcccgcaagaacctggcggcagcgcaaaagatg

SEQ ID NO: 231214 - DNA, 103 bp, Artificial Sequence
  Synthetic Polynucleotide
taatacgactcactatagggttccaggggcggatgtggggaacttgcgggaacagaggagacccgcaatgtccccacataacctggcggcagcgcaaaagatg

SEQ ID NO: 231215 - DNA, 103 bp, Artificial Sequence
  Synthetic Polynucleotide
taatacgactcactatagggggggataggcttccaggggcggatgtggggaacagaggagaccccacatgcgcccctggaacctggcggcagcgcaaaagatg

SEQ ID NO: 231216 - DNA, 103 bp, Artificial Sequence
  Synthetic Polynucleotide
taatacgactcactataggggtgggcatcaggggataggcttccaggggcaacagaggagagcccctatgagcctatccaacctggcggcagcgcaaaagatg

SEQ ID NO: 231217 - DNA, 103 bp, Artificial Sequence
  Synthetic Polynucleotide
taatacgactcactatagggttggaggcaggtgggcatcaggggataggcaacagaggagagcctatatgctgatgcccaacctggcggcagcgcaaaagatg

SEQ ID NO: 231218 - DNA, 103 bp, Artificial Sequence
  Synthetic Polynucleotide
taatacgactcactatagggaggagctgacttggaggcaggtgggcatcaaacagaggagatgatgcatgcctgcctccaacctggcggcagcgcaaaagatg

SEQ ID NO: 231219 - DNA, 103 bp, Artificial Sequence
  Synthetic Polynucleotide
taatacgactcactatagggtgaggaacccaggagctgacttggaggcagaacagaggagactgcctatgagtcagctcaacctggcggcagcgcaaaagatg

SEQ ID NO: 231220 - DNA, 103 bp, Artificial Sequence
  Synthetic Polynucleotide
taatacgactcactatagggggctgtcagatgaggaacccaggagctgacaacagaggagagtcagcatgtgggttcctaacctggcggcagcgcaaaagatg

SEQ ID NO: 231221 - DNA, 103 bp, Artificial Sequence
  Synthetic Polynucleotide
taatacgactcactatagggtggggctccccaatctcctttggtgggacgaacagaggagacgtcccatgaaaggagataacctggcggcagcgcaaaagatg

SEQ ID NO: 231222 - DNA, 103 bp, Artificial Sequence
  Synthetic Polynucleotide
taatacgactcactataggggaggtgggcaggctgtcagatgaggaacccaacagaggagagggttcatgatctgacagaacctggcggcagcgcaaaagatg

SEQ ID NO: 231223 - DNA, 103 bp, Artificial Sequence
  Synthetic Polynucleotide
taatacgactcactatagggtgggggtggtgaggtgggcaggctgtcagaaacagaggagatctgacatgctgcccaccaacctggcggcagcgcaaaagatg

SEQ ID NO: 231224 - DNA, 103 bp, Artificial Sequence
  Synthetic Polynucleotide
taatacgactcactatagggggctgtcgtctgggggtggtgaggtgggcaaacagaggagatgcccaatgcaccaccccaacctggcggcagcgcaaaagatg

SEQ ID NO: 231225 - DNA, 103 bp, Artificial Sequence
  Synthetic Polynucleotide
taatacgactcactatagggttcagggacaggctgtcgtctgggggtggtaacagaggagaaccaccatgagacgacagaacctggcggcagcgcaaaagatg

SEQ ID NO: 231226 - DNA, 103 bp, Artificial Sequence
  Synthetic Polynucleotide
taatacgactcactataggggcggaacaccttcagggacaggctgtcgtcaacagaggagagacgacatgctgtccctgaacctggcggcagcgcaaaagatg

SEQ ID NO: 231227 - DNA, 103 bp, Artificial Sequence
  Synthetic Polynucleotide
taatacgactcactatagggacactaggcagcggaacaccttcagggacaaacagaggagatgtcccatgaggtgttccaacctggcggcagcgcaaaagatg

SEQ ID NO: 231228 - DNA, 103 bp, Artificial Sequence
  Synthetic Polynucleotide
taatacgactcactatagggaaggcctggcacactaggcagcggaacaccaacagaggagaggtgttatgctgcctagtaacctggcggcagcgcaaaagatg

SEQ ID NO: 231229 - DNA, 103 bp, Artificial Sequence
  Synthetic Polynucleotide
taatacgactcactataggggtctgtgctgaaggcctggcacactaggcaaacagaggagatgcctaatgtgccaggccaacctggcggcagcgcaaaagatg

SEQ ID NO: 231230 - DNA, 103 bp, Artificial Sequence
  Synthetic Polynucleotide
taatacgactcactataggggctccaggctgtctgtgctgaaggcctggcaacagaggagagccaggatgtcagcacagaacctggcggcagcgcaaaagatg

SEQ ID NO: 231231 - DNA, 103 bp, Artificial Sequence
  Synthetic Polynucleotide
taatacgactcactatagggtagagcagcagctccaggctgtctgtgctgaacagaggagacagcacatgcagcctggaaacctggcggcagcgcaaaagatg

SEQ ID NO: 231232 - DNA, 103 bp, Artificial Sequence
  Synthetic Polynucleotide
taatacgactcactatagggaggcccttcctggggctccccaatctccttaacagaggagaaaggagatgggggagcccaacctggcggcagcgcaaaagatg

SEQ ID NO: 231233 - DNA, 103 bp, Artificial Sequence
  Synthetic Polynucleotide
taatacgactcactataggggctgcagtggtagagcagcagctccaggctaacagaggagaagcctgatgctgctgctcaacctggcggcagcgcaaaagatg

SEQ ID NO: 231234 - DNA, 103 bp, Artificial Sequence
  Synthetic Polynucleotide
taatacgactcactatagggtccggcctatgctgcagtggtagagcagcaaacagaggagatgctgcatgaccactgcaaacctggcggcagcgcaaaagatg

SEQ ID NO: 231235 - DNA, 103 bp, Artificial Sequence
  Synthetic Polynucleotide
taatacgactcactatagggtccgggaggctccggcctatgctgcagtggaacagaggagaccactgatgcataggccgaacctggcggcagcgcaaaagatg

SEQ ID NO: 231236 - DNA, 103 bp, Artificial Sequence
  Synthetic Polynucleotide
taatacgactcactatagggccattcagcttccgggaggctccggcctataacagaggagaataggcatgagcctcccgaacctggcggcagcgcaaaagatg

SEQ ID NO: 231237 - DNA, 103 bp, Artificial Sequence
  Synthetic Polynucleotide
taatacgactcactatagggccacctccttccattcagcttccgggaggcaacagaggagagcctccatgaagctgaataacctggcggcagcgcaaaagatg

SEQ ID NO: 231238 - DNA, 103 bp, Artificial Sequence
  Synthetic Polynucleotide
taatacgactcactataggggtgtcaccagccacctccttccattcagctaacagaggagaagctgaatggaaggaggtaacctggcggcagcgcaaaagatg

SEQ ID NO: 231239 - DNA, 103 bp, Artificial Sequence
  Synthetic Polynucleotide
taatacgactcactataggggcagcggtgggtgtcaccagccacctccttaacagaggagaaaggagatggctggtgacaacctggcggcagcgcaaaagatg

SEQ ID NO: 231240 - DNA, 103 bp, Artificial Sequence
  Synthetic Polynucleotide
taatacgactcactatagggagcaaagcttgcagcggtgggtgtcaccagaacagaggagactggtgatgcccaccgctaacctggcggcagcgcaaaagatg

SEQ ID NO: 231241 - DNA, 103 bp, Artificial Sequence
  Synthetic Polynucleotide
taatacgactcactataggggtgccatagcagcaaagcttgcagcggtggaacagaggagaccaccgatgcaagctttgaacctggcggcagcgcaaaagatg

SEQ ID NO: 231242 - DNA, 103 bp, Artificial Sequence
  Synthetic Polynucleotide
taatacgactcactatagggcttgagctgggtgccatagcagcaaagcttaacagaggagaaagcttatgtgctatggcaacctggcggcagcgcaaaagatg

SEQ ID NO: 231243 - DNA, 103 bp, Artificial Sequence
  Synthetic Polynucleotide
taatacgactcactataggggaccacagtcaggcccttcctggggctcccaacagaggagagggagcatgaggaagggcaacctggcggcagcgcaaaagatg

SEQ ID NO: 231244 - DNA, 103 bp, Artificial Sequence
  Synthetic Polynucleotide
taatacgactcactatagggggaagttggccttgagctgggtgccatagcaacagaggagagctatgatgcccagctcaaacctggcggcagcgcaaaagatg

SEQ ID NO: 231245 - DNA, 103 bp, Artificial Sequence
  Synthetic Polynucleotide
taatacgactcactatagggaggtggagttggaagttggccttgagctggaacagaggagaccagctatgggccaacttaacctggcggcagcgcaaaagatg

SEQ ID NO: 231246 - DNA, 103 bp, Artificial Sequence
  Synthetic Polynucleotide
taatacgactcactataggggtcagtcttgaggtggagttggaagttggcaacagaggagagccaacatgcaactccacaacctggcggcagcgcaaaagatg

SEQ ID NO: 231247 - DNA, 103 bp, Artificial Sequence
  Synthetic Polynucleotide
taatacgactcactataggggagcatgtttgtcagtcttgaggtggagttaacagaggagaaactccatgtcaagactgaacctggcggcagcgcaaaagatg

SEQ ID NO: 231248 - DNA, 103 bp, Artificial Sequence
  Synthetic Polynucleotide
taatacgactcactatagggtggtacttctgagcatgtttgtcagtcttgaacagaggagacaagacatgcaaacatgcaacctggcggcagcgcaaaagatg

SEQ ID NO: 231249 - DNA, 103 bp, Artificial Sequence
  Synthetic Polynucleotide
taatacgactcactatagggggctgccagctggtacttctgagcatgtttaacagaggagaaaacatatgcagaagtacaacctggcggcagcgcaaaagatg

SEQ ID NO: 231250 - DNA, 103 bp, Artificial Sequence
  Synthetic Polynucleotide
taatacgactcactatagggcccgcaggtgggctgccagctggtacttctaacagaggagaagaagtatgagctggcagaacctggcggcagcgcaaaagatg

SEQ ID NO: 231251 - DNA, 103 bp, Artificial Sequence
  Synthetic Polynucleotide
taatacgactcactatagggccacccccctcccgcaggtgggctgccagcaacagaggagagctggcatgccacctgcgaacctggcggcagcgcaaaagatg

SEQ ID NO: 231252 - DNA, 103 bp, Artificial Sequence
  Synthetic Polynucleotide
taatacgactcactataggggcccatggctccacccccctcccgcaggtgaacagaggagacacctgatggaggggggtaacctggcggcagcgcaaaagatg

SEQ ID NO: 231253 - DNA, 103 bp, Artificial Sequence
  Synthetic Polynucleotide
taatacgactcactataggggggaaggggtgcccatggctccacccccctaacagaggagaagggggatggagccatggaacctggcggcagcgcaaaagatg

SEQ ID NO: 231254 - DNA, 103 bp, Artificial Sequence
  Synthetic Polynucleotide
taatacgactcactatagggggtgggaagtgaccacagtcaggcccttccaacagaggagaggaaggatgtgactgtggaacctggcggcagcgcaaaagatg

SEQ ID NO: 231255 - DNA, 103 bp, Artificial Sequence
  Synthetic Polynucleotide
taatacgactcactatagggagggatgctggggaaggggtgcccatggctaacagaggagaagccatatgcaccccttcaacctggcggcagcgcaaaagatg

SEQ ID NO: 231256 - DNA, 103 bp, Artificial Sequence
  Synthetic Polynucleotide
taatacgactcactatagggcccatctcccagggatgctggggaaggggtaacagaggagaacccctatgccagcatccaacctggcggcagcgcaaaagatg

SEQ ID NO: 231257 - DNA, 103 bp, Artificial Sequence
  Synthetic Polynucleotide
taatacgactcactatagggcataaggagccccatctcccagggatgctgaacagaggagacagcatatgtgggagatgaacctggcggcagcgcaaaagatg

SEQ ID NO: 231258 - DNA, 103 bp, Artificial Sequence
  Synthetic Polynucleotide
taatacgactcactataggggagacagacccataaggagccccatctcccaacagaggagagggagaatgggctccttaaacctggcggcagcgcaaaagatg

SEQ ID NO: 231259 - DNA, 103 bp, Artificial Sequence
  Synthetic Polynucleotide
taatacgactcactataggggtgtagtggggagacagacccataaggagcaacagaggagagctcctatggggtctgtcaacctggcggcagcgcaaaagatg

SEQ ID NO: 231260 - DNA, 103 bp, Artificial Sequence
  Synthetic Polynucleotide
taatacgactcactatagggtgcagcgcaggtgtagtggggagacagaccaacagaggagaggtctgatgccccactacaacctggcggcagcgcaaaagatg

SEQ ID NO: 231261 - DNA, 103 bp, Artificial Sequence
  Synthetic Polynucleotide
taatacgactcactatagggtcacagatgttgcagcgcaggtgtagtgggaacagaggagacccactatgcctgcgctgaacctggcggcagcgcaaaagatg

SEQ ID NO: 231262 - DNA, 103 bp, Artificial Sequence
  Synthetic Polynucleotide
taatacgactcactatagggggactcaaagtcacagatgttgcagcgcagaacagaggagactgcgcatgaacatctgtaacctggcggcagcgcaaaagatg

SEQ ID NO: 231263 - DNA, 103 bp, Artificial Sequence
  Synthetic Polynucleotide
taatacgactcactatagggccttgctgttggactcaaagtcacagatgtaacagaggagaacatctatgactttgagtaacctggcggcagcgcaaaagatg

SEQ ID NO: 231264 - DNA, 103 bp, Artificial Sequence
  Synthetic Polynucleotide
taatacgactcactatagggtgcatcttctccttgctgttggactcaaagaacagaggagactttgaatgcaacagcaaaacctggcggcagcgcaaaagatg

SEQ ID NO: 231265 - DNA, 103 bp, Artificial Sequence
  Synthetic Polynucleotide
taatacgactcactatagggtgggtcatttggtgggaagtgaccacagtcaacagaggagagactgtatgcacttcccaaacctggcggcagcgcaaaagatg

SEQ ID NO: 231266 - DNA, 103 bp, Artificial Sequence
  Synthetic Polynucleotide
taatacgactcactatagggggcatgcagctgcatcttctccttgctgttaacagaggagaaacagcatggagaagatgaacctggcggcagcgcaaaagatg

SEQ ID NO: 231267 - DNA, 103 bp, Artificial Sequence
  Synthetic Polynucleotide
taatacgactcactatagggctgcacccctggcatgcagctgcatcttctaacagaggagaagaagaatgagctgcatgaacctggcggcagcgcaaaagatg

SEQ ID NO: 231268 - DNA, 103 bp, Artificial Sequence
  Synthetic Polynucleotide
taatacgactcactatagggtcttcgtgggctgcacccctggcatgcagcaacagaggagagctgcaatgcaggggtgcaacctggcggcagcgcaaaagatg

SEQ ID NO: 231269 - DNA, 103 bp, Artificial Sequence
  Synthetic Polynucleotide
taatacgactcactatagggttggctgttttcttcgtgggctgcacccctaacagaggagaaggggtatggcccacgaaaacctggcggcagcgcaaaagatg

SEQ ID NO: 231270 - DNA, 103 bp, Artificial Sequence
  Synthetic Polynucleotide
taatacgactcactatagggacttatagatttggctgttttcttcgtgggaacagaggagacccacgatgaaaacagccaacctggcggcagcgcaaaagatg

SEQ ID NO: 231271 - DNA, 103 bp, Artificial Sequence
  Synthetic Polynucleotide
taatacgactcactatagggtccagcagaaacttatagatttggctgtttaacagaggagaaaacagatgaatctataaaacctggcggcagcgcaaaagatg

SEQ ID NO: 231272 - DNA, 103 bp, Artificial Sequence
  Synthetic Polynucleotide
taatacgactcactatagggtccctccatgtccagcagaaacttatagataacagaggagaatctatatgtttctgctgaacctggcggcagcgcaaaagatg

SEQ ID NO: 231273 - DNA, 103 bp, Artificial Sequence
  Synthetic Polynucleotide
taatacgactcactatagggctgcctccgctccctccatgtccagcagaaaacagaggagattctgcatgacatggaggaacctggcggcagcgcaaaagatg

SEQ ID NO: 231274 - DNA, 103 bp, Artificial Sequence
  Synthetic Polynucleotide
taatacgactcactatagggagctctgcccctgcctccgctccctccatgaacagaggagacatggaatgagcggaggcaacctggcggcagcgcaaaagatg

SEQ ID NO: 231275 - DNA, 103 bp, Artificial Sequence
  Synthetic Polynucleotide
taatacgactcactataggggtatagccccagctctgcccctgcctccgcaacagaggagagcggagatgggggcagagaacctggcggcagcgcaaaagatg

SEQ ID NO: 231276 - DNA, 103 bp, Artificial Sequence
  Synthetic Polynucleotide
taatacgactcactatagggtttccacccctgggtcatttggtgggaagtaacagaggagaacttccatgcaaatgaccaacctggcggcagcgcaaaagatg

SEQ ID NO: 231277 - DNA, 103 bp, Artificial Sequence
  Synthetic Polynucleotide
taatacgactcactatagggacaggcagtggtatagccccagctctgcccaacagaggagagggcagatgtggggctataacctggcggcagcgcaaaagatg

SEQ ID NO: 231278 - DNA, 103 bp, Artificial Sequence
  Synthetic Polynucleotide
taatacgactcactatagggcacgcacacaacaggcagtggtatagccccaacagaggagaggggctatgccactgcctaacctggcggcagcgcaaaagatg

SEQ ID NO: 231279 - DNA, 103 bp, Artificial Sequence
  Synthetic Polynucleotide
taatacgactcactataggggggtgtctcccacgcacacaacaggcagtgaacagaggagacactgcatgttgtgtgcgaacctggcggcagcgcaaaagatg

SEQ ID NO: 231280 - DNA, 103 bp, Artificial Sequence
  Synthetic Polynucleotide
taatacgactcactatagggccaagcgggagggtgtctcccacgcacacaaacagaggagatgtgtgatggggagacacaacctggcggcagcgcaaaagatg

SEQ ID NO: 231281 - DNA, 103 bp, Artificial Sequence
  Synthetic Polynucleotide
taatacgactcactatagggtgcagcacagccaagcgggagggtgtctccaacagaggagaggagacatgctcccgcttaacctggcggcagcgcaaaagatg

SEQ ID NO: 231282 - DNA, 103 bp, Artificial Sequence
  Synthetic Polynucleotide
taatacgactcactataggggcgcaggtgttgcagcacagccaagcgggaaacagaggagatcccgcatggctgtgctgaacctggcggcagcgcaaaagatg

SEQ ID NO: 231283 - DNA, 103 bp, Artificial Sequence
  Synthetic Polynucleotide
taatacgactcactataggggggcaggtgtgcgcaggtgttgcagcacagaacagaggagactgtgcatgaacacctgcaacctggcggcagcgcaaaagatg

SEQ ID NO: 231284 - DNA, 103 bp, Artificial Sequence
  Synthetic Polynucleotide
taatacgactcactataggggcatcgcggtgggcaggtgtgcgcaggtgtaacagaggagaacacctatgcacacctgcaacctggcggcagcgcaaaagatg

SEQ ID NO: 231285 - DNA, 103 bp, Artificial Sequence
  Synthetic Polynucleotide
taatacgactcactatagggctgggcctgggcatcgcggtgggcaggtgtaacagaggagaacacctatgcaccgcgataacctggcggcagcgcaaaagatg

SEQ ID NO: 231286 - DNA, 103 bp, Artificial Sequence
  Synthetic Polynucleotide
taatacgactcactataggggcagacgcctctgggcctgggcatcgcggtaacagaggagaaccgcgatgcccaggcccaacctggcggcagcgcaaaagatg

SEQ ID NO: 231287 - DNA, 103 bp, Artificial Sequence
  Synthetic Polynucleotide
taatacgactcactatagggtccttgtccttttccacccctgggtcatttaacagaggagaaaatgaatgaggggtggaaacctggcggcagcgcaaaagatg

SEQ ID NO: 231288 - DNA, 103 bp, Artificial Sequence
  Synthetic Polynucleotide
taatacgactcactatagggtgtagcagctgcagacgcctctgggcctggaacagaggagaccaggcatggaggcgtctaacctggcggcagcgcaaaagatg

SEQ ID NO: 231289 - DNA, 103 bp, Artificial Sequence
  Synthetic Polynucleotide
taatacgactcactatagggtgggccattctgtagcagctgcagacgcctaacagaggagaaggcgtatgcagctgctaaacctggcggcagcgcaaaagatg

SEQ ID NO: 231290 - DNA, 103 bp, Artificial Sequence
  Synthetic Polynucleotide
taatacgactcactatagggcctcagtggttgggccattctgtagcagctaacagaggagaagctgcatgagaatggccaacctggcggcagcgcaaaagatg

SEQ ID NO: 231291 - DNA, 103 bp, Artificial Sequence
  Synthetic Polynucleotide
taatacgactcactataggggcgagtccttcctcagtggttgggccattcaacagaggagagaatggatgaaccactgaaacctggcggcagcgcaaaagatg

SEQ ID NO: 231292 - DNA, 103 bp, Artificial Sequence
  Synthetic Polynucleotide
taatacgactcactatagggctgaagagctgcgagtccttcctcagtggtaacagaggagaaccactatggaaggactcaacctggcggcagcgcaaaagatg

SEQ ID NO: 231293 - DNA, 103 bp, Artificial Sequence
  Synthetic Polynucleotide
taatacgactcactatagggtcaggatgctctgaagagctgcgagtccttaacagaggagaaaggacatgcagctcttcaacctggcggcagcgcaaaagatg

SEQ ID NO: 231294 - DNA, 103 bp, Artificial Sequence
  Synthetic Polynucleotide
taatacgactcactatagggtggctgaagctcaggatgctctgaagagctaacagaggagaagctctatggagcatcctaacctggcggcagcgcaaaagatg

SEQ ID NO: 231295 - DNA, 103 bp, Artificial Sequence
  Synthetic Polynucleotide
taatacgactcactataggggagctgcccgtggctgaagctcaggatgctaacagaggagaagcatcatgagcttcagcaacctggcggcagcgcaaaagatg

SEQ ID NO: 231296 - DNA, 103 bp, Artificial Sequence
  Synthetic Polynucleotide
taatacgactcactatagggcgggagtccggagctgcccgtggctgaagcaacagaggagagcttcaatgacgggcagcaacctggcggcagcgcaaaagatg

SEQ ID NO: 231297 - DNA, 103 bp, Artificial Sequence
  Synthetic Polynucleotide
taatacgactcactatagggggagccttcccgggagtccggagctgcccgaacagaggagacgggcaatgccggactccaacctggcggcagcgcaaaagatg

SEQ ID NO: 231298 - DNA, 103 bp, Artificial Sequence
  Synthetic Polynucleotide
taatacgactcactatagggctcctcctgctccttgtccttttccaccccaacagaggagaggggtgatgaaggacaagaacctggcggcagcgcaaaagatg

SEQ ID NO: 231299 - DNA, 103 bp, Artificial Sequence
  Synthetic Polynucleotide
taatacgactcactataggggggggtgacaggagccttcccgggagtccgaacagaggagacggactatggggaaggctaacctggcggcagcgcaaaagatg

SEQ ID NO: 231300 - DNA, 103 bp, Artificial Sequence
  Synthetic Polynucleotide
taatacgactcactataggggctcagctaagggggtgacaggagccttccaacagaggagaggaaggatgctgtcacccaacctggcggcagcgcaaaagatg

SEQ ID NO: 231301 - DNA, 103 bp, Artificial Sequence
  Synthetic Polynucleotide
taatacgactcactatagggggggtgggtggctcagctaagggggtgacaaacagaggagatgtcacatgcttagctgaaacctggcggcagcgcaaaagatg

SEQ ID NO: 231302 - DNA, 103 bp, Artificial Sequence
  Synthetic Polynucleotide
taatacgactcactatagggatctttctcaggggtgggtggctcagctaaaacagaggagattagctatgccacccaccaacctggcggcagcgcaaaagatg

SEQ ID NO: 231303 - DNA, 103 bp, Artificial Sequence
  Synthetic Polynucleotide
taatacgactcactatagggtgttctgggcatctttctcaggggtgggtgaacagaggagacacccaatgctgagaaagaacctggcggcagcgcaaaagatg

SEQ ID NO: 231304 - DNA, 103 bp, Artificial Sequence
  Synthetic Polynucleotide
taatacgactcactatagggtgttctgtcttgttctgggcatctttctcaaacagaggagatgagaaatgtgcccagaaaacctggcggcagcgcaaaagatg

SEQ ID NO: 231305 - DNA, 103 bp, Artificial Sequence
  Synthetic Polynucleotide
taatacgactcactatagggtgaagccaattgttctgtcttgttctgggcaacagaggagagcccagatgaagacagaaaacctggcggcagcgcaaaagatg

SEQ ID NO: 231306 - DNA, 103 bp, Artificial Sequence
  Synthetic Polynucleotide
taatacgactcactatagggctgtctcttctgaagccaattgttctgtctaacagaggagaagacagatgaattggcttaacctggcggcagcgcaaaagatg

SEQ ID NO: 231307 - DNA, 103 bp, Artificial Sequence
  Synthetic Polynucleotide
taatacgactcactataggggtcttgttttctgtctcttctgaagccaataacagaggagaattggcatgagaagagacaacctggcggcagcgcaaaagatg

SEQ ID NO: 231308 - DNA, 103 bp, Artificial Sequence
  Synthetic Polynucleotide
taatacgactcactatagggggaagggccagtcttgttttctgtctcttcaacagaggagagaagagatggaaaacaagaacctggcggcagcgcaaaagatg

SEQ ID NO: 231309 - DNA, 103 bp, Artificial Sequence
  Synthetic Polynucleotide
taatacgactcactatagggcttcttcttcctcctcctgctccttgtcctaacagaggagaaggacaatgagcaggaggaacctggcggcagcgcaaaagatg

SEQ ID NO: 231310 - DNA, 103 bp, Artificial Sequence
  Synthetic Polynucleotide
taatacgactcactatagggcactgtctctggaagggccagtcttgttttaacagaggagaaaaacaatgctggcccttaacctggcggcagcgcaaaagatg

SEQ ID NO: 231311 - DNA, 103 bp, Artificial Sequence
  Synthetic Polynucleotide
taatacgactcactataggggtctggttggcactgtctctggaagggccaaacagaggagatggcccatgcagagacagaacctggcggcagcgcaaaagatg

SEQ ID NO: 231312 - DNA, 103 bp, Artificial Sequence
  Synthetic Polynucleotide
taatacgactcactataggggtataccgtggtctggttggcactgtctctaacagaggagaagagacatggccaaccagaacctggcggcagcgcaaaagatg

SEQ ID NO: 231313 - DNA, 103 bp, Artificial Sequence
  Synthetic Polynucleotide
taatacgactcactatagggatggacagcagtataccgtggtctggttggaacagaggagaccaaccatgccacggtataacctggcggcagcgcaaaagatg

SEQ ID NO: 231314 - DNA, 103 bp, Artificial Sequence
  Synthetic Polynucleotide
taatacgactcactatagggaagctgcagtatggacagcagtataccgtgaacagaggagacacggtatgctgctgtccaacctggcggcagcgcaaaagatg

SEQ ID NO: 231315 - DNA, 103 bp, Artificial Sequence
  Synthetic Polynucleotide
taatacgactcactatagggtgggctcaggaagctgcagtatggacagcaaacagaggagatgctgtatgtactgcagcaacctggcggcagcgcaaaagatg

SEQ ID NO: 231316 - DNA, 103 bp, Artificial Sequence
  Synthetic Polynucleotide
taatacgactcactatagggggctggactctgggctcaggaagctgcagtaacagaggagaactgcaatgtcctgagccaacctggcggcagcgcaaaagatg

SEQ ID NO: 231317 - DNA, 103 bp, Artificial Sequence
  Synthetic Polynucleotide
taatacgactcactataggggccctcacctggctggactctgggctcaggaacagaggagacctgagatgagagtccagaacctggcggcagcgcaaaagatg

SEQ ID NO: 231318 - DNA, 103 bp, Artificial Sequence
  Synthetic Polynucleotide
taatacgactcactataggggagtgtatgagccctcacctggctggactcaacagaggagagagtccatgcaggtgaggaacctggcggcagcgcaaaagatg

SEQ ID NO: 231319 - DNA, 103 bp, Artificial Sequence
  Synthetic Polynucleotide
taatacgactcactatagggcatgctgggagagtgtatgagccctcacctaacagaggagaaggtgaatgctcatacacaacctggcggcagcgcaaaagatg

SEQ ID NO: 231320 - DNA, 103 bp, Artificial Sequence
  Synthetic Polynucleotide
taatacgactcactatagggccaggggagggggtggtaccagtggtagagaacagaggagactctacatgtggtaccacaacctggcggcagcgcaaaagatg

SEQ ID NO: 231321 - DNA, 103 bp, Artificial Sequence
  Synthetic Polynucleotide
taatacgactcactatagggggagggagcccttcttcttcctcctcctgcaacagaggagagcaggaatgggaagaagaaacctggcggcagcgcaaaagatg

SEQ ID NO: 231322 - DNA, 103 bp, Artificial Sequence
  Synthetic Polynucleotide
taatacgactcactatagggggctgcactgcatgctgggagagtgtatgaaacagaggagatcatacatgctcccagcaaacctggcggcagcgcaaaagatg

SEQ ID NO: 231323 - DNA, 103 bp, Artificial Sequence
  Synthetic Polynucleotide
taatacgactcactatagggtctgtacttgggctgcactgcatgctgggaaacagaggagatcccagatggcagtgcagaacctggcggcagcgcaaaagatg

SEQ ID NO: 231324 - DNA, 103 bp, Artificial Sequence
  Synthetic Polynucleotide
taatacgactcactatagggacagtgggcatctgtacttgggctgcactgaacagaggagacagtgcatgccaagtacaaacctggcggcagcgcaaaagatg

SEQ ID NO: 231325 - DNA, 103 bp, Artificial Sequence
  Synthetic Polynucleotide
taatacgactcactatagggtgttcctggcacagtgggcatctgtacttgaacagaggagacaagtaatgatgcccactaacctggcggcagcgcaaaagatg

SEQ ID NO: 231326 - DNA, 103 bp, Artificial Sequence
  Synthetic Polynucleotide
taatacgactcactataggggcccaccagctgttcctggcacagtgggcaaacagaggagatgcccaatgtgccaggaaaacctggcggcagcgcaaaagatg

SEQ ID NO: 231327 - DNA, 103 bp, Artificial Sequence
  Synthetic Polynucleotide
taatacgactcactataggggggcaggccggcccaccagctgttcctggcaacagaggagagccaggatgagctggtggaacctggcggcagcgcaaaagatg

SEQ ID NO: 231328 - DNA, 103 bp, Artificial Sequence
  Synthetic Polynucleotide
taatacgactcactatagggtggaagtgcagggcaggccggcccaccagcaacagaggagagctggtatgccggcctgcaacctggcggcagcgcaaaagatg

SEQ ID NO: 231329 - DNA, 103 bp, Artificial Sequence
  Synthetic Polynucleotide
taatacgactcactataggggtggctaaggtggaagtgcagggcaggccgaacagaggagacggcctatgctgcacttcaacctggcggcagcgcaaaagatg

SEQ ID NO: 231330 - DNA, 103 bp, Artificial Sequence
  Synthetic Polynucleotide
taatacgactcactatagggcgttgtgaaggtggctaaggtggaagtgcaaacagaggagatgcactatgaccttagccaacctggcggcagcgcaaaagatg

SEQ ID NO: 231331 - DNA, 103 bp, Artificial Sequence
  Synthetic Polynucleotide
taatacgactcactatagggtcgggcaccacgttgtgaaggtggctaaggaacagaggagaccttagatgccttcacaaaacctggcggcagcgcaaaagatg

SEQ ID NO: 231332 - DNA, 103 bp, Artificial Sequence
  Synthetic Polynucleotide
taatacgactcactatagggtaggtccatgggagggagcccttcttcttcaacagaggagagaagaaatggggctccctaacctggcggcagcgcaaaagatg

SEQ ID NO: 231333 - DNA, 103 bp, Artificial Sequence
  Synthetic Polynucleotide
taatacgactcactatagggctcaacgcactcgggcaccacgttgtgaagaacagaggagacttcacatggtggtgcccaacctggcggcagcgcaaaagatg

SEQ ID NO: 231334 - DNA, 103 bp, Artificial Sequence
  Synthetic Polynucleotide
taatacgactcactataggggcagcagcttctcaacgcactcgggcaccaaacagaggagatggtgcatgagtgcgttgaacctggcggcagcgcaaaagatg

SEQ ID NO: 231335 - DNA, 103 bp, Artificial Sequence
  Synthetic Polynucleotide
taatacgactcactataggggtagctacaagcagcagcttctcaacgcacaacagaggagagtgcgtatggaagctgctaacctggcggcagcgcaaaagatg

SEQ ID NO: 231336 - DNA, 103 bp, Artificial Sequence
  Synthetic Polynucleotide
taatacgactcactatagggttctacagttgtagctacaagcagcagcttaacagaggagaaagctgatgcttgtagctaacctggcggcagcgcaaaagatg

SEQ ID NO: 231337 - DNA, 103 bp, Artificial Sequence
  Synthetic Polynucleotide
taatacgactcactatagggtaaatgtcatttctacagttgtagctacaaaacagaggagattgtagatgcaactgtagaacctggcggcagcgcaaaagatg

SEQ ID NO: 231338 - DNA, 103 bp, Artificial Sequence
  Synthetic Polynucleotide
taatacgactcactatagggactttggttgtaaatgtcatttctacagttaacagaggagaaactgtatgaatgacattaacctggcggcagcgcaaaagatg

SEQ ID NO: 231339 - DNA, 103 bp, Artificial Sequence
  Synthetic Polynucleotide
taatacgactcactatagggtgcagacagcactttggttgtaaatgtcataacagaggagaatgacaatgacaaccaaaaacctggcggcagcgcaaaagatg

SEQ ID NO: 231340 - DNA, 103 bp, Artificial Sequence
  Synthetic Polynucleotide
taatacgactcactatagggttaatgtgggtgcagacagcactttggttgaacagaggagacaaccaatgtgctgtctgaacctggcggcagcgcaaaagatg

SEQ ID NO: 231341 - DNA, 103 bp, Artificial Sequence
  Synthetic Polynucleotide
taatacgactcactatagggtccagagggcttaatgtgggtgcagacagcaacagaggagagctgtcatgacccacattaacctggcggcagcgcaaaagatg

SEQ ID NO: 231342 - DNA, 103 bp, Artificial Sequence
  Synthetic Polynucleotide
taatacgactcactatagggttggccattgtccagagggcttaatgtgggaacagaggagacccacaatgagccctctgaacctggcggcagcgcaaaagatg

SEQ ID NO: 231343 - DNA, 103 bp, Artificial Sequence
  Synthetic Polynucleotide
taatacgactcactatagggagtggttgcttaggtccatgggagggagccaacagaggagaggctccatgccatggaccaacctggcggcagcgcaaaagatg

SEQ ID NO: 231344 - DNA, 103 bp, Artificial Sequence
  Synthetic Polynucleotide
taatacgactcactatagggtggggggttcttggccattgtccagagggcaacagaggagagccctcatgacaatggccaacctggcggcagcgcaaaagatg

SEQ ID NO: 231345 - DNA, 103 bp, Artificial Sequence
  Synthetic Polynucleotide
taatacgactcactatagggggcccatgagtggggggttcttggccattgaacagaggagacaatggatgagaacccccaacctggcggcagcgcaaaagatg

SEQ ID NO: 231346 - DNA, 103 bp, Artificial Sequence
  Synthetic Polynucleotide
taatacgactcactatagggtgtaggctctggcccatgagtggggggttcaacagaggagagaacccatgactcatgggaacctggcggcagcgcaaaagatg

SEQ ID NO: 231347 - DNA, 103 bp, Artificial Sequence
  Synthetic Polynucleotide
taatacgactcactatagggctctgctcggtgtaggctctggcccatgagaacagaggagactcatgatgcagagcctaaacctggcggcagcgcaaaagatg

SEQ ID NO: 231348 - DNA, 103 bp, Artificial Sequence
  Synthetic Polynucleotide
taatacgactcactataggggctgcctggtctctgctcggtgtaggctctaacagaggagaagagccatgaccgagcagaacctggcggcagcgcaaaagatg

SEQ ID NO: 231349 - DNA, 103 bp, Artificial Sequence
  Synthetic Polynucleotide
taatacgactcactatagggagggccttctgctgcctggtctctgctcggaacagaggagaccgagcatggaccaggcaaacctggcggcagcgcaaaagatg

SEQ ID NO: 231350 - DNA, 103 bp, Artificial Sequence
  Synthetic Polynucleotide
taatacgactcactataggggggtcaggttagggccttctgctgcctggtaacagaggagaaccaggatgcagaaggccaacctggcggcagcgcaaaagatg

SEQ ID NO: 231351 - DNA, 103 bp, Artificial Sequence
  Synthetic Polynucleotide
taatacgactcactatagggctggcttctggggtcaggttagggccttctaacagaggagaagaaggatgtaacctgacaacctggcggcagcgcaaaagatg

SEQ ID NO: 231352 - DNA, 103 bp, Artificial Sequence
  Synthetic Polynucleotide
taatacgactcactatagggaggatctggactggcttctggggtcaggttaacagaggagaaacctgatgccagaagccaacctggcggcagcgcaaaagatg

SEQ ID NO: 231353 - DNA, 103 bp, Artificial Sequence
  Synthetic Polynucleotide
taatacgactcactataggggctcaggaagaggatctggactggcttctgaacagaggagacagaagatggtccagatcaacctggcggcagcgcaaaagatg

SEQ ID NO: 231354 - DNA, 103 bp, Artificial Sequence
  Synthetic Polynucleotide
taatacgactcactataggggtgaagaataagtggttgcttaggtccatgaacagaggagacatggaatgaagcaaccaaacctggcggcagcgcaaaagatg

SEQ ID NO: 231355 - DNA, 103 bp, Artificial Sequence
  Synthetic Polynucleotide
taatacgactcactataggggccaggggaggctcaggaagaggatctggaaacagaggagatccagaatgtcttcctgaaacctggcggcagcgcaaaagatg

SEQ ID NO: 231356 - DNA, 103 bp, Artificial Sequence
  Synthetic Polynucleotide
taatacgactcactatagggctcaactgaggccaggggaggctcaggaagaacagaggagacttcctatgcctcccctgaacctggcggcagcgcaaaagatg

SEQ ID NO: 231357 - DNA, 103 bp, Artificial Sequence
  Synthetic Polynucleotide
taatacgactcactatagggtgtctgggacctcaactgaggccaggggagaacagaggagactccccatgcctcagttgaacctggcggcagcgcaaaagatg

SEQ ID NO: 231358 - DNA, 103 bp, Artificial Sequence
  Synthetic Polynucleotide
taatacgactcactatagggcctgagggtttgtctgggacctcaactgagaacagaggagactcagtatgggtcccagaaacctggcggcagcgcaaaagatg

SEQ ID NO: 231359 - DNA, 103 bp, Artificial Sequence
  Synthetic Polynucleotide
taatacgactcactataggggccagggcttcctgagggtttgtctgggacaacagaggagagtcccaatgaaaccctcaaacctggcggcagcgcaaaagatg

SEQ ID NO: 231360 - DNA, 103 bp, Artificial Sequence
  Synthetic Polynucleotide
taatacgactcactatagggaagggggttggccagggcttcctgagggttaacagaggagaaaccctatggaagccctgaacctggcggcagcgcaaaagatg

SEQ ID NO: 231361 - DNA, 103 bp, Artificial Sequence
  Synthetic Polynucleotide
taatacgactcactatagggggggctggagaagggggttggccagggcttaacagaggagaaagcccatgccaacccccaacctggcggcagcgcaaaagatg

SEQ ID NO: 231362 - DNA, 103 bp, Artificial Sequence
  Synthetic Polynucleotide
taatacgactcactataggggactggagatggggctggagaagggggttgaacagaggagacaacccatgtctccagccaacctggcggcagcgcaaaagatg

SEQ ID NO: 231363 - DNA, 103 bp, Artificial Sequence
  Synthetic Polynucleotide
taatacgactcactatagggcaggttcagggactggagatggggctggagaacagaggagactccagatgcatctccagaacctggcggcagcgcaaaagatg

SEQ ID NO: 231364 - DNA, 103 bp, Artificial Sequence
  Synthetic Polynucleotide
taatacgactcactataggggcttgggcatcaggttcagggactggagataacagaggagaatctccatgccctgaaccaacctggcggcagcgcaaaagatg

SEQ ID NO: 231365 - DNA, 103 bp, Artificial Sequence
  Synthetic Polynucleotide
taatacgactcactatagggacctccagctgtgaagaataagtggttgctaacagaggagaagcaacatgttattcttcaacctggcggcagcgcaaaagatg

SEQ ID NO: 231366 - DNA, 103 bp, Artificial Sequence
  Synthetic Polynucleotide
taatacgactcactatagggtacgtcttcagcttgggcatcaggttcaggaacagaggagacctgaaatggatgcccaaaacctggcggcagcgcaaaagatg

SEQ ID NO: 231367 - DNA, 103 bp, Artificial Sequence
  Synthetic Polynucleotide
taatacgactcactataggggcggaggagctacgtcttcagcttgggcataacagaggagaatgcccatgctgaagacgaacctggcggcagcgcaaaagatg

SEQ ID NO: 231368 - DNA, 103 bp, Artificial Sequence
  Synthetic Polynucleotide
taatacgactcactataggggccatggtgggcggaggagctacgtcttcaaacagaggagatgaagaatgagctcctccaacctggcggcagcgcaaaagatg

SEQ ID NO: 231369 - DNA, 103 bp, Artificial Sequence
  Synthetic Polynucleotide
taatacgactcactatagggttcctcctcagccatggtgggcggaggagcaacagaggagagctcctatgcccaccatgaacctggcggcagcgcaaaagatg

SEQ ID NO: 231370 - DNA, 103 bp, Artificial Sequence
  Synthetic Polynucleotide
taatacgactcactatagggtggtcccctcttcctcctcagccatggtggaacagaggagaccaccaatgctgaggaggaacctggcggcagcgcaaaagatg

SEQ ID NO: 231371 - DNA, 103 bp, Artificial Sequence
  Synthetic Polynucleotide
taatacgactcactatagggagctccccagtggtcccctcttcctcctcaaacagaggagatgaggaatgagaggggacaacctggcggcagcgcaaaagatg

SEQ ID NO: 231372 - DNA, 103 bp, Artificial Sequence
  Synthetic Polynucleotide
taatacgactcactatagggtgcagagcggagctccccagtggtcccctcaacagaggagagaggggatgactggggagaacctggcggcagcgcaaaagatg

SEQ ID NO: 231373 - DNA, 103 bp, Artificial Sequence
  Synthetic Polynucleotide
taatacgactcactataggggagctggctctgcagagcggagctccccagaacagaggagactggggatgtccgctctgaacctggcggcagcgcaaaagatg

SEQ ID NO: 231374 - DNA, 103 bp, Artificial Sequence
  Synthetic Polynucleotide
taatacgactcactataggggagtcagctggagctggctctgcagagcggaacagaggagaccgctcatgagagccagcaacctggcggcagcgcaaaagatg

SEQ ID NO: 231375 - DNA, 103 bp, Artificial Sequence
  Synthetic Polynucleotide
taatacgactcactatagggagggtggcgagagtcagctggagctggctcaacagaggagagagccaatgccagctgacaacctggcggcagcgcaaaagatg

SEQ ID NO: 231376 - DNA, 103 bp, Artificial Sequence
  Synthetic Polynucleotide
taatacgactcactatagggggtaggcctcacctccagctgtgaagaataaacagaggagatattctatgcagctggagaacctggcggcagcgcaaaagatg

SEQ ID NO: 231377 - DNA, 103 bp, Artificial Sequence
  Synthetic Polynucleotide
taatacgactcactataggggataggtcagagggtggcgagagtcagctgaacagaggagacagctgatgctcgccaccaacctggcggcagcgcaaaagatg

SEQ ID NO: 231378 - DNA, 103 bp, Artificial Sequence
  Synthetic Polynucleotide
taatacgactcactataggggtggttttccgataggtcagagggtggcgaaacagaggagatcgccaatgtctgacctaaacctggcggcagcgcaaaagatg

SEQ ID NO: 231379 - DNA, 103 bp, Artificial Sequence
  Synthetic Polynucleotide
taatacgactcactatagggggcaaagttggtggttttccgataggtcagaacagaggagactgaccatgcggaaaaccaacctggcggcagcgcaaaagatg

SEQ ID NO: 231380 - DNA, 103 bp, Artificial Sequence
  Synthetic Polynucleotide
taatacgactcactatagggacttgtccagggcaaagttggtggttttccaacagaggagaggaaaaatgccaactttgaacctggcggcagcgcaaaagatg

SEQ ID NO: 231381 - DNA, 103 bp, Artificial Sequence
  Synthetic Polynucleotide
taatacgactcactataggggggtcgagaaacttgtccagggcaaagttgaacagaggagacaacttatgcctggacaaaacctggcggcagcgcaaaagatg

SEQ ID NO: 231382 - DNA, 103 bp, Artificial Sequence
  Synthetic Polynucleotide
taatacgactcactataggggggccgggcagggtcgagaaacttgtccagaacagaggagactggacatgtttctcgacaacctggcggcagcgcaaaagatg

SEQ ID NO: 231383 - DNA, 103 bp, Artificial Sequence
  Synthetic Polynucleotide
taatacgactcactatagggtgcacttatagggccgggcagggtcgagaaaacagaggagattctcgatgctgcccggcaacctggcggcagcgcaaaagatg

SEQ ID NO: 231384 - DNA, 103 bp, Artificial Sequence
  Synthetic Polynucleotide
taatacgactcactatagggttacacacagtgcacttatagggccgggcaaacagaggagatgcccgatgctataagtgaacctggcggcagcgcaaaagatg

SEQ ID NO: 231385 - DNA, 103 bp, Artificial Sequence
  Synthetic Polynucleotide
taatacgactcactataggggaaggactccttacacacagtgcacttataaacagaggagatataagatgactgtgtgtaacctggcggcagcgcaaaagatg

SEQ ID NO: 231386 - DNA, 103 bp, Artificial Sequence
  Synthetic Polynucleotide
taatacgactcactatagggtcttctgggtgaaggactccttacacacagaacagaggagactgtgtatgaggagtcctaacctggcggcagcgcaaaagatg

SEQ ID NO: 231387 - DNA, 103 bp, Artificial Sequence
  Synthetic Polynucleotide
taatacgactcactatagggttggccactaggtaggcctcacctccagctaacagaggagaagctggatgtgaggcctaaacctggcggcagcgcaaaagatg

SEQ ID NO: 231388 - DNA, 103 bp, Artificial Sequence
  Synthetic Polynucleotide
taatacgactcactatagggaacagaatattcttctgggtgaaggactccaacagaggagaggagtcatgcacccagaaaacctggcggcagcgcaaaagatg

SEQ ID NO: 231389 - DNA, 103 bp, Artificial Sequence
  Synthetic Polynucleotide
taatacgactcactatagggataatgaaccaacagaatattcttctgggtaacagaggagaacccagatgaatattctgaacctggcggcagcgcaaaagatg

SEQ ID NO: 231390 - DNA, 103 bp, Artificial Sequence
  Synthetic Polynucleotide
taatacgactcactatagggagacagaattataatgaaccaacagaatataacagaggagaatattcatgtggttcattaacctggcggcagcgcaaaagatg

SEQ ID NO: 231391 - DNA, 103 bp, Artificial Sequence
  Synthetic Polynucleotide
taatacgactcactatagggtgaaggtgggagacagaattataatgaaccaacagaggagaggttcaatgtaattctgtaacctggcggcagcgcaaaagatg

SEQ ID NO: 231392 - DNA, 103 bp, Artificial Sequence
  Synthetic Polynucleotide
taatacgactcactatagggcttcatcttgtgaaggtgggagacagaattaacagaggagaaattctatgtcccaccttaacctggcggcagcgcaaaagatg

SEQ ID NO: 231393 - DNA, 103 bp, Artificial Sequence
  Synthetic Polynucleotide
taatacgactcactatagggtggcagccttcttcatcttgtgaaggtgggaacagaggagacccaccatgacaagatgaaacctggcggcagcgcaaaagatg

SEQ ID NO: 231394 - DNA, 103 bp, Artificial Sequence
  Synthetic Polynucleotide
taatacgactcactataggggaggggtcaatggcagccttcttcatcttgaacagaggagacaagatatggaaggctgcaacctggcggcagcgcaaaagatg

SEQ ID NO: 231395 - DNA, 103 bp, Artificial Sequence
  Synthetic Polynucleotide
taatacgactcactatagggtgcaggggcagaggggtcaatggcagccttaacagaggagaaaggctatgattgaccccaacctggcggcagcgcaaaagatg

SEQ ID NO: 231396 - DNA, 103 bp, Artificial Sequence
  Synthetic Polynucleotide
taatacgactcactatagggcctctccccgtgcaggggcagaggggtcaaaacagaggagattgaccatgctgcccctgaacctggcggcagcgcaaaagatg

SEQ ID NO: 231397 - DNA, 103 bp, Artificial Sequence
  Synthetic Polynucleotide
taatacgactcactatagggggggcaccggcctctccccgtgcaggggcaaacagaggagatgccccatgacggggagaaacctggcggcagcgcaaaagatg

SEQ ID NO: 231398 - DNA, 103 bp, Artificial Sequence
  Synthetic Polynucleotide
taatacgactcactatagggcagggacagcttggccactaggtaggcctcaacagaggagagaggccatgctagtggccaacctggcggcagcgcaaaagatg

SEQ ID NO: 231399 - DNA, 103 bp, Artificial Sequence
  Synthetic Polynucleotide
taatacgactcactatagggggtggtgggtggggcaccggcctctccccgaacagaggagacggggaatggccggtgccaacctggcggcagcgcaaaagatg

SEQ ID NO: 231400 - DNA, 103 bp, Artificial Sequence
  Synthetic Polynucleotide
taatacgactcactatagggtggcagcagtggtggtgggtggggcaccggaacagaggagaccggtgatgcacccaccaaacctggcggcagcgcaaaagatg

SEQ ID NO: 231401 - DNA, 103 bp, Artificial Sequence
  Synthetic Polynucleotide
taatacgactcactatagggggcttgtctgtggcagcagtggtggtgggtaacagaggagaacccacatgcactgctgcaacctggcggcagcgcaaaagatg

SEQ ID NO: 231402 - DNA, 103 bp, Artificial Sequence
  Synthetic Polynucleotide
taatacgactcactataggggcacttaaagggcttgtctgtggcagcagtaacagaggagaactgctatgacagacaagaacctggcggcagcgcaaaagatg

SEQ ID NO: 231403 - DNA, 103 bp, Artificial Sequence
  Synthetic Polynucleotide
taatacgactcactatagggtgcagactgtgcacttaaagggcttgtctgaacagaggagacagacaatgcctttaagtaacctggcggcagcgcaaaagatg

SEQ ID NO: 231404 - DNA, 103 bp, Artificial Sequence
  Synthetic Polynucleotide
taatacgactcactatagggtaggagactctgcagactgtgcacttaaagaacagaggagactttaaatgcacagtctgaacctggcggcagcgcaaaagatg

SEQ ID NO: 231405 - DNA, 103 bp, Artificial Sequence
  Synthetic Polynucleotide
taatacgactcactataggggctctggttgtaggagactctgcagactgtaacagaggagaacagtcatgagagtctccaacctggcggcagcgcaaaagatg

SEQ ID NO: 231406 - DNA, 103 bp, Artificial Sequence
  Synthetic Polynucleotide
taatacgactcactatagggccagggtggagctctggttgtaggagactcaacagaggagagagtctatgacaaccagaaacctggcggcagcgcaaaagatg

SEQ ID NO: 231407 - DNA, 103 bp, Artificial Sequence
  Synthetic Polynucleotide
taatacgactcactatagggatgtggatctccagggtggagctctggttgaacagaggagacaaccaatgctccaccctaacctggcggcagcgcaaaagatg

SEQ ID NO: 231408 - DNA, 103 bp, Artificial Sequence
  Synthetic Polynucleotide
taatacgactcactatagggaactgaccgcatgtggatctccagggtggaaacagaggagatccaccatggagatccacaacctggcggcagcgcaaaagatg

SEQ ID NO: 231409 - DNA, 103 bp, Artificial Sequence
  Synthetic Polynucleotide
taatacgactcactatagggtgccacctggcagggacagcttggccactaaacagaggagatagtggatgagctgtcccaacctggcggcagcgcaaaagatg

SEQ ID NO: 231410 - DNA, 103 bp, Artificial Sequence
  Synthetic Polynucleotide
taatacgactcactatagggtctgatgcagaactgaccgcatgtggatctaacagaggagaagatccatgtgcggtcagaacctggcggcagcgcaaaagatg

SEQ ID NO: 231411 - DNA, 103 bp, Artificial Sequence
  Synthetic Polynucleotide
taatacgactcactatagggcgagagcgagtctgatgcagaactgaccgcaacagaggagagcggtcatgtctgcatcaaacctggcggcagcgcaaaagatg

SEQ ID NO: 231412 - DNA, 103 bp, Artificial Sequence
  Synthetic Polynucleotide
taatacgactcactatagggcttggttccccgagagcgagtctgatgcagaacagaggagactgcatatgactcgctctaacctggcggcagcgcaaaagatg

SEQ ID NO: 231413 - DNA, 103 bp, Artificial Sequence
  Synthetic Polynucleotide
taatacgactcactatagggtggaatcagtcttggttccccgagagcgagaacagaggagactcgctatgggggaaccaaacctggcggcagcgcaaaagatg

SEQ ID NO: 231414 - DNA, 103 bp, Artificial Sequence
  Synthetic Polynucleotide
taatacgactcactatagggccttcaatcttggaatcagtcttggttcccaacagaggagagggaacatggactgattcaacctggcggcagcgcaaaagatg

SEQ ID NO: 231415 - DNA, 103 bp, Artificial Sequence
  Synthetic Polynucleotide
taatacgactcactataggggcgttctggcccttcaatcttggaatcagtaacagaggagaactgatatgaagattgaaaacctggcggcagcgcaaaagatg

SEQ ID NO: 231416 - DNA, 103 bp, Artificial Sequence
  Synthetic Polynucleotide
taatacgactcactatagggcttcttggctgcgttctggcccttcaatctaacagaggagaagattgatgggccagaacaacctggcggcagcgcaaaagatg

SEQ ID NO: 231417 - DNA, 103 bp, Artificial Sequence
  Synthetic Polynucleotide
taatacgactcactatagggtccttgggctcttcttggctgcgttctggcaacagaggagagccagaatgcagccaagaaacctggcggcagcgcaaaagatg

SEQ ID NO: 231418 - DNA, 103 bp, Artificial Sequence
  Synthetic Polynucleotide
taatacgactcactatagggtgtctcgccttccttgggctcttcttggctaacagaggagaagccaaatggagcccaagaacctggcggcagcgcaaaagatg

SEQ ID NO: 231419 - DNA, 103 bp, Artificial Sequence
  Synthetic Polynucleotide
taatacgactcactatagggcctccccctctgtctcgccttccttgggctaacagaggagaagcccaatgaaggcgagaaacctggcggcagcgcaaaagatg

SEQ ID NO: 231420 - DNA, 103 bp, Artificial Sequence
  Synthetic Polynucleotide
taatacgactcactatagggaggagttcactgccacctggcagggacagcaacagaggagagctgtcatggccaggtggaacctggcggcagcgcaaaagatg

SEQ ID NO: 231421 - DNA, 103 bp, Artificial Sequence
  Synthetic Polynucleotide
taatacgactcactatagggtcagtgcccacctccccctctgtctcgcctaacagaggagaaggcgaatgagagggggaaacctggcggcagcgcaaaagatg

SEQ ID NO: 231422 - DNA, 103 bp, Artificial Sequence
  Synthetic Polynucleotide
taatacgactcactataggggcccttcttctcagtgcccacctccccctcaacagaggagagaggggatggtgggcactaacctggcggcagcgcaaaagatg

SEQ ID NO: 231423 - DNA, 103 bp, Artificial Sequence
  Synthetic Polynucleotide
taatacgactcactatagggtggtgtcagggcccttcttctcagtgcccaaacagaggagatgggcaatgagaagaaggaacctggcggcagcgcaaaagatg

SEQ ID NO: 231424 - DNA, 103 bp, Artificial Sequence
  Synthetic Polynucleotide
taatacgactcactatagggatgaagccactggtgtcagggcccttcttcaacagaggagagaagaaatgccctgacacaacctggcggcagcgcaaaagatg

SEQ ID NO: 231425 - DNA, 103 bp, Artificial Sequence
  Synthetic Polynucleotide
taatacgactcactatagggcaatccagatatgaagccactggtgtcaggaacagaggagacctgacatgagtggcttcaacctggcggcagcgcaaaagatg

SEQ ID NO: 231426 - DNA, 103 bp, Artificial Sequence
  Synthetic Polynucleotide
taatacgactcactatagggacaggaaaggcaatccagatatgaagccacaacagaggagagtggctatgtatctggataacctggcggcagcgcaaaagatg

SEQ ID NO: 231427 - DNA, 103 bp, Artificial Sequence
  Synthetic Polynucleotide
taatacgactcactataggggggggaggggacaggaaaggcaatccagataacagaggagaatctggatggcctttcctaacctggcggcagcgcaaaagatg

SEQ ID NO: 231428 - DNA, 103 bp, Artificial Sequence
  Synthetic Polynucleotide
taatacgactcactatagggcaagggaggtgggggaggggacaggaaaggaacagaggagacctttcatgtcccctcccaacctggcggcagcgcaaaagatg

SEQ ID NO: 231429 - DNA, 103 bp, Artificial Sequence
  Synthetic Polynucleotide
taatacgactcactatagggggtgcaggtccaagggaggtgggggaggggaacagaggagacccctcatgcacctccctaacctggcggcagcgcaaaagatg

SEQ ID NO: 231430 - DNA, 103 bp, Artificial Sequence
  Synthetic Polynucleotide
taatacgactcactataggggctgggaatcggtgcaggtccaagggaggtaacagaggagaacctccatgggacctgcaaacctggcggcagcgcaaaagatg

SEQ ID NO: 231431 - DNA, 103 bp, Artificial Sequence
  Synthetic Polynucleotide
taatacgactcactatagggggcattgtgcccaggggagggggtggtaccaacagaggagaggtaccatgccctcccctaacctggcggcagcgcaaaagatg

SEQ ID NO: 231432 - DNA, 103 bp, Artificial Sequence
  Synthetic Polynucleotide
taatacgactcactatagggctttggtaacaggagttcactgccacctggaacagaggagaccaggtatgagtgaactcaacctggcggcagcgcaaaagatg

SEQ ID NO: 231433 - DNA, 103 bp, Artificial Sequence
  Synthetic Polynucleotide
taatacgactcactataggggaagagaggggctgggaatcggtgcaggtcaacagaggagagacctgatgcgattcccaaacctggcggcagcgcaaaagatg

SEQ ID NO: 231434 - DNA, 103 bp, Artificial Sequence
  Synthetic Polynucleotide
taatacgactcactatagggctggtggggtgaagagaggggctgggaatcaacagaggagagattccatgcccctctctaacctggcggcagcgcaaaagatg

SEQ ID NO: 231435 - DNA, 103 bp, Artificial Sequence
  Synthetic Polynucleotide
taatacgactcactataggggggggcaggactggtggggtgaagagagggaacagaggagaccctctatgcaccccaccaacctggcggcagcgcaaaagatg

SEQ ID NO: 231436 - DNA, 103 bp, Artificial Sequence
  Synthetic Polynucleotide
taatacgactcactatagggcagagggaaggggggcaggactggtggggtaacagaggagaaccccaatggtcctgcccaacctggcggcagcgcaaaagatg

SEQ ID NO: 231437 - DNA, 103 bp, Artificial Sequence
  Synthetic Polynucleotide
taatacgactcactatagggattcgggcaccagagggaaggggggcaggaaacagaggagatcctgcatgccttccctcaacctggcggcagcgcaaaagatg

SEQ ID NO: 231438 - DNA, 103 bp, Artificial Sequence
  Synthetic Polynucleotide
taatacgactcactatagggttaagcagtgattcgggcaccagagggaagaacagaggagacttcccatgggtgcccgaaacctggcggcagcgcaaaagatg

SEQ ID NO: 231439 - DNA, 103 bp, Artificial Sequence
  Synthetic Polynucleotide
taatacgactcactatagggctgctggagcttaagcagtgattcgggcacaacagaggagagtgcccatgtcactgcttaacctggcggcagcgcaaaagatg

SEQ ID NO: 231440 - DNA, 103 bp, Artificial Sequence
  Synthetic Polynucleotide
taatacgactcactataggggcagctgctgctgctggagcttaagcagtgaacagaggagacactgcatgagctccagcaacctggcggcagcgcaaaagatg

SEQ ID NO: 231441 - DNA, 103 bp, Artificial Sequence
  Synthetic Polynucleotide
taatacgactcactatagggaagggcaggagcagctgctgctgctggagcaacagaggagagctccaatggcagcagctaacctggcggcagcgcaaaagatg

SEQ ID NO: 231442 - DNA, 103 bp, Artificial Sequence
  Synthetic Polynucleotide
taatacgactcactataggggtggaggtagaagggcaggagcagctgctgaacagaggagacagcagatgctcctgcccaacctggcggcagcgcaaaagatg

SEQ ID NO: 231443 - DNA, 103 bp, Artificial Sequence
  Synthetic Polynucleotide
taatacgactcactatagggaggggaagccctttggtaacaggagttcacaacagaggagagtgaacatgtgttaccaaaacctggcggcagcgcaaaagatg

SEQ ID NO: 231444 - DNA, 103 bp, Artificial Sequence
  Synthetic Polynucleotide
taatacgactcactatagggccttgagatcgtggaggtagaagggcaggaaacagaggagatcctgcatgtctacctccaacctggcggcagcgcaaaagatg

SEQ ID NO: 231445 - DNA, 103 bp, Artificial Sequence
  Synthetic Polynucleotide
taatacgactcactatagggttgggccccaccttgagatcgtggaggtagaacagaggagactacctatgcgatctcaaaacctggcggcagcgcaaaagatg

SEQ ID NO: 231446 - DNA, 103 bp, Artificial Sequence
  Synthetic Polynucleotide
taatacgactcactatagggtagtgtcagcttgggccccaccttgagatcaacagaggagagatctcatggtggggcccaacctggcggcagcgcaaaagatg

SEQ ID NO: 231447 - DNA, 103 bp, Artificial Sequence
  Synthetic Polynucleotide
taatacgactcactatagggcaggcccagctagtgtcagcttgggccccaaacagaggagatggggcatgagctgacacaacctggcggcagcgcaaaagatg

SEQ ID NO: 231448 - DNA, 103 bp, Artificial Sequence
  Synthetic Polynucleotide
taatacgactcactatagggagcacaggtgcaggcccagctagtgtcagcaacagaggagagctgacatgagctgggccaacctggcggcagcgcaaaagatg

SEQ ID NO: 231449 - DNA, 103 bp, Artificial Sequence
  Synthetic Polynucleotide
taatacgactcactatagggtggcagggacagcacaggtgcaggcccagcaacagaggagagctgggatggcacctgtgaacctggcggcagcgcaaaagatg

SEQ ID NO: 231450 - DNA, 103 bp, Artificial Sequence
  Synthetic Polynucleotide
taatacgactcactataggggggtggcagctggcagggacagcacaggtgaacagaggagacacctgatgtgtccctgcaacctggcggcagcgcaaaagatg

SEQ ID NO: 231451 - DNA, 103 bp, Artificial Sequence
  Synthetic Polynucleotide
taatacgactcactatagggggaggaggaggggtggcagctggcagggacaacagaggagagtccctatgagctgccacaacctggcggcagcgcaaaagatg

SEQ ID NO: 231452 - DNA, 103 bp, Artificial Sequence
  Synthetic Polynucleotide
taatacgactcactatagggaggttggggtggaggaggaggggtggcagcaacagaggagagctgccatgcctcctcctaacctggcggcagcgcaaaagatg

SEQ ID NO: 231453 - DNA, 103 bp, Artificial Sequence
  Synthetic Polynucleotide
taatacgactcactatagggcagccttgggaggttggggtggaggaggagaacagaggagactcctcatgcaccccaacaacctggcggcagcgcaaaagatg

SEQ ID NO: 231454 - DNA, 103 bp, Artificial Sequence
  Synthetic Polynucleotide
taatacgactcactataggggcctcaccccaggggaagccctttggtaacaacagaggagagttaccatggggcttcccaacctggcggcagcgcaaaagatg

SEQ ID NO: 231455 - DNA, 103 bp, Artificial Sequence
  Synthetic Polynucleotide
taatacgactcactatagggtcagccagctcagccttgggaggttggggtaacagaggagaaccccaatgtcccaaggcaacctggcggcagcgcaaaagatg

SEQ ID NO: 231456 - DNA, 103 bp, Artificial Sequence
  Synthetic Polynucleotide
taatacgactcactatagggccactcccgctcagccagctcagccttgggaacagaggagacccaagatggagctggctaacctggcggcagcgcaaaagatg

SEQ ID NO: 231457 - DNA, 103 bp, Artificial Sequence
  Synthetic Polynucleotide
taatacgactcactatagggggggccgctcccactcccgctcagccagctaacagaggagaagctggatgagcgggagtaacctggcggcagcgcaaaagatg

SEQ ID NO: 231458 - DNA, 103 bp, Artificial Sequence
  Synthetic Polynucleotide
taatacgactcactatagggttggccatggggggccgctcccactcccgcaacagaggagagcgggaatgggagcggccaacctggcggcagcgcaaaagatg

SEQ ID NO: 231459 - DNA, 103 bp, Artificial Sequence
  Synthetic Polynucleotide
taatacgactcactatagggattaccctctttggccatggggggccgctcaacagaggagagagcggatgcccatggccaacctggcggcagcgcaaaagatg

SEQ ID NO: 231460 - DNA, 103 bp, Artificial Sequence
  Synthetic Polynucleotide
taatacgactcactataggggccctgcctcattaccctctttggccatggaacagaggagaccatggatgaagagggtaaacctggcggcagcgcaaaagatg

SEQ ID NO: 231461 - DNA, 103 bp, Artificial Sequence
  Synthetic Polynucleotide
taatacgactcactatagggggtgaggaaggccctgcctcattaccctctaacagaggagaagagggatgtgaggcaggaacctggcggcagcgcaaaagatg

SEQ ID NO: 231462 - DNA, 103 bp, Artificial Sequence
  Synthetic Polynucleotide
taatacgactcactatagggtgggtcggggggtgaggaaggccctgcctcaacagaggagagaggcaatgccttcctcaaacctggcggcagcgcaaaagatg

SEQ ID NO: 231463 - DNA, 103 bp, Artificial Sequence
  Synthetic Polynucleotide
taatacgactcactatagggcgttgggcaatgggtcggggggtgaggaagaacagaggagacttcctatgcccccgaccaacctggcggcagcgcaaaagatg

SEQ ID NO: 231464 - DNA, 103 bp, Artificial Sequence
  Synthetic Polynucleotide
taatacgactcactatagggcgggcagcctcgttgggcaatgggtcggggaacagaggagaccccgaatgattgcccaaaacctggcggcagcgcaaaagatg

SEQ ID NO: 231465 - DNA, 103 bp, Artificial Sequence
  Synthetic Polynucleotide
taatacgactcactatagggcttgatgcccgcctcaccccaggggaagccaacagaggagaggcttcatgtggggtgagaacctggcggcagcgcaaaagatg

SEQ ID NO: 231466 - DNA, 103 bp, Artificial Sequence
  Synthetic Polynucleotide
taatacgactcactatagggggctgcagtgcgggcagcctcgttgggcaaaacagaggagattgcccatggaggctgccaacctggcggcagcgcaaaagatg

SEQ ID NO: 231467 - DNA, 103 bp, Artificial Sequence
  Synthetic Polynucleotide
taatacgactcactataggggaagggctttggctgcagtgcgggcagcctaacagaggagaaggctgatggcactgcagaacctggcggcagcgcaaaagatg

SEQ ID NO: 231468 - DNA, 103 bp, Artificial Sequence
  Synthetic Polynucleotide
taatacgactcactatagggaagttttctagaagggctttggctgcagtgaacagaggagacactgcatgcaaagccctaacctggcggcagcgcaaaagatg

SEQ ID NO: 231469 - DNA, 103 bp, Artificial Sequence
  Synthetic Polynucleotide
taatacgactcactatagggctcaaagccaaagttttctagaagggctttaacagaggagaaaagccatgctagaaaacaacctggcggcagcgcaaaagatg

SEQ ID NO: 231470 - DNA, 103 bp, Artificial Sequence
  Synthetic Polynucleotide
taatacgactcactatagggggatcaccagctcaaagccaaagttttctaaacagaggagatagaaaatgttggctttgaacctggcggcagcgcaaaagatg

SEQ ID NO: 231471 - DNA, 103 bp, Artificial Sequence
  Synthetic Polynucleotide
taatacgactcactatagggtcattgtactggatcaccagctcaaagccaaacagaggagatggcttatggctggtgataacctggcggcagcgcaaaagatg

SEQ ID NO: 231472 - DNA, 103 bp, Artificial Sequence
  Synthetic Polynucleotide
taatacgactcactatagggttgcttcccttcattgtactggatcaccagaacagaggagactggtgatgcagtacaataacctggcggcagcgcaaaagatg

SEQ ID NO: 231473 - DNA, 103 bp, Artificial Sequence
  Synthetic Polynucleotide
taatacgactcactatagggggggcacagcttgcttcccttcattgtactaacagaggagaagtacaatgaagggaagcaacctggcggcagcgcaaaagatg

SEQ ID NO: 231474 - DNA, 103 bp, Artificial Sequence
  Synthetic Polynucleotide
taatacgactcactataggggtagggggagggggcacagcttgcttccctaacagaggagaagggaaatgagctgtgccaacctggcggcagcgcaaaagatg

SEQ ID NO: 231475 - DNA, 103 bp, Artificial Sequence
  Synthetic Polynucleotide
taatacgactcactatagggtgggggtggggtagggggagggggcacagcaacagaggagagctgtgatgcctccccctaacctggcggcagcgcaaaagatg

SEQ ID NO: 231476 - DNA, 103 bp, Artificial Sequence
  Synthetic Polynucleotide
taatacgactcactatagggtgggctcttccttgatgcccgcctcaccccaacagaggagaggggtgatgcgggcatcaaacctggcggcagcgcaaaagatg

SEQ ID NO: 231477 - DNA, 103 bp, Artificial Sequence
  Synthetic Polynucleotide
taatacgactcactataggggggcctcaggtgggggtggggtagggggagaacagaggagactccccatgccccaccccaacctggcggcagcgcaaaagatg

SEQ ID NO: 231478 - DNA, 103 bp, Artificial Sequence
  Synthetic Polynucleotide
taatacgactcactatagggccacccccgagggcctcaggtgggggtgggaacagaggagacccaccatgacctgaggcaacctggcggcagcgcaaaagatg

SEQ ID NO: 231479 - DNA, 103 bp, Artificial Sequence
  Synthetic Polynucleotide
taatacgactcactatagggcagcttgtccccacccccgagggcctcaggaacagaggagacctgagatgctcgggggtaacctggcggcagcgcaaaagatg

SEQ ID NO: 231480 - DNA, 103 bp, Artificial Sequence
  Synthetic Polynucleotide
taatacgactcactatagggccccacaggccagcttgtccccacccccgaaacagaggagatcggggatggggacaagcaacctggcggcagcgcaaaagatg

SEQ ID NO: 231481 - DNA, 103 bp, Artificial Sequence
  Synthetic Polynucleotide
taatacgactcactatagggttcccacaggccccacaggccagcttgtccaacagaggagaggacaaatgggcctgtggaacctggcggcagcgcaaaagatg

SEQ ID NO: 231482 - DNA, 103 bp, Artificial Sequence
  Synthetic Polynucleotide
taatacgactcactatagggggagaagagtttcccacaggccccacaggcaacagaggagagcctgtatggcctgtgggaacctggcggcagcgcaaaagatg

SEQ ID NO: 231483 - DNA, 103 bp, Artificial Sequence
  Synthetic Polynucleotide
taatacgactcactatagggtaagcatattggagaagagtttcccacaggaacagaggagacctgtgatgaactcttctaacctggcggcagcgcaaaagatg

SEQ ID NO: 231484 - DNA, 103 bp, Artificial Sequence
  Synthetic Polynucleotide
taatacgactcactataggggtcttgaggataagcatattggagaagagtaacagaggagaactcttatgcaatatgctaacctggcggcagcgcaaaagatg

SEQ ID NO: 231485 - DNA, 103 bp, Artificial Sequence
  Synthetic Polynucleotide
taatacgactcactatagggttcctcgtgtgtcttgaggataagcatattaacagaggagaaatatgatgatcctcaagaacctggcggcagcgcaaaagatg

SEQ ID NO: 231486 - DNA, 103 bp, Artificial Sequence
  Synthetic Polynucleotide
taatacgactcactatagggggtggacatgttcctcgtgtgtcttgaggaaacagaggagatcctcaatgcacacgaggaacctggcggcagcgcaaaagatg

SEQ ID NO: 231487 - DNA, 103 bp, Artificial Sequence
  Synthetic Polynucleotide
taatacgactcactatagggaagggcagactgggctcttccttgatgcccaacagaggagagggcatatgggaagagccaacctggcggcagcgcaaaagatg

SEQ ID NO: 231488 - DNA, 103 bp, Artificial Sequence
  Synthetic Polynucleotide
taatacgactcactatagggagaaagcggcggtggacatgttcctcgtgtaacagaggagaacacgaatgacatgtccaaacctggcggcagcgcaaaagatg

SEQ ID NO: 231489 - DNA, 103 bp, Artificial Sequence
  Synthetic Polynucleotide
taatacgactcactatagggttcaaagggcagaaagcggcggtggacatgaacagaggagacatgtcatgcgccgctttaacctggcggcagcgcaaaagatg

SEQ ID NO: 231490 - DNA, 103 bp, Artificial Sequence
  Synthetic Polynucleotide
taatacgactcactatagggggctcagggcttcaaagggcagaaagcggcaacagaggagagccgctatgtgccctttgaacctggcggcagcgcaaaagatg

SEQ ID NO: 231491 - DNA, 103 bp, Artificial Sequence
  Synthetic Polynucleotide
taatacgactcactataggggcagcataacggctcagggcttcaaagggcaacagaggagagcccttatgagccctgagaacctggcggcagcgcaaaagatg

SEQ ID NO: 231492 - DNA, 103 bp, Artificial Sequence
  Synthetic Polynucleotide
taatacgactcactatagggtcgaaactgagcagcataacggctcagggcaacagaggagagccctgatgcgttatgctaacctggcggcagcgcaaaagatg

SEQ ID NO: 231493 - DNA, 103 bp, Artificial Sequence
  Synthetic Polynucleotide
taatacgactcactatagggcatagctctttcgaaactgagcagcataacaacagaggagagttatgatgctcagtttcaacctggcggcagcgcaaaagatg

SEQ ID NO: 231494 - DNA, 103 bp, Artificial Sequence
  Synthetic Polynucleotide
taatacgactcactatagggtataggctgtcatagctctttcgaaactgaaacagaggagatcagttatgaaagagctaaacctggcggcagcgcaaaagatg

SEQ ID NO: 231495 - DNA, 103 bp, Artificial Sequence
  Synthetic Polynucleotide
taatacgactcactatagggaaggggcgggtataggctgtcatagctcttaacagaggagaaagagcatggacagcctaaacctggcggcagcgcaaaagatg

SEQ ID NO: 231496 - DNA, 103 bp, Artificial Sequence
  Synthetic Polynucleotide
taatacgactcactataggggaggctctgcaaggggcgggtataggctgtaacagaggagaacagccatgacccgccccaacctggcggcagcgcaaaagatg

SEQ ID NO: 231497 - DNA, 103 bp, Artificial Sequence
  Synthetic Polynucleotide
taatacgactcactatagggggaggtttgggaggctctgcaaggggcgggaacagaggagacccgccatgtgcagagccaacctggcggcagcgcaaaagatg

SEQ ID NO: 231498 - DNA, 103 bp, Artificial Sequence
  Synthetic Polynucleotide
taatacgactcactataggggtaggcaaggaagggcagactgggctcttcaacagaggagagaagagatgagtctgcccaacctggcggcagcgcaaaagatg

SEQ ID NO: 231499 - DNA, 103 bp, Artificial Sequence
  Synthetic Polynucleotide
taatacgactcactatagggagacccatcaggaggtttgggaggctctgcaacagaggagagcagagatgcccaaacctaacctggcggcagcgcaaaagatg

SEQ ID NO: 231500 - DNA, 103 bp, Artificial Sequence
  Synthetic Polynucleotide
taatacgactcactataggggtgaatccagagacccatcaggaggtttggaacagaggagaccaaacatgctgatgggtaacctggcggcagcgcaaaagatg

SEQ ID NO: 231501 - DNA, 103 bp, Artificial Sequence
  Synthetic Polynucleotide
taatacgactcactatagggtggggaacaggtgaatccagagacccatcaaacagaggagatgatggatgtctggattcaacctggcggcagcgcaaaagatg

SEQ ID NO: 231502 - DNA, 103 bp, Artificial Sequence
  Synthetic Polynucleotide
taatacgactcactatagggtgggcccagatggggaacaggtgaatccagaacagaggagactggatatgcctgttcccaacctggcggcagcgcaaaagatg

SEQ ID NO: 231503 - DNA, 103 bp, Artificial Sequence
  Synthetic Polynucleotide
taatacgactcactatagggccaggaagggtgggcccagatggggaacagaacagaggagactgttcatgatctgggccaacctggcggcagcgcaaaagatg

SEQ ID NO: 231504 - DNA, 103 bp, Artificial Sequence
  Synthetic Polynucleotide
taatacgactcactatagggggctctgggaccaggaagggtgggcccagaaacagaggagatctgggatgacccttcctaacctggcggcagcgcaaaagatg

SEQ ID NO: 231505 - DNA, 103 bp, Artificial Sequence
  Synthetic Polynucleotide
taatacgactcactatagggccctgcctcaggctctgggaccaggaagggaacagaggagacccttcatggtcccagagaacctggcggcagcgcaaaagatg

SEQ ID NO: 231506 - DNA, 103 bp, Artificial Sequence
  Synthetic Polynucleotide
taatacgactcactatagggcacgggtcccccctgcctcaggctctgggaaacagaggagatcccagatgctgaggcagaacctggcggcagcgcaaaagatg

SEQ ID NO: 231507 - DNA, 103 bp, Artificial Sequence
  Synthetic Polynucleotide
taatacgactcactatagggtcttcaggggcacgggtcccccctgcctcaaacagaggagatgaggcatgggggacccgaacctggcggcagcgcaaaagatg

SEQ ID NO: 231508 - DNA, 103 bp, Artificial Sequence
  Synthetic Polynucleotide
taatacgactcactatagggtcgacttcgctcttcaggggcacgggtcccaacagaggagagggaccatggcccctgaaaacctggcggcagcgcaaaagatg

SEQ ID NO: 231509 - DNA, 103 bp, Artificial Sequence
  Synthetic Polynucleotide
taatacgactcactatagggaggggggtgggtaggcaaggaagggcagacaacagaggagagtctgcatgtccttgcctaacctggcggcagcgcaaaagatg

SEQ ID NO: 231510 - DNA, 103 bp, Artificial Sequence
  Synthetic Polynucleotide
taatacgactcactataggggtccccctgctcgacttcgctcttcaggggaacagaggagacccctgatgagcgaagtcaacctggcggcagcgcaaaagatg

SEQ ID NO: 231511 - DNA, 103 bp, Artificial Sequence
  Synthetic Polynucleotide
taatacgactcactatagggatgggccagtgtccccctgctcgacttcgcaacagaggagagcgaagatgagcagggggaacctggcggcagcgcaaaagatg

SEQ ID NO: 231512 - DNA, 103 bp, Artificial Sequence
  Synthetic Polynucleotide
taatacgactcactatagggttcctcttctatgggccagtgtccccctgcaacagaggagagcagggatgcactggcccaacctggcggcagcgcaaaagatg

SEQ ID NO: 231513 - DNA, 103 bp, Artificial Sequence
  Synthetic Polynucleotide
taatacgactcactatagggtggagctttcttcctcttctatgggccagtaacagaggagaactggcatgtagaagaggaacctggcggcagcgcaaaagatg

SEQ ID NO: 231514 - DNA, 103 bp, Artificial Sequence
  Synthetic Polynucleotide
taatacgactcactatagggagattccctctggagctttcttcctcttctaacagaggagaagaagaatgagaaagctcaacctggcggcagcgcaaaagatg

SEQ ID NO: 231515 - DNA, 103 bp, Artificial Sequence
  Synthetic Polynucleotide
taatacgactcactatagggcaggggaggaagattccctctggagctttcaacagaggagagaaagcatgagagggaataacctggcggcagcgcaaaagatg

SEQ ID NO: 231516 - DNA, 103 bp, Artificial Sequence
  Synthetic Polynucleotide
taatacgactcactatagggcggcaggcaccaggggaggaagattccctcaacagaggagagagggaatgttcctccccaacctggcggcagcgcaaaagatg

SEQ ID NO: 231517 - DNA, 103 bp, Artificial Sequence
  Synthetic Polynucleotide
taatacgactcactatagggaaccggcggccggcaggcaccaggggaggaaacagaggagatcctccatgggtgcctgcaacctggcggcagcgcaaaagatg

SEQ ID NO: 231518 - DNA, 103 bp, Artificial Sequence
  Synthetic Polynucleotide
taatacgactcactatagggggttctggagaaccggcggccggcaggcacaacagaggagagtgcctatgggccgccggaacctggcggcagcgcaaaagatg

SEQ ID NO: 231519 - DNA, 103 bp, Artificial Sequence
  Synthetic Polynucleotide
taatacgactcactatagggctgtgaacttggttctggagaaccggcggcaacagaggagagccgccatgtctccagaaaacctggcggcagcgcaaaagatg

SEQ ID NO: 231520 - DNA, 103 bp, Artificial Sequence
  Synthetic Polynucleotide
taatacgactcactataggggtgaggtgtgaggggggtgggtaggcaaggaacagaggagaccttgcatgcccacccccaacctggcggcagcgcaaaagatg

SEQ ID NO: 231521 - DNA, 103 bp, Artificial Sequence
  Synthetic Polynucleotide
taatacgactcactataggggtctggaactctgtgaacttggttctggagaacagaggagactccagatgcaagttcacaacctggcggcagcgcaaaagatg

SEQ ID NO: 231522 - DNA, 103 bp, Artificial Sequence
  Synthetic Polynucleotide
taatacgactcactatagggcagggcttgggtctggaactctgtgaacttaacagaggagaaagttcatggagttccagaacctggcggcagcgcaaaagatg

SEQ ID NO: 231523 - DNA, 103 bp, Artificial Sequence
  Synthetic Polynucleotide
taatacgactcactatagggagaaagactgcagggcttgggtctggaactaacagaggagaagttccatgcccaagcccaacctggcggcagcgcaaaagatg

SEQ ID NO: 231524 - DNA, 103 bp, Artificial Sequence
  Synthetic Polynucleotide
taatacgactcactatagggctagtctcaaagaaagactgcagggcttggaacagaggagaccaagcatggcagtctttaacctggcggcagcgcaaaagatg

SEQ ID NO: 231525 - DNA, 103 bp, Artificial Sequence
  Synthetic Polynucleotide
taatacgactcactatagggggggtaggcgctagtctcaaagaaagactgaacagaggagacagtctatgtttgagactaacctggcggcagcgcaaaagatg

SEQ ID NO: 231526 - DNA, 103 bp, Artificial Sequence
  Synthetic Polynucleotide
taatacgactcactatagggctccgtctttggggtaggcgctagtctcaaaacagaggagattgagaatggcgcctaccaacctggcggcagcgcaaaagatg

SEQ ID NO: 231527 - DNA, 103 bp, Artificial Sequence
  Synthetic Polynucleotide
taatacgactcactatagggcgctccacctctccgtctttggggtaggcgaacagaggagacgcctaatgcaaagacggaacctggcggcagcgcaaaagatg

SEQ ID NO: 231528 - DNA, 103 bp, Artificial Sequence
  Synthetic Polynucleotide
taatacgactcactatagggacttgcgagtcgctccacctctccgtctttaacagaggagaaaagacatggaggtggagaacctggcggcagcgcaaaagatg

SEQ ID NO: 231529 - DNA, 103 bp, Artificial Sequence
  Synthetic Polynucleotide
taatacgactcactataggggacccaacagacttgcgagtcgctccacctaacagaggagaaggtggatggactcgcaaaacctggcggcagcgcaaaagatg

SEQ ID NO: 231530 - DNA, 103 bp, Artificial Sequence
  Synthetic Polynucleotide
taatacgactcactatagggcggctagccagacccaacagacttgcgagtaacagaggagaactcgcatgtctgttgggaacctggcggcagcgcaaaagatg

SEQ ID NO: 231531 - DNA, 103 bp, Artificial Sequence
  Synthetic Polynucleotide
taatacgactcactataggggtgaagggcagtgaggtgtgaggggggtggaacagaggagaccacccatgtcacacctcaacctggcggcagcgcaaaagatg

SEQ ID NO: 231532 - DNA, 103 bp, Artificial Sequence
  Synthetic Polynucleotide
taatacgactcactatagggcaccaccacacggctagccagacccaacagaacagaggagactgttgatgctggctagcaacctggcggcagcgcaaaagatg

SEQ ID NO: 231533 - DNA, 103 bp, Artificial Sequence
  Synthetic Polynucleotide
taatacgactcactatagggggaaccacaccaccaccacacggctagccaaacagaggagatggctaatggtgtggtggaacctggcggcagcgcaaaagatg

SEQ ID NO: 231534 - DNA, 103 bp, Artificial Sequence
  Synthetic Polynucleotide
taatacgactcactatagggcgggcattctggaaccacaccaccaccacaaacagaggagatgtggtatgggtgtggttaacctggcggcagcgcaaaagatg

SEQ ID NO: 231535 - DNA, 103 bp, Artificial Sequence
  Synthetic Polynucleotide
taatacgactcactatagggtgctttctggcgggcattctggaaccacacaacagaggagagtgtggatgcagaatgccaacctggcggcagcgcaaaagatg

SEQ ID NO: 231536 - DNA, 103 bp, Artificial Sequence
  Synthetic Polynucleotide
taatacgactcactatagggcatttttgcgtgctttctggcgggcattctaacagaggagaagaatgatggccagaaagaacctggcggcagcgcaaaagatg

SEQ ID NO: 231537 - DNA, 103 bp, Artificial Sequence
  Synthetic Polynucleotide
taatacgactcactatagggccctcacaggcatttttgcgtgctttctggaacagaggagaccagaaatgacgcaaaaaaacctggcggcagcgcaaaagatg

SEQ ID NO: 231538 - DNA, 103 bp, Artificial Sequence
  Synthetic Polynucleotide
taatacgactcactatagggcatggacccaccctcacaggcatttttgcgaacagaggagacgcaaaatggcctgtgagaacctggcggcagcgcaaaagatg

SEQ ID NO: 231539 - DNA, 103 bp, Artificial Sequence
  Synthetic Polynucleotide
taatacgactcactatagggctccggttggcatggacccaccctcacaggaacagaggagacctgtgatggtgggtccaaacctggcggcagcgcaaaagatg

SEQ ID NO: 231540 - DNA, 103 bp, Artificial Sequence
  Synthetic Polynucleotide
taatacgactcactatagggccagtgcctcctccggttggcatggacccaaacagaggagatgggtcatggccaaccggaacctggcggcagcgcaaaagatg

SEQ ID NO: 231541 - DNA, 103 bp, Artificial Sequence
  Synthetic Polynucleotide
taatacgactcactatagggggaggctcccccagtgcctcctccggttggaacagaggagaccaaccatgggaggcactaacctggcggcagcgcaaaagatg

SEQ ID NO: 231542 - DNA, 103 bp, Artificial Sequence
  Synthetic Polynucleotide
taatacgactcactataggggcagggacggggcattgtgcccaggggaggaacagaggagacctcccatgggcacaatgaacctggcggcagcgcaaaagatg

SEQ ID NO: 231543 - DNA, 103 bp, Artificial Sequence
  Synthetic Polynucleotide
taatacgactcactatagggcatgttggatgtgaagggcagtgaggtgtgaacagaggagacacaccatgctgcccttcaacctggcggcagcgcaaaagatg

SEQ ID NO: 231544 - DNA, 103 bp, Artificial Sequence
  Synthetic Polynucleotide
taatacgactcactataggggcctgcagccggaggctcccccagtgcctcaacagaggagagaggcaatgggggagcctaacctggcggcagcgcaaaagatg

SEQ ID NO: 231545 - DNA, 103 bp, Artificial Sequence
  Synthetic Polynucleotide
taatacgactcactataggggcgtggcaacgcctgcagccggaggctcccaacagaggagagggagcatgcggctgcagaacctggcggcagcgcaaaagatg

SEQ ID NO: 231546 - DNA, 103 bp, Artificial Sequence
  Synthetic Polynucleotide
taatacgactcactatagggggagaaagtggcgtggcaacgcctgcagccaacagaggagaggctgcatgcgttgccacaacctggcggcagcgcaaaagatg

SEQ ID NO: 231547 - DNA, 103 bp, Artificial Sequence
  Synthetic Polynucleotide
taatacgactcactatagggcaaaaacacaggagaaagtggcgtggcaacaacagaggagagttgccatgccactttctaacctggcggcagcgcaaaagatg

SEQ ID NO: 231548 - DNA, 103 bp, Artificial Sequence
  Synthetic Polynucleotide
taatacgactcactatagggcgcaccaactcaaaaacacaggagaaagtgaacagaggagacactttatgctgtgttttaacctggcggcagcgcaaaagatg

SEQ ID NO: 231549 - DNA, 103 bp, Artificial Sequence
  Synthetic Polynucleotide
taatacgactcactatagggcttgaggtggcgcaccaactcaaaaacacaaacagaggagatgtgttatggagttggtgaacctggcggcagcgcaaaagatg

SEQ ID NO: 231550 - DNA, 103 bp, Artificial Sequence
  Synthetic Polynucleotide
taatacgactcactatagggcatagcacttcttgaggtggcgcaccaactaacagaggagaagttggatggccacctcaaacctggcggcagcgcaaaagatg

SEQ ID NO: 231551 - DNA, 103 bp, Artificial Sequence
  Synthetic Polynucleotide
taatacgactcactataggggtctggtcatcatagcacttcttgaggtggaacagaggagaccacctatggaagtgctaaacctggcggcagcgcaaaagatg

SEQ ID NO: 231552 - DNA, 103 bp, Artificial Sequence
  Synthetic Polynucleotide
taatacgactcactatagggctcttcaagggtctggtcatcatagcacttaacagaggagaaagtgcatggatgaccagaacctggcggcagcgcaaaagatg

SEQ ID NO: 231553 - DNA, 103 bp, Artificial Sequence
  Synthetic Polynucleotide
taatacgactcactatagggcttcctcctcctcttcaagggtctggtcataacagaggagaatgaccatgcccttgaagaacctggcggcagcgcaaaagatg

SEQ ID NO: 231554 - DNA, 103 bp, Artificial Sequence
  Synthetic Polynucleotide
taatacgactcactataggggggtcaaagccatgttggatgtgaagggcaaacagaggagatgccctatgcatccaacaaacctggcggcagcgcaaaagatg

SEQ ID NO: 231555 - DNA, 103 bp, Artificial Sequence
  Synthetic Polynucleotide
taatacgactcactatagggctctctgcctcttcctcctcctcttcaaggaacagaggagaccttgaatgggaggaggaaacctggcggcagcgcaaaagatg

SEQ ID NO: 231556 - DNA, 103 bp, Artificial Sequence
  Synthetic Polynucleotide
taatacgactcactatagggctcttcccctctctctgcctcttcctcctcaacagaggagagaggagatggaggcagagaacctggcggcagcgcaaaagatg

SEQ ID NO: 231557 - DNA, 103 bp, Artificial Sequence
  Synthetic Polynucleotide
taatacgactcactatagggcctcttcctcctcttcccctctctctgcctaacagaggagaaggcagatggaggggaagaacctggcggcagcgcaaaagatg

SEQ ID NO: 231558 - DNA, 103 bp, Artificial Sequence
  Synthetic Polynucleotide
taatacgactcactatagggtcttcttccacctcttcctcctcttcccctaacagaggagaaggggaatgggaggaagaaacctggcggcagcgcaaaagatg

SEQ ID NO: 231559 - DNA, 103 bp, Artificial Sequence
  Synthetic Polynucleotide
taatacgactcactatagggctctacttcttcttcttccacctcttcctcaacagaggagagaggaaatggtggaagaaaacctggcggcagcgcaaaagatg

SEQ ID NO: 231560 - DNA, 103 bp, Artificial Sequence
  Synthetic Polynucleotide
taatacgactcactatagggcctgttcctcctctacttcttcttcttccaaacagaggagatggaagatgaagaagtagaacctggcggcagcgcaaaagatg

SEQ ID NO: 231561 - DNA, 103 bp, Artificial Sequence
  Synthetic Polynucleotide
taatacgactcactatagggggttcaaggccctgttcctcctctacttctaacagaggagaagaagtatgggaggaacaaacctggcggcagcgcaaaagatg

SEQ ID NO: 231562 - DNA, 103 bp, Artificial Sequence
  Synthetic Polynucleotide
taatacgactcactatagggccctgctggaggttcaaggccctgttcctcaacagaggagagaggaaatgggccttgaaaacctggcggcagcgcaaaagatg

SEQ ID NO: 231563 - DNA, 103 bp, Artificial Sequence
  Synthetic Polynucleotide
taatacgactcactatagggggccctcaggccctgctggaggttcaaggcaacagaggagagccttgatgctccagcagaacctggcggcagcgcaaaagatg

SEQ ID NO: 231564 - DNA, 103 bp, Artificial Sequence
  Synthetic Polynucleotide
taatacgactcactatagggtctggtaatgggccctcaggccctgctggaaacagaggagatccagcatggcctgagggaacctggcggcagcgcaaaagatg

SEQ ID NO: 231565 - DNA, 103 bp, Artificial Sequence
  Synthetic Polynucleotide
taatacgactcactataggggccttggattgggtcaaagccatgttggataacagaggagaatccaaatgggctttgacaacctggcggcagcgcaaaagatg

SEQ ID NO: 231566 - DNA, 103 bp, Artificial Sequence
  Synthetic Polynucleotide
taatacgactcactatagggatctggaggctctggtaatgggccctcaggaacagaggagacctgagatgccattaccaaacctggcggcagcgcaaaagatg

SEQ ID NO: 231567 - DNA, 103 bp, Artificial Sequence
  Synthetic Polynucleotide
taatacgactcactataggggctcctccccatctggaggctctggtaatgaacagaggagacattacatgagcctccagaacctggcggcagcgcaaaagatg

SEQ ID NO: 231568 - DNA, 103 bp, Artificial Sequence
  Synthetic Polynucleotide
taatacgactcactataggggcttggctcagctcctccccatctggaggcaacagaggagagcctccatgtggggaggaaacctggcggcagcgcaaaagatg

SEQ ID NO: 231569 - DNA, 103 bp, Artificial Sequence
  Synthetic Polynucleotide
taatacgactcactatagggtgttgcctctgcttggctcagctcctccccaacagaggagaggggagatgctgagccaaaacctggcggcagcgcaaaagatg

SEQ ID NO: 231570 - DNA, 103 bp, Artificial Sequence
  Synthetic Polynucleotide
taatacgactcactatagggctcctgcctttgttgcctctgcttggctcaaacagaggagatgagccatgcagaggcaaaacctggcggcagcgcaaaagatg

SEQ ID NO: 231571 - DNA, 103 bp, Artificial Sequence
  Synthetic Polynucleotide
taatacgactcactatagggggctctttgcctcctgcctttgttgcctctaacagaggagaagaggcatgaaaggcaggaacctggcggcagcgcaaaagatg

SEQ ID NO: 231572 - DNA, 103 bp, Artificial Sequence
  Synthetic Polynucleotide
taatacgactcactatagggcttctcttcaggctctttgcctcctgccttaacagaggagaaaggcaatgggcaaagagaacctggcggcagcgcaaaagatg

SEQ ID NO: 231573 - DNA, 103 bp, Artificial Sequence
  Synthetic Polynucleotide
taatacgactcactatagggatggagtagccttctcttcaggctctttgcaacagaggagagcaaagatgctgaagagaaacctggcggcagcgcaaaagatg

SEQ ID NO: 231574 - DNA, 103 bp, Artificial Sequence
  Synthetic Polynucleotide
taatacgactcactatagggggggaaggtgatggagtagccttctcttcaaacagaggagatgaagaatgggctactccaacctggcggcagcgcaaaagatg

SEQ ID NO: 231575 - DNA, 103 bp, Artificial Sequence
  Synthetic Polynucleotide
taatacgactcactatagggggtatgggctggggaaggtgatggagtagcaacagaggagagctactatgtcaccttccaacctggcggcagcgcaaaagatg

SEQ ID NO: 231576 - DNA, 103 bp, Artificial Sequence
  Synthetic Polynucleotide
taatacgactcactatagggaagagctaaagccttggattgggtcaaagcaacagaggagagctttgatgcaatccaagaacctggcggcagcgcaaaagatg

SEQ ID NO: 231577 - DNA, 103 bp, Artificial Sequence
  Synthetic Polynucleotide
taatacgactcactatagggactggtcacaggtatgggctggggaaggtgaacagaggagacaccttatgcagcccataaacctggcggcagcgcaaaagatg

SEQ ID NO: 231578 - DNA, 103 bp, Artificial Sequence
  Synthetic Polynucleotide
taatacgactcactataggggaaatggcacactggtcacaggtatgggctaacagaggagaagcccaatgctgtgaccaaacctggcggcagcgcaaaagatg

SEQ ID NO: 231579 - DNA, 103 bp, Artificial Sequence
  Synthetic Polynucleotide
taatacgactcactataggggctggagaaagaaatggcacactggtcacaaacagaggagatgtgacatgtgtgccattaacctggcggcagcgcaaaagatg

SEQ ID NO: 231580 - DNA, 103 bp, Artificial Sequence
  Synthetic Polynucleotide
taatacgactcactatagggggaggtcctggctggagaaagaaatggcacaacagaggagagtgccaatgctttctccaaacctggcggcagcgcaaaagatg

SEQ ID NO: 231581 - DNA, 103 bp, Artificial Sequence
  Synthetic Polynucleotide
taatacgactcactatagggtgactggtcaggaggtcctggctggagaaaaacagaggagatttctcatgccaggacctaacctggcggcagcgcaaaagatg

SEQ ID NO: 231582 - DNA, 103 bp, Artificial Sequence
  Synthetic Polynucleotide
taatacgactcactatagggtagtcggcggtgactggtcaggaggtcctgaacagaggagacaggacatgctgaccagtaacctggcggcagcgcaaaagatg

SEQ ID NO: 231583 - DNA, 103 bp, Artificial Sequence
  Synthetic Polynucleotide
taatacgactcactataggggcaggaaatgtagtcggcggtgactggtcaaacagaggagatgaccaatgaccgccgacaacctggcggcagcgcaaaagatg

SEQ ID NO: 231584 - DNA, 103 bp, Artificial Sequence
  Synthetic Polynucleotide
taatacgactcactatagggtgcagagatggcaggaaatgtagtcggcggaacagaggagaccgccgatgacatttcctaacctggcggcagcgcaaaagatg

SEQ ID NO: 231585 - DNA, 103 bp, Artificial Sequence
  Synthetic Polynucleotide
taatacgactcactatagggagcactgggctgcagagatggcaggaaatgaacagaggagacatttcatgccatctctgaacctggcggcagcgcaaaagatg

SEQ ID NO: 231586 - DNA, 103 bp, Artificial Sequence
  Synthetic Polynucleotide
taatacgactcactataggggttgggggggagcactgggctgcagagatgaacagaggagacatctcatgagcccagtgaacctggcggcagcgcaaaagatg

SEQ ID NO: 231587 - DNA, 103 bp, Artificial Sequence
  Synthetic Polynucleotide
taatacgactcactatagggatttggtcagaagagctaaagccttggattaacagaggagaaatccaatgctttagctcaacctggcggcagcgcaaaagatg

SEQ ID NO: 231588 - DNA, 103 bp, Artificial Sequence
  Synthetic Polynucleotide
taatacgactcactatagggagatctaggagttgggggggagcactgggcaacagaggagagcccagatgtcccccccaaacctggcggcagcgcaaaagatg

SEQ ID NO: 231589 - DNA, 103 bp, Artificial Sequence
  Synthetic Polynucleotide
taatacgactcactatagggcagcaagggcagatctaggagttgggggggaacagaggagaccccccatgctcctagataacctggcggcagcgcaaaagatg

SEQ ID NO: 231590 - DNA, 103 bp, Artificial Sequence
  Synthetic Polynucleotide
taatacgactcactatagggccccaaacaccagcaagggcagatctaggaaacagaggagatcctagatgtgcccttgcaacctggcggcagcgcaaaagatg

SEQ ID NO: 231591 - DNA, 103 bp, Artificial Sequence
  Synthetic Polynucleotide
taatacgactcactataggggggtttctctccccaaacaccagcaagggcaacagaggagagcccttatgggtgtttggaacctggcggcagcgcaaaagatg

SEQ ID NO: 231592 - DNA, 103 bp, Artificial Sequence
  Synthetic Polynucleotide
taatacgactcactatagggtgccaccagggggtttctctccccaaacacaacagaggagagtgtttatggagagaaacaacctggcggcagcgcaaaagatg

SEQ ID NO: 231593 - DNA, 103 bp, Artificial Sequence
  Synthetic Polynucleotide
taatacgactcactataggggtgaggtggctgccaccagggggtttctctaacagaggagaagagaaatgccctggtggaacctggcggcagcgcaaaagatg

SEQ ID NO: 231594 - DNA, 103 bp, Artificial Sequence
  Synthetic Polynucleotide
taatacgactcactatagggcctggcattggtgaggtggctgccaccaggaacagaggagacctggtatgagccacctcaacctggcggcagcgcaaaagatg

SEQ ID NO: 231595 - DNA, 103 bp, Artificial Sequence
  Synthetic Polynucleotide
taatacgactcactataggggagaggtggacctggcattggtgaggtggcaacagaggagagccaccatgccaatgccaaacctggcggcagcgcaaaagatg

SEQ ID NO: 231596 - DNA, 103 bp, Artificial Sequence
  Synthetic Polynucleotide
taatacgactcactataggggcttccgtttgagaggtggacctggcattgaacagaggagacaatgcatggtccacctcaacctggcggcagcgcaaaagatg

SEQ ID NO: 231597 - DNA, 103 bp, Artificial Sequence
  Synthetic Polynucleotide
taatacgactcactatagggccgtcctcatgcttccgtttgagaggtggaaacagaggagatccaccatgcaaacggaaaacctggcggcagcgcaaaagatg

SEQ ID NO: 231598 - DNA, 103 bp, Artificial Sequence
  Synthetic Polynucleotide
taatacgactcactatagggatgggacagaatttggtcagaagagctaaaaacagaggagatttagcatgtctgaccaaaacctggcggcagcgcaaaagatg

SEQ ID NO: 231599 - DNA, 103 bp, Artificial Sequence
  Synthetic Polynucleotide
taatacgactcactatagggagacaagctgccgtcctcatgcttccgtttaacagaggagaaaacggatgcatgaggacaacctggcggcagcgcaaaagatg

SEQ ID NO: 231600 - DNA, 103 bp, Artificial Sequence
  Synthetic Polynucleotide
taatacgactcactatagggtgcctgtgggagacaagctgccgtcctcataacagaggagaatgaggatggcagcttgtaacctggcggcagcgcaaaagatg

SEQ ID NO: 231601 - DNA, 103 bp, Artificial Sequence
  Synthetic Polynucleotide
taatacgactcactatagggcctgcttcactgcctgtgggagacaagctgaacagaggagacagcttatgtcccacaggaacctggcggcagcgcaaaagatg

SEQ ID NO: 231602 - DNA, 103 bp, Artificial Sequence
  Synthetic Polynucleotide
taatacgactcactatagggccctcctccccctgcttcactgcctgtgggaacagaggagacccacaatgagtgaagcaaacctggcggcagcgcaaaagatg

SEQ ID NO: 231603 - DNA, 103 bp, Artificial Sequence
  Synthetic Polynucleotide
taatacgactcactataggggctcgccctcccctcctccccctgcttcacaacagaggagagtgaagatgggggaggagaacctggcggcagcgcaaaagatg

SEQ ID NO: 231604 - DNA, 103 bp, Artificial Sequence
  Synthetic Polynucleotide
taatacgactcactatagggtccctggggggctcgccctcccctcctcccaacagaggagagggaggatgggagggcgaaacctggcggcagcgcaaaagatg

SEQ ID NO: 231605 - DNA, 103 bp, Artificial Sequence
  Synthetic Polynucleotide
taatacgactcactatagggcaggcgcttgtccctggggggctcgccctcaacagaggagagagggcatgccccccaggaacctggcggcagcgcaaaagatg

SEQ ID NO: 231606 - DNA, 103 bp, Artificial Sequence
  Synthetic Polynucleotide
taatacgactcactatagggtggtggtgcgcaggcgcttgtccctgggggaacagaggagacccccaatgacaagcgccaacctggcggcagcgcaaaagatg

SEQ ID NO: 231607 - DNA, 103 bp, Artificial Sequence
  Synthetic Polynucleotide
taatacgactcactatagggtcaggcaagatggtggtgcgcaggcgcttgaacagaggagacaagcgatggcgcaccacaacctggcggcagcgcaaaagatg

SEQ ID NO: 231608 - DNA, 103 bp, Artificial Sequence
  Synthetic Polynucleotide
taatacgactcactatagggctctagctgctcaggcaagatggtggtgcgaacagaggagacgcaccatgatcttgcctaacctggcggcagcgcaaaagatg

SEQ ID NO: 231609 - DNA, 103 bp, Artificial Sequence
  Synthetic Polynucleotide
taatacgactcactatagggctgaggtatcatgggacagaatttggtcagaacagaggagactgaccatgttctgtcccaacctggcggcagcgcaaaagatg

SEQ ID NO: 231610 - DNA, 103 bp, Artificial Sequence
  Synthetic Polynucleotide
taatacgactcactatagggggtacaggatctctagctgctcaggcaagaaacagaggagatcttgcatgagcagctagaacctggcggcagcgcaaaagatg

SEQ ID NO: 231611 - DNA, 103 bp, Artificial Sequence
  Synthetic Polynucleotide
taatacgactcactatagggatgtaccaacggtacaggatctctagctgcaacagaggagagcagctatggatcctgtaaacctggcggcagcgcaaaagatg

SEQ ID NO: 231612 - DNA, 103 bp, Artificial Sequence
  Synthetic Polynucleotide
taatacgactcactatagggggaatcctgcatgtaccaacggtacaggataacagaggagaatcctgatgcgttggtacaacctggcggcagcgcaaaagatg

SEQ ID NO: 231613 - DNA, 103 bp, Artificial Sequence
  Synthetic Polynucleotide
taatacgactcactataggggtgttgggttggaatcctgcatgtaccaacaacagaggagagttggtatgtgcaggattaacctggcggcagcgcaaaagatg

SEQ ID NO: 231614 - DNA, 103 bp, Artificial Sequence
  Synthetic Polynucleotide
taatacgactcactatagggagcatcttgcgtgttgggttggaatcctgcaacagaggagagcaggaatgcaacccaacaacctggcggcagcgcaaaagatg

SEQ ID NO: 231615 - DNA, 103 bp, Artificial Sequence
  Synthetic Polynucleotide
taatacgactcactataggggatgcagtcgagcatcttgcgtgttgggttaacagaggagaaacccaatgcgcaagatgaacctggcggcagcgcaaaagatg

SEQ ID NO: 231616 - DNA, 103 bp, Artificial Sequence
  Synthetic Polynucleotide
taatacgactcactatagggcctcctcggagatgcagtcgagcatcttgcaacagaggagagcaagaatgtcgactgcaaacctggcggcagcgcaaaagatg

SEQ ID NO: 231617 - DNA, 103 bp, Artificial Sequence
  Synthetic Polynucleotide
taatacgactcactatagggttgagccccacctcctcggagatgcagtcgaacagaggagacgactgatgctccgaggaaacctggcggcagcgcaaaagatg

SEQ ID NO: 231618 - DNA, 103 bp, Artificial Sequence
  Synthetic Polynucleotide
taatacgactcactatagggcactcgctttttgagccccacctcctcggaaacagaggagatccgagatggtggggctcaacctggcggcagcgcaaaagatg

SEQ ID NO: 231619 - DNA, 103 bp, Artificial Sequence
  Synthetic Polynucleotide
taatacgactcactatagggagacctgtaccactcgctttttgagccccaaacagaggagatggggcatgaaaagcgagaacctggcggcagcgcaaaagatg

SEQ ID NO: 231620 - DNA, 103 bp, Artificial Sequence
  Synthetic Polynucleotide
taatacgactcactatagggggagatggtgctgaggtatcatgggacagaaacagaggagatctgtcatgtgatacctcaacctggcggcagcgcaaaagatg

SEQ ID NO: 231621 - DNA, 103 bp, Artificial Sequence
  Synthetic Polynucleotide
taatacgactcactatagggttctggaaccagacctgtaccactcgctttaacagaggagaaaagcgatgggtacaggtaacctggcggcagcgcaaaagatg

SEQ ID NO: 231622 - DNA, 103 bp, Artificial Sequence
  Synthetic Polynucleotide
taatacgactcactatagggggccctggtattctggaaccagacctgtacaacagaggagagtacagatgtggttccagaacctggcggcagcgcaaaagatg

SEQ ID NO: 231623 - DNA, 103 bp, Artificial Sequence
  Synthetic Polynucleotide
taatacgactcactatagggtcctctcccgggccctggtattctggaaccaacagaggagaggttccatgataccagggaacctggcggcagcgcaaaagatg

SEQ ID NO: 231624 - DNA, 103 bp, Artificial Sequence
  Synthetic Polynucleotide
taatacgactcactatagggaactggcctttcctctcccgggccctggtaaacagaggagataccagatgccgggagagaacctggcggcagcgcaaaagatg

SEQ ID NO: 231625 - DNA, 103 bp, Artificial Sequence
  Synthetic Polynucleotide
taatacgactcactatagggggtgcttcgaaactggcctttcctctcccgaacagaggagacgggagatgaaaggccagaacctggcggcagcgcaaaagatg

SEQ ID NO: 231626 - DNA, 103 bp, Artificial Sequence
  Synthetic Polynucleotide
taatacgactcactatagggcccccccaggggtgcttcgaaactggccttaacagaggagaaaggccatgttcgaagcaaacctggcggcagcgcaaaagatg

SEQ ID NO: 231627 - DNA, 103 bp, Artificial Sequence
  Synthetic Polynucleotide
taatacgactcactatagggggactaggcacccccccaggggtgcttcgaaacagaggagatcgaagatgccctgggggaacctggcggcagcgcaaaagatg

SEQ ID NO: 231628 - DNA, 103 bp, Artificial Sequence
  Synthetic Polynucleotide
taatacgactcactatagggtttcactgctggactaggcacccccccaggaacagaggagacctgggatggtgcctagtaacctggcggcagcgcaaaagatg

SEQ ID NO: 231629 - DNA, 103 bp, Artificial Sequence
  Synthetic Polynucleotide
taatacgactcactatagggtggcaggcggtttcactgctggactaggcaaacagaggagatgcctaatgcagcagtgaaacctggcggcagcgcaaaagatg

SEQ ID NO: 231630 - DNA, 103 bp, Artificial Sequence
  Synthetic Polynucleotide
taatacgactcactatagggggggtggctgtggcaggcggtttcactgctaacagaggagaagcagtatgaccgcctgcaacctggcggcagcgcaaaagatg

SEQ ID NO: 231631 - DNA, 103 bp, Artificial Sequence
  Synthetic Polynucleotide
taatacgactcactatagggacaggcagccggagatggtgctgaggtatcaacagaggagagataccatggcaccatctaacctggcggcagcgcaaaagatg

SEQ ID NO: 231632 - DNA, 103 bp, Artificial Sequence
  Synthetic Polynucleotide
taatacgactcactatagggcaaggatgcaggggtggctgtggcaggcggaacagaggagaccgcctatgacagccaccaacctggcggcagcgcaaaagatg

SEQ ID NO: 231633 - DNA, 103 bp, Artificial Sequence
  Synthetic Polynucleotide
taatacgactcactatagggtgaacttgggcaaggatgcaggggtggctgaacagaggagacagccaatgctgcatcctaacctggcggcagcgcaaaagatg

SEQ ID NO: 231634 - DNA, 103 bp, Artificial Sequence
  Synthetic Polynucleotide
taatacgactcactatagggaataagaggttgaacttgggcaaggatgcaaacagaggagatgcatcatggcccaagttaacctggcggcagcgcaaaagatg

SEQ ID NO: 231635 - DNA, 103 bp, Artificial Sequence
  Synthetic Polynucleotide
taatacgactcactatagggtaccttgcctaataagaggttgaacttgggaacagaggagacccaagatgaacctcttaaacctggcggcagcgcaaaagatg

SEQ ID NO: 231636 - DNA, 103 bp, Artificial Sequence
  Synthetic Polynucleotide
taatacgactcactatagggtgccatcatctaccttgcctaataagaggtaacagaggagaacctctatgtaggcaaggaacctggcggcagcgcaaaagatg

SEQ ID NO: 231637 - DNA, 103 bp, Artificial Sequence
  Synthetic Polynucleotide
taatacgactcactatagggtccctcccagtgccatcatctaccttgcctaacagaggagaaggcaaatgagatgatggaacctggcggcagcgcaaaagatg

SEQ ID NO: 231638 - DNA, 103 bp, Artificial Sequence
  Synthetic Polynucleotide
taatacgactcactatagggctttggggcttccctcccagtgccatcatcaacagaggagagatgatatgactgggaggaacctggcggcagcgcaaaagatg

SEQ ID NO: 231639 - DNA, 103 bp, Artificial Sequence
  Synthetic Polynucleotide
taatacgactcactataggggtgcttccctctttggggcttccctcccagaacagaggagactgggaatgaagccccaaaacctggcggcagcgcaaaagatg

SEQ ID NO: 231640 - DNA, 103 bp, Artificial Sequence
  Synthetic Polynucleotide
taatacgactcactatagggggaaaagcaggtgcttccctctttggggctaacagaggagaagccccatggagggaagcaacctggcggcagcgcaaaagatg

SEQ ID NO: 231641 - DNA, 103 bp, Artificial Sequence
  Synthetic Polynucleotide
taatacgactcactatagggagtggggtagggaaaagcaggtgcttccctaacagaggagaagggaaatgcctgcttttaacctggcggcagcgcaaaagatg

SEQ ID NO: 231642 - DNA, 103 bp, Artificial Sequence
  Synthetic Polynucleotide
taatacgactcactataggggcctttcctcacaggcagccggagatggtgaacagaggagacaccatatgcggctgcctaacctggcggcagcgcaaaagatg

SEQ ID NO: 231643 - DNA, 103 bp, Artificial Sequence
  Synthetic Polynucleotide
taatacgactcactatagggcaagcgtggcagtggggtagggaaaagcagaacagaggagactgcttatgcctaccccaaacctggcggcagcgcaaaagatg

SEQ ID NO: 231644 - DNA, 103 bp, Artificial Sequence
  Synthetic Polynucleotide
taatacgactcactatagggggcccagaagcaagcgtggcagtggggtagaacagaggagactacccatgtgccacgctaacctggcggcagcgcaaaagatg

SEQ ID NO: 231645 - DNA, 103 bp, Artificial Sequence
  Synthetic Polynucleotide
taatacgactcactataggggaaaggctggggcccagaagcaagcgtggcaacagaggagagccacgatggcttctgggaacctggcggcagcgcaaaagatg

SEQ ID NO: 231646 - DNA, 103 bp, Artificial Sequence
  Synthetic Polynucleotide
taatacgactcactatagggcaggtggtaggaaaggctggggcccagaagaacagaggagacttctgatgcccagccttaacctggcggcagcgcaaaagatg

SEQ ID NO: 231647 - DNA, 103 bp, Artificial Sequence
  Synthetic Polynucleotide
taatacgactcactataggggcctctttcccaggtggtaggaaaggctggaacagaggagaccagccatgcctaccaccaacctggcggcagcgcaaaagatg

SEQ ID NO: 231648 - DNA, 103 bp, Artificial Sequence
  Synthetic Polynucleotide
taatacgactcactatagggtggggtggtggcctctttcccaggtggtagaacagaggagactaccaatggggaaagagaacctggcggcagcgcaaaagatg

SEQ ID NO: 231649 - DNA, 103 bp, Artificial Sequence
  Synthetic Polynucleotide
taatacgactcactataggggctctggtgttggggtggtggcctctttccaacagaggagaggaaagatgccaccacccaacctggcggcagcgcaaaagatg

SEQ ID NO: 231650 - DNA, 103 bp, Artificial Sequence
  Synthetic Polynucleotide
taatacgactcactatagggggtagaggtggctctggtgttggggtggtgaacagaggagacaccacatgaacaccagaaacctggcggcagcgcaaaagatg

SEQ ID NO: 231651 - DNA, 103 bp, Artificial Sequence
  Synthetic Polynucleotide
taatacgactcactatagggaggtaggagaggtagaggtggctctggtgtaacagaggagaacaccaatgccacctctaaacctggcggcagcgcaaaagatg

SEQ ID NO: 231652 - DNA, 103 bp, Artificial Sequence
  Synthetic Polynucleotide
taatacgactcactataggggtggagggggaggtaggagaggtagaggtgaacagaggagacacctcatgctctcctacaacctggcggcagcgcaaaagatg

SEQ ID NO: 231653 - DNA, 103 bp, Artificial Sequence
  Synthetic Polynucleotide
taatacgactcactataggggtgtccgaaggcagggacggggcattgtgcaacagaggagagcacaaatgcccgtccctaacctggcggcagcgcaaaagatg

SEQ ID NO: 231654 - DNA, 103 bp, Artificial Sequence
  Synthetic Polynucleotide
taatacgactcactatagggaaagctccatgcctttcctcacaggcagccaacagaggagaggctgcatgtgaggaaagaacctggcggcagcgcaaaagatg

SEQ ID NO: 231655 - DNA, 103 bp, Artificial Sequence
  Synthetic Polynucleotide
taatacgactcactatagggtcctcactgggtggagggggaggtaggagaaacagaggagatctcctatgtccccctccaacctggcggcagcgcaaaagatg

SEQ ID NO: 231656 - DNA, 103 bp, Artificial Sequence
  Synthetic Polynucleotide
taatacgactcactatagggtgggccctcttcctcactgggtggagggggaacagaggagaccccctatgcccagtgagaacctggcggcagcgcaaaagatg

SEQ ID NO: 231657 - DNA, 103 bp, Artificial Sequence
  Synthetic Polynucleotide
taatacgactcactataggggtggttcctctgggccctcttcctcactggaacagaggagaccagtgatgaagagggccaacctggcggcagcgcaaaagatg

SEQ ID NO: 231658 - DNA, 103 bp, Artificial Sequence
  Synthetic Polynucleotide
taatacgactcactataggggaagctttaggtggttcctctgggccctctaacagaggagaagagggatgagaggaaccaacctggcggcagcgcaaaagatg

SEQ ID NO: 231659 - DNA, 103 bp, Artificial Sequence
  Synthetic Polynucleotide
taatacgactcactatagggactctctggagaagctttaggtggttcctcaacagaggagagaggaaatgcctaaagctaacctggcggcagcgcaaaagatg

SEQ ID NO: 231660 - DNA, 103 bp, Artificial Sequence
  Synthetic Polynucleotide
taatacgactcactatagggtgcaagcctcactctctggagaagctttagaacagaggagactaaagatgctccagagaaacctggcggcagcgcaaaagatg

SEQ ID NO: 231661 - DNA, 103 bp, Artificial Sequence
  Synthetic Polynucleotide
taatacgactcactataggggcagagagactgcaagcctcactctctggaaacagaggagatccagaatgtgaggcttgaacctggcggcagcgcaaaagatg

SEQ ID NO: 231662 - DNA, 103 bp, Artificial Sequence
  Synthetic Polynucleotide
taatacgactcactatagggcagatctcctgcagagagactgcaagcctcaacagaggagagaggctatgagtctctctaacctggcggcagcgcaaaagatg

SEQ ID NO: 231663 - DNA, 103 bp, Artificial Sequence
  Synthetic Polynucleotide
taatacgactcactatagggatgaatcactcagatctcctgcagagagacaacagaggagagtctctatgcaggagatcaacctggcggcagcgcaaaagatg

SEQ ID NO: 231664 - DNA, 103 bp, Artificial Sequence
  Synthetic Polynucleotide
taatacgactcactatagggctggaagcagatgaatcactcagatctcctaacagaggagaaggagaatggagtgattcaacctggcggcagcgcaaaagatg

SEQ ID NO: 231665 - DNA, 103 bp, Artificial Sequence
  Synthetic Polynucleotide
taatacgactcactataggggtagctccagaaagctccatgcctttcctcaacagaggagagaggaaatgcatggagctaacctggcggcagcgcaaaagatg

SEQ ID NO: 231666 - DNA, 103 bp, Artificial Sequence
  Synthetic Polynucleotide
taatacgactcactatagggttcagctaggctggaagcagatgaatcactaacagaggagaagtgatatgtctgcttccaacctggcggcagcgcaaaagatg

SEQ ID NO: 231667 - DNA, 103 bp, Artificial Sequence
  Synthetic Polynucleotide
taatacgactcactataggggggattctggttcagctaggctggaagcagaacagaggagactgcttatggcctagctgaacctggcggcagcgcaaaagatg

SEQ ID NO: 231668 - DNA, 103 bp, Artificial Sequence
  Synthetic Polynucleotide
taatacgactcactatagggccagccccaggggattctggttcagctaggaacagaggagacctagcatgaccagaatcaacctggcggcagcgcaaaagatg

SEQ ID NO: 231669 - DNA, 103 bp, Artificial Sequence
  Synthetic Polynucleotide
taatacgactcactatagggactggtccctccagccccaggggattctggaacagaggagaccagaaatgcctggggctaacctggcggcagcgcaaaagatg

SEQ ID NO: 231670 - DNA, 103 bp, Artificial Sequence
  Synthetic Polynucleotide
taatacgactcactatagggcaggtcccccactggtccctccagccccagaacagaggagactggggatggagggaccaaacctggcggcagcgcaaaagatg

SEQ ID NO: 231671 - DNA, 103 bp, Artificial Sequence
  Synthetic Polynucleotide
taatacgactcactataggggtcccacctccaggtcccccactggtccctaacagaggagaagggacatgtgggggaccaacctggcggcagcgcaaaagatg

SEQ ID NO: 231672 - DNA, 103 bp, Artificial Sequence
  Synthetic Polynucleotide
taatacgactcactatagggtggaaccccagtcccacctccaggtcccccaacagaggagagggggaatgggaggtgggaacctggcggcagcgcaaaagatg

SEQ ID NO: 231673 - DNA, 103 bp, Artificial Sequence
  Synthetic Polynucleotide
taatacgactcactatagggccattccatctggaaccccagtcccacctcaacagaggagagaggtgatgctggggttcaacctggcggcagcgcaaaagatg

SEQ ID NO: 231674 - DNA, 103 bp, Artificial Sequence
  Synthetic Polynucleotide
taatacgactcactatagggcgccgctgccccattccatctggaaccccaaacagaggagatggggtatgagatggaataacctggcggcagcgcaaaagatg

SEQ ID NO: 231675 - DNA, 103 bp, Artificial Sequence
  Synthetic Polynucleotide
taatacgactcactatagggggtcctgtagcgccgctgccccattccatcaacagaggagagatggaatggggcagcggaacctggcggcagcgcaaaagatg

SEQ ID NO: 231676 - DNA, 103 bp, Artificial Sequence
  Synthetic Polynucleotide
taatacgactcactataggggagccagctggtagctccagaaagctccataacagaggagaatggagatgtctggagctaacctggcggcagcgcaaaagatg

SEQ ID NO: 231677 - DNA, 103 bp, Artificial Sequence
  Synthetic Polynucleotide
taatacgactcactatagggtgctcatctgggtcctgtagcgccgctgccaacagaggagaggcagcatggctacaggaaacctggcggcagcgcaaaagatg

SEQ ID NO: 231678 - DNA, 103 bp, Artificial Sequence
  Synthetic Polynucleotide
taatacgactcactatagggagctgcaggctgctcatctgggtcctgtagaacagaggagactacagatgccagatgagaacctggcggcagcgcaaaagatg

SEQ ID NO: 231679 - DNA, 103 bp, Artificial Sequence
  Synthetic Polynucleotide
taatacgactcactatagggcatgatcttcagctgcaggctgctcatctgaacagaggagacagatgatgagcctgcagaacctggcggcagcgcaaaagatg

SEQ ID NO: 231680 - DNA, 103 bp, Artificial Sequence
  Synthetic Polynucleotide
taatacgactcactatagggagcaggctttcatgatcttcagctgcaggcaacagaggagagcctgcatgtgaagatcaaacctggcggcagcgcaaaagatg

SEQ ID NO: 231681 - DNA, 103 bp, Artificial Sequence
  Synthetic Polynucleotide
taatacgactcactatagggtaagcttcatagcaggctttcatgatcttcaacagaggagagaagatatggaaagcctgaacctggcggcagcgcaaaagatg

SEQ ID NO: 231682 - DNA, 103 bp, Artificial Sequence
  Synthetic Polynucleotide
taatacgactcactataggggggggtgcggtaagcttcatagcaggctttaacagaggagaaaagccatgtatgaagctaacctggcggcagcgcaaaagatg

SEQ ID NO: 231683 - DNA, 103 bp, Artificial Sequence
  Synthetic Polynucleotide
taatacgactcactatagggcctgcatggtgggggtgcggtaagcttcataacagaggagaatgaagatgaccgcacccaacctggcggcagcgcaaaagatg

SEQ ID NO: 231684 - DNA, 103 bp, Artificial Sequence
  Synthetic Polynucleotide
taatacgactcactatagggacctcacactcctgcatggtgggggtgcggaacagaggagaccgcacatgcaccatgcaaacctggcggcagcgcaaaagatg

SEQ ID NO: 231685 - DNA, 103 bp, Artificial Sequence
  Synthetic Polynucleotide
taatacgactcactatagggctctcccagcacctcacactcctgcatggtaacagaggagaaccatgatggagtgtgagaacctggcggcagcgcaaaagatg

SEQ ID NO: 231686 - DNA, 103 bp, Artificial Sequence
  Synthetic Polynucleotide
taatacgactcactataggggcccaatctcctctcccagcacctcacactaacagaggagaagtgtgatgtgctgggagaacctggcggcagcgcaaaagatg

SEQ ID NO: 231687 - DNA, 103 bp, Artificial Sequence
  Synthetic Polynucleotide
taatacgactcactatagggggtggatttggagccagctggtagctccagaacagaggagactggagatgccagctggcaacctggcggcagcgcaaaagatg

SEQ ID NO: 231688 - DNA, 103 bp, Artificial Sequence
  Synthetic Polynucleotide
taatacgactcactatagggctcttgggcagcccaatctcctctcccagcaacagaggagagctgggatgggagattggaacctggcggcagcgcaaaagatg

SEQ ID NO: 231689 - DNA, 103 bp, Artificial Sequence
  Synthetic Polynucleotide
taatacgactcactatagggctggatgactctcttgggcagcccaatctcaacagaggagagagattatgctgcccaagaacctggcggcagcgcaaaagatg

SEQ ID NO: 231690 - DNA, 103 bp, Artificial Sequence
  Synthetic Polynucleotide
taatacgactcactatagggggaaccagacctggatgactctcttgggcaaacagaggagatgcccaatggagtcatccaacctggcggcagcgcaaaagatg

SEQ ID NO: 231691 - DNA, 103 bp, Artificial Sequence
  Synthetic Polynucleotide
taatacgactcactatagggcgagcattctggaaccagacctggatgactaacagaggagaagtcatatgggtctggttaacctggcggcagcgcaaaagatg

SEQ ID NO: 231692 - DNA, 103 bp, Artificial Sequence
  Synthetic Polynucleotide
taatacgactcactatagggttccttggcacgagcattctggaaccagacaacagaggagagtctggatgcagaatgctaacctggcggcagcgcaaaagatg

SEQ ID NO: 231693 - DNA, 103 bp, Artificial Sequence
  Synthetic Polynucleotide
taatacgactcactatagggtggccttcttttccttggcacgagcattctaacagaggagaagaatgatggtgccaaggaacctggcggcagcgcaaaagatg

SEQ ID NO: 231694 - DNA, 103 bp, Artificial Sequence
  Synthetic Polynucleotide
taatacgactcactatagggccctgtagtttggccttcttttccttggcaaacagaggagatgccaaatgaaagaaggcaacctggcggcagcgcaaaagatg

SEQ ID NO: 231695 - DNA, 103 bp, Artificial Sequence
  Synthetic Polynucleotide
taatacgactcactatagggagcggctgtcccctgtagtttggccttcttaacagaggagaaagaagatgaaactacagaacctggcggcagcgcaaaagatg

SEQ ID NO: 231696 - DNA, 103 bp, Artificial Sequence
  Synthetic Polynucleotide
taatacgactcactatagggcagtgctcccagcggctgtcccctgtagttaacagaggagaaactacatgggacagccgaacctggcggcagcgcaaaagatg

SEQ ID NO: 231697 - DNA, 103 bp, Artificial Sequence
  Synthetic Polynucleotide
taatacgactcactatagggctgctgcccccagtgctcccagcggctgtcaacagaggagagacagcatgtgggagcacaacctggcggcagcgcaaaagatg

SEQ ID NO: 231698 - DNA, 103 bp, Artificial Sequence
  Synthetic Polynucleotide
taatacgactcactataggggggatctccgggtggatttggagccagctgaacagaggagacagctgatgccaaatccaaacctggcggcagcgcaaaagatg

SEQ ID NO: 231699 - DNA, 103 bp, Artificial Sequence
  Synthetic Polynucleotide
taatacgactcactataggggaggccctcactgctgcccccagtgctcccaacagaggagagggagcatggggggcagcaacctggcggcagcgcaaaagatg

SEQ ID NO: 231700 - DNA, 103 bp, Artificial Sequence
  Synthetic Polynucleotide
taatacgactcactataggggggctgctaagaggccctcactgctgccccaacagaggagaggggcaatggtgagggccaacctggcggcagcgcaaaagatg

SEQ ID NO: 231701 - DNA, 103 bp, Artificial Sequence
  Synthetic Polynucleotide
taatacgactcactatagggtcagtgcgctgggctgctaagaggccctcaaacagaggagatgagggatgcttagcagcaacctggcggcagcgcaaaagatg

SEQ ID NO: 231702 - DNA, 103 bp, Artificial Sequence
  Synthetic Polynucleotide
taatacgactcactatagggataggggcagtcagtgcgctgggctgctaaaacagaggagattagcaatgcagcgcactaacctggcggcagcgcaaaagatg

SEQ ID NO: 231703 - DNA, 103 bp, Artificial Sequence
  Synthetic Polynucleotide
taatacgactcactatagggtgacatcacaataggggcagtcagtgcgctaacagaggagaagcgcaatgactgcccctaacctggcggcagcgcaaaagatg

SEQ ID NO: 231704 - DNA, 103 bp, Artificial Sequence
  Synthetic Polynucleotide
taatacgactcactatagggaaatcatacttgacatcacaataggggcagaacagaggagactgcccatgttgtgatgtaacctggcggcagcgcaaaagatg

SEQ ID NO: 231705 - DNA, 103 bp, Artificial Sequence
  Synthetic Polynucleotide
taatacgactcactatagggggagacatagaaatcatacttgacatcacaaacagaggagatgtgatatgaagtatgataacctggcggcagcgcaaaagatg

SEQ ID NO: 231706 - DNA, 103 bp, Artificial Sequence
  Synthetic Polynucleotide
taatacgactcactatagggggcctcggcaggagacatagaaatcatactaacagaggagaagtatgatgtctatgtctaacctggcggcagcgcaaaagatg

SEQ ID NO: 231707 - DNA, 103 bp, Artificial Sequence
  Synthetic Polynucleotide
taatacgactcactataggggaaaagagatggcctcggcaggagacatagaacagaggagactatgtatgctgccgaggaacctggcggcagcgcaaaagatg

SEQ ID NO: 231708 - DNA, 103 bp, Artificial Sequence
  Synthetic Polynucleotide
taatacgactcactataggggtgctgacgggaaaagagatggcctcggcaaacagaggagatgccgaatgcatctctttaacctggcggcagcgcaaaagatg

SEQ ID NO: 231709 - DNA, 103 bp, Artificial Sequence
  Synthetic Polynucleotide
taatacgactcactatagggggccatctttgggatctccgggtggatttgaacagaggagacaaatcatgccggagatcaacctggcggcagcgcaaaagatg

SEQ ID NO: 231710 - DNA, 103 bp, Artificial Sequence
  Synthetic Polynucleotide
taatacgactcactataggggcttggccaggtgctgacgggaaaagagataacagaggagaatctctatgcccgtcagcaacctggcggcagcgcaaaagatg

SEQ ID NO: 231711 - DNA, 103 bp, Artificial Sequence
  Synthetic Polynucleotide
taatacgactcactataggggcctccttgagcttggccaggtgctgacggaacagaggagaccgtcaatgcctggccaaaacctggcggcagcgcaaaagatg

SEQ ID NO: 231712 - DNA, 103 bp, Artificial Sequence
  Synthetic Polynucleotide
taatacgactcactatagggggctcgaaccgcctccttgagcttggccagaacagaggagactggccatgctcaaggagaacctggcggcagcgcaaaagatg

SEQ ID NO: 231713 - DNA, 103 bp, Artificial Sequence
  Synthetic Polynucleotide
taatacgactcactatagggtcttcagctgggctcgaaccgcctccttgaaacagaggagatcaaggatgcggttcgagaacctggcggcagcgcaaaagatg

SEQ ID NO: 231714 - DNA, 103 bp, Artificial Sequence
  Synthetic Polynucleotide
taatacgactcactatagggttgctttcactcttcagctgggctcgaaccaacagaggagaggttcgatgccagctgaaaacctggcggcagcgcaaaagatg

SEQ ID NO: 231715 - DNA, 103 bp, Artificial Sequence
  Synthetic Polynucleotide
taatacgactcactataggggtcgtagcacttgctttcactcttcagctgaacagaggagacagctgatgagtgaaagcaacctggcggcagcgcaaaagatg

SEQ ID NO: 231716 - DNA, 103 bp, Artificial Sequence
  Synthetic Polynucleotide
taatacgactcactatagggctggggccaagtcgtagcacttgctttcacaacagaggagagtgaaaatgagtgctacgaacctggcggcagcgcaaaagatg

SEQ ID NO: 231717 - DNA, 103 bp, Artificial Sequence
  Synthetic Polynucleotide
taatacgactcactataggggcctcaggtgctggggccaagtcgtagcacaacagaggagagtgctaatgcttggccccaacctggcggcagcgcaaaagatg

SEQ ID NO: 231718 - DNA, 103 bp, Artificial Sequence
  Synthetic Polynucleotide
taatacgactcactatagggagctgggggagcctcaggtgctggggccaaaacagaggagattggccatggcacctgagaacctggcggcagcgcaaaagatg

SEQ ID NO: 231719 - DNA, 103 bp, Artificial Sequence
  Synthetic Polynucleotide
taatacgactcactataggggggccttgagagctgggggagcctcaggtgaacagaggagacacctgatgctcccccagaacctggcggcagcgcaaaagatg

SEQ ID NO: 231720 - DNA, 103 bp, Artificial Sequence
  Synthetic Polynucleotide
taatacgactcactatagggttccccatggggccatctttgggatctccgaacagaggagacggagaatgcaaagatggaacctggcggcagcgcaaaagatg

SEQ ID NO: 231721 - DNA, 103 bp, Artificial Sequence
  Synthetic Polynucleotide
taatacgactcactataggggtggcaggtggggccttgagagctgggggaaacagaggagatcccccatgtctcaaggcaacctggcggcagcgcaaaagatg

SEQ ID NO: 231722 - DNA, 103 bp, Artificial Sequence
  Synthetic Polynucleotide
taatacgactcactatagggggcaggtgtggtggcaggtggggccttgagaacagaggagactcaagatgccacctgccaacctggcggcagcgcaaaagatg

SEQ ID NO: 231723 - DNA, 103 bp, Artificial Sequence
  Synthetic Polynucleotide
taatacgactcactatagggggggcatggaggcaggtgtggtggcaggtgaacagaggagacacctgatgccacacctgaacctggcggcagcgcaaaagatg

SEQ ID NO: 231724 - DNA, 103 bp, Artificial Sequence
  Synthetic Polynucleotide
taatacgactcactataggggcagccccgaggggcatggaggcaggtgtgaacagaggagacacaccatgctccatgccaacctggcggcagcgcaaaagatg

SEQ ID NO: 231725 - DNA, 103 bp, Artificial Sequence
  Synthetic Polynucleotide
taatacgactcactatagggcaaggttggggcagccccgaggggcatggaaacagaggagatccatgatgctcggggctaacctggcggcagcgcaaaagatg

SEQ ID NO: 231726 - DNA, 103 bp, Artificial Sequence
  Synthetic Polynucleotide
taatacgactcactatagggccaggcgaggcaaggttggggcagccccgaaacagaggagatcggggatgccccaacctaacctggcggcagcgcaaaagatg

SEQ ID NO: 231727 - DNA, 103 bp, Artificial Sequence
  Synthetic Polynucleotide
taatacgactcactatagggaggaccggcgccaggcgaggcaaggttgggaacagaggagacccaacatggcctcgcctaacctggcggcagcgcaaaagatg

SEQ ID NO: 231728 - DNA, 103 bp, Artificial Sequence
  Synthetic Polynucleotide
taatacgactcactataggggccagataagaggaccggcgccaggcgaggaacagaggagacctcgcatggcgccggtcaacctggcggcagcgcaaaagatg

SEQ ID NO: 231729 - DNA, 103 bp, Artificial Sequence
  Synthetic Polynucleotide
taatacgactcactatagggccagagctgggccagataagaggaccggcgaacagaggagacgccggatgtcttatctgaacctggcggcagcgcaaaagatg

SEQ ID NO: 231730 - DNA, 103 bp, Artificial Sequence
  Synthetic Polynucleotide
taatacgactcactataggggggggctgagccagagctgggccagataagaacagaggagacttatcatgcccagctctaacctggcggcagcgcaaaagatg

SEQ ID NO: 231731 - DNA, 103 bp, Artificial Sequence
  Synthetic Polynucleotide
taatacgactcactataggggcccccgctgttccccatggggccatctttaacagaggagaaaagatatgcccatggggaacctggcggcagcgcaaaagatg

SEQ ID NO: 231732 - DNA, 103 bp, Artificial Sequence
  Synthetic Polynucleotide
taatacgactcactataggggttgcccagcgggggctgagccagagctggaacagaggagaccagctatggctcagcccaacctggcggcagcgcaaaagatg

SEQ ID NO: 231733 - DNA, 103 bp, Artificial Sequence
  Synthetic Polynucleotide
taatacgactcactatagggaaggagctaagttgcccagcgggggctgagaacagaggagactcagcatgcgctgggcaaacctggcggcagcgcaaaagatg

SEQ ID NO: 231734 - DNA, 103 bp, Artificial Sequence
  Synthetic Polynucleotide
taatacgactcactatagggcctgaattgaaaggagctaagttgcccagcaacagaggagagctgggatgcttagctccaacctggcggcagcgcaaaagatg

SEQ ID NO: 231735 - DNA, 103 bp, Artificial Sequence
  Synthetic Polynucleotide
taatacgactcactatagggggctgccgggcctgaattgaaaggagctaaaacagaggagattagctatgttcaattcaaacctggcggcagcgcaaaagatg

SEQ ID NO: 231736 - DNA, 103 bp, Artificial Sequence
  Synthetic Polynucleotide
taatacgactcactatagggggcctgaggaggctgccgggcctgaattgaaacagaggagatcaattatggcccggcagaacctggcggcagcgcaaaagatg

SEQ ID NO: 231737 - DNA, 103 bp, Artificial Sequence
  Synthetic Polynucleotide
taatacgactcactatagggaggccgaggaggcctgaggaggctgccgggaacagaggagacccggcatgctcctcaggaacctggcggcagcgcaaaagatg

SEQ ID NO: 231738 - DNA, 103 bp, Artificial Sequence
  Synthetic Polynucleotide
taatacgactcactatagggcgaagtggcgaggccgaggaggcctgaggaaacagaggagatcctcaatgctcctcggcaacctggcggcagcgcaaaagatg

SEQ ID NO: 231739 - DNA, 103 bp, Artificial Sequence
  Synthetic Polynucleotide
taatacgactcactatagggtaggcaggaccgaagtggcgaggccgaggaaacagaggagatcctcgatgtcgccacttaacctggcggcagcgcaaaagatg

SEQ ID NO: 231740 - DNA, 103 bp, Artificial Sequence
  Synthetic Polynucleotide
taatacgactcactatagggactgtggtggtaggcaggaccgaagtggcgaacagaggagacgccacatgggtcctgccaacctggcggcagcgcaaaagatg

SEQ ID NO: 231741 - DNA, 103 bp, Artificial Sequence
  Synthetic Polynucleotide
taatacgactcactatagggagtctggaccactgtggtggtaggcaggacaacagaggagagtcctgatgaccaccacaaacctggcggcagcgcaaaagatg

SEQ ID NO: 231742 - DNA, 103 bp, Artificial Sequence
  Synthetic Polynucleotide
taatacgactcactatagggccacgtggttgcccccgctgttccccatggaacagaggagaccatggatgacagcggggaacctggcggcagcgcaaaagatg

SEQ ID NO: 231743 - DNA, 103 bp, Artificial Sequence
  Synthetic Polynucleotide
taatacgactcactatagggctgggccagcagtctggaccactgtggtggaacagaggagaccaccaatgtggtccagaaacctggcggcagcgcaaaagatg

SEQ ID NO: 231744 - DNA, 103 bp, Artificial Sequence
  Synthetic Polynucleotide
taatacgactcactatagggaaggggcggcctgggccagcagtctggaccaacagaggagaggtccaatgtgctggcccaacctggcggcagcgcaaaagatg

SEQ ID NO: 231745 - DNA, 103 bp, Artificial Sequence
  Synthetic Polynucleotide
taatacgactcactatagggtctctgaggtaaggggcggcctgggccagcaacagaggagagctggcatgggccgccccaacctggcggcagcgcaaaagatg

SEQ ID NO: 231746 - DNA, 103 bp, Artificial Sequence
  Synthetic Polynucleotide
taatacgactcactatagggcgggcatgggtctctgaggtaaggggcggcaacagaggagagccgccatgtacctcagaaacctggcggcagcgcaaaagatg

SEQ ID NO: 231747 - DNA, 103 bp, Artificial Sequence
  Synthetic Polynucleotide
taatacgactcactatagggttggtttggtcgggcatgggtctctgaggtaacagaggagaacctcaatgacccatgccaacctggcggcagcgcaaaagatg

SEQ ID NO: 231748 - DNA, 103 bp, Artificial Sequence
  Synthetic Polynucleotide
taatacgactcactatagggtgtggaggtgttggtttggtcgggcatgggaacagaggagacccatgatggaccaaaccaacctggcggcagcgcaaaagatg

SEQ ID NO: 231749 - DNA, 103 bp, Artificial Sequence
  Synthetic Polynucleotide
taatacgactcactatagggtggtgcctgctgtggaggtgttggtttggtaacagaggagaaccaaaatgacacctccaaacctggcggcagcgcaaaagatg

SEQ ID NO: 231750 - DNA, 103 bp, Artificial Sequence
  Synthetic Polynucleotide
taatacgactcactatagggacagggtcagtggtgcctgctgtggaggtgaacagaggagacacctcatgagcaggcacaacctggcggcagcgcaaaagatg

SEQ ID NO: 231751 - DNA, 103 bp, Artificial Sequence
  Synthetic Polynucleotide
taatacgactcactatagggagggcctgggacagggtcagtggtgcctgcaacagaggagagcaggcatgactgaccctaacctggcggcagcgcaaaagatg

SEQ ID NO: 231752 - DNA, 103 bp, Artificial Sequence
  Synthetic Polynucleotide
taatacgactcactataggggctcagtaggagggcctgggacagggtcagaacagaggagactgaccatgtcccaggccaacctggcggcagcgcaaaagatg

SEQ ID NO: 231753 - DNA, 103 bp, Artificial Sequence
  Synthetic Polynucleotide
taatacgactcactatagggcagaagaccgccacgtggttgcccccgctgaacagaggagacagcggatgcaaccacgtaacctggcggcagcgcaaaagatg

SEQ ID NO: 231754 - DNA, 103 bp, Artificial Sequence
  Synthetic Polynucleotide
taatacgactcactatagggtcccccaagggctcagtaggagggcctgggaacagaggagacccaggatgtcctactgaaacctggcggcagcgcaaaagatg

SEQ ID NO: 231755 - DNA, 103 bp, Artificial Sequence
  Synthetic Polynucleotide
taatacgactcactatagggggagaccttgtcccccaagggctcagtaggaacagaggagacctactatgcccttggggaacctggcggcagcgcaaaagatg

SEQ ID NO: 231756 - DNA, 103 bp, Artificial Sequence
  Synthetic Polynucleotide
taatacgactcactatagggttcgctcactggagaccttgtcccccaaggaacagaggagaccttggatgacaaggtctaacctggcggcagcgcaaaagatg

SEQ ID NO: 231757 - DNA, 103 bp, Artificial Sequence
  Synthetic Polynucleotide
taatacgactcactataggggcaactggctttcgctcactggagaccttgaacagaggagacaaggtatgcagtgagcgaacctggcggcagcgcaaaagatg

SEQ ID NO: 231758 - DNA, 103 bp, Artificial Sequence
  Synthetic Polynucleotide
taatacgactcactatagggggtggggcctgcaactggctttcgctcactaacagaggagaagtgagatgaagccagttaacctggcggcagcgcaaaagatg

SEQ ID NO: 231759 - DNA, 103 bp, Artificial Sequence
  Synthetic Polynucleotide
taatacgactcactatagggtggaggagctggtggggcctgcaactggctaacagaggagaagccagatgcaggccccaaacctggcggcagcgcaaaagatg

SEQ ID NO: 231760 - DNA, 103 bp, Artificial Sequence
  Synthetic Polynucleotide
taatacgactcactatagggagggcatcattggaggagctggtggggcctaacagaggagaaggcccatgcagctcctcaacctggcggcagcgcaaaagatg

SEQ ID NO: 231761 - DNA, 103 bp, Artificial Sequence
  Synthetic Polynucleotide
taatacgactcactataggggaggttcttgagggcatcattggaggagctaacagaggagaagctccatgaatgatgccaacctggcggcagcgcaaaagatg

SEQ ID NO: 231762 - DNA, 103 bp, Artificial Sequence
  Synthetic Polynucleotide
taatacgactcactatagggtcaatgctttgaggttcttgagggcatcataacagaggagaatgatgatgtcaagaaccaacctggcggcagcgcaaaagatg

SEQ ID NO: 231763 - DNA, 103 bp, Artificial Sequence
  Synthetic Polynucleotide
taatacgactcactatagggacagtggtcttcaatgctttgaggttcttgaacagaggagacaagaaatgcaaagcattaacctggcggcagcgcaaaagatg

SEQ ID NO: 231764 - DNA, 103 bp, Artificial Sequence
  Synthetic Polynucleotide
taatacgactcactatagggggaggagaaggtgtccgaaggcagggacggaacagaggagaccgtccatgccttcggacaacctggcggcagcgcaaaagatg

SEQ ID NO: 231765 - DNA, 103 bp, Artificial Sequence
  Synthetic Polynucleotide
taatacgactcactatagggaaggcagagccagaagaccgccacgtggttaacagaggagaaaccacatggcggtcttcaacctggcggcagcgcaaaagatg

SEQ ID NO: 231766 - DNA, 103 bp, Artificial Sequence
  Synthetic Polynucleotide
taatacgactcactatagggcagggctgggacagtggtcttcaatgctttaacagaggagaaaagcaatgaagaccactaacctggcggcagcgcaaaagatg

SEQ ID NO: 231767 - DNA, 103 bp, Artificial Sequence
  Synthetic Polynucleotide
taatacgactcactatagggggccccccaacagggctgggacagtggtctaacagaggagaagaccaatgtcccagcccaacctggcggcagcgcaaaagatg

SEQ ID NO: 231768 - DNA, 103 bp, Artificial Sequence
  Synthetic Polynucleotide
taatacgactcactatagggggcaggaactggccccccaacagggctgggaacagaggagacccagcatggttggggggaacctggcggcagcgcaaaagatg

SEQ ID NO: 231769 - DNA, 103 bp, Artificial Sequence
  Synthetic Polynucleotide
taatacgactcactatagggcaatggaaagggcaggaactggccccccaaaacagaggagattggggatgcagttcctgaacctggcggcagcgcaaaagatg

SEQ ID NO: 231770 - DNA, 103 bp, Artificial Sequence
  Synthetic Polynucleotide
taatacgactcactatagggcagcagggggcaatggaaagggcaggaactaacagaggagaagttccatgcctttccataacctggcggcagcgcaaaagatg

SEQ ID NO: 231771 - DNA, 103 bp, Artificial Sequence
  Synthetic Polynucleotide
taatacgactcactataggggctgttcccccagcagggggcaatggaaagaacagaggagactttccatggccccctgcaacctggcggcagcgcaaaagatg

SEQ ID NO: 231772 - DNA, 103 bp, Artificial Sequence
  Synthetic Polynucleotide
taatacgactcactatagggagctggcggtgctgttcccccagcagggggaacagaggagaccccctatggggggaacaaacctggcggcagcgcaaaagatg

SEQ ID NO: 231773 - DNA, 103 bp, Artificial Sequence
  Synthetic Polynucleotide
taatacgactcactatagggggccaaagacagctggcggtgctgttccccaacagaggagaggggaaatgcaccgccagaacctggcggcagcgcaaaagatg

SEQ ID NO: 231774 - DNA, 103 bp, Artificial Sequence
  Synthetic Polynucleotide
taatacgactcactatagggtgtagctgggggccaaagacagctggcggtaacagaggagaaccgccatgtgtctttggaacctggcggcagcgcaaaagatg

SEQ ID NO: 231775 - DNA, 103 bp, Artificial Sequence
  Synthetic Polynucleotide
taatacgactcactataggggtaggccccctgtagctgggggccaaagacaacagaggagagtctttatgccccagctaaacctggcggcagcgcaaaagatg

SEQ ID NO: 231776 - DNA, 103 bp, Artificial Sequence
  Synthetic Polynucleotide
taatacgactcactatagggggcggcacagaaggcagagccagaagaccgaacagaggagacggtctatgggctctgccaacctggcggcagcgcaaaagatg

SEQ ID NO: 231777 - DNA, 103 bp, Artificial Sequence
  Synthetic Polynucleotide
taatacgactcactataggggctgttggaagtaggccccctgtagctgggaacagaggagacccagcatgagggggcctaacctggcggcagcgcaaaagatg

SEQ ID NO: 231778 - DNA, 103 bp, Artificial Sequence
  Synthetic Polynucleotide
taatacgactcactatagggatgccatagagctgttggaagtaggcccccaacagaggagagggggcatgcttccaacaaacctggcggcagcgcaaaagatg

SEQ ID NO: 231779 - DNA, 103 bp, Artificial Sequence
  Synthetic Polynucleotide
taatacgactcactatagggccccttcttcatgccatagagctgttggaaaacagaggagattccaaatgctctatggcaacctggcggcagcgcaaaagatg

SEQ ID NO: 231780 - DNA, 103 bp, Artificial Sequence
  Synthetic Polynucleotide
taatacgactcactatagggtgggaaatagccccttcttcatgccatagaaacagaggagatctatgatgtgaagaaggaacctggcggcagcgcaaaagatg

SEQ ID NO: 231781 - DNA, 103 bp, Artificial Sequence
  Synthetic Polynucleotide
taatacgactcactatagggatggggttcatgggaaatagccccttcttcaacagaggagagaagaaatggctatttccaacctggcggcagcgcaaaagatg

SEQ ID NO: 231782 - DNA, 103 bp, Artificial Sequence
  Synthetic Polynucleotide
taatacgactcactatagggctgaggtatcatggggttcatgggaaatagaacagaggagactatttatgatgaaccccaacctggcggcagcgcaaaagatg

SEQ ID NO: 231783 - DNA, 103 bp, Artificial Sequence
  Synthetic Polynucleotide
taatacgactcactatagggcaatgagggtctgaggtatcatggggttcaaacagaggagatgaaccatgtgatacctcaacctggcggcagcgcaaaagatg

SEQ ID NO: 231784 - DNA, 103 bp, Artificial Sequence
  Synthetic Polynucleotide
taatacgactcactataggggggagcagcccaatgagggtctgaggtatcaacagaggagagataccatggaccctcataacctggcggcagcgcaaaagatg

SEQ ID NO: 231785 - DNA, 103 bp, Artificial Sequence
  Synthetic Polynucleotide
taatacgactcactataggggagggcattggggagcagcccaatgagggtaacagaggagaaccctcatggggctgctcaacctggcggcagcgcaaaagatg

SEQ ID NO: 231786 - DNA, 103 bp, Artificial Sequence
  Synthetic Polynucleotide
taatacgactcactataggggcggctggaggagggcattggggagcagccaacagaggagaggctgcatgccaatgcccaacctggcggcagcgcaaaagatg

SEQ ID NO: 231787 - DNA, 103 bp, Artificial Sequence
  Synthetic Polynucleotide
taatacgactcactatagggctgaaacccaggcggcacagaaggcagagcaacagaggagagctctgatgtctgtgccgaacctggcggcagcgcaaaagatg

SEQ ID NO: 231788 - DNA, 103 bp, Artificial Sequence
  Synthetic Polynucleotide
taatacgactcactatagggggctggggtggcggctggaggagggcattgaacagaggagacaatgcatgcctccagccaacctggcggcagcgcaaaagatg

SEQ ID NO: 231789 - DNA, 103 bp, Artificial Sequence
  Synthetic Polynucleotide
taatacgactcactataggggggctcagggggctggggtggcggctggagaacagaggagactccagatgccaccccagaacctggcggcagcgcaaaagatg

SEQ ID NO: 231790 - DNA, 103 bp, Artificial Sequence
  Synthetic Polynucleotide
taatacgactcactatagggctgtggctgtgggctcagggggctggggtgaacagaggagacaccccatgcccctgagcaacctggcggcagcgcaaaagatg

SEQ ID NO: 231791 - DNA, 103 bp, Artificial Sequence
  Synthetic Polynucleotide
taatacgactcactatagggtttggaggtgctgtggctgtgggctcagggaacagaggagaccctgaatgcacagccacaacctggcggcagcgcaaaagatg

SEQ ID NO: 231792 - DNA, 103 bp, Artificial Sequence
  Synthetic Polynucleotide
taatacgactcactatagggttcaggaggctttggaggtgctgtggctgtaacagaggagaacagccatggcacctccaaacctggcggcagcgcaaaagatg

SEQ ID NO: 231793 - DNA, 103 bp, Artificial Sequence
  Synthetic Polynucleotide
taatacgactcactataggggagcaggcagttcaggaggctttggaggtgaacagaggagacacctcatgagcctcctgaacctggcggcagcgcaaaagatg

SEQ ID NO: 231794 - DNA, 103 bp, Artificial Sequence
  Synthetic Polynucleotide
taatacgactcactatagggccctcccctggagcaggcagttcaggaggcaacagaggagagcctccatgactgcctgcaacctggcggcagcgcaaaagatg

SEQ ID NO: 231795 - DNA, 103 bp, Artificial Sequence
  Synthetic Polynucleotide
taatacgactcactatagggaccagcttccccctcccctggagcaggcagaacagaggagactgcctatgccaggggagaacctggcggcagcgcaaaagatg

SEQ ID NO: 231796 - DNA, 103 bp, Artificial Sequence
  Synthetic Polynucleotide
taatacgactcactatagggcatcaacctcaccagcttccccctcccctgaacagaggagacaggggatggggaagctgaacctggcggcagcgcaaaagatg

SEQ ID NO: 231797 - DNA, 103 bp, Artificial Sequence
  Synthetic Polynucleotide
taatacgactcactataggggtcagcagctcatcaacctcaccagcttccaacagaggagaggaagcatgtgaggttgaaacctggcggcagcgcaaaagatg

SEQ ID NO: 231798 - DNA, 103 bp, Artificial Sequence
  Synthetic Polynucleotide
taatacgactcactatagggctggggcttgctgaaacccaggcggcacagaacagaggagactgtgcatgctgggtttcaacctggcggcagcgcaaaagatg

SEQ ID NO: 231799 - DNA, 103 bp, Artificial Sequence
  Synthetic Polynucleotide
taatacgactcactatagggagtgctgcctgtcagcagctcatcaacctcaacagaggagagaggttatggagctgctgaacctggcggcagcgcaaaagatg

SEQ ID NO: 231800 - DNA, 103 bp, Artificial Sequence
  Synthetic Polynucleotide
taatacgactcactatagggtggagatgccagtgctgcctgtcagcagctaacagaggagaagctgcatgcaggcagcaaacctggcggcagcgcaaaagatg

SEQ ID NO: 231801 - DNA, 103 bp, Artificial Sequence
  Synthetic Polynucleotide
taatacgactcactatagggacatccacggtggagatgccagtgctgcctaacagaggagaaggcagatgtggcatctcaacctggcggcagcgcaaaagatg

SEQ ID NO: 231802 - DNA, 103 bp, Artificial Sequence
  Synthetic Polynucleotide
taatacgactcactataggggcgatgggttacatccacggtggagatgccaacagaggagaggcatcatgaccgtggataacctggcggcagcgcaaaagatg

SEQ ID NO: 231803 - DNA, 103 bp, Artificial Sequence
  Synthetic Polynucleotide
taatacgactcactatagggggcacaggtagcgatgggttacatccacggaacagaggagaccgtggatgtaacccatcaacctggcggcagcgcaaaagatg

SEQ ID NO: 231804 - DNA, 103 bp, Artificial Sequence
  Synthetic Polynucleotide
taatacgactcactatagggttgcactggcggcacaggtagcgatgggttaacagaggagaaacccaatgctacctgtgaacctggcggcagcgcaaaagatg

SEQ ID NO: 231805 - DNA, 103 bp, Artificial Sequence
  Synthetic Polynucleotide
taatacgactcactatagggaaatgccatcttgcactggcggcacaggtaaacagaggagatacctgatgcgccagtgcaacctggcggcagcgcaaaagatg

SEQ ID NO: 231806 - DNA, 103 bp, Artificial Sequence
  Synthetic Polynucleotide
taatacgactcactatagggcctccccgtcaaatgccatcttgcactggcaacagaggagagccagtatgagatggcataacctggcggcagcgcaaaagatg

SEQ ID NO: 231807 - DNA, 103 bp, Artificial Sequence
  Synthetic Polynucleotide
taatacgactcactataggggtagccggggcctccccgtcaaatgccatcaacagaggagagatggcatgtgacggggaaacctggcggcagcgcaaaagatg

SEQ ID NO: 231808 - DNA, 103 bp, Artificial Sequence
  Synthetic Polynucleotide
taatacgactcactatagggctggtgggcagtagccggggcctccccgtcaacagaggagagacgggatggccccggctaacctggcggcagcgcaaaagatg

SEQ ID NO: 231809 - DNA, 103 bp, Artificial Sequence
  Synthetic Polynucleotide
taatacgactcactatagggccataaaggcctggggcttgctgaaacccaaacagaggagatgggttatggcaagccccaacctggcggcagcgcaaaagatg

SEQ ID NO: 231810 - DNA, 103 bp, Artificial Sequence
  Synthetic Polynucleotide
taatacgactcactatagggagaaggatctctggtgggcagtagccggggaacagaggagaccccggatgctgcccaccaacctggcggcagcgcaaaagatg

SEQ ID NO: 231811 - DNA, 103 bp, Artificial Sequence
  Synthetic Polynucleotide
taatacgactcactatagggccaaagaagcagaaggatctctggtgggcaaacagaggagatgcccaatggagatccttaacctggcggcagcgcaaaagatg

SEQ ID NO: 231812 - DNA, 103 bp, Artificial Sequence
  Synthetic Polynucleotide
taatacgactcactatagggagagccccgcccaaagaagcagaaggatctaacagaggagaagatccatgtgcttctttaacctggcggcagcgcaaaagatg

SEQ ID NO: 231813 - DNA, 103 bp, Artificial Sequence
  Synthetic Polynucleotide
taatacgactcactatagggtggagcccccagagccccgcccaaagaagcaacagaggagagcttctatgggcggggctaacctggcggcagcgcaaaagatg

SEQ ID NO: 231814 - DNA, 103 bp, Artificial Sequence
  Synthetic Polynucleotide
taatacgactcactataggggggggtggcatggagcccccagagccccgcaacagaggagagcggggatgtgggggctcaacctggcggcagcgcaaaagatg

SEQ ID NO: 231815 - DNA, 103 bp, Artificial Sequence
  Synthetic Polynucleotide
taatacgactcactatagggcacccgcaatgggggtggcatggagcccccaacagaggagagggggcatgatgccacccaacctggcggcagcgcaaaagatg

SEQ ID NO: 231816 - DNA, 103 bp, Artificial Sequence
  Synthetic Polynucleotide
taatacgactcactatagggtgcagatgggcacccgcaatgggggtggcaaacagaggagatgccacatgcattgcgggaacctggcggcagcgcaaaagatg

SEQ ID NO: 231817 - DNA, 103 bp, Artificial Sequence
  Synthetic Polynucleotide
taatacgactcactatagggcagtggtaggtgcagatgggcacccgcaataacagaggagaattgcgatggcccatctgaacctggcggcagcgcaaaagatg

SEQ ID NO: 231818 - DNA, 103 bp, Artificial Sequence
  Synthetic Polynucleotide
taatacgactcactatagggacatgccaggcagtggtaggtgcagatgggaacagaggagacccatcatgacctaccacaacctggcggcagcgcaaaagatg

SEQ ID NO: 231819 - DNA, 103 bp, Artificial Sequence
  Synthetic Polynucleotide
taatacgactcactataggggcagcacctcacatgccaggcagtggtaggaacagaggagacctaccatggcctggcataacctggcggcagcgcaaaagatg

SEQ ID NO: 231820 - DNA, 103 bp, Artificial Sequence
  Synthetic Polynucleotide
taatacgactcactatagggtgtgtgtgatccataaaggcctggggcttgaacagaggagacaagccatgggcctttataacctggcggcagcgcaaaagatg

SEQ ID NO: 231821 - DNA, 103 bp, Artificial Sequence
  Synthetic Polynucleotide
taatacgactcactatagggcgcccactcagcagcacctcacatgccaggaacagaggagacctggcatgtgaggtgctaacctggcggcagcgcaaaagatg

SEQ ID NO: 231822 - DNA, 103 bp, Artificial Sequence
  Synthetic Polynucleotide
taatacgactcactatagggtagggcttcacgcccactcagcagcacctcaacagaggagagaggtgatgctgagtgggaacctggcggcagcgcaaaagatg

SEQ ID NO: 231823 - DNA, 103 bp, Artificial Sequence
  Synthetic Polynucleotide
taatacgactcactatagggggtgggaggctagggcttcacgcccactcaaacagaggagatgagtgatggtgaagcccaacctggcggcagcgcaaaagatg

SEQ ID NO: 231824 - DNA, 103 bp, Artificial Sequence
  Synthetic Polynucleotide
taatacgactcactataggggaggagcgcaggtgggaggctagggcttcaaacagaggagatgaagcatgagcctcccaaacctggcggcagcgcaaaagatg

SEQ ID NO: 231825 - DNA, 103 bp, Artificial Sequence
  Synthetic Polynucleotide
taatacgactcactatagggcctgtgggccgaggagcgcaggtgggaggcaacagaggagagcctccatgctgcgctccaacctggcggcagcgcaaaagatg

SEQ ID NO: 231826 - DNA, 103 bp, Artificial Sequence
  Synthetic Polynucleotide
taatacgactcactatagggctgccttgcgcctgtgggccgaggagcgcaaacagaggagatgcgctatgcggcccacaaacctggcggcagcgcaaaagatg

SEQ ID NO: 231827 - DNA, 103 bp, Artificial Sequence
  Synthetic Polynucleotide
taatacgactcactatagggtgaggtggggctgccttgcgcctgtgggccaacagaggagaggcccaatggcgcaaggcaacctggcggcagcgcaaaagatg

SEQ ID NO: 231828 - DNA, 103 bp, Artificial Sequence
  Synthetic Polynucleotide
taatacgactcactatagggtgggcccccttgaggtggggctgccttgcgaacagaggagacgcaagatggccccacctaacctggcggcagcgcaaaagatg

SEQ ID NO: 231829 - DNA, 103 bp, Artificial Sequence
  Synthetic Polynucleotide
taatacgactcactatagggtggagatgggtgggcccccttgaggtggggaacagaggagaccccacatgaagggggccaacctggcggcagcgcaaaagatg

SEQ ID NO: 231830 - DNA, 103 bp, Artificial Sequence
  Synthetic Polynucleotide
taatacgactcactataggggcgttggtgatggagatgggtgggccccctaacagaggagaagggggatgacccatctcaacctggcggcagcgcaaaagatg

SEQ ID NO: 231831 - DNA, 103 bp, Artificial Sequence
  Synthetic Polynucleotide
taatacgactcactatagggcccatgagactgtgtgtgatccataaaggcaacagaggagagcctttatggatcacacaaacctggcggcagcgcaaaagatg

SEQ ID NO: 231832 - DNA, 103 bp, Artificial Sequence
  Synthetic Polynucleotide
taatacgactcactatagggagcagtggcggcgttggtgatggagatgggaacagaggagacccatcatgatcaccaacaacctggcggcagcgcaaaagatg

SEQ ID NO: 231833 - DNA, 103 bp, Artificial Sequence
  Synthetic Polynucleotide
taatacgactcactatagggcagccgaggcagcagtggcggcgttggtgaaacagaggagatcaccaatgccgccactgaacctggcggcagcgcaaaagatg

SEQ ID NO: 231834 - DNA, 103 bp, Artificial Sequence
  Synthetic Polynucleotide
taatacgactcactatagggaaagccacagcagccgaggcagcagtggcgaacagaggagacgccacatgtgcctcggcaacctggcggcagcgcaaaagatg

SEQ ID NO: 231835 - DNA, 103 bp, Artificial Sequence
  Synthetic Polynucleotide
taatacgactcactatagggctctttggcaaaagccacagcagccgaggcaacagaggagagcctcgatggctgtggctaacctggcggcagcgcaaaagatg

SEQ ID NO: 231836 - DNA, 103 bp, Artificial Sequence
  Synthetic Polynucleotide
taatacgactcactatagggatcttgcttcctctttggcaaaagccacagaacagaggagactgtggatgttgccaaagaacctggcggcagcgcaaaagatg

SEQ ID NO: 231837 - DNA, 103 bp, Artificial Sequence
  Synthetic Polynucleotide
taatacgactcactataggggtgtgaggtaatcttgcttcctctttggcaaacagaggagatgccaaatgggaagcaagaacctggcggcagcgcaaaagatg

SEQ ID NO: 231838 - DNA, 103 bp, Artificial Sequence
  Synthetic Polynucleotide
taatacgactcactataggggttggagtccgtgtgaggtaatcttgcttcaacagaggagagaagcaatgttacctcacaacctggcggcagcgcaaaagatg

SEQ ID NO: 231839 - DNA, 103 bp, Artificial Sequence
  Synthetic Polynucleotide
taatacgactcactatagggtagtttttgggttggagtccgtgtgaggtaaacagaggagatacctcatgcggactccaaacctggcggcagcgcaaaagatg

SEQ ID NO: 231840 - DNA, 103 bp, Artificial Sequence
  Synthetic Polynucleotide
taatacgactcactataggggaggtagtcgtagtttttgggttggagtccaacagaggagaggactcatgcccaaaaacaacctggcggcagcgcaaaagatg

SEQ ID NO: 231841 - DNA, 103 bp, Artificial Sequence
  Synthetic Polynucleotide
taatacgactcactatagggtagaagtgtagaggtagtcgtagtttttggaacagaggagaccaaaaatgacgactaccaacctggcggcagcgcaaaagatg

SEQ ID NO: 231842 - DNA, 103 bp, Artificial Sequence
  Synthetic Polynucleotide
taatacgactcactatagggttagcttcaccccatgagactgtgtgtgataacagaggagaatcacaatgagtctcatgaacctggcggcagcgcaaaagatg

SEQ ID NO: 231843 - DNA, 103 bp, Artificial Sequence
  Synthetic Polynucleotide
taatacgactcactatagggtgggcaggggttagcttcaccccatgagacaacagaggagagtctcaatgggtgaagctaacctggcggcagcgcaaaagatg

SEQ ID NO: 231844 - DNA, 103 bp, Artificial Sequence
  Synthetic Polynucleotide
taatacgactcactataggggccctgatattgggcaggggttagcttcacaacagaggagagtgaagatgacccctgccaacctggcggcagcgcaaaagatg

SEQ ID NO: 231845 - DNA, 103 bp, Artificial Sequence
  Synthetic Polynucleotide
taatacgactcactatagggagggggtgctggaggagaaggtgtccgaagaacagaggagacttcggatgccttctcctaacctggcggcagcgcaaaagatg

SEQ ID NO: 231846 - DNA, 103 bp, Artificial Sequence
  Synthetic Polynucleotide
taatacgactcactatagggtacctgacaggccctgatattgggcaggggaacagaggagacccctgatgaatatcaggaacctggcggcagcgcaaaagatg

SEQ ID NO: 231847 - DNA, 103 bp, Artificial Sequence
  Synthetic Polynucleotide
taatacgactcactatagggacagctgggctacctgacaggccctgatataacagaggagaatatcaatgcctgtcaggaacctggcggcagcgcaaaagatg

SEQ ID NO: 231848 - DNA, 103 bp, Artificial Sequence
  Synthetic Polynucleotide
taatacgactcactatagggctcctggagtacagctgggctacctgacagaacagaggagactgtcaatgagcccagctaacctggcggcagcgcaaaagatg

SEQ ID NO: 231849 - DNA, 103 bp, Artificial Sequence
  Synthetic Polynucleotide
taatacgactcactatagggcttcatctccctcctggagtacagctgggcaacagaggagagcccagatgtactccaggaacctggcggcagcgcaaaagatg

SEQ ID NO: 231850 - DNA, 103 bp, Artificial Sequence
  Synthetic Polynucleotide
taatacgactcactataggggccttgcagccttcatctccctcctggagtaacagaggagaactccaatggggagatgaaacctggcggcagcgcaaaagatg

SEQ ID NO: 231851 - DNA, 103 bp, Artificial Sequence
  Synthetic Polynucleotide
taatacgactcactataggggcttatgagggccttgcagccttcatctccaacagaggagaggagatatgggctgcaagaacctggcggcagcgcaaaagatg

SEQ ID NO: 231852 - DNA, 103 bp, Artificial Sequence
  Synthetic Polynucleotide
taatacgactcactataggggctccagaaagcttatgagggccttgcagcaacagaggagagctgcaatgccctcataaaacctggcggcagcgcaaaagatg

SEQ ID NO: 231853 - DNA, 103 bp, Artificial Sequence
  Synthetic Polynucleotide
taatacgactcactataggggggagttttggctccagaaagcttatgaggaacagaggagacctcatatgctttctggaaacctggcggcagcgcaaaagatg

SEQ ID NO: 231854 - DNA, 103 bp, Artificial Sequence
  Synthetic Polynucleotide
taatacgactcactatagggggggcgagcagggagttttggctccagaaaaacagaggagatttctgatgccaaaactcaacctggcggcagcgcaaaagatg

SEQ ID NO: 231855 - DNA, 103 bp, Artificial Sequence
  Synthetic Polynucleotide
taatacgactcactatagggtgtcagaagaggggcgagcagggagttttgaacagaggagacaaaacatgctgctcgccaacctggcggcagcgcaaaagatg

SEQ ID NO: 231856 - DNA, 103 bp, Artificial Sequence
  Synthetic Polynucleotide
taatacgactcactatagggacaggatcagagggggtgctggaggagaagaacagaggagacttctcatgcagcaccccaacctggcggcagcgcaaaagatg

SEQ ID NO: 231857 - DNA, 103 bp, Artificial Sequence
  Synthetic Polynucleotide
taatacgactcactatagggtcaaggggtatgtcagaagaggggcgagcaaacagaggagatgctcgatgctcttctgaaacctggcggcagcgcaaaagatg

SEQ ID NO: 231858 - DNA, 103 bp, Artificial Sequence
  Synthetic Polynucleotide
taatacgactcactataggggctgctgttgtcaaggggtatgtcagaagaaacagaggagatcttctatgataccccttaacctggcggcagcgcaaaagatg

SEQ ID NO: 231859 - DNA, 103 bp, Artificial Sequence
  Synthetic Polynucleotide
taatacgactcactatagggtgttcactgtgctgctgttgtcaaggggtaaacagaggagataccccatgacaacagcaaacctggcggcagcgcaaaagatg

SEQ ID NO: 231860 - DNA, 103 bp, Artificial Sequence
  Synthetic Polynucleotide
taatacgactcactatagggttcgcctccatgttcactgtgctgctgttgaacagaggagacaacagatgcacagtgaaaacctggcggcagcgcaaaagatg

SEQ ID NO: 231861 - DNA, 103 bp, Artificial Sequence
  Synthetic Polynucleotide
taatacgactcactatagggctgggccacattcgcctccatgttcactgtaacagaggagaacagtgatgatggaggcgaacctggcggcagcgcaaaagatg

SEQ ID NO: 231862 - DNA, 103 bp, Artificial Sequence
  Synthetic Polynucleotide
taatacgactcactatagggcatcctctgtctgggccacattcgcctccaaacagaggagatggaggatgatgtggcccaacctggcggcagcgcaaaagatg

SEQ ID NO: 231863 - DNA, 103 bp, Artificial Sequence
  Synthetic Polynucleotide
taatacgactcactatagggtcaggggggccatcctctgtctgggccacaaacagaggagatgtggcatggacagaggaaacctggcggcagcgcaaaagatg

SEQ ID NO: 231864 - DNA, 103 bp, Artificial Sequence
  Synthetic Polynucleotide
taatacgactcactataggggacttctgcctcaggggggccatcctctgtaacagaggagaacagagatgggcccccctaacctggcggcagcgcaaaagatg

SEQ ID NO: 231865 - DNA, 103 bp, Artificial Sequence
  Synthetic Polynucleotide
taatacgactcactatagggtaagggcctggacttctgcctcaggggggcaacagaggagagcccccatgaggcagaagaacctggcggcagcgcaaaagatg

SEQ ID NO: 231866 - DNA, 103 bp, Artificial Sequence
  Synthetic Polynucleotide
taatacgactcactatagggtccaggaggataagggcctggacttctgccaacagaggagaggcagaatgccaggccctaacctggcggcagcgcaaaagatg

SEQ ID NO: 231867 - DNA, 103 bp, Artificial Sequence
  Synthetic Polynucleotide
taatacgactcactatagggcgagacgacgggcgagtcacagccttccataacagaggagaatggaaatgtgtgactcgaacctggcggcagcgcaaaagatg

SEQ ID NO: 231868 - DNA, 103 bp, Artificial Sequence
  Synthetic Polynucleotide
taatacgactcactatagggctccatgctactgggtttgtcagggaggtgaacagaggagacacctcatggacaaacccaacctggcggcagcgcaaaagatg

SEQ ID NO: 231869 - DNA, 103 bp, Artificial Sequence
  Synthetic Polynucleotide
taatacgactcactatagggcagaaaacttacaaggggttccttgtctttaacagaggagaaaagacatggaaccccttaacctggcggcagcgcaaaagatg

SEQ ID NO: 231870 - DNA, 103 bp, Artificial Sequence
  Synthetic Polynucleotide
taatacgactcactataggggccttccatgccatacataggctgcaggtaaacagaggagatacctgatgcctatgtataacctggcggcagcgcaaaagatg

SEQ ID NO: 231871 - DNA, 103 bp, Artificial Sequence
  Synthetic Polynucleotide
taatacgactcactatagggaggggaacaggccttccatgccatacatagaacagaggagactatgtatggcatggaagaacctggcggcagcgcaaaagatg

SEQ ID NO: 231872 - DNA, 103 bp, Artificial Sequence
  Synthetic Polynucleotide
taatacgactcactataggggcagggctgtaggggaacaggccttccatgaacagaggagacatggaatgcctgttcccaacctggcggcagcgcaaaagatg

SEQ ID NO: 231873 - DNA, 103 bp, Artificial Sequence
  Synthetic Polynucleotide
taatacgactcactatagggctgcgacagtgcagggctgtaggggaacagaacagaggagactgttcatgtacagccctaacctggcggcagcgcaaaagatg

SEQ ID NO: 231874 - DNA, 103 bp, Artificial Sequence
  Synthetic Polynucleotide
taatacgactcactatagggccatcagggcctgcgacagtgcagggctgtaacagaggagaacagccatgcactgtcgcaacctggcggcagcgcaaaagatg

SEQ ID NO: 231875 - DNA, 103 bp, Artificial Sequence
  Synthetic Polynucleotide
taatacgactcactatagggggggacagccccatcagggcctgcgacagtaacagaggagaactgtcatgggccctgataacctggcggcagcgcaaaagatg

SEQ ID NO: 231876 - DNA, 103 bp, Artificial Sequence
  Synthetic Polynucleotide
taatacgactcactatagggtagggagcctggggacagccccatcagggcaacagaggagagccctgatggggctgtccaacctggcggcagcgcaaaagatg

SEQ ID NO: 231877 - DNA, 103 bp, Artificial Sequence
  Synthetic Polynucleotide
taatacgactcactatagggactgctgcagtagggagcctggggacagccaacagaggagaggctgtatgcaggctcccaacctggcggcagcgcaaaagatg

SEQ ID NO: 231878 - DNA, 103 bp, Artificial Sequence
  Synthetic Polynucleotide
taatacgactcactatagggtattgctggtactgctgcagtagggagcctaacagaggagaaggctcatgactgcagcaaacctggcggcagcgcaaaagatg

SEQ ID NO: 231879 - DNA, 103 bp, Artificial Sequence
  Synthetic Polynucleotide
taatacgactcactatagggactctgctggtattgctggtactgctgcagaacagaggagactgcagatgtaccagcaaaacctggcggcagcgcaaaagatg

SEQ ID NO: 231880 - DNA, 103 bp, Artificial Sequence
  Synthetic Polynucleotide
taatacgactcactatagggtttttggttccagaaaacttacaaggggttaacagaggagaaaccccatgtaagttttcaacctggcggcagcgcaaaagatg

SEQ ID NO: 231881 - DNA, 103 bp, Artificial Sequence
  Synthetic Polynucleotide
taatacgactcactatagggcctcctgcagactctgctggtattgctggtaacagaggagaaccagcatgaccagcagaaacctggcggcagcgcaaaagatg

SEQ ID NO: 231882 - DNA, 103 bp, Artificial Sequence
  Synthetic Polynucleotide
taatacgactcactatagggtgctgaattgcctcctgcagactctgctggaacagaggagaccagcaatgtctgcaggaaacctggcggcagcgcaaaagatg

SEQ ID NO: 231883 - DNA, 103 bp, Artificial Sequence
  Synthetic Polynucleotide
taatacgactcactatagggctgctgctgctgctgaattgcctcctgcagaacagaggagactgcagatggcaattcagaacctggcggcagcgcaaaagatg

SEQ ID NO: 231884 - DNA, 103 bp, Artificial Sequence
  Synthetic Polynucleotide
taatacgactcactataggggtagttgccgctgctgctgctgctgaattgaacagaggagacaattcatgagcagcagcaacctggcggcagcgcaaaagatg

SEQ ID NO: 231885 - DNA, 103 bp, Artificial Sequence
  Synthetic Polynucleotide
taatacgactcactatagggtgctgctgctgtagttgccgctgctgctgcaacagaggagagcagcaatggcggcaactaacctggcggcagcgcaaaagatg

SEQ ID NO: 231886 - DNA, 103 bp, Artificial Sequence
  Synthetic Polynucleotide
taatacgactcactatagggtttttgctgctgctgctgctgtagttgccgaacagaggagacggcaaatgcagcagcagaacctggcggcagcgcaaaagatg

SEQ ID NO: 231887 - DNA, 103 bp, Artificial Sequence
  Synthetic Polynucleotide
taatacgactcactataggggctgctgcactttttgctgctgctgctgctaacagaggagaagcagcatgagcagcaaaaacctggcggcagcgcaaaagatg

SEQ ID NO: 231888 - DNA, 103 bp, Artificial Sequence
  Synthetic Polynucleotide
taatacgactcactatagggttgggctgctgctgctgcactttttgctgcaacagaggagagcagcaatgagtgcagcaaacctggcggcagcgcaaaagatg

SEQ ID NO: 231889 - DNA, 103 bp, Artificial Sequence
  Synthetic Polynucleotide
taatacgactcactatagggttggcttgctttgggctgctgctgctgcacaacagaggagagtgcagatgcagcagcccaacctggcggcagcgcaaaagatg

SEQ ID NO: 231890 - DNA, 103 bp, Artificial Sequence
  Synthetic Polynucleotide
taatacgactcactatagggggactggggtttggcttgctttgggctgctaacagaggagaagcagcatgaagcaagccaacctggcggcagcgcaaaagatg

SEQ ID NO: 231891 - DNA, 103 bp, Artificial Sequence
  Synthetic Polynucleotide
taatacgactcactatagggaagtttttgttttttggttccagaaaacttaacagaggagaaagtttatgggaaccaaaaacctggcggcagcgcaaaagatg

SEQ ID NO: 231892 - DNA, 103 bp, Artificial Sequence
  Synthetic Polynucleotide
taatacgactcactataggggccccgggggggactggggtttggcttgctaacagaggagaagcaagatgaaccccagtaacctggcggcagcgcaaaagatg

SEQ ID NO: 231893 - DNA, 103 bp, Artificial Sequence
  Synthetic Polynucleotide
taatacgactcactatagggtggggaaggagccccgggggggactggggtaacagaggagaaccccaatgccccccgggaacctggcggcagcgcaaaagatg

SEQ ID NO: 231894 - DNA, 103 bp, Artificial Sequence
  Synthetic Polynucleotide
taatacgactcactatagggggtctttgtctggggaaggagccccgggggaacagaggagacccccgatgctccttcccaacctggcggcagcgcaaaagatg

SEQ ID NO: 231895 - DNA, 103 bp, Artificial Sequence
  Synthetic Polynucleotide
taatacgactcactatagggtctttggcagggtctttgtctggggaaggaaacagaggagatccttcatgagacaaagaaacctggcggcagcgcaaaagatg

SEQ ID NO: 231896 - DNA, 103 bp, Artificial Sequence
  Synthetic Polynucleotide
taatacgactcactatagggtttgggggattctttggcagggtctttgtcaacagaggagagacaaaatgcctgccaaaaacctggcggcagcgcaaaagatg

SEQ ID NO: 231897 - DNA, 103 bp, Artificial Sequence
  Synthetic Polynucleotide
taatacgactcactataggggttcttctggtttgggggattctttggcagaacagaggagactgccaatgaatcccccaaacctggcggcagcgcaaaagatg

SEQ ID NO: 231898 - DNA, 103 bp, Artificial Sequence
  Synthetic Polynucleotide
taatacgactcactataggggtgtttttctgttcttctggtttgggggataacagaggagaatccccatgaccagaagaaacctggcggcagcgcaaaagatg

SEQ ID NO: 231899 - DNA, 103 bp, Artificial Sequence
  Synthetic Polynucleotide
taatacgactcactatagggctcacggggggtgtttttctgttcttctggaacagaggagaccagaaatgcagaaaaacaacctggcggcagcgcaaaagatg

SEQ ID NO: 231900 - DNA, 103 bp, Artificial Sequence
  Synthetic Polynucleotide
taatacgactcactatagggggggggacacctcacggggggtgtttttctaacagaggagaagaaaaatgccccccgtgaacctggcggcagcgcaaaagatg

SEQ ID NO: 231901 - DNA, 103 bp, Artificial Sequence
  Synthetic Polynucleotide
taatacgactcactatagggttcggcaggaggggggacacctcacgggggaacagaggagacccccgatgggtgtccccaacctggcggcagcgcaaaagatg

SEQ ID NO: 231902 - DNA, 103 bp, Artificial Sequence
  Synthetic Polynucleotide
taatacgactcactatagggagggtgttgaaagtttttgttttttggttcaacagaggagagaaccaatgaacaaaaacaacctggcggcagcgcaaaagatg

SEQ ID NO: 231903 - DNA, 103 bp, Artificial Sequence
  Synthetic Polynucleotide
taatacgactcactatagggttcagggagtttcggcaggaggggggacacaacagaggagagtgtccatgctcctgccgaacctggcggcagcgcaaaagatg

SEQ ID NO: 231904 - DNA, 103 bp, Artificial Sequence
  Synthetic Polynucleotide
taatacgactcactatagggcttctggctcttcagggagtttcggcaggaaacagaggagatcctgcatgaactccctgaacctggcggcagcgcaaaagatg

SEQ ID NO: 231905 - DNA, 103 bp, Artificial Sequence
  Synthetic Polynucleotide
taatacgactcactatagggttgctttctgcttctggctcttcagggagtaacagaggagaactcccatgagagccagaaacctggcggcagcgcaaaagatg

SEQ ID NO: 231906 - DNA, 103 bp, Artificial Sequence
  Synthetic Polynucleotide
taatacgactcactataggggtccgcacttttgctttctgcttctggctcaacagaggagagagccaatggcagaaagcaacctggcggcagcgcaaaagatg

SEQ ID NO: 231907 - DNA, 103 bp, Artificial Sequence
  Synthetic Polynucleotide
taatacgactcactatagggcgtagagggagtccgcacttttgctttctgaacagaggagacagaaaatgaaagtgcggaacctggcggcagcgcaaaagatg

SEQ ID NO: 231908 - DNA, 103 bp, Artificial Sequence
  Synthetic Polynucleotide
taatacgactcactatagggatgaaggggtcgtagagggagtccgcacttaacagaggagaaagtgcatgctccctctaaacctggcggcagcgcaaaagatg

SEQ ID NO: 231909 - DNA, 103 bp, Artificial Sequence
  Synthetic Polynucleotide
taatacgactcactatagggctttggaacaatgaaggggtcgtagagggaaacagaggagatccctcatggaccccttcaacctggcggcagcgcaaaagatg

SEQ ID NO: 231910 - DNA, 103 bp, Artificial Sequence
  Synthetic Polynucleotide
taatacgactcactatagggtgtactgcacctttggaacaatgaaggggtaacagaggagaacccctatgttgttccaaaacctggcggcagcgcaaaagatg

SEQ ID NO: 231911 - DNA, 103 bp, Artificial Sequence
  Synthetic Polynucleotide
taatacgactcactatagggcagaccaacttgtactgcacctttggaacaaacagaggagatgttccatgggtgcagtaaacctggcggcagcgcaaaagatg

SEQ ID NO: 231912 - DNA, 103 bp, Artificial Sequence
  Synthetic Polynucleotide
taatacgactcactataggggcacttgcggcagaccaacttgtactgcacaacagaggagagtgcagatgaagttggtcaacctggcggcagcgcaaaagatg

SEQ ID NO: 231913 - DNA, 103 bp, Artificial Sequence
  Synthetic Polynucleotide
taatacgactcactatagggtggaaactaaagggtgttgaaagtttttgtaacagaggagaacaaaaatgttcaacaccaacctggcggcagcgcaaaagatg

SEQ ID NO: 231914 - DNA, 103 bp, Artificial Sequence
  Synthetic Polynucleotide
taatacgactcactatagggagcccgcctggcacttgcggcagaccaactaacagaggagaagttggatggccgcaagtaacctggcggcagcgcaaaagatg

SEQ ID NO: 231915 - DNA, 103 bp, Artificial Sequence
  Synthetic Polynucleotide
taatacgactcactatagggtcgtcgctgaagcccgcctggcacttgcggaacagaggagaccgcaaatgccaggcgggaacctggcggcagcgcaaaagatg

SEQ ID NO: 231916 - DNA, 103 bp, Artificial Sequence
  Synthetic Polynucleotide
taatacgactcactatagggcgctgcctcctcgtcgctgaagcccgcctgaacagaggagacaggcgatgttcagcgacaacctggcggcagcgcaaaagatg

SEQ ID NO: 231917 - DNA, 103 bp, Artificial Sequence
  Synthetic Polynucleotide
taatacgactcactatagggggtggctcctcgctgcctcctcgtcgctgaaacagaggagatcagcgatgaggaggcagaacctggcggcagcgcaaaagatg

SEQ ID NO: 231918 - DNA, 103 bp, Artificial Sequence
  Synthetic Polynucleotide
taatacgactcactatagggagggacttcaggtggctcctcgctgcctccaacagaggagaggaggcatggaggagccaaacctggcggcagcgcaaaagatg

SEQ ID NO: 231919 - DNA, 103 bp, Artificial Sequence
  Synthetic Polynucleotide
taatacgactcactataggggaagaagcagagggacttcaggtggctcctaacagaggagaaggagcatgctgaagtccaacctggcggcagcgcaaaagatg

SEQ ID NO: 231920 - DNA, 103 bp, Artificial Sequence
  Synthetic Polynucleotide
taatacgactcactatagggcagactggccgaagaagcagagggacttcaaacagaggagatgaagtatgtctgcttctaacctggcggcagcgcaaaagatg

SEQ ID NO: 231921 - DNA, 103 bp, Artificial Sequence
  Synthetic Polynucleotide
taatacgactcactatagggaggttcaccacagactggccgaagaagcagaacagaggagactgcttatgcggccagtcaacctggcggcagcgcaaaagatg

SEQ ID NO: 231922 - DNA, 103 bp, Artificial Sequence
  Synthetic Polynucleotide
taatacgactcactatagggcatctcttgcaggttcaccacagactggccaacagaggagaggccagatggtggtgaacaacctggcggcagcgcaaaagatg

SEQ ID NO: 231923 - DNA, 103 bp, Artificial Sequence
  Synthetic Polynucleotide
taatacgactcactatagggcgtgaagcaccatctcttgcaggttcaccaaacagaggagatggtgaatgtgcaagagaaacctggcggcagcgcaaaagatg

SEQ ID NO: 231924 - DNA, 103 bp, Artificial Sequence
  Synthetic Polynucleotide
taatacgactcactatagggaggttagctgtggaaactaaagggtgttgaaacagaggagatcaacaatgtttagtttcaacctggcggcagcgcaaaagatg

SEQ ID NO: 231925 - DNA, 103 bp, Artificial Sequence
  Synthetic Polynucleotide
taatacgactcactatagggccggtggggacgtgaagcaccatctcttgcaacagaggagagcaagaatgggtgcttcaaacctggcggcagcgcaaaagatg

SEQ ID NO: 231926 - DNA, 103 bp, Artificial Sequence
  Synthetic Polynucleotide
taatacgactcactataggggccgccgccgccggtggggacgtgaagcacaacagaggagagtgcttatggtccccaccaacctggcggcagcgcaaaagatg

SEQ ID NO: 231927 - DNA, 103 bp, Artificial Sequence
  Synthetic Polynucleotide
taatacgactcactatagggcactgccaccgccgccgccgccggtggggaaacagaggagatccccaatggcggcggcgaacctggcggcagcgcaaaagatg

SEQ ID NO: 231928 - DNA, 103 bp, Artificial Sequence
  Synthetic Polynucleotide
taatacgactcactatagggccgccgccgccactgccaccgccgccgccgaacagaggagacggcggatgcggtggcagaacctggcggcagcgcaaaagatg

SEQ ID NO: 231929 - DNA, 103 bp, Artificial Sequence
  Synthetic Polynucleotide
taatacgactcactataggggccaccgccgccgccgccgccactgccaccaacagaggagaggtggcatgggcggcggcaacctggcggcagcgcaaaagatg

SEQ ID NO: 231930 - DNA, 103 bp, Artificial Sequence
  Synthetic Polynucleotide
taatacgactcactatagggcgccgccgccgccaccgccgccgccgccgcaacagaggagagcggcgatggcggcggtgaacctggcggcagcgcaaaagatg

SEQ ID NO: 231931 - DNA, 103 bp, Artificial Sequence
  Synthetic Polynucleotide
taatacgactcactatagggccgccgccgccgccgccgccgccaccgccgaacagaggagacggcggatgcggcggcggaacctggcggcagcgcaaaagatg

SEQ ID NO: 231932 - DNA, 103 bp, Artificial Sequence
  Synthetic Polynucleotide
taatacgactcactataggggtggtacgagccgccgccgccgccgccgccaacagaggagaggcggcatgggcggcggcaacctggcggcagcgcaaaagatg

SEQ ID NO: 231933 - DNA, 103 bp, Artificial Sequence
  Synthetic Polynucleotide
taatacgactcactatagggacgccaggcagtggtacgagccgccgccgcaacagaggagagcggcgatggctcgtaccaacctggcggcagcgcaaaagatg

SEQ ID NO: 231934 - DNA, 103 bp, Artificial Sequence
  Synthetic Polynucleotide
taatacgactcactataggggcgctctcgcacgccaggcagtggtacgagaacagaggagactcgtaatgctgcctggcaacctggcggcagcgcaaaagatg

SEQ ID NO: 231935 - DNA, 103 bp, Artificial Sequence
  Synthetic Polynucleotide
taatacgactcactatagggggggcctatgaggttagctgtggaaactaaaacagaggagattagttatgacagctaacaacctggcggcagcgcaaaagatg

SEQ ID NO: 231936 - DNA, 103 bp, Artificial Sequence
  Synthetic Polynucleotide
taatacgactcactatagggcccacagagcgcgctctcgcacgccaggcaaacagaggagatgcctgatgtgcgagagcaacctggcggcagcgcaaaagatg

SEQ ID NO: 231937 - DNA, 103 bp, Artificial Sequence
  Synthetic Polynucleotide
taatacgactcactataggggagcttcctccccacagagcgcgctctcgcaacagaggagagcgagaatgcgctctgtgaacctggcggcagcgcaaaagatg

SEQ ID NO: 231938 - DNA, 103 bp, Artificial Sequence
  Synthetic Polynucleotide
taatacgactcactatagggtgttgactcagagcttcctccccacagagcaacagaggagagctctgatgggaggaagcaacctggcggcagcgcaaaagatg

SEQ ID NO: 231939 - DNA, 103 bp, Artificial Sequence
  Synthetic Polynucleotide
taatacgactcactatagggcgactcgagatgttgactcagagcttcctcaacagaggagagaggaaatgctgagtcaaaacctggcggcagcgcaaaagatg

SEQ ID NO: 231940 - DNA, 103 bp, Artificial Sequence
  Synthetic Polynucleotide
taatacgactcactatagggtgtgcaaggccgactcgagatgttgactcaaacagaggagatgagtcatgatctcgagtaacctggcggcagcgcaaaagatg

SEQ ID NO: 231941 - DNA, 103 bp, Artificial Sequence
  Synthetic Polynucleotide
taatacgactcactataggggttctgtgtttgtgcaaggccgactcgagaaacagaggagatctcgaatgggccttgcaaacctggcggcagcgcaaaagatg

SEQ ID NO: 231942 - DNA, 103 bp, Artificial Sequence
  Synthetic Polynucleotide
taatacgactcactatagggtctcgtgattgttctgtgtttgtgcaaggcaacagaggagagccttgatgaaacacagaaacctggcggcagcgcaaaagatg

SEQ ID NO: 231943 - DNA, 103 bp, Artificial Sequence
  Synthetic Polynucleotide
taatacgactcactatagggttcttgctgctctcgtgattgttctgtgttaacagaggagaaacacaatgcaatcacgaaacctggcggcagcgcaaaagatg

SEQ ID NO: 231944 - DNA, 103 bp, Artificial Sequence
  Synthetic Polynucleotide
taatacgactcactatagggtctttggcgtttcttgctgctctcgtgattaacagaggagaaatcacatgagcagcaagaacctggcggcagcgcaaaagatg

SEQ ID NO: 231945 - DNA, 103 bp, Artificial Sequence
  Synthetic Polynucleotide
taatacgactcactatagggactagggtgctctttggcgtttcttgctgcaacagaggagagcagcaatgaacgccaaaaacctggcggcagcgcaaaagatg

SEQ ID NO: 231946 - DNA, 103 bp, Artificial Sequence
  Synthetic Polynucleotide
taatacgactcactatagggaactgtgtccggggcctatgaggttagctgaacagaggagacagctaatgtcataggccaacctggcggcagcgcaaaagatg

SEQ ID NO: 231947 - DNA, 103 bp, Artificial Sequence
  Synthetic Polynucleotide
taatacgactcactataggggaggtaataaactagggtgctctttggcgtaacagaggagaacgccaatgagcaccctaaacctggcggcagcgcaaaagatg

SEQ ID NO: 231948 - DNA, 103 bp, Artificial Sequence
  Synthetic Polynucleotide
taatacgactcactatagggcaggcagagtgaggtaataaactagggtgcaacagaggagagcacccatgtttattaccaacctggcggcagcgcaaaagatg

SEQ ID NO: 231949 - DNA, 103 bp, Artificial Sequence
  Synthetic Polynucleotide
taatacgactcactatagggatcggggaagcaggcagagtgaggtaataaaacagaggagattattaatgcactctgccaacctggcggcagcgcaaaagatg

SEQ ID NO: 231950 - DNA, 103 bp, Artificial Sequence
  Synthetic Polynucleotide
taatacgactcactatagggcggtgctaggatcggggaagcaggcagagtaacagaggagaactctgatggcttccccgaacctggcggcagcgcaaaagatg

SEQ ID NO: 231951 - DNA, 103 bp, Artificial Sequence
  Synthetic Polynucleotide
taatacgactcactataggggaggtagatgcggtgctaggatcggggaagaacagaggagacttcccatgtcctagcacaacctggcggcagcgcaaaagatg

SEQ ID NO: 231952 - DNA, 103 bp, Artificial Sequence
  Synthetic Polynucleotide
taatacgactcactatagggggcagactgcgaggtagatgcggtgctaggaacagaggagacctagcatggcatctaccaacctggcggcagcgcaaaagatg

SEQ ID NO: 231953 - DNA, 103 bp, Artificial Sequence
  Synthetic Polynucleotide
taatacgactcactatagggttgagtgagcggcagactgcgaggtagatgaacagaggagacatctaatgcgcagtctgaacctggcggcagcgcaaaagatg

SEQ ID NO: 231954 - DNA, 103 bp, Artificial Sequence
  Synthetic Polynucleotide
taatacgactcactataggggggctgtcgtttgagtgagcggcagactgcaacagaggagagcagtcatgcgctcactcaacctggcggcagcgcaaaagatg

SEQ ID NO: 231955 - DNA, 103 bp, Artificial Sequence
  Synthetic Polynucleotide
taatacgactcactatagggcgggggaggggggctgtcgtttgagtgagcaacagaggagagctcacatgaacgacagcaacctggcggcagcgcaaaagatg

SEQ ID NO: 231956 - DNA, 103 bp, Artificial Sequence
  Synthetic Polynucleotide
taatacgactcactatagggcggcggccgacgggggaggggggctgtcgtaacagaggagaacgacaatgcccctccccaacctggcggcagcgcaaaagatg

SEQ ID NO: 231957 - DNA, 103 bp, Artificial Sequence
  Synthetic Polynucleotide
taatacgactcactatagggttaccataaaaactgtgtccggggcctatgaacagaggagacataggatgcggacacagaacctggcggcagcgcaaaagatg

SEQ ID NO: 231958 - DNA, 103 bp, Artificial Sequence
  Synthetic Polynucleotide
taatacgactcactataggggaggagggggcggcggccgacgggggagggaacagaggagaccctccatggtcggccgcaacctggcggcagcgcaaaagatg

SEQ ID NO: 231959 - DNA, 103 bp, Artificial Sequence
  Synthetic Polynucleotide
taatacgactcactataggggggggaagcggaggagggggcggcggccgaaacagaggagatcggccatggccccctccaacctggcggcagcgcaaaagatg

SEQ ID NO: 231960 - DNA, 103 bp, Artificial Sequence
  Synthetic Polynucleotide
taatacgactcactatagggtggaggcgtggggggaagcggaggagggggaacagaggagaccccctatgccgcttcccaacctggcggcagcgcaaaagatg

SEQ ID NO: 231961 - DNA, 103 bp, Artificial Sequence
  Synthetic Polynucleotide
taatacgactcactatagggcaagacttcctggaggcgtggggggaagcgaacagaggagacgcttcatgccacgcctcaacctggcggcagcgcaaaagatg

SEQ ID NO: 231962 - DNA, 103 bp, Artificial Sequence
  Synthetic Polynucleotide
taatacgactcactatagggcacttgcggccaagacttcctggaggcgtgaacagaggagacacgccatgaggaagtctaacctggcggcagcgcaaaagatg

SEQ ID NO: 231963 - DNA, 103 bp, Artificial Sequence
  Synthetic Polynucleotide
taatacgactcactatagggcccgggagaccacttgcggccaagacttccaacagaggagaggaagtatgggccgcaagaacctggcggcagcgcaaaagatg

SEQ ID NO: 231964 - DNA, 103 bp, Artificial Sequence
  Synthetic Polynucleotide
taatacgactcactataggggctgccgaagcccgggagaccacttgcggcaacagaggagagccgcaatgggtctcccgaacctggcggcagcgcaaaagatg

SEQ ID NO: 231965 - DNA, 103 bp, Artificial Sequence
  Synthetic Polynucleotide
taatacgactcactatagggagggggcttcgctgccgaagcccgggagacaacagaggagagtctccatggcttcggcaaacctggcggcagcgcaaaagatg

SEQ ID NO: 231966 - DNA, 103 bp, Artificial Sequence
  Synthetic Polynucleotide
taatacgactcactataggggaggaaaagaagggggcttcgctgccgaagaacagaggagacttcggatgcgaagccccaacctggcggcagcgcaaaagatg

SEQ ID NO: 231967 - DNA, 103 bp, Artificial Sequence
  Synthetic Polynucleotide
taatacgactcactataggggaggagagaggaggaaaagaagggggcttcaacagaggagagaagccatgttcttttccaacctggcggcagcgcaaaagatg

SEQ ID NO: 231968 - DNA, 103 bp, Artificial Sequence
  Synthetic Polynucleotide
taatacgactcactataggggccactaaatttaccataaaaactgtgtccaacagaggagaggacacatgttttatggtaacctggcggcagcgcaaaagatg

SEQ ID NO: 231969 - DNA, 103 bp, Artificial Sequence
  Synthetic Polynucleotide
taatacgactcactatagggcgttgaagatgaggagagaggaggaaaagaaacagaggagatcttttatgcctctctccaacctggcggcagcgcaaaagatg

SEQ ID NO: 231970 - DNA, 103 bp, Artificial Sequence
  Synthetic Polynucleotide
taatacgactcactatagggttgaggtaaccgttgaagatgaggagagagaacagaggagactctctatgcatcttcaaaacctggcggcagcgcaaaagatg

SEQ ID NO: 231971 - DNA, 103 bp, Artificial Sequence
  Synthetic Polynucleotide
taatacgactcactatagggctgcatgaacttgaggtaaccgttgaagataacagaggagaatcttcatgggttacctcaacctggcggcagcgcaaaagatg

SEQ ID NO: 231972 - DNA, 103 bp, Artificial Sequence
  Synthetic Polynucleotide
taatacgactcactatagggccctgaggtgctgcatgaacttgaggtaacaacagaggagagttaccatgagttcatgcaacctggcggcagcgcaaaagatg

SEQ ID NO: 231973 - DNA, 103 bp, Artificial Sequence
  Synthetic Polynucleotide
taatacgactcactatagggagggctgaacccctgaggtgctgcatgaacaacagaggagagttcatatggcacctcagaacctggcggcagcgcaaaagatg

SEQ ID NO: 231974 - DNA, 103 bp, Artificial Sequence
  Synthetic Polynucleotide
taatacgactcactataggggttggcatcgagggctgaacccctgaggtgaacagaggagacacctcatgggttcagccaacctggcggcagcgcaaaagatg

SEQ ID NO: 231975 - DNA, 103 bp, Artificial Sequence
  Synthetic Polynucleotide
taatacgactcactatagggatagtcgtctgttggcatcgagggctgaacaacagaggagagttcagatgtcgatgccaaacctggcggcagcgcaaaagatg

SEQ ID NO: 231976 - DNA, 103 bp, Artificial Sequence
  Synthetic Polynucleotide
taatacgactcactatagggactcctccgaatagtcgtctgttggcatcgaacagaggagacgatgcatgcagacgactaacctggcggcagcgcaaaagatg

SEQ ID NO: 231977 - DNA, 103 bp, Artificial Sequence
  Synthetic Polynucleotide
taatacgactcactatagggtccgtgtcagactcctccgaatagtcgtctaacagaggagaagacgaatgttcggaggaaacctggcggcagcgcaaaagatg

SEQ ID NO: 231978 - DNA, 103 bp, Artificial Sequence
  Synthetic Polynucleotide
taatacgactcactatagggttggctgagatccgtgtcagactcctccgaaacagaggagatcggagatgtctgacacgaacctggcggcagcgcaaaagatg

SEQ ID NO: 231979 - DNA, 103 bp, Artificial Sequence
  Synthetic Polynucleotide
taatacgactcactatagggctgtggactgctccatgctactgggtttgtaacagaggagaacaaacatggtagcatggaacctggcggcagcgcaaaagatg

SEQ ID NO: 231980 - DNA, 103 bp, Artificial Sequence
  Synthetic Polynucleotide
taatacgactcactatagggccattcgaatgccactaaatttaccataaaaacagaggagatttatgatgaatttagtgaacctggcggcagcgcaaaagatg

SEQ ID NO: 231981 - DNA, 103 bp, Artificial Sequence
  Synthetic Polynucleotide
taatacgactcactatagggcgtcggacttttggctgagatccgtgtcagaacagaggagactgacaatgatctcagccaacctggcggcagcgcaaaagatg

SEQ ID NO: 231982 - DNA, 103 bp, Artificial Sequence
  Synthetic Polynucleotide
taatacgactcactatagggctcgccggtccgtcggacttttggctgagaaacagaggagatctcagatgaaagtccgaaacctggcggcagcgcaaaagatg

SEQ ID NO: 231983 - DNA, 103 bp, Artificial Sequence
  Synthetic Polynucleotide
taatacgactcactatagggctccaccgggctcgccggtccgtcggacttaacagaggagaaagtccatgggaccggcgaacctggcggcagcgcaaaagatg

SEQ ID NO: 231984 - DNA, 103 bp, Artificial Sequence
  Synthetic Polynucleotide
taatacgactcactatagggctttgggaccctccaccgggctcgccggtcaacagaggagagaccggatggcccggtggaacctggcggcagcgcaaaagatg

SEQ ID NO: 231985 - DNA, 103 bp, Artificial Sequence
  Synthetic Polynucleotide
taatacgactcactatagggcagctggggtctttgggaccctccaccgggaacagaggagacccggtatggggtcccaaaacctggcggcagcgcaaaagatg

SEQ ID NO: 231986 - DNA, 103 bp, Artificial Sequence
  Synthetic Polynucleotide
taatacgactcactataggggtccttggggcagctggggtctttgggaccaacagaggagaggtcccatggaccccagcaacctggcggcagcgcaaaagatg

SEQ ID NO: 231987 - DNA, 103 bp, Artificial Sequence
  Synthetic Polynucleotide
taatacgactcactatagggtcagaccactgtccttggggcagctggggtaacagaggagaaccccaatggccccaaggaacctggcggcagcgcaaaagatg

SEQ ID NO: 231988 - DNA, 103 bp, Artificial Sequence
  Synthetic Polynucleotide
taatacgactcactatagggcctacactggtcagaccactgtccttggggaacagaggagaccccaaatgcagtggtctaacctggcggcagcgcaaaagatg

SEQ ID NO: 231989 - DNA, 103 bp, Artificial Sequence
  Synthetic Polynucleotide
taatacgactcactatagggggtgtccgttcctacactggtcagaccactaacagaggagaagtggtatgaccagtgtaaacctggcggcagcgcaaaagatg

SEQ ID NO: 231990 - DNA, 103 bp, Artificial Sequence
  Synthetic Polynucleotide
taatacgactcactatagggacaatctgaaggtgtccgttcctacactggaacagaggagaccagtgatggaacggacaaacctggcggcagcgcaaaagatg

SEQ ID NO: 231991 - DNA, 103 bp, Artificial Sequence
  Synthetic Polynucleotide
taatacgactcactatagggtcctccccttccattcgaatgccactaaataacagaggagaatttagatgcattcgaataacctggcggcagcgcaaaagatg

SEQ ID NO: 231992 - DNA, 103 bp, Artificial Sequence
  Synthetic Polynucleotide
taatacgactcactatagggtgggagagcttcctccccttccattcgaataacagaggagaattcgaatggaaggggagaacctggcggcagcgcaaaagatg

SEQ ID NO: 231993 - DNA, 103 bp, Artificial Sequence
  Synthetic Polynucleotide
taatacgactcactatagggcggagcccgctgggagagcttcctccccttaacagaggagaaaggggatgaagctctccaacctggcggcagcgcaaaagatg

SEQ ID NO: 231994 - DNA, 103 bp, Artificial Sequence
  Synthetic Polynucleotide
taatacgactcactataggggggccagcggcggagcccgctgggagagctaacagaggagaagctctatgagcgggctcaacctggcggcagcgcaaaagatg

SEQ ID NO: 231995 - DNA, 103 bp, Artificial Sequence
  Synthetic Polynucleotide
taatacgactcactataggggggctgctcggggccagcggcggagcccgcaacagaggagagcgggcatggccgctggcaacctggcggcagcgcaaaagatg

SEQ ID NO: 231996 - DNA, 103 bp, Artificial Sequence
  Synthetic Polynucleotide
taatacgactcactataggggaccagcctggggctgctcggggccagcggaacagaggagaccgctgatgccgagcagcaacctggcggcagcgcaaaagatg

SEQ ID NO: 231997 - DNA, 103 bp, Artificial Sequence
  Synthetic Polynucleotide
taatacgactcactatagggggggtcaagagaccagcctggggctgctcgaacagaggagacgagcaatgccaggctggaacctggcggcagcgcaaaagatg

SEQ ID NO: 231998 - DNA, 103 bp, Artificial Sequence
  Synthetic Polynucleotide
taatacgactcactatagggcagggtgctgggggtcaagagaccagcctgaacagaggagacaggctatgctcttgaccaacctggcggcagcgcaaaagatg

SEQ ID NO: 231999 - DNA, 103 bp, Artificial Sequence
  Synthetic Polynucleotide
taatacgactcactatagggcaaggttcaacagggtgctgggggtcaagaaacagaggagatcttgaatgccagcacccaacctggcggcagcgcaaaagatg

SEQ ID NO: 232000 - DNA, 103 bp, Artificial Sequence
  Synthetic Polynucleotide
taatacgactcactatagggtggctctcgcctgtggactgctccatgctaaacagaggagatagcatatggcagtccacaacctggcggcagcgcaaaagatg

SEQ ID NO: 232001 - DNA, 103 bp, Artificial Sequence
  Synthetic Polynucleotide
taatacgactcactataggggtgagcccgccaaggttcaacagggtgctgaacagaggagacagcacatggttgaacctaacctggcggcagcgcaaaagatg

SEQ ID NO: 232002 - DNA, 103 bp, Artificial Sequence
  Synthetic Polynucleotide
taatacgactcactatagggtaccgagctggtgagcccgccaaggttcaaaacagaggagattgaacatgggcgggctcaacctggcggcagcgcaaaagatg

SEQ ID NO: 232003 - DNA, 103 bp, Artificial Sequence
  Synthetic Polynucleotide
taatacgactcactataggggggtcttcagtaccgagctggtgagcccgcaacagaggagagcgggcatgccagctcggaacctggcggcagcgcaaaagatg

SEQ ID NO: 232004 - DNA, 103 bp, Artificial Sequence
  Synthetic Polynucleotide
taatacgactcactataggggaggtaatgggggtcttcagtaccgagctgaacagaggagacagctcatgactgaagacaacctggcggcagcgcaaaagatg

SEQ ID NO: 232005 - DNA, 103 bp, Artificial Sequence
  Synthetic Polynucleotide
taatacgactcactatagggcagggggactgaggtaatgggggtcttcagaacagaggagactgaagatgcccattaccaacctggcggcagcgcaaaagatg

SEQ ID NO: 232006 - DNA, 103 bp, Artificial Sequence
  Synthetic Polynucleotide
taatacgactcactatagggccagaggccccagggggactgaggtaatggaacagaggagaccattaatgcagtcccccaacctggcggcagcgcaaaagatg

SEQ ID NO: 232007 - DNA, 103 bp, Artificial Sequence
  Synthetic Polynucleotide
taatacgactcactatagggggactggaagccagaggccccagggggactaacagaggagaagtcccatgggggcctctaacctggcggcagcgcaaaagatg

SEQ ID NO: 232008 - DNA, 103 bp, Artificial Sequence
  Synthetic Polynucleotide
taatacgactcactatagggggatttggtaggactggaagccagaggcccaacagaggagagggcctatggcttccagtaacctggcggcagcgcaaaagatg

SEQ ID NO: 232009 - DNA, 103 bp, Artificial Sequence
  Synthetic Polynucleotide
taatacgactcactatagggtgccctctgaggatttggtaggactggaagaacagaggagacttccaatgctaccaaataacctggcggcagcgcaaaagatg

SEQ ID NO: 232010 - DNA, 103 bp, Artificial Sequence
  Synthetic Polynucleotide
taatacgactcactatagggccagagtccttgccctctgaggatttggtaaacagaggagataccaaatgctcagagggaacctggcggcagcgcaaaagatg

SEQ ID NO: 232011 - DNA, 103 bp, Artificial Sequence
  Synthetic Polynucleotide
taatacgactcactatagggcaagggcccgtggctctcgcctgtggactgaacagaggagacagtccatgggcgagagcaacctggcggcagcgcaaaagatg

SEQ ID NO: 232012 - DNA, 103 bp, Artificial Sequence
  Synthetic Polynucleotide
taatacgactcactatagggttctgccgccccagagtccttgccctctgaaacagaggagatcagagatgaaggactctaacctggcggcagcgcaaaagatg

SEQ ID NO: 232013 - DNA, 103 bp, Artificial Sequence
  Synthetic Polynucleotide
taatacgactcactataggggcttctctccttctgccgccccagagtcctaacagaggagaaggactatggggcggcagaacctggcggcagcgcaaaagatg

SEQ ID NO: 232014 - DNA, 103 bp, Artificial Sequence
  Synthetic Polynucleotide
taatacgactcactatagggcccacttcctgcttctctccttctgccgccaacagaggagaggcggcatgaggagagaaaacctggcggcagcgcaaaagatg

SEQ ID NO: 232015 - DNA, 103 bp, Artificial Sequence
  Synthetic Polynucleotide
taatacgactcactatagggatccccgtcgcccacttcctgcttctctccaacagaggagaggagagatgcaggaagtgaacctggcggcagcgcaaaagatg

SEQ ID NO: 232016 - DNA, 103 bp, Artificial Sequence
  Synthetic Polynucleotide
taatacgactcactatagggcagagaagcaatccccgtcgcccacttcctaacagaggagaaggaagatggcgacggggaacctggcggcagcgcaaaagatg

SEQ ID NO: 232017 - DNA, 103 bp, Artificial Sequence
  Synthetic Polynucleotide
taatacgactcactatagggtctaccttctcagagaagcaatccccgtcgaacagaggagacgacggatgttgcttctcaacctggcggcagcgcaaaagatg

SEQ ID NO: 232018 - DNA, 103 bp, Artificial Sequence
  Synthetic Polynucleotide
taatacgactcactatagggttcggctggctctaccttctcagagaagcaaacagaggagatgcttcatggagaaggtaaacctggcggcagcgcaaaagatg

SEQ ID NO: 232019 - DNA, 103 bp, Artificial Sequence
  Synthetic Polynucleotide
taatacgactcactatagggccgcctcctcttcggctggctctaccttctaacagaggagaagaaggatgagccagccgaacctggcggcagcgcaaaagatg

SEQ ID NO: 232020 - DNA, 103 bp, Artificial Sequence
  Synthetic Polynucleotide
taatacgactcactatagggtcttcctcctccgcctcctcttcggctggcaacagaggagagccagcatgagaggaggcaacctggcggcagcgcaaaagatg

SEQ ID NO: 232021 - DNA, 103 bp, Artificial Sequence
  Synthetic Polynucleotide
taatacgactcactatagggttcctcctcctcttcctcctccgcctcctcaacagaggagagaggagatggaggaggaaaacctggcggcagcgcaaaagatg

SEQ ID NO: 232022 - DNA, 103 bp, Artificial Sequence
  Synthetic Polynucleotide
taatacgactcactatagggtcaggctgtccaagggcccgtggctctcgcaacagaggagagcgagaatgacgggccctaacctggcggcagcgcaaaagatg

SEQ ID NO: 232023 - DNA, 103 bp, Artificial Sequence
  Synthetic Polynucleotide
taatacgactcactatagggcctccgcctcttcctcctcctcttcctcctaacagaggagaaggaggatgaggaggaggaacctggcggcagcgcaaaagatg

SEQ ID NO: 232024 - DNA, 103 bp, Artificial Sequence
  Synthetic Polynucleotide
taatacgactcactatagggtcctcctcctcctccgcctcttcctcctccaacagaggagaggaggaatgagaggcggaaacctggcggcagcgcaaaagatg

SEQ ID NO: 232025 - DNA, 103 bp, Artificial Sequence
  Synthetic Polynucleotide
taatacgactcactatagggctcctcttcttcctcctcctcctccgcctcaacagaggagagaggcgatggaggaggagaacctggcggcagcgcaaaagatg

SEQ ID NO: 232026 - DNA, 103 bp, Artificial Sequence
  Synthetic Polynucleotide
taatacgactcactatagggcttcttcctcctcctcttcttcctcctcctaacagaggagaaggaggatgaagaagaggaacctggcggcagcgcaaaagatg

SEQ ID NO: 232027 - DNA, 103 bp, Artificial Sequence
  Synthetic Polynucleotide
taatacgactcactatagggtcctcctcctcttcttcctcctcctcttctaacagaggagaagaagaatgggaggaagaaacctggcggcagcgcaaaagatg

SEQ ID NO: 232028 - DNA, 103 bp, Artificial Sequence
  Synthetic Polynucleotide
taatacgactcactatagggaccctcgtcttcctcctcctcttcttcctcaacagaggagagaggaaatggaggaggagaacctggcggcagcgcaaaagatg

SEQ ID NO: 232029 - DNA, 103 bp, Artificial Sequence
  Synthetic Polynucleotide
taatacgactcactataggggtcctttgcaaccctcgtcttcctcctcctaacagaggagaaggaggatgaagacgaggaacctggcggcagcgcaaaagatg

SEQ ID NO: 232030 - DNA, 103 bp, Artificial Sequence
  Synthetic Polynucleotide
taatacgactcactatagggcttggaaagagtcctttgcaaccctcgtctaacagaggagaagacgaatgttgcaaaggaacctggcggcagcgcaaaagatg

SEQ ID NO: 232031 - DNA, 103 bp, Artificial Sequence
  Synthetic Polynucleotide
taatacgactcactatagggatccaactcgcttggaaagagtcctttgcaaacagaggagatgcaaaatgctctttccaaacctggcggcagcgcaaaagatg

SEQ ID NO: 232032 - DNA, 103 bp, Artificial Sequence
  Synthetic Polynucleotide
taatacgactcactatagggccagttcctcatccaactcgcttggaaagaaacagaggagatctttcatggcgagttggaacctggcggcagcgcaaaagatg

SEQ ID NO: 232033 - DNA, 103 bp, Artificial Sequence
  Synthetic Polynucleotide
taatacgactcactatagggaagggggccctcaggctgtccaagggcccgaacagaggagacgggccatgggacagcctaacctggcggcagcgcaaaagatg

SEQ ID NO: 232034 - DNA, 103 bp, Artificial Sequence
  Synthetic Polynucleotide
taatacgactcactatagggggcctgtcctccagttcctcatccaactcgaacagaggagacgagttatgtgaggaactaacctggcggcagcgcaaaagatg

SEQ ID NO: 232035 - DNA, 103 bp, Artificial Sequence
  Synthetic Polynucleotide
taatacgactcactatagggctcctcatggggcctgtcctccagttcctcaacagaggagagaggaaatggaggacaggaacctggcggcagcgcaaaagatg

SEQ ID NO: 232036 - DNA, 103 bp, Artificial Sequence
  Synthetic Polynucleotide
taatacgactcactatagggcggccccaggctcctcatggggcctgtcctaacagaggagaaggacaatgcccatgaggaacctggcggcagcgcaaaagatg

SEQ ID NO: 232037 - DNA, 103 bp, Artificial Sequence
  Synthetic Polynucleotide
taatacgactcactatagggctacctgctgcggccccaggctcctcatggaacagaggagaccatgaatggcctggggcaacctggcggcagcgcaaaagatg

SEQ ID NO: 232038 - DNA, 103 bp, Artificial Sequence
  Synthetic Polynucleotide
taatacgactcactatagggtttgctgctactacctgctgcggccccaggaacagaggagacctgggatggcagcaggtaacctggcggcagcgcaaaagatg

SEQ ID NO: 232039 - DNA, 103 bp, Artificial Sequence
  Synthetic Polynucleotide
taatacgactcactatagggcaaggtcctttttgctgctactacctgctgaacagaggagacagcagatggtagcagcaaacctggcggcagcgcaaaagatg

SEQ ID NO: 232040 - DNA, 103 bp, Artificial Sequence
  Synthetic Polynucleotide
taatacgactcactatagggtttgagagagcaaggtcctttttgctgctaaacagaggagatagcagatgaaaggacctaacctggcggcagcgcaaaagatg

SEQ ID NO: 232041 - DNA, 103 bp, Artificial Sequence
  Synthetic Polynucleotide
taatacgactcactatagggaatgctttggtttgagagagcaaggtccttaacagaggagaaaggacatggctctctcaaacctggcggcagcgcaaaagatg

SEQ ID NO: 232042 - DNA, 103 bp, Artificial Sequence
  Synthetic Polynucleotide
taatacgactcactataggggggagttagaaatgctttggtttgagagagaacagaggagactctctatgaccaaagcaaacctggcggcagcgcaaaagatg

SEQ ID NO: 232043 - DNA, 103 bp, Artificial Sequence
  Synthetic Polynucleotide
taatacgactcactatagggggcattaagggggagttagaaatgctttggaacagaggagaccaaagatgttctaactcaacctggcggcagcgcaaaagatg

SEQ ID NO: 232044 - DNA, 103 bp, Artificial Sequence
  Synthetic Polynucleotide
taatacgactcactataggggcgctcattgaagggggccctcaggctgtcaacagaggagagacagcatgagggcccccaacctggcggcagcgcaaaagatg

SEQ ID NO: 232045 - DNA, 103 bp, Artificial Sequence
  Synthetic Polynucleotide
taatacgactcactataggggagcacgttaggcattaagggggagttagaaacagaggagatctaacatgcccttaatgaacctggcggcagcgcaaaagatg

SEQ ID NO: 232046 - DNA, 103 bp, Artificial Sequence
  Synthetic Polynucleotide
taatacgactcactatagggacagggtctggagcacgttaggcattaaggaacagaggagaccttaaatgctaacgtgcaacctggcggcagcgcaaaagatg

SEQ ID NO: 232047 - DNA, 103 bp, Artificial Sequence
  Synthetic Polynucleotide
taatacgactcactataggggtgcccctcgacagggtctggagcacgttaaacagaggagataacgtatgccagaccctaacctggcggcagcgcaaaagatg

SEQ ID NO: 232048 - DNA, 103 bp, Artificial Sequence
  Synthetic Polynucleotide
taatacgactcactatagggagtagaagctgtgcccctcgacagggtctgaacagaggagacagaccatgtcgaggggcaacctggcggcagcgcaaaagatg

SEQ ID NO: 232049 - DNA, 103 bp, Artificial Sequence
  Synthetic Polynucleotide
taatacgactcactatagggaattagaactagtagaagctgtgcccctcgaacagaggagacgagggatgcagcttctaaacctggcggcagcgcaaaagatg

SEQ ID NO: 232050 - DNA, 103 bp, Artificial Sequence
  Synthetic Polynucleotide
taatacgactcactataggggaagaagcagaattagaactagtagaagctaacagaggagaagcttcatgtagttctaaaacctggcggcagcgcaaaagatg

SEQ ID NO: 232051 - DNA, 103 bp, Artificial Sequence
  Synthetic Polynucleotide
taatacgactcactataggggacaacaaaggaagaagcagaattagaactaacagaggagaagttctatgtctgcttctaacctggcggcagcgcaaaagatg

SEQ ID NO: 232052 - DNA, 103 bp, Artificial Sequence
  Synthetic Polynucleotide
taatacgactcactatagggcaccatcaaagacaacaaaggaagaagcagaacagaggagactgcttatgcctttgttgaacctggcggcagcgcaaaagatg

SEQ ID NO: 232053 - DNA, 103 bp, Artificial Sequence
  Synthetic Polynucleotide
taatacgactcactatagggctcctgttcgcaccatcaaagacaacaaagaacagaggagactttgtatgctttgatggaacctggcggcagcgcaaaagatg

SEQ ID NO: 232054 - DNA, 103 bp, Artificial Sequence
  Synthetic Polynucleotide
taatacgactcactatagggtaaacgattcctcctgttcgcaccatcaaaaacagaggagatttgatatggcgaacaggaacctggcggcagcgcaaaagatg

SEQ ID NO: 232055 - DNA, 103 bp, Artificial Sequence
  Synthetic Polynucleotide
taatacgactcactatagggtctccgcgaggcgctcattgaagggggcccaacagaggagagggcccatgtcaatgagcaacctggcggcagcgcaaaagatg

SEQ ID NO: 232056 - DNA, 103 bp, Artificial Sequence
  Synthetic Polynucleotide
taatacgactcactatagggtgttaaagcttaaacgattcctcctgttcgaacagaggagacgaacaatgggaatcgttaacctggcggcagcgcaaaagatg

SEQ ID NO: 232057 - DNA, 103 bp, Artificial Sequence
  Synthetic Polynucleotide
taatacgactcactatagggacgccctcactgttaaagcttaaacgattcaacagaggagagaatcgatgaagctttaaaacctggcggcagcgcaaaagatg

SEQ ID NO: 232058 - DNA, 103 bp, Artificial Sequence
  Synthetic Polynucleotide
taatacgactcactatagggattggccctgacgccctcactgttaaagctaacagaggagaagctttatgagtgagggcaacctggcggcagcgcaaaagatg

SEQ ID NO: 232059 - DNA, 103 bp, Artificial Sequence
  Synthetic Polynucleotide
taatacgactcactatagggcctctgccacattggccctgacgccctcacaacagaggagagtgaggatgtcagggccaaacctggcggcagcgcaaaagatg

SEQ ID NO: 232060 - DNA, 103 bp, Artificial Sequence
  Synthetic Polynucleotide
taatacgactcactatagggctcctgccgccctctgccacattggccctgaacagaggagacagggcatgtgtggcagaaacctggcggcagcgcaaaagatg

SEQ ID NO: 232061 - DNA, 103 bp, Artificial Sequence
  Synthetic Polynucleotide
taatacgactcactataggggaagtccagcctcctgccgccctctgccacaacagaggagagtggcaatgggcggcaggaacctggcggcagcgcaaaagatg

SEQ ID NO: 232062 - DNA, 103 bp, Artificial Sequence
  Synthetic Polynucleotide
taatacgactcactatagggtttcgtcagcgaagtccagcctcctgccgcaacagaggagagcggcaatgggctggactaacctggcggcagcgcaaaagatg

SEQ ID NO: 232063 - DNA, 103 bp, Artificial Sequence
  Synthetic Polynucleotide
taatacgactcactatagggttattggcactttcgtcagcgaagtccagcaacagaggagagctggaatgcgctgacgaaacctggcggcagcgcaaaagatg

SEQ ID NO: 232064 - DNA, 103 bp, Artificial Sequence
  Synthetic Polynucleotide
taatacgactcactatagggggcattgtctttattggcactttcgtcagcaacagaggagagctgacatgagtgccaataacctggcggcagcgcaaaagatg

SEQ ID NO: 232065 - DNA, 103 bp, Artificial Sequence
  Synthetic Polynucleotide
taatacgactcactatagggctggtgctgtggcattgtctttattggcacaacagaggagagtgccaatgaagacaatgaacctggcggcagcgcaaaagatg

SEQ ID NO: 232066 - DNA, 103 bp, Artificial Sequence
  Synthetic Polynucleotide
taatacgactcactataggggacgcggtgctctccgcgaggcgctcattgaacagaggagacaatgaatgcctcgcggaaacctggcggcagcgcaaaagatg

SEQ ID NO: 232067 - DNA, 103 bp, Artificial Sequence
  Synthetic Polynucleotide
taatacgactcactatagggtcatttggttctggtgctgtggcattgtctaacagaggagaagacaaatgcacagcaccaacctggcggcagcgcaaaagatg

SEQ ID NO: 232068 - DNA, 103 bp, Artificial Sequence
  Synthetic Polynucleotide
taatacgactcactatagggctctgtgctttcatttggttctggtgctgtaacagaggagaacagcaatggaaccaaataacctggcggcagcgcaaaagatg

SEQ ID NO: 232069 - DNA, 103 bp, Artificial Sequence
  Synthetic Polynucleotide
taatacgactcactatagggcatcgtcaccctctgtgctttcatttggttaacagaggagaaaccaaatgaaagcacagaacctggcggcagcgcaaaagatg

SEQ ID NO: 232070 - DNA, 103 bp, Artificial Sequence
  Synthetic Polynucleotide
taatacgactcactatagggacgaagcccccatcgtcaccctctgtgcttaacagaggagaaagcacatggggtgacgaaacctggcggcagcgcaaaagatg

SEQ ID NO: 232071 - DNA, 103 bp, Artificial Sequence
  Synthetic Polynucleotide
taatacgactcactataggggtgatggggaacgaagcccccatcgtcaccaacagaggagaggtgacatggggggcttcaacctggcggcagcgcaaaagatg

SEQ ID NO: 232072 - DNA, 103 bp, Artificial Sequence
  Synthetic Polynucleotide
taatacgactcactatagggcagcgtgctggtgatggggaacgaagccccaacagaggagaggggctatgttccccatcaacctggcggcagcgcaaaagatg

SEQ ID NO: 232073 - DNA, 103 bp, Artificial Sequence
  Synthetic Polynucleotide
taatacgactcactatagggcagagggagccagcgtgctggtgatggggaaacagaggagatccccaatgccagcacgcaacctggcggcagcgcaaaagatg

SEQ ID NO: 232074 - DNA, 103 bp, Artificial Sequence
  Synthetic Polynucleotide
taatacgactcactatagggcccaagctcgcagagggagccagcgtgctgaacagaggagacagcacatgggctccctcaacctggcggcagcgcaaaagatg

SEQ ID NO: 232075 - DNA, 103 bp, Artificial Sequence
  Synthetic Polynucleotide
taatacgactcactatagggactccccaaccccaagctcgcagagggagcaacagaggagagctcccatggcgagcttgaacctggcggcagcgcaaaagatg

SEQ ID NO: 232076 - DNA, 103 bp, Artificial Sequence
  Synthetic Polynucleotide
taatacgactcactatagggcccgaggggcactccccaaccccaagctcgaacagaggagacgagctatgggttggggaaacctggcggcagcgcaaaagatg

SEQ ID NO: 232077 - DNA, 103 bp, Artificial Sequence
  Synthetic Polynucleotide
taatacgactcactataggggggcccggccgacgcggtgctctccgcgagaacagaggagactcgcgatgagcaccgcgaacctggcggcagcgcaaaagatg

SEQ ID NO: 232078 - DNA, 103 bp, Artificial Sequence
  Synthetic Polynucleotide
taatacgactcactatagggcacgccactccccgaggggcactccccaacaacagaggagagttgggatgtgcccctcgaacctggcggcagcgcaaaagatg

SEQ ID NO: 232079 - DNA, 103 bp, Artificial Sequence
  Synthetic Polynucleotide
taatacgactcactatagggtggggcactccacgccactccccgaggggcaacagaggagagcccctatgggagtggcgaacctggcggcagcgcaaaagatg

SEQ ID NO: 232080 - DNA, 103 bp, Artificial Sequence
  Synthetic Polynucleotide
taatacgactcactataggggtgtcgcatttggggcactccacgccactcaacagaggagagagtggatgggagtgcccaacctggcggcagcgcaaaagatg

SEQ ID NO: 232081 - DNA, 103 bp, Artificial Sequence
  Synthetic Polynucleotide
taatacgactcactataggggcccaggaccgtgtcgcatttggggcactcaacagaggagagagtgcatgaaatgcgacaacctggcggcagcgcaaaagatg

SEQ ID NO: 232082 - DNA, 103 bp, Artificial Sequence
  Synthetic Polynucleotide
taatacgactcactatagggagcgggaggagcccaggaccgtgtcgcattaacagaggagaaatgcgatgcggtcctggaacctggcggcagcgcaaaagatg

SEQ ID NO: 232083 - DNA, 103 bp, Artificial Sequence
  Synthetic Polynucleotide
taatacgactcactatagggccgcccagcgagcgggaggagcccaggaccaacagaggagaggtcctatgctcctcccgaacctggcggcagcgcaaaagatg

SEQ ID NO: 232084 - DNA, 103 bp, Artificial Sequence
  Synthetic Polynucleotide
taatacgactcactatagggggtcatgtggccgcccagcgagcgggaggaaacagaggagatcctccatgtcgctgggcaacctggcggcagcgcaaaagatg

SEQ ID NO: 232085 - DNA, 103 bp, Artificial Sequence
  Synthetic Polynucleotide
taatacgactcactatagggaatgcatcatggtcatgtggccgcccagcgaacagaggagacgctggatggccacatgaaacctggcggcagcgcaaaagatg

SEQ ID NO: 232086 - DNA, 103 bp, Artificial Sequence
  Synthetic Polynucleotide
taatacgactcactataggggagttacgagaatgcatcatggtcatgtggaacagaggagaccacatatgcatgatgcaaacctggcggcagcgcaaaagatg

SEQ ID NO: 232087 - DNA, 103 bp, Artificial Sequence
  Synthetic Polynucleotide
taatacgactcactatagggtgtcttacacgagttacgagaatgcatcataacagaggagaatgatgatgtctcgtaacaacctggcggcagcgcaaaagatg

SEQ ID NO: 232088 - DNA, 103 bp, Artificial Sequence
  Synthetic Polynucleotide
taatacgactcactatagggtgtccttccccgagacgacgggcgagtcacaacagaggagagtgactatgccgtcgtctaacctggcggcagcgcaaaagatg

SEQ ID NO: 232089 - DNA, 103 bp, Artificial Sequence
  Synthetic Polynucleotide
taatacgactcactataggggctcggaggggggcccggccgacgcggtgcaacagaggagagcaccgatgcggccgggcaacctggcggcagcgcaaaagatg

SEQ ID NO: 232090 - DNA, 103 bp, Artificial Sequence
  Synthetic Polynucleotide
taatacgactcactatagggggcacttgagtgtcttacacgagttacgagaacagaggagactcgtaatgcgtgtaagaaacctggcggcagcgcaaaagatg

SEQ ID NO: 232091 - DNA, 103 bp, Artificial Sequence
  Synthetic Polynucleotide
taatacgactcactatagggttgcacttggggcacttgagtgtcttacacaacagaggagagtgtaaatgactcaagtgaacctggcggcagcgcaaaagatg

SEQ ID NO: 232092 - DNA, 103 bp, Artificial Sequence
  Synthetic Polynucleotide
taatacgactcactatagggatagtgccagttgcacttggggcacttgagaacagaggagactcaagatgcccaagtgcaacctggcggcagcgcaaaagatg

SEQ ID NO: 232093 - DNA, 103 bp, Artificial Sequence
  Synthetic Polynucleotide
taatacgactcactataggggctggtacttatagtgccagttgcacttggaacagaggagaccaagtatgactggcactaacctggcggcagcgcaaaagatg

SEQ ID NO: 232094 - DNA, 103 bp, Artificial Sequence
  Synthetic Polynucleotide
taatacgactcactatagggtccagggtctgctggtacttatagtgccagaacagaggagactggcaatgtaagtaccaaacctggcggcagcgcaaaagatg

SEQ ID NO: 232095 - DNA, 103 bp, Artificial Sequence
  Synthetic Polynucleotide
taatacgactcactatagggcatgtgtgcctccagggtctgctggtacttaacagaggagaaagtacatgcagaccctgaacctggcggcagcgcaaaagatg

SEQ ID NO: 232096 - DNA, 103 bp, Artificial Sequence
  Synthetic Polynucleotide
taatacgactcactataggggcttctccttcatgtgtgcctccagggtctaacagaggagaagacccatgaggcacacaaacctggcggcagcgcaaaagatg

SEQ ID NO: 232097 - DNA, 103 bp, Artificial Sequence
  Synthetic Polynucleotide
taatacgactcactatagggggctccgggtgcttctccttcatgtgtgccaacagaggagaggcacaatggaaggagaaaacctggcggcagcgcaaaagatg

SEQ ID NO: 232098 - DNA, 103 bp, Artificial Sequence
  Synthetic Polynucleotide
taatacgactcactatagggggagccccccggctccgggtgcttctccttaacagaggagaaaggagatgcacccggagaacctggcggcagcgcaaaagatg

SEQ ID NO: 232099 - DNA, 103 bp, Artificial Sequence
  Synthetic Polynucleotide
taatacgactcactatagggagtagacacaggagccccccggctccgggtaacagaggagaacccggatgcggggggctaacctggcggcagcgcaaaagatg

SEQ ID NO: 232100 - DNA, 103 bp, Artificial Sequence
  Synthetic Polynucleotide
taatacgactcactatagggttgctggcgggctcggaggggggcccggccaacagaggagaggccggatgcccctccgaaacctggcggcagcgcaaaagatg

SEQ ID NO: 232101 - DNA, 103 bp, Artificial Sequence
  Synthetic Polynucleotide
taatacgactcactatagggccgcttttgcagtagacacaggagccccccaacagaggagaggggggatgctgtgtctaaacctggcggcagcgcaaaagatg

SEQ ID NO: 232102 - DNA, 103 bp, Artificial Sequence
  Synthetic Polynucleotide
taatacgactcactataggggtggggctgcccgcttttgcagtagacacaaacagaggagatgtgtcatgtgcaaaagcaacctggcggcagcgcaaaagatg

SEQ ID NO: 232103 - DNA, 103 bp, Artificial Sequence
  Synthetic Polynucleotide
taatacgactcactatagggccagccgggggtggggctgcccgcttttgcaacagaggagagcaaaaatgggcagccccaacctggcggcagcgcaaaagatg

SEQ ID NO: 232104 - DNA, 103 bp, Artificial Sequence
  Synthetic Polynucleotide
taatacgactcactatagggtcgcctcgtgccagccgggggtggggctgcaacagaggagagcagccatgcccccggctaacctggcggcagcgcaaaagatg

SEQ ID NO: 232105 - DNA, 103 bp, Artificial Sequence
  Synthetic Polynucleotide
taatacgactcactatagggcgtgtagctctcgcctcgtgccagccggggaacagaggagaccccggatggcacgaggcaacctggcggcagcgcaaaagatg

SEQ ID NO: 232106 - DNA, 103 bp, Artificial Sequence
  Synthetic Polynucleotide
taatacgactcactatagggtgtaaccacacgtgtagctctcgcctcgtgaacagaggagacacgagatgagagctacaaacctggcggcagcgcaaaagatg

SEQ ID NO: 232107 - DNA, 103 bp, Artificial Sequence
  Synthetic Polynucleotide
taatacgactcactatagggcggaaaggcttgtaaccacacgtgtagctcaacagaggagagagctaatggtgtggttaaacctggcggcagcgcaaaagatg

SEQ ID NO: 232108 - DNA, 103 bp, Artificial Sequence
  Synthetic Polynucleotide
taatacgactcactatagggcacctcgcagcggaaaggcttgtaaccacaaacagaggagatgtggtatgaagcctttcaacctggcggcagcgcaaaagatg

SEQ ID NO: 232109 - DNA, 103 bp, Artificial Sequence
  Synthetic Polynucleotide
taatacgactcactatagggagtagttacacacctcgcagcggaaaggctaacagaggagaagccttatggctgcgaggaacctggcggcagcgcaaaagatg

SEQ ID NO: 232110 - DNA, 103 bp, Artificial Sequence
  Synthetic Polynucleotide
taatacgactcactataggggtagttgtggagtagttacacacctcgcagaacagaggagactgcgaatggtgtaactaaacctggcggcagcgcaaaagatg

SEQ ID NO: 232111 - DNA, 103 bp, Artificial Sequence
  Synthetic Polynucleotide
taatacgactcactatagggggtgacctccttgctggcgggctcggagggaacagaggagaccctccatgcccgccagcaacctggcggcagcgcaaaagatg

SEQ ID NO: 232112 - DNA, 103 bp, Artificial Sequence
  Synthetic Polynucleotide
taatacgactcactataggggttgcctttggtagttgtggagtagttacaaacagaggagatgtaacatgtccacaactaacctggcggcagcgcaaaagatg

SEQ ID NO: 232113 - DNA, 103 bp, Artificial Sequence
  Synthetic Polynucleotide
taatacgactcactataggggaatactgaggttgcctttggtagttgtggaacagaggagaccacaaatgccaaaggcaaacctggcggcagcgcaaaagatg

SEQ ID NO: 232114 - DNA, 103 bp, Artificial Sequence
  Synthetic Polynucleotide
taatacgactcactataggggactgcatatgaatactgaggttgcctttgaacagaggagacaaaggatgcctcagtataacctggcggcagcgcaaaagatg

SEQ ID NO: 232115 - DNA, 103 bp, Artificial Sequence
  Synthetic Polynucleotide
taatacgactcactatagggatgcttgtcagactgcatatgaatactgagaacagaggagactcagtatgcatatgcagaacctggcggcagcgcaaaagatg

SEQ ID NO: 232116 - DNA, 103 bp, Artificial Sequence
  Synthetic Polynucleotide
taatacgactcactatagggtgttgttgagatgcttgtcagactgcatataacagaggagaatatgcatgctgacaagcaacctggcggcagcgcaaaagatg

SEQ ID NO: 232117 - DNA, 103 bp, Artificial Sequence
  Synthetic Polynucleotide
taatacgactcactatagggaggttctgcatgttgttgagatgcttgtcaaacagaggagatgacaaatgtctcaacaaaacctggcggcagcgcaaaagatg

SEQ ID NO: 232118 - DNA, 103 bp, Artificial Sequence
  Synthetic Polynucleotide
taatacgactcactatagggtccattctgcaggttctgcatgttgttgagaacagaggagactcaacatgatgcagaacaacctggcggcagcgcaaaagatg

SEQ ID NO: 232119 - DNA, 103 bp, Artificial Sequence
  Synthetic Polynucleotide
taatacgactcactataggggctccccccctccattctgcaggttctgcaaacagaggagatgcagaatgtgcagaatgaacctggcggcagcgcaaaagatg

SEQ ID NO: 232120 - DNA, 103 bp, Artificial Sequence
  Synthetic Polynucleotide
taatacgactcactatagggctgaagacctgctccccccctccattctgcaacagaggagagcagaaatgagggggggaaacctggcggcagcgcaaaagatg

SEQ ID NO: 232121 - DNA, 103 bp, Artificial Sequence
  Synthetic Polynucleotide
taatacgactcactatagggggcagtgtggctgaagacctgctcccccccaacagaggagaggggggatgcaggtcttcaacctggcggcagcgcaaaagatg

SEQ ID NO: 232122 - DNA, 103 bp, Artificial Sequence
  Synthetic Polynucleotide
taatacgactcactatagggattcgttgcaggtgacctccttgctggcggaacagaggagaccgccaatgaggaggtcaaacctggcggcagcgcaaaagatg

SEQ ID NO: 232123 - DNA, 103 bp, Artificial Sequence
  Synthetic Polynucleotide
taatacgactcactatagggccgccgccccggcagtgtggctgaagacctaacagaggagaaggtctatggccacactgaacctggcggcagcgcaaaagatg

SEQ ID NO: 232124 - DNA, 103 bp, Artificial Sequence
  Synthetic Polynucleotide
taatacgactcactatagggaccgccgccgccgccgccccggcagtgtggaacagaggagaccacacatgcggggcggcaacctggcggcagcgcaaaagatg

SEQ ID NO: 232125 - DNA, 103 bp, Artificial Sequence
  Synthetic Polynucleotide
taatacgactcactatagggcgccgcagccaccgccgccgccgccgccccaacagaggagaggggcgatggcggcggcgaacctggcggcagcgcaaaagatg

SEQ ID NO: 232126 - DNA, 103 bp, Artificial Sequence
  Synthetic Polynucleotide
taatacgactcactatagggctgccgccgccgccgcagccaccgccgccgaacagaggagacggcggatgtggctgcggaacctggcggcagcgcaaaagatg

SEQ ID NO: 232127 - DNA, 103 bp, Artificial Sequence
  Synthetic Polynucleotide
taatacgactcactatagggctgatattggctgccgccgccgccgcagccaacagaggagaggctgcatgggcggcggcaacctggcggcagcgcaaaagatg

SEQ ID NO: 232128 - DNA, 103 bp, Artificial Sequence
  Synthetic Polynucleotide
taatacgactcactataggggcaggagctactgatattggctgccgccgcaacagaggagagcggcgatggccaatatcaacctggcggcagcgcaaaagatg

SEQ ID NO: 232129 - DNA, 103 bp, Artificial Sequence
  Synthetic Polynucleotide
taatacgactcactatagggagggggccccgcaggagctactgatattggaacagaggagaccaataatggtagctcctaacctggcggcagcgcaaaagatg

SEQ ID NO: 232130 - DNA, 103 bp, Artificial Sequence
  Synthetic Polynucleotide
taatacgactcactatagggttggtcggcgagggggccccgcaggagctaaacagaggagatagctcatgcggggccccaacctggcggcagcgcaaaagatg

SEQ ID NO: 232131 - DNA, 103 bp, Artificial Sequence
  Synthetic Polynucleotide
taatacgactcactatagggggtttttggtttggtcggcgagggggccccaacagaggagaggggccatgtcgccgaccaacctggcggcagcgcaaaagatg

SEQ ID NO: 232132 - DNA, 103 bp, Artificial Sequence
  Synthetic Polynucleotide
taatacgactcactatagggaggtgggtttggtttttggtttggtcggcgaacagaggagacgccgaatgaaccaaaaaaacctggcggcagcgcaaaagatg

SEQ ID NO: 232133 - DNA, 103 bp, Artificial Sequence
  Synthetic Polynucleotide
taatacgactcactataggggaggccgaacattcgttgcaggtgacctccaacagaggagaggaggtatgctgcaacgaaacctggcggcagcgcaaaagatg

SEQ ID NO: 232134 - DNA, 103 bp, Artificial Sequence
  Synthetic Polynucleotide
taatacgactcactatagggtcgcaccgccaggtgggtttggtttttggtaacagaggagaaccaaaatgcaaacccacaacctggcggcagcgcaaaagatg

SEQ ID NO: 232135 - DNA, 103 bp, Artificial Sequence
  Synthetic Polynucleotide
taatacgactcactatagggatcacacacctcgcaccgccaggtgggtttaacagaggagaaaacccatgtggcggtgcaacctggcggcagcgcaaaagatg

SEQ ID NO: 232136 - DNA, 103 bp, Artificial Sequence
  Synthetic Polynucleotide
taatacgactcactatagggtggtctcataatcacacacctcgcaccgccaacagaggagaggcggtatgaggtgtgtgaacctggcggcagcgcaaaagatg

SEQ ID NO: 232137 - DNA, 103 bp, Artificial Sequence
  Synthetic Polynucleotide
taatacgactcactatagggctggccacgttggtctcataatcacacaccaacagaggagaggtgtgatgttatgagacaacctggcggcagcgcaaaagatg

SEQ ID NO: 232138 - DNA, 103 bp, Artificial Sequence
  Synthetic Polynucleotide
taatacgactcactataggggcggaggttcctggccacgttggtctcataaacagaggagatatgagatgaacgtggccaacctggcggcagcgcaaaagatg

SEQ ID NO: 232139 - DNA, 103 bp, Artificial Sequence
  Synthetic Polynucleotide
taatacgactcactatagggtcatgtgaatgcggaggttcctggccacgtaacagaggagaacgtggatgggaacctccaacctggcggcagcgcaaaagatg

SEQ ID NO: 232140 - DNA, 103 bp, Artificial Sequence
  Synthetic Polynucleotide
taatacgactcactatagggttctcactggtcatgtgaatgcggaggttcaacagaggagagaacctatgcattcacataacctggcggcagcgcaaaagatg

SEQ ID NO: 232141 - DNA, 103 bp, Artificial Sequence
  Synthetic Polynucleotide
taatacgactcactatagggatgcatgtgcttctcactggtcatgtgaataacagaggagaattcacatgaccagtgagaacctggcggcagcgcaaaagatg

SEQ ID NO: 232142 - DNA, 103 bp, Artificial Sequence
  Synthetic Polynucleotide
taatacgactcactatagggacatcatgttatgcatgtgcttctcactggaacagaggagaccagtgatgagcacatgcaacctggcggcagcgcaaaagatg

SEQ ID NO: 232143 - DNA, 103 bp, Artificial Sequence
  Synthetic Polynucleotide
taatacgactcactatagggtgttgcagtaacatcatgttatgcatgtgcaacagaggagagcacatatgtaacatgataacctggcggcagcgcaaaagatg

SEQ ID NO: 232144 - DNA, 103 bp, Artificial Sequence
  Synthetic Polynucleotide
taatacgactcactataggggctggcaaaggaggccgaacattcgttgcaaacagaggagatgcaacatgtgttcggccaacctggcggcagcgcaaaagatg

SEQ ID NO: 232145 - DNA, 103 bp, Artificial Sequence
  Synthetic Polynucleotide
taatacgactcactatagggggtcatgttctgttgcagtaacatcatgttaacagaggagaaacatgatgttactgcaaaacctggcggcagcgcaaaagatg

SEQ ID NO: 232146 - DNA, 103 bp, Artificial Sequence
  Synthetic Polynucleotide
taatacgactcactataggggttggatctgggtcatgttctgttgcagtaaacagaggagatactgcatgagaacatgaaacctggcggcagcgcaaaagatg

SEQ ID NO: 232147 - DNA, 103 bp, Artificial Sequence
  Synthetic Polynucleotide
taatacgactcactatagggtggcggttgtgttggatctgggtcatgttcaacagaggagagaacatatgccagatccaaacctggcggcagcgcaaaagatg

SEQ ID NO: 232148 - DNA, 103 bp, Artificial Sequence
  Synthetic Polynucleotide
taatacgactcactataggggaggcccaggtggcggttgtgttggatctgaacagaggagacagatcatgcacaaccgcaacctggcggcagcgcaaaagatg

SEQ ID NO: 232149 - DNA, 103 bp, Artificial Sequence
  Synthetic Polynucleotide
taatacgactcactataggggcaggctgccgaggcccaggtggcggttgtaacagaggagaacaaccatgacctgggccaacctggcggcagcgcaaaagatg

SEQ ID NO: 232150 - DNA, 103 bp, Artificial Sequence
  Synthetic Polynucleotide
taatacgactcactataggggcgggtgagggcaggctgccgaggcccaggaacagaggagacctgggatgcggcagcctaacctggcggcagcgcaaaagatg

SEQ ID NO: 232151 - DNA, 103 bp, Artificial Sequence
  Synthetic Polynucleotide
taatacgactcactatagggctcggcctcggcgggtgagggcaggctgccaacagaggagaggcagcatgccctcacccaacctggcggcagcgcaaaagatg

SEQ ID NO: 232152 - DNA, 103 bp, Artificial Sequence
  Synthetic Polynucleotide
taatacgactcactatagggattggtagagctcggcctcggcgggtgaggaacagaggagacctcacatgccgaggccgaacctggcggcagcgcaaaagatg

SEQ ID NO: 232153 - DNA, 103 bp, Artificial Sequence
  Synthetic Polynucleotide
taatacgactcactataggggccaggtagtattggtagagctcggcctcgaacagaggagacgaggcatggctctaccaaacctggcggcagcgcaaaagatg

SEQ ID NO: 232154 - DNA, 103 bp, Artificial Sequence
  Synthetic Polynucleotide
taatacgactcactatagggcatgttctgggccaggtagtattggtagagaacagaggagactctacatgtactacctgaacctggcggcagcgcaaaagatg

SEQ ID NO: 232155 - DNA, 103 bp, Artificial Sequence
  Synthetic Polynucleotide
taatacgactcactatagggaggtctggaggctggcaaaggaggccgaacaacagaggagagttcggatgcctttgccaaacctggcggcagcgcaaaagatg

SEQ ID NO: 232156 - DNA, 103 bp, Artificial Sequence
  Synthetic Polynucleotide
taatacgactcactatagggtgggcaggttcatgttctgggccaggtagtaacagaggagaactaccatgcccagaacaaacctggcggcagcgcaaaagatg

SEQ ID NO: 232157 - DNA, 103 bp, Artificial Sequence
  Synthetic Polynucleotide
taatacgactcactatagggatcttcaggttgggcaggttcatgttctggaacagaggagaccagaaatggaacctgccaacctggcggcagcgcaaaagatg

SEQ ID NO: 232158 - DNA, 103 bp, Artificial Sequence
  Synthetic Polynucleotide
taatacgactcactatagggagcactgtccatcttcaggttgggcaggttaacagaggagaaacctgatgaacctgaagaacctggcggcagcgcaaaagatg

SEQ ID NO: 232159 - DNA, 103 bp, Artificial Sequence
  Synthetic Polynucleotide
taatacgactcactatagggcgtccgaggcagcactgtccatcttcaggtaacagaggagaacctgaatgtggacagtgaacctggcggcagcgcaaaagatg

SEQ ID NO: 232160 - DNA, 103 bp, Artificial Sequence
  Synthetic Polynucleotide
taatacgactcactatagggatgaactgggcgtccgaggcagcactgtccaacagaggagaggacagatgtgcctcggaaacctggcggcagcgcaaaagatg

SEQ ID NO: 232161 - DNA, 103 bp, Artificial Sequence
  Synthetic Polynucleotide
taatacgactcactatagggtccgctcatcatgaactgggcgtccgaggcaacagaggagagcctcgatggcccagttcaacctggcggcagcgcaaaagatg

SEQ ID NO: 232162 - DNA, 103 bp, Artificial Sequence
  Synthetic Polynucleotide
taatacgactcactatagggccagctggaatccgctcatcatgaactgggaacagaggagacccagtatgtgatgagcgaacctggcggcagcgcaaaagatg

SEQ ID NO: 232163 - DNA, 103 bp, Artificial Sequence
  Synthetic Polynucleotide
taatacgactcactatagggccggcgggatccagctggaatccgctcatcaacagaggagagatgagatgattccagctaacctggcggcagcgcaaaagatg

SEQ ID NO: 232164 - DNA, 103 bp, Artificial Sequence
  Synthetic Polynucleotide
taatacgactcactatagggggccatgggcccggcgggatccagctggaaaacagaggagattccagatggatcccgccaacctggcggcagcgcaaaagatg

SEQ ID NO: 232165 - DNA, 103 bp, Artificial Sequence
  Synthetic Polynucleotide
taatacgactcactataggggcgtcatggcggccatgggcccggcgggataacagaggagaatcccgatgggcccatggaacctggcggcagcgcaaaagatg

SEQ ID NO: 232166 - DNA, 103 bp, Artificial Sequence
  Synthetic Polynucleotide
taatacgactcactatagggtgctccatgtaggtctggaggctggcaaagaacagaggagactttgcatgcctccagacaacctggcggcagcgcaaaagatg

SEQ ID NO: 232167 - DNA, 103 bp, Artificial Sequence
  Synthetic Polynucleotide
taatacgactcactatagggactagagcaggcgtcatggcggccatgggcaacagaggagagcccatatgcgccatgacaacctggcggcagcgcaaaagatg

SEQ ID NO: 232168 - DNA, 103 bp, Artificial Sequence
  Synthetic Polynucleotide
taatacgactcactatagggctcaccgcccactagagcaggcgtcatggcaacagaggagagccatgatgcctgctctaaacctggcggcagcgcaaaagatg

SEQ ID NO: 232169 - DNA, 103 bp, Artificial Sequence
  Synthetic Polynucleotide
taatacgactcactatagggctagggggatctcaccgcccactagagcagaacagaggagactgctcatgtgggcggtgaacctggcggcagcgcaaaagatg

SEQ ID NO: 232170 - DNA, 103 bp, Artificial Sequence
  Synthetic Polynucleotide
taatacgactcactatagggagccgcatgtctagggggatctcaccgcccaacagaggagagggcggatggatccccctaacctggcggcagcgcaaaagatg

SEQ ID NO: 232171 - DNA, 103 bp, Artificial Sequence
  Synthetic Polynucleotide
taatacgactcactatagggcccgcccccgagccgcatgtctagggggataacagaggagaatccccatggacatgcggaacctggcggcagcgcaaaagatg

SEQ ID NO: 232172 - DNA, 103 bp, Artificial Sequence
  Synthetic Polynucleotide
taatacgactcactatagggacaccagctgcccgcccccgagccgcatgtaacagaggagaacatgcatgtcgggggcgaacctggcggcagcgcaaaagatg

SEQ ID NO: 232173 - DNA, 103 bp, Artificial Sequence
  Synthetic Polynucleotide
taatacgactcactatagggagctcctctgacaccagctgcccgcccccgaacagaggagacgggggatggcagctggtaacctggcggcagcgcaaaagatg

SEQ ID NO: 232174 - DNA, 103 bp, Artificial Sequence
  Synthetic Polynucleotide
taatacgactcactatagggcaggttcatcagctcctctgacaccagctgaacagaggagacagctgatgtcagaggagaacctggcggcagcgcaaaagatg

SEQ ID NO: 232175 - DNA, 103 bp, Artificial Sequence
  Synthetic Polynucleotide
taatacgactcactatagggagctctcgcccaggttcatcagctcctctgaacagaggagacagaggatgtgatgaaccaacctggcggcagcgcaaaagatg

SEQ ID NO: 232176 - DNA, 103 bp, Artificial Sequence
  Synthetic Polynucleotide
taatacgactcactataggggtctggatgaagctctcgcccaggttcatcaacagaggagagatgaaatggggcgagagaacctggcggcagcgcaaaagatg

SEQ ID NO: 232177 - DNA, 103 bp, Artificial Sequence
  Synthetic Polynucleotide
taatacgactcactatagggggggcagtggtgctccatgtaggtctggagaacagaggagactccagatgtacatggagaacctggcggcagcgcaaaagatg

SEQ ID NO: 232178 - DNA, 103 bp, Artificial Sequence
  Synthetic Polynucleotide
taatacgactcactatagggcgggtcgttggtctggatgaagctctcgccaacagaggagaggcgagatgttcatccagaacctggcggcagcgcaaaagatg

SEQ ID NO: 232179 - DNA, 103 bp, Artificial Sequence
  Synthetic Polynucleotide
taatacgactcactataggggcttcagcgacgggtcgttggtctggatgaaacagaggagatcatccatgccaacgaccaacctggcggcagcgcaaaagatg

SEQ ID NO: 232180 - DNA, 103 bp, Artificial Sequence
  Synthetic Polynucleotide
taatacgactcactatagggcactggaagagcttcagcgacgggtcgttgaacagaggagacaacgaatggtcgctgaaaacctggcggcagcgcaaaagatg

SEQ ID NO: 232181 - DNA, 103 bp, Artificial Sequence
  Synthetic Polynucleotide
taatacgactcactataggggcagacggcgcactggaagagcttcagcgaaacagaggagatcgctgatgctcttccagaacctggcggcagcgcaaaagatg

SEQ ID NO: 232182 - DNA, 103 bp, Artificial Sequence
  Synthetic Polynucleotide
taatacgactcactatagggtgaacttgttgcagacggcgcactggaagaaacagaggagatcttccatggcgccgtctaacctggcggcagcgcaaaagatg

SEQ ID NO: 232183 - DNA, 103 bp, Artificial Sequence
  Synthetic Polynucleotide
taatacgactcactatagggttgtccgtcgtgaacttgttgcagacggcgaacagaggagacgccgtatgcaacaagttaacctggcggcagcgcaaaagatg

SEQ ID NO: 232184 - DNA, 103 bp, Artificial Sequence
  Synthetic Polynucleotide
taatacgactcactatagggcatgtccaggttgtccgtcgtgaacttgttaacagaggagaaacaagatgacgacggacaacctggcggcagcgcaaaagatg

SEQ ID NO: 232185 - DNA, 103 bp, Artificial Sequence
  Synthetic Polynucleotide
taatacgactcactataggggcaggcccagcatgtccaggttgtccgtcgaacagaggagacgacggatgacctggacaaacctggcggcagcgcaaaagatg

SEQ ID NO: 232186 - DNA, 103 bp, Artificial Sequence
  Synthetic Polynucleotide
taatacgactcactatagggacgttcatgtgcaggcccagcatgtccaggaacagaggagacctggaatggctgggcctaacctggcggcagcgcaaaagatg

SEQ ID NO: 232187 - DNA, 103 bp, Artificial Sequence
  Synthetic Polynucleotide
taatacgactcactataggggctgcgctccacgttcatgtgcaggcccagaacagaggagactgggcatgcacatgaacaacctggcggcagcgcaaaagatg

SEQ ID NO: 232188 - DNA, 103 bp, Artificial Sequence
  Synthetic Polynucleotide
taatacgactcactatagggggcgcgcgctggggcagtggtgctccatgtaacagaggagaacatggatgaccactgccaacctggcggcagcgcaaaagatg

SEQ ID NO: 232189 - DNA, 103 bp, Artificial Sequence
  Synthetic Polynucleotide
taatacgactcactatagggcctccgacaggctgcgctccacgttcatgtaacagaggagaacatgaatgtggagcgcaaacctggcggcagcgcaaaagatg

SEQ ID NO: 232190 - DNA, 103 bp, Artificial Sequence
  Synthetic Polynucleotide
taatacgactcactatagggttccactcgtcctccgacaggctgcgctccaacagaggagaggagcgatgcctgtcggaaacctggcggcagcgcaaaagatg

SEQ ID NO: 232191 - DNA, 103 bp, Artificial Sequence
  Synthetic Polynucleotide
taatacgactcactatagggcatcaccgccttccactcgtcctccgacagaacagaggagactgtcgatggacgagtggaacctggcggcagcgcaaaagatg

SEQ ID NO: 232192 - DNA, 103 bp, Artificial Sequence
  Synthetic Polynucleotide
taatacgactcactatagggatgagtcccccatcaccgccttccactcgtaacagaggagaacgagtatgaggcggtgaaacctggcggcagcgcaaaagatg

SEQ ID NO: 232193 - DNA, 103 bp, Artificial Sequence
  Synthetic Polynucleotide
taatacgactcactatagggttgcactggtatgagtcccccatcaccgccaacagaggagaggcggtatggggggactcaacctggcggcagcgcaaaagatg

SEQ ID NO: 232194 - DNA, 103 bp, Artificial Sequence
  Synthetic Polynucleotide
taatacgactcactataggggcggcagagcttgcactggtatgagtccccaacagaggagaggggacatgtaccagtgcaacctggcggcagcgcaaaagatg

SEQ ID NO: 232195 - DNA, 103 bp, Artificial Sequence
  Synthetic Polynucleotide
taatacgactcactataggggggtgttgtagcggcagagcttgcactggtaacagaggagaaccagtatgagctctgccaacctggcggcagcgcaaaagatg

SEQ ID NO: 232196 - DNA, 103 bp, Artificial Sequence
  Synthetic Polynucleotide
taatacgactcactataggggccttgagctgggtgttgtagcggcagagcaacagaggagagctctgatgctacaacacaacctggcggcagcgcaaaagatg

SEQ ID NO: 232197 - DNA, 103 bp, Artificial Sequence
  Synthetic Polynucleotide
taatacgactcactatagggctggaagttggccttgagctgggtgttgtaaacagaggagatacaacatgcagctcaagaacctggcggcagcgcaaaagatg

SEQ ID NO: 232198 - DNA, 103 bp, Artificial Sequence
  Synthetic Polynucleotide
taatacgactcactatagggtgcagtgcagctggaagttggccttgagctaacagaggagaagctcaatgccaacttccaacctggcggcagcgcaaaagatg

SEQ ID NO: 232199 - DNA, 103 bp, Artificial Sequence
  Synthetic Polynucleotide
taatacgactcactatagggccgcacccattgtccttccccgagacgacgaacagaggagacgtcgtatgggggaaggaaacctggcggcagcgcaaaagatg

SEQ ID NO: 232200 - DNA, 103 bp, Artificial Sequence
  Synthetic Polynucleotide
taatacgactcactatagggggtggcggggggcgcgcgctggggcagtggaacagaggagaccactgatgcagcgcgcgaacctggcggcagcgcaaaagatg

SEQ ID NO: 232201 - DNA, 103 bp, Artificial Sequence
  Synthetic Polynucleotide
taatacgactcactatagggttgtctgtcttgcagtgcagctggaagttgaacagaggagacaacttatggctgcactgaacctggcggcagcgcaaaagatg

SEQ ID NO: 232202 - DNA, 103 bp, Artificial Sequence
  Synthetic Polynucleotide
taatacgactcactatagggctgcacgtgcttgtctgtcttgcagtgcagaacagaggagactgcacatgaagacagacaacctggcggcagcgcaaaagatg

SEQ ID NO: 232203 - DNA, 103 bp, Artificial Sequence
  Synthetic Polynucleotide
taatacgactcactataggggctggtacttctgcacgtgcttgtctgtctaacagaggagaagacagatgagcacgtgcaacctggcggcagcgcaaaagatg

SEQ ID NO: 232204 - DNA, 103 bp, Artificial Sequence
  Synthetic Polynucleotide
taatacgactcactatagggtgggccaccagctggtacttctgcacgtgcaacagaggagagcacgtatggaagtaccaaacctggcggcagcgcaaaagatg

SEQ ID NO: 232205 - DNA, 103 bp, Artificial Sequence
  Synthetic Polynucleotide
taatacgactcactatagggctccttgatgtgggccaccagctggtacttaacagaggagaaagtacatgctggtggccaacctggcggcagcgcaaaagatg

SEQ ID NO: 232206 - DNA, 103 bp, Artificial Sequence
  Synthetic Polynucleotide
taatacgactcactatagggccttgccgccctccttgatgtgggccaccaaacagaggagatggtggatgacatcaaggaacctggcggcagcgcaaaagatg

SEQ ID NO: 232207 - DNA, 103 bp, Artificial Sequence
  Synthetic Polynucleotide
taatacgactcactatagggcactcgttggccttgccgccctccttgatgaacagaggagacatcaaatggggcggcaaaacctggcggcagcgcaaaagatg

SEQ ID NO: 232208 - DNA, 103 bp, Artificial Sequence
  Synthetic Polynucleotide
taatacgactcactatagggcttgagcctccactcgttggccttgccgccaacagaggagaggcggcatggccaacgagaacctggcggcagcgcaaaagatg

SEQ ID NO: 232209 - DNA, 103 bp, Artificial Sequence
  Synthetic Polynucleotide
taatacgactcactatagggtggccacacacttgagcctccactcgttggaacagaggagaccaacgatgggaggctcaaacctggcggcagcgcaaaagatg

SEQ ID NO: 232210 - DNA, 103 bp, Artificial Sequence
  Synthetic Polynucleotide
taatacgactcactataggggggttgccgatggccacacacttgagcctcaacagaggagagaggctatggtgtgtggcaacctggcggcagcgcaaaagatg

SEQ ID NO: 232211 - DNA, 103 bp, Artificial Sequence
  Synthetic Polynucleotide
taatacgactcactatagggctctctcaggggtggcggggggcgcgcgctaacagaggagaagcgcgatgcccccgccaaacctggcggcagcgcaaaagatg

SEQ ID NO: 232212 - DNA, 103 bp, Artificial Sequence
  Synthetic Polynucleotide
taatacgactcactataggggaggtgcacggggttgccgatggccacacaaacagaggagatgtgtgatgatcggcaacaacctggcggcagcgcaaaagatg

SEQ ID NO: 232213 - DNA, 103 bp, Artificial Sequence
  Synthetic Polynucleotide
taatacgactcactatagggcgttgcacttgaggtgcacggggttgccgaaacagaggagatcggcaatgccgtgcaccaacctggcggcagcgcaaaagatg

SEQ ID NO: 232214 - DNA, 103 bp, Artificial Sequence
  Synthetic Polynucleotide
taatacgactcactatagggtagtcacaggcgttgcacttgaggtgcacgaacagaggagacgtgcaatgcaagtgcaaaacctggcggcagcgcaaaagatg

SEQ ID NO: 232215 - DNA, 103 bp, Artificial Sequence
  Synthetic Polynucleotide
taatacgactcactataggggttggtgtagtagtcacaggcgttgcacttaacagaggagaaagtgcatggcctgtgacaacctggcggcagcgcaaaagatg

SEQ ID NO: 232216 - DNA, 103 bp, Artificial Sequence
  Synthetic Polynucleotide
taatacgactcactatagggtctccaggctgttggtgtagtagtcacaggaacagaggagacctgtgatgactacaccaaacctggcggcagcgcaaaagatg

SEQ ID NO: 232217 - DNA, 103 bp, Artificial Sequence
  Synthetic Polynucleotide
taatacgactcactatagggagccgcagcttctccaggctgttggtgtagaacagaggagactacacatgcagcctggaaacctggcggcagcgcaaaagatg

SEQ ID NO: 232218 - DNA, 103 bp, Artificial Sequence
  Synthetic Polynucleotide
taatacgactcactataggggaccgtgtgcagccgcagcttctccaggctaacagaggagaagcctgatgaagctgcggaacctggcggcagcgcaaaagatg

SEQ ID NO: 232219 - DNA, 103 bp, Artificial Sequence
  Synthetic Polynucleotide
taatacgactcactataggggcctggagttgaccgtgtgcagccgcagctaacagaggagaagctgcatgtgcacacggaacctggcggcagcgcaaaagatg

SEQ ID NO: 232220 - DNA, 103 bp, Artificial Sequence
  Synthetic Polynucleotide
taatacgactcactatagggctggcctcgtgcctggagttgaccgtgtgcaacagaggagagcacacatgcaactccagaacctggcggcagcgcaaaagatg

SEQ ID NO: 232221 - DNA, 103 bp, Artificial Sequence
  Synthetic Polynucleotide
taatacgactcactatagggcaacttcaggctggcctcgtgcctggagttaacagaggagaaactccatgcacgaggccaacctggcggcagcgcaaaagatg

SEQ ID NO: 232222 - DNA, 103 bp, Artificial Sequence
  Synthetic Polynucleotide
taatacgactcactatagggtggcgctctcctctctcaggggtggcggggaacagaggagaccccgcatgccctgagagaacctggcggcagcgcaaaagatg

SEQ ID NO: 232223 - DNA, 103 bp, Artificial Sequence
  Synthetic Polynucleotide
taatacgactcactatagggggtgcttgtacaacttcaggctggcctcgtaacagaggagaacgaggatggcctgaagtaacctggcggcagcgcaaaagatg

SEQ ID NO: 232224 - DNA, 103 bp, Artificial Sequence
  Synthetic Polynucleotide
taatacgactcactatagggtgctgctgcaggtgcttgtacaacttcaggaacagaggagacctgaaatggtacaagcaaacctggcggcagcgcaaaagatg

SEQ ID NO: 232225 - DNA, 103 bp, Artificial Sequence
  Synthetic Polynucleotide
taatacgactcactatagggaccactctcatgctgctgcaggtgcttgtaaacagaggagatacaagatgctgcagcagaacctggcggcagcgcaaaagatg

SEQ ID NO: 232226 - DNA, 103 bp, Artificial Sequence
  Synthetic Polynucleotide
taatacgactcactatagggcaccttctacaccactctcatgctgctgcaaacagaggagatgcagcatgatgagagtgaacctggcggcagcgcaaaagatg

SEQ ID NO: 232227 - DNA, 103 bp, Artificial Sequence
  Synthetic Polynucleotide
taatacgactcactatagggtagcagctctcaccttctacaccactctcaaacagaggagatgagagatgtgtagaaggaacctggcggcagcgcaaaagatg

SEQ ID NO: 232228 - DNA, 103 bp, Artificial Sequence
  Synthetic Polynucleotide
taatacgactcactataggggcagtggtagtagcagctctcaccttctacaacagaggagagtagaaatggagagctgcaacctggcggcagcgcaaaagatg

SEQ ID NO: 232229 - DNA, 103 bp, Artificial Sequence
  Synthetic Polynucleotide
taatacgactcactatagggtgcacagaacgcagtggtagtagcagctctaacagaggagaagagctatgactaccactaacctggcggcagcgcaaaagatg

SEQ ID NO: 232230 - DNA, 103 bp, Artificial Sequence
  Synthetic Polynucleotide
taatacgactcactataggggtggagtagttgcacagaacgcagtggtagaacagaggagactaccaatgcgttctgtgaacctggcggcagcgcaaaagatg

SEQ ID NO: 232231 - DNA, 103 bp, Artificial Sequence
  Synthetic Polynucleotide
taatacgactcactatagggcttggccttggtggagtagttgcacagaacaacagaggagagttctgatgaactactccaacctggcggcagcgcaaaagatg

SEQ ID NO: 232232 - DNA, 103 bp, Artificial Sequence
  Synthetic Polynucleotide
taatacgactcactatagggtgaggttgagcttggccttggtggagtagtaacagaggagaactactatgccaaggccaaacctggcggcagcgcaaaagatg

SEQ ID NO: 232233 - DNA, 103 bp, Artificial Sequence
  Synthetic Polynucleotide
taatacgactcactatagggccggtgtcgctggcgctctcctctctcaggaacagaggagacctgagatgggagagcgcaacctggcggcagcgcaaaagatg

SEQ ID NO: 232234 - DNA, 103 bp, Artificial Sequence
  Synthetic Polynucleotide
taatacgactcactatagggacatgctggatgaggttgagcttggccttgaacagaggagacaaggcatggctcaacctaacctggcggcagcgcaaaagatg

SEQ ID NO: 232235 - DNA, 103 bp, Artificial Sequence
  Synthetic Polynucleotide
taatacgactcactatagggcatggagcgcacatgctggatgaggttgagaacagaggagactcaacatgatccagcataacctggcggcagcgcaaaagatg

SEQ ID NO: 232236 - DNA, 103 bp, Artificial Sequence
  Synthetic Polynucleotide
taatacgactcactataggggctggtgcttcatggagcgcacatgctggaaacagaggagatccagcatgtgcgctccaaacctggcggcagcgcaaaagatg

SEQ ID NO: 232237 - DNA, 103 bp, Artificial Sequence
  Synthetic Polynucleotide
taatacgactcactatagggctctcgcttcgctggtgcttcatggagcgcaacagaggagagcgctcatggaagcaccaaacctggcggcagcgcaaaagatg

SEQ ID NO: 232238 - DNA, 103 bp, Artificial Sequence
  Synthetic Polynucleotide
taatacgactcactatagggctttcgcaggctctcgcttcgctggtgcttaacagaggagaaagcacatgcgaagcgagaacctggcggcagcgcaaaagatg

SEQ ID NO: 232239 - DNA, 103 bp, Artificial Sequence
  Synthetic Polynucleotide
taatacgactcactataggggccgctgcagctttcgcaggctctcgcttcaacagaggagagaagcgatggcctgcgaaaacctggcggcagcgcaaaagatg

SEQ ID NO: 232240 - DNA, 103 bp, Artificial Sequence
  Synthetic Polynucleotide
taatacgactcactatagggcccttctgcagccgctgcagctttcgcaggaacagaggagacctgcgatggctgcagcgaacctggcggcagcgcaaaagatg

SEQ ID NO: 232241 - DNA, 103 bp, Artificial Sequence
  Synthetic Polynucleotide
taatacgactcactatagggctctggaaggcccttctgcagccgctgcagaacagaggagactgcagatgctgcagaagaacctggcggcagcgcaaaagatg

SEQ ID NO: 232242 - DNA, 103 bp, Artificial Sequence
  Synthetic Polynucleotide
taatacgactcactatagggcctcgtcctcctctggaaggcccttctgcaaacagaggagatgcagaatggccttccagaacctggcggcagcgcaaaagatg

SEQ ID NO: 232243 - DNA, 103 bp, Artificial Sequence
  Synthetic Polynucleotide
taatacgactcactatagggtgccccaggtcctcgtcctcctctggaaggaacagaggagaccttccatgggaggacgaaacctggcggcagcgcaaaagatg

SEQ ID NO: 232244 - DNA, 103 bp, Artificial Sequence
  Synthetic Polynucleotide
taatacgactcactatagggcccctcctcaccggtgtcgctggcgctctcaacagaggagagagagcatgagcgacaccaacctggcggcagcgcaaaagatg

SEQ ID NO: 232245 - DNA, 103 bp, Artificial Sequence
  Synthetic Polynucleotide
taatacgactcactatagggggtgaagatctgccccaggtcctcgtcctcaacagaggagagaggacatggacctggggaacctggcggcagcgcaaaagatg

SEQ ID NO: 232246 - DNA, 103 bp, Artificial Sequence
  Synthetic Polynucleotide
taatacgactcactatagggacctgcggatggtgaagatctgccccaggtaacagaggagaacctggatgagatcttcaaacctggcggcagcgcaaaagatg

SEQ ID NO: 232247 - DNA, 103 bp, Artificial Sequence
  Synthetic Polynucleotide
taatacgactcactataggggtggaggggcacctgcggatggtgaagatcaacagaggagagatcttatgcatccgcagaacctggcggcagcgcaaaagatg

SEQ ID NO: 232248 - DNA, 103 bp, Artificial Sequence
  Synthetic Polynucleotide
taatacgactcactatagggttctgggtccgtggaggggcacctgcggataacagaggagaatccgcatgtgcccctccaacctggcggcagcgcaaaagatg

SEQ ID NO: 232249 - DNA, 103 bp, Artificial Sequence
  Synthetic Polynucleotide
taatacgactcactatagggcaatggcttcttctgggtccgtggaggggcaacagaggagagcccctatgcggacccagaacctggcggcagcgcaaaagatg

SEQ ID NO: 232250 - DNA, 103 bp, Artificial Sequence
  Synthetic Polynucleotide
taatacgactcactatagggtcaacatcttcaatggcttcttctgggtccaacagaggagaggacccatgagaagccataacctggcggcagcgcaaaagatg

SEQ ID NO: 232251 - DNA, 103 bp, Artificial Sequence
  Synthetic Polynucleotide
taatacgactcactatagggactgggtccttcaacatcttcaatggcttcaacagaggagagaagccatggaagatgttaacctggcggcagcgcaaaagatg

SEQ ID NO: 232252 - DNA, 103 bp, Artificial Sequence
  Synthetic Polynucleotide
taatacgactcactatagggcagctgtttcactgggtccttcaacatcttaacagaggagaaagatgatgaaggacccaaacctggcggcagcgcaaaagatg

SEQ ID NO: 232253 - DNA, 103 bp, Artificial Sequence
  Synthetic Polynucleotide
taatacgactcactatagggtctggatcagcagctgtttcactgggtcctaacagaggagaaggaccatgtgaaacagcaacctggcggcagcgcaaaagatg

SEQ ID NO: 232254 - DNA, 103 bp, Artificial Sequence
  Synthetic Polynucleotide
taatacgactcactatagggagcaagctcctctggatcagcagctgtttcaacagaggagagaaacaatggctgatccaaacctggcggcagcgcaaaagatg

SEQ ID NO: 232255 - DNA, 103 bp, Artificial Sequence
  Synthetic Polynucleotide
taatacgactcactatagggtctcctcgtccccctcctcaccggtgtcgcaacagaggagagcgacaatggtgaggaggaacctggcggcagcgcaaaagatg

SEQ ID NO: 232256 - DNA, 103 bp, Artificial Sequence
  Synthetic Polynucleotide
taatacgactcactatagggcttggtccttagcaagctcctctggatcagaacagaggagactgatcatgaggagcttgaacctggcggcagcgcaaaagatg

SEQ ID NO: 232257 - DNA, 103 bp, Artificial Sequence
  Synthetic Polynucleotide
taatacgactcactataggggctccgccctcttggtccttagcaagctccaacagaggagaggagctatgtaaggaccaaacctggcggcagcgcaaaagatg

SEQ ID NO: 232258 - DNA, 103 bp, Artificial Sequence
  Synthetic Polynucleotide
taatacgactcactataggggctggacgatgctccgccctcttggtccttaacagaggagaaaggacatggagggcggaaacctggcggcagcgcaaaagatg

SEQ ID NO: 232259 - DNA, 103 bp, Artificial Sequence
  Synthetic Polynucleotide
taatacgactcactatagggtctctgcttggctggacgatgctccgccctaacagaggagaagggcgatgcatcgtccaaacctggcggcagcgcaaaagatg

SEQ ID NO: 232260 - DNA, 103 bp, Artificial Sequence
  Synthetic Polynucleotide
taatacgactcactataggggtcagctccttctctgcttggctggacgataacagaggagaatcgtcatgccaagcagaaacctggcggcagcgcaaaagatg

SEQ ID NO: 232261 - DNA, 103 bp, Artificial Sequence
  Synthetic Polynucleotide
taatacgactcactatagggaggagaatctgtcagctccttctctgcttgaacagaggagacaagcaatgaaggagctgaacctggcggcagcgcaaaagatg

SEQ ID NO: 232262 - DNA, 103 bp, Artificial Sequence
  Synthetic Polynucleotide
taatacgactcactatagggtggaggttgcaggagaatctgtcagctcctaacagaggagaaggagcatgcagattctcaacctggcggcagcgcaaaagatg

SEQ ID NO: 232263 - DNA, 103 bp, Artificial Sequence
  Synthetic Polynucleotide
taatacgactcactataggggagatgcgtttggaggttgcaggagaatctaacagaggagaagattcatgtgcaacctcaacctggcggcagcgcaaaagatg

SEQ ID NO: 232264 - DNA, 103 bp, Artificial Sequence
  Synthetic Polynucleotide
taatacgactcactatagggacctgggaaggagatgcgtttggaggttgcaacagaggagagcaaccatgaaacgcatcaacctggcggcagcgcaaaagatg

SEQ ID NO: 232265 - DNA, 103 bp, Artificial Sequence
  Synthetic Polynucleotide
taatacgactcactatagggactctgagctacctgggaaggagatgcgttaacagaggagaaacgcaatgccttcccagaacctggcggcagcgcaaaagatg

SEQ ID NO: 232266 - DNA, 103 bp, Artificial Sequence
  Synthetic Polynucleotide
taatacgactcactatagggtccacgtcactctcctcgtccccctcctcaaacagaggagatgaggaatgggacgaggaaacctggcggcagcgcaaaagatg

SEQ ID NO: 232267 - DNA, 103 bp, Artificial Sequence
  Synthetic Polynucleotide
taatacgactcactataggggagaggggagactctgagctacctgggaagaacagaggagacttcccatgtagctcagaaacctggcggcagcgcaaaagatg

SEQ ID NO: 232268 - DNA, 103 bp, Artificial Sequence
  Synthetic Polynucleotide
taatacgactcactatagggtcgcttcgaagagaggggagactctgagctaacagaggagaagctcaatgtctcccctcaacctggcggcagcgcaaaagatg

SEQ ID NO: 232269 - DNA, 103 bp, Artificial Sequence
  Synthetic Polynucleotide
taatacgactcactatagggctgtttttggtcgcttcgaagagaggggagaacagaggagactccccatgcttcgaagcaacctggcggcagcgcaaaagatg

SEQ ID NO: 232270 - DNA, 103 bp, Artificial Sequence
  Synthetic Polynucleotide
taatacgactcactatagggatctcctcagctgtttttggtcgcttcgaaaacagaggagattcgaaatgaccaaaaacaacctggcggcagcgcaaaagatg

SEQ ID NO: 232271 - DNA, 103 bp, Artificial Sequence
  Synthetic Polynucleotide
taatacgactcactatagggctccggtttgatctcctcagctgtttttggaacagaggagaccaaaaatggctgaggagaacctggcggcagcgcaaaagatg

SEQ ID NO: 232272 - DNA, 103 bp, Artificial Sequence
  Synthetic Polynucleotide
taatacgactcactatagggggtacatctgctccggtttgatctcctcagaacagaggagactgaggatgtcaaaccggaacctggcggcagcgcaaaagatg

SEQ ID NO: 232273 - DNA, 103 bp, Artificial Sequence
  Synthetic Polynucleotide
taatacgactcactatagggtagggacactggtacatctgctccggtttgaacagaggagacaaaccatggcagatgtaaacctggcggcagcgcaaaagatg

SEQ ID NO: 232274 - DNA, 103 bp, Artificial Sequence
  Synthetic Polynucleotide
taatacgactcactataggggtacttgcagtagggacactggtacatctgaacagaggagacagatgatgcagtgtcccaacctggcggcagcgcaaaagatg

SEQ ID NO: 232275 - DNA, 103 bp, Artificial Sequence
  Synthetic Polynucleotide
taatacgactcactatagggcggcattactgtacttgcagtagggacactaacagaggagaagtgtcatgactgcaagtaacctggcggcagcgcaaaagatg

SEQ ID NO: 232276 - DNA, 103 bp, Artificial Sequence
  Synthetic Polynucleotide
taatacgactcactatagggcggttgacatcggcattactgtacttgcagaacagaggagactgcaaatgcagtaatgcaacctggcggcagcgcaaaagatg

SEQ ID NO: 232277 - DNA, 103 bp, Artificial Sequence
  Synthetic Polynucleotide
taatacgactcactatagggggccaggttctccacgtcactctcctcgtcaacagaggagagacgagatgagtgacgtgaacctggcggcagcgcaaaagatg

SEQ ID NO: 232278 - DNA, 103 bp, Artificial Sequence
  Synthetic Polynucleotide
taatacgactcactatagggcacccggagccggttgacatcggcattactaacagaggagaagtaatatggatgtcaacaacctggcggcagcgcaaaagatg

SEQ ID NO: 232279 - DNA, 103 bp, Artificial Sequence
  Synthetic Polynucleotide
taatacgactcactatagggtcatggcatgcacccggagccggttgacataacagaggagaatgtcaatgggctccgggaacctggcggcagcgcaaaagatg

SEQ ID NO: 232280 - DNA, 103 bp, Artificial Sequence
  Synthetic Polynucleotide
taatacgactcactataggggagtgctgcgtcatggcatgcacccggagcaacagaggagagctccgatggcatgccataacctggcggcagcgcaaaagatg

SEQ ID NO: 232281 - DNA, 103 bp, Artificial Sequence
  Synthetic Polynucleotide
taatacgactcactataggggggttgcaccgagtgctgcgtcatggcatgaacagaggagacatgccatgacgcagcacaacctggcggcagcgcaaaagatg

SEQ ID NO: 232282 - DNA, 103 bp, Artificial Sequence
  Synthetic Polynucleotide
taatacgactcactatagggagcgaagcatgggttgcaccgagtgctgcgaacagaggagacgcagcatgcggtgcaacaacctggcggcagcgcaaaagatg

SEQ ID NO: 232283 - DNA, 103 bp, Artificial Sequence
  Synthetic Polynucleotide
taatacgactcactatagggcacagggggcagcgaagcatgggttgcaccaacagaggagaggtgcaatgcatgcttcgaacctggcggcagcgcaaaagatg

SEQ ID NO: 232284 - DNA, 103 bp, Artificial Sequence
  Synthetic Polynucleotide
taatacgactcactatagggcatgtcctggcacagggggcagcgaagcataacagaggagaatgcttatgtgccccctgaacctggcggcagcgcaaaagatg

SEQ ID NO: 232285 - DNA, 103 bp, Artificial Sequence
  Synthetic Polynucleotide
taatacgactcactatagggtgttgttgagcatgtcctggcacagggggcaacagaggagagcccccatggccaggacaaacctggcggcagcgcaaaagatg

SEQ ID NO: 232286 - DNA, 103 bp, Artificial Sequence
  Synthetic Polynucleotide
taatacgactcactatagggaggtggatcttgttgttgagcatgtcctggaacagaggagaccaggaatggctcaacaaaacctggcggcagcgcaaaagatg

SEQ ID NO: 232287 - DNA, 103 bp, Artificial Sequence
  Synthetic Polynucleotide
taatacgactcactataggggtgcagctggaggtggatcttgttgttgagaacagaggagactcaacatgaagatccacaacctggcggcagcgcaaaagatg

SEQ ID NO: 232288 - DNA, 103 bp, Artificial Sequence
  Synthetic Polynucleotide
taatacgactcactatagggcgatctccccggccaggttctccacgtcacaacagaggagagtgacgatgagaacctggaacctggcggcagcgcaaaagatg

SEQ ID NO: 232289 - DNA, 103 bp, Artificial Sequence
  Synthetic Polynucleotide
taatacgactcactatagggggtgggtgaggtgcagctggaggtggatctaacagaggagaagatccatgtccagctgcaacctggcggcagcgcaaaagatg

SEQ ID NO: 232290 - DNA, 103 bp, Artificial Sequence
  Synthetic Polynucleotide
taatacgactcactatagggacgctgtggaggtgggtgaggtgcagctggaacagaggagaccagctatgcctcacccaaacctggcggcagcgcaaaagatg

SEQ ID NO: 232291 - DNA, 103 bp, Artificial Sequence
  Synthetic Polynucleotide
taatacgactcactataggggtcaggtgccacgctgtggaggtgggtgagaacagaggagactcaccatgctccacagcaacctggcggcagcgcaaaagatg

SEQ ID NO: 232292 - DNA, 103 bp, Artificial Sequence
  Synthetic Polynucleotide
taatacgactcactatagggtctccacgcagtcaggtgccacgctgtggaaacagaggagatccacaatgtggcacctgaacctggcggcagcgcaaaagatg

SEQ ID NO: 232293 - DNA, 103 bp, Artificial Sequence
  Synthetic Polynucleotide
taatacgactcactatagggataatgagcttctccacgcagtcaggtgccaacagaggagaggcaccatgctgcgtggaaacctggcggcagcgcaaaagatg

SEQ ID NO: 232294 - DNA, 103 bp, Artificial Sequence
  Synthetic Polynucleotide
taatacgactcactatagggggtcaccgtcataatgagcttctccacgcaaacagaggagatgcgtgatgaagctcattaacctggcggcagcgcaaaagatg

SEQ ID NO: 232295 - DNA, 103 bp, Artificial Sequence
  Synthetic Polynucleotide
taatacgactcactatagggtctcaggggtggtcaccgtcataatgagctaacagaggagaagctcaatgtgacggtgaaacctggcggcagcgcaaaagatg

SEQ ID NO: 232296 - DNA, 103 bp, Artificial Sequence
  Synthetic Polynucleotide
taatacgactcactatagggggcatcaccatctcaggggtggtcaccgtcaacagaggagagacggtatgcacccctgaaacctggcggcagcgcaaaagatg

SEQ ID NO: 232297 - DNA, 103 bp, Artificial Sequence
  Synthetic Polynucleotide
taatacgactcactatagggcatgctgcttggcatcaccatctcaggggtaacagaggagaacccctatgatggtgatgaacctggcggcagcgcaaaagatg

SEQ ID NO: 232298 - DNA, 103 bp, Artificial Sequence
  Synthetic Polynucleotide
taatacgactcactatagggctgggaggaacatgctgcttggcatcaccaaacagaggagatggtgaatgcaagcagcaaacctggcggcagcgcaaaagatg

SEQ ID NO: 232299 - DNA, 103 bp, Artificial Sequence
  Synthetic Polynucleotide
taatacgactcactatagggggctggtagacgatctccccggccaggttcaacagaggagagaacctatgcggggagataacctggcggcagcgcaaaagatg

SEQ ID NO: 232300 - DNA, 103 bp, Artificial Sequence
  Synthetic Polynucleotide
taatacgactcactatagggggaacagctgctgggaggaacatgctgcttaacagaggagaaagcagatggttcctcccaacctggcggcagcgcaaaagatg

SEQ ID NO: 232301 - DNA, 103 bp, Artificial Sequence
  Synthetic Polynucleotide
taatacgactcactatagggatctcgatctggaacagctgctgggaggaaaacagaggagattcctcatggcagctgttaacctggcggcagcgcaaaagatg

SEQ ID NO: 232302 - DNA, 103 bp, Artificial Sequence
  Synthetic Polynucleotide
taatacgactcactatagggtggaattcccatctcgatctggaacagctgaacagaggagacagctgatgcagatcgagaacctggcggcagcgcaaaagatg

SEQ ID NO: 232303 - DNA, 103 bp, Artificial Sequence
  Synthetic Polynucleotide
taatacgactcactatagggtcttccaaattggaattcccatctcgatctaacagaggagaagatcgatgtgggaattcaacctggcggcagcgcaaaagatg

SEQ ID NO: 232304 - DNA, 103 bp, Artificial Sequence
  Synthetic Polynucleotide
taatacgactcactatagggctttcctgcctcttccaaattggaattcccaacagaggagagggaatatgaatttggaaaacctggcggcagcgcaaaagatg

SEQ ID NO: 232305 - DNA, 103 bp, Artificial Sequence
  Synthetic Polynucleotide
taatacgactcactatagggtttcaggctgctttcctgcctcttccaaataacagaggagaatttggatgaggcaggaaaacctggcggcagcgcaaaagatg

SEQ ID NO: 232306 - DNA, 103 bp, Artificial Sequence
  Synthetic Polynucleotide
taatacgactcactatagggtcctctgaggtttcaggctgctttcctgccaacagaggagaggcaggatggcagcctgaaacctggcggcagcgcaaaagatg

SEQ ID NO: 232307 - DNA, 103 bp, Artificial Sequence
  Synthetic Polynucleotide
taatacgactcactatagggctttcccagatcctctgaggtttcaggctgaacagaggagacagcctatgacctcagagaacctggcggcagcgcaaaagatg

SEQ ID NO: 232308 - DNA, 103 bp, Artificial Sequence
  Synthetic Polynucleotide
taatacgactcactataggggcaagatgttctttcccagatcctctgaggaacagaggagacctcagatgatctgggaaaacctggcggcagcgcaaaagatg

SEQ ID NO: 232309 - DNA, 103 bp, Artificial Sequence
  Synthetic Polynucleotide
taatacgactcactatagggcttgcggatggcaagatgttctttcccagaaacagaggagatctgggatggaacatcttaacctggcggcagcgcaaaagatg

SEQ ID NO: 232310 - DNA, 103 bp, Artificial Sequence
  Synthetic Polynucleotide
taatacgactcactatagggctgagggataccgcacccattgtccttcccaacagaggagagggaagatgaatgggtgcaacctggcggcagcgcaaaagatg

SEQ ID NO: 232311 - DNA, 103 bp, Artificial Sequence
  Synthetic Polynucleotide
taatacgactcactatagggggagccgtccggctggtagacgatctccccaacagaggagaggggagatggtctaccagaacctggcggcagcgcaaaagatg

SEQ ID NO: 232312 - DNA, 103 bp, Artificial Sequence
  Synthetic Polynucleotide
taatacgactcactatagggttgctctgtgcttgcggatggcaagatgttaacagaggagaaacatcatgccatccgcaaacctggcggcagcgcaaaagatg

SEQ ID NO: 232313 - DNA, 103 bp, Artificial Sequence
  Synthetic Polynucleotide
taatacgactcactatagggaatctccgctttgctctgtgcttgcggatgaacagaggagacatccgatggcacagagcaacctggcggcagcgcaaaagatg

SEQ ID NO: 232314 - DNA, 103 bp, Artificial Sequence
  Synthetic Polynucleotide
taatacgactcactataggggatggtttcaaatctccgctttgctctgtgaacagaggagacacagaatgaagcggagaaacctggcggcagcgcaaaagatg

SEQ ID NO: 232315 - DNA, 103 bp, Artificial Sequence
  Synthetic Polynucleotide
taatacgactcactataggggtcagcaggggatggtttcaaatctccgctaacagaggagaagcggaatgttgaaaccaaacctggcggcagcgcaaaagatg

SEQ ID NO: 232316 - DNA, 103 bp, Artificial Sequence
  Synthetic Polynucleotide
taatacgactcactatagggcagagcctgggtcagcaggggatggtttcaaacagaggagatgaaacatgcccctgctgaacctggcggcagcgcaaaagatg

SEQ ID NO: 232317 - DNA, 103 bp, Artificial Sequence
  Synthetic Polynucleotide
taatacgactcactatagggtcttctctcacagagcctgggtcagcagggaacagaggagaccctgcatgcccaggctcaacctggcggcagcgcaaaagatg

SEQ ID NO: 232318 - DNA, 103 bp, Artificial Sequence
  Synthetic Polynucleotide
taatacgactcactataggggaagcctgagtcttctctcacagagcctggaacagaggagaccaggcatggtgagagaaaacctggcggcagcgcaaaagatg

SEQ ID NO: 232319 - DNA, 103 bp, Artificial Sequence
  Synthetic Polynucleotide
taatacgactcactatagggtccagcagatgaagcctgagtcttctctcaaacagaggagatgagagatgactcaggctaacctggcggcagcgcaaaagatg

SEQ ID NO: 232320 - DNA, 103 bp, Artificial Sequence
  Synthetic Polynucleotide
taatacgactcactatagggcaccccttcttccagcagatgaagcctgagaacagaggagactcaggatgcatctgctgaacctggcggcagcgcaaaagatg

SEQ ID NO: 232321 - DNA, 103 bp, Artificial Sequence
  Synthetic Polynucleotide
taatacgactcactatagggaacctggttgcaccccttcttccagcagataacagaggagaatctgcatgaagaaggggaacctggcggcagcgcaaaagatg

SEQ ID NO: 232322 - DNA, 103 bp, Artificial Sequence
  Synthetic Polynucleotide
taatacgactcactatagggcaatgtacgcggagccgtccggctggtagaaacagaggagatctaccatgcggacggctaacctggcggcagcgcaaaagatg

SEQ ID NO: 232323 - DNA, 103 bp, Artificial Sequence
  Synthetic Polynucleotide
taatacgactcactatagggaagttttgaaaacctggttgcaccccttctaacagaggagaagaaggatggcaaccaggaacctggcggcagcgcaaaagatg

SEQ ID NO: 232324 - DNA, 103 bp, Artificial Sequence
  Synthetic Polynucleotide
taatacgactcactatagggagggcagcagaagttttgaaaacctggttgaacagaggagacaaccaatgtttcaaaacaacctggcggcagcgcaaaagatg

SEQ ID NO: 232325 - DNA, 103 bp, Artificial Sequence
  Synthetic Polynucleotide
taatacgactcactatagggatgcgtctgaagggcagcagaagttttgaaaacagaggagattcaaaatgtctgctgccaacctggcggcagcgcaaaagatg

SEQ ID NO: 232326 - DNA, 103 bp, Artificial Sequence
  Synthetic Polynucleotide
taatacgactcactatagggcttcattaaaatgcgtctgaagggcagcagaacagaggagactgctgatgttcagacgcaacctggcggcagcgcaaaagatg

SEQ ID NO: 232327 - DNA, 103 bp, Artificial Sequence
  Synthetic Polynucleotide
taatacgactcactatagggttggcatgcacttcattaaaatgcgtctgaaacagaggagatcagacatgttttaatgaaacctggcggcagcgcaaaagatg

SEQ ID NO: 232328 - DNA, 103 bp, Artificial Sequence
  Synthetic Polynucleotide
taatacgactcactatagggctgaggcctcttggcatgcacttcattaaaaacagaggagatttaatatggtgcatgccaacctggcggcagcgcaaaagatg

SEQ ID NO: 232329 - DNA, 103 bp, Artificial Sequence
  Synthetic Polynucleotide
taatacgactcactatagggacaccggcagctgaggcctcttggcatgcaaacagaggagatgcatgatgagaggcctcaacctggcggcagcgcaaaagatg

SEQ ID NO: 232330 - DNA, 103 bp, Artificial Sequence
  Synthetic Polynucleotide
taatacgactcactatagggtggcgatctgacaccggcagctgaggcctcaacagaggagagaggccatggctgccggtaacctggcggcagcgcaaaagatg

SEQ ID NO: 232331 - DNA, 103 bp, Artificial Sequence
  Synthetic Polynucleotide
taatacgactcactatagggcttgtacacatggcgatctgacaccggcagaacagaggagactgccgatgtcagatcgcaacctggcggcagcgcaaaagatg

SEQ ID NO: 232332 - DNA, 103 bp, Artificial Sequence
  Synthetic Polynucleotide
taatacgactcactatagggtacagcggtacttgtacacatggcgatctgaacagaggagacagatcatgatgtgtacaaacctggcggcagcgcaaaagatg

SEQ ID NO: 232333 - DNA, 103 bp, Artificial Sequence
  Synthetic Polynucleotide
taatacgactcactatagggaggctctccacaatgtacgcggagccgtccaacagaggagaggacggatgcgcgtacataacctggcggcagcgcaaaagatg

SEQ ID NO: 232334 - DNA, 103 bp, Artificial Sequence
  Synthetic Polynucleotide
taatacgactcactatagggctacactgattacagcggtacttgtacacaaacagaggagatgtgtaatggtaccgctgaacctggcggcagcgcaaaagatg

SEQ ID NO: 232335 - DNA, 103 bp, Artificial Sequence
  Synthetic Polynucleotide
taatacgactcactataggggaaggccaggctacactgattacagcggtaaacagaggagataccgcatgaatcagtgtaacctggcggcagcgcaaaagatg

SEQ ID NO: 232336 - DNA, 103 bp, Artificial Sequence
  Synthetic Polynucleotide
taatacgactcactatagggcaatggtcttgaaggccaggctacactgataacagaggagaatcagtatggcctggcctaacctggcggcagcgcaaaagatg

SEQ ID NO: 232337 - DNA, 103 bp, Artificial Sequence
  Synthetic Polynucleotide
taatacgactcactatagggtgcaacttttcaatggtcttgaaggccaggaacagaggagacctggcatgcaagaccataacctggcggcagcgcaaaagatg

SEQ ID NO: 232338 - DNA, 103 bp, Artificial Sequence
  Synthetic Polynucleotide
taatacgactcactatagggagaatggagctgcaacttttcaatggtcttaacagaggagaaagaccatggaaaagttgaacctggcggcagcgcaaaagatg

SEQ ID NO: 232339 - DNA, 103 bp, Artificial Sequence
  Synthetic Polynucleotide
taatacgactcactatagggcatggtactgagaatggagctgcaacttttaacagaggagaaaaagtatgagctccattaacctggcggcagcgcaaaagatg

SEQ ID NO: 232340 - DNA, 103 bp, Artificial Sequence
  Synthetic Polynucleotide
taatacgactcactataggggctctgatcacatggtactgagaatggagcaacagaggagagctccaatgtcagtaccaaacctggcggcagcgcaaaagatg

SEQ ID NO: 232341 - DNA, 103 bp, Artificial Sequence
  Synthetic Polynucleotide
taatacgactcactatagggcatggtggcagctctgatcacatggtactgaacagaggagacagtacatggtgatcagaaacctggcggcagcgcaaaagatg

SEQ ID NO: 232342 - DNA, 103 bp, Artificial Sequence
  Synthetic Polynucleotide
taatacgactcactatagggaaagacagcacatggtggcagctctgatcaaacagaggagatgatcaatgctgccaccaaacctggcggcagcgcaaaagatg

SEQ ID NO: 232343 - DNA, 103 bp, Artificial Sequence
  Synthetic Polynucleotide
taatacgactcactatagggctgcgctgacaaagacagcacatggtggcaaacagaggagatgccacatggtgctgtctaacctggcggcagcgcaaaagatg

SEQ ID NO: 232344 - DNA, 103 bp, Artificial Sequence
  Synthetic Polynucleotide
taatacgactcactatagggcagctggctcaggctctccacaatgtacgcaacagaggagagcgtacatggtggagagcaacctggcggcagcgcaaaagatg

SEQ ID NO: 232345 - DNA, 103 bp, Artificial Sequence
  Synthetic Polynucleotide
taatacgactcactatagggagttcggaaactgcgctgacaaagacagcaaacagaggagatgctgtatgtgtcagcgcaacctggcggcagcgcaaaagatg

SEQ ID NO: 232346 - DNA, 103 bp, Artificial Sequence
  Synthetic Polynucleotide
taatacgactcactataggggagcctggaaagttcggaaactgcgctgacaacagaggagagtcagcatggtttccgaaaacctggcggcagcgcaaaagatg

SEQ ID NO: 232347 - DNA, 103 bp, Artificial Sequence
  Synthetic Polynucleotide
taatacgactcactatagggtgcttcttcagagcctggaaagttcggaaaaacagaggagatttccgatgtttccaggcaacctggcggcagcgcaaaagatg

SEQ ID NO: 232348 - DNA, 103 bp, Artificial Sequence
  Synthetic Polynucleotide
taatacgactcactatagggtgtctcaaggtgcttcttcagagcctggaaaacagaggagattccagatgctgaagaagaacctggcggcagcgcaaaagatg

SEQ ID NO: 232349 - DNA, 103 bp, Artificial Sequence
  Synthetic Polynucleotide
taatacgactcactatagggccaggtggcttgtctcaaggtgcttcttcaaacagaggagatgaagaatgaccttgagaaacctggcggcagcgcaaaagatg

SEQ ID NO: 232350 - DNA, 103 bp, Artificial Sequence
  Synthetic Polynucleotide
taatacgactcactatagggtcactcagctccaggtggcttgtctcaaggaacagaggagaccttgaatgaagccacctaacctggcggcagcgcaaaagatg

SEQ ID NO: 232351 - DNA, 103 bp, Artificial Sequence
  Synthetic Polynucleotide
taatacgactcactataggggatgtcagcctcactcagctccaggtggctaacagaggagaagccacatggagctgagtaacctggcggcagcgcaaaagatg

SEQ ID NO: 232352 - DNA, 103 bp, Artificial Sequence
  Synthetic Polynucleotide
taatacgactcactatagggaaagctgttggatgtcagcctcactcagctaacagaggagaagctgaatgaggctgacaaacctggcggcagcgcaaaagatg

SEQ ID NO: 232353 - DNA, 103 bp, Artificial Sequence
  Synthetic Polynucleotide
taatacgactcactatagggaggccaccataaagctgttggatgtcagccaacagaggagaggctgaatgccaacagctaacctggcggcagcgcaaaagatg

SEQ ID NO: 232354 - DNA, 103 bp, Artificial Sequence
  Synthetic Polynucleotide
taatacgactcactatagggattggccagcaggccaccataaagctgttgaacagaggagacaacagatgtatggtggcaacctggcggcagcgcaaaagatg

SEQ ID NO: 232355 - DNA, 103 bp, Artificial Sequence
  Synthetic Polynucleotide
taatacgactcactatagggcgccctgggtcagctggctcaggctctccaaacagaggagatggagaatgtgagccagcaacctggcggcagcgcaaaagatg

SEQ ID NO: 232356 - DNA, 103 bp, Artificial Sequence
  Synthetic Polynucleotide
taatacgactcactatagggggaggtccccattggccagcaggccaccataacagaggagaatggtgatgtgctggccaaacctggcggcagcgcaaaagatg

SEQ ID NO: 232357 - DNA, 103 bp, Artificial Sequence
  Synthetic Polynucleotide
taatacgactcactatagggcccattgccaggaggtccccattggccagcaacagaggagagctggcatgtggggacctaacctggcggcagcgcaaaagatg

SEQ ID NO: 232358 - DNA, 103 bp, Artificial Sequence
  Synthetic Polynucleotide
taatacgactcactatagggagtggggtctcccattgccaggaggtccccaacagaggagaggggacatgctggcaatgaacctggcggcagcgcaaaagatg

SEQ ID NO: 232359 - DNA, 103 bp, Artificial Sequence
  Synthetic Polynucleotide
taatacgactcactatagggcctctgccagagtggggtctcccattgccaaacagaggagatggcaaatggagaccccaaacctggcggcagcgcaaaagatg

SEQ ID NO: 232360 - DNA, 103 bp, Artificial Sequence
  Synthetic Polynucleotide
taatacgactcactatagggatggtatggtcctctgccagagtggggtctaacagaggagaagacccatgtctggcagaaacctggcggcagcgcaaaagatg

SEQ ID NO: 232361 - DNA, 103 bp, Artificial Sequence
  Synthetic Polynucleotide
taatacgactcactatagggctcaacaattatggtatggtcctctgccagaacagaggagactggcaatggaccataccaacctggcggcagcgcaaaagatg

SEQ ID NO: 232362 - DNA, 103 bp, Artificial Sequence
  Synthetic Polynucleotide
taatacgactcactatagggccttgtcttcctcaacaattatggtatggtaacagaggagaaccataatgtaattgttgaacctggcggcagcgcaaaagatg

SEQ ID NO: 232363 - DNA, 103 bp, Artificial Sequence
  Synthetic Polynucleotide
taatacgactcactatagggctctcttcctccttgtcttcctcaacaattaacagaggagaaattgtatgggaagacaaaacctggcggcagcgcaaaagatg

SEQ ID NO: 232364 - DNA, 103 bp, Artificial Sequence
  Synthetic Polynucleotide
taatacgactcactatagggttccaagtcactctcttcctccttgtcttcaacagaggagagaagacatggaggaagagaacctggcggcagcgcaaaagatg

SEQ ID NO: 232365 - DNA, 103 bp, Artificial Sequence
  Synthetic Polynucleotide
taatacgactcactatagggtctgtttatcttccaagtcactctcttcctaacagaggagaaggaagatggtgacttggaacctggcggcagcgcaaaagatg

SEQ ID NO: 232366 - DNA, 103 bp, Artificial Sequence
  Synthetic Polynucleotide
taatacgactcactatagggcaggcgcccccgccctgggtcagctggctcaacagaggagagagccaatggacccagggaacctggcggcagcgcaaaagatg

SEQ ID NO: 232367 - DNA, 103 bp, Artificial Sequence
  Synthetic Polynucleotide
taatacgactcactatagggcccgttgggctctgtttatcttccaagtcaaacagaggagatgacttatgagataaacaaacctggcggcagcgcaaaagatg

SEQ ID NO: 232368 - DNA, 103 bp, Artificial Sequence
  Synthetic Polynucleotide
taatacgactcactatagggagagtcactgcccgttgggctctgtttatcaacagaggagagataaaatgagcccaacgaacctggcggcagcgcaaaagatg

SEQ ID NO: 232369 - DNA, 103 bp, Artificial Sequence
  Synthetic Polynucleotide
taatacgactcactataggggtactgacccagagtcactgcccgttgggcaacagaggagagcccaaatggcagtgactaacctggcggcagcgcaaaagatg

SEQ ID NO: 232370 - DNA, 103 bp, Artificial Sequence
  Synthetic Polynucleotide
taatacgactcactataggggagtcttcttgtactgacccagagtcactgaacagaggagacagtgaatgtgggtcagtaacctggcggcagcgcaaaagatg

SEQ ID NO: 232371 - DNA, 103 bp, Artificial Sequence
  Synthetic Polynucleotide
taatacgactcactatagggctctgagcccgagtcttcttgtactgacccaacagaggagagggtcaatgcaagaagacaacctggcggcagcgcaaaagatg

SEQ ID NO: 232372 - DNA, 103 bp, Artificial Sequence
  Synthetic Polynucleotide
taatacgactcactatagggctctctttggctctgagcccgagtcttcttaacagaggagaaagaagatgcgggctcagaacctggcggcagcgcaaaagatg

SEQ ID NO: 232373 - DNA, 103 bp, Artificial Sequence
  Synthetic Polynucleotide
taatacgactcactatagggaaaggcagagctctctttggctctgagcccaacagaggagagggctcatggccaaagagaacctggcggcagcgcaaaagatg

SEQ ID NO: 232374 - DNA, 103 bp, Artificial Sequence
  Synthetic Polynucleotide
taatacgactcactatagggaccttttctgaaaggcagagctctctttggaacagaggagaccaaagatggctctgcctaacctggcggcagcgcaaaagatg

SEQ ID NO: 232375 - DNA, 103 bp, Artificial Sequence
  Synthetic Polynucleotide
taatacgactcactatagggtaaaattgggaccttttctgaaaggcagagaacagaggagactctgcatgtcagaaaagaacctggcggcagcgcaaaagatg

SEQ ID NO: 232376 - DNA, 103 bp, Artificial Sequence
  Synthetic Polynucleotide
taatacgactcactatagggttttccatagtaaaattgggaccttttctgaacagaggagacagaaaatgtcccaatttaacctggcggcagcgcaaaagatg

SEQ ID NO: 232377 - DNA, 103 bp, Artificial Sequence
  Synthetic Polynucleotide
taatacgactcactataggggccactcccacaggcgcccccgccctgggtaacagaggagaacccagatggggggcgccaacctggcggcagcgcaaaagatg

SEQ ID NO: 232378 - DNA, 103 bp, Artificial Sequence
  Synthetic Polynucleotide
taatacgactcactataggggtctaggaacttttccatagtaaaattgggaacagaggagacccaatatgactatggaaaacctggcggcagcgcaaaagatg

SEQ ID NO: 232379 - DNA, 103 bp, Artificial Sequence
  Synthetic Polynucleotide
taatacgactcactatagggggcgagaagggtctaggaacttttccatagaacagaggagactatggatgagttcctagaacctggcggcagcgcaaaagatg

SEQ ID NO: 232380 - DNA, 103 bp, Artificial Sequence
  Synthetic Polynucleotide
taatacgactcactatagggcacttgtaagggcgagaagggtctaggaacaacagaggagagttcctatgcccttctcgaacctggcggcagcgcaaaagatg

SEQ ID NO: 232381 - DNA, 103 bp, Artificial Sequence
  Synthetic Polynucleotide
taatacgactcactataggggcagacggtacacttgtaagggcgagaaggaacagaggagaccttctatgccttacaagaacctggcggcagcgcaaaagatg

SEQ ID NO: 232382 - DNA, 103 bp, Artificial Sequence
  Synthetic Polynucleotide
taatacgactcactatagggaagattccttgcagacggtacacttgtaagaacagaggagacttacaatggtaccgtctaacctggcggcagcgcaaaagatg

SEQ ID NO: 232383 - DNA, 103 bp, Artificial Sequence
  Synthetic Polynucleotide
taatacgactcactatagggttttgagtgaaagattccttgcagacggtaaacagaggagataccgtatgcaaggaatcaacctggcggcagcgcaaaagatg

SEQ ID NO: 232384 - DNA, 103 bp, Artificial Sequence
  Synthetic Polynucleotide
taatacgactcactatagggcaggatattcttttgagtgaaagattccttaacagaggagaaaggaaatgttcactcaaaacctggcggcagcgcaaaagatg

SEQ ID NO: 232385 - DNA, 103 bp, Artificial Sequence
  Synthetic Polynucleotide
taatacgactcactatagggagtgtactagcaggatattcttttgagtgaaacagaggagatcactcatgagaatatccaacctggcggcagcgcaaaagatg

SEQ ID NO: 232386 - DNA, 103 bp, Artificial Sequence
  Synthetic Polynucleotide
taatacgactcactatagggacagaattgtagtgtactagcaggatattcaacagaggagagaatatatggctagtacaaacctggcggcagcgcaaaagatg

SEQ ID NO: 232387 - DNA, 103 bp, Artificial Sequence
  Synthetic Polynucleotide
taatacgactcactatagggcaggtgggagacagaattgtagtgtactagaacagaggagactagtaatgtacaattctaacctggcggcagcgcaaaagatg

SEQ ID NO: 232388 - DNA, 103 bp, Artificial Sequence
  Synthetic Polynucleotide
taatacgactcactatagggcactgccactgccactcccacaggcgccccaacagaggagaggggcgatggtgggagtgaacctggcggcagcgcaaaagatg

SEQ ID NO: 232389 - DNA, 103 bp, Artificial Sequence
  Synthetic Polynucleotide
taatacgactcactatagggttaacttatgcaggtgggagacagaattgtaacagaggagaacaattatgtctcccaccaacctggcggcagcgcaaaagatg

SEQ ID NO: 232390 - DNA, 103 bp, Artificial Sequence
  Synthetic Polynucleotide
taatacgactcactatagggagggctctctttaacttatgcaggtgggagaacagaggagactcccaatggcataagttaacctggcggcagcgcaaaagatg

SEQ ID NO: 232391 - DNA, 103 bp, Artificial Sequence
  Synthetic Polynucleotide
taatacgactcactatagggtgattcttgaagggctctctttaacttatgaacagaggagacataagatgaagagagccaacctggcggcagcgcaaaagatg

SEQ ID NO: 232392 - DNA, 103 bp, Artificial Sequence
  Synthetic Polynucleotide
taatacgactcactataggggaccggttgctgattcttgaagggctctctaacagaggagaagagagatgttcaagaataacctggcggcagcgcaaaagatg

SEQ ID NO: 232393 - DNA, 103 bp, Artificial Sequence
  Synthetic Polynucleotide
taatacgactcactatagggggttctggctgaccggttgctgattcttgaaacagaggagatcaagaatgagcaaccggaacctggcggcagcgcaaaagatg

SEQ ID NO: 232394 - DNA, 103 bp, Artificial Sequence
  Synthetic Polynucleotide
taatacgactcactataggggctgctggtgggttctggctgaccggttgcaacagaggagagcaaccatgcagccagaaaacctggcggcagcgcaaaagatg

SEQ ID NO: 232395 - DNA, 103 bp, Artificial Sequence
  Synthetic Polynucleotide
taatacgactcactatagggtgttgtctgggctgctggtgggttctggctaacagaggagaagccagatgccaccagcaaacctggcggcagcgcaaaagatg

SEQ ID NO: 232396 - DNA, 103 bp, Artificial Sequence
  Synthetic Polynucleotide
taatacgactcactatagggttaaaaggtttgttgtctgggctgctggtgaacagaggagacaccagatgcccagacaaaacctggcggcagcgcaaaagatg

SEQ ID NO: 232397 - DNA, 103 bp, Artificial Sequence
  Synthetic Polynucleotide
taatacgactcactatagggagtgttacacttaaaaggtttgttgtctggaacagaggagaccagacatgaaaccttttaacctggcggcagcgcaaaagatg

SEQ ID NO: 232398 - DNA, 103 bp, Artificial Sequence
  Synthetic Polynucleotide
taatacgactcactatagggccacattacaagtgttacacttaaaaggttaacagaggagaaaccttatgagtgtaacaaacctggcggcagcgcaaaagatg

SEQ ID NO: 232399 - DNA, 103 bp, Artificial Sequence
  Synthetic Polynucleotide
taatacgactcactataggggggagaggcccactgccactgccactcccaaacagaggagatgggagatgcagtggcagaacctggcggcagcgcaaaagatg

SEQ ID NO: 232400 - DNA, 103 bp, Artificial Sequence
  Synthetic Polynucleotide
taatacgactcactatagggtggctgtaggccacattacaagtgttacacaacagaggagagtgtaaatgttgtaatgtaacctggcggcagcgcaaaagatg

SEQ ID NO: 232401 - DNA, 103 bp, Artificial Sequence
  Synthetic Polynucleotide
taatacgactcactatagggagtggaactctggctgtaggccacattacaaacagaggagatgtaatatggcctacagcaacctggcggcagcgcaaaagatg

SEQ ID NO: 232402 - DNA, 103 bp, Artificial Sequence
  Synthetic Polynucleotide
taatacgactcactatagggggatctccagagtggaactctggctgtaggaacagaggagacctacaatgagagttccaaacctggcggcagcgcaaaagatg

SEQ ID NO: 232403 - DNA, 103 bp, Artificial Sequence
  Synthetic Polynucleotide
taatacgactcactataggggacctcatatggatctccagagtggaactcaacagaggagagagttcatgtctggagataacctggcggcagcgcaaaagatg

SEQ ID NO: 232404 - DNA, 103 bp, Artificial Sequence
  Synthetic Polynucleotide
taatacgactcactatagggatgtaacacagacctcatatggatctccagaacagaggagactggagatgcatatgaggaacctggcggcagcgcaaaagatg

SEQ ID NO: 232405 - DNA, 103 bp, Artificial Sequence
  Synthetic Polynucleotide
taatacgactcactatagggccttggtttgatgtaacacagacctcatataacagaggagaatatgaatgctgtgttacaacctggcggcagcgcaaaagatg

SEQ ID NO: 232406 - DNA, 103 bp, Artificial Sequence
  Synthetic Polynucleotide
taatacgactcactataggggctgcccgggccttggtttgatgtaacacaaacagaggagatgtgttatgtcaaaccaaaacctggcggcagcgcaaaagatg

SEQ ID NO: 232407 - DNA, 103 bp, Artificial Sequence
  Synthetic Polynucleotide
taatacgactcactatagggctccagcttggctgcccgggccttggtttgaacagaggagacaaaccatggcccgggcaaacctggcggcagcgcaaaagatg

SEQ ID NO: 232408 - DNA, 103 bp, Artificial Sequence
  Synthetic Polynucleotide
taatacgactcactatagggcacttgcagcctccagcttggctgcccgggaacagaggagacccgggatgccaagctggaacctggcggcagcgcaaaagatg

SEQ ID NO: 232409 - DNA, 103 bp, Artificial Sequence
  Synthetic Polynucleotide
taatacgactcactatagggttgctgctgccacttgcagcctccagcttgaacagaggagacaagctatgggctgcaagaacctggcggcagcgcaaaagatg

SEQ ID NO: 232410 - DNA, 103 bp, Artificial Sequence
  Synthetic Polynucleotide
taatacgactcactataggggaaaagcgaggggagaggcccactgccactaacagaggagaagtggcatggggcctctcaacctggcggcagcgcaaaagatg

SEQ ID NO: 232411 - DNA, 103 bp, Artificial Sequence
  Synthetic Polynucleotide
taatacgactcactatagggcccagtcccattgctgctgccacttgcagcaacagaggagagctgcaatgggcagcagcaacctggcggcagcgcaaaagatg

SEQ ID NO: 232412 - DNA, 103 bp, Artificial Sequence
  Synthetic Polynucleotide
taatacgactcactatagggtgctgctgttcccagtcccattgctgctgcaacagaggagagcagcaatgatgggactgaacctggcggcagcgcaaaagatg

SEQ ID NO: 232413 - DNA, 103 bp, Artificial Sequence
  Synthetic Polynucleotide
taatacgactcactatagggaaggaaatactgctgctgttcccagtcccaaacagaggagatgggacatggaacagcagaacctggcggcagcgcaaaagatg

SEQ ID NO: 232414 - DNA, 103 bp, Artificial Sequence
  Synthetic Polynucleotide
taatacgactcactatagggggaggagctcaaggaaatactgctgctgttaacagaggagaaacagcatgagtatttccaacctggcggcagcgcaaaagatg

SEQ ID NO: 232415 - DNA, 103 bp, Artificial Sequence
  Synthetic Polynucleotide
taatacgactcactataggggacttggcgtggaggagctcaaggaaatacaacagaggagagtatttatgtgagctcctaacctggcggcagcgcaaaagatg

SEQ ID NO: 232416 - DNA, 103 bp, Artificial Sequence
  Synthetic Polynucleotide
taatacgactcactataggggtgctcacaggacttggcgtggaggagctcaacagaggagagagctcatgcacgccaagaacctggcggcagcgcaaaagatg

SEQ ID NO: 232417 - DNA, 103 bp, Artificial Sequence
  Synthetic Polynucleotide
taatacgactcactatagggactgccactggtgctcacaggacttggcgtaacagaggagaacgccaatgcctgtgagcaacctggcggcagcgcaaaagatg

SEQ ID NO: 232418 - DNA, 103 bp, Artificial Sequence
  Synthetic Polynucleotide
taatacgactcactatagggtaaaggtgttactgccactggtgctcacagaacagaggagactgtgaatgccagtggcaaacctggcggcagcgcaaaagatg

SEQ ID NO: 232419 - DNA, 103 bp, Artificial Sequence
  Synthetic Polynucleotide
taatacgactcactatagggttggaggtggtaaaggtgttactgccactgaacagaggagacagtggatgtaacaccttaacctggcggcagcgcaaaagatg

SEQ ID NO: 232420 - DNA, 103 bp, Artificial Sequence
  Synthetic Polynucleotide
taatacgactcactatagggactgcttggattggaggtggtaaaggtgttaacagaggagaaacaccatgaccacctccaacctggcggcagcgcaaaagatg

SEQ ID NO: 232421 - DNA, 103 bp, Artificial Sequence
  Synthetic Polynucleotide
taatacgactcactatagggattgctggtgctgagggataccgcacccataacagaggagaatgggtatggtatccctcaacctggcggcagcgcaaaagatg

SEQ ID NO: 232422 - DNA, 103 bp, Artificial Sequence
  Synthetic Polynucleotide
taatacgactcactataggggagagttcaggaaaagcgaggggagaggccaacagaggagaggcctcatgcctcgctttaacctggcggcagcgcaaaagatg

SEQ ID NO: 232423 - DNA, 103 bp, Artificial Sequence
  Synthetic Polynucleotide
taatacgactcactatagggcaatgccagcactgcttggattggaggtggaacagaggagaccacctatgatccaagcaaacctggcggcagcgcaaaagatg

SEQ ID NO: 232424 - DNA, 103 bp, Artificial Sequence
  Synthetic Polynucleotide
taatacgactcactataggggagcttggagcaatgccagcactgcttggaaacagaggagatccaagatgtgctggcataacctggcggcagcgcaaaagatg

SEQ ID NO: 232425 - DNA, 103 bp, Artificial Sequence
  Synthetic Polynucleotide
taatacgactcactatagggtagtaagttagagcttggagcaatgccagcaacagaggagagctggcatggctccaagcaacctggcggcagcgcaaaagatg

SEQ ID NO: 232426 - DNA, 103 bp, Artificial Sequence
  Synthetic Polynucleotide
taatacgactcactataggggcacttggcttagtaagttagagcttggagaacagaggagactccaaatgctaacttacaacctggcggcagcgcaaaagatg

SEQ ID NO: 232427 - DNA, 103 bp, Artificial Sequence
  Synthetic Polynucleotide
taatacgactcactatagggctctcagtgggcacttggcttagtaagttaaacagaggagataacttatgaagccaagtaacctggcggcagcgcaaaagatg

SEQ ID NO: 232428 - DNA, 103 bp, Artificial Sequence
  Synthetic Polynucleotide
taatacgactcactatagggcatccctacactctcagtgggcacttggctaacagaggagaagccaaatgcccactgagaacctggcggcagcgcaaaagatg

SEQ ID NO: 232429 - DNA, 103 bp, Artificial Sequence
  Synthetic Polynucleotide
taatacgactcactatagggccaggggtggcatccctacactctcagtggaacagaggagaccactgatggtgtagggaaacctggcggcagcgcaaaagatg

SEQ ID NO: 232430 - DNA, 103 bp, Artificial Sequence
  Synthetic Polynucleotide
taatacgactcactatagggataggattccccaggggtggcatccctacaaacagaggagatgtaggatggccacccctaacctggcggcagcgcaaaagatg

SEQ ID NO: 232431 - DNA, 103 bp, Artificial Sequence
  Synthetic Polynucleotide
taatacgactcactataggggttggcaccaataggattccccaggggtggaacagaggagaccacccatggggaatcctaacctggcggcagcgcaaaagatg

SEQ ID NO: 232432 - DNA, 103 bp, Artificial Sequence
  Synthetic Polynucleotide
taatacgactcactataggggggaagcaatgttggcaccaataggattccaacagaggagaggaatcatgttggtgccaaacctggcggcagcgcaaaagatg

SEQ ID NO: 232433 - DNA, 103 bp, Artificial Sequence
  Synthetic Polynucleotide
taatacgactcactataggggcgccagggagagagttcaggaaaagcgagaacagaggagactcgctatgcctgaactcaacctggcggcagcgcaaaagatg

SEQ ID NO: 232434 - DNA, 103 bp, Artificial Sequence
  Synthetic Polynucleotide
taatacgactcactatagggggctctgaaggggaagcaatgttggcaccaaacagaggagatggtgcatgcattgcttcaacctggcggcagcgcaaaagatg

SEQ ID NO: 232435 - DNA, 103 bp, Artificial Sequence
  Synthetic Polynucleotide
taatacgactcactatagggggcctctttgggctctgaaggggaagcaataacagaggagaattgctatgccttcagagaacctggcggcagcgcaaaagatg

SEQ ID NO: 232436 - DNA, 103 bp, Artificial Sequence
  Synthetic Polynucleotide
taatacgactcactatagggtcttccgattggcctctttgggctctgaagaacagaggagacttcagatgccaaagaggaacctggcggcagcgcaaaagatg

SEQ ID NO: 232437 - DNA, 103 bp, Artificial Sequence
  Synthetic Polynucleotide
taatacgactcactatagggtctgccagtttcttccgattggcctctttgaacagaggagacaaagaatgcaatcggaaaacctggcggcagcgcaaaagatg

SEQ ID NO: 232438 - DNA, 103 bp, Artificial Sequence
  Synthetic Polynucleotide
taatacgactcactatagggtgcaatcatatctgccagtttcttccgattaacagaggagaaatcggatgaaactggcaaacctggcggcagcgcaaaagatg

SEQ ID NO: 232439 - DNA, 103 bp, Artificial Sequence
  Synthetic Polynucleotide
taatacgactcactataggggctgcctggatgcaatcatatctgccagttaacagaggagaaactggatgatatgattgaacctggcggcagcgcaaaagatg

SEQ ID NO: 232440 - DNA, 103 bp, Artificial Sequence
  Synthetic Polynucleotide
taatacgactcactatagggtgttgttgctgctgcctggatgcaatcataaacagaggagatatgatatgatccaggcaaacctggcggcagcgcaaaagatg

SEQ ID NO: 232441 - DNA, 103 bp, Artificial Sequence
  Synthetic Polynucleotide
taatacgactcactatagggttgctgctgctgttgttgctgctgcctggaaacagaggagatccaggatgcagcaacaaaacctggcggcagcgcaaaagatg

SEQ ID NO: 232442 - DNA, 103 bp, Artificial Sequence
  Synthetic Polynucleotide
taatacgactcactataggggttgttgctgttgctgctgctgttgttgctaacagaggagaagcaacatgagcagcagcaacctggcggcagcgcaaaagatg

SEQ ID NO: 232443 - DNA, 103 bp, Artificial Sequence
  Synthetic Polynucleotide
taatacgactcactatagggtgttgttgttgttgttgctgttgctgctgcaacagaggagagcagcaatgacagcaacaaacctggcggcagcgcaaaagatg

SEQ ID NO: 232444 - DNA, 103 bp, Artificial Sequence
  Synthetic Polynucleotide
taatacgactcactatagggcttgccccccgcgccagggagagagttcagaacagaggagactgaacatgctccctggcaacctggcggcagcgcaaaagatg

SEQ ID NO: 232445 - DNA, 103 bp, Artificial Sequence
  Synthetic Polynucleotide
taatacgactcactatagggttgttgttgttgttgttgttgttgttgctgaacagaggagacagcaaatgcaacaacaaaacctggcggcagcgcaaaagatg

SEQ ID NO: 232446 - DNA, 103 bp, Artificial Sequence
  Synthetic Polynucleotide
taatacgactcactatagggtttgtgcttgttgttgttgttgttgttgttaacagaggagaaacaacatgaacaacaacaacctggcggcagcgcaaaagatg

SEQ ID NO: 232447 - DNA, 103 bp, Artificial Sequence
  Synthetic Polynucleotide
taatacgactcactatagggtgggccagcgtttgtgcttgttgttgttgtaacagaggagaacaacaatgacaagcacaaacctggcggcagcgcaaaagatg

SEQ ID NO: 232448 - DNA, 103 bp, Artificial Sequence
  Synthetic Polynucleotide
taatacgactcactatagggagcctgggcctgggccagcgtttgtgcttgaacagaggagacaagcaatgacgctggccaacctggcggcagcgcaaaagatg

SEQ ID NO: 232449 - DNA, 103 bp, Artificial Sequence
  Synthetic Polynucleotide
taatacgactcactatagggcttgaacttgagcctgggcctgggccagcgaacagaggagacgctggatgaggcccaggaacctggcggcagcgcaaaagatg

SEQ ID NO: 232450 - DNA, 103 bp, Artificial Sequence
  Synthetic Polynucleotide
taatacgactcactatagggtgcaggtgagcttgaacttgagcctgggccaacagaggagaggcccaatgtcaagttcaaacctggcggcagcgcaaaagatg

SEQ ID NO: 232451 - DNA, 103 bp, Artificial Sequence
  Synthetic Polynucleotide
taatacgactcactatagggcagctcctgctgcaggtgagcttgaacttgaacagaggagacaagttatggctcacctgaacctggcggcagcgcaaaagatg

SEQ ID NO: 232452 - DNA, 103 bp, Artificial Sequence
  Synthetic Polynucleotide
taatacgactcactatagggcctgttgctgcagctcctgctgcaggtgagaacagaggagactcaccatgagcaggagcaacctggcggcagcgcaaaagatg

SEQ ID NO: 232453 - DNA, 103 bp, Artificial Sequence
  Synthetic Polynucleotide
taatacgactcactatagggatcagggcagcctgttgctgcagctcctgcaacagaggagagcaggaatggcagcaacaaacctggcggcagcgcaaaagatg

SEQ ID NO: 232454 - DNA, 103 bp, Artificial Sequence
  Synthetic Polynucleotide
taatacgactcactatagggctgagactggatcagggcagcctgttgctgaacagaggagacagcaaatggctgccctgaacctggcggcagcgcaaaagatg

SEQ ID NO: 232455 - DNA, 103 bp, Artificial Sequence
  Synthetic Polynucleotide
taatacgactcactatagggggtccccttgcttgccccccgcgccagggaaacagaggagatccctgatgcggggggcaaacctggcggcagcgcaaaagatg

SEQ ID NO: 232456 - DNA, 103 bp, Artificial Sequence
  Synthetic Polynucleotide
taatacgactcactatagggggttaaacagctgagactggatcagggcagaacagaggagactgcccatgtccagtctcaacctggcggcagcgcaaaagatg

SEQ ID NO: 232457 - DNA, 103 bp, Artificial Sequence
  Synthetic Polynucleotide
taatacgactcactatagggaggagggtggggttaaacagctgagactggaacagaggagaccagtcatggctgtttaaaacctggcggcagcgcaaaagatg

SEQ ID NO: 232458 - DNA, 103 bp, Artificial Sequence
  Synthetic Polynucleotide
taatacgactcactataggggaagtgaggaaggagggtggggttaaacagaacagaggagactgtttatgcccaccctcaacctggcggcagcgcaaaagatg

SEQ ID NO: 232459 - DNA, 103 bp, Artificial Sequence
  Synthetic Polynucleotide
taatacgactcactatagggttgtcatggggaagtgaggaaggagggtggaacagaggagaccacccatgttcctcactaacctggcggcagcgcaaaagatg

SEQ ID NO: 232460 - DNA, 103 bp, Artificial Sequence
  Synthetic Polynucleotide
taatacgactcactatagggagggtctcagttgtcatggggaagtgaggaaacagaggagatcctcaatgccccatgacaacctggcggcagcgcaaaagatg

SEQ ID NO: 232461 - DNA, 103 bp, Artificial Sequence
  Synthetic Polynucleotide
taatacgactcactatagggtagttgcagcagggtctcagttgtcatgggaacagaggagacccatgatgactgagaccaacctggcggcagcgcaaaagatg

SEQ ID NO: 232462 - DNA, 103 bp, Artificial Sequence
  Synthetic Polynucleotide
taatacgactcactataggggctgctgctgtagttgcagcagggtctcagaacagaggagactgagaatgtgctgcaacaacctggcggcagcgcaaaagatg

SEQ ID NO: 232463 - DNA, 103 bp, Artificial Sequence
  Synthetic Polynucleotide
taatacgactcactatagggaggaggtgctgctgctgctgtagttgcagcaacagaggagagctgcaatgacagcagcaaacctggcggcagcgcaaaagatg

SEQ ID NO: 232464 - DNA, 103 bp, Artificial Sequence
  Synthetic Polynucleotide
taatacgactcactataggggaaagggaagaggaggtgctgctgctgctgaacagaggagacagcagatgcagcacctcaacctggcggcagcgcaaaagatg

SEQ ID NO: 232465 - DNA, 103 bp, Artificial Sequence
  Synthetic Polynucleotide
taatacgactcactatagggtggggatgtagaaagggaagaggaggtgctaacagaggagaagcaccatgtcttcccttaacctggcggcagcgcaaaagatg

SEQ ID NO: 232466 - DNA, 103 bp, Artificial Sequence
  Synthetic Polynucleotide
taatacgactcactataggggcacacgaagggtccccttgcttgccccccaacagaggagaggggggatggcaaggggaaacctggcggcagcgcaaaagatg

SEQ ID NO: 232467 - DNA, 103 bp, Artificial Sequence
  Synthetic Polynucleotide
taatacgactcactatagggaactcagcactggggatgtagaaagggaagaacagaggagacttcccatgctacatcccaacctggcggcagcgcaaaagatg

SEQ ID NO: 232468 - DNA, 103 bp, Artificial Sequence
  Synthetic Polynucleotide
taatacgactcactataggggttaagctggaactcagcactggggatgtaaacagaggagatacatcatgagtgctgagaacctggcggcagcgcaaaagatg

SEQ ID NO: 232469 - DNA, 103 bp, Artificial Sequence
  Synthetic Polynucleotide
taatacgactcactatagggtcacctcggggttaagctggaactcagcacaacagaggagagtgctgatgtccagcttaaacctggcggcagcgcaaaagatg

SEQ ID NO: 232470 - DNA, 103 bp, Artificial Sequence
  Synthetic Polynucleotide
taatacgactcactatagggactggcaagctcacctcggggttaagctggaacagaggagaccagctatgccccgaggtaacctggcggcagcgcaaaagatg

SEQ ID NO: 232471 - DNA, 103 bp, Artificial Sequence
  Synthetic Polynucleotide
taatacgactcactatagggcccactggtcactggcaagctcacctcgggaacagaggagacccgagatgagcttgccaaacctggcggcagcgcaaaagatg

SEQ ID NO: 232472 - DNA, 103 bp, Artificial Sequence
  Synthetic Polynucleotide
taatacgactcactataggggtgtcagtgccccactggtcactggcaagcaacagaggagagcttgcatgtgaccagtgaacctggcggcagcgcaaaagatg

SEQ ID NO: 232473 - DNA, 103 bp, Artificial Sequence
  Synthetic Polynucleotide
taatacgactcactataggggtcccagtcagtgtcagtgccccactggtcaacagaggagagaccagatgggcactgacaacctggcggcagcgcaaaagatg

SEQ ID NO: 232474 - DNA, 103 bp, Artificial Sequence
  Synthetic Polynucleotide
taatacgactcactataggggcctgggcctgtcccagtcagtgtcagtgcaacagaggagagcactgatgctgactgggaacctggcggcagcgcaaaagatg

SEQ ID NO: 232475 - DNA, 103 bp, Artificial Sequence
  Synthetic Polynucleotide
taatacgactcactatagggcttccagcaggcctgggcctgtcccagtcaaacagaggagatgactgatgcaggcccagaacctggcggcagcgcaaaagatg

SEQ ID NO: 232476 - DNA, 103 bp, Artificial Sequence
  Synthetic Polynucleotide
taatacgactcactataggggccttcagatcttccagcaggcctgggcctaacagaggagaaggcccatgcctgctggaaacctggcggcagcgcaaaagatg

SEQ ID NO: 232477 - DNA, 103 bp, Artificial Sequence
  Synthetic Polynucleotide
taatacgactcactatagggcacgggtgcagcacacgaagggtccccttgaacagaggagacaagggatgccttcgtgtaacctggcggcagcgcaaaagatg

SEQ ID NO: 232478 - DNA, 103 bp, Artificial Sequence
  Synthetic Polynucleotide
taatacgactcactatagggctgaacctgagccttcagatcttccagcagaacagaggagactgctgatggatctgaagaacctggcggcagcgcaaaagatg

SEQ ID NO: 232479 - DNA, 103 bp, Artificial Sequence
  Synthetic Polynucleotide
taatacgactcactataggggctgtgggacctgaacctgagccttcagataacagaggagaatctgaatgctcaggttcaacctggcggcagcgcaaaagatg

SEQ ID NO: 232480 - DNA, 103 bp, Artificial Sequence
  Synthetic Polynucleotide
taatacgactcactatagggtgatggctctgctgtgggacctgaacctgaaacagaggagatcaggtatgggtcccacaaacctggcggcagcgcaaaagatg

SEQ ID NO: 232481 - DNA, 103 bp, Artificial Sequence
  Synthetic Polynucleotide
taatacgactcactatagggcaagatctgctgatggctctgctgtgggacaacagaggagagtcccaatgcagagccataacctggcggcagcgcaaaagatg

SEQ ID NO: 232482 - DNA, 103 bp, Artificial Sequence
  Synthetic Polynucleotide
taatacgactcactataggggctgctgcggcaagatctgctgatggctctaacagaggagaagagccatgagcagatctaacctggcggcagcgcaaaagatg

SEQ ID NO: 232483 - DNA, 103 bp, Artificial Sequence
  Synthetic Polynucleotide
taatacgactcactatagggtggttctgctgctgctgcggcaagatctgcaacagaggagagcagatatggccgcagcaaacctggcggcagcgcaaaagatg

SEQ ID NO: 232484 - DNA, 103 bp, Artificial Sequence
  Synthetic Polynucleotide
taatacgactcactatagggtatagagagttggttctgctgctgctgcggaacagaggagaccgcagatgcagcagaacaacctggcggcagcgcaaaagatg

SEQ ID NO: 232485 - DNA, 103 bp, Artificial Sequence
  Synthetic Polynucleotide
taatacgactcactataggggactctgggctatagagagttggttctgctaacagaggagaagcagaatgaactctctaaacctggcggcagcgcaaaagatg

SEQ ID NO: 232486 - DNA, 103 bp, Artificial Sequence
  Synthetic Polynucleotide
taatacgactcactatagggagggcagagtgactctgggctatagagagtaacagaggagaactctcatgagcccagagaacctggcggcagcgcaaaagatg

SEQ ID NO: 232487 - DNA, 103 bp, Artificial Sequence
  Synthetic Polynucleotide
taatacgactcactatagggtggctgaaggagggcagagtgactctgggcaacagaggagagcccagatgcactctgccaacctggcggcagcgcaaaagatg

SEQ ID NO: 232488 - DNA, 103 bp, Artificial Sequence
  Synthetic Polynucleotide
taatacgactcactatagggtctgcgggtacacgggtgcagcacacgaagaacagaggagacttcgtatgctgcacccgaacctggcggcagcgcaaaagatg

SEQ ID NO: 232489 - DNA, 103 bp, Artificial Sequence
  Synthetic Polynucleotide
taatacgactcactatagggggtgctggcttggctgaaggagggcagagtaacagaggagaactctgatgtccttcagcaacctggcggcagcgcaaaagatg

SEQ ID NO: 232490 - DNA, 103 bp, Artificial Sequence
  Synthetic Polynucleotide
taatacgactcactatagggttcttttcggggtgctggcttggctgaaggaacagaggagaccttcaatgaagccagcaaacctggcggcagcgcaaaagatg

SEQ ID NO: 232491 - DNA, 103 bp, Artificial Sequence
  Synthetic Polynucleotide
taatacgactcactatagggcaatttgttcttcttttcggggtgctggctaacagaggagaagccagatgcccgaaaagaacctggcggcagcgcaaaagatg

SEQ ID NO: 232492 - DNA, 103 bp, Artificial Sequence
  Synthetic Polynucleotide
taatacgactcactatagggctttgatgaccaatttgttcttcttttcggaacagaggagaccgaaaatgagaacaaataacctggcggcagcgcaaaagatg

SEQ ID NO: 232493 - DNA, 103 bp, Artificial Sequence
  Synthetic Polynucleotide
taatacgactcactatagggttttccttttctttgatgaccaatttgttcaacagaggagagaacaaatgggtcatcaaaacctggcggcagcgcaaaagatg

SEQ ID NO: 232494 - DNA, 103 bp, Artificial Sequence
  Synthetic Polynucleotide
taatacgactcactatagggctggctttctttttccttttctttgatgacaacagaggagagtcatcatggaaaaggaaaacctggcggcagcgcaaaagatg

SEQ ID NO: 232495 - DNA, 103 bp, Artificial Sequence
  Synthetic Polynucleotide
taatacgactcactatagggccctctctctctggctttctttttccttttaacagaggagaaaaaggatgaagaaagccaacctggcggcagcgcaaaagatg

SEQ ID NO: 232496 - DNA, 103 bp, Artificial Sequence
  Synthetic Polynucleotide
taatacgactcactatagggtcggcgctgtccctctctctctggctttctaacagaggagaagaaagatggagagagagaacctggcggcagcgcaaaagatg

SEQ ID NO: 232497 - DNA, 103 bp, Artificial Sequence
  Synthetic Polynucleotide
taatacgactcactatagggctctcccccctcggcgctgtccctctctctaacagaggagaagagagatggacagcgccaacctggcggcagcgcaaaagatg

SEQ ID NO: 232498 - DNA, 103 bp, Artificial Sequence
  Synthetic Polynucleotide
taatacgactcactatagggcggtgttgccctctcccccctcggcgctgtaacagaggagaacagcgatgaggggggagaacctggcggcagcgcaaaagatg

SEQ ID NO: 232499 - DNA, 103 bp, Artificial Sequence
  Synthetic Polynucleotide
taatacgactcactataggggtgttgatgatctgcgggtacacgggtgcaaacagaggagatgcaccatggtacccgcaaacctggcggcagcgcaaaagatg

SEQ ID NO: 232500 - DNA, 103 bp, Artificial Sequence
  Synthetic Polynucleotide
taatacgactcactatagggtccttcggaccggtgttgccctctccccccaacagaggagaggggggatggggcaacacaacctggcggcagcgcaaaagatg

SEQ ID NO: 232501 - DNA, 103 bp, Artificial Sequence
  Synthetic Polynucleotide
taatacgactcactatagggtggcagtgtttccttcggaccggtgttgccaacagaggagaggcaacatgggtccgaagaacctggcggcagcgcaaaagatg

SEQ ID NO: 232502 - DNA, 103 bp, Artificial Sequence
  Synthetic Polynucleotide
taatacgactcactatagggtcaaggcatctggcagtgtttccttcggacaacagaggagagtccgaatgaaacactgcaacctggcggcagcgcaaaagatg

SEQ ID NO: 232503 - DNA, 103 bp, Artificial Sequence
  Synthetic Polynucleotide
taatacgactcactatagggtctttggccttcaaggcatctggcagtgttaacagaggagaaacactatgagatgccttaacctggcggcagcgcaaaagatg

SEQ ID NO: 232504 - DNA, 103 bp, Artificial Sequence
  Synthetic Polynucleotide
taatacgactcactatagggctctttcttctctttggccttcaaggcatcaacagaggagagatgccatgaaggccaaaaacctggcggcagcgcaaaagatg

SEQ ID NO: 232505 - DNA, 103 bp, Artificial Sequence
  Synthetic Polynucleotide
taatacgactcactatagggctggtgccaactctttcttctctttggcctaacagaggagaaggccaatgagaagaaagaacctggcggcagcgcaaaagatg

SEQ ID NO: 232506 - DNA, 103 bp, Artificial Sequence
  Synthetic Polynucleotide
taatacgactcactataggggaaccaccccctggtgccaactctttcttcaacagaggagagaagaaatggttggcaccaacctggcggcagcgcaaaagatg

SEQ ID NO: 232507 - DNA, 103 bp, Artificial Sequence
  Synthetic Polynucleotide
taatacgactcactatagggggaaggctcagaaccaccccctggtgccaaaacagaggagattggcaatggggggtggtaacctggcggcagcgcaaaagatg

SEQ ID NO: 232508 - DNA, 103 bp, Artificial Sequence
  Synthetic Polynucleotide
taatacgactcactataggggagggagcatggaaggctcagaaccaccccaacagaggagaggggtgatgctgagccttaacctggcggcagcgcaaaagatg

SEQ ID NO: 232509 - DNA, 103 bp, Artificial Sequence
  Synthetic Polynucleotide
taatacgactcactataggggcaatgcgtggagggagcatggaaggctcaaacagaggagatgagccatgcatgctcccaacctggcggcagcgcaaaagatg

SEQ ID NO: 232510 - DNA, 103 bp, Artificial Sequence
  Synthetic Polynucleotide
taatacgactcactatagggtatgtggaaagtgttgatgatctgcgggtaaacagaggagatacccgatgatcatcaacaacctggcggcagcgcaaaagatg

SEQ ID NO: 232511 - DNA, 103 bp, Artificial Sequence
  Synthetic Polynucleotide
taatacgactcactatagggggcatctgaagcaatgcgtggagggagcataacagaggagaatgctcatgccacgcattaacctggcggcagcgcaaaagatg

SEQ ID NO: 232512 - DNA, 103 bp, Artificial Sequence
  Synthetic Polynucleotide
taatacgactcactatagggcgttccctctggcatctgaagcaatgcgtgaacagaggagacacgcaatgcttcagatgaacctggcggcagcgcaaaagatg

SEQ ID NO: 232513 - DNA, 103 bp, Artificial Sequence
  Synthetic Polynucleotide
taatacgactcactataggggccttggtggcgttccctctggcatctgaaaacagaggagattcagaatgcagagggaaaacctggcggcagcgcaaaagatg

SEQ ID NO: 232514 - DNA, 103 bp, Artificial Sequence
  Synthetic Polynucleotide
taatacgactcactatagggctccagcagggccttggtggcgttccctctaacagaggagaagagggatggccaccaagaacctggcggcagcgcaaaagatg

SEQ ID NO: 232515 - DNA, 103 bp, Artificial Sequence
  Synthetic Polynucleotide
taatacgactcactatagggagccaaagttctccagcagggccttggtggaacagaggagaccaccaatgccctgctggaacctggcggcagcgcaaaagatg

SEQ ID NO: 232516 - DNA, 103 bp, Artificial Sequence
  Synthetic Polynucleotide
taatacgactcactatagggaccaactcaaagccaaagttctccagcaggaacagaggagacctgctatggaactttggaacctggcggcagcgcaaaagatg

SEQ ID NO: 232517 - DNA, 103 bp, Artificial Sequence
  Synthetic Polynucleotide
taatacgactcactatagggatactggatgaccaactcaaagccaaagttaacagaggagaaactttatgtttgagttgaacctggcggcagcgcaaaagatg

SEQ ID NO: 232518 - DNA, 103 bp, Artificial Sequence
  Synthetic Polynucleotide
taatacgactcactatagggtgttctcattatactggatgaccaactcaaaacagaggagattgagtatgtcatccagtaacctggcggcagcgcaaaagatg

SEQ ID NO: 232519 - DNA, 103 bp, Artificial Sequence
  Synthetic Polynucleotide
taatacgactcactatagggaccttctgcttgttctcattatactggatgaacagaggagacatccaatgtaatgagaaaacctggcggcagcgcaaaagatg

SEQ ID NO: 232520 - DNA, 103 bp, Artificial Sequence
  Synthetic Polynucleotide
taatacgactcactatagggctttttctgcaccttctgcttgttctcattaacagaggagaaatgagatgaagcagaagaacctggcggcagcgcaaaagatg

SEQ ID NO: 232521 - DNA, 103 bp, Artificial Sequence
  Synthetic Polynucleotide
taatacgactcactatagggaggatgaggctatgtggaaagtgttgatgaaacagaggagatcatcaatgctttccacaaacctggcggcagcgcaaaagatg

SEQ ID NO: 232522 - DNA, 103 bp, Artificial Sequence
  Synthetic Polynucleotide
taatacgactcactatagggtcttcccattctttttctgcaccttctgctaacagaggagaagcagaatgtgcagaaaaaacctggcggcagcgcaaaagatg

SEQ ID NO: 232523 - DNA, 103 bp, Artificial Sequence
  Synthetic Polynucleotide
taatacgactcactatagggccctggtcagtcttcccattctttttctgcaacagaggagagcagaaatggaatgggaaaacctggcggcagcgcaaaagatg

SEQ ID NO: 232524 - DNA, 103 bp, Artificial Sequence
  Synthetic Polynucleotide
taatacgactcactatagggcaggttctctccctggtcagtcttcccattaacagaggagaaatgggatgactgaccagaacctggcggcagcgcaaaagatg

SEQ ID NO: 232525 - DNA, 103 bp, Artificial Sequence
  Synthetic Polynucleotide
taatacgactcactatagggcgagcttttccaggttctctccctggtcagaacagaggagactgaccatggagagaaccaacctggcggcagcgcaaaagatg

SEQ ID NO: 232526 - DNA, 103 bp, Artificial Sequence
  Synthetic Polynucleotide
taatacgactcactataggggagtcacactcgagcttttccaggttctctaacagaggagaagagaaatgggaaaagctaacctggcggcagcgcaaaagatg

SEQ ID NO: 232527 - DNA, 103 bp, Artificial Sequence
  Synthetic Polynucleotide
taatacgactcactatagggcttgccgcaggagtcacactcgagcttttcaacagaggagagaaaagatggagtgtgacaacctggcggcagcgcaaaagatg

SEQ ID NO: 232528 - DNA, 103 bp, Artificial Sequence
  Synthetic Polynucleotide
taatacgactcactatagggtggaaaacaacttgccgcaggagtcacactaacagaggagaagtgtgatgcctgcggcaaacctggcggcagcgcaaaagatg

SEQ ID NO: 232529 - DNA, 103 bp, Artificial Sequence
  Synthetic Polynucleotide
taatacgactcactatagggatcaagatgttggaaaacaacttgccgcagaacagaggagactgcggatggttgttttcaacctggcggcagcgcaaaagatg

SEQ ID NO: 232530 - DNA, 103 bp, Artificial Sequence
  Synthetic Polynucleotide
taatacgactcactatagggactctttaaaatcaagatgttggaaaacaaaacagaggagattgtttatgaacatcttgaacctggcggcagcgcaaaagatg

SEQ ID NO: 232531 - DNA, 103 bp, Artificial Sequence
  Synthetic Polynucleotide
taatacgactcactataggggctcttgatgactctttaaaatcaagatgtaacagaggagaacatctatgttttaaagaaacctggcggcagcgcaaaagatg

SEQ ID NO: 232532 - DNA, 103 bp, Artificial Sequence
  Synthetic Polynucleotide
taatacgactcactatagggagttcagtccattgctggtgctgagggataaacagaggagatatcccatggcaccagcaaacctggcggcagcgcaaaagatg

SEQ ID NO: 232533 - DNA, 103 bp, Artificial Sequence
  Synthetic Polynucleotide
taatacgactcactatagggcatttcccgaaggatgaggctatgtggaaaaacagaggagatttccaatgagcctcatcaacctggcggcagcgcaaaagatg

SEQ ID NO: 232534 - DNA, 103 bp, Artificial Sequence
  Synthetic Polynucleotide
taatacgactcactatagggtgatgaacgtgctcttgatgactctttaaaaacagaggagatttaaaatgtcatcaagaaacctggcggcagcgcaaaagatg

SEQ ID NO: 232535 - DNA, 103 bp, Artificial Sequence
  Synthetic Polynucleotide
taatacgactcactatagggaaagtaattctgatgaacgtgctcttgatgaacagaggagacatcaaatgcacgttcataacctggcggcagcgcaaaagatg

SEQ ID NO: 232536 - DNA, 103 bp, Artificial Sequence
  Synthetic Polynucleotide
taatacgactcactataggggtttgaaaggaaagtaattctgatgaacgtaacagaggagaacgttcatgagaattactaacctggcggcagcgcaaaagatg

SEQ ID NO: 232537 - DNA, 103 bp, Artificial Sequence
  Synthetic Polynucleotide
taatacgactcactatagggctctcgagctgtttgaaaggaaagtaattcaacagaggagagaattaatgtcctttcaaaacctggcggcagcgcaaaagatg

SEQ ID NO: 232538 - DNA, 103 bp, Artificial Sequence
  Synthetic Polynucleotide
taatacgactcactatagggtttggcaaacctctcgagctgtttgaaaggaacagaggagacctttcatgcagctcgagaacctggcggcagcgcaaaagatg

SEQ ID NO: 232539 - DNA, 103 bp, Artificial Sequence
  Synthetic Polynucleotide
taatacgactcactatagggctctgtactgtttggcaaacctctcgagctaacagaggagaagctcgatgggtttgccaaacctggcggcagcgcaaaagatg

SEQ ID NO: 232540 - DNA, 103 bp, Artificial Sequence
  Synthetic Polynucleotide
taatacgactcactatagggtcgtagtggtctctgtactgtttggcaaacaacagaggagagtttgcatgacagtacagaacctggcggcagcgcaaaagatg

SEQ ID NO: 232541 - DNA, 103 bp, Artificial Sequence
  Synthetic Polynucleotide
taatacgactcactataggggtacagtttatcgtagtggtctctgtactgaacagaggagacagtacatggaccactacaacctggcggcagcgcaaaagatg

SEQ ID NO: 232542 - DNA, 103 bp, Artificial Sequence
  Synthetic Polynucleotide
taatacgactcactataggggcctcagtgggtacagtttatcgtagtggtaacagaggagaaccactatgataaactgtaacctggcggcagcgcaaaagatg

SEQ ID NO: 232543 - DNA, 103 bp, Artificial Sequence
  Synthetic Polynucleotide
taatacgactcactatagggggggtctggggcctcagtgggtacagtttaaacagaggagataaactatgcccactgagaacctggcggcagcgcaaaagatg

SEQ ID NO: 232544 - DNA, 103 bp, Artificial Sequence
  Synthetic Polynucleotide
taatacgactcactataggggccctcaaaccatttcccgaaggatgaggcaacagaggagagcctcaatgttcgggaaaaacctggcggcagcgcaaaagatg

SEQ ID NO: 232545 - DNA, 103 bp, Artificial Sequence
  Synthetic Polynucleotide
taatacgactcactatagggtggtggctctggggtctggggcctcagtggaacagaggagaccactgatgccccagaccaacctggcggcagcgcaaaagatg

SEQ ID NO: 232546 - DNA, 103 bp, Artificial Sequence
  Synthetic Polynucleotide
taatacgactcactatagggggggaggtggtggtggctctggggtctgggaacagaggagacccagaatgcagagccacaacctggcggcagcgcaaaagatg

SEQ ID NO: 232547 - DNA, 103 bp, Artificial Sequence
  Synthetic Polynucleotide
taatacgactcactataggggggggtggagggggaggtggtggtggctctaacagaggagaagagccatgaccacctccaacctggcggcagcgcaaaagatg

SEQ ID NO: 232548 - DNA, 103 bp, Artificial Sequence
  Synthetic Polynucleotide
taatacgactcactatagggtgggggtggagggggtggagggggaggtggaacagaggagaccacctatgcctccacccaacctggcggcagcgcaaaagatg

SEQ ID NO: 232549 - DNA, 103 bp, Artificial Sequence
  Synthetic Polynucleotide
taatacgactcactatagggctgccggaagtgggggtggagggggtggagaacagaggagactccacatgctccaccccaacctggcggcagcgcaaaagatg

SEQ ID NO: 232550 - DNA, 103 bp, Artificial Sequence
  Synthetic Polynucleotide
taatacgactcactatagggtgaggcggcgctgccggaagtgggggtggaaacagaggagatccaccatgacttccggcaacctggcggcagcgcaaaagatg

SEQ ID NO: 232551 - DNA, 103 bp, Artificial Sequence
  Synthetic Polynucleotide
taatacgactcactatagggggacgccggctgaggcggcgctgccggaagaacagaggagacttccgatggcgccgcctaacctggcggcagcgcaaaagatg

SEQ ID NO: 232552 - DNA, 103 bp, Artificial Sequence
  Synthetic Polynucleotide
taatacgactcactatagggtggctggtgtggacgccggctgaggcggcgaacagaggagacgccgcatgagccggcgtaacctggcggcagcgcaaaagatg

SEQ ID NO: 232553 - DNA, 103 bp, Artificial Sequence
  Synthetic Polynucleotide
taatacgactcactataggggatgcggggatggctggtgtggacgccggcaacagaggagagccggcatgcacaccagcaacctggcggcagcgcaaaagatg

SEQ ID NO: 232554 - DNA, 103 bp, Artificial Sequence
  Synthetic Polynucleotide
taatacgactcactataggggggtggggctgatgcggggatggctggtgtaacagaggagaacaccaatgatccccgcaaacctggcggcagcgcaaaagatg

SEQ ID NO: 232555 - DNA, 103 bp, Artificial Sequence
  Synthetic Polynucleotide
taatacgactcactatagggcctggtctgggccctcaaaccatttcccgaaacagaggagatcgggaatgggtttgaggaacctggcggcagcgcaaaagatg

SEQ ID NO: 232556 - DNA, 103 bp, Artificial Sequence
  Synthetic Polynucleotide
taatacgactcactataggggtgaggtgatgggtggggctgatgcggggaaacagaggagatccccgatgcagccccacaacctggcggcagcgcaaaagatg

SEQ ID NO: 232557 - DNA, 103 bp, Artificial Sequence
  Synthetic Polynucleotide
taatacgactcactataggggcaattgtaggtgaggtgatgggtggggctaacagaggagaagccccatgcatcacctcaacctggcggcagcgcaaaagatg

SEQ ID NO: 232558 - DNA, 103 bp, Artificial Sequence
  Synthetic Polynucleotide
taatacgactcactatagggctgggccggtgcaattgtaggtgaggtgataacagaggagaatcaccatgcctacaattaacctggcggcagcgcaaaagatg

SEQ ID NO: 232559 - DNA, 103 bp, Artificial Sequence
  Synthetic Polynucleotide
taatacgactcactataggggcactgatggctgggccggtgcaattgtagaacagaggagactacaaatgcaccggcccaacctggcggcagcgcaaaagatg

SEQ ID NO: 232560 - DNA, 103 bp, Artificial Sequence
  Synthetic Polynucleotide
taatacgactcactatagggtgggtgagcggcactgatggctgggccggtaacagaggagaaccggcatggccatcagtaacctggcggcagcgcaaaagatg

SEQ ID NO: 232561 - DNA, 103 bp, Artificial Sequence
  Synthetic Polynucleotide
taatacgactcactatagggcatggagagctgggtgagcggcactgatggaacagaggagaccatcaatgccgctcaccaacctggcggcagcgcaaaagatg

SEQ ID NO: 232562 - DNA, 103 bp, Artificial Sequence
  Synthetic Polynucleotide
taatacgactcactataggggctccatcggcatggagagctgggtgagcgaacagaggagacgctcaatgagctctccaaacctggcggcagcgcaaaagatg

SEQ ID NO: 232563 - DNA, 103 bp, Artificial Sequence
  Synthetic Polynucleotide
taatacgactcactatagggaagatgggcagctccatcggcatggagagcaacagaggagagctctcatggccgatggaaacctggcggcagcgcaaaagatg

SEQ ID NO: 232564 - DNA, 103 bp, Artificial Sequence
  Synthetic Polynucleotide
taatacgactcactatagggcagcggcgagaagatgggcagctccatcggaacagaggagaccgatgatgctgcccatcaacctggcggcagcgcaaaagatg

SEQ ID NO: 232565 - DNA, 103 bp, Artificial Sequence
  Synthetic Polynucleotide
taatacgactcactatagggtctgcatcatcagcggcgagaagatgggcaaacagaggagatgcccaatgtctcgccgcaacctggcggcagcgcaaaagatg

SEQ ID NO: 232566 - DNA, 103 bp, Artificial Sequence
  Synthetic Polynucleotide
taatacgactcactatagggttcgggaaagcctggtctgggccctcaaacaacagaggagagtttgaatgcccagaccaaacctggcggcagcgcaaaagatg

SEQ ID NO: 232567 - DNA, 103 bp, Artificial Sequence
  Synthetic Polynucleotide
taatacgactcactatagggagcggcatcgtctgcatcatcagcggcgagaacagaggagactcgccatggatgatgcaaacctggcggcagcgcaaaagatg

SEQ ID NO: 232568 - DNA, 103 bp, Artificial Sequence
  Synthetic Polynucleotide
taatacgactcactatagggcaaggtctgcagcggcatcgtctgcatcataacagaggagaatgatgatgacgatgccgaacctggcggcagcgcaaaagatg

SEQ ID NO: 232569 - DNA, 103 bp, Artificial Sequence
  Synthetic Polynucleotide
taatacgactcactataggggctgagccggcaaggtctgcagcggcatcgaacagaggagacgatgcatgtgcagacctaacctggcggcagcgcaaaagatg

SEQ ID NO: 232570 - DNA, 103 bp, Artificial Sequence
  Synthetic Polynucleotide
taatacgactcactatagggtgcgggggtagctgagccggcaaggtctgcaacagaggagagcagacatggccggctcaaacctggcggcagcgcaaaagatg

SEQ ID NO: 232571 - DNA, 103 bp, Artificial Sequence
  Synthetic Polynucleotide
taatacgactcactatagggaggtcccagctgcgggggtagctgagccggaacagaggagaccggctatgctacccccgaacctggcggcagcgcaaaagatg

SEQ ID NO: 232572 - DNA, 103 bp, Artificial Sequence
  Synthetic Polynucleotide
taatacgactcactataggggaggctccacaggtcccagctgcgggggtaaacagaggagataccccatgagctgggacaacctggcggcagcgcaaaagatg

SEQ ID NO: 232573 - DNA, 103 bp, Artificial Sequence
  Synthetic Polynucleotide
taatacgactcactatagggtccgcaggcagaggctccacaggtcccagcaacagaggagagctgggatgtgtggagccaacctggcggcagcgcaaaagatg

SEQ ID NO: 232574 - DNA, 103 bp, Artificial Sequence
  Synthetic Polynucleotide
taatacgactcactatagggttgggccaggtccgcaggcagaggctccacaacagaggagagtggagatgctgcctgcgaacctggcggcagcgcaaaagatg

SEQ ID NO: 232575 - DNA, 103 bp, Artificial Sequence
  Synthetic Polynucleotide
taatacgactcactataggggctggtagagttgggccaggtccgcaggcaaacagaggagatgcctgatgacctggcccaacctggcggcagcgcaaaagatg

SEQ ID NO: 232576 - DNA, 103 bp, Artificial Sequence
  Synthetic Polynucleotide
taatacgactcactatagggttgagctgatgctggtagagttgggccaggaacagaggagacctggcatgactctaccaaacctggcggcagcgcaaaagatg

SEQ ID NO: 232577 - DNA, 103 bp, Artificial Sequence
  Synthetic Polynucleotide
taatacgactcactatagggggctgaggtattcgggaaagcctggtctggaacagaggagaccagacatggctttcccgaacctggcggcagcgcaaaagatg

SEQ ID NO: 232578 - DNA, 103 bp, Artificial Sequence
  Synthetic Polynucleotide
taatacgactcactatagggcagggttggattgagctgatgctggtagagaacagaggagactctacatgcatcagctcaacctggcggcagcgcaaaagatg

SEQ ID NO: 232579 - DNA, 103 bp, Artificial Sequence
  Synthetic Polynucleotide
taatacgactcactataggggctgctggagcagggttggattgagctgataacagaggagaatcagcatgatccaacccaacctggcggcagcgcaaaagatg

SEQ ID NO: 232580 - DNA, 103 bp, Artificial Sequence
  Synthetic Polynucleotide
taatacgactcactatagggctcttgttctgctgctggagcagggttggaaacagaggagatccaacatggctccagcaaacctggcggcagcgcaaaagatg

SEQ ID NO: 232581 - DNA, 103 bp, Artificial Sequence
  Synthetic Polynucleotide
taatacgactcactatagggggtgcgaggcctcttgttctgctgctggagaacagaggagactccagatgcagaacaagaacctggcggcagcgcaaaagatg

SEQ ID NO: 232582 - DNA, 103 bp, Artificial Sequence
  Synthetic Polynucleotide
taatacgactcactatagggctgtgatcctggtgcgaggcctcttgttctaacagaggagaagaacaatgggcctcgcaaacctggcggcagcgcaaaagatg

SEQ ID NO: 232583 - DNA, 103 bp, Artificial Sequence
  Synthetic Polynucleotide
taatacgactcactatagggagctgatcatctgtgatcctggtgcgaggcaacagaggagagcctcgatgcaggatcacaacctggcggcagcgcaaaagatg

SEQ ID NO: 232584 - DNA, 103 bp, Artificial Sequence
  Synthetic Polynucleotide
taatacgactcactatagggcaagactcggagctgatcatctgtgatcctaacagaggagaaggatcatggatgatcagaacctggcggcagcgcaaaagatg

SEQ ID NO: 232585 - DNA, 103 bp, Artificial Sequence
  Synthetic Polynucleotide
taatacgactcactatagggaatattgccgcaagactcggagctgatcataacagaggagaatgatcatgtccgagtctaacctggcggcagcgcaaaagatg

SEQ ID NO: 232586 - DNA, 103 bp, Artificial Sequence
  Synthetic Polynucleotide
taatacgactcactatagggttaatgtcaaaatattgccgcaagactcggaacagaggagaccgagtatggcggcaataaacctggcggcagcgcaaaagatg

SEQ ID NO: 232587 - DNA, 103 bp, Artificial Sequence
  Synthetic Polynucleotide
taatacgactcactataggggggggagttgttaatgtcaaaatattgccgaacagaggagacggcaaatgtttgacattaacctggcggcagcgcaaaagatg

SEQ ID NO: 232588 - DNA, 103 bp, Artificial Sequence
  Synthetic Polynucleotide
taatacgactcactataggggccccgccagggctgaggtattcgggaaagaacagaggagactttccatgatacctcagaacctggcggcagcgcaaaagatg

SEQ ID NO: 232589 - DNA, 103 bp, Artificial Sequence
  Synthetic Polynucleotide
taatacgactcactataggggctcttcactgggggagttgttaatgtcaaaacagaggagattgacaatgacaactcccaacctggcggcagcgcaaaagatg

SEQ ID NO: 232590 - DNA, 103 bp, Artificial Sequence
  Synthetic Polynucleotide
taatacgactcactatagggtcttttatttgctcttcactgggggagttgaacagaggagacaactcatgcagtgaagaaacctggcggcagcgcaaaagatg

SEQ ID NO: 232591 - DNA, 103 bp, Artificial Sequence
  Synthetic Polynucleotide
taatacgactcactataggggtctgccatctcttttatttgctcttcactaacagaggagaagtgaaatgcaaataaaaaacctggcggcagcgcaaaagatg

SEQ ID NO: 232592 - DNA, 103 bp, Artificial Sequence
  Synthetic Polynucleotide
taatacgactcactatagggacccggacttgtctgccatctcttttatttaacagaggagaaaataaatgagatggcagaacctggcggcagcgcaaaagatg

SEQ ID NO: 232593 - DNA, 103 bp, Artificial Sequence
  Synthetic Polynucleotide
taatacgactcactatagggttctggggcaacccggacttgtctgccatcaacagaggagagatggcatgcaagtccggaacctggcggcagcgcaaaagatg

SEQ ID NO: 232594 - DNA, 103 bp, Artificial Sequence
  Synthetic Polynucleotide
taatacgactcactatagggcttgatcactttctggggcaacccggacttaacagaggagaaagtccatgttgccccagaacctggcggcagcgcaaaagatg

SEQ ID NO: 232595 - DNA, 103 bp, Artificial Sequence
  Synthetic Polynucleotide
taatacgactcactatagggtgaaccagtgcttgatcactttctggggcaaacagaggagatgccccatgaagtgatcaaacctggcggcagcgcaaaagatg

SEQ ID NO: 232596 - DNA, 103 bp, Artificial Sequence
  Synthetic Polynucleotide
taatacgactcactatagggagagtgttcctgaaccagtgcttgatcactaacagaggagaagtgatatggcactggttaacctggcggcagcgcaaaagatg

SEQ ID NO: 232597 - DNA, 103 bp, Artificial Sequence
  Synthetic Polynucleotide
taatacgactcactatagggctctttgaagagagtgttcctgaaccagtgaacagaggagacactggatgaggaacactaacctggcggcagcgcaaaagatg

SEQ ID NO: 232598 - DNA, 103 bp, Artificial Sequence
  Synthetic Polynucleotide
taatacgactcactatagggtacgctgcctctctttgaagagagtgttccaacagaggagaggaacaatgtcttcaaagaacctggcggcagcgcaaaagatg

SEQ ID NO: 232599 - DNA, 103 bp, Artificial Sequence
  Synthetic Polynucleotide
taatacgactcactatagggacggggctgagccccgccagggctgaggtaaacagaggagatacctcatgcctggcgggaacctggcggcagcgcaaaagatg

SEQ ID NO: 232600 - DNA, 103 bp, Artificial Sequence
  Synthetic Polynucleotide
taatacgactcactataggggagtccttgttacgctgcctctctttgaagaacagaggagacttcaaatggaggcagcgaacctggcggcagcgcaaaagatg

SEQ ID NO: 232601 - DNA, 103 bp, Artificial Sequence
  Synthetic Polynucleotide
taatacgactcactataggggttgtaaggggagtccttgttacgctgcctaacagaggagaaggcagatgaacaaggacaacctggcggcagcgcaaaagatg

SEQ ID NO: 232602 - DNA, 103 bp, Artificial Sequence
  Synthetic Polynucleotide
taatacgactcactataggggattactgaagttgtaaggggagtccttgtaacagaggagaacaaggatgccccttacaaacctggcggcagcgcaaaagatg

SEQ ID NO: 232603 - DNA, 103 bp, Artificial Sequence
  Synthetic Polynucleotide
taatacgactcactataggggtgataggaggattactgaagttgtaagggaacagaggagacccttaatgcttcagtaaaacctggcggcagcgcaaaagatg

SEQ ID NO: 232604 - DNA, 103 bp, Artificial Sequence
  Synthetic Polynucleotide
taatacgactcactatagggctccaggctggtgataggaggattactgaaaacagaggagattcagtatgcctcctatcaacctggcggcagcgcaaaagatg

SEQ ID NO: 232605 - DNA, 103 bp, Artificial Sequence
  Synthetic Polynucleotide
taatacgactcactatagggtcttgagctcctccaggctggtgataggagaacagaggagactcctaatgccagcctggaacctggcggcagcgcaaaagatg

SEQ ID NO: 232606 - DNA, 103 bp, Artificial Sequence
  Synthetic Polynucleotide
taatacgactcactatagggcgggagtcaatcttgagctcctccaggctgaacagaggagacagcctatgggagctcaaaacctggcggcagcgcaaaagatg

SEQ ID NO: 232607 - DNA, 103 bp, Artificial Sequence
  Synthetic Polynucleotide
taatacgactcactatagggcgaagggggccgggagtcaatcttgagctcaacagaggagagagctcatgattgactccaacctggcggcagcgcaaaagatg

SEQ ID NO: 232608 - DNA, 103 bp, Artificial Sequence
  Synthetic Polynucleotide
taatacgactcactataggggaggttccggcgaagggggccgggagtcaaaacagaggagattgactatgggcccccttaacctggcggcagcgcaaaagatg

SEQ ID NO: 232609 - DNA, 103 bp, Artificial Sequence
  Synthetic Polynucleotide
taatacgactcactatagggtcctgctttggaggttccggcgaagggggcaacagaggagagcccccatggccggaaccaacctggcggcagcgcaaaagatg

SEQ ID NO: 232610 - DNA, 103 bp, Artificial Sequence
  Synthetic Polynucleotide
taatacgactcactataggggctgtgcaggacggggctgagccccgccagaacagaggagactggcgatgctcagccccaacctggcggcagcgcaaaagatg

SEQ ID NO: 232611 - DNA, 103 bp, Artificial Sequence
  Synthetic Polynucleotide
taatacgactcactatagggtccccagtactcctgctttggaggttccggaacagaggagaccggaaatgccaaagcagaacctggcggcagcgcaaaagatg

SEQ ID NO: 232612 - DNA, 103 bp, Artificial Sequence
  Synthetic Polynucleotide
taatacgactcactatagggacctcttgcttccccagtactcctgctttgaacagaggagacaaagcatgagtactgggaacctggcggcagcgcaaaagatg

SEQ ID NO: 232613 - DNA, 103 bp, Artificial Sequence
  Synthetic Polynucleotide
taatacgactcactataggggttcttgaagacctcttgcttccccagtacaacagaggagagtactgatgaagcaagagaacctggcggcagcgcaaaagatg

SEQ ID NO: 232614 - DNA, 103 bp, Artificial Sequence
  Synthetic Polynucleotide
taatacgactcactatagggcgtaaaccttgttcttgaagacctcttgctaacagaggagaagcaagatgtcttcaagaaacctggcggcagcgcaaaagatg

SEQ ID NO: 232615 - DNA, 103 bp, Artificial Sequence
  Synthetic Polynucleotide
taatacgactcactataggggctggtagtccgtaaaccttgttcttgaagaacagaggagacttcaaatgcaaggtttaaacctggcggcagcgcaaaagatg

SEQ ID NO: 232616 - DNA, 103 bp, Artificial Sequence
  Synthetic Polynucleotide
taatacgactcactatagggaagaccctcagctggtagtccgtaaaccttaacagaggagaaaggttatgggactaccaaacctggcggcagcgcaaaagatg

SEQ ID NO: 232617 - DNA, 103 bp, Artificial Sequence
  Synthetic Polynucleotide
taatacgactcactataggggaagtcctgtaagaccctcagctggtagtcaacagaggagagactacatgctgagggtcaacctggcggcagcgcaaaagatg

SEQ ID NO: 232618 - DNA, 103 bp, Artificial Sequence
  Synthetic Polynucleotide
taatacgactcactatagggtggcatcgaagaagtcctgtaagaccctcaaacagaggagatgagggatgtacaggactaacctggcggcagcgcaaaagatg

SEQ ID NO: 232619 - DNA, 103 bp, Artificial Sequence
  Synthetic Polynucleotide
taatacgactcactataggggggtaagcattggcatcgaagaagtcctgtaacagaggagaacaggaatgcttcgatgcaacctggcggcagcgcaaaagatg

SEQ ID NO: 232620 - DNA, 103 bp, Artificial Sequence
  Synthetic Polynucleotide
taatacgactcactatagggatcatcctttgggtaagcattggcatcgaaaacagaggagattcgatatgaatgcttacaacctggcggcagcgcaaaagatg

SEQ ID NO: 232621 - DNA, 103 bp, Artificial Sequence
  Synthetic Polynucleotide
taatacgactcactatagggacacgcggaagctgtgcaggacggggctgaaacagaggagatcagccatgtcctgcacaaacctggcggcagcgcaaaagatg

SEQ ID NO: 232622 - DNA, 103 bp, Artificial Sequence
  Synthetic Polynucleotide
taatacgactcactataggggctcaaattcatcatcctttgggtaagcataacagaggagaatgcttatgcaaaggatgaacctggcggcagcgcaaaagatg

SEQ ID NO: 232623 - DNA, 103 bp, Artificial Sequence
  Synthetic Polynucleotide
taatacgactcactatagggttagagagttgctcaaattcatcatcctttaacagaggagaaaaggaatgtgaatttgaaacctggcggcagcgcaaaagatg

SEQ ID NO: 232624 - DNA, 103 bp, Artificial Sequence
  Synthetic Polynucleotide
taatacgactcactataggggttcagtaaattagagagttgctcaaattcaacagaggagagaatttatgcaactctctaacctggcggcagcgcaaaagatg

SEQ ID NO: 232625 - DNA, 103 bp, Artificial Sequence
  Synthetic Polynucleotide
taatacgactcactataggggggttggaaggttcagtaaattagagagttaacagaggagaaactctatgatttactgaaacctggcggcagcgcaaaagatg

SEQ ID NO: 232626 - DNA, 103 bp, Artificial Sequence
  Synthetic Polynucleotide
taatacgactcactatagggactatcactcgggttggaaggttcagtaaaaacagaggagatttactatgccttccaacaacctggcggcagcgcaaaagatg

SEQ ID NO: 232627 - DNA, 103 bp, Artificial Sequence
  Synthetic Polynucleotide
taatacgactcactatagggaaaccacaccactatcactcgggttggaagaacagaggagacttccaatgcgagtgataaacctggcggcagcgcaaaagatg

SEQ ID NO: 232628 - DNA, 103 bp, Artificial Sequence
  Synthetic Polynucleotide
taatacgactcactataggggggcattctgaaaccacaccactatcactcaacagaggagagagtgaatgtggtgtggtaacctggcggcagcgcaaaagatg

SEQ ID NO: 232629 - DNA, 103 bp, Artificial Sequence
  Synthetic Polynucleotide
taatacgactcactataggggccttctgtcgggcattctgaaaccacaccaacagaggagaggtgtgatgtcagaatgcaacctggcggcagcgcaaaagatg

SEQ ID NO: 232630 - DNA, 103 bp, Artificial Sequence
  Synthetic Polynucleotide
taatacgactcactatagggattcttcctggccttctgtcgggcattctgaacagaggagacagaatatgcgacagaagaacctggcggcagcgcaaaagatg

SEQ ID NO: 232631 - DNA, 103 bp, Artificial Sequence
  Synthetic Polynucleotide
taatacgactcactataggggattctcataattcttcctggccttctgtcaacagaggagagacagaatgccaggaagaaacctggcggcagcgcaaaagatg

SEQ ID NO: 232632 - DNA, 103 bp, Artificial Sequence
  Synthetic Polynucleotide
taatacgactcactatagggcgcacgtcaaacacgcggaagctgtgcaggaacagaggagacctgcaatgcttccgcgtaacctggcggcagcgcaaaagatg

SEQ ID NO: 232633 - DNA, 103 bp, Artificial Sequence
  Synthetic Polynucleotide
taatacgactcactatagggccctctccctgattctcataattcttcctgaacagaggagacaggaaatgttatgagaaaacctggcggcagcgcaaaagatg

SEQ ID NO: 232634 - DNA, 103 bp, Artificial Sequence
  Synthetic Polynucleotide
taatacgactcactatagggtccatctttgccctctccctgattctcataaacagaggagatatgagatgcagggagagaacctggcggcagcgcaaaagatg

SEQ ID NO: 232635 - DNA, 103 bp, Artificial Sequence
  Synthetic Polynucleotide
taatacgactcactatagggcacgccgctctccatctttgccctctccctaacagaggagaagggagatggcaaagatgaacctggcggcagcgcaaaagatg

SEQ ID NO: 232636 - DNA, 103 bp, Artificial Sequence
  Synthetic Polynucleotide
taatacgactcactatagggtttgtaagctcacgccgctctccatctttgaacagaggagacaaagaatgagagcggcgaacctggcggcagcgcaaaagatg

SEQ ID NO: 232637 - DNA, 103 bp, Artificial Sequence
  Synthetic Polynucleotide
taatacgactcactataggggtatctatcatttgtaagctcacgccgctcaacagaggagagagcggatggagcttacaaacctggcggcagcgcaaaagatg

SEQ ID NO: 232638 - DNA, 103 bp, Artificial Sequence
  Synthetic Polynucleotide
taatacgactcactatagggttgttcgaatgtatctatcatttgtaagctaacagaggagaagcttaatgatgatagataacctggcggcagcgcaaaagatg

SEQ ID NO: 232639 - DNA, 103 bp, Artificial Sequence
  Synthetic Polynucleotide
taatacgactcactatagggttcaagttgcttgttcgaatgtatctatcaaacagaggagatgatagatgcattcgaacaacctggcggcagcgcaaaagatg

SEQ ID NO: 232640 - DNA, 103 bp, Artificial Sequence
  Synthetic Polynucleotide
taatacgactcactataggggcactggtagttcaagttgcttgttcgaataacagaggagaattcgaatgagcaacttgaacctggcggcagcgcaaaagatg

SEQ ID NO: 232641 - DNA, 103 bp, Artificial Sequence
  Synthetic Polynucleotide
taatacgactcactatagggtacattttttgcactggtagttcaagttgcaacagaggagagcaactatgactaccagtaacctggcggcagcgcaaaagatg

SEQ ID NO: 232642 - DNA, 103 bp, Artificial Sequence
  Synthetic Polynucleotide
taatacgactcactatagggaacaccaggctacattttttgcactggtagaacagaggagactaccaatgcaaaaaatgaacctggcggcagcgcaaaagatg

SEQ ID NO: 232643 - DNA, 103 bp, Artificial Sequence
  Synthetic Polynucleotide
taatacgactcactatagggggtgctgttgagttcagtccattgctggtgaacagaggagacaccagatgtggactgaaaacctggcggcagcgcaaaagatg

SEQ ID NO: 232644 - DNA, 103 bp, Artificial Sequence
  Synthetic Polynucleotide
taatacgactcactataggggcttttgtgtcgcacgtcaaacacgcggaaaacagaggagattccgcatgtttgacgtgaacctggcggcagcgcaaaagatg

SEQ ID NO: 232645 - DNA, 103 bp, Artificial Sequence
  Synthetic Polynucleotide
taatacgactcactataggggatgcgctgaaacaccaggctacattttttaacagaggagaaaaaaaatgagcctggtgaacctggcggcagcgcaaaagatg

SEQ ID NO: 232646 - DNA, 103 bp, Artificial Sequence
  Synthetic Polynucleotide
taatacgactcactatagggtgagatcaaagatgcgctgaaacaccaggcaacagaggagagcctggatgttcagcgcaaacctggcggcagcgcaaaagatg

SEQ ID NO: 232647 - DNA, 103 bp, Artificial Sequence
  Synthetic Polynucleotide
taatacgactcactatagggtggtgcttgatgagatcaaagatgcgctgaaacagaggagatcagcgatgctttgatctaacctggcggcagcgcaaaagatg

SEQ ID NO: 232648 - DNA, 103 bp, Artificial Sequence
  Synthetic Polynucleotide
taatacgactcactatagggcagcttcttctggtgcttgatgagatcaaaaacagaggagatttgatatgatcaagcacaacctggcggcagcgcaaaagatg

SEQ ID NO: 232649 - DNA, 103 bp, Artificial Sequence
  Synthetic Polynucleotide
taatacgactcactatagggccttgtaacacagcttcttctggtgcttgaaacagaggagatcaagcatgagaagaagcaacctggcggcagcgcaaaagatg

SEQ ID NO: 232650 - DNA, 103 bp, Artificial Sequence
  Synthetic Polynucleotide
taatacgactcactatagggtcatcctcatccttgtaacacagcttcttcaacagaggagagaagaaatggtgttacaaaacctggcggcagcgcaaaagatg

SEQ ID NO: 232651 - DNA, 103 bp, Artificial Sequence
  Synthetic Polynucleotide
taatacgactcactatagggctgcccctcctcatcctcatccttgtaacaaacagaggagatgttacatggatgaggataacctggcggcagcgcaaaagatg

SEQ ID NO: 232652 - DNA, 103 bp, Artificial Sequence
  Synthetic Polynucleotide
taatacgactcactatagggggctgtcgtcctgcccctcctcatcctcataacagaggagaatgaggatgaggaggggcaacctggcggcagcgcaaaagatg

SEQ ID NO: 232653 - DNA, 103 bp, Artificial Sequence
  Synthetic Polynucleotide
taatacgactcactatagggtcctcattttggctgtcgtcctgcccctccaacagaggagaggagggatgggacgacagaacctggcggcagcgcaaaagatg

SEQ ID NO: 232654 - DNA, 103 bp, Artificial Sequence
  Synthetic Polynucleotide
taatacgactcactatagggatccatggaatcctcattttggctgtcgtcaacagaggagagacgacatgcaaaatgagaacctggcggcagcgcaaaagatg

SEQ ID NO: 232655 - DNA, 103 bp, Artificial Sequence
  Synthetic Polynucleotide
taatacgactcactatagggaatccttgttgcttttgtgtcgcacgtcaaaacagaggagattgacgatggacacaaaaaacctggcggcagcgcaaaagatg

SEQ ID NO: 232656 - DNA, 103 bp, Artificial Sequence
  Synthetic Polynucleotide
taatacgactcactatagggtttccatggcatccatggaatcctcattttaacagaggagaaaaatgatgattccatggaacctggcggcagcgcaaaagatg

SEQ ID NO: 232657 - DNA, 103 bp, Artificial Sequence
  Synthetic Polynucleotide
taatacgactcactatagggggcgtcaggatttccatggcatccatggaaaacagaggagattccatatgtgccatggaaacctggcggcagcgcaaaagatg

SEQ ID NO: 232658 - DNA, 103 bp, Artificial Sequence
  Synthetic Polynucleotide
taatacgactcactatagggtgagctggtaggcgtcaggatttccatggcaacagaggagagccatgatgatcctgacgaacctggcggcagcgcaaaagatg

SEQ ID NO: 232659 - DNA, 103 bp, Artificial Sequence
  Synthetic Polynucleotide
taatacgactcactatagggtactgcaggatgagctggtaggcgtcaggaaacagaggagatcctgaatgctaccagctaacctggcggcagcgcaaaagatg

SEQ ID NO: 232660 - DNA, 103 bp, Artificial Sequence
  Synthetic Polynucleotide
taatacgactcactatagggggcatcggggtactgcaggatgagctggtaaacagaggagataccagatgatcctgcagaacctggcggcagcgcaaaagatg

SEQ ID NO: 232661 - DNA, 103 bp, Artificial Sequence
  Synthetic Polynucleotide
taatacgactcactatagggagcctgtgagggcatcggggtactgcaggaaacagaggagatcctgcatgaccccgatgaacctggcggcagcgcaaaagatg

SEQ ID NO: 232662 - DNA, 103 bp, Artificial Sequence
  Synthetic Polynucleotide
taatacgactcactataggggggcgctgtaagcctgtgagggcatcggggaacagaggagaccccgaatgcctcacaggaacctggcggcagcgcaaaagatg

SEQ ID NO: 232663 - DNA, 103 bp, Artificial Sequence
  Synthetic Polynucleotide
taatacgactcactataggggatggtgctggggcgctgtaagcctgtgagaacagaggagactcacaatgttacagcgcaacctggcggcagcgcaaaagatg

SEQ ID NO: 232664 - DNA, 103 bp, Artificial Sequence
  Synthetic Polynucleotide
taatacgactcactatagggattattggctgatggtgctggggcgctgtaaacagaggagatacagcatgccagcaccaaacctggcggcagcgcaaaagatg

SEQ ID NO: 232665 - DNA, 103 bp, Artificial Sequence
  Synthetic Polynucleotide
taatacgactcactatagggaggaagctgtattattggctgatggtgctgaacagaggagacagcacatgcagccaataaacctggcggcagcgcaaaagatg

SEQ ID NO: 232666 - DNA, 103 bp, Artificial Sequence
  Synthetic Polynucleotide
taatacgactcactatagggctgttcaggtaatccttgttgcttttgtgtaacagaggagaacacaaatgcaacaaggaaacctggcggcagcgcaaaagatg

SEQ ID NO: 232667 - DNA, 103 bp, Artificial Sequence
  Synthetic Polynucleotide
taatacgactcactatagggaagaaagcggaggaagctgtattattggctaacagaggagaagccaaatgtacagcttcaacctggcggcagcgcaaaagatg

SEQ ID NO: 232668 - DNA, 103 bp, Artificial Sequence
  Synthetic Polynucleotide
taatacgactcactatagggtgtaagctgcaagaaagcggaggaagctgtaacagaggagaacagctatgtccgctttcaacctggcggcagcgcaaaagatg

SEQ ID NO: 232669 - DNA, 103 bp, Artificial Sequence
  Synthetic Polynucleotide
taatacgactcactatagggcagcctccgctgtaagctgcaagaaagcggaacagaggagaccgcttatgtgcagcttaaacctggcggcagcgcaaaagatg

SEQ ID NO: 232670 - DNA, 103 bp, Artificial Sequence
  Synthetic Polynucleotide
taatacgactcactataggggccagttcctcagcctccgctgtaagctgcaacagaggagagcagctatgagcggaggcaacctggcggcagcgcaaaagatg

SEQ ID NO: 232671 - DNA, 103 bp, Artificial Sequence
  Synthetic Polynucleotide
taatacgactcactatagggattgaaggtggccagttcctcagcctccgcaacagaggagagcggagatggaggaactgaacctggcggcagcgcaaaagatg

SEQ ID NO: 232672 - DNA, 103 bp, Artificial Sequence
  Synthetic Polynucleotide
taatacgactcactatagggctgtttttgaattgaaggtggccagttcctaacagaggagaaggaacatgccaccttcaaacctggcggcagcgcaaaagatg

SEQ ID NO: 232673 - DNA, 103 bp, Artificial Sequence
  Synthetic Polynucleotide
taatacgactcactatagggtcgcctgcctctgtttttgaattgaaggtgaacagaggagacaccttatgttcaaaaacaacctggcggcagcgcaaaagatg

SEQ ID NO: 232674 - DNA, 103 bp, Artificial Sequence
  Synthetic Polynucleotide
taatacgactcactatagggtggtttctcatcgcctgcctctgtttttgaaacagaggagatcaaaaatggaggcaggcaacctggcggcagcgcaaaagatg

SEQ ID NO: 232675 - DNA, 103 bp, Artificial Sequence
  Synthetic Polynucleotide
taatacgactcactatagggccgccagctttggtttctcatcgcctgcctaacagaggagaaggcagatgatgagaaacaacctggcggcagcgcaaaagatg

SEQ ID NO: 232676 - DNA, 103 bp, Artificial Sequence
  Synthetic Polynucleotide
taatacgactcactatagggctgggagcttccgccagctttggtttctcaaacagaggagatgagaaatgaaagctggcaacctggcggcagcgcaaaagatg

SEQ ID NO: 232677 - DNA, 103 bp, Artificial Sequence
  Synthetic Polynucleotide
taatacgactcactatagggagaaccgtcgctgttcaggtaatccttgttaacagaggagaaacaagatgtacctgaacaacctggcggcagcgcaaaagatg

SEQ ID NO: 232678 - DNA, 103 bp, Artificial Sequence
  Synthetic Polynucleotide
taatacgactcactatagggtggctgtgcactgggagcttccgccagcttaacagaggagaaagctgatggaagctcccaacctggcggcagcgcaaaagatg

SEQ ID NO: 232679 - DNA, 103 bp, Artificial Sequence
  Synthetic Polynucleotide
taatacgactcactataggggggtttggtttggctgtgcactgggagcttaacagaggagaaagctcatggtgcacagcaacctggcggcagcgcaaaagatg

SEQ ID NO: 232680 - DNA, 103 bp, Artificial Sequence
  Synthetic Polynucleotide
taatacgactcactatagggtgcttttcttgggtttggtttggctgtgcaaacagaggagatgcacaatgaaaccaaacaacctggcggcagcgcaaaagatg

SEQ ID NO: 232681 - DNA, 103 bp, Artificial Sequence
  Synthetic Polynucleotide
taatacgactcactatagggtggttgtccttgcttttcttgggtttggttaacagaggagaaaccaaatgcaagaaaagaacctggcggcagcgcaaaagatg

SEQ ID NO: 232682 - DNA, 103 bp, Artificial Sequence
  Synthetic Polynucleotide
taatacgactcactataggggctctggctttggttgtccttgcttttcttaacagaggagaaagaaaatgaaggacaacaacctggcggcagcgcaaaagatg

SEQ ID NO: 232683 - DNA, 103 bp, Artificial Sequence
  Synthetic Polynucleotide
taatacgactcactatagggtgctgctgcagctctggctttggttgtcctaacagaggagaaggacaatgaaagccagaaacctggcggcagcgcaaaagatg

SEQ ID NO: 232684 - DNA, 103 bp, Artificial Sequence
  Synthetic Polynucleotide
taatacgactcactataggggggctgctcttgctgctgcagctctggcttaacagaggagaaagccaatgctgcagcagaacctggcggcagcgcaaaagatg

SEQ ID NO: 232685 - DNA, 103 bp, Artificial Sequence
  Synthetic Polynucleotide
taatacgactcactatagggtcttctgctcgggctgctcttgctgctgcaaacagaggagatgcagcatgaagagcagcaacctggcggcagcgcaaaagatg

SEQ ID NO: 232686 - DNA, 103 bp, Artificial Sequence
  Synthetic Polynucleotide
taatacgactcactatagggggagtgttggtcttctgctcgggctgctctaacagaggagaagagcaatgcgagcagaaaacctggcggcagcgcaaaagatg

SEQ ID NO: 232687 - DNA, 103 bp, Artificial Sequence
  Synthetic Polynucleotide
taatacgactcactatagggcttctgctggggagtgttggtcttctgctcaacagaggagagagcagatgaccaacactaacctggcggcagcgcaaaagatg

SEQ ID NO: 232688 - DNA, 103 bp, Artificial Sequence
  Synthetic Polynucleotide
taatacgactcactatagggagcttttggcagaaccgtcgctgttcaggtaacagaggagaacctgaatggcgacggttaacctggcggcagcgcaaaagatg

SEQ ID NO: 232689 - DNA, 103 bp, Artificial Sequence
  Synthetic Polynucleotide
taatacgactcactataggggctgggggagcttctgctggggagtgttggaacagaggagaccaacaatgcccagcagaaacctggcggcagcgcaaaagatg

SEQ ID NO: 232690 - DNA, 103 bp, Artificial Sequence
  Synthetic Polynucleotide
taatacgactcactatagggagggacaccagctgggggagcttctgctggaacagaggagaccagcaatggctcccccaaacctggcggcagcgcaaaagatg

SEQ ID NO: 232691 - DNA, 103 bp, Artificial Sequence
  Synthetic Polynucleotide
taatacgactcactatagggcaacgaaggcagggacaccagctgggggagaacagaggagactccccatgctggtgtccaacctggcggcagcgcaaaagatg

SEQ ID NO: 232692 - DNA, 103 bp, Artificial Sequence
  Synthetic Polynucleotide
taatacgactcactataggggaggctgtggcaacgaaggcagggacaccaaacagaggagatggtgtatgtgccttcgtaacctggcggcagcgcaaaagatg

SEQ ID NO: 232693 - DNA, 103 bp, Artificial Sequence
  Synthetic Polynucleotide
taatacgactcactataggggcttgtggaggaggctgtggcaacgaaggcaacagaggagagccttcatggccacagccaacctggcggcagcgcaaaagatg

SEQ ID NO: 232694 - DNA, 103 bp, Artificial Sequence
  Synthetic Polynucleotide
taatacgactcactatagggtggagggggcgcttgtggaggaggctgtggaacagaggagaccacagatgcctccacaaaacctggcggcagcgcaaaagatg

SEQ ID NO: 232695 - DNA, 103 bp, Artificial Sequence
  Synthetic Polynucleotide
taatacgactcactatagggaggggcactgtggagggggcgcttgtggagaacagaggagactccacatgcgccccctcaacctggcggcagcgcaaaagatg

SEQ ID NO: 232696 - DNA, 103 bp, Artificial Sequence
  Synthetic Polynucleotide
taatacgactcactataggggactggggtaaggggcactgtggagggggcaacagaggagagcccccatgacagtgcccaacctggcggcagcgcaaaagatg

SEQ ID NO: 232697 - DNA, 103 bp, Artificial Sequence
  Synthetic Polynucleotide
taatacgactcactatagggactggggctcgactggggtaaggggcactgaacagaggagacagtgcatgttaccccagaacctggcggcagcgcaaaagatg

SEQ ID NO: 232698 - DNA, 103 bp, Artificial Sequence
  Synthetic Polynucleotide
taatacgactcactataggggctgggaaggactggggctcgactggggtaaacagaggagataccccatgcgagccccaaacctggcggcagcgcaaaagatg

SEQ ID NO: 232699 - DNA, 103 bp, Artificial Sequence
  Synthetic Polynucleotide
taatacgactcactataggggatacgcaggagcttttggcagaaccgtcgaacagaggagacgacggatgtgccaaaagaacctggcggcagcgcaaaagatg

SEQ ID NO: 232700 - DNA, 103 bp, Artificial Sequence
  Synthetic Polynucleotide
taatacgactcactatagggaggtgggagagctgggaaggactggggctcaacagaggagagagcccatgtccttcccaaacctggcggcagcgcaaaagatg

SEQ ID NO: 232701 - DNA, 103 bp, Artificial Sequence
  Synthetic Polynucleotide
taatacgactcactatagggcttgaggggcaggtgggagagctgggaaggaacagaggagaccttccatgctctcccacaacctggcggcagcgcaaaagatg

SEQ ID NO: 232702 - DNA, 103 bp, Artificial Sequence
  Synthetic Polynucleotide
taatacgactcactatagggtgtggaggggcttgaggggcaggtgggagaaacagaggagatctcccatgtgcccctcaaacctggcggcagcgcaaaagatg

SEQ ID NO: 232703 - DNA, 103 bp, Artificial Sequence
  Synthetic Polynucleotide
taatacgactcactatagggggagttgatgtgtggaggggcttgaggggcaacagaggagagcccctatggcccctccaaacctggcggcagcgcaaaagatg

SEQ ID NO: 232704 - DNA, 103 bp, Artificial Sequence
  Synthetic Polynucleotide
taatacgactcactataggggagctgttgaggagttgatgtgtggaggggaacagaggagacccctcatgacatcaactaacctggcggcagcgcaaaagatg

SEQ ID NO: 232705 - DNA, 103 bp, Artificial Sequence
  Synthetic Polynucleotide
taatacgactcactataggggtaggtttgcgagctgttgaggagttgatgaacagaggagacatcaaatgctcaacagcaacctggcggcagcgcaaaagatg

SEQ ID NO: 232706 - DNA, 103 bp, Artificial Sequence
  Synthetic Polynucleotide
taatacgactcactatagggagctgaggaggtaggtttgcgagctgttgaaacagaggagatcaacaatgcgcaaacctaacctggcggcagcgcaaaagatg

SEQ ID NO: 232707 - DNA, 103 bp, Artificial Sequence
  Synthetic Polynucleotide
taatacgactcactataggggtaggggattagctgaggaggtaggtttgcaacagaggagagcaaacatgcctcctcagaacctggcggcagcgcaaaagatg

SEQ ID NO: 232708 - DNA, 103 bp, Artificial Sequence
  Synthetic Polynucleotide
taatacgactcactatagggggtcacactggtaggggattagctgaggagaacagaggagactcctcatgtaatcccctaacctggcggcagcgcaaaagatg

SEQ ID NO: 232709 - DNA, 103 bp, Artificial Sequence
  Synthetic Polynucleotide
taatacgactcactatagggaacttacactggtcacactggtaggggattaacagaggagaaatcccatgccagtgtgaaacctggcggcagcgcaaaagatg

SEQ ID NO: 232710 - DNA, 103 bp, Artificial Sequence
  Synthetic Polynucleotide
taatacgactcactatagggaacatctttggatacgcaggagcttttggcaacagaggagagccaaaatgtcctgcgtaaacctggcggcagcgcaaaagatg

SEQ ID NO: 232711 - DNA, 103 bp, Artificial Sequence
  Synthetic Polynucleotide
taatacgactcactatagggcggaaatgccaacttacactggtcacactgaacagaggagacagtgtatgcagtgtaagaacctggcggcagcgcaaaagatg

SEQ ID NO: 232712 - DNA, 103 bp, Artificial Sequence
  Synthetic Polynucleotide
taatacgactcactataggggctcaaatgacggaaatgccaacttacactaacagaggagaagtgtaatgtggcatttcaacctggcggcagcgcaaaagatg

SEQ ID NO: 232713 - DNA, 103 bp, Artificial Sequence
  Synthetic Polynucleotide
taatacgactcactatagggtcctgccagtgctcaaatgacggaaatgccaacagaggagaggcattatggtcatttgaaacctggcggcagcgcaaaagatg

SEQ ID NO: 232714 - DNA, 103 bp, Artificial Sequence
  Synthetic Polynucleotide
taatacgactcactatagggctgctgatgctcctgccagtgctcaaatgaaacagaggagatcatttatgcactggcagaacctggcggcagcgcaaaagatg

SEQ ID NO: 232715 - DNA, 103 bp, Artificial Sequence
  Synthetic Polynucleotide
taatacgactcactatagggggaagtggagctgctgatgctcctgccagtaacagaggagaactggcatgagcatcagcaacctggcggcagcgcaaaagatg

SEQ ID NO: 232716 - DNA, 103 bp, Artificial Sequence
  Synthetic Polynucleotide
taatacgactcactatagggtgcgcgctcaggaagtggagctgctgatgcaacagaggagagcatcaatggctccacttaacctggcggcagcgcaaaagatg

SEQ ID NO: 232717 - DNA, 103 bp, Artificial Sequence
  Synthetic Polynucleotide
taatacgactcactataggggaactggttctgcgcgctcaggaagtggagaacagaggagactccacatgctgagcgcgaacctggcggcagcgcaaaagatg

SEQ ID NO: 232718 - DNA, 103 bp, Artificial Sequence
  Synthetic Polynucleotide
taatacgactcactataggggggggtggatgaactggttctgcgcgctcaaacagaggagatgagcgatgagaaccagtaacctggcggcagcgcaaaagatg

SEQ ID NO: 232719 - DNA, 103 bp, Artificial Sequence
  Synthetic Polynucleotide
taatacgactcactatagggtccaaaaactgggggtggatgaactggttcaacagaggagagaaccaatgcatccacccaacctggcggcagcgcaaaagatg

SEQ ID NO: 232720 - DNA, 103 bp, Artificial Sequence
  Synthetic Polynucleotide
taatacgactcactatagggcagggacctgtccaaaaactgggggtggataacagaggagaatccacatgcagtttttgaacctggcggcagcgcaaaagatg

SEQ ID NO: 232721 - DNA, 103 bp, Artificial Sequence
  Synthetic Polynucleotide
taatacgactcactatagggcattgttgggaacatctttggatacgcaggaacagaggagacctgcgatgccaaagatgaacctggcggcagcgcaaaagatg

SEQ ID NO: 232722 - DNA, 103 bp, Artificial Sequence
  Synthetic Polynucleotide
taatacgactcactatagggaaggcatatccagggacctgtccaaaaactaacagaggagaagttttatgacaggtcccaacctggcggcagcgcaaaagatg

SEQ ID NO: 232723 - DNA, 103 bp, Artificial Sequence
  Synthetic Polynucleotide
taatacgactcactatagggaagagcatgaaaggcatatccagggacctgaacagaggagacaggtcatgggatatgccaacctggcggcagcgcaaaagatg

SEQ ID NO: 232724 - DNA, 103 bp, Artificial Sequence
  Synthetic Polynucleotide
taatacgactcactatagggactgggatcaaagagcatgaaaggcatatcaacagaggagagatatgatgttcatgctcaacctggcggcagcgcaaaagatg

SEQ ID NO: 232725 - DNA, 103 bp, Artificial Sequence
  Synthetic Polynucleotide
taatacgactcactatagggggagtgggttactgggatcaaagagcatgaaacagaggagatcatgcatgttgatcccaaacctggcggcagcgcaaaagatg

SEQ ID NO: 232726 - DNA, 103 bp, Artificial Sequence
  Synthetic Polynucleotide
taatacgactcactatagggtggctggccaggagtgggttactgggatcaaacagaggagatgatccatgtaacccactaacctggcggcagcgcaaaagatg

SEQ ID NO: 232727 - DNA, 103 bp, Artificial Sequence
  Synthetic Polynucleotide
taatacgactcactatagggagagagcagctggctggccaggagtgggttaacagaggagaaacccaatgctggccagcaacctggcggcagcgcaaaagatg

SEQ ID NO: 232728 - DNA, 103 bp, Artificial Sequence
  Synthetic Polynucleotide
taatacgactcactataggggtatggccccagagagcagctggctggccaaacagaggagatggccaatgagctgctctaacctggcggcagcgcaaaagatg

SEQ ID NO: 232729 - DNA, 103 bp, Artificial Sequence
  Synthetic Polynucleotide
taatacgactcactatagggggaatctgaggtatggccccagagagcagcaacagaggagagctgctatgtggggccataacctggcggcagcgcaaaagatg

SEQ ID NO: 232730 - DNA, 103 bp, Artificial Sequence
  Synthetic Polynucleotide
taatacgactcactatagggtgagcttgctggaatctgaggtatggccccaacagaggagaggggccatgcctcagattaacctggcggcagcgcaaaagatg

SEQ ID NO: 232731 - DNA, 103 bp, Artificial Sequence
  Synthetic Polynucleotide
taatacgactcactataggggagaagtggctgagcttgctggaatctgagaacagaggagactcagaatgcagcaagctaacctggcggcagcgcaaaagatg

SEQ ID NO: 232732 - DNA, 103 bp, Artificial Sequence
  Synthetic Polynucleotide
taatacgactcactataggggacaggtccacattgttgggaacatctttgaacagaggagacaaagaatgtcccaacaaaacctggcggcagcgcaaaagatg

SEQ ID NO: 232733 - DNA, 103 bp, Artificial Sequence
  Synthetic Polynucleotide
taatacgactcactatagggggagttgaaggagaagtggctgagcttgctaacagaggagaagcaagatgagccacttcaacctggcggcagcgcaaaagatg

SEQ ID NO: 232734 - DNA, 103 bp, Artificial Sequence
  Synthetic Polynucleotide
taatacgactcactatagggtgtggaggttggagttgaaggagaagtggcaacagaggagagccactatgccttcaactaacctggcggcagcgcaaaagatg

SEQ ID NO: 232735 - DNA, 103 bp, Artificial Sequence
  Synthetic Polynucleotide
taatacgactcactataggggagtgttcattgtggaggttggagttgaagaacagaggagacttcaaatgcaacctccaaacctggcggcagcgcaaaagatg

SEQ ID NO: 232736 - DNA, 103 bp, Artificial Sequence
  Synthetic Polynucleotide
taatacgactcactatagggttcctcttgagagtgttcattgtggaggttaacagaggagaaacctcatgaatgaacacaacctggcggcagcgcaaaagatg

SEQ ID NO: 232737 - DNA, 103 bp, Artificial Sequence
  Synthetic Polynucleotide
taatacgactcactatagggttcctccagcttcctcttgagagtgttcataacagaggagaatgaacatgctcaagaggaacctggcggcagcgcaaaagatg

SEQ ID NO: 232738 - DNA, 103 bp, Artificial Sequence
  Synthetic Polynucleotide
taatacgactcactatagggcactggccttttcctccagcttcctcttgaaacagaggagatcaagaatgagctggaggaacctggcggcagcgcaaaagatg

SEQ ID NO: 232739 - DNA, 103 bp, Artificial Sequence
  Synthetic Polynucleotide
taatacgactcactatagggccagggcttgcactggccttttcctccagcaacagaggagagctggaatgaaaggccagaacctggcggcagcgcaaaagatg

SEQ ID NO: 232740 - DNA, 103 bp, Artificial Sequence
  Synthetic Polynucleotide
taatacgactcactataggggtcgttttcgccagggcttgcactggccttaacagaggagaaaggccatggcaagccctaacctggcggcagcgcaaaagatg

SEQ ID NO: 232741 - DNA, 103 bp, Artificial Sequence
  Synthetic Polynucleotide
taatacgactcactatagggctgtcccactgtcgttttcgccagggcttgaacagaggagacaagccatggcgaaaacgaacctggcggcagcgcaaaagatg

SEQ ID NO: 232742 - DNA, 103 bp, Artificial Sequence
  Synthetic Polynucleotide
taatacgactcactatagggtcttctcctcctgtcccactgtcgttttcgaacagaggagacgaaaaatgcagtgggacaacctggcggcagcgcaaaagatg

SEQ ID NO: 232743 - DNA, 103 bp, Artificial Sequence
  Synthetic Polynucleotide
taatacgactcactatagggatcgaatttggacaggtccacattgttgggaacagaggagacccaacatggtggacctgaacctggcggcagcgcaaaagatg

SEQ ID NO: 232744 - DNA, 103 bp, Artificial Sequence
  Synthetic Polynucleotide
taatacgactcactatagggtctctgaggctcttctcctcctgtcccactaacagaggagaagtgggatgggaggagaaaacctggcggcagcgcaaaagatg

SEQ ID NO: 232745 - DNA, 103 bp, Artificial Sequence
  Synthetic Polynucleotide
taatacgactcactatagggaacgcttgtctctctgaggctcttctcctcaacagaggagagaggagatgagcctcagaaacctggcggcagcgcaaaagatg

SEQ ID NO: 232746 - DNA, 103 bp, Artificial Sequence
  Synthetic Polynucleotide
taatacgactcactataggggttgttctcaaacgcttgtctctctgaggcaacagaggagagcctcaatgagacaagcgaacctggcggcagcgcaaaagatg

SEQ ID NO: 232747 - DNA, 103 bp, Artificial Sequence
  Synthetic Polynucleotide
taatacgactcactatagggcggtgtgatggttgttctcaaacgcttgtcaacagaggagagacaagatgttgagaacaaacctggcggcagcgcaaaagatg

SEQ ID NO: 232748 - DNA, 103 bp, Artificial Sequence
  Synthetic Polynucleotide
taatacgactcactatagggctagttgttccggtgtgatggttgttctcaaacagaggagatgagaaatgccatcacacaacctggcggcagcgcaaaagatg

SEQ ID NO: 232749 - DNA, 103 bp, Artificial Sequence
  Synthetic Polynucleotide
taatacgactcactatagggtagagaatttctagttgttccggtgtgatgaacagaggagacatcacatgggaacaactaacctggcggcagcgcaaaagatg

SEQ ID NO: 232750 - DNA, 103 bp, Artificial Sequence
  Synthetic Polynucleotide
taatacgactcactatagggatacttctggtagagaatttctagttgttcaacagaggagagaacaaatggaaattctcaacctggcggcagcgcaaaagatg

SEQ ID NO: 232751 - DNA, 103 bp, Artificial Sequence
  Synthetic Polynucleotide
taatacgactcactatagggaatccagtagatacttctggtagagaatttaacagaggagaaaattcatgaccagaagtaacctggcggcagcgcaaaagatg

SEQ ID NO: 232752 - DNA, 103 bp, Artificial Sequence
  Synthetic Polynucleotide
taatacgactcactataggggtcggattggaatccagtagatacttctggaacagaggagaccagaaatgtctactggaaacctggcggcagcgcaaaagatg

SEQ ID NO: 232753 - DNA, 103 bp, Artificial Sequence
  Synthetic Polynucleotide
taatacgactcactatagggcatctttcgagtcggattggaatccagtagaacagaggagactactgatgtccaatccgaacctggcggcagcgcaaaagatg

SEQ ID NO: 232754 - DNA, 103 bp, Artificial Sequence
  Synthetic Polynucleotide
taatacgactcactatagggcagggaggtgggtgctgttgagttcagtccaacagaggagaggactgatgtcaacagcaaacctggcggcagcgcaaaagatg

SEQ ID NO: 232755 - DNA, 103 bp, Artificial Sequence
  Synthetic Polynucleotide
taatacgactcactataggggcacaaagccatcgaatttggacaggtccaaacagaggagatggaccatgccaaattcgaacctggcggcagcgcaaaagatg

SEQ ID NO: 232756 - DNA, 103 bp, Artificial Sequence
  Synthetic Polynucleotide
taatacgactcactatagggtgtgatccaacatctttcgagtcggattggaacagaggagaccaatcatgctcgaaagaaacctggcggcagcgcaaaagatg

SEQ ID NO: 232757 - DNA, 103 bp, Artificial Sequence
  Synthetic Polynucleotide
taatacgactcactatagggtcgtgtgcaatgtgatccaacatctttcgaaacagaggagatcgaaaatggttggatcaaacctggcggcagcgcaaaagatg

SEQ ID NO: 232758 - DNA, 103 bp, Artificial Sequence
  Synthetic Polynucleotide
taatacgactcactatagggcaagcccacctcgtgtgcaatgtgatccaaaacagaggagattggatatgattgcacacaacctggcggcagcgcaaaagatg

SEQ ID NO: 232759 - DNA, 103 bp, Artificial Sequence
  Synthetic Polynucleotide
taatacgactcactatagggcacgtttcttcaagcccacctcgtgtgcaaaacagaggagattgcacatgaggtgggctaacctggcggcagcgcaaaagatg

SEQ ID NO: 232760 - DNA, 103 bp, Artificial Sequence
  Synthetic Polynucleotide
taatacgactcactatagggacttgtaccacacgtttcttcaagcccaccaacagaggagaggtgggatggaagaaacgaacctggcggcagcgcaaaagatg

SEQ ID NO: 232761 - DNA, 103 bp, Artificial Sequence
  Synthetic Polynucleotide
taatacgactcactatagggctgaaaccagacttgtaccacacgtttcttaacagaggagaaagaaaatggtggtacaaaacctggcggcagcgcaaaagatg

SEQ ID NO: 232762 - DNA, 103 bp, Artificial Sequence
  Synthetic Polynucleotide
taatacgactcactatagggctcgggtgttctgaaaccagacttgtaccaaacagaggagatggtacatgtctggtttcaacctggcggcagcgcaaaagatg

SEQ ID NO: 232763 - DNA, 103 bp, Artificial Sequence
  Synthetic Polynucleotide
taatacgactcactatagggctttcccgagctcgggtgttctgaaaccagaacagaggagactggttatggaacacccgaacctggcggcagcgcaaaagatg

SEQ ID NO: 232764 - DNA, 103 bp, Artificial Sequence
  Synthetic Polynucleotide
taatacgactcactatagggctgtcctttcctttcccgagctcgggtgttaacagaggagaaacaccatggctcgggaaaacctggcggcagcgcaaaagatg

SEQ ID NO: 232765 - DNA, 103 bp, Artificial Sequence
  Synthetic Polynucleotide
taatacgactcactatagggcagcccggaactgtcctttcctttcccgagaacagaggagactcgggatgggaaaggacaacctggcggcagcgcaaaagatg

SEQ ID NO: 232766 - DNA, 103 bp, Artificial Sequence
  Synthetic Polynucleotide
taatacgactcactatagggttgccatagagcacaaagccatcgaatttgaacagaggagacaaattatgtggctttgtaacctggcggcagcgcaaaagatg

SEQ ID NO: 232767 - DNA, 103 bp, Artificial Sequence
  Synthetic Polynucleotide
taatacgactcactataggggctgggcctacagcccggaactgtcctttcaacagaggagagaaaggatggttccgggcaacctggcggcagcgcaaaagatg

SEQ ID NO: 232768 - DNA, 103 bp, Artificial Sequence
  Synthetic Polynucleotide
taatacgactcactataggggtgggcctgcgctgggcctacagcccggaaaacagaggagattccggatggtaggcccaaacctggcggcagcgcaaaagatg

SEQ ID NO: 232769 - DNA, 103 bp, Artificial Sequence
  Synthetic Polynucleotide
taatacgactcactatagggggcatctcctgtgggcctgcgctgggcctaaacagaggagataggccatgcgcaggcccaacctggcggcagcgcaaaagatg

SEQ ID NO: 232770 - DNA, 103 bp, Artificial Sequence
  Synthetic Polynucleotide
taatacgactcactatagggctgcaaaaagggcatctcctgtgggcctgcaacagaggagagcaggcatgcaggagatgaacctggcggcagcgcaaaagatg

SEQ ID NO: 232771 - DNA, 103 bp, Artificial Sequence
  Synthetic Polynucleotide
taatacgactcactataggggaagagcgctctgcaaaaagggcatctcctaacagaggagaaggagaatgcctttttgcaacctggcggcagcgcaaaagatg

SEQ ID NO: 232772 - DNA, 103 bp, Artificial Sequence
  Synthetic Polynucleotide
taatacgactcactatagggtcttggctttgaagagcgctctgcaaaaagaacagaggagactttttatggagcgctctaacctggcggcagcgcaaaagatg

SEQ ID NO: 232773 - DNA, 103 bp, Artificial Sequence
  Synthetic Polynucleotide
taatacgactcactatagggtcaagagcagtcttggctttgaagagcgctaacagaggagaagcgctatgcaaagccaaaacctggcggcagcgcaaaagatg

SEQ ID NO: 232774 - DNA, 103 bp, Artificial Sequence
  Synthetic Polynucleotide
taatacgactcactataggggatatgagcctcaagagcagtcttggctttaacagaggagaaaagccatgactgctcttaacctggcggcagcgcaaaagatg

SEQ ID NO: 232775 - DNA, 103 bp, Artificial Sequence
  Synthetic Polynucleotide
taatacgactcactataggggacgggaccggatatgagcctcaagagcagaacagaggagactgctcatgaggctcataaacctggcggcagcgcaaaagatg

SEQ ID NO: 232776 - DNA, 103 bp, Artificial Sequence
  Synthetic Polynucleotide
taatacgactcactatagggtcatgccagtgacgggaccggatatgagccaacagaggagaggctcaatgccggtcccgaacctggcggcagcgcaaaagatg

SEQ ID NO: 232777 - DNA, 103 bp, Artificial Sequence
  Synthetic Polynucleotide
taatacgactcactataggggggcttcctcttgccatagagcacaaagccaacagaggagaggctttatgctctatggcaacctggcggcagcgcaaaagatg

SEQ ID NO: 232778 - DNA, 103 bp, Artificial Sequence
  Synthetic Polynucleotide
taatacgactcactatagggtctcttggcttcatgccagtgacgggaccgaacagaggagacggtccatgcactggcataacctggcggcagcgcaaaagatg

SEQ ID NO: 232779 - DNA, 103 bp, Artificial Sequence
  Synthetic Polynucleotide
taatacgactcactatagggtgtagccagctctcttggcttcatgccagtaacagaggagaactggcatgaagccaagaaacctggcggcagcgcaaaagatg

SEQ ID NO: 232780 - DNA, 103 bp, Artificial Sequence
  Synthetic Polynucleotide
taatacgactcactatagggagagttaggttgtagccagctctcttggctaacagaggagaagccaaatgagctggctaaacctggcggcagcgcaaaagatg

SEQ ID NO: 232781 - DNA, 103 bp, Artificial Sequence
  Synthetic Polynucleotide
taatacgactcactatagggcatcgcagacagagttaggttgtagccagcaacagaggagagctggcatgaacctaactaacctggcggcagcgcaaaagatg

SEQ ID NO: 232782 - DNA, 103 bp, Artificial Sequence
  Synthetic Polynucleotide
taatacgactcactatagggagtctaagagcatcgcagacagagttaggtaacagaggagaacctaaatgtgtctgcgaaacctggcggcagcgcaaaagatg

SEQ ID NO: 232783 - DNA, 103 bp, Artificial Sequence
  Synthetic Polynucleotide
taatacgactcactatagggcccccatcacagtctaagagcatcgcagacaacagaggagagtctgcatggctcttagaaacctggcggcagcgcaaaagatg

SEQ ID NO: 232784 - DNA, 103 bp, Artificial Sequence
  Synthetic Polynucleotide
taatacgactcactatagggcatctggagtcccccatcacagtctaagagaacagaggagactcttaatgtgtgatgggaacctggcggcagcgcaaaagatg

SEQ ID NO: 232785 - DNA, 103 bp, Artificial Sequence
  Synthetic Polynucleotide
taatacgactcactatagggtatctcctttcatctggagtcccccatcacaacagaggagagtgatgatggactccagaaacctggcggcagcgcaaaagatg

SEQ ID NO: 232786 - DNA, 103 bp, Artificial Sequence
  Synthetic Polynucleotide
taatacgactcactatagggccgtcaaaaatatctcctttcatctggagtaacagaggagaactccaatggaaaggagaaacctggcggcagcgcaaaagatg

SEQ ID NO: 232787 - DNA, 103 bp, Artificial Sequence
  Synthetic Polynucleotide
taatacgactcactatagggaaagctagttccgtcaaaaatatctcctttaacagaggagaaaaggaatgatttttgacaacctggcggcagcgcaaaagatg

SEQ ID NO: 232788 - DNA, 103 bp, Artificial Sequence
  Synthetic Polynucleotide
taatacgactcactatagggacatcaggatgggcttcctcttgccatagaaacagaggagatctatgatgagaggaagcaacctggcggcagcgcaaaagatg

SEQ ID NO: 232789 - DNA, 103 bp, Artificial Sequence
  Synthetic Polynucleotide
taatacgactcactataggggtaggtgggaaaagctagttccgtcaaaaaaacagaggagatttttgatggaactagctaacctggcggcagcgcaaaagatg

SEQ ID NO: 232790 - DNA, 103 bp, Artificial Sequence
  Synthetic Polynucleotide
taatacgactcactatagggctgcttgggggtaggtgggaaaagctagttaacagaggagaaactagatgttcccacctaacctggcggcagcgcaaaagatg

SEQ ID NO: 232791 - DNA, 103 bp, Artificial Sequence
  Synthetic Polynucleotide
taatacgactcactatagggaccatcactactgcttgggggtaggtgggaaacagaggagatcccacatgcccccaagcaacctggcggcagcgcaaaagatg

SEQ ID NO: 232792 - DNA, 103 bp, Artificial Sequence
  Synthetic Polynucleotide
taatacgactcactatagggggacaccctgaccatcactactgcttggggaacagaggagaccccaaatggtagtgatgaacctggcggcagcgcaaaagatg

SEQ ID NO: 232793 - DNA, 103 bp, Artificial Sequence
  Synthetic Polynucleotide
taatacgactcactatagggggtgagagggggacaccctgaccatcactaaacagaggagatagtgaatgtcagggtgtaacctggcggcagcgcaaaagatg

SEQ ID NO: 232794 - DNA, 103 bp, Artificial Sequence
  Synthetic Polynucleotide
taatacgactcactatagggtttactcacaggtgagagggggacaccctgaacagaggagacagggtatgcccctctcaaacctggcggcagcgcaaaagatg

SEQ ID NO: 232795 - DNA, 103 bp, Artificial Sequence
  Synthetic Polynucleotide
taatacgactcactatagggattccatggttttactcacaggtgagagggaacagaggagaccctctatgctgtgagtaaacctggcggcagcgcaaaagatg

SEQ ID NO: 232796 - DNA, 103 bp, Artificial Sequence
  Synthetic Polynucleotide
taatacgactcactatagggctgggtgacaattccatggttttactcacaaacagaggagatgtgagatgaaccatggaaacctggcggcagcgcaaaagatg

SEQ ID NO: 232797 - DNA, 103 bp, Artificial Sequence
  Synthetic Polynucleotide
taatacgactcactatagggtagaagagttctgggtgacaattccatggtaacagaggagaaccatgatgttgtcacccaacctggcggcagcgcaaaagatg

SEQ ID NO: 232798 - DNA, 103 bp, Artificial Sequence
  Synthetic Polynucleotide
taatacgactcactatagggaggaagggcttagaagagttctgggtgacaaacagaggagatgtcacatggaactcttcaacctggcggcagcgcaaaagatg

SEQ ID NO: 232799 - DNA, 103 bp, Artificial Sequence
  Synthetic Polynucleotide
taatacgactcactatagggcacaagaaacacatcaggatgggcttcctcaacagaggagagaggaaatgcatcctgataacctggcggcagcgcaaaagatg

SEQ ID NO: 232800 - DNA, 103 bp, Artificial Sequence
  Synthetic Polynucleotide
taatacgactcactatagggaccttaatggaggaagggcttagaagagttaacagaggagaaactctatgaagcccttcaacctggcggcagcgcaaaagatg

SEQ ID NO: 232801 - DNA, 103 bp, Artificial Sequence
  Synthetic Polynucleotide
taatacgactcactatagggaatcccttccaccttaatggaggaagggctaacagaggagaagccctatgtccattaagaacctggcggcagcgcaaaagatg

SEQ ID NO: 232802 - DNA, 103 bp, Artificial Sequence
  Synthetic Polynucleotide
taatacgactcactatagggcaaagtcttcaatcccttccaccttaatggaacagaggagaccattaatgtggaagggaaacctggcggcagcgcaaaagatg

SEQ ID NO: 232803 - DNA, 103 bp, Artificial Sequence
  Synthetic Polynucleotide
taatacgactcactataggggaggggctttcaaagtcttcaatcccttccaacagaggagaggaaggatgtgaagacttaacctggcggcagcgcaaaagatg

SEQ ID NO: 232804 - DNA, 103 bp, Artificial Sequence
  Synthetic Polynucleotide
taatacgactcactatagggtgaggacatggaggggctttcaaagtcttcaacagaggagagaagacatggaaagccccaacctggcggcagcgcaaaagatg

SEQ ID NO: 232805 - DNA, 103 bp, Artificial Sequence
  Synthetic Polynucleotide
taatacgactcactatagggttagattaactgaggacatggaggggctttaacagaggagaaaagccatgccatgtcctaacctggcggcagcgcaaaagatg

SEQ ID NO: 232806 - DNA, 103 bp, Artificial Sequence
  Synthetic Polynucleotide
taatacgactcactatagggtggtcaaagtttagattaactgaggacatgaacagaggagacatgtcatgagttaatctaacctggcggcagcgcaaaagatg

SEQ ID NO: 232807 - DNA, 103 bp, Artificial Sequence
  Synthetic Polynucleotide
taatacgactcactatagggcagcttagtttggtcaaagtttagattaacaacagaggagagttaatatgaactttgacaacctggcggcagcgcaaaagatg

SEQ ID NO: 232808 - DNA, 103 bp, Artificial Sequence
  Synthetic Polynucleotide
taatacgactcactatagggcatcgttgtccagcttagtttggtcaaagtaacagaggagaactttgatgaaactaagcaacctggcggcagcgcaaaagatg

SEQ ID NO: 232809 - DNA, 103 bp, Artificial Sequence
  Synthetic Polynucleotide
taatacgactcactataggggaggaacagtcatcgttgtccagcttagttaacagaggagaaactaaatgggacaacgaaacctggcggcagcgcaaaagatg

SEQ ID NO: 232810 - DNA, 103 bp, Artificial Sequence
  Synthetic Polynucleotide
taatacgactcactatagggggagagtttgcacaagaaacacatcaggataacagaggagaatcctgatgtgtttcttgaacctggcggcagcgcaaaagatg

SEQ ID NO: 232811 - DNA, 103 bp, Artificial Sequence
  Synthetic Polynucleotide
taatacgactcactatagggtgtgttgacagaggaacagtcatcgttgtcaacagaggagagacaacatggactgttccaacctggcggcagcgcaaaagatg

SEQ ID NO: 232812 - DNA, 103 bp, Artificial Sequence
  Synthetic Polynucleotide
taatacgactcactatagggctgtgattgctgtgttgacagaggaacagtaacagaggagaactgttatgctgtcaacaaacctggcggcagcgcaaaagatg

SEQ ID NO: 232813 - DNA, 103 bp, Artificial Sequence
  Synthetic Polynucleotide
taatacgactcactataggggttgtggtatctgtgattgctgtgttgacaaacagaggagatgtcaaatgagcaatcacaacctggcggcagcgcaaaagatg

SEQ ID NO: 232814 - DNA, 103 bp, Artificial Sequence
  Synthetic Polynucleotide
taatacgactcactatagggctcgtctccagttgtggtatctgtgattgcaacagaggagagcaatcatggataccacaaacctggcggcagcgcaaaagatg

SEQ ID NO: 232815 - DNA, 103 bp, Artificial Sequence
  Synthetic Polynucleotide
taatacgactcactatagggctgcgttgccctcgtctccagttgtggtataacagaggagaataccaatgctggagacgaacctggcggcagcgcaaaagatg

SEQ ID NO: 232816 - DNA, 103 bp, Artificial Sequence
  Synthetic Polynucleotide
taatacgactcactatagggctgtcgttatctgcgttgccctcgtctccaaacagaggagatggagaatggggcaacgcaacctggcggcagcgcaaaagatg

SEQ ID NO: 232817 - DNA, 103 bp, Artificial Sequence
  Synthetic Polynucleotide
taatacgactcactatagggtcccgttgcactgtcgttatctgcgttgccaacagaggagaggcaacatggataacgacaacctggcggcagcgcaaaagatg

SEQ ID NO: 232818 - DNA, 103 bp, Artificial Sequence
  Synthetic Polynucleotide
taatacgactcactatagggcagttgctattcccgttgcactgtcgttataacagaggagaataacgatggtgcaacggaacctggcggcagcgcaaaagatg

SEQ ID NO: 232819 - DNA, 103 bp, Artificial Sequence
  Synthetic Polynucleotide
taatacgactcactataggggatttggtttcagttgctattcccgttgcaaacagaggagatgcaacatgaatagcaacaacctggcggcagcgcaaaagatg

SEQ ID NO: 232820 - DNA, 103 bp, Artificial Sequence
  Synthetic Polynucleotide
taatacgactcactatagggtgcagaagaggatttggtttcagttgctataacagaggagaatagcaatggaaaccaaaaacctggcggcagcgcaaaagatg

SEQ ID NO: 232821 - DNA, 103 bp, Artificial Sequence
  Synthetic Polynucleotide
taatacgactcactatagggcgtacccaaaggagagtttgcacaagaaacaacagaggagagtttctatggcaaactctaacctggcggcagcgcaaaagatg

SEQ ID NO: 232822 - DNA, 103 bp, Artificial Sequence
  Synthetic Polynucleotide
taatacgactcactatagggcttcgttgggtgcagaagaggatttggtttaacagaggagaaaaccaatgcctcttctgaacctggcggcagcgcaaaagatg

SEQ ID NO: 232823 - DNA, 103 bp, Artificial Sequence
  Synthetic Polynucleotide
taatacgactcactatagggttggtcaacccttcgttgggtgcagaagagaacagaggagactcttcatgacccaacgaaacctggcggcagcgcaaaagatg

SEQ ID NO: 232824 - DNA, 103 bp, Artificial Sequence
  Synthetic Polynucleotide
taatacgactcactatagggcatggccgctttggtcaacccttcgttgggaacagaggagacccaacatggggttgaccaacctggcggcagcgcaaaagatg

SEQ ID NO: 232825 - DNA, 103 bp, Artificial Sequence
  Synthetic Polynucleotide
taatacgactcactatagggacattgccatcatggccgctttggtcaaccaacagaggagaggttgaatgaagcggccaaacctggcggcagcgcaaaagatg

SEQ ID NO: 232826 - DNA, 103 bp, Artificial Sequence
  Synthetic Polynucleotide
taatacgactcactatagggtcatactcagacattgccatcatggccgctaacagaggagaagcggcatggatggcaataacctggcggcagcgcaaaagatg

SEQ ID NO: 232827 - DNA, 103 bp, Artificial Sequence
  Synthetic Polynucleotide
taatacgactcactatagggcaaccgatcttcatactcagacattgccataacagaggagaatggcaatgtctgagtataacctggcggcagcgcaaaagatg

SEQ ID NO: 232828 - DNA, 103 bp, Artificial Sequence
  Synthetic Polynucleotide
taatacgactcactataggggaccagatgacaaccgatcttcatactcagaacagaggagactgagtatgaagatcggtaacctggcggcagcgcaaaagatg

SEQ ID NO: 232829 - DNA, 103 bp, Artificial Sequence
  Synthetic Polynucleotide
taatacgactcactataggggggctgaccagaccagatgacaaccgatctaacagaggagaagatcgatggtcatctggaacctggcggcagcgcaaaagatg

SEQ ID NO: 232830 - DNA, 103 bp, Artificial Sequence
  Synthetic Polynucleotide
taatacgactcactataggggctcggggccgggctgaccagaccagatgaaacagaggagatcatctatgctggtcagcaacctggcggcagcgcaaaagatg

SEQ ID NO: 232831 - DNA, 103 bp, Artificial Sequence
  Synthetic Polynucleotide
taatacgactcactatagggtgctataaaagctcggggccgggctgaccaaacagaggagatggtcaatgcggccccgaaacctggcggcagcgcaaaagatg

SEQ ID NO: 232832 - DNA, 103 bp, Artificial Sequence
  Synthetic Polynucleotide
taatacgactcactatagggaacgaacggacgtacccaaaggagagtttgaacagaggagacaaactatgctttgggtaaacctggcggcagcgcaaaagatg

SEQ ID NO: 232833 - DNA, 103 bp, Artificial Sequence
  Synthetic Polynucleotide
taatacgactcactatagggtcatattccttgctataaaagctcggggccaacagaggagaggccccatgcttttatagaacctggcggcagcgcaaaagatg

SEQ ID NO: 232834 - DNA, 103 bp, Artificial Sequence
  Synthetic Polynucleotide
taatacgactcactatagggaccttcattgtcatattccttgctataaaaaacagaggagattttatatgaaggaatataacctggcggcagcgcaaaagatg

SEQ ID NO: 232835 - DNA, 103 bp, Artificial Sequence
  Synthetic Polynucleotide
taatacgactcactatagggagtccactgtaccttcattgtcatattcctaacagaggagaaggaatatgacaatgaagaacctggcggcagcgcaaaagatg

SEQ ID NO: 232836 - DNA, 103 bp, Artificial Sequence
  Synthetic Polynucleotide
taatacgactcactataggggtttcactgtagtccactgtaccttcattgaacagaggagacaatgaatgtacagtggaaacctggcggcagcgcaaaagatg

SEQ ID NO: 232837 - DNA, 103 bp, Artificial Sequence
  Synthetic Polynucleotide
taatacgactcactatagggaaggcttgaggtttcactgtagtccactgtaacagaggagaacagtgatgtacagtgaaaacctggcggcagcgcaaaagatg

SEQ ID NO: 232838 - DNA, 103 bp, Artificial Sequence
  Synthetic Polynucleotide
taatacgactcactatagggagggatctgcaaggcttgaggtttcactgtaacagaggagaacagtgatgcctcaagccaacctggcggcagcgcaaaagatg

SEQ ID NO: 232839 - DNA, 103 bp, Artificial Sequence
  Synthetic Polynucleotide
taatacgactcactatagggctcggggagcagggatctgcaaggcttgagaacagaggagactcaagatgtgcagatccaacctggcggcagcgcaaaagatg

SEQ ID NO: 232840 - DNA, 103 bp, Artificial Sequence
  Synthetic Polynucleotide
taatacgactcactatagggcgcaccaggactcggggagcagggatctgcaacagaggagagcagatatgtgctccccgaacctggcggcagcgcaaaagatg

SEQ ID NO: 232841 - DNA, 103 bp, Artificial Sequence
  Synthetic Polynucleotide
taatacgactcactatagggcagatccactcgcaccaggactcggggagcaacagaggagagctcccatggtcctggtgaacctggcggcagcgcaaaagatg

SEQ ID NO: 232842 - DNA, 103 bp, Artificial Sequence
  Synthetic Polynucleotide
taatacgactcactataggggatttgcctgcagatccactcgcaccaggaaacagaggagatcctggatggagtggatcaacctggcggcagcgcaaaagatg

SEQ ID NO: 232843 - DNA, 103 bp, Artificial Sequence
  Synthetic Polynucleotide
taatacgactcactataggggtgggtcacaaacgaacggacgtacccaaaaacagaggagatttgggatggtccgttcgaacctggcggcagcgcaaaagatg

SEQ ID NO: 232844 - DNA, 103 bp, Artificial Sequence
  Synthetic Polynucleotide
taatacgactcactataggggctgtcaccagatttgcctgcagatccactaacagaggagaagtggaatggcaggcaaaaacctggcggcagcgcaaaagatg

SEQ ID NO: 232845 - DNA, 103 bp, Artificial Sequence
  Synthetic Polynucleotide
taatacgactcactataggggccgatctccgctgtcaccagatttgcctgaacagaggagacaggcaatgctggtgacaaacctggcggcagcgcaaaagatg

SEQ ID NO: 232846 - DNA, 103 bp, Artificial Sequence
  Synthetic Polynucleotide
taatacgactcactatagggttctgcccaggccgatctccgctgtcaccaaacagaggagatggtgaatgcggagatcgaacctggcggcagcgcaaaagatg

SEQ ID NO: 232847 - DNA, 103 bp, Artificial Sequence
  Synthetic Polynucleotide
taatacgactcactataggggcgaaaacgtttctgcccaggccgatctccaacagaggagaggagatatgcctgggcagaacctggcggcagcgcaaaagatg

SEQ ID NO: 232848 - DNA, 103 bp, Artificial Sequence
  Synthetic Polynucleotide
taatacgactcactatagggtcatttgagtgcgaaaacgtttctgcccagaacagaggagactgggcatgaacgttttcaacctggcggcagcgcaaaagatg

SEQ ID NO: 232849 - DNA, 103 bp, Artificial Sequence
  Synthetic Polynucleotide
taatacgactcactatagggtgcagattggtcatttgagtgcgaaaacgtaacagaggagaacgtttatgcactcaaataacctggcggcagcgcaaaagatg

SEQ ID NO: 232850 - DNA, 103 bp, Artificial Sequence
  Synthetic Polynucleotide
taatacgactcactataggggaccttcagctgcagattggtcatttgagtaacagaggagaactcaaatgaccaatctgaacctggcggcagcgcaaaagatg

SEQ ID NO: 232851 - DNA, 103 bp, Artificial Sequence
  Synthetic Polynucleotide
taatacgactcactatagggatgacttgaggaccttcagctgcagattggaacagaggagaccaatcatgagctgaaggaacctggcggcagcgcaaaagatg

SEQ ID NO: 232852 - DNA, 103 bp, Artificial Sequence
  Synthetic Polynucleotide
taatacgactcactatagggtcattaaagcatgacttgaggaccttcagcaacagaggagagctgaaatgcctcaagtcaacctggcggcagcgcaaaagatg

SEQ ID NO: 232853 - DNA, 103 bp, Artificial Sequence
  Synthetic Polynucleotide
taatacgactcactatagggtgtcctgtagtcattaaagcatgacttgagaacagaggagactcaagatgtgctttaataacctggcggcagcgcaaaagatg

SEQ ID NO: 232854 - DNA, 103 bp, Artificial Sequence
  Synthetic Polynucleotide
taatacgactcactatagggcatgcaccgcgtgggtcacaaacgaacggaaacagaggagatccgttatgttgtgacccaacctggcggcagcgcaaaagatg

SEQ ID NO: 232855 - DNA, 103 bp, Artificial Sequence
  Synthetic Polynucleotide
taatacgactcactataggggcatagtgggtgtcctgtagtcattaaagcaacagaggagagctttaatgactacaggaaacctggcggcagcgcaaaagatg

SEQ ID NO: 232856 - DNA, 103 bp, Artificial Sequence
  Synthetic Polynucleotide
taatacgactcactatagggtcacattctagcatagtgggtgtcctgtagaacagaggagactacagatgacccactataacctggcggcagcgcaaaagatg

SEQ ID NO: 232857 - DNA, 103 bp, Artificial Sequence
  Synthetic Polynucleotide
taatacgactcactataggggcccaggacctcacattctagcatagtgggaacagaggagacccactatgctagaatgtaacctggcggcagcgcaaaagatg

SEQ ID NO: 232858 - DNA, 103 bp, Artificial Sequence
  Synthetic Polynucleotide
taatacgactcactatagggcaatgtcattgcccaggacctcacattctaaacagaggagatagaatatgaggtcctggaacctggcggcagcgcaaaagatg

SEQ ID NO: 232859 - DNA, 103 bp, Artificial Sequence
  Synthetic Polynucleotide
taatacgactcactatagggtttggcagtccaatgtcattgcccaggaccaacagaggagaggtcctatgcaatgacataacctggcggcagcgcaaaagatg

SEQ ID NO: 232860 - DNA, 103 bp, Artificial Sequence
  Synthetic Polynucleotide
taatacgactcactatagggaacgactctctttggcagtccaatgtcattaacagaggagaaatgacatgggactgccaaacctggcggcagcgcaaaagatg

SEQ ID NO: 232861 - DNA, 103 bp, Artificial Sequence
  Synthetic Polynucleotide
taatacgactcactatagggaccagacctgaacgactctctttggcagtcaacagaggagagactgcatgagagagtcgaacctggcggcagcgcaaaagatg

SEQ ID NO: 232862 - DNA, 103 bp, Artificial Sequence
  Synthetic Polynucleotide
taatacgactcactataggggcattctggaaccagacctgaacgactctcaacagaggagagagagtatgtcaggtctgaacctggcggcagcgcaaaagatg

SEQ ID NO: 232863 - DNA, 103 bp, Artificial Sequence
  Synthetic Polynucleotide
taatacgactcactatagggttttgcccgggcattctggaaccagacctgaacagaggagacaggtcatgttccagaataacctggcggcagcgcaaaagatg

SEQ ID NO: 232864 - DNA, 103 bp, Artificial Sequence
  Synthetic Polynucleotide
taatacgactcactatagggacttcttttcttttgcccgggcattctggaaacagaggagatccagaatgcccgggcaaaacctggcggcagcgcaaaagatg

SEQ ID NO: 232865 - DNA, 103 bp, Artificial Sequence
  Synthetic Polynucleotide
taatacgactcactatagggctgggtttgtcagggaggtgggtgctgttgaacagaggagacaacagatgccacctcccaacctggcggcagcgcaaaagatg

SEQ ID NO: 232866 - DNA, 103 bp, Artificial Sequence
  Synthetic Polynucleotide
taatacgactcactatagggattcgatggtcatgcaccgcgtgggtcacaaacagaggagatgtgacatgcgcggtgcaaacctggcggcagcgcaaaagatg

SEQ ID NO: 232867 - DNA, 103 bp, Artificial Sequence
  Synthetic Polynucleotide
taatacgactcactatagggcttaacttggacttcttttcttttgcccggaacagaggagaccgggcatgagaaaagaaaacctggcggcagcgcaaaagatg

SEQ ID NO: 232868 - DNA, 103 bp, Artificial Sequence
  Synthetic Polynucleotide
taatacgactcactatagggcttggccatgcttaacttggacttcttttcaacagaggagagaaaagatgtccaagttaaacctggcggcagcgcaaaagatg

SEQ ID NO: 232869 - DNA, 103 bp, Artificial Sequence
  Synthetic Polynucleotide
taatacgactcactatagggtaccaaaatgcttggccatgcttaacttggaacagaggagaccaagtatggcatggccaaacctggcggcagcgcaaaagatg

SEQ ID NO: 232870 - DNA, 103 bp, Artificial Sequence
  Synthetic Polynucleotide
taatacgactcactataggggtttggtttataccaaaatgcttggccatgaacagaggagacatggcatggcattttggaacctggcggcagcgcaaaagatg

SEQ ID NO: 232871 - DNA, 103 bp, Artificial Sequence
  Synthetic Polynucleotide
taatacgactcactatagggctcataactcgtttggtttataccaaaatgaacagaggagacattttatgataaaccaaaacctggcggcagcgcaaaagatg

SEQ ID NO: 232872 - DNA, 103 bp, Artificial Sequence
  Synthetic Polynucleotide
taatacgactcactatagggttttgggtccctcataactcgtttggtttaaacagaggagataaaccatgcgagttatgaacctggcggcagcgcaaaagatg

SEQ ID NO: 232873 - DNA, 103 bp, Artificial Sequence
  Synthetic Polynucleotide
taatacgactcactataggggtgcactctgttttgggtccctcataactcaacagaggagagagttaatggggacccaaaacctggcggcagcgcaaaagatg

SEQ ID NO: 232874 - DNA, 103 bp, Artificial Sequence
  Synthetic Polynucleotide
taatacgactcactataggggccacacaaagtgcactctgttttgggtccaacagaggagaggacccatgacagagtgcaacctggcggcagcgcaaaagatg

SEQ ID NO: 232875 - DNA, 103 bp, Artificial Sequence
  Synthetic Polynucleotide
taatacgactcactatagggtgtacttgatgccacacaaagtgcactctgaacagaggagacagagtatgctttgtgtgaacctggcggcagcgcaaaagatg

SEQ ID NO: 232876 - DNA, 103 bp, Artificial Sequence
  Synthetic Polynucleotide
taatacgactcactatagggagccgagcgctgtacttgatgccacacaaaaacagaggagatttgtgatgcatcaagtaaacctggcggcagcgcaaaagatg

SEQ ID NO: 232877 - DNA, 103 bp, Artificial Sequence
  Synthetic Polynucleotide
taatacgactcactataggggctcagggtcattcgatggtcatgcaccgcaacagaggagagcggtgatggaccatcgaaacctggcggcagcgcaaaagatg

SEQ ID NO: 232878 - DNA, 103 bp, Artificial Sequence
  Synthetic Polynucleotide
taatacgactcactatagggacgtacagacagccgagcgctgtacttgataacagaggagaatcaagatgagcgctcggaacctggcggcagcgcaaaagatg

SEQ ID NO: 232879 - DNA, 103 bp, Artificial Sequence
  Synthetic Polynucleotide
taatacgactcactatagggagatatggtcacgtacagacagccgagcgcaacagaggagagcgctcatgtgtctgtacaacctggcggcagcgcaaaagatg

SEQ ID NO: 232880 - DNA, 103 bp, Artificial Sequence
  Synthetic Polynucleotide
taatacgactcactatagggtgttgggaaaagatatggtcacgtacagacaacagaggagagtctgtatgtgaccatataacctggcggcagcgcaaaagatg

SEQ ID NO: 232881 - DNA, 103 bp, Artificial Sequence
  Synthetic Polynucleotide
taatacgactcactatagggggagatatgctgttgggaaaagatatggtcaacagaggagagaccatatgttttcccaaaacctggcggcagcgcaaaagatg

SEQ ID NO: 232882 - DNA, 103 bp, Artificial Sequence
  Synthetic Polynucleotide
taatacgactcactatagggctttaactttggagatatgctgttgggaaaaacagaggagatttcccatgagcatatctaacctggcggcagcgcaaaagatg

SEQ ID NO: 232883 - DNA, 103 bp, Artificial Sequence
  Synthetic Polynucleotide
taatacgactcactatagggccaatggtgtctttaactttggagatatgcaacagaggagagcatatatgcaaagttaaaacctggcggcagcgcaaaagatg

SEQ ID NO: 232884 - DNA, 103 bp, Artificial Sequence
  Synthetic Polynucleotide
taatacgactcactatagggcagctggcttccaatggtgtctttaactttaacagaggagaaaagttatggacaccattaacctggcggcagcgcaaaagatg

SEQ ID NO: 232885 - DNA, 103 bp, Artificial Sequence
  Synthetic Polynucleotide
taatacgactcactatagggtctccttgtccagctggcttccaatggtgtaacagaggagaacaccaatggaagccagcaacctggcggcagcgcaaaagatg

SEQ ID NO: 232886 - DNA, 103 bp, Artificial Sequence
  Synthetic Polynucleotide
taatacgactcactatagggaagtattctttctccttgtccagctggcttaacagaggagaaagccaatgggacaaggaaacctggcggcagcgcaaaagatg

SEQ ID NO: 232887 - DNA, 103 bp, Artificial Sequence
  Synthetic Polynucleotide
taatacgactcactatagggggctgggtcaaagtattctttctccttgtcaacagaggagagacaagatgaaagaatacaacctggcggcagcgcaaaagatg

SEQ ID NO: 232888 - DNA, 103 bp, Artificial Sequence
  Synthetic Polynucleotide
taatacgactcactataggggctcgtcttcgctcagggtcattcgatggtaacagaggagaaccatcatgtgaccctgaaacctggcggcagcgcaaaagatg

SEQ ID NO: 232889 - DNA, 103 bp, Artificial Sequence
  Synthetic Polynucleotide
taatacgactcactataggggacgtacggtggctgggtcaaagtattcttaacagaggagaaagaatatgttgacccagaacctggcggcagcgcaaaagatg

SEQ ID NO: 232890 - DNA, 103 bp, Artificial Sequence
  Synthetic Polynucleotide
taatacgactcactataggggccatcaactgacgtacggtggctgggtcaaacagaggagatgacccatgcaccgtacgaacctggcggcagcgcaaaagatg

SEQ ID NO: 232891 - DNA, 103 bp, Artificial Sequence
  Synthetic Polynucleotide
taatacgactcactatagggctcttgttgagccatcaactgacgtacggtaacagaggagaaccgtaatgcagttgatgaacctggcggcagcgcaaaagatg

SEQ ID NO: 232892 - DNA, 103 bp, Artificial Sequence
  Synthetic Polynucleotide
taatacgactcactatagggtccggtccaactcttgttgagccatcaactaacagaggagaagttgaatgctcaacaagaacctggcggcagcgcaaaagatg

SEQ ID NO: 232893 - DNA, 103 bp, Artificial Sequence
  Synthetic Polynucleotide
taatacgactcactataggggcctttttaatccggtccaactcttgttgaaacagaggagatcaacaatggttggaccgaacctggcggcagcgcaaaagatg

SEQ ID NO: 232894 - DNA, 103 bp, Artificial Sequence
  Synthetic Polynucleotide
taatacgactcactataggggacctcgttggcctttttaatccggtccaaaacagaggagattggacatgattaaaaagaacctggcggcagcgcaaaagatg

SEQ ID NO: 232895 - DNA, 103 bp, Artificial Sequence
  Synthetic Polynucleotide
taatacgactcactatagggccagtccaaggacctcgttggcctttttaaaacagaggagattaaaaatgccaacgaggaacctggcggcagcgcaaaagatg

SEQ ID NO: 232896 - DNA, 103 bp, Artificial Sequence
  Synthetic Polynucleotide
taatacgactcactatagggtgctgagctgccagtccaaggacctcgttgaacagaggagacaacgaatgccttggactaacctggcggcagcgcaaaagatg

SEQ ID NO: 232897 - DNA, 103 bp, Artificial Sequence
  Synthetic Polynucleotide
taatacgactcactatagggcatcccttgctgctgagctgccagtccaagaacagaggagacttggaatggcagctcagaacctggcggcagcgcaaaagatg

SEQ ID NO: 232898 - DNA, 103 bp, Artificial Sequence
  Synthetic Polynucleotide
taatacgactcactatagggtgttgtcaaacatcccttgctgctgagctgaacagaggagacagctcatgagcaagggaaacctggcggcagcgcaaaagatg

SEQ ID NO: 232899 - DNA, 103 bp, Artificial Sequence
  Synthetic Polynucleotide
taatacgactcactatagggagaattttccgctcgtcttcgctcagggtcaacagaggagagaccctatgcgaagacgaaacctggcggcagcgcaaaagatg

SEQ ID NO: 232900 - DNA, 103 bp, Artificial Sequence
  Synthetic Polynucleotide
taatacgactcactatagggtgaagaggggtgttgtcaaacatcccttgcaacagaggagagcaaggatggtttgacaaaacctggcggcagcgcaaaagatg

SEQ ID NO: 232901 - DNA, 103 bp, Artificial Sequence
  Synthetic Polynucleotide
taatacgactcactataggggttaagggcctgaagaggggtgttgtcaaaaacagaggagatttgacatgacccctcttaacctggcggcagcgcaaaagatg

SEQ ID NO: 232902 - DNA, 103 bp, Artificial Sequence
  Synthetic Polynucleotide
taatacgactcactatagggctgtaggaaggttaagggcctgaagaggggaacagaggagacccctcatgaggcccttaaacctggcggcagcgcaaaagatg

SEQ ID NO: 232903 - DNA, 103 bp, Artificial Sequence
  Synthetic Polynucleotide
taatacgactcactataggggctggatatgctgtaggaaggttaagggccaacagaggagaggccctatgccttcctacaacctggcggcagcgcaaaagatg

SEQ ID NO: 232904 - DNA, 103 bp, Artificial Sequence
  Synthetic Polynucleotide
taatacgactcactataggggccctggagcgctggatatgctgtaggaagaacagaggagacttcctatggcatatccaaacctggcggcagcgcaaaagatg

SEQ ID NO: 232905 - DNA, 103 bp, Artificial Sequence
  Synthetic Polynucleotide
taatacgactcactatagggcaggaggaatgccctggagcgctggatatgaacagaggagacatatcatgcgctccaggaacctggcggcagcgcaaaagatg

SEQ ID NO: 232906 - DNA, 103 bp, Artificial Sequence
  Synthetic Polynucleotide
taatacgactcactataggggggagcaacacaggaggaatgccctggagcaacagaggagagctccaatgcattcctccaacctggcggcagcgcaaaagatg

SEQ ID NO: 232907 - DNA, 103 bp, Artificial Sequence
  Synthetic Polynucleotide
taatacgactcactataggggttgaggcccgggagcaacacaggaggaataacagaggagaattcctatggtgttgctcaacctggcggcagcgcaaaagatg

SEQ ID NO: 232908 - DNA, 103 bp, Artificial Sequence
  Synthetic Polynucleotide
taatacgactcactatagggaggaggggctgttgaggcccgggagcaacaaacagaggagatgttgcatgcgggcctcaaacctggcggcagcgcaaaagatg

SEQ ID NO: 232909 - DNA, 103 bp, Artificial Sequence
  Synthetic Polynucleotide
taatacgactcactatagggaagcctggcaaggaggggctgttgaggcccaacagaggagagggcctatgcagcccctcaacctggcggcagcgcaaaagatg

SEQ ID NO: 232910 - DNA, 103 bp, Artificial Sequence
  Synthetic Polynucleotide
taatacgactcactatagggcttattgctaagaattttccgctcgtcttcaacagaggagagaagacatgcggaaaattaacctggcggcagcgcaaaagatg

SEQ ID NO: 232911 - DNA, 103 bp, Artificial Sequence
  Synthetic Polynucleotide
taatacgactcactatagggggatggagtaaagcctggcaaggaggggctaacagaggagaagccccatgttgccaggcaacctggcggcagcgcaaaagatg

SEQ ID NO: 232912 - DNA, 103 bp, Artificial Sequence
  Synthetic Polynucleotide
taatacgactcactatagggaagctgtgttggatggagtaaagcctggcaaacagaggagatgccagatgttactccataacctggcggcagcgcaaaagatg

SEQ ID NO: 232913 - DNA, 103 bp, Artificial Sequence
  Synthetic Polynucleotide
taatacgactcactatagggggagacgttaaagctgtgttggatggagtaaacagaggagatactccatgcaacacagcaacctggcggcagcgcaaaagatg

SEQ ID NO: 232914 - DNA, 103 bp, Artificial Sequence
  Synthetic Polynucleotide
taatacgactcactataggggttcggcttaggagacgttaaagctgtgttaacagaggagaaacacaatgttaacgtctaacctggcggcagcgcaaaagatg

SEQ ID NO: 232915 - DNA, 103 bp, Artificial Sequence
  Synthetic Polynucleotide
taatacgactcactataggggacccatcaagttcggcttaggagacgttaaacagaggagataacgtatgctaagccgaaacctggcggcagcgcaaaagatg

SEQ ID NO: 232916 - DNA, 103 bp, Artificial Sequence
  Synthetic Polynucleotide
taatacgactcactataggggtgctgggcagacccatcaagttcggcttaaacagaggagataagccatgcttgatgggaacctggcggcagcgcaaaagatg

SEQ ID NO: 232917 - DNA, 103 bp, Artificial Sequence
  Synthetic Polynucleotide
taatacgactcactatagggaggaacagttgtgctgggcagacccatcaaaacagaggagattgatgatgctgcccagcaacctggcggcagcgcaaaagatg

SEQ ID NO: 232918 - DNA, 103 bp, Artificial Sequence
  Synthetic Polynucleotide
taatacgactcactatagggggccaggggaaggaacagttgtgctgggcaaacagaggagatgcccaatgcaactgttcaacctggcggcagcgcaaaagatg

SEQ ID NO: 232919 - DNA, 103 bp, Artificial Sequence
  Synthetic Polynucleotide
taatacgactcactataggggaagtggggaggccaggggaaggaacagttaacagaggagaaactgtatgttcccctggaacctggcggcagcgcaaaagatg

SEQ ID NO: 232920 - DNA, 103 bp, Artificial Sequence
  Synthetic Polynucleotide
taatacgactcactatagggtggtaatccagaagtggggaggccaggggaaacagaggagatcccctatgctccccactaacctggcggcagcgcaaaagatg

SEQ ID NO: 232921 - DNA, 103 bp, Artificial Sequence
  Synthetic Polynucleotide
taatacgactcactatagggcggagatgttcttattgctaagaattttccaacagaggagaggaaaaatgttagcaataaacctggcggcagcgcaaaagatg

SEQ ID NO: 232922 - DNA, 103 bp, Artificial Sequence
  Synthetic Polynucleotide
taatacgactcactatagggacggtttatttggtaatccagaagtggggaaacagaggagatccccaatgctggattacaacctggcggcagcgcaaaagatg

SEQ ID NO: 232923 - DNA, 103 bp, Artificial Sequence
  Synthetic Polynucleotide
taatacgactcactataggggacgctgaggacggtttatttggtaatccaaacagaggagatggattatgaaataaaccaacctggcggcagcgcaaaagatg

SEQ ID NO: 232924 - DNA, 103 bp, Artificial Sequence
  Synthetic Polynucleotide
taatacgactcactatagggggagctcagcgacgctgaggacggtttattaacagaggagaaataaaatgtcctcagcgaacctggcggcagcgcaaaagatg

SEQ ID NO: 232925 - DNA, 103 bp, Artificial Sequence
  Synthetic Polynucleotide
taatacgactcactatagggctggggttggggagctcagcgacgctgaggaacagaggagacctcagatgcgctgagctaacctggcggcagcgcaaaagatg

SEQ ID NO: 232926 - DNA, 103 bp, Artificial Sequence
  Synthetic Polynucleotide
taatacgactcactataggggtggcttgtgctggggttggggagctcagcaacagaggagagctgagatgcccaaccccaacctggcggcagcgcaaaagatg

SEQ ID NO: 232927 - DNA, 103 bp, Artificial Sequence
  Synthetic Polynucleotide
taatacgactcactatagggcatcgccatcgtggcttgtgctggggttggaacagaggagaccaaccatggcacaagccaacctggcggcagcgcaaaagatg

SEQ ID NO: 232928 - DNA, 103 bp, Artificial Sequence
  Synthetic Polynucleotide
taatacgactcactataggggctgagggcccatcgccatcgtggcttgtgaacagaggagacacaagatgcgatggcgaaacctggcggcagcgcaaaagatg

SEQ ID NO: 232929 - DNA, 103 bp, Artificial Sequence
  Synthetic Polynucleotide
taatacgactcactatagggtgggggggttgctgagggcccatcgccatcaacagaggagagatggcatggggccctcaaacctggcggcagcgcaaaagatg

SEQ ID NO: 232930 - DNA, 103 bp, Artificial Sequence
  Synthetic Polynucleotide
taatacgactcactatagggctgctgctgctgggggggttgctgagggccaacagaggagaggccctatgcaaccccccaacctggcggcagcgcaaaagatg

SEQ ID NO: 232931 - DNA, 103 bp, Artificial Sequence
  Synthetic Polynucleotide
taatacgactcactataggggctgctgctgctgctgctgctgggggggttaacagaggagaaaccccatgagcagcagcaacctggcggcagcgcaaaagatg

SEQ ID NO: 232932 - DNA, 103 bp, Artificial Sequence
  Synthetic Polynucleotide
taatacgactcactatagggtggatgatagcggagatgttcttattgctaaacagaggagatagcaaatggaacatctcaacctggcggcagcgcaaaagatg

SEQ ID NO: 232933 - DNA, 103 bp, Artificial Sequence
  Synthetic Polynucleotide
taatacgactcactatagggacctgtggttgctgctgctgctgctgctgcaacagaggagagcagcaatggcagcagcaaacctggcggcagcgcaaaagatg

SEQ ID NO: 232934 - DNA, 103 bp, Artificial Sequence
  Synthetic Polynucleotide
taatacgactcactatagggaggctgctgcacctgtggttgctgctgctgaacagaggagacagcagatgcaaccacagaacctggcggcagcgcaaaagatg

SEQ ID NO: 232935 - DNA, 103 bp, Artificial Sequence
  Synthetic Polynucleotide
taatacgactcactataggggcggcgggggaggctgctgcacctgtggttaacagaggagaaaccacatgtgcagcagcaacctggcggcagcgcaaaagatg

SEQ ID NO: 232936 - DNA, 103 bp, Artificial Sequence
  Synthetic Polynucleotide
taatacgactcactatagggtgggctgctggcggcgggggaggctgctgcaacagaggagagcagcaatgtcccccgccaacctggcggcagcgcaaaagatg

SEQ ID NO: 232937 - DNA, 103 bp, Artificial Sequence
  Synthetic Polynucleotide
taatacgactcactataggggggtggcggctgggctgctggcggcgggggaacagaggagacccccgatgccagcagccaacctggcggcagcgcaaaagatg

SEQ ID NO: 232938 - DNA, 103 bp, Artificial Sequence
  Synthetic Polynucleotide
taatacgactcactataggggctgtggtgtgggtggcggctgggctgctgaacagaggagacagcagatgagccgccacaacctggcggcagcgcaaaagatg

SEQ ID NO: 232939 - DNA, 103 bp, Artificial Sequence
  Synthetic Polynucleotide
taatacgactcactatagggtgcagtgggagctgtggtgtgggtggcggcaacagaggagagccgccatgcacaccacaaacctggcggcagcgcaaaagatg

SEQ ID NO: 232940 - DNA, 103 bp, Artificial Sequence
  Synthetic Polynucleotide
taatacgactcactatagggctgctgctgttgcagtgggagctgtggtgtaacagaggagaacaccaatgctcccactgaacctggcggcagcgcaaaagatg

SEQ ID NO: 232941 - DNA, 103 bp, Artificial Sequence
  Synthetic Polynucleotide
taatacgactcactatagggccttgcgttgctgctgctgttgcagtgggaaacagaggagatcccacatgaacagcagcaacctggcggcagcgcaaaagatg

SEQ ID NO: 232942 - DNA, 103 bp, Artificial Sequence
  Synthetic Polynucleotide
taatacgactcactatagggctgtctttgtccttgcgttgctgctgctgtaacagaggagaacagcaatggcaacgcaaaacctggcggcagcgcaaaagatg

SEQ ID NO: 232943 - DNA, 103 bp, Artificial Sequence
  Synthetic Polynucleotide
taatacgactcactataggggccgatcccttggatgatagcggagatgttaacagaggagaaacatcatggctatcatcaacctggcggcagcgcaaaagatg

SEQ ID NO: 232944 - DNA, 103 bp, Artificial Sequence
  Synthetic Polynucleotide
taatacgactcactatagggtactttctcactgtctttgtccttgcgttgaacagaggagacaacgcatggacaaagacaacctggcggcagcgcaaaagatg

SEQ ID NO: 232945 - DNA, 103 bp, Artificial Sequence
  Synthetic Polynucleotide
taatacgactcactatagggccttctcctttactttctcactgtctttgtaacagaggagaacaaagatggtgagaaagaacctggcggcagcgcaaaagatg

SEQ ID NO: 232946 - DNA, 103 bp, Artificial Sequence
  Synthetic Polynucleotide
taatacgactcactatagggtgtgccttttccttctcctttactttctcaaacagaggagatgagaaatgaaaggagaaaacctggcggcagcgcaaaagatg

SEQ ID NO: 232947 - DNA, 103 bp, Artificial Sequence
  Synthetic Polynucleotide
taatacgactcactatagggtttccctttgtgtgccttttccttctccttaacagaggagaaaggagatggaaaaggcaaacctggcggcagcgcaaaagatg

SEQ ID NO: 232948 - DNA, 103 bp, Artificial Sequence
  Synthetic Polynucleotide
taatacgactcactatagggggggttcccctttccctttgtgtgccttttaacagaggagaaaaaggatgacaaagggaaacctggcggcagcgcaaaagatg

SEQ ID NO: 232949 - DNA, 103 bp, Artificial Sequence
  Synthetic Polynucleotide
taatacgactcactataggggggacaggcaggggttcccctttccctttgaacagaggagacaaaggatgaggggaaccaacctggcggcagcgcaaaagatg

SEQ ID NO: 232950 - DNA, 103 bp, Artificial Sequence
  Synthetic Polynucleotide
taatacgactcactatagggctccttcttggggacaggcaggggttccccaacagaggagaggggaaatgctgcctgtcaacctggcggcagcgcaaaagatg

SEQ ID NO: 232951 - DNA, 103 bp, Artificial Sequence
  Synthetic Polynucleotide
taatacgactcactatagggcctctcctttctccttcttggggacaggcaaacagaggagatgcctgatgccaagaaggaacctggcggcagcgcaaaagatg

SEQ ID NO: 232952 - DNA, 103 bp, Artificial Sequence
  Synthetic Polynucleotide
taatacgactcactataggggccgtgggggcctctcctttctccttcttgaacagaggagacaagaaatggaaaggagaaacctggcggcagcgcaaaagatg

SEQ ID NO: 232953 - DNA, 103 bp, Artificial Sequence
  Synthetic Polynucleotide
taatacgactcactatagggggctgcagttgccgtgggggcctctcctttaacagaggagaaaaggaatggcccccacgaacctggcggcagcgcaaaagatg

SEQ ID NO: 232954 - DNA, 103 bp, Artificial Sequence
  Synthetic Polynucleotide
taatacgactcactatagggccttgtctttgccgatcccttggatgatagaacagaggagactatcaatgaagggatcgaacctggcggcagcgcaaaagatg

SEQ ID NO: 232955 - DNA, 103 bp, Artificial Sequence
  Synthetic Polynucleotide
taatacgactcactatagggctgagatcgtggctgcagttgccgtgggggaacagaggagacccccaatgcaactgcagaacctggcggcagcgcaaaagatg

SEQ ID NO: 232956 - DNA, 103 bp, Artificial Sequence
  Synthetic Polynucleotide
taatacgactcactatagggggcagcggggctgagatcgtggctgcagttaacagaggagaaactgcatgcacgatctcaacctggcggcagcgcaaaagatg

SEQ ID NO: 232957 - DNA, 103 bp, Artificial Sequence
  Synthetic Polynucleotide
taatacgactcactatagggctccatggtgggcagcggggctgagatcgtaacagaggagaacgatcatggccccgctgaacctggcggcagcgcaaaagatg

SEQ ID NO: 232958 - DNA, 103 bp, Artificial Sequence
  Synthetic Polynucleotide
taatacgactcactatagggctaccgcatactccatggtgggcagcggggaacagaggagaccccgcatgccaccatggaacctggcggcagcgcaaaagatg

SEQ ID NO: 232959 - DNA, 103 bp, Artificial Sequence
  Synthetic Polynucleotide
taatacgactcactatagggtgtgcagggtctaccgcatactccatggtgaacagaggagacaccatatggtatgcggtaacctggcggcagcgcaaaagatg

SEQ ID NO: 232960 - DNA, 103 bp, Artificial Sequence
  Synthetic Polynucleotide
taatacgactcactatagggggcctgcagctgtgcagggtctaccgcataaacagaggagatatgcgatggaccctgcaaacctggcggcagcgcaaaagatg

SEQ ID NO: 232961 - DNA, 103 bp, Artificial Sequence
  Synthetic Polynucleotide
taatacgactcactatagggcggcctgcagggcctgcagctgtgcagggtaacagaggagaaccctgatgagctgcaggaacctggcggcagcgcaaaagatg

SEQ ID NO: 232962 - DNA, 103 bp, Artificial Sequence
  Synthetic Polynucleotide
taatacgactcactataggggaagtcaacgcggcctgcagggcctgcagcaacagaggagagctgcaatgcctgcaggcaacctggcggcagcgcaaaagatg

SEQ ID NO: 232963 - DNA, 103 bp, Artificial Sequence
  Synthetic Polynucleotide
taatacgactcactatagggtgtggggtccgaagtcaacgcggcctgcagaacagaggagactgcagatggcgttgactaacctggcggcagcgcaaaagatg

SEQ ID NO: 232964 - DNA, 103 bp, Artificial Sequence
  Synthetic Polynucleotide
taatacgactcactatagggtgagcaatgctgtggggtccgaagtcaacgaacagaggagacgttgaatgcggaccccaaacctggcggcagcgcaaaagatg

SEQ ID NO: 232965 - DNA, 103 bp, Artificial Sequence
  Synthetic Polynucleotide
taatacgactcactatagggacaaggggttccttgtctttgccgatccctaacagaggagaagggatatgcaaagacaaaacctggcggcagcgcaaaagatg

SEQ ID NO: 232966 - DNA, 103 bp, Artificial Sequence
  Synthetic Polynucleotide
taatacgactcactatagggaactggcttgtgagcaatgctgtggggtccaacagaggagaggacccatgagcattgctaacctggcggcagcgcaaaagatg

SEQ ID NO: 232967 - DNA, 103 bp, Artificial Sequence
  Synthetic Polynucleotide
taatacgactcactataggggtaaggaaggaactggcttgtgagcaatgcaacagaggagagcattgatgacaagccagaacctggcggcagcgcaaaagatg

SEQ ID NO: 232968 - DNA, 103 bp, Artificial Sequence
  Synthetic Polynucleotide
taatacgactcactatagggctggtacaaagtaaggaaggaactggcttgaacagaggagacaagccatgtccttccttaacctggcggcagcgcaaaagatg

SEQ ID NO: 232969 - DNA, 103 bp, Artificial Sequence
  Synthetic Polynucleotide
taatacgactcactatagggggagaaaagcctggtacaaagtaaggaaggaacagaggagaccttccatgctttgtaccaacctggcggcagcgcaaaagatg

SEQ ID NO: 232970 - DNA, 103 bp, Artificial Sequence
  Synthetic Polynucleotide
taatacgactcactatagggagcataataaggagaaaagcctggtacaaaaacagaggagatttgtaatgggcttttctaacctggcggcagcgcaaaagatg

SEQ ID NO: 232971 - DNA, 103 bp, Artificial Sequence
  Synthetic Polynucleotide
taatacgactcactatagggggatctggggagcataataaggagaaaagcaacagaggagagcttttatgcttattatgaacctggcggcagcgcaaaagatg

SEQ ID NO: 232972 - DNA, 103 bp, Artificial Sequence
  Synthetic Polynucleotide
taatacgactcactatagggagggcgccagggatctggggagcataataaaacagaggagattattaatgtccccagataacctggcggcagcgcaaaagatg

SEQ ID NO: 232973 - DNA, 103 bp, Artificial Sequence
  Synthetic Polynucleotide
taatacgactcactatagggcccgctctgcagggcgccagggatctggggaacagaggagaccccagatgcctggcgccaacctggcggcagcgcaaaagatg

SEQ ID NO: 232974 - DNA, 103 bp, Artificial Sequence
  Synthetic Polynucleotide
taatacgactcactataggggctgcaggtacccgctctgcagggcgccagaacagaggagactggcgatgtgcagagcgaacctggcggcagcgcaaaagatg

SEQ ID NO: 232975 - DNA, 103 bp, Artificial Sequence
  Synthetic Polynucleotide
taatacgactcactatagggccatacataggctgcaggtacccgctctgcaacagaggagagcagagatggtacctgcaaacctggcggcagcgcaaaagatg

SEQ ID NO: 232976 - DNA, 103 bp, Artificial Sequence
  Synthetic Polynucleotide
taatacgactcactatagggtgagataggaggggagtcacaggtttccataacagaggagaatggaaatgtgtgactccaacctggcggcagcgcaaaagatg

SEQ ID NO: 232977 - DNA, 103 bp, Artificial Sequence
  Synthetic Polynucleotide
taatacgactcactatagggaggctccatccctgcaactttctctggcacaacagaggagagtgccaatgaaagttgcaaacctggcggcagcgcaaaagatg

SEQ ID NO: 232978 - DNA, 103 bp, Artificial Sequence
  Synthetic Polynucleotide
taatacgactcactatagggtttttttggttccagaaagcttataagaggaacagaggagacctcttatgagctttctgaacctggcggcagcgcaaaagatg

SEQ ID NO: 232979 - DNA, 103 bp, Artificial Sequence
  Synthetic Polynucleotide
taatacgactcactatagggctgttcttgctgttgcttttgctgcttttgaacagaggagacaaaagatgcaaaagcaaaacctggcggcagcgcaaaagatg

SEQ ID NO: 232980 - DNA, 103 bp, Artificial Sequence
  Synthetic Polynucleotide
taatacgactcactataggggtttctgctgctgttcttgctgttgcttttaacagaggagaaaaagcatgagcaagaacaacctggcggcagcgcaaaagatg

SEQ ID NO: 232981 - DNA, 103 bp, Artificial Sequence
  Synthetic Polynucleotide
taatacgactcactataggggcctgaactggtttctgctgctgttcttgcaacagaggagagcaagaatggcagcagaaaacctggcggcagcgcaaaagatg

SEQ ID NO: 232982 - DNA, 103 bp, Artificial Sequence
  Synthetic Polynucleotide
taatacgactcactatagggggatgtctttgcctgaactggtttctgctgaacagaggagacagcagatgccagttcagaacctggcggcagcgcaaaagatg

SEQ ID NO: 232983 - DNA, 103 bp, Artificial Sequence
  Synthetic Polynucleotide
taatacgactcactatagggtttctactttggatgtctttgcctgaactgaacagaggagacagttcatgcaaagacataacctggcggcagcgcaaaagatg

SEQ ID NO: 232984 - DNA, 103 bp, Artificial Sequence
  Synthetic Polynucleotide
taatacgactcactatagggggctggtcactttctactttggatgtctttaacagaggagaaaagacatgcaaagtagaaacctggcggcagcgcaaaagatg

SEQ ID NO: 232985 - DNA, 103 bp, Artificial Sequence
  Synthetic Polynucleotide
taatacgactcactatagggggagttttgcggctggtcactttctactttaacagaggagaaaagtaatgagtgaccagaacctggcggcagcgcaaaagatg

SEQ ID NO: 232986 - DNA, 103 bp, Artificial Sequence
  Synthetic Polynucleotide
taatacgactcactatagggaagcatcgttggagttttgcggctggtcacaacagaggagagtgaccatgcgcaaaactaacctggcggcagcgcaaaagatg

SEQ ID NO: 232987 - DNA, 103 bp, Artificial Sequence
  Synthetic Polynucleotide
taatacgactcactatagggtttgtttctgaagcatcgttggagttttgcaacagaggagagcaaaaatgcaacgatgcaacctggcggcagcgcaaaagatg

SEQ ID NO: 232988 - DNA, 103 bp, Artificial Sequence
  Synthetic Polynucleotide
taatacgactcactatagggtttgtcttcctttgtttctgaagcatcgttaacagaggagaaacgatatgtcagaaacaaacctggcggcagcgcaaaagatg

SEQ ID NO: 232989 - DNA, 103 bp, Artificial Sequence
  Synthetic Polynucleotide
taatacgactcactatagggcagaagtggatttttttggttccagaaagcaacagaggagagctttcatgaaccaaaaaaacctggcggcagcgcaaaagatg

SEQ ID NO: 232990 - DNA, 103 bp, Artificial Sequence
  Synthetic Polynucleotide
taatacgactcactatagggtagcagtacttttgtcttcctttgtttctgaacagaggagacagaaaatgaggaagacaaacctggcggcagcgcaaaagatg

SEQ ID NO: 232991 - DNA, 103 bp, Artificial Sequence
  Synthetic Polynucleotide
taatacgactcactataggggtgctttctgtagcagtacttttgtcttccaacagaggagaggaagaatgaagtactgcaacctggcggcagcgcaaaagatg

SEQ ID NO: 232992 - DNA, 103 bp, Artificial Sequence
  Synthetic Polynucleotide
taatacgactcactatagggttcttcttttgtgctttctgtagcagtactaacagaggagaagtactatgacagaaagcaacctggcggcagcgcaaaagatg

SEQ ID NO: 232993 - DNA, 103 bp, Artificial Sequence
  Synthetic Polynucleotide
taatacgactcactatagggctaactggggttcttcttttgtgctttctgaacagaggagacagaaaatgcaaaagaagaacctggcggcagcgcaaaagatg

SEQ ID NO: 232994 - DNA, 103 bp, Artificial Sequence
  Synthetic Polynucleotide
taatacgactcactatagggcttttggattctaactggggttcttcttttaacagaggagaaaaagaatgaccccagttaacctggcggcagcgcaaaagatg

SEQ ID NO: 232995 - DNA, 103 bp, Artificial Sequence
  Synthetic Polynucleotide
taatacgactcactatagggaaagtctgcacttttggattctaactggggaacagaggagaccccagatggaatccaaaaacctggcggcagcgcaaaagatg

SEQ ID NO: 232996 - DNA, 103 bp, Artificial Sequence
  Synthetic Polynucleotide
taatacgactcactatagggaagtgtctgaaaagtctgcacttttggattaacagaggagaaatccaatggtgcagactaacctggcggcagcgcaaaagatg

SEQ ID NO: 232997 - DNA, 103 bp, Artificial Sequence
  Synthetic Polynucleotide
taatacgactcactatagggggaacaacgtaagtgtctgaaaagtctgcaaacagaggagatgcagaatgttcagacacaacctggcggcagcgcaaaagatg

SEQ ID NO: 232998 - DNA, 103 bp, Artificial Sequence
  Synthetic Polynucleotide
taatacgactcactatagggcttgacgaatggaacaacgtaagtgtctgaaacagaggagatcagacatgtacgttgttaacctggcggcagcgcaaaagatg

SEQ ID NO: 232999 - DNA, 103 bp, Artificial Sequence
  Synthetic Polynucleotide
taatacgactcactatagggtaaactcatacttgacgaatggaacaacgtaacagaggagaacgttgatgcattcgtcaaacctggcggcagcgcaaaagatg

SEQ ID NO: 233000 - DNA, 103 bp, Artificial Sequence
  Synthetic Polynucleotide
taatacgactcactatagggtggggataaacagaagtggatttttttggtaacagaggagaaccaaaatgatccacttcaacctggcggcagcgcaaaagatg

SEQ ID NO: 233001 - DNA, 103 bp, Artificial Sequence
  Synthetic Polynucleotide
taatacgactcactatagggtttctgcatataaactcatacttgacgaataacagaggagaattcgtatggtatgagttaacctggcggcagcgcaaaagatg

SEQ ID NO: 233002 - DNA, 103 bp, Artificial Sequence
  Synthetic Polynucleotide
taatacgactcactatagggcatctggcactttctgcatataaactcataaacagaggagatatgagatgatatgcagaaacctggcggcagcgcaaaagatg

SEQ ID NO: 233003 - DNA, 103 bp, Artificial Sequence
  Synthetic Polynucleotide
taatacgactcactatagggcagtaaacatcatctggcactttctgcataaacagaggagatatgcaatgagtgccagaaacctggcggcagcgcaaaagatg

SEQ ID NO: 233004 - DNA, 103 bp, Artificial Sequence
  Synthetic Polynucleotide
taatacgactcactataggggcgtcttcatcagtaaacatcatctggcacaacagaggagagtgccaatggatgtttacaacctggcggcagcgcaaaagatg

SEQ ID NO: 233005 - DNA, 103 bp, Artificial Sequence
  Synthetic Polynucleotide
taatacgactcactatagggatttactgcggcgtcttcatcagtaaacataacagaggagaatgtttatggatgaagacaacctggcggcagcgcaaaagatg

SEQ ID NO: 233006 - DNA, 103 bp, Artificial Sequence
  Synthetic Polynucleotide
taatacgactcactatagggacttttgatgatttactgcggcgtcttcataacagaggagaatgaagatgccgcagtaaaacctggcggcagcgcaaaagatg

SEQ ID NO: 233007 - DNA, 103 bp, Artificial Sequence
  Synthetic Polynucleotide
taatacgactcactatagggtaacagaaggacttttgatgatttactgcgaacagaggagacgcagtatgtcatcaaaaaacctggcggcagcgcaaaagatg

SEQ ID NO: 233008 - DNA, 103 bp, Artificial Sequence
  Synthetic Polynucleotide
taatacgactcactatagggctgaccgaaataacagaaggacttttgatgaacagaggagacatcaaatgtccttctgtaacctggcggcagcgcaaaagatg

SEQ ID NO: 233009 - DNA, 103 bp, Artificial Sequence
  Synthetic Polynucleotide
taatacgactcactatagggcaatcaaaggctgaccgaaataacagaaggaacagaggagaccttctatgatttcggtcaacctggcggcagcgcaaaagatg

SEQ ID NO: 233010 - DNA, 103 bp, Artificial Sequence
  Synthetic Polynucleotide
taatacgactcactatagggtcttgtgggtcaatcaaaggctgaccgaaaaacagaggagatttcggatggcctttgataacctggcggcagcgcaaaagatg

SEQ ID NO: 233011 - DNA, 103 bp, Artificial Sequence
  Synthetic Polynucleotide
taatacgactcactatagggagtagaaaaatggggataaacagaagtggaaacagaggagatccactatggtttatcccaacctggcggcagcgcaaaagatg

SEQ ID NO: 233012 - DNA, 103 bp, Artificial Sequence
  Synthetic Polynucleotide
taatacgactcactatagggaagcactgtctcttgtgggtcaatcaaaggaacagaggagacctttgatggacccacaaaacctggcggcagcgcaaaagatg

SEQ ID NO: 233013 - DNA, 103 bp, Artificial Sequence
  Synthetic Polynucleotide
taatacgactcactatagggctgggacacgaagcactgtctcttgtgggtaacagaggagaacccacatgagacagtgcaacctggcggcagcgcaaaagatg

SEQ ID NO: 233014 - DNA, 103 bp, Artificial Sequence
  Synthetic Polynucleotide
taatacgactcactatagggtatttgctgactgggacacgaagcactgtcaacagaggagagacagtatgtcgtgtcccaacctggcggcagcgcaaaagatg

SEQ ID NO: 233015 - DNA, 103 bp, Artificial Sequence
  Synthetic Polynucleotide
taatacgactcactatagggaagacactgatatttgctgactgggacacgaacagaggagacgtgtcatggtcagcaaaaacctggcggcagcgcaaaagatg

SEQ ID NO: 233016 - DNA, 103 bp, Artificial Sequence
  Synthetic Polynucleotide
taatacgactcactatagggcatcacaggcaagacactgatatttgctgaaacagaggagatcagcaatgatcagtgtcaacctggcggcagcgcaaaagatg

SEQ ID NO: 233017 - DNA, 103 bp, Artificial Sequence
  Synthetic Polynucleotide
taatacgactcactatagggctgatagccacatcacaggcaagacactgaaacagaggagatcagtgatgtgcctgtgaaacctggcggcagcgcaaaagatg

SEQ ID NO: 233018 - DNA, 103 bp, Artificial Sequence
  Synthetic Polynucleotide
taatacgactcactatagggttcattcccactgatagccacatcacaggcaacagaggagagcctgtatggtggctatcaacctggcggcagcgcaaaagatg

SEQ ID NO: 233019 - DNA, 103 bp, Artificial Sequence
  Synthetic Polynucleotide
taatacgactcactatagggggctaagtgcttcattcccactgatagccaaacagaggagatggctaatggtgggaatgaacctggcggcagcgcaaaagatg

SEQ ID NO: 233020 - DNA, 103 bp, Artificial Sequence
  Synthetic Polynucleotide
taatacgactcactatagggtggaggtgttggctaagtgcttcattcccaaacagaggagatgggaaatgagcacttagaacctggcggcagcgcaaaagatg

SEQ ID NO: 233021 - DNA, 103 bp, Artificial Sequence
  Synthetic Polynucleotide
taatacgactcactatagggcaagcttgactggaggtgttggctaagtgcaacagaggagagcacttatgcaacacctcaacctggcggcagcgcaaaagatg

SEQ ID NO: 233022 - DNA, 103 bp, Artificial Sequence
  Synthetic Polynucleotide
taatacgactcactatagggtgaggtttgtagtagaaaaatggggataaaaacagaggagatttatcatgatttttctaaacctggcggcagcgcaaaagatg

SEQ ID NO: 233023 - DNA, 103 bp, Artificial Sequence
  Synthetic Polynucleotide
taatacgactcactatagggtctctttgtgcaagcttgactggaggtgttaacagaggagaaacaccatgagtcaagctaacctggcggcagcgcaaaagatg

SEQ ID NO: 233024 - DNA, 103 bp, Artificial Sequence
  Synthetic Polynucleotide
taatacgactcactatagggttgattgttttctctttgtgcaagcttgacaacagaggagagtcaagatggcacaaagaaacctggcggcagcgcaaaagatg

SEQ ID NO: 233025 - DNA, 103 bp, Artificial Sequence
  Synthetic Polynucleotide
taatacgactcactatagggcattgcttgtttgattgttttctctttgtgaacagaggagacacaaaatgaaaacaatcaacctggcggcagcgcaaaagatg

SEQ ID NO: 233026 - DNA, 103 bp, Artificial Sequence
  Synthetic Polynucleotide
taatacgactcactatagggtggcatttctcattgcttgtttgattgtttaacagaggagaaaacaaatgaacaagcaaaacctggcggcagcgcaaaagatg

SEQ ID NO: 233027 - DNA, 103 bp, Artificial Sequence
  Synthetic Polynucleotide
taatacgactcactatagggacatgctctttggcatttctcattgcttgtaacagaggagaacaagcatggagaaatgcaacctggcggcagcgcaaaagatg

SEQ ID NO: 233028 - DNA, 103 bp, Artificial Sequence
  Synthetic Polynucleotide
taatacgactcactatagggtaataatctaacatgctctttggcatttctaacagaggagaagaaatatgaaagagcataacctggcggcagcgcaaaagatg

SEQ ID NO: 233029 - DNA, 103 bp, Artificial Sequence
  Synthetic Polynucleotide
taatacgactcactatagggctgagtgaggtaataatctaacatgctcttaacagaggagaaagagcatgttagattataacctggcggcagcgcaaaagatg

SEQ ID NO: 233030 - DNA, 103 bp, Artificial Sequence
  Synthetic Polynucleotide
taatacgactcactatagggggggagcagactgagtgaggtaataatctaaacagaggagatagattatgacctcactcaacctggcggcagcgcaaaagatg

SEQ ID NO: 233031 - DNA, 103 bp, Artificial Sequence
  Synthetic Polynucleotide
taatacgactcactataggggttaggattaggggagcagactgagtgaggaacagaggagacctcacatggtctgctccaacctggcggcagcgcaaaagatg

SEQ ID NO: 233032 - DNA, 103 bp, Artificial Sequence
  Synthetic Polynucleotide
taatacgactcactatagggtagatgtggtgttaggattaggggagcagaaacagaggagatctgctatgctaatcctaaacctggcggcagcgcaaaagatg

SEQ ID NO: 233033 - DNA, 103 bp, Artificial Sequence
  Synthetic Polynucleotide
taatacgactcactatagggtcgggtcctatgaggtttgtagtagaaaaaaacagaggagatttttcatgtacaaacctaacctggcggcagcgcaaaagatg

SEQ ID NO: 233034 - DNA, 103 bp, Artificial Sequence
  Synthetic Polynucleotide
taatacgactcactataggggactgcgaggtagatgtggtgttaggattaaacagaggagataatccatgcaccacatcaacctggcggcagcgcaaaagatg

SEQ ID NO: 233035 - DNA, 103 bp, Artificial Sequence
  Synthetic Polynucleotide
taatacgactcactatagggagaagctgcagactgcgaggtagatgtggtaacagaggagaaccacaatgacctcgcagaacctggcggcagcgcaaaagatg

SEQ ID NO: 233036 - DNA, 103 bp, Artificial Sequence
  Synthetic Polynucleotide
taatacgactcactatagggtgttattagaagaagctgcagactgcgaggaacagaggagacctcgcatgctgcagcttaacctggcggcagcgcaaaagatg

SEQ ID NO: 233037 - DNA, 103 bp, Artificial Sequence
  Synthetic Polynucleotide
taatacgactcactatagggtgaggataggtgttattagaagaagctgcaaacagaggagatgcagcatgttctaataaaacctggcggcagcgcaaaagatg

SEQ ID NO: 233038 - DNA, 103 bp, Artificial Sequence
  Synthetic Polynucleotide
taatacgactcactataggggcaagaaagatgaggataggtgttattagaaacagaggagatctaatatgacctatcctaacctggcggcagcgcaaaagatg

SEQ ID NO: 233039 - DNA, 103 bp, Artificial Sequence
  Synthetic Polynucleotide
taatacgactcactatagggtcatggagaagcaagaaagatgaggataggaacagaggagacctatcatgatctttcttaacctggcggcagcgcaaaagatg

SEQ ID NO: 233040 - DNA, 103 bp, Artificial Sequence
  Synthetic Polynucleotide
taatacgactcactatagggggccaggacttcatggagaagcaagaaagaaacagaggagatctttcatgcttctccataacctggcggcagcgcaaaagatg

SEQ ID NO: 233041 - DNA, 103 bp, Artificial Sequence
  Synthetic Polynucleotide
taatacgactcactatagggaaggatattaggccaggacttcatggagaaaacagaggagattctccatgaagtcctggaacctggcggcagcgcaaaagatg

SEQ ID NO: 233042 - DNA, 103 bp, Artificial Sequence
  Synthetic Polynucleotide
taatacgactcactatagggacgcttggaaaaggatattaggccaggactaacagaggagaagtcctatgctaatatccaacctggcggcagcgcaaaagatg

SEQ ID NO: 233043 - DNA, 103 bp, Artificial Sequence
  Synthetic Polynucleotide
taatacgactcactatagggctcctggcagacgcttggaaaaggatattaaacagaggagataatatatgtttccaagcaacctggcggcagcgcaaaagatg

SEQ ID NO: 233044 - DNA, 103 bp, Artificial Sequence
  Synthetic Polynucleotide
taatacgactcactataggggaaggttggatcgggtcctatgaggtttgtaacagaggagaacaaacatgataggacccaacctggcggcagcgcaaaagatg

SEQ ID NO: 233045 - DNA, 103 bp, Artificial Sequence
  Synthetic Polynucleotide
taatacgactcactatagggagaagcagctctcctggcagacgcttggaaaacagaggagattccaaatgtctgccaggaacctggcggcagcgcaaaagatg

SEQ ID NO: 233046 - DNA, 103 bp, Artificial Sequence
  Synthetic Polynucleotide
taatacgactcactatagggaagaagggggagaagcagctctcctggcagaacagaggagactgccaatggagctgcttaacctggcggcagcgcaaaagatg

SEQ ID NO: 233047 - DNA, 103 bp, Artificial Sequence
  Synthetic Polynucleotide
taatacgactcactataggggaaggaggagaagaagggggagaagcagctaacagaggagaagctgcatgtcccccttcaacctggcggcagcgcaaaagatg

SEQ ID NO: 233048 - DNA, 103 bp, Artificial Sequence
  Synthetic Polynucleotide
taatacgactcactatagggcaaggaaagggaaggaggagaagaagggggaacagaggagaccccctatgtctcctcctaacctggcggcagcgcaaaagatg

SEQ ID NO: 233049 - DNA, 103 bp, Artificial Sequence
  Synthetic Polynucleotide
taatacgactcactatagggccgttgaaggcaaggaaagggaaggaggagaacagaggagactcctcatgccctttcctaacctggcggcagcgcaaaagatg

SEQ ID NO: 233050 - DNA, 103 bp, Artificial Sequence
  Synthetic Polynucleotide
taatacgactcactatagggcttgaggtaaccgttgaaggcaaggaaaggaacagaggagacctttcatggccttcaacaacctggcggcagcgcaaaagatg

SEQ ID NO: 233051 - DNA, 103 bp, Artificial Sequence
  Synthetic Polynucleotide
taatacgactcactataggggctgcacaaacttgaggtaaccgttgaaggaacagaggagaccttcaatggttacctcaaacctggcggcagcgcaaaagatg

SEQ ID NO: 233052 - DNA, 103 bp, Artificial Sequence
  Synthetic Polynucleotide
taatacgactcactatagggcccctgaggtgctgcacaaacttgaggtaaaacagaggagattacctatggtttgtgcaaacctggcggcagcgcaaaagatg

SEQ ID NO: 233053 - DNA, 103 bp, Artificial Sequence
  Synthetic Polynucleotide
taatacgactcactataggggaggtttgaacccctgaggtgctgcacaaaaacagaggagatttgtgatgcacctcaggaacctggcggcagcgcaaaagatg

SEQ ID NO: 233054 - DNA, 103 bp, Artificial Sequence
  Synthetic Polynucleotide
taatacgactcactatagggtgtgggtagtgaggtttgaacccctgaggtaacagaggagaacctcaatggttcaaaccaacctggcggcagcgcaaaagatg

SEQ ID NO: 233055 - DNA, 103 bp, Artificial Sequence
  Synthetic Polynucleotide
taatacgactcactatagggataaaccgcggaaggttggatcgggtcctaaacagaggagataggacatgatccaacctaacctggcggcagcgcaaaagatg

SEQ ID NO: 233056 - DNA, 103 bp, Artificial Sequence
  Synthetic Polynucleotide
taatacgactcactatagggaacaactttctgtgggtagtgaggtttgaaaacagaggagattcaaaatgcactacccaaacctggcggcagcgcaaaagatg

SEQ ID NO: 233057 - DNA, 103 bp, Artificial Sequence
  Synthetic Polynucleotide
taatacgactcactataggggactcatctgaacaactttctgtgggtagtaacagaggagaactaccatgagaaagttgaacctggcggcagcgcaaaagatg

SEQ ID NO: 233058 - DNA, 103 bp, Artificial Sequence
  Synthetic Polynucleotide
taatacgactcactatagggctcactgtcagactcatctgaacaactttcaacagaggagagaaagtatgtcagatgagaacctggcggcagcgcaaaagatg

SEQ ID NO: 233059 - DNA, 103 bp, Artificial Sequence
  Synthetic Polynucleotide
taatacgactcactatagggtctggctcagctcactgtcagactcatctgaacagaggagacagatgatgctgacagtgaacctggcggcagcgcaaaagatg

SEQ ID NO: 233060 - DNA, 103 bp, Artificial Sequence
  Synthetic Polynucleotide
taatacgactcactatagggtcttctagcttctggctcagctcactgtcaaacagaggagatgacagatggctgagccaaacctggcggcagcgcaaaagatg

SEQ ID NO: 233061 - DNA, 103 bp, Artificial Sequence
  Synthetic Polynucleotide
taatacgactcactatagggattatctaagtcttctagcttctggctcagaacagaggagactgagcatgaagctagaaaacctggcggcagcgcaaaagatg

SEQ ID NO: 233062 - DNA, 103 bp, Artificial Sequence
  Synthetic Polynucleotide
taatacgactcactatagggcttccaaagaattatctaagtcttctagctaacagaggagaagctagatgacttagataaacctggcggcagcgcaaaagatg

SEQ ID NO: 233063 - DNA, 103 bp, Artificial Sequence
  Synthetic Polynucleotide
taatacgactcactatagggttagccttcacttccaaagaattatctaagaacagaggagacttagaatgttctttggaaacctggcggcagcgcaaaagatg

SEQ ID NO: 233064 - DNA, 103 bp, Artificial Sequence
  Synthetic Polynucleotide
taatacgactcactatagggagaagcaggcttagccttcacttccaaagaaacagaggagatctttgatggtgaaggctaacctggcggcagcgcaaaagatg

SEQ ID NO: 233065 - DNA, 103 bp, Artificial Sequence
  Synthetic Polynucleotide
taatacgactcactatagggcatctaggccagaagcaggcttagccttcaaacagaggagatgaaggatgagcctgcttaacctggcggcagcgcaaaagatg

SEQ ID NO: 233066 - DNA, 103 bp, Artificial Sequence
  Synthetic Polynucleotide
taatacgactcactatagggaaagcgctccataaaccgcggaaggttggaaacagaggagatccaacatgccgcggtttaacctggcggcagcgcaaaagatg

SEQ ID NO: 233067 - DNA, 103 bp, Artificial Sequence
  Synthetic Polynucleotide
taatacgactcactatagggttgaaattaccatctaggccagaagcaggcaacagaggagagcctgcatgtggcctagaaacctggcggcagcgcaaaagatg

SEQ ID NO: 233068 - DNA, 103 bp, Artificial Sequence
  Synthetic Polynucleotide
taatacgactcactatagggtcggatgctattgaaattaccatctaggccaacagaggagaggcctaatgggtaatttcaacctggcggcagcgcaaaagatg

SEQ ID NO: 233069 - DNA, 103 bp, Artificial Sequence
  Synthetic Polynucleotide
taatacgactcactatagggacatatccattcggatgctattgaaattacaacagaggagagtaattatgatagcatccaacctggcggcagcgcaaaagatg

SEQ ID NO: 233070 - DNA, 103 bp, Artificial Sequence
  Synthetic Polynucleotide
taatacgactcactatagggtacacactgaacatatccattcggatgctaaacagaggagatagcatatgaatggatataacctggcggcagcgcaaaagatg

SEQ ID NO: 233071 - DNA, 103 bp, Artificial Sequence
  Synthetic Polynucleotide
taatacgactcactatagggttcaacatgaaaagcgctccataaaccgcgaacagaggagacgcggtatgtggagcgctaacctggcggcagcgcaaaagatg

SEQ ID NO: 233072 - DNA, 103 bp, Artificial Sequence
  Synthetic Polynucleotide
taatacgactcactatagggtttccctgtcaggctccatccctgcaacttaacagaggagaaagttgatgggatggagcaacctggcggcagcgcaaaagatg

SEQ ID NO: 233073 - DNA, 103 bp, Artificial Sequence
  Synthetic Polynucleotide
taatacgactcactatagggagtcaccattttcaacatgaaaagcgctccaacagaggagaggagcgatgttcatgttgaacctggcggcagcgcaaaagatg

SEQ ID NO: 233074 - DNA, 103 bp, Artificial Sequence
  Synthetic Polynucleotide
taatacgactcactataggggccggcaaagagtcaccattttcaacatgaaacagaggagatcatgtatgaaatggtgaaacctggcggcagcgcaaaagatg

SEQ ID NO: 233075 - DNA, 103 bp, Artificial Sequence
  Synthetic Polynucleotide
taatacgactcactatagggggcaaagccagccggcaaagagtcaccattaacagaggagaaatggtatgtctttgccgaacctggcggcagcgcaaaagatg

SEQ ID NO: 233076 - DNA, 103 bp, Artificial Sequence
  Synthetic Polynucleotide
taatacgactcactatagggcttttaagaaggcaaagccagccggcaaagaacagaggagactttgcatgctggctttgaacctggcggcagcgcaaaagatg

SEQ ID NO: 233077 - DNA, 103 bp, Artificial Sequence
  Synthetic Polynucleotide
taatacgactcactatagggctcgcgcttccttttaagaaggcaaagccaaacagaggagatggcttatgcttcttaaaaacctggcggcagcgcaaaagatg

SEQ ID NO: 233078 - DNA, 103 bp, Artificial Sequence
  Synthetic Polynucleotide
taatacgactcactataggggctcgaggtgctcgcgcttccttttaagaaaacagaggagattcttaatgggaagcgcgaacctggcggcagcgcaaaagatg

SEQ ID NO: 233079 - DNA, 103 bp, Artificial Sequence
  Synthetic Polynucleotide
taatacgactcactataggggctctgctgagctcgaggtgctcgcgcttcaacagaggagagaagcgatggcacctcgaaacctggcggcagcgcaaaagatg

SEQ ID NO: 233080 - DNA, 103 bp, Artificial Sequence
  Synthetic Polynucleotide
taatacgactcactatagggcccagcggctgctctgctgagctcgaggtgaacagaggagacacctcatgctcagcagaaacctggcggcagcgcaaaagatg

SEQ ID NO: 233081 - DNA, 103 bp, Artificial Sequence
  Synthetic Polynucleotide
taatacgactcactatagggttgggtaatccccagcggctgctctgctgaaacagaggagatcagcaatgcagccgctgaacctggcggcagcgcaaaagatg

SEQ ID NO: 233082 - DNA, 103 bp, Artificial Sequence
  Synthetic Polynucleotide
taatacgactcactatagggcctttggcatttgggtaatccccagcggctaacagaggagaagccgcatgggattacccaacctggcggcagcgcaaaagatg

SEQ ID NO: 233083 - DNA, 103 bp, Artificial Sequence
  Synthetic Polynucleotide
taatacgactcactataggggtggagctgttttccctgtcaggctccatcaacagaggagagatggaatgtgacagggaaacctggcggcagcgcaaaagatg

SEQ ID NO: 233084 - DNA, 103 bp, Artificial Sequence
  Synthetic Polynucleotide
taatacgactcactatagggttcacttcagcctttggcatttgggtaatcaacagaggagagattacatgaatgccaaaaacctggcggcagcgcaaaagatg

SEQ ID NO: 233085 - DNA, 103 bp, Artificial Sequence
  Synthetic Polynucleotide
taatacgactcactatagggcccccccagattcacttcagcctttggcataacagaggagaatgccaatggctgaagtgaacctggcggcagcgcaaaagatg

SEQ ID NO: 233086 - DNA, 103 bp, Artificial Sequence
  Synthetic Polynucleotide
taatacgactcactatagggaactagacagcccccccagattcacttcagaacagaggagactgaagatgatctgggggaacctggcggcagcgcaaaagatg

SEQ ID NO: 233087 - DNA, 103 bp, Artificial Sequence
  Synthetic Polynucleotide
taatacgactcactatagggttcactactaaactagacagcccccccagaaacagaggagatctgggatggctgtctagaacctggcggcagcgcaaaagatg

SEQ ID NO: 233088 - DNA, 103 bp, Artificial Sequence
  Synthetic Polynucleotide
taatacgactcactatagggaattggggtgttcactactaaactagacagaacagaggagactgtctatgttagtagtgaacctggcggcagcgcaaaagatg

SEQ ID NO: 233089 - DNA, 103 bp, Artificial Sequence
  Synthetic Polynucleotide
taatacgactcactatagggagacagaggtaattggggtgttcactactaaacagaggagatagtagatgacaccccaaaacctggcggcagcgcaaaagatg

SEQ ID NO: 233090 - DNA, 103 bp, Artificial Sequence
  Synthetic Polynucleotide
taatacgactcactatagggtggctgagggagacagaggtaattggggtgaacagaggagacaccccatgtacctctgtaacctggcggcagcgcaaaagatg

SEQ ID NO: 233091 - DNA, 103 bp, Artificial Sequence
  Synthetic Polynucleotide
taatacgactcactatagggagacgatgagtggctgagggagacagaggtaacagaggagaacctctatgtccctcagcaacctggcggcagcgcaaaagatg

SEQ ID NO: 233092 - DNA, 103 bp, Artificial Sequence
  Synthetic Polynucleotide
taatacgactcactatagggtgctagactcagacgatgagtggctgagggaacagaggagaccctcaatgactcatcgtaacctggcggcagcgcaaaagatg

SEQ ID NO: 233093 - DNA, 103 bp, Artificial Sequence
  Synthetic Polynucleotide
taatacgactcactatagggtctgacatcttgctagactcagacgatgagaacagaggagactcatcatgtgagtctagaacctggcggcagcgcaaaagatg

SEQ ID NO: 233094 - DNA, 103 bp, Artificial Sequence
  Synthetic Polynucleotide
taatacgactcactataggggttgtcatctgtggagctgttttccctgtcaacagaggagagacaggatgaacagctccaacctggcggcagcgcaaaagatg

SEQ ID NO: 233095 - DNA, 103 bp, Artificial Sequence
  Synthetic Polynucleotide
taatacgactcactataggggtctttgctctctgacatcttgctagactcaacagaggagagagtctatgaagatgtcaaacctggcggcagcgcaaaagatg

SEQ ID NO: 233096 - DNA, 103 bp, Artificial Sequence
  Synthetic Polynucleotide
taatacgactcactatagggtgttctcttggtctttgctctctgacatctaacagaggagaagatgtatgagagcaaagaacctggcggcagcgcaaaagatg

SEQ ID NO: 233097 - DNA, 103 bp, Artificial Sequence
  Synthetic Polynucleotide
taatacgactcactatagggctttcacagttgttctcttggtctttgctcaacagaggagagagcaaatgccaagagaaaacctggcggcagcgcaaaagatg

SEQ ID NO: 233098 - DNA, 103 bp, Artificial Sequence
  Synthetic Polynucleotide
taatacgactcactatagggttcttttggcctttcacagttgttctcttgaacagaggagacaagagatgaactgtgaaaacctggcggcagcgcaaaagatg

SEQ ID NO: 233099 - DNA, 103 bp, Artificial Sequence
  Synthetic Polynucleotide
taatacgactcactatagggaaacgttgctttcttttggcctttcacagtaacagaggagaactgtgatgggccaaaagaacctggcggcagcgcaaaagatg

SEQ ID NO: 233100 - DNA, 103 bp, Artificial Sequence
  Synthetic Polynucleotide
taatacgactcactatagggtttgggtgtaaaacgttgctttcttttggcaacagaggagagccaaaatgaagcaacgtaacctggcggcagcgcaaaagatg

SEQ ID NO: 233101 - DNA, 103 bp, Artificial Sequence
  Synthetic Polynucleotide
taatacgactcactataggggcactccccgtttgggtgtaaaacgttgctaacagaggagaagcaacatgttacacccaaacctggcggcagcgcaaaagatg

SEQ ID NO: 233102 - DNA, 103 bp, Artificial Sequence
  Synthetic Polynucleotide
taatacgactcactatagggttttgacagggcactccccgtttgggtgtaaacagaggagatacaccatgacggggagtaacctggcggcagcgcaaaagatg

SEQ ID NO: 233103 - DNA, 103 bp, Artificial Sequence
  Synthetic Polynucleotide
taatacgactcactataggggtgggttcacttttgacagggcactccccgaacagaggagacggggaatgccctgtcaaaacctggcggcagcgcaaaagatg

SEQ ID NO: 233104 - DNA, 103 bp, Artificial Sequence
  Synthetic Polynucleotide
taatacgactcactatagggtcccggttcagtgggttcacttttgacaggaacagaggagacctgtcatgagtgaacccaacctggcggcagcgcaaaagatg

SEQ ID NO: 233105 - DNA, 103 bp, Artificial Sequence
  Synthetic Polynucleotide
taatacgactcactatagggccgttttcaggttgtcatctgtggagctgtaacagaggagaacagctatgcagatgacaaacctggcggcagcgcaaaagatg

SEQ ID NO: 233106 - DNA, 103 bp, Artificial Sequence
  Synthetic Polynucleotide
taatacgactcactatagggcatcctcatctcccggttcagtgggttcacaacagaggagagtgaacatgctgaaccggaacctggcggcagcgcaaaagatg

SEQ ID NO: 233107 - DNA, 103 bp, Artificial Sequence
  Synthetic Polynucleotide
taatacgactcactataggggcatcttcttcatcctcatctcccggttcaaacagaggagatgaaccatgagatgaggaaacctggcggcagcgcaaaagatg

SEQ ID NO: 233108 - DNA, 103 bp, Artificial Sequence
  Synthetic Polynucleotide
taatacgactcactatagggattggagtacgcatcttcttcatcctcatcaacagaggagagatgagatggaagaagataacctggcggcagcgcaaaagatg

SEQ ID NO: 233109 - DNA, 103 bp, Artificial Sequence
  Synthetic Polynucleotide
taatacgactcactatagggcatcaagttcattggagtacgcatcttcttaacagaggagaaagaagatgcgtactccaaacctggcggcagcgcaaaagatg

SEQ ID NO: 233110 - DNA, 103 bp, Artificial Sequence
  Synthetic Polynucleotide
taatacgactcactatagggacttcctcgtcatcaagttcattggagtacaacagaggagagtactcatgtgaacttgaaacctggcggcagcgcaaaagatg

SEQ ID NO: 233111 - DNA, 103 bp, Artificial Sequence
  Synthetic Polynucleotide
taatacgactcactatagggttcacctaatacttcctcgtcatcaagttcaacagaggagagaacttatggacgaggaaaacctggcggcagcgcaaaagatg

SEQ ID NO: 233112 - DNA, 103 bp, Artificial Sequence
  Synthetic Polynucleotide
taatacgactcactatagggtatcggtgagttcacctaatacttcctcgtaacagaggagaacgaggatgtattaggtgaacctggcggcagcgcaaaagatg

SEQ ID NO: 233113 - DNA, 103 bp, Artificial Sequence
  Synthetic Polynucleotide
taatacgactcactatagggttaccaatactatcggtgagttcacctaataacagaggagaattaggatgactcaccgaaacctggcggcagcgcaaaagatg

SEQ ID NO: 233114 - DNA, 103 bp, Artificial Sequence
  Synthetic Polynucleotide
taatacgactcactataggggaaatctttgttaccaatactatcggtgagaacagaggagactcaccatgagtattggtaacctggcggcagcgcaaaagatg

SEQ ID NO: 233115 - DNA, 103 bp, Artificial Sequence
  Synthetic Polynucleotide
taatacgactcactatagggttaagagagggaaatctttgttaccaatacaacagaggagagtattgatgacaaagattaacctggcggcagcgcaaaagatg

SEQ ID NO: 233116 - DNA, 103 bp, Artificial Sequence
  Synthetic Polynucleotide
taatacgactcactatagggttgcgctcatccgttttcaggttgtcatctaacagaggagaagatgaatgcctgaaaacaacctggcggcagcgcaaaagatg

SEQ ID NO: 233117 - DNA, 103 bp, Artificial Sequence
  Synthetic Polynucleotide
taatacgactcactatagggatgctttggtttaagagagggaaatctttgaacagaggagacaaagaatgccctctcttaacctggcggcagcgcaaaagatg

SEQ ID NO: 233118 - DNA, 103 bp, Artificial Sequence
  Synthetic Polynucleotide
taatacgactcactatagggtaaaggagaaatgctttggtttaagagaggaacagaggagacctctcatgaaccaaagcaacctggcggcagcgcaaaagatg

SEQ ID NO: 233119 - DNA, 103 bp, Artificial Sequence
  Synthetic Polynucleotide
taatacgactcactatagggcactggatgataaaggagaaatgctttggtaacagaggagaaccaaaatgtttctccttaacctggcggcagcgcaaaagatg

SEQ ID NO: 233120 - DNA, 103 bp, Artificial Sequence
  Synthetic Polynucleotide
taatacgactcactatagggaattttagcacactggatgataaaggagaaaacagaggagattctccatgatcatccagaacctggcggcagcgcaaaagatg

SEQ ID NO: 233121 - DNA, 103 bp, Artificial Sequence
  Synthetic Polynucleotide
taatacgactcactatagggcttttcaataaattttagcacactggatgaaacagaggagatcatccatggtgctaaaaaacctggcggcagcgcaaaagatg

SEQ ID NO: 233122 - DNA, 103 bp, Artificial Sequence
  Synthetic Polynucleotide
taatacgactcactatagggacgaggtacccttttcaataaattttagcaaacagaggagatgctaaatgttattgaaaaacctggcggcagcgcaaaagatg

SEQ ID NO: 233123 - DNA, 103 bp, Artificial Sequence
  Synthetic Polynucleotide
taatacgactcactataggggccgaggaggacgaggtacccttttcaataaacagaggagatattgaatggggtacctcaacctggcggcagcgcaaaagatg

SEQ ID NO: 233124 - DNA, 103 bp, Artificial Sequence
  Synthetic Polynucleotide
taatacgactcactatagggagaaacagtcgccgaggaggacgaggtaccaacagaggagaggtaccatgtcctcctcgaacctggcggcagcgcaaaagatg

SEQ ID NO: 233125 - DNA, 103 bp, Artificial Sequence
  Synthetic Polynucleotide
taatacgactcactatagggctgtgtcatcagaaacagtcgccgaggaggaacagaggagacctcctatgcgactgtttaacctggcggcagcgcaaaagatg

SEQ ID NO: 233126 - DNA, 103 bp, Artificial Sequence
  Synthetic Polynucleotide
taatacgactcactatagggtttttcttttctgtgtcatcagaaacagtcaacagaggagagactgtatgtgatgacacaacctggcggcagcgcaaaagatg

SEQ ID NO: 233127 - DNA, 103 bp, Artificial Sequence
  Synthetic Polynucleotide
taatacgactcactatagggggcttcacttttgcgctcatccgttttcagaacagaggagactgaaaatggatgagcgcaacctggcggcagcgcaaaagatg

SEQ ID NO: 233128 - DNA, 103 bp, Artificial Sequence
  Synthetic Polynucleotide
taatacgactcactatagggagcagtctgttttttcttttctgtgtcatcaacagaggagagatgacatggaaaagaaaaacctggcggcagcgcaaaagatg

SEQ ID NO: 233129 - DNA, 103 bp, Artificial Sequence
  Synthetic Polynucleotide
taatacgactcactatagggccctaacagcagcagtctgttttttcttttaacagaggagaaaaagaatgaacagactgaacctggcggcagcgcaaaagatg

SEQ ID NO: 233130 - DNA, 103 bp, Artificial Sequence
  Synthetic Polynucleotide
taatacgactcactatagggctgccactggccctaacagcagcagtctgtaacagaggagaacagacatgtgctgttagaacctggcggcagcgcaaaagatg

SEQ ID NO: 233131 - DNA, 103 bp, Artificial Sequence
  Synthetic Polynucleotide
taatacgactcactatagggactagcaacactgccactggccctaacagcaacagaggagagctgttatggccagtggcaacctggcggcagcgcaaaagatg

SEQ ID NO: 233132 - DNA, 103 bp, Artificial Sequence
  Synthetic Polynucleotide
taatacgactcactatagggtgccatagttactagcaacactgccactggaacagaggagaccagtgatggtgttgctaaacctggcggcagcgcaaaagatg

SEQ ID NO: 233133 - DNA, 103 bp, Artificial Sequence
  Synthetic Polynucleotide
taatacgactcactatagggttgccactgatgccatagttactagcaacaaacagaggagatgttgcatgtaactatggaacctggcggcagcgcaaaagatg

SEQ ID NO: 233134 - DNA, 103 bp, Artificial Sequence
  Synthetic Polynucleotide
taatacgactcactatagggtgcaaagtccttgccactgatgccatagttaacagaggagaaactatatgatcagtggcaacctggcggcagcgcaaaagatg

SEQ ID NO: 233135 - DNA, 103 bp, Artificial Sequence
  Synthetic Polynucleotide
taatacgactcactatagggcacttgcgtctgcaaagtccttgccactgaaacagaggagatcagtgatgaggactttgaacctggcggcagcgcaaaagatg

SEQ ID NO: 233136 - DNA, 103 bp, Artificial Sequence
  Synthetic Polynucleotide
taatacgactcactatagggtctttactggcacttgcgtctgcaaagtccaacagaggagaggacttatgagacgcaagaacctggcggcagcgcaaaagatg

SEQ ID NO: 233137 - DNA, 103 bp, Artificial Sequence
  Synthetic Polynucleotide
taatacgactcactatagggtgtggcactgtctttactggcacttgcgtcaacagaggagagacgcaatggccagtaaaaacctggcggcagcgcaaaagatg

SEQ ID NO: 233138 - DNA, 103 bp, Artificial Sequence
  Synthetic Polynucleotide
taatacgactcactatagggaacccagcaaggcttcacttttgcgctcataacagaggagaatgagcatgaaagtgaagaacctggcggcagcgcaaaagatg

SEQ ID NO: 233139 - DNA, 103 bp, Artificial Sequence
  Synthetic Polynucleotide
taatacgactcactataggggatgagcagctgtggcactgtctttactggaacagaggagaccagtaatgacagtgccaaacctggcggcagcgcaaaagatg

SEQ ID NO: 233140 - DNA, 103 bp, Artificial Sequence
  Synthetic Polynucleotide
taatacgactcactatagggatttcacttggatgagcagctgtggcactgaacagaggagacagtgcatgagctgctcaaacctggcggcagcgcaaaagatg

SEQ ID NO: 233141 - DNA, 103 bp, Artificial Sequence
  Synthetic Polynucleotide
taatacgactcactatagggtccccgggctatttcacttggatgagcagcaacagaggagagctgctatgccaagtgaaaacctggcggcagcgcaaaagatg

SEQ ID NO: 233142 - DNA, 103 bp, Artificial Sequence
  Synthetic Polynucleotide
taatacgactcactatagggtgtcttcgtctccccgggctatttcacttgaacagaggagacaagtgatgtagcccgggaacctggcggcagcgcaaaagatg

SEQ ID NO: 233143 - DNA, 103 bp, Artificial Sequence
  Synthetic Polynucleotide
taatacgactcactataggggtggctgaactgtcttcgtctccccgggctaacagaggagaagcccgatgagacgaagaaacctggcggcagcgcaaaagatg

SEQ ID NO: 233144 - DNA, 103 bp, Artificial Sequence
  Synthetic Polynucleotide
taatacgactcactatagggctggtgaggagtggctgaactgtcttcgtcaacagaggagagacgaaatgagttcagccaacctggcggcagcgcaaaagatg

SEQ ID NO: 233145 - DNA, 103 bp, Artificial Sequence
  Synthetic Polynucleotide
taatacgactcactatagggtaaagccatgctggtgaggagtggctgaacaacagaggagagttcagatgctcctcaccaacctggcggcagcgcaaaagatg

SEQ ID NO: 233146 - DNA, 103 bp, Artificial Sequence
  Synthetic Polynucleotide
taatacgactcactataggggtactcggggtaaagccatgctggtgaggaaacagaggagatcctcaatggcatggcttaacctggcggcagcgcaaaagatg

SEQ ID NO: 233147 - DNA, 103 bp, Artificial Sequence
  Synthetic Polynucleotide
taatacgactcactatagggtgtgccaggagtactcggggtaaagccatgaacagaggagacatggcatgaccccgagtaacctggcggcagcgcaaaagatg

SEQ ID NO: 233148 - DNA, 103 bp, Artificial Sequence
  Synthetic Polynucleotide
taatacgactcactatagggcaggccctggtgtgccaggagtactcggggaacagaggagaccccgaatgctcctggcaaacctggcggcagcgcaaaagatg

SEQ ID NO: 233149 - DNA, 103 bp, Artificial Sequence
  Synthetic Polynucleotide
taatacgactcactatagggtcaacgctgaaacccagcaaggcttcacttaacagaggagaaagtgaatgcttgctgggaacctggcggcagcgcaaaagatg

SEQ ID NO: 233150 - DNA, 103 bp, Artificial Sequence
  Synthetic Polynucleotide
taatacgactcactatagggccgtctcctccaggccctggtgtgccaggaaacagaggagatcctggatgaccagggccaacctggcggcagcgcaaaagatg

SEQ ID NO: 233151 - DNA, 103 bp, Artificial Sequence
  Synthetic Polynucleotide
taatacgactcactataggggcccggtgagccgtctcctccaggccctggaacagaggagaccagggatgggaggagacaacctggcggcagcgcaaaagatg

SEQ ID NO: 233152 - DNA, 103 bp, Artificial Sequence
  Synthetic Polynucleotide
taatacgactcactatagggcgatgccactgcccggtgagccgtctcctcaacagaggagagaggagatggctcaccggaacctggcggcagcgcaaaagatg

SEQ ID NO: 233153 - DNA, 103 bp, Artificial Sequence
  Synthetic Polynucleotide
taatacgactcactatagggtttggacactcgatgccactgcccggtgagaacagaggagactcaccatgcagtggcataacctggcggcagcgcaaaagatg

SEQ ID NO: 233154 - DNA, 103 bp, Artificial Sequence
  Synthetic Polynucleotide
taatacgactcactatagggagtgtcgcactttggacactcgatgccactaacagaggagaagtggcatggagtgtccaaacctggcggcagcgcaaaagatg

SEQ ID NO: 233155 - DNA, 103 bp, Artificial Sequence
  Synthetic Polynucleotide
taatacgactcactatagggaccccaacacagtgtcgcactttggacactaacagaggagaagtgtcatgagtgcgacaaacctggcggcagcgcaaaagatg

SEQ ID NO: 233156 - DNA, 103 bp, Artificial Sequence
  Synthetic Polynucleotide
taatacgactcactataggggacctcgaagaccccaacacagtgtcgcacaacagaggagagtgcgaatgtgtgttgggaacctggcggcagcgcaaaagatg

SEQ ID NO: 233157 - DNA, 103 bp, Artificial Sequence
  Synthetic Polynucleotide
taatacgactcactatagggaccaccaagagacctcgaagaccccaacacaacagaggagagtgttgatgtcttcgaggaacctggcggcagcgcaaaagatg

SEQ ID NO: 233158 - DNA, 103 bp, Artificial Sequence
  Synthetic Polynucleotide
taatacgactcactatagggtagtcatatgaccaccaagagacctcgaagaacagaggagacttcgaatgctcttggtgaacctggcggcagcgcaaaagatg

SEQ ID NO: 233159 - DNA, 103 bp, Artificial Sequence
  Synthetic Polynucleotide
taatacgactcactataggggagtgcatcatagtcatatgaccaccaagaaacagaggagatcttggatgtcatatgacaacctggcggcagcgcaaaagatg

SEQ ID NO: 233160 - DNA, 103 bp, Artificial Sequence
  Synthetic Polynucleotide
taatacgactcactatagggagctgcattctcaacgctgaaacccagcaaaacagaggagattgctgatgttcagcgttaacctggcggcagcgcaaaagatg

SEQ ID NO: 233161 - DNA, 103 bp, Artificial Sequence
  Synthetic Polynucleotide
taatacgactcactatagggtgagttcctcgagtgcatcatagtcatatgaacagaggagacatatgatgatgatgcacaacctggcggcagcgcaaaagatg

SEQ ID NO: 233162 - DNA, 103 bp, Artificial Sequence
  Synthetic Polynucleotide
taatacgactcactataggggggttttgcatgagttcctcgagtgcatcaaacagaggagatgatgcatgcgaggaactaacctggcggcagcgcaaaagatg

SEQ ID NO: 233163 - DNA, 103 bp, Artificial Sequence
  Synthetic Polynucleotide
taatacgactcactatagggggacatttgagggttttgcatgagttcctcaacagaggagagaggaaatgatgcaaaacaacctggcggcagcgcaaaagatg

SEQ ID NO: 233164 - DNA, 103 bp, Artificial Sequence
  Synthetic Polynucleotide
taatacgactcactataggggttacatttaggacatttgagggttttgcaaacagaggagatgcaaaatgctcaaatgtaacctggcggcagcgcaaaagatg

SEQ ID NO: 233165 - DNA, 103 bp, Artificial Sequence
  Synthetic Polynucleotide
taatacgactcactatagggtgtagtgccagttacatttaggacatttgaaacagaggagatcaaatatgctaaatgtaaacctggcggcagcgcaaaagatg

SEQ ID NO: 233166 - DNA, 103 bp, Artificial Sequence
  Synthetic Polynucleotide
taatacgactcactatagggtgctgatatttgtagtgccagttacatttaaacagaggagataaatgatgctggcactaaacctggcggcagcgcaaaagatg

SEQ ID NO: 233167 - DNA, 103 bp, Artificial Sequence
  Synthetic Polynucleotide
taatacgactcactatagggctccagggtctgctgatatttgtagtgccaaacagaggagatggcacatgaaatatcagaacctggcggcagcgcaaaagatg

SEQ ID NO: 233168 - DNA, 103 bp, Artificial Sequence
  Synthetic Polynucleotide
taatacgactcactatagggtcatatgggcctccagggtctgctgatattaacagaggagaaatatcatgagaccctggaacctggcggcagcgcaaaagatg

SEQ ID NO: 233169 - DNA, 103 bp, Artificial Sequence
  Synthetic Polynucleotide
taatacgactcactatagggtgtttctccttcatatgggcctccagggtcaacagaggagagaccctatgggcccatataacctggcggcagcgcaaaagatg

SEQ ID NO: 233170 - DNA, 103 bp, Artificial Sequence
  Synthetic Polynucleotide
taatacgactcactatagggcggctcagggtgtttctccttcatatgggcaacagaggagagcccatatgaaggagaaaaacctggcggcagcgcaaaagatg

SEQ ID NO: 233171 - DNA, 103 bp, Artificial Sequence
  Synthetic Polynucleotide
taatacgactcactatagggtttcctgccttgagataggaggggagtcacaacagaggagagtgactatgctcctatctaacctggcggcagcgcaaaagatg

SEQ ID NO: 233172 - DNA, 103 bp, Artificial Sequence
  Synthetic Polynucleotide
taatacgactcactatagggcctgagtggcagctgcattctcaacgctgaaacagaggagatcagcgatgagaatgcagaacctggcggcagcgcaaaagatg

SEQ ID NO: 233173 - DNA, 103 bp, Artificial Sequence
  Synthetic Polynucleotide
taatacgactcactatagggaagagccacccggctcagggtgtttctcctaacagaggagaaggagaatgaccctgagcaacctggcggcagcgcaaaagatg

SEQ ID NO: 233174 - DNA, 103 bp, Artificial Sequence
  Synthetic Polynucleotide
taatacgactcactatagggcaataaacacaagagccacccggctcagggaacagaggagaccctgaatggggtggctcaacctggcggcagcgcaaaagatg

SEQ ID NO: 233175 - DNA, 103 bp, Artificial Sequence
  Synthetic Polynucleotide
taatacgactcactatagggtccagtcttacaataaacacaagagccaccaacagaggagaggtggcatgtgtgtttataacctggcggcagcgcaaaagatg

SEQ ID NO: 233176 - DNA, 103 bp, Artificial Sequence
  Synthetic Polynucleotide
taatacgactcactatagggggtgaggctgtccagtcttacaataaacacaacagaggagagtgtttatggtaagactgaacctggcggcagcgcaaaagatg

SEQ ID NO: 233177 - DNA, 103 bp, Artificial Sequence
  Synthetic Polynucleotide
taatacgactcactataggggcaagcctggggtgaggctgtccagtcttaaacagaggagataagacatgacagcctcaaacctggcggcagcgcaaaagatg

SEQ ID NO: 233178 - DNA, 103 bp, Artificial Sequence
  Synthetic Polynucleotide
taatacgactcactatagggctcaccccgggcaagcctggggtgaggctgaacagaggagacagcctatgcccaggcttaacctggcggcagcgcaaaagatg

SEQ ID NO: 233179 - DNA, 103 bp, Artificial Sequence
  Synthetic Polynucleotide
taatacgactcactatagggacgtgtaactctcaccccgggcaagcctggaacagaggagaccaggcatgcccggggtgaacctggcggcagcgcaaaagatg

SEQ ID NO: 233180 - DNA, 103 bp, Artificial Sequence
  Synthetic Polynucleotide
taatacgactcactatagggttatagccacacgtgtaactctcaccccggaacagaggagaccggggatggagttacacaacctggcggcagcgcaaaagatg

SEQ ID NO: 233181 - DNA, 103 bp, Artificial Sequence
  Synthetic Polynucleotide
taatacgactcactatagggacggaagggtttatagccacacgtgtaactaacagaggagaagttacatgtgtggctataacctggcggcagcgcaaaagatg

SEQ ID NO: 233182 - DNA, 103 bp, Artificial Sequence
  Synthetic Polynucleotide
taatacgactcactatagggaaacctcacaacggaagggtttatagccacaacagaggagagtggctatgaacccttccaacctggcggcagcgcaaaagatg

SEQ ID NO: 233183 - DNA, 103 bp, Artificial Sequence
  Synthetic Polynucleotide
taatacgactcactataggggctgaggtaacctgagtggcagctgcattcaacagaggagagaatgcatgtgccactcaaacctggcggcagcgcaaaagatg

SEQ ID NO: 233184 - DNA, 103 bp, Artificial Sequence
  Synthetic Polynucleotide
taatacgactcactataggggagtagttacaaacctcacaacggaagggtaacagaggagaacccttatgttgtgaggtaacctggcggcagcgcaaaagatg

SEQ ID NO: 233185 - DNA, 103 bp, Artificial Sequence
  Synthetic Polynucleotide
taatacgactcactatagggggtagtggtagagtagttacaaacctcacaaacagaggagatgtgagatgtgtaactacaacctggcggcagcgcaaaagatg

SEQ ID NO: 233186 - DNA, 103 bp, Artificial Sequence
  Synthetic Polynucleotide
taatacgactcactatagggggttgcctttggtagtggtagagtagttacaacagaggagagtaactatgctaccactaaacctggcggcagcgcaaaagatg

SEQ ID NO: 233187 - DNA, 103 bp, Artificial Sequence
  Synthetic Polynucleotide
taatacgactcactatagggtgaatactgaggttgcctttggtagtggtaaacagaggagataccacatgcaaaggcaaaacctggcggcagcgcaaaagatg

SEQ ID NO: 233188 - DNA, 103 bp, Artificial Sequence
  Synthetic Polynucleotide
taatacgactcactatagggcgactgcatatgaatactgaggttgcctttaacagaggagaaaaggcatgctcagtattaacctggcggcagcgcaaaagatg

SEQ ID NO: 233189 - DNA, 103 bp, Artificial Sequence
  Synthetic Polynucleotide
taatacgactcactatagggggtgcttgtccgactgcatatgaatactgaaacagaggagatcagtaatgatatgcagtaacctggcggcagcgcaaaagatg

SEQ ID NO: 233190 - DNA, 103 bp, Artificial Sequence
  Synthetic Polynucleotide
taatacgactcactatagggacattgttcaggtgcttgtccgactgcataaacagaggagatatgcaatgggacaagcaaacctggcggcagcgcaaaagatg

SEQ ID NO: 233191 - DNA, 103 bp, Artificial Sequence
  Synthetic Polynucleotide
taatacgactcactataggggagattctgaacattgttcaggtgcttgtcaacagaggagagacaagatgctgaacaataacctggcggcagcgcaaaagatg

SEQ ID NO: 233192 - DNA, 103 bp, Artificial Sequence
  Synthetic Polynucleotide
taatacgactcactatagggtgccattttggagattctgaacattgttcaaacagaggagatgaacaatgttcagaatcaacctggcggcagcgcaaaagatg

SEQ ID NO: 233193 - DNA, 103 bp, Artificial Sequence
  Synthetic Polynucleotide
taatacgactcactatagggtgctcaccattgccattttggagattctgaaacagaggagatcagaaatgccaaaatggaacctggcggcagcgcaaaagatg

SEQ ID NO: 233194 - DNA, 103 bp, Artificial Sequence
  Synthetic Polynucleotide
taatacgactcactatagggtatctcctttgctgaggtaacctgagtggcaacagaggagagccactatggttacctcaaacctggcggcagcgcaaaagatg

SEQ ID NO: 233195 - DNA, 103 bp, Artificial Sequence
  Synthetic Polynucleotide
taatacgactcactataggggccaaacacctgctcaccattgccattttgaacagaggagacaaaatatgaatggtgagaacctggcggcagcgcaaaagatg

SEQ ID NO: 233196 - DNA, 103 bp, Artificial Sequence
  Synthetic Polynucleotide
taatacgactcactataggggggcagagtggccaaacacctgctcaccataacagaggagaatggtgatgaggtgtttgaacctggcggcagcgcaaaagatg

SEQ ID NO: 233197 - DNA, 103 bp, Artificial Sequence
  Synthetic Polynucleotide
taatacgactcactatagggttgggggctggggcagagtggccaaacaccaacagaggagaggtgttatgccactctgcaacctggcggcagcgcaaaagatg

SEQ ID NO: 233198 - DNA, 103 bp, Artificial Sequence
  Synthetic Polynucleotide
taatacgactcactataggggaggctggtgttgggggctggggcagagtgaacagaggagacactctatgccagcccccaacctggcggcagcgcaaaagatg

SEQ ID NO: 233199 - DNA, 103 bp, Artificial Sequence
  Synthetic Polynucleotide
taatacgactcactatagggcgcagccactgaggctggtgttgggggctgaacagaggagacagcccatgacaccagccaacctggcggcagcgcaaaagatg

SEQ ID NO: 233200 - DNA, 103 bp, Artificial Sequence
  Synthetic Polynucleotide
taatacgactcactataggggagggtgttccgcagccactgaggctggtgaacagaggagacaccagatgcagtggctgaacctggcggcagcgcaaaagatg

SEQ ID NO: 233201 - DNA, 103 bp, Artificial Sequence
  Synthetic Polynucleotide
taatacgactcactatagggtttggacggagagggtgttccgcagccactaacagaggagaagtggcatgggaacacccaacctggcggcagcgcaaaagatg

SEQ ID NO: 233202 - DNA, 103 bp, Artificial Sequence
  Synthetic Polynucleotide
taatacgactcactatagggtctgtttgggtttggacggagagggtgttcaacagaggagagaacacatgctccgtccaaacctggcggcagcgcaaaagatg

SEQ ID NO: 233203 - DNA, 103 bp, Artificial Sequence
  Synthetic Polynucleotide
taatacgactcactatagggcaggtgggtttctgtttgggtttggacggaaacagaggagatccgtcatgacccaaacaaacctggcggcagcgcaaaagatg

SEQ ID NO: 233204 - DNA, 103 bp, Artificial Sequence
  Synthetic Polynucleotide
taatacgactcactatagggttcacaccgccaggtgggtttctgtttgggaacagaggagacccaaaatgaaacccaccaacctggcggcagcgcaaaagatg

SEQ ID NO: 233205 - DNA, 103 bp, Artificial Sequence
  Synthetic Polynucleotide
taatacgactcactatagggcgttgcagggtatctcctttgctgaggtaaaacagaggagattacctatgcaaaggagaaacctggcggcagcgcaaaagatg

SEQ ID NO: 233206 - DNA, 103 bp, Artificial Sequence
  Synthetic Polynucleotide
taatacgactcactatagggaatcacaaacttcacaccgccaggtgggttaacagaggagaaacccaatgggcggtgtgaacctggcggcagcgcaaaagatg

SEQ ID NO: 233207 - DNA, 103 bp, Artificial Sequence
  Synthetic Polynucleotide
taatacgactcactatagggttggtttcataatcacaaacttcacaccgcaacagaggagagcggtgatgagtttgtgaaacctggcggcagcgcaaaagatg

SEQ ID NO: 233208 - DNA, 103 bp, Artificial Sequence
  Synthetic Polynucleotide
taatacgactcactatagggcctggcgacattggtttcataatcacaaacaacagaggagagtttgtatgtatgaaaccaacctggcggcagcgcaaaagatg

SEQ ID NO: 233209 - DNA, 103 bp, Artificial Sequence
  Synthetic Polynucleotide
taatacgactcactatagggttcggaggttcctggcgacattggtttcataacagaggagaatgaaaatgatgtcgccaaacctggcggcagcgcaaaagatg

SEQ ID NO: 233210 - DNA, 103 bp, Artificial Sequence
  Synthetic Polynucleotide
taatacgactcactataggggtcatatgaattcggaggttcctggcgacaaacagaggagatgtcgcatggaacctccgaacctggcggcagcgcaaaagatg

SEQ ID NO: 233211 - DNA, 103 bp, Artificial Sequence
  Synthetic Polynucleotide
taatacgactcactatagggcttttcgctggtcatatgaattcggaggttaacagaggagaaacctcatgattcatatgaacctggcggcagcgcaaaagatg

SEQ ID NO: 233212 - DNA, 103 bp, Artificial Sequence
  Synthetic Polynucleotide
taatacgactcactatagggtatgcatgtgcttttcgctggtcatatgaaaacagaggagattcataatgccagcgaaaaacctggcggcagcgcaaaagatg

SEQ ID NO: 233213 - DNA, 103 bp, Artificial Sequence
  Synthetic Polynucleotide
taatacgactcactatagggagcatcatattatgcatgtgcttttcgctgaacagaggagacagcgaatggcacatgcaaacctggcggcagcgcaaaagatg

SEQ ID NO: 233214 - DNA, 103 bp, Artificial Sequence
  Synthetic Polynucleotide
taatacgactcactatagggctgctgcaaaagcatcatattatgcatgtgaacagaggagacacatgatgaatatgatgaacctggcggcagcgcaaaagatg

SEQ ID NO: 233215 - DNA, 103 bp, Artificial Sequence
  Synthetic Polynucleotide
taatacgactcactataggggcttcatgttctgctgcaaaagcatcatataacagaggagaatatgaatgttttgcagcaacctggcggcagcgcaaaagatg

SEQ ID NO: 233216 - DNA, 103 bp, Artificial Sequence
  Synthetic Polynucleotide
taatacgactcactataggggtggcacattcgttgcagggtatctcctttaacagaggagaaaaggaatgaccctgcaaaacctggcggcagcgcaaaagatg

SEQ ID NO: 233217 - DNA, 103 bp, Artificial Sequence
  Synthetic Polynucleotide
taatacgactcactatagggtgctggatctgcttcatgttctgctgcaaaaacagaggagatttgcaatggaacatgaaaacctggcggcagcgcaaaagatg

SEQ ID NO: 233218 - DNA, 103 bp, Artificial Sequence
  Synthetic Polynucleotide
taatacgactcactataggggtgcagattatgctggatctgcttcatgttaacagaggagaaacatgatgcagatccagaacctggcggcagcgcaaaagatg

SEQ ID NO: 233219 - DNA, 103 bp, Artificial Sequence
  Synthetic Polynucleotide
taatacgactcactatagggcgaggcccaagtgcagattatgctggatctaacagaggagaagatccatgataatctgcaacctggcggcagcgcaaaagatg

SEQ ID NO: 233220 - DNA, 103 bp, Artificial Sequence
  Synthetic Polynucleotide
taatacgactcactatagggtccgccggggcgaggcccaagtgcagattaaacagaggagataatctatgcttgggcctaacctggcggcagcgcaaaagatg

SEQ ID NO: 233221 - DNA, 103 bp, Artificial Sequence
  Synthetic Polynucleotide
taatacgactcactatagggaagctctgcttccgccggggcgaggcccaaaacagaggagattgggcatggccccggcgaacctggcggcagcgcaaaagatg

SEQ ID NO: 233222 - DNA, 103 bp, Artificial Sequence
  Synthetic Polynucleotide
taatacgactcactatagggagtactgataaagctctgcttccgccggggaacagaggagaccccggatgaagcagagcaacctggcggcagcgcaaaagatg

SEQ ID NO: 233223 - DNA, 103 bp, Artificial Sequence
  Synthetic Polynucleotide
taatacgactcactatagggtgggctaggtagtactgataaagctctgctaacagaggagaagcagaatgttatcagtaaacctggcggcagcgcaaaagatg

SEQ ID NO: 233224 - DNA, 103 bp, Artificial Sequence
  Synthetic Polynucleotide
taatacgactcactataggggcctatgttctgggctaggtagtactgataaacagaggagatatcagatgtacctagccaacctggcggcagcgcaaaagatg

SEQ ID NO: 233225 - DNA, 103 bp, Artificial Sequence
  Synthetic Polynucleotide
taatacgactcactatagggttccggtcaggcctatgttctgggctaggtaacagaggagaacctagatgagaacatagaacctggcggcagcgcaaaagatg

SEQ ID NO: 233226 - DNA, 103 bp, Artificial Sequence
  Synthetic Polynucleotide
taatacgactcactatagggtccagcttcattccggtcaggcctatgttcaacagaggagagaacatatgcctgaccggaacctggcggcagcgcaaaagatg

SEQ ID NO: 233227 - DNA, 103 bp, Artificial Sequence
  Synthetic Polynucleotide
taatacgactcactataggggggaaaagaagtggcacattcgttgcagggaacagaggagaccctgcatggaatgtgccaacctggcggcagcgcaaaagatg

SEQ ID NO: 233228 - DNA, 103 bp, Artificial Sequence
  Synthetic Polynucleotide
taatacgactcactatagggggcagggttttccagcttcattccggtcagaacagaggagactgaccatgatgaagctgaacctggcggcagcgcaaaagatg

SEQ ID NO: 233229 - DNA, 103 bp, Artificial Sequence
  Synthetic Polynucleotide
taatacgactcactataggggctgagggtcggcagggttttccagcttcaaacagaggagatgaagcatgaaaaccctgaacctggcggcagcgcaaaagatg

SEQ ID NO: 233230 - DNA, 103 bp, Artificial Sequence
  Synthetic Polynucleotide
taatacgactcactatagggttgatcatcagctgagggtcggcagggtttaacagaggagaaaacccatgcgaccctcaaacctggcggcagcgcaaaagatg

SEQ ID NO: 233231 - DNA, 103 bp, Artificial Sequence
  Synthetic Polynucleotide
taatacgactcactatagggctggaatggattgatcatcagctgagggtcaacagaggagagaccctatgctgatgatcaacctggcggcagcgcaaaagatg

SEQ ID NO: 233232 - DNA, 103 bp, Artificial Sequence
  Synthetic Polynucleotide
taatacgactcactatagggctggatccagctggaatggattgatcatcaaacagaggagatgatgaatgatccattccaacctggcggcagcgcaaaagatg

SEQ ID NO: 233233 - DNA, 103 bp, Artificial Sequence
  Synthetic Polynucleotide
taatacgactcactataggggctgctgtcgctggatccagctggaatggaaacagaggagatccattatggctggatccaacctggcggcagcgcaaaagatg

SEQ ID NO: 233234 - DNA, 103 bp, Artificial Sequence
  Synthetic Polynucleotide
taatacgactcactatagggtgccaaagccgctgctgtcgctggatccagaacagaggagactggatatggcgacagcaaacctggcggcagcgcaaaagatg

SEQ ID NO: 233235 - DNA, 103 bp, Artificial Sequence
  Synthetic Polynucleotide
taatacgactcactatagggcgagccctggtgccaaagccgctgctgtcgaacagaggagacgacagatgcggctttggaacctggcggcagcgcaaaagatg

SEQ ID NO: 233236 - DNA, 103 bp, Artificial Sequence
  Synthetic Polynucleotide
taatacgactcactatagggtcattatttacgagccctggtgccaaagccaacagaggagaggctttatgaccagggctaacctggcggcagcgcaaaagatg

SEQ ID NO: 233237 - DNA, 103 bp, Artificial Sequence
  Synthetic Polynucleotide
taatacgactcactatagggaggcggcagctcattatttacgagccctggaacagaggagaccagggatggtaaataataacctggcggcagcgcaaaagatg

SEQ ID NO: 233238 - DNA, 103 bp, Artificial Sequence
  Synthetic Polynucleotide
taatacgactcactatagggtctgtaaactgggaaaagaagtggcacattaacagaggagaaatgtgatgcttcttttcaacctggcggcagcgcaaaagatg

SEQ ID NO: 233239 - DNA, 103 bp, Artificial Sequence
  Synthetic Polynucleotide
taatacgactcactataggggccggatttcaggcggcagctcattatttaaacagaggagataaataatgagctgccgcaacctggcggcagcgcaaaagatg

SEQ ID NO: 233240 - DNA, 103 bp, Artificial Sequence
  Synthetic Polynucleotide
taatacgactcactatagggccactggcaagccggatttcaggcggcagcaacagaggagagctgccatgtgaaatccgaacctggcggcagcgcaaaagatg

SEQ ID NO: 233241 - DNA, 103 bp, Artificial Sequence
  Synthetic Polynucleotide
taatacgactcactatagggcattagctgaccactggcaagccggatttcaacagaggagagaaatcatgcttgccagtaacctggcggcagcgcaaaagatg

SEQ ID NO: 233242 - DNA, 103 bp, Artificial Sequence
  Synthetic Polynucleotide
taatacgactcactatagggggtcatcacccattagctgaccactggcaaaacagaggagattgccaatggtcagctaaaacctggcggcagcgcaaaagatg

SEQ ID NO: 233243 - DNA, 103 bp, Artificial Sequence
  Synthetic Polynucleotide
taatacgactcactatagggaggagggacaggtcatcacccattagctgaaacagaggagatcagctatggggtgatgaaacctggcggcagcgcaaaagatg

SEQ ID NO: 233244 - DNA, 103 bp, Artificial Sequence
  Synthetic Polynucleotide
taatacgactcactatagggtcctgcagtaaggagggacaggtcatcaccaacagaggagaggtgatatgctgtccctcaacctggcggcagcgcaaaagatg

SEQ ID NO: 233245 - DNA, 103 bp, Artificial Sequence
  Synthetic Polynucleotide
taatacgactcactataggggtgacagctctcctgcagtaaggagggacaaacagaggagatgtcccatgttactgcagaacctggcggcagcgcaaaagatg

SEQ ID NO: 233246 - DNA, 103 bp, Artificial Sequence
  Synthetic Polynucleotide
taatacgactcactatagggctgatataaggtgacagctctcctgcagtaaacagaggagatactgcatgagagctgtcaacctggcggcagcgcaaaagatg

SEQ ID NO: 233247 - DNA, 103 bp, Artificial Sequence
  Synthetic Polynucleotide
taatacgactcactatagggcgctgggtcactgatataaggtgacagctcaacagaggagagagctgatgccttatatcaacctggcggcagcgcaaaagatg

SEQ ID NO: 233248 - DNA, 103 bp, Artificial Sequence
  Synthetic Polynucleotide
taatacgactcactatagggatagcttcagcgctgggtcactgatataagaacagaggagacttataatggtgacccagaacctggcggcagcgcaaaagatg

SEQ ID NO: 233249 - DNA, 103 bp, Artificial Sequence
  Synthetic Polynucleotide
taatacgactcactatagggtccatgtatttctgtaaactgggaaaagaaaacagaggagattctttatgcagtttacaaacctggcggcagcgcaaaagatg

SEQ ID NO: 233250 - DNA, 103 bp, Artificial Sequence
  Synthetic Polynucleotide
taatacgactcactataggggcacactggaatagcttcagcgctgggtcaaacagaggagatgacccatggctgaagctaacctggcggcagcgcaaaagatg

SEQ ID NO: 233251 - DNA, 103 bp, Artificial Sequence
  Synthetic Polynucleotide
taatacgactcactataggggttgcaaacagcacactggaatagcttcagaacagaggagactgaagatgttccagtgtaacctggcggcagcgcaaaagatg

SEQ ID NO: 233252 - DNA, 103 bp, Artificial Sequence
  Synthetic Polynucleotide
taatacgactcactatagggaggtgaatttgttgcaaacagcacactggaaacagaggagatccagtatgctgtttgcaaacctggcggcagcgcaaaagatg

SEQ ID NO: 233253 - DNA, 103 bp, Artificial Sequence
  Synthetic Polynucleotide
taatacgactcactatagggaggctgtcagaggtgaatttgttgcaaacaaacagaggagatgtttgatgcaaattcacaacctggcggcagcgcaaaagatg

SEQ ID NO: 233254 - DNA, 103 bp, Artificial Sequence
  Synthetic Polynucleotide
taatacgactcactatagggtagggcctccaggctgtcagaggtgaatttaacagaggagaaaattcatgtctgacagcaacctggcggcagcgcaaaagatg

SEQ ID NO: 233255 - DNA, 103 bp, Artificial Sequence
  Synthetic Polynucleotide
taatacgactcactatagggcatgcacacttagggcctccaggctgtcagaacagaggagactgacaatgtggaggcccaacctggcggcagcgcaaaagatg

SEQ ID NO: 233256 - DNA, 103 bp, Artificial Sequence
  Synthetic Polynucleotide
taatacgactcactatagggtcactgctcacatgcacacttagggcctccaacagaggagaggaggcatgaagtgtgcaaacctggcggcagcgcaaaagatg

SEQ ID NO: 233257 - DNA, 103 bp, Artificial Sequence
  Synthetic Polynucleotide
taatacgactcactataggggagagagcgctcactgctcacatgcacactaacagaggagaagtgtgatggtgagcagtaacctggcggcagcgcaaaagatg

SEQ ID NO: 233258 - DNA, 103 bp, Artificial Sequence
  Synthetic Polynucleotide
taatacgactcactatagggcctcttcagggagagagcgctcactgctcaaacagaggagatgagcaatgagcgctctcaacctggcggcagcgcaaaagatg

SEQ ID NO: 233259 - DNA, 103 bp, Artificial Sequence
  Synthetic Polynucleotide
taatacgactcactataggggccctccattcctcttcagggagagagcgcaacagaggagagcgctcatgccctgaagaaacctggcggcagcgcaaaagatg

SEQ ID NO: 233260 - DNA, 103 bp, Artificial Sequence
  Synthetic Polynucleotide
taatacgactcactataggggcagtggtgttccatgtatttctgtaaactaacagaggagaagtttaatgaaatacatgaacctggcggcagcgcaaaagatg

SEQ ID NO: 233261 - DNA, 103 bp, Artificial Sequence
  Synthetic Polynucleotide
taatacgactcactatagggtccaattactgccctccattcctcttcaggaacagaggagacctgaaatggaatggaggaacctggcggcagcgcaaaagatg

SEQ ID NO: 233262 - DNA, 103 bp, Artificial Sequence
  Synthetic Polynucleotide
taatacgactcactatagggggtagatatctccaattactgccctccattaacagaggagaaatggaatgcagtaattgaacctggcggcagcgcaaaagatg

SEQ ID NO: 233263 - DNA, 103 bp, Artificial Sequence
  Synthetic Polynucleotide
taatacgactcactatagggagcttgcactggtagatatctccaattactaacagaggagaagtaatatgagatatctaaacctggcggcagcgcaaaagatg

SEQ ID NO: 233264 - DNA, 103 bp, Artificial Sequence
  Synthetic Polynucleotide
taatacgactcactataggggtagttgcagagcttgcactggtagatatcaacagaggagagatatcatgcagtgcaagaacctggcggcagcgcaaaagatg

SEQ ID NO: 233265 - DNA, 103 bp, Artificial Sequence
  Synthetic Polynucleotide
taatacgactcactataggggctgagtgttgtagttgcagagcttgcactaacagaggagaagtgcaatgtctgcaactaacctggcggcagcgcaaaagatg

SEQ ID NO: 233266 - DNA, 103 bp, Artificial Sequence
  Synthetic Polynucleotide
taatacgactcactatagggttggctttgagctgagtgttgtagttgcagaacagaggagactgcaaatgcaacactcaaacctggcggcagcgcaaaagatg

SEQ ID NO: 233267 - DNA, 103 bp, Artificial Sequence
  Synthetic Polynucleotide
taatacgactcactatagggtagctggaagttggctttgagctgagtgttaacagaggagaaacactatgctcaaagccaacctggcggcagcgcaaaagatg

SEQ ID NO: 233268 - DNA, 103 bp, Artificial Sequence
  Synthetic Polynucleotide
taatacgactcactatagggtcttgcagtgtagctggaagttggctttgaaacagaggagatcaaagatgacttccagcaacctggcggcagcgcaaaagatg

SEQ ID NO: 233269 - DNA, 103 bp, Artificial Sequence
  Synthetic Polynucleotide
taatacgactcactatagggtgtttatcagtcttgcagtgtagctggaagaacagaggagacttccaatgacactgcaaaacctggcggcagcgcaaaagatg

SEQ ID NO: 233270 - DNA, 103 bp, Artificial Sequence
  Synthetic Polynucleotide
taatacgactcactatagggtttctgcatatgtttatcagtcttgcagtgaacagaggagacactgcatgactgataaaaacctggcggcagcgcaaaagatg

SEQ ID NO: 233271 - DNA, 103 bp, Artificial Sequence
  Synthetic Polynucleotide
taatacgactcactataggggggcattagggcagtggtgttccatgtattaacagaggagaaatacaatgaacaccactaacctggcggcagcgcaaaagatg

SEQ ID NO: 233272 - DNA, 103 bp, Artificial Sequence
  Synthetic Polynucleotide
taatacgactcactatagggccagttgatatttctgcatatgtttatcagaacagaggagactgataatgatatgcagaaacctggcggcagcgcaaaagatg

SEQ ID NO: 233273 - DNA, 103 bp, Artificial Sequence
  Synthetic Polynucleotide
taatacgactcactatagggatgtgagccaccagttgatatttctgcataaacagaggagatatgcaatgatatcaactaacctggcggcagcgcaaaagatg

SEQ ID NO: 233274 - DNA, 103 bp, Artificial Sequence
  Synthetic Polynucleotide
taatacgactcactatagggcccttctttaatgtgagccaccagttgataaacagaggagatatcaaatggtggctcacaacctggcggcagcgcaaaagatg

SEQ ID NO: 233275 - DNA, 103 bp, Artificial Sequence
  Synthetic Polynucleotide
taatacgactcactatagggtgcttttgcccccttctttaatgtgagccaaacagaggagatggctcatgttaaagaagaacctggcggcagcgcaaaagatg

SEQ ID NO: 233276 - DNA, 103 bp, Artificial Sequence
  Synthetic Polynucleotide
taatacgactcactatagggctccactcattgcttttgcccccttctttaaacagaggagataaagaatggggcaaaagaacctggcggcagcgcaaaagatg

SEQ ID NO: 233277 - DNA, 103 bp, Artificial Sequence
  Synthetic Polynucleotide
taatacgactcactatagggacacttcaacctccactcattgcttttgccaacagaggagaggcaaaatgaatgagtggaacctggcggcagcgcaaaagatg

SEQ ID NO: 233278 - DNA, 103 bp, Artificial Sequence
  Synthetic Polynucleotide
taatacgactcactatagggcaatggcaatacacttcaacctccactcataacagaggagaatgagtatgggttgaagtaacctggcggcagcgcaaaagatg

SEQ ID NO: 233279 - DNA, 103 bp, Artificial Sequence
  Synthetic Polynucleotide
taatacgactcactatagggacagggttgccaatggcaatacacttcaacaacagaggagagttgaaatgtattgccataacctggcggcagcgcaaaagatg

SEQ ID NO: 233280 - DNA, 103 bp, Artificial Sequence
  Synthetic Polynucleotide
taatacgactcactatagggttttaggtgaacagggttgccaatggcaataacagaggagaattgccatgggcaaccctaacctggcggcagcgcaaaagatg

SEQ ID NO: 233281 - DNA, 103 bp, Artificial Sequence
  Synthetic Polynucleotide
taatacgactcactatagggaggcgttacattttaggtgaacagggttgcaacagaggagagcaaccatgttcacctaaaacctggcggcagcgcaaaagatg

SEQ ID NO: 233282 - DNA, 103 bp, Artificial Sequence
  Synthetic Polynucleotide
taatacgactcactatagggctctgcccattttcctgccttgagataggaaacagaggagatcctatatgaaggcaggaaacctggcggcagcgcaaaagatg

SEQ ID NO: 233283 - DNA, 103 bp, Artificial Sequence
  Synthetic Polynucleotide
taatacgactcactatagggacaggaaggcgggcattagggcagtggtgtaacagaggagaacaccaatgccctaatgcaacctggcggcagcgcaaaagatg

SEQ ID NO: 233284 - DNA, 103 bp, Artificial Sequence
  Synthetic Polynucleotide
taatacgactcactatagggtaatagtcacaggcgttacattttaggtgaaacagaggagatcacctatgatgtaacgcaacctggcggcagcgcaaaagatg

SEQ ID NO: 233285 - DNA, 103 bp, Artificial Sequence
  Synthetic Polynucleotide
taatacgactcactatagggactgttggtgtaatagtcacaggcgttacaaacagaggagatgtaacatgtgtgactataacctggcggcagcgcaaaagatg

SEQ ID NO: 233286 - DNA, 103 bp, Artificial Sequence
  Synthetic Polynucleotide
taatacgactcactatagggatttatccacactgttggtgtaatagtcacaacagaggagagtgactatgacaccaacaaacctggcggcagcgcaaaagatg

SEQ ID NO: 233287 - DNA, 103 bp, Artificial Sequence
  Synthetic Polynucleotide
taatacgactcactatagggtgcaagcgtaatttatccacactgttggtgaacagaggagacaccaaatgtgtggataaaacctggcggcagcgcaaaagatg

SEQ ID NO: 233288 - DNA, 103 bp, Artificial Sequence
  Synthetic Polynucleotide
taatacgactcactatagggattggtggtatgcaagcgtaatttatccacaacagaggagagtggatatgttacgcttgaacctggcggcagcgcaaaagatg

SEQ ID NO: 233289 - DNA, 103 bp, Artificial Sequence
  Synthetic Polynucleotide
taatacgactcactatagggcgtgcctgtgattggtggtatgcaagcgtaaacagaggagatacgctatgataccaccaaacctggcggcagcgcaaaagatg

SEQ ID NO: 233290 - DNA, 103 bp, Artificial Sequence
  Synthetic Polynucleotide
taatacgactcactatagggagggccgcctcgtgcctgtgattggtggtaaacagaggagataccacatgtcacaggcaaacctggcggcagcgcaaaagatg

SEQ ID NO: 233291 - DNA, 103 bp, Artificial Sequence
  Synthetic Polynucleotide
taatacgactcactataggggtagagcttcagggccgcctcgtgcctgtgaacagaggagacacaggatggaggcggccaacctggcggcagcgcaaaagatg

SEQ ID NO: 233292 - DNA, 103 bp, Artificial Sequence
  Synthetic Polynucleotide
taatacgactcactataggggcaagtgcttgtagagcttcagggccgcctaacagaggagaaggcggatgtgaagctctaacctggcggcagcgcaaaagatg

SEQ ID NO: 233293 - DNA, 103 bp, Artificial Sequence
  Synthetic Polynucleotide
taatacgactcactatagggtcttgcttctgcaagtgcttgtagagcttcaacagaggagagaagctatgcaagcacttaacctggcggcagcgcaaaagatg

SEQ ID NO: 233294 - DNA, 103 bp, Artificial Sequence
  Synthetic Polynucleotide
taatacgactcactatagggatccttcaggacaggaaggcgggcattaggaacagaggagacctaatatgcgccttcctaacctggcggcagcgcaaaagatg

SEQ ID NO: 233295 - DNA, 103 bp, Artificial Sequence
  Synthetic Polynucleotide
taatacgactcactatagggcactgcaccctcttgcttctgcaagtgcttaacagaggagaaagcacatgcagaagcaaaacctggcggcagcgcaaaagatg

SEQ ID NO: 233296 - DNA, 103 bp, Artificial Sequence
  Synthetic Polynucleotide
taatacgactcactatagggattcgggattcactgcaccctcttgcttctaacagaggagaagaagcatgagggtgcagaacctggcggcagcgcaaaagatg

SEQ ID NO: 233297 - DNA, 103 bp, Artificial Sequence
  Synthetic Polynucleotide
taatacgactcactatagggtaatagcaggattcgggattcactgcacccaacagaggagagggtgcatggaatcccgaaacctggcggcagcgcaaaagatg

SEQ ID NO: 233298 - DNA, 103 bp, Artificial Sequence
  Synthetic Polynucleotide
taatacgactcactatagggggcacagtagtaatagcaggattcgggattaacagaggagaaatcccatgtcctgctataacctggcggcagcgcaaaagatg

SEQ ID NO: 233299 - DNA, 103 bp, Artificial Sequence
  Synthetic Polynucleotide
taatacgactcactatagggaatcacacacggcacagtagtaatagcaggaacagaggagacctgctatgactactgtgaacctggcggcagcgcaaaagatg

SEQ ID NO: 233300 - DNA, 103 bp, Artificial Sequence
  Synthetic Polynucleotide
taatacgactcactatagggttggtggtgtaatcacacacggcacagtagaacagaggagactactgatgcgtgtgtgaaacctggcggcagcgcaaaagatg

SEQ ID NO: 233301 - DNA, 103 bp, Artificial Sequence
  Synthetic Polynucleotide
taatacgactcactatagggcaacttgaccttggtggtgtaatcacacacaacagaggagagtgtgtatgtacaccaccaacctggcggcagcgcaaaagatg

SEQ ID NO: 233302 - DNA, 103 bp, Artificial Sequence
  Synthetic Polynucleotide
taatacgactcactataggggtaccagattcaacttgaccttggtggtgtaacagaggagaacaccaatgaggtcaagtaacctggcggcagcgcaaaagatg

SEQ ID NO: 233303 - DNA, 103 bp, Artificial Sequence
  Synthetic Polynucleotide
taatacgactcactatagggcggacatgttgtaccagattcaacttgaccaacagaggagaggtcaaatggaatctggtaacctggcggcagcgcaaaagatg

SEQ ID NO: 233304 - DNA, 103 bp, Artificial Sequence
  Synthetic Polynucleotide
taatacgactcactatagggcttcaccgaacggacatgttgtaccagattaacagaggagaaatctgatgcaacatgtcaacctggcggcagcgcaaaagatg

SEQ ID NO: 233305 - DNA, 103 bp, Artificial Sequence
  Synthetic Polynucleotide
taatacgactcactatagggtctcgttgtcatccttcaggacaggaaggcaacagaggagagccttcatgtcctgaaggaacctggcggcagcgcaaaagatg

SEQ ID NO: 233306 - DNA, 103 bp, Artificial Sequence
  Synthetic Polynucleotide
taatacgactcactatagggtctgctgatgcttcaccgaacggacatgttaacagaggagaaacatgatggttcggtgaaacctggcggcagcgcaaaagatg

SEQ ID NO: 233307 - DNA, 103 bp, Artificial Sequence
  Synthetic Polynucleotide
taatacgactcactatagggaggccctcagtctgctgatgcttcaccgaaaacagaggagattcggtatggcatcagcaaacctggcggcagcgcaaaagatg

SEQ ID NO: 233308 - DNA, 103 bp, Artificial Sequence
  Synthetic Polynucleotide
taatacgactcactataggggagcttccgtaggccctcagtctgctgatgaacagaggagacatcagatgactgagggcaacctggcggcagcgcaaaagatg

SEQ ID NO: 233309 - DNA, 103 bp, Artificial Sequence
  Synthetic Polynucleotide
taatacgactcactatagggggtggagctggagcttccgtaggccctcagaacagaggagactgaggatgtacggaagcaacctggcggcagcgcaaaagatg

SEQ ID NO: 233310 - DNA, 103 bp, Artificial Sequence
  Synthetic Polynucleotide
taatacgactcactatagggaggccttgctggtggagctggagcttccgtaacagaggagaacggaaatgccagctccaaacctggcggcagcgcaaaagatg

SEQ ID NO: 233311 - DNA, 103 bp, Artificial Sequence
  Synthetic Polynucleotide
taatacgactcactatagggctctggtgccaggccttgctggtggagctgaacagaggagacagctcatgcagcaaggcaacctggcggcagcgcaaaagatg

SEQ ID NO: 233312 - DNA, 103 bp, Artificial Sequence
  Synthetic Polynucleotide
taatacgactcactatagggggttgtcctcctctggtgccaggccttgctaacagaggagaagcaagatgtggcaccagaacctggcggcagcgcaaaagatg

SEQ ID NO: 233313 - DNA, 103 bp, Artificial Sequence
  Synthetic Polynucleotide
taatacgactcactatagggatctcactgaggttgtcctcctctggtgccaacagaggagaggcaccatgggaggacaaaacctggcggcagcgcaaaagatg

SEQ ID NO: 233314 - DNA, 103 bp, Artificial Sequence
  Synthetic Polynucleotide
taatacgactcactatagggaacaaaaaagatctcactgaggttgtcctcaacagaggagagaggacatgctcagtgagaacctggcggcagcgcaaaagatg

SEQ ID NO: 233315 - DNA, 103 bp, Artificial Sequence
  Synthetic Polynucleotide
taatacgactcactatagggggcaatctttaacaaaaaagatctcactgaaacagaggagatcagtgatgtcttttttgaacctggcggcagcgcaaaagatg

SEQ ID NO: 233316 - DNA, 103 bp, Artificial Sequence
  Synthetic Polynucleotide
taatacgactcactatagggctgatctcgctctcgttgtcatccttcaggaacagaggagacctgaaatgtgacaacgaaacctggcggcagcgcaaaagatg

SEQ ID NO: 233317 - DNA, 103 bp, Artificial Sequence
  Synthetic Polynucleotide
taatacgactcactatagggtcatttggtgggcaatctttaacaaaaaagaacagaggagactttttatgtaaagattgaacctggcggcagcgcaaaagatg

SEQ ID NO: 233318 - DNA, 103 bp, Artificial Sequence
  Synthetic Polynucleotide
taatacgactcactatagggagtttcaagctcatttggtgggcaatctttaacagaggagaaaagatatgccaccaaataacctggcggcagcgcaaaagatg

SEQ ID NO: 233319 - DNA, 103 bp, Artificial Sequence
  Synthetic Polynucleotide
taatacgactcactatagggccaatgaggcagtttcaagctcatttggtgaacagaggagacaccaaatgagcttgaaaaacctggcggcagcgcaaaagatg

SEQ ID NO: 233320 - DNA, 103 bp, Artificial Sequence
  Synthetic Polynucleotide
taatacgactcactataggggtcctggctcccaatgaggcagtttcaagcaacagaggagagcttgaatgtgcctcattaacctggcggcagcgcaaaagatg

SEQ ID NO: 233321 - DNA, 103 bp, Artificial Sequence
  Synthetic Polynucleotide
taatacgactcactatagggatcatcacaagtcctggctcccaatgaggcaacagaggagagcctcaatgggagccaggaacctggcggcagcgcaaaagatg

SEQ ID NO: 233322 - DNA, 103 bp, Artificial Sequence
  Synthetic Polynucleotide
taatacgactcactatagggctgtaagatcatcatcacaagtcctggctcaacagaggagagagccaatgcttgtgatgaacctggcggcagcgcaaaagatg

SEQ ID NO: 233323 - DNA, 103 bp, Artificial Sequence
  Synthetic Polynucleotide
taatacgactcactatagggaactgctgctctgtaagatcatcatcacaaaacagaggagattgtgaatgtgatcttacaacctggcggcagcgcaaaagatg

SEQ ID NO: 233324 - DNA, 103 bp, Artificial Sequence
  Synthetic Polynucleotide
taatacgactcactatagggggtcgatctcaactgctgctctgtaagatcaacagaggagagatcttatggagcagcagaacctggcggcagcgcaaaagatg

SEQ ID NO: 233325 - DNA, 103 bp, Artificial Sequence
  Synthetic Polynucleotide
taatacgactcactataggggttcttctgaggtcgatctcaactgctgctaacagaggagaagcagcatgtgagatcgaaacctggcggcagcgcaaaagatg

SEQ ID NO: 233326 - DNA, 103 bp, Artificial Sequence
  Synthetic Polynucleotide
taatacgactcactatagggtcctcactttgttcttctgaggtcgatctcaacagaggagagagatcatgctcagaagaaacctggcggcagcgcaaaagatg

SEQ ID NO: 233327 - DNA, 103 bp, Artificial Sequence
  Synthetic Polynucleotide
taatacgactcactatagggctctaactcgctgatctcgctctcgttgtcaacagaggagagacaacatgagcgagatcaacctggcggcagcgcaaaagatg

SEQ ID NO: 233328 - DNA, 103 bp, Artificial Sequence
  Synthetic Polynucleotide
taatacgactcactatagggtccttctgcctcctcactttgttcttctgaaacagaggagatcagaaatgcaaagtgagaacctggcggcagcgcaaaagatg

SEQ ID NO: 233329 - DNA, 103 bp, Artificial Sequence
  Synthetic Polynucleotide
taatacgactcactataggggcttaatagctccttctgcctcctcactttaacagaggagaaaagtgatgaggcagaagaacctggcggcagcgcaaaagatg

SEQ ID NO: 233330 - DNA, 103 bp, Artificial Sequence
  Synthetic Polynucleotide
taatacgactcactatagggactgctgtaggcttaatagctccttctgccaacagaggagaggcagaatgagctattaaaacctggcggcagcgcaaaagatg

SEQ ID NO: 233331 - DNA, 103 bp, Artificial Sequence
  Synthetic Polynucleotide
taatacgactcactataggggtcctcggccactgctgtaggcttaatagcaacagaggagagctattatgcctacagcaaacctggcggcagcgcaaaagatg

SEQ ID NO: 233332 - DNA, 103 bp, Artificial Sequence
  Synthetic Polynucleotide
taatacgactcactatagggctttttcatcgtcctcggccactgctgtagaacagaggagactacagatgtggccgaggaacctggcggcagcgcaaaagatg

SEQ ID NO: 233333 - DNA, 103 bp, Artificial Sequence
  Synthetic Polynucleotide
taatacgactcactatagggtcacttgtgtctttttcatcgtcctcggccaacagaggagaggccgaatgcgatgaaaaaacctggcggcagcgcaaaagatg

SEQ ID NO: 233334 - DNA, 103 bp, Artificial Sequence
  Synthetic Polynucleotide
taatacgactcactatagggattgtctctctcacttgtgtctttttcatcaacagaggagagatgaaatggacacaagtaacctggcggcagcgcaaaagatg

SEQ ID NO: 233335 - DNA, 103 bp, Artificial Sequence
  Synthetic Polynucleotide
taatacgactcactatagggtgccttcactattgtctctctcacttgtgtaacagaggagaacacaaatgagagagacaaacctggcggcagcgcaaaagatg

SEQ ID NO: 233336 - DNA, 103 bp, Artificial Sequence
  Synthetic Polynucleotide
taatacgactcactatagggttagagtttttgccttcactattgtctctcaacagaggagagagagaatgtagtgaaggaacctggcggcagcgcaaaagatg

SEQ ID NO: 233337 - DNA, 103 bp, Artificial Sequence
  Synthetic Polynucleotide
taatacgactcactatagggagagtctttattagagtttttgccttcactaacagaggagaagtgaaatgaaaaactctaacctggcggcagcgcaaaagatg

SEQ ID NO: 233338 - DNA, 103 bp, Artificial Sequence
  Synthetic Polynucleotide
taatacgactcactatagggcgtcactgtcctctaactcgctgatctcgcaacagaggagagcgagaatggcgagttagaacctggcggcagcgcaaaagatg

SEQ ID NO: 233339 - DNA, 103 bp, Artificial Sequence
  Synthetic Polynucleotide
taatacgactcactatagggtgattatcccagagtctttattagagttttaacagaggagaaaaactatgataaagactaacctggcggcagcgcaaaagatg

SEQ ID NO: 233340 - DNA, 103 bp, Artificial Sequence
  Synthetic Polynucleotide
taatacgactcactatagggttctctggtgtgattatcccagagtctttaaacagaggagataaagaatgtgggataataacctggcggcagcgcaaaagatg

SEQ ID NO: 233341 - DNA, 103 bp, Artificial Sequence
  Synthetic Polynucleotide
taatacgactcactatagggttttagttccttctctggtgtgattatcccaacagaggagagggataatgacaccagagaacctggcggcagcgcaaaagatg

SEQ ID NO: 233342 - DNA, 103 bp, Artificial Sequence
  Synthetic Polynucleotide
taatacgactcactatagggccacactaacttttagttccttctctggtgaacagaggagacaccagatgaggaactaaaacctggcggcagcgcaaaagatg

SEQ ID NO: 233343 - DNA, 103 bp, Artificial Sequence
  Synthetic Polynucleotide
taatacgactcactataggggtaccccctgccacactaacttttagttccaacagaggagaggaactatgagttagtgtaacctggcggcagcgcaaaagatg

SEQ ID NO: 233344 - DNA, 103 bp, Artificial Sequence
  Synthetic Polynucleotide
taatacgactcactataggggagtggctgggtaccccctgccacactaacaacagaggagagttagtatggcagggggtaacctggcggcagcgcaaaagatg

SEQ ID NO: 233345 - DNA, 103 bp, Artificial Sequence
  Synthetic Polynucleotide
taatacgactcactatagggttgccagcaggagtggctgggtaccccctgaacagaggagacaggggatgcccagccacaacctggcggcagcgcaaaagatg

SEQ ID NO: 233346 - DNA, 103 bp, Artificial Sequence
  Synthetic Polynucleotide
taatacgactcactatagggtcctcttcttttgccagcaggagtggctggaacagaggagaccagccatgcctgctggcaacctggcggcagcgcaaaagatg

SEQ ID NO: 233347 - DNA, 103 bp, Artificial Sequence
  Synthetic Polynucleotide
taatacgactcactatagggtgttgcaacatcctcttcttttgccagcagaacagaggagactgctgatgaaagaagagaacctggcggcagcgcaaaagatg

SEQ ID NO: 233348 - DNA, 103 bp, Artificial Sequence
  Synthetic Polynucleotide
taatacgactcactatagggttgacctttttgttgcaacatcctcttcttaacagaggagaaagaagatgatgttgcaaaacctggcggcagcgcaaaagatg

SEQ ID NO: 233349 - DNA, 103 bp, Artificial Sequence
  Synthetic Polynucleotide
taatacgactcactatagggagattttccacgtcactgtcctctaactcgaacagaggagacgagttatgggacagtgaaacctggcggcagcgcaaaagatg

SEQ ID NO: 233350 - DNA, 103 bp, Artificial Sequence
  Synthetic Polynucleotide
taatacgactcactatagggtctgtaggttttgacctttttgttgcaacaaacagaggagatgttgcatgaaaaaggtcaacctggcggcagcgcaaaagatg

SEQ ID NO: 233351 - DNA, 103 bp, Artificial Sequence
  Synthetic Polynucleotide
taatacgactcactatagggtttattgtcctctgtaggttttgaccttttaacagaggagaaaaaggatgaaacctacaaacctggcggcagcgcaaaagatg

SEQ ID NO: 233352 - DNA, 103 bp, Artificial Sequence
  Synthetic Polynucleotide
taatacgactcactatagggcatgacagaatttattgtcctctgtaggttaacagaggagaaacctaatgaggacaataaacctggcggcagcgcaaaagatg

SEQ ID NO: 233353 - DNA, 103 bp, Artificial Sequence
  Synthetic Polynucleotide
taatacgactcactatagggtagaactgttcatgacagaatttattgtccaacagaggagaggacaaatgattctgtcaaacctggcggcagcgcaaaagatg

SEQ ID NO: 233354 - DNA, 103 bp, Artificial Sequence
  Synthetic Polynucleotide
taatacgactcactatagggaggacattgatagaactgttcatgacagaaaacagaggagattctgtatggaacagttcaacctggcggcagcgcaaaagatg

SEQ ID NO: 233355 - DNA, 103 bp, Artificial Sequence
  Synthetic Polynucleotide
taatacgactcactatagggagttacaataaggacattgatagaactgttaacagaggagaaacagtatgatcaatgtcaacctggcggcagcgcaaaagatg

SEQ ID NO: 233356 - DNA, 103 bp, Artificial Sequence
  Synthetic Polynucleotide
taatacgactcactatagggctactattgtagttacaataaggacattgaaacagaggagatcaatgatgttattgtaaaacctggcggcagcgcaaaagatg

SEQ ID NO: 233357 - DNA, 103 bp, Artificial Sequence
  Synthetic Polynucleotide
taatacgactcactatagggactttggtccctactattgtagttacaataaacagaggagatattgtatgtacaatagtaacctggcggcagcgcaaaagatg

SEQ ID NO: 233358 - DNA, 103 bp, Artificial Sequence
  Synthetic Polynucleotide
taatacgactcactatagggtctggatacgactttggtccctactattgtaacagaggagaacaataatggggaccaaaaacctggcggcagcgcaaaagatg

SEQ ID NO: 233359 - DNA, 103 bp, Artificial Sequence
  Synthetic Polynucleotide
taatacgactcactatagggaggacgtgcatctggatacgactttggtccaacagaggagaggaccaatgtcgtatccaaacctggcggcagcgcaaaagatg

SEQ ID NO: 233360 - DNA, 103 bp, Artificial Sequence
  Synthetic Polynucleotide
taatacgactcactatagggctcccctgttagattttccacgtcactgtcaacagaggagagacagtatggtggaaaataacctggcggcagcgcaaaagatg

SEQ ID NO: 233361 - DNA, 103 bp, Artificial Sequence
  Synthetic Polynucleotide
taatacgactcactataggggtgctgtgataggacgtgcatctggatacgaacagaggagacgtatcatgatgcacgtcaacctggcggcagcgcaaaagatg

SEQ ID NO: 233362 - DNA, 103 bp, Artificial Sequence
  Synthetic Polynucleotide
taatacgactcactataggggctgcaccgagtgctgtgataggacgtgcaaacagaggagatgcacgatgtatcacagcaacctggcggcagcgcaaaagatg

SEQ ID NO: 233363 - DNA, 103 bp, Artificial Sequence
  Synthetic Polynucleotide
taatacgactcactatagggcagatgaccggctgcaccgagtgctgtgataacagaggagaatcacaatgctcggtgcaaacctggcggcagcgcaaaagatg

SEQ ID NO: 233364 - DNA, 103 bp, Artificial Sequence
  Synthetic Polynucleotide
taatacgactcactataggggagaggacagcagatgaccggctgcaccgaaacagaggagatcggtgatgccggtcatcaacctggcggcagcgcaaaagatg

SEQ ID NO: 233365 - DNA, 103 bp, Artificial Sequence
  Synthetic Polynucleotide
taatacgactcactatagggcgtcctgacagagaggacagcagatgaccgaacagaggagacggtcaatggctgtcctcaacctggcggcagcgcaaaagatg

SEQ ID NO: 233366 - DNA, 103 bp, Artificial Sequence
  Synthetic Polynucleotide
taatacgactcactatagggttgctgaggacgtcctgacagagaggacagaacagaggagactgtccatgctgtcaggaaacctggcggcagcgcaaaagatg

SEQ ID NO: 233367 - DNA, 103 bp, Artificial Sequence
  Synthetic Polynucleotide
taatacgactcactatagggatgcattttgttgctgaggacgtcctgacaaacagaggagatgtcagatggtcctcagcaacctggcggcagcgcaaaagatg

SEQ ID NO: 233368 - DNA, 103 bp, Artificial Sequence
  Synthetic Polynucleotide
taatacgactcactataggggcagttggagatgcattttgttgctgaggaaacagaggagatcctcaatgacaaaatgcaacctggcggcagcgcaaaagatg

SEQ ID NO: 233369 - DNA, 103 bp, Artificial Sequence
  Synthetic Polynucleotide
taatacgactcactatagggtgcgtcagatgcagttggagatgcattttgaacagaggagacaaaatatgtctccaactaacctggcggcagcgcaaaagatg

SEQ ID NO: 233370 - DNA, 103 bp, Artificial Sequence
  Synthetic Polynucleotide
taatacgactcactatagggactgtgcaaatgcgtcagatgcagttggagaacagaggagactccaaatgcatctgacgaacctggcggcagcgcaaaagatg

SEQ ID NO: 233371 - DNA, 103 bp, Artificial Sequence
  Synthetic Polynucleotide
taatacgactcactatagggggtaaacgatctcccctgttagattttccaaacagaggagatggaaaatgtaacaggggaacctggcggcagcgcaaaagatg

SEQ ID NO: 233372 - DNA, 103 bp, Artificial Sequence
  Synthetic Polynucleotide
taatacgactcactatagggctggagacacactgtgcaaatgcgtcagataacagaggagaatctgaatgatttgcacaaacctggcggcagcgcaaaagatg

SEQ ID NO: 233373 - DNA, 103 bp, Artificial Sequence
  Synthetic Polynucleotide
taatacgactcactatagggtccacacagtctggagacacactgtgcaaaaacagaggagatttgcaatgtgtgtctccaacctggcggcagcgcaaaagatg

SEQ ID NO: 233374 - DNA, 103 bp, Artificial Sequence
  Synthetic Polynucleotide
taatacgactcactatagggaagcagcttctccacacagtctggagacacaacagaggagagtgtctatggactgtgtgaacctggcggcagcgcaaaagatg

SEQ ID NO: 233375 - DNA, 103 bp, Artificial Sequence
  Synthetic Polynucleotide
taatacgactcactataggggcactgtcataagcagcttctccacacagtaacagaggagaactgtgatgagaagctgcaacctggcggcagcgcaaaagatg

SEQ ID NO: 233376 - DNA, 103 bp, Artificial Sequence
  Synthetic Polynucleotide
taatacgactcactatagggtcagggacaggcactgtcataagcagcttcaacagaggagagaagctatgtatgacagtaacctggcggcagcgcaaaagatg

SEQ ID NO: 233377 - DNA, 103 bp, Artificial Sequence
  Synthetic Polynucleotide
taatacgactcactatagggcatcatcacatcagggacaggcactgtcataacagaggagaatgacaatgcctgtccctaacctggcggcagcgcaaaagatg

SEQ ID NO: 233378 - DNA, 103 bp, Artificial Sequence
  Synthetic Polynucleotide
taatacgactcactatagggtactgtttggcatcatcacatcagggacagaacagaggagactgtccatgatgtgatgaaacctggcggcagcgcaaaagatg

SEQ ID NO: 233379 - DNA, 103 bp, Artificial Sequence
  Synthetic Polynucleotide
taatacgactcactatagggggcagtagcatactgtttggcatcatcacaaacagaggagatgtgatatggccaaacagaacctggcggcagcgcaaaagatg

SEQ ID NO: 233380 - DNA, 103 bp, Artificial Sequence
  Synthetic Polynucleotide
taatacgactcactatagggggcagctgctggcagtagcatactgtttggaacagaggagaccaaacatgatgctactgaacctggcggcagcgcaaaagatg

SEQ ID NO: 233381 - DNA, 103 bp, Artificial Sequence
  Synthetic Polynucleotide
taatacgactcactatagggatttctcagaggcagctgctggcagtagcaaacagaggagatgctacatgcagcagctgaacctggcggcagcgcaaaagatg

SEQ ID NO: 233382 - DNA, 103 bp, Artificial Sequence
  Synthetic Polynucleotide
taatacgactcactatagggccatcaggctggtaaacgatctcccctgttaacagaggagaaacaggatggatcgtttaaacctggcggcagcgcaaaagatg

SEQ ID NO: 233383 - DNA, 103 bp, Artificial Sequence
  Synthetic Polynucleotide
taatacgactcactatagggtcccgctctgatttctcagaggcagctgctaacagaggagaagcagcatgctctgagaaaacctggcggcagcgcaaaagatg

SEQ ID NO: 233384 - DNA, 103 bp, Artificial Sequence
  Synthetic Polynucleotide
taatacgactcactatagggtgcaggtgtgtcccgctctgatttctcagaaacagaggagatctgagatgtcagagcggaacctggcggcagcgcaaaagatg

SEQ ID NO: 233385 - DNA, 103 bp, Artificial Sequence
  Synthetic Polynucleotide
taatacgactcactatagggctgtcacggctgcaggtgtgtcccgctctgaacagaggagacagagcatgacacacctgaacctggcggcagcgcaaaagatg

SEQ ID NO: 233386 - DNA, 103 bp, Artificial Sequence
  Synthetic Polynucleotide
taatacgactcactataggggacccctcagctgtcacggctgcaggtgtgaacagaggagacacaccatgagccgtgacaacctggcggcagcgcaaaagatg

SEQ ID NO: 233387 - DNA, 103 bp, Artificial Sequence
  Synthetic Polynucleotide
taatacgactcactatagggatatttcccagacccctcagctgtcacggcaacagaggagagccgtgatggctgaggggaacctggcggcagcgcaaaagatg

SEQ ID NO: 233388 - DNA, 103 bp, Artificial Sequence
  Synthetic Polynucleotide
taatacgactcactatagggtttcacctgaatatttcccagacccctcagaacagaggagactgaggatgctgggaaataacctggcggcagcgcaaaagatg

SEQ ID NO: 233389 - DNA, 103 bp, Artificial Sequence
  Synthetic Polynucleotide
taatacgactcactatagggtccattggactttcacctgaatatttcccaaacagaggagatgggaaatgttcaggtgaaacctggcggcagcgcaaaagatg

SEQ ID NO: 233390 - DNA, 103 bp, Artificial Sequence
  Synthetic Polynucleotide
taatacgactcactataggggcttttgtcatccattggactttcacctgaaacagaggagatcaggtatgagtccaatgaacctggcggcagcgcaaaagatg

SEQ ID NO: 233391 - DNA, 103 bp, Artificial Sequence
  Synthetic Polynucleotide
taatacgactcactataggggacctgccatgcttttgtcatccattggacaacagaggagagtccaaatgatgacaaaaaacctggcggcagcgcaaaagatg

SEQ ID NO: 233392 - DNA, 103 bp, Artificial Sequence
  Synthetic Polynucleotide
taatacgactcactataggggaatcctcgagacctgccatgcttttgtcaaacagaggagatgacaaatgcatggcaggaacctggcggcagcgcaaaagatg

SEQ ID NO: 233393 - DNA, 103 bp, Artificial Sequence
  Synthetic Polynucleotide
taatacgactcactatagggctttgatgtgctctgcccattttcctgcctaacagaggagaaggcagatgaatgggcagaacctggcggcagcgcaaaagatg

SEQ ID NO: 233394 - DNA, 103 bp, Artificial Sequence
  Synthetic Polynucleotide
taatacgactcactatagggatatgctgacccatcaggctggtaaacgataacagaggagaatcgttatgcagcctgataacctggcggcagcgcaaaagatg

SEQ ID NO: 233395 - DNA, 103 bp, Artificial Sequence
  Synthetic Polynucleotide
taatacgactcactatagggattagcctttgaatcctcgagacctgccataacagaggagaatggcaatgctcgaggataacctggcggcagcgcaaaagatg

SEQ ID NO: 233396 - DNA, 103 bp, Artificial Sequence
  Synthetic Polynucleotide
taatacgactcactatagggttacttccacattagcctttgaatcctcgaaacagaggagatcgaggatgcaaaggctaaacctggcggcagcgcaaaagatg

SEQ ID NO: 233397 - DNA, 103 bp, Artificial Sequence
  Synthetic Polynucleotide
taatacgactcactatagggtcctcattctttacttccacattagcctttaacagaggagaaaaggcatgtgtggaagtaacctggcggcagcgcaaaagatg

SEQ ID NO: 233398 - DNA, 103 bp, Artificial Sequence
  Synthetic Polynucleotide
taatacgactcactatagggcggtttctgctcctcattctttacttccacaacagaggagagtggaaatgaagaatgagaacctggcggcagcgcaaaagatg

SEQ ID NO: 233399 - DNA, 103 bp, Artificial Sequence
  Synthetic Polynucleotide
taatacgactcactataggggttctttagtcggtttctgctcctcattctaacagaggagaagaatgatgagcagaaacaacctggcggcagcgcaaaagatg

SEQ ID NO: 233400 - DNA, 103 bp, Artificial Sequence
  Synthetic Polynucleotide
taatacgactcactatagggacttccaagggttctttagtcggtttctgcaacagaggagagcagaaatggactaaagaaacctggcggcagcgcaaaagatg

SEQ ID NO: 233401 - DNA, 103 bp, Artificial Sequence
  Synthetic Polynucleotide
taatacgactcactatagggccattctgagacttccaagggttctttagtaacagaggagaactaaaatgcccttggaaaacctggcggcagcgcaaaagatg

SEQ ID NO: 233402 - DNA, 103 bp, Artificial Sequence
  Synthetic Polynucleotide
taatacgactcactatagggtatttttattccattctgagacttccaaggaacagaggagaccttggatgtctcagaataacctggcggcagcgcaaaagatg

SEQ ID NO: 233403 - DNA, 103 bp, Artificial Sequence
  Synthetic Polynucleotide
taatacgactcactatagggtccttactgctatttttattccattctgagaacagaggagactcagaatggaataaaaaaacctggcggcagcgcaaaagatg

SEQ ID NO: 233404 - DNA, 103 bp, Artificial Sequence
  Synthetic Polynucleotide
taatacgactcactataggggattttcacatccttactgctatttttattaacagaggagaaataaaatgagcagtaagaacctggcggcagcgcaaaagatg

SEQ ID NO: 233405 - DNA, 103 bp, Artificial Sequence
  Synthetic Polynucleotide
taatacgactcactatagggcctcaattatatatgctgacccatcaggctaacagaggagaagcctgatgggtcagcataacctggcggcagcgcaaaagatg

SEQ ID NO: 233406 - DNA, 103 bp, Artificial Sequence
  Synthetic Polynucleotide
taatacgactcactataggggtgtgtcggggattttcacatccttactgcaacagaggagagcagtaatgatgtgaaaaaacctggcggcagcgcaaaagatg

SEQ ID NO: 233407 - DNA, 103 bp, Artificial Sequence
  Synthetic Polynucleotide
taatacgactcactatagggtgatcttgcagtgtgtcggggattttcacaaacagaggagatgtgaaatgccccgacacaacctggcggcagcgcaaaagatg

SEQ ID NO: 233408 - DNA, 103 bp, Artificial Sequence
  Synthetic Polynucleotide
taatacgactcactatagggttcatttaattgatcttgcagtgtgtcgggaacagaggagacccgacatgctgcaagataacctggcggcagcgcaaaagatg

SEQ ID NO: 233409 - DNA, 103 bp, Artificial Sequence
  Synthetic Polynucleotide
taatacgactcactatagggttttttgctgttcatttaattgatcttgcaaacagaggagatgcaagatgaattaaatgaacctggcggcagcgcaaaagatg

SEQ ID NO: 233410 - DNA, 103 bp, Artificial Sequence
  Synthetic Polynucleotide
taatacgactcactatagggagcggttgccttttttgctgttcatttaataacagaggagaattaaaatgacagcaaaaaacctggcggcagcgcaaaagatg

SEQ ID NO: 233411 - DNA, 103 bp, Artificial Sequence
  Synthetic Polynucleotide
taatacgactcactatagggagaaacagagagcggttgccttttttgctgaacagaggagacagcaaatgaggcaaccgaacctggcggcagcgcaaaagatg

SEQ ID NO: 233412 - DNA, 103 bp, Artificial Sequence
  Synthetic Polynucleotide
taatacgactcactatagggcatgacggtcagaaacagagagcggttgccaacagaggagaggcaacatgtctctgtttaacctggcggcagcgcaaaagatg

SEQ ID NO: 233413 - DNA, 103 bp, Artificial Sequence
  Synthetic Polynucleotide
taatacgactcactatagggtacttgtagacatgacggtcagaaacagagaacagaggagactctgtatgtgaccgtcaaacctggcggcagcgcaaaagatg

SEQ ID NO: 233414 - DNA, 103 bp, Artificial Sequence
  Synthetic Polynucleotide
taatacgactcactataggggttacagcgatacttgtagacatgacggtcaacagaggagagaccgtatggtctacaagaacctggcggcagcgcaaaagatg

SEQ ID NO: 233415 - DNA, 103 bp, Artificial Sequence
  Synthetic Polynucleotide
taatacgactcactatagggagctacaatggttacagcgatacttgtagaaacagaggagatctacaatgatcgctgtaaacctggcggcagcgcaaaagatg

SEQ ID NO: 233416 - DNA, 103 bp, Artificial Sequence
  Synthetic Polynucleotide
taatacgactcactatagggtctttggagtcctcaattatatatgctgacaacagaggagagtcagcatgtataattgaaacctggcggcagcgcaaaagatg

SEQ ID NO: 233417 - DNA, 103 bp, Artificial Sequence
  Synthetic Polynucleotide
taatacgactcactatagggttgaaagccaagctacaatggttacagcgaaacagaggagatcgctgatgccattgtagaacctggcggcagcgcaaaagatg

SEQ ID NO: 233418 - DNA, 103 bp, Artificial Sequence
  Synthetic Polynucleotide
taatacgactcactatagggctgcatagttttgaaagccaagctacaatgaacagaggagacattgtatgttggctttcaacctggcggcagcgcaaaagatg

SEQ ID NO: 233419 - DNA, 103 bp, Artificial Sequence
  Synthetic Polynucleotide
taatacgactcactatagggtctgaagcttctgcatagttttgaaagccaaacagaggagatggcttatgaaactatgcaacctggcggcagcgcaaaagatg

SEQ ID NO: 233420 - DNA, 103 bp, Artificial Sequence
  Synthetic Polynucleotide
taatacgactcactatagggtgggaatgtatctgaagcttctgcatagttaacagaggagaaactatatggaagcttcaaacctggcggcagcgcaaaagatg

SEQ ID NO: 233421 - DNA, 103 bp, Artificial Sequence
  Synthetic Polynucleotide
taatacgactcactatagggtgcatgatactgggaatgtatctgaagcttaacagaggagaaagcttatgatacattccaacctggcggcagcgcaaaagatg

SEQ ID NO: 233422 - DNA, 103 bp, Artificial Sequence
  Synthetic Polynucleotide
taatacgactcactatagggcagcccgaattgcatgatactgggaatgtaaacagaggagatacattatgagtatcatgaacctggcggcagcgcaaaagatg

SEQ ID NO: 233423 - DNA, 103 bp, Artificial Sequence
  Synthetic Polynucleotide
taatacgactcactatagggcacattgtcgcagcccgaattgcatgatacaacagaggagagtatcaatgaattcgggcaacctggcggcagcgcaaaagatg

SEQ ID NO: 233424 - DNA, 103 bp, Artificial Sequence
  Synthetic Polynucleotide
taatacgactcactataggggcagaggttacacattgtcgcagcccgaataacagaggagaattcggatggcgacaatgaacctggcggcagcgcaaaagatg

SEQ ID NO: 233425 - DNA, 103 bp, Artificial Sequence
  Synthetic Polynucleotide
taatacgactcactatagggaactgcgctggcagaggttacacattgtcgaacagaggagacgacaaatggtaacctctaacctggcggcagcgcaaaagatg

SEQ ID NO: 233426 - DNA, 103 bp, Artificial Sequence
  Synthetic Polynucleotide
taatacgactcactatagggaatgtacggaaactgcgctggcagaggttaaacagaggagataacctatgccagcgcagaacctggcggcagcgcaaaagatg

SEQ ID NO: 233427 - DNA, 103 bp, Artificial Sequence
  Synthetic Polynucleotide
taatacgactcactatagggctgcccactttctttggagtcctcaattataacagaggagaataattatggactccaaaaacctggcggcagcgcaaaagatg

SEQ ID NO: 233428 - DNA, 103 bp, Artificial Sequence
  Synthetic Polynucleotide
taatacgactcactatagggtaaagcctggaatgtacggaaactgcgctgaacagaggagacagcgcatgttccgtacaaacctggcggcagcgcaaaagatg

SEQ ID NO: 233429 - DNA, 103 bp, Artificial Sequence
  Synthetic Polynucleotide
taatacgactcactatagggagtgtttttttaaagcctggaatgtacggaaacagaggagatccgtaatgtccaggcttaacctggcggcagcgcaaaagatg

SEQ ID NO: 233430 - DNA, 103 bp, Artificial Sequence
  Synthetic Polynucleotide
taatacgactcactatagggcctgcttccaagtgtttttttaaagcctggaacagaggagaccaggcatgaaaaaaacaaacctggcggcagcgcaaaagatg

SEQ ID NO: 233431 - DNA, 103 bp, Artificial Sequence
  Synthetic Polynucleotide
taatacgactcactatagggttcagggtggcctgcttccaagtgttttttaacagaggagaaaaaaaatgttggaagcaaacctggcggcagcgcaaaagatg

SEQ ID NO: 233432 - DNA, 103 bp, Artificial Sequence
  Synthetic Polynucleotide
taatacgactcactatagggcttcactcagttcagggtggcctgcttccaaacagaggagatggaagatggccaccctgaacctggcggcagcgcaaaagatg

SEQ ID NO: 233433 - DNA, 103 bp, Artificial Sequence
  Synthetic Polynucleotide
taatacgactcactatagggtgaagttcagcttcactcagttcagggtggaacagaggagaccacccatgactgagtgaaacctggcggcagcgcaaaagatg

SEQ ID NO: 233434 - DNA, 103 bp, Artificial Sequence
  Synthetic Polynucleotide
taatacgactcactatagggatatagctgttgaagttcagcttcactcagaacagaggagactgagtatggctgaacttaacctggcggcagcgcaaaagatg

SEQ ID NO: 233435 - DNA, 103 bp, Artificial Sequence
  Synthetic Polynucleotide
taatacgactcactataggggcaaggaggcatatagctgttgaagttcagaacagaggagactgaacatgaacagctataacctggcggcagcgcaaaagatg

SEQ ID NO: 233436 - DNA, 103 bp, Artificial Sequence
  Synthetic Polynucleotide
taatacgactcactatagggccattcacgggcaaggaggcatatagctgtaacagaggagaacagctatgtgcctccttaacctggcggcagcgcaaaagatg

SEQ ID NO: 233437 - DNA, 103 bp, Artificial Sequence
  Synthetic Polynucleotide
taatacgactcactatagggccacagttctccattcacgggcaaggaggcaacagaggagagcctccatgcccgtgaataacctggcggcagcgcaaaagatg

SEQ ID NO: 233438 - DNA, 103 bp, Artificial Sequence
  Synthetic Polynucleotide
taatacgactcactatagggtctgtgcattctgcccactttctttggagtaacagaggagaactccaatgaaagtgggcaacctggcggcagcgcaaaagatg

SEQ ID NO: 233439 - DNA, 103 bp, Artificial Sequence
  Synthetic Polynucleotide
taatacgactcactatagggcgctctctgcccacagttctccattcacggaacagaggagaccgtgaatggagaactgtaacctggcggcagcgcaaaagatg

SEQ ID NO: 233440 - DNA, 103 bp, Artificial Sequence
  Synthetic Polynucleotide
taatacgactcactataggggacatagtttcgctctctgcccacagttctaacagaggagaagaactatgggcagagagaacctggcggcagcgcaaaagatg

SEQ ID NO: 233441 - DNA, 103 bp, Artificial Sequence
  Synthetic Polynucleotide
taatacgactcactataggggtcatcctgggacatagtttcgctctctgcaacagaggagagcagagatggaaactatgaacctggcggcagcgcaaaagatg

SEQ ID NO: 233442 - DNA, 103 bp, Artificial Sequence
  Synthetic Polynucleotide
taatacgactcactatagggctaggccatggtcatcctgggacatagtttaacagaggagaaaactaatgcccaggatgaacctggcggcagcgcaaaagatg

SEQ ID NO: 233443 - DNA, 103 bp, Artificial Sequence
  Synthetic Polynucleotide
taatacgactcactatagggatttcctgctctaggccatggtcatcctggaacagaggagaccaggaatgccatggcctaacctggcggcagcgcaaaagatg

SEQ ID NO: 233444 - DNA, 103 bp, Artificial Sequence
  Synthetic Polynucleotide
taatacgactcactatagggctctctctccatttcctgctctaggccatgaacagaggagacatggcatggagcaggaaaacctggcggcagcgcaaaagatg

SEQ ID NO: 233445 - DNA, 103 bp, Artificial Sequence
  Synthetic Polynucleotide
taatacgactcactatagggccacctcatactctctctccatttcctgctaacagaggagaagcaggatgtggagagagaacctggcggcagcgcaaaagatg

SEQ ID NO: 233446 - DNA, 103 bp, Artificial Sequence
  Synthetic Polynucleotide
taatacgactcactatagggccttcgtggtccacctcatactctctctccaacagaggagaggagagatggtatgaggtaacctggcggcagcgcaaaagatg

SEQ ID NO: 233447 - DNA, 103 bp, Artificial Sequence
  Synthetic Polynucleotide
taatacgactcactatagggacttgctttcccttcgtggtccacctcataaacagaggagatatgagatggaccacgaaaacctggcggcagcgcaaaagatg

SEQ ID NO: 233448 - DNA, 103 bp, Artificial Sequence
  Synthetic Polynucleotide
taatacgactcactatagggttcctacaggacttgctttcccttcgtggtaacagaggagaaccacgatgggaaagcaaaacctggcggcagcgcaaaagatg

SEQ ID NO: 233449 - DNA, 103 bp, Artificial Sequence
  Synthetic Polynucleotide
taatacgactcactatagggtttgccccagtctgtgcattctgcccacttaacagaggagaaagtggatggaatgcacaaacctggcggcagcgcaaaagatg

SEQ ID NO: 233450 - DNA, 103 bp, Artificial Sequence
  Synthetic Polynucleotide
taatacgactcactatagggctactatcacttcctacaggacttgctttcaacagaggagagaaagcatgtcctgtaggaacctggcggcagcgcaaaagatg

SEQ ID NO: 233451 - DNA, 103 bp, Artificial Sequence
  Synthetic Polynucleotide
taatacgactcactatagggtggaatagagctactatcacttcctacaggaacagaggagacctgtaatgagtgatagtaacctggcggcagcgcaaaagatg

SEQ ID NO: 233452 - DNA, 103 bp, Artificial Sequence
  Synthetic Polynucleotide
taatacgactcactatagggccatgtcatctggaatagagctactatcacaacagaggagagtgataatggctctattcaacctggcggcagcgcaaaagatg

SEQ ID NO: 233453 - DNA, 103 bp, Artificial Sequence
  Synthetic Polynucleotide
taatacgactcactatagggggttcagagcccatgtcatctggaatagagaacagaggagactctatatgagatgacataacctggcggcagcgcaaaagatg

SEQ ID NO: 233454 - DNA, 103 bp, Artificial Sequence
  Synthetic Polynucleotide
taatacgactcactatagggggtccgctttggttcagagcccatgtcatcaacagaggagagatgacatgggctctgaaaacctggcggcagcgcaaaagatg

SEQ ID NO: 233455 - DNA, 103 bp, Artificial Sequence
  Synthetic Polynucleotide
taatacgactcactatagggtaaaaggtaaggtccgctttggttcagagcaacagaggagagctctgatgcaaagcggaaacctggcggcagcgcaaaagatg

SEQ ID NO: 233456 - DNA, 103 bp, Artificial Sequence
  Synthetic Polynucleotide
taatacgactcactatagggggcccttttctaaaaggtaaggtccgctttaacagaggagaaaagcgatgcttacctttaacctggcggcagcgcaaaagatg

SEQ ID NO: 233457 - DNA, 103 bp, Artificial Sequence
  Synthetic Polynucleotide
taatacgactcactatagggcgtaaaattgggcccttttctaaaaggtaaaacagaggagattacctatgagaaaagggaacctggcggcagcgcaaaagatg

SEQ ID NO: 233458 - DNA, 103 bp, Artificial Sequence
  Synthetic Polynucleotide
taatacgactcactatagggatttttccatcgtaaaattgggcccttttcaacagaggagagaaaagatgccaattttaaacctggcggcagcgcaaaagatg

SEQ ID NO: 233459 - DNA, 103 bp, Artificial Sequence
  Synthetic Polynucleotide
taatacgactcactatagggggatcaaggaatttttccatcgtaaaattgaacagaggagacaatttatggatggaaaaaacctggcggcagcgcaaaagatg

SEQ ID NO: 233460 - DNA, 103 bp, Artificial Sequence
  Synthetic Polynucleotide
taatacgactcactataggggagtttgctatttgccccagtctgtgcattaacagaggagaaatgcaatgactggggcaaacctggcggcagcgcaaaagatg

SEQ ID NO: 233461 - DNA, 103 bp, Artificial Sequence
  Synthetic Polynucleotide
taatacgactcactatagggtggacgagatggatcaaggaatttttccataacagaggagaatggaaatgttccttgataacctggcggcagcgcaaaagatg

SEQ ID NO: 233462 - DNA, 103 bp, Artificial Sequence
  Synthetic Polynucleotide
taatacgactcactatagggtacatttatatggacgagatggatcaaggaaacagaggagatccttgatgcatctcgtcaacctggcggcagcgcaaaagatg

SEQ ID NO: 233463 - DNA, 103 bp, Artificial Sequence
  Synthetic Polynucleotide
taatacgactcactatagggttacacactgtacatttatatggacgagataacagaggagaatctcgatgatataaatgaacctggcggcagcgcaaaagatg

SEQ ID NO: 233464 - DNA, 103 bp, Artificial Sequence
  Synthetic Polynucleotide
taatacgactcactataggggaatgactctttacacactgtacatttataaacagaggagatataaaatgacagtgtgtaacctggcggcagcgcaaaagatg

SEQ ID NO: 233465 - DNA, 103 bp, Artificial Sequence
  Synthetic Polynucleotide
taatacgactcactatagggtcttttgggtgaatgactctttacacactgaacagaggagacagtgtatgaagagtcataacctggcggcagcgcaaaagatg

SEQ ID NO: 233466 - DNA, 103 bp, Artificial Sequence
  Synthetic Polynucleotide
taatacgactcactatagggaagagaatgttcttttgggtgaatgactctaacagaggagaagagtcatgcacccaaaaaacctggcggcagcgcaaaagatg

SEQ ID NO: 233467 - DNA, 103 bp, Artificial Sequence
  Synthetic Polynucleotide
taatacgactcactatagggatagtggaccaagagaatgttcttttgggtaacagaggagaacccaaatgaacattctcaacctggcggcagcgcaaaagatg

SEQ ID NO: 233468 - DNA, 103 bp, Artificial Sequence
  Synthetic Polynucleotide
taatacgactcactatagggaaactgaattatagtggaccaagagaatgtaacagaggagaacattcatgtggtccactaacctggcggcagcgcaaaagatg

SEQ ID NO: 233469 - DNA, 103 bp, Artificial Sequence
  Synthetic Polynucleotide
taatacgactcactatagggtgcaagtgagaaactgaattatagtggaccaacagaggagaggtccaatgtaattcagtaacctggcggcagcgcaaaagatg

SEQ ID NO: 233470 - DNA, 103 bp, Artificial Sequence
  Synthetic Polynucleotide
taatacgactcactatagggtttcagcttatgcaagtgagaaactgaattaacagaggagaaattcaatgtctcacttgaacctggcggcagcgcaaaagatg

SEQ ID NO: 233471 - DNA, 103 bp, Artificial Sequence
  Synthetic Polynucleotide
taatacgactcactatagggctgtagaaaagagtttgctatttgccccagaacagaggagactggggatgatagcaaacaacctggcggcagcgcaaaagatg

SEQ ID NO: 233472 - DNA, 103 bp, Artificial Sequence
  Synthetic Polynucleotide
taatacgactcactataggggcaaaacttttttcagcttatgcaagtgagaacagaggagactcactatgataagctgaaacctggcggcagcgcaaaagatg

SEQ ID NO: 233473 - DNA, 103 bp, Artificial Sequence
  Synthetic Polynucleotide
taatacgactcactataggggaggcttcctgcaaaacttttttcagcttaaacagaggagataagctatgaaaagttttaacctggcggcagcgcaaaagatg

SEQ ID NO: 233474 - DNA, 103 bp, Artificial Sequence
  Synthetic Polynucleotide
taatacgactcactataggggacaggactggaggcttcctgcaaaactttaacagaggagaaaagttatgcaggaagccaacctggcggcagcgcaaaagatg

SEQ ID NO: 233475 - DNA, 103 bp, Artificial Sequence
  Synthetic Polynucleotide
taatacgactcactatagggtttcttgtgggacaggactggaggcttcctaacagaggagaaggaagatgccagtcctgaacctggcggcagcgcaaaagatg

SEQ ID NO: 233476 - DNA, 103 bp, Artificial Sequence
  Synthetic Polynucleotide
taatacgactcactatagggttgctgttggtttcttgtgggacaggactgaacagaggagacagtccatgcccacaagaaacctggcggcagcgcaaaagatg

SEQ ID NO: 233477 - DNA, 103 bp, Artificial Sequence
  Synthetic Polynucleotide
taatacgactcactataggggttatctgtgttgctgttggtttcttgtggaacagaggagaccacaaatgaccaacagcaacctggcggcagcgcaaaagatg

SEQ ID NO: 233478 - DNA, 103 bp, Artificial Sequence
  Synthetic Polynucleotide
taatacgactcactatagggtgtagggtttgttatctgtgttgctgttggaacagaggagaccaacaatgacacagataaacctggcggcagcgcaaaagatg

SEQ ID NO: 233479 - DNA, 103 bp, Artificial Sequence
  Synthetic Polynucleotide
taatacgactcactatagggatgctgcacttgtagggtttgttatctgtgaacagaggagacacagaatgcaaaccctaaacctggcggcagcgcaaaagatg

SEQ ID NO: 233480 - DNA, 103 bp, Artificial Sequence
  Synthetic Polynucleotide
taatacgactcactatagggaacattgcagatgctgcacttgtagggtttaacagaggagaaaacccatgaagtgcagcaacctggcggcagcgcaaaagatg

SEQ ID NO: 233481 - DNA, 103 bp, Artificial Sequence
  Synthetic Polynucleotide
taatacgactcactatagggggctgtatgcaacattgcagatgctgcactaacagaggagaagtgcaatgtctgcaatgaacctggcggcagcgcaaaagatg

SEQ ID NO: 233482 - DNA, 103 bp, Artificial Sequence
  Synthetic Polynucleotide
taatacgactcactatagggaggaacatcgctgtagaaaagagtttgctaaacagaggagatagcaaatgcttttctacaacctggcggcagcgcaaaagatg

SEQ ID NO: 233483 - DNA, 103 bp, Artificial Sequence
  Synthetic Polynucleotide
taatacgactcactataggggttgagctttggctgtatgcaacattgcagaacagaggagactgcaaatgtgcatacagaacctggcggcagcgcaaaagatg

SEQ ID NO: 233484 - DNA, 103 bp, Artificial Sequence
  Synthetic Polynucleotide
taatacgactcactataggggatttccaatgttgagctttggctgtatgcaacagaggagagcatacatgcaaagctcaaacctggcggcagcgcaaaagatg

SEQ ID NO: 233485 - DNA, 103 bp, Artificial Sequence
  Synthetic Polynucleotide
taatacgactcactatagggacctcatgtggatttccaatgttgagctttaacagaggagaaaagctatgcattggaaaaacctggcggcagcgcaaaagatg

SEQ ID NO: 233486 - DNA, 103 bp, Artificial Sequence
  Synthetic Polynucleotide
taatacgactcactatagggtggagcacagacctcatgtggatttccaataacagaggagaattggaatgccacatgagaacctggcggcagcgcaaaagatg

SEQ ID NO: 233487 - DNA, 103 bp, Artificial Sequence
  Synthetic Polynucleotide
taatacgactcactatagggctttgtctggtggagcacagacctcatgtgaacagaggagacacatgatgtctgtgctcaacctggcggcagcgcaaaagatg

SEQ ID NO: 233488 - DNA, 103 bp, Artificial Sequence
  Synthetic Polynucleotide
taatacgactcactatagggcagccctagcctttgtctggtggagcacagaacagaggagactgtgcatgaccagacaaaacctggcggcagcgcaaaagatg

SEQ ID NO: 233489 - DNA, 103 bp, Artificial Sequence
  Synthetic Polynucleotide
taatacgactcactatagggtccagctttgcagccctagcctttgtctggaacagaggagaccagacatgggctagggcaacctggcggcagcgcaaaagatg

SEQ ID NO: 233490 - DNA, 103 bp, Artificial Sequence
  Synthetic Polynucleotide
taatacgactcactatagggaccactgggctccagctttgcagccctagcaacagaggagagctaggatggcaaagctgaacctggcggcagcgcaaaagatg

SEQ ID NO: 233491 - DNA, 103 bp, Artificial Sequence
  Synthetic Polynucleotide
taatacgactcactatagggcagccacatgaccactgggctccagctttgaacagaggagacaaagcatgagcccagtgaacctggcggcagcgcaaaagatg

SEQ ID NO: 233492 - DNA, 103 bp, Artificial Sequence
  Synthetic Polynucleotide
taatacgactcactatagggctgtgcccaccagccacatgaccactgggcaacagaggagagcccagatgtcatgtggcaacctggcggcagcgcaaaagatg

SEQ ID NO: 233493 - DNA, 103 bp, Artificial Sequence
  Synthetic Polynucleotide
taatacgactcactatagggcagggagtccaggaacatcgctgtagaaaaaacagaggagattttctatggcgatgttcaacctggcggcagcgcaaaagatg

SEQ ID NO: 233494 - DNA, 103 bp, Artificial Sequence
  Synthetic Polynucleotide
taatacgactcactatagggtgctgcaatgctgtgcccaccagccacatgaacagaggagacatgtgatgggtgggcacaacctggcggcagcgcaaaagatg

SEQ ID NO: 233495 - DNA, 103 bp, Artificial Sequence
  Synthetic Polynucleotide
taatacgactcactatagggtgttgacatttgctgcaatgctgtgcccacaacagaggagagtgggcatggcattgcagaacctggcggcagcgcaaaagatg

SEQ ID NO: 233496 - DNA, 103 bp, Artificial Sequence
  Synthetic Polynucleotide
taatacgactcactatagggtggccagggctgttgacatttgctgcaatgaacagaggagacattgcatgaaatgtcaaaacctggcggcagcgcaaaagatg

SEQ ID NO: 233497 - DNA, 103 bp, Artificial Sequence
  Synthetic Polynucleotide
taatacgactcactatagggtaacatcccctggccagggctgttgacattaacagaggagaaatgtcatgagccctggcaacctggcggcagcgcaaaagatg

SEQ ID NO: 233498 - DNA, 103 bp, Artificial Sequence
  Synthetic Polynucleotide
taatacgactcactatagggtcatggaatctaacatcccctggccagggcaacagaggagagccctgatgaggggatgtaacctggcggcagcgcaaaagatg

SEQ ID NO: 233499 - DNA, 103 bp, Artificial Sequence
  Synthetic Polynucleotide
taatacgactcactataggggctgctaaactcatggaatctaacatccccaacagaggagaggggatatgagattccataacctggcggcagcgcaaaagatg

SEQ ID NO: 233500 - DNA, 103 bp, Artificial Sequence
  Synthetic Polynucleotide
taatacgactcactataggggctgtttacagctgctaaactcatggaatcaacagaggagagattccatgagtttagcaaacctggcggcagcgcaaaagatg

SEQ ID NO: 233501 - DNA, 103 bp, Artificial Sequence
  Synthetic Polynucleotide
taatacgactcactataggggggtatctttgctgtttacagctgctaaacaacagaggagagtttagatgctgtaaacaaacctggcggcagcgcaaaagatg

SEQ ID NO: 233502 - DNA, 103 bp, Artificial Sequence
  Synthetic Polynucleotide
taatacgactcactataggggcatctaaatgggtatctttgctgtttacaaacagaggagatgtaaaatgcaaagatacaacctggcggcagcgcaaaagatg

SEQ ID NO: 233503 - DNA, 103 bp, Artificial Sequence
  Synthetic Polynucleotide
taatacgactcactatagggtaattctttggcatctaaatgggtatctttaacagaggagaaaagatatgcatttagataacctggcggcagcgcaaaagatg

SEQ ID NO: 233504 - DNA, 103 bp, Artificial Sequence
  Synthetic Polynucleotide
taatacgactcactatagggttccacatagctttgatgtgctctgcccataacagaggagaatgggcatggcacatcaaaacctggcggcagcgcaaaagatg

SEQ ID NO: 233505 - DNA, 103 bp, Artificial Sequence
  Synthetic Polynucleotide
taatacgactcactatagggcagcagatgccagggagtccaggaacatcgaacagaggagacgatgtatgtggactcccaacctggcggcagcgcaaaagatg

SEQ ID NO: 233506 - DNA, 103 bp, Artificial Sequence
  Synthetic Polynucleotide
taatacgactcactataggggctttttatttaattctttggcatctaaataacagaggagaatttagatgccaaagaataacctggcggcagcgcaaaagatg

SEQ ID NO: 233507 - DNA, 103 bp, Artificial Sequence
  Synthetic Polynucleotide
taatacgactcactatagggtcaggagtttgctttttatttaattctttgaacagaggagacaaagaatgaaataaaaaaacctggcggcagcgcaaaagatg

SEQ ID NO: 233508 - DNA, 103 bp, Artificial Sequence
  Synthetic Polynucleotide
taatacgactcactatagggagagattaaatcaggagtttgctttttattaacagaggagaaataaaatgcaaactcctaacctggcggcagcgcaaaagatg

SEQ ID NO: 233509 - DNA, 103 bp, Artificial Sequence
  Synthetic Polynucleotide
taatacgactcactatagggcaggttgagcagagattaaatcaggagtttaacagaggagaaaactcatgatttaatctaacctggcggcagcgcaaaagatg

SEQ ID NO: 233510 - DNA, 103 bp, Artificial Sequence
  Synthetic Polynucleotide
taatacgactcactataggggggtgatgtgcaggttgagcagagattaaaaacagaggagatttaatatgtgctcaaccaacctggcggcagcgcaaaagatg

SEQ ID NO: 233511 - DNA, 103 bp, Artificial Sequence
  Synthetic Polynucleotide
taatacgactcactatagggtgactgtggtgggtgatgtgcaggttgagcaacagaggagagctcaaatggcacatcacaacctggcggcagcgcaaaagatg

SEQ ID NO: 233512 - DNA, 103 bp, Artificial Sequence
  Synthetic Polynucleotide
taatacgactcactatagggtttgtgctggtgactgtggtgggtgatgtgaacagaggagacacatcatgcaccacagtaacctggcggcagcgcaaaagatg

SEQ ID NO: 233513 - DNA, 103 bp, Artificial Sequence
  Synthetic Polynucleotide
taatacgactcactatagggtgcatctgaatttgtgctggtgactgtggtaacagaggagaaccacaatgaccagcacaaacctggcggcagcgcaaaagatg

SEQ ID NO: 233514 - DNA, 103 bp, Artificial Sequence
  Synthetic Polynucleotide
taatacgactcactataggggtgctgtagttgcatctgaatttgtgctggaacagaggagaccagcaatgattcagatgaacctggcggcagcgcaaaagatg

SEQ ID NO: 233515 - DNA, 103 bp, Artificial Sequence
  Synthetic Polynucleotide
taatacgactcactataggggttgtaattcgtgctgtagttgcatctgaaaacagaggagattcagaatgaactacagcaacctggcggcagcgcaaaagatg

SEQ ID NO: 233516 - DNA, 103 bp, Artificial Sequence
  Synthetic Polynucleotide
taatacgactcactatagggctcttctctccagcagatgccagggagtccaacagaggagaggactcatgggcatctgcaacctggcggcagcgcaaaagatg

SEQ ID NO: 233517 - DNA, 103 bp, Artificial Sequence
  Synthetic Polynucleotide
taatacgactcactataggggcggcttgctgttgtaattcgtgctgtagtaacagaggagaactacaatgcgaattacaaacctggcggcagcgcaaaagatg

SEQ ID NO: 233518 - DNA, 103 bp, Artificial Sequence
  Synthetic Polynucleotide
taatacgactcactatagggctgaaagaatgcggcttgctgttgtaattcaacagaggagagaattaatgcagcaagccaacctggcggcagcgcaaaagatg

SEQ ID NO: 233519 - DNA, 103 bp, Artificial Sequence
  Synthetic Polynucleotide
taatacgactcactataggggaaactgaggctgaaagaatgcggcttgctaacagaggagaagcaagatgcattctttcaacctggcggcagcgcaaaagatg

SEQ ID NO: 233520 - DNA, 103 bp, Artificial Sequence
  Synthetic Polynucleotide
taatacgactcactataggggctgggtttagaaactgaggctgaaagaataacagaggagaattcttatggcctcagttaacctggcggcagcgcaaaagatg

SEQ ID NO: 233521 - DNA, 103 bp, Artificial Sequence
  Synthetic Polynucleotide
taatacgactcactatagggaggcaaaaaggctgggtttagaaactgaggaacagaggagacctcagatgctaaacccaaacctggcggcagcgcaaaagatg

SEQ ID NO: 233522 - DNA, 103 bp, Artificial Sequence
  Synthetic Polynucleotide
taatacgactcactatagggtaggaaaatgaggcaaaaaggctgggtttaaacagaggagataaaccatgcctttttgcaacctggcggcagcgcaaaagatg

SEQ ID NO: 233523 - DNA, 103 bp, Artificial Sequence
  Synthetic Polynucleotide
taatacgactcactatagggtctggggtcataggaaaatgaggcaaaaagaacagaggagactttttatgtcattttccaacctggcggcagcgcaaaagatg

SEQ ID NO: 233524 - DNA, 103 bp, Artificial Sequence
  Synthetic Polynucleotide
taatacgactcactatagggcagcagtgcttctggggtcataggaaaatgaacagaggagacattttatgatgaccccaaacctggcggcagcgcaaaagatg

SEQ ID NO: 233525 - DNA, 103 bp, Artificial Sequence
  Synthetic Polynucleotide
taatacgactcactataggggctgaaactgcagcagtgcttctggggtcaaacagaggagatgacccatgaagcactgcaacctggcggcagcgcaaaagatg

SEQ ID NO: 233526 - DNA, 103 bp, Artificial Sequence
  Synthetic Polynucleotide
taatacgactcactatagggaactgaggctgctgaaactgcagcagtgctaacagaggagaagcactatggcagtttcaaacctggcggcagcgcaaaagatg

SEQ ID NO: 233527 - DNA, 103 bp, Artificial Sequence
  Synthetic Polynucleotide
taatacgactcactatagggagactgatcactcttctctccagcagatgcaacagaggagagcatctatgggagagaagaacctggcggcagcgcaaaagatg

SEQ ID NO: 233528 - DNA, 103 bp, Artificial Sequence
  Synthetic Polynucleotide
taatacgactcactatagggtggaaagagaaactgaggctgctgaaactgaacagaggagacagtttatgcagcctcagaacctggcggcagcgcaaaagatg

SEQ ID NO: 233529 - DNA, 103 bp, Artificial Sequence
  Synthetic Polynucleotide
taatacgactcactataggggtatataaaatggaaagagaaactgaggctaacagaggagaagcctcatgttctctttcaacctggcggcagcgcaaaagatg

SEQ ID NO: 233530 - DNA, 103 bp, Artificial Sequence
  Synthetic Polynucleotide
taatacgactcactatagggtccgtcccaggtatataaaatggaaagagaaacagaggagatctcttatgattttatataacctggcggcagcgcaaaagatg

SEQ ID NO: 233531 - DNA, 103 bp, Artificial Sequence
  Synthetic Polynucleotide
taatacgactcactatagggcaagctgaactccgtcccaggtatataaaaaacagaggagattttatatgcctgggacgaacctggcggcagcgcaaaagatg

SEQ ID NO: 233532 - DNA, 103 bp, Artificial Sequence
  Synthetic Polynucleotide
taatacgactcactatagggaatctggccccaagctgaactccgtcccagaacagaggagactgggaatgagttcagctaacctggcggcagcgcaaaagatg

SEQ ID NO: 233533 - DNA, 103 bp, Artificial Sequence
  Synthetic Polynucleotide
taatacgactcactatagggggcaagcccaaatctggccccaagctgaacaacagaggagagttcagatgggggccagaaacctggcggcagcgcaaaagatg

SEQ ID NO: 233534 - DNA, 103 bp, Artificial Sequence
  Synthetic Polynucleotide
taatacgactcactatagggggcagagcctggcaagcccaaatctggcccaacagaggagagggccaatgttgggcttgaacctggcggcagcgcaaaagatg

SEQ ID NO: 233535 - DNA, 103 bp, Artificial Sequence
  Synthetic Polynucleotide
taatacgactcactatagggtcccaaatgtggcagagcctggcaagcccaaacagaggagatgggctatgcaggctctgaacctggcggcagcgcaaaagatg

SEQ ID NO: 233536 - DNA, 103 bp, Artificial Sequence
  Synthetic Polynucleotide
taatacgactcactatagggatgccaggcatcccaaatgtggcagagcctaacagaggagaaggctcatgcacatttggaacctggcggcagcgcaaaagatg

SEQ ID NO: 233537 - DNA, 103 bp, Artificial Sequence
  Synthetic Polynucleotide
taatacgactcactatagggcattcctgtcatgccaggcatcccaaatgtaacagaggagaacatttatgatgcctggcaacctggcggcagcgcaaaagatg

SEQ ID NO: 233538 - DNA, 103 bp, Artificial Sequence
  Synthetic Polynucleotide
taatacgactcactataggggtgcagaagcagactgatcactcttctctcaacagaggagagagagaatggtgatcagtaacctggcggcagcgcaaaagatg

SEQ ID NO: 233539 - DNA, 103 bp, Artificial Sequence
  Synthetic Polynucleotide
taatacgactcactatagggaggagccagccattcctgtcatgccaggcaaacagaggagatgcctgatgtgacaggaaaacctggcggcagcgcaaaagatg

SEQ ID NO: 233540 - DNA, 103 bp, Artificial Sequence
  Synthetic Polynucleotide
taatacgactcactatagggtcttcaagcaaggagccagccattcctgtcaacagaggagagacaggatgggctggctcaacctggcggcagcgcaaaagatg

SEQ ID NO: 233541 - DNA, 103 bp, Artificial Sequence
  Synthetic Polynucleotide
taatacgactcactatagggctgctttaggtcttcaagcaaggagccagcaacagaggagagctggcatgttgcttgaaaacctggcggcagcgcaaaagatg

SEQ ID NO: 233542 - DNA, 103 bp, Artificial Sequence
  Synthetic Polynucleotide
taatacgactcactatagggtttgaatctgctgctttaggtcttcaagcaaacagaggagatgcttgatgacctaaagcaacctggcggcagcgcaaaagatg

SEQ ID NO: 233543 - DNA, 103 bp, Artificial Sequence
  Synthetic Polynucleotide
taatacgactcactatagggtgatgttgggtttgaatctgctgctttaggaacagaggagacctaaaatggcagattcaaacctggcggcagcgcaaaagatg

SEQ ID NO: 233544 - DNA, 103 bp, Artificial Sequence
  Synthetic Polynucleotide
taatacgactcactatagggttgaccaacgtgatgttgggtttgaatctgaacagaggagacagattatgacccaacataacctggcggcagcgcaaaagatg

SEQ ID NO: 233545 - DNA, 103 bp, Artificial Sequence
  Synthetic Polynucleotide
taatacgactcactatagggggagttgagtttgaccaacgtgatgttgggaacagaggagacccaacatgacgttggtcaacctggcggcagcgcaaaagatg

SEQ ID NO: 233546 - DNA, 103 bp, Artificial Sequence
  Synthetic Polynucleotide
taatacgactcactatagggtgtagtatctggagttgagtttgaccaacgaacagaggagacgttggatgaactcaactaacctggcggcagcgcaaaagatg

SEQ ID NO: 233547 - DNA, 103 bp, Artificial Sequence
  Synthetic Polynucleotide
taatacgactcactatagggtgcttgttgctgtagtatctggagttgagtaacagaggagaactcaaatgcagatactaaacctggcggcagcgcaaaagatg

SEQ ID NO: 233548 - DNA, 103 bp, Artificial Sequence
  Synthetic Polynucleotide
taatacgactcactatagggggtattgttgtgcttgttgctgtagtatctaacagaggagaagatacatgagcaacaagaacctggcggcagcgcaaaagatg

SEQ ID NO: 233549 - DNA, 103 bp, Artificial Sequence
  Synthetic Polynucleotide
taatacgactcactatagggaacgacataggtgcagaagcagactgatcaaacagaggagatgatcaatgtgcttctgcaacctggcggcagcgcaaaagatg

SEQ ID NO: 233550 - DNA, 103 bp, Artificial Sequence
  Synthetic Polynucleotide
taatacgactcactatagggtgtgtggcttggtattgttgtgcttgttgcaacagaggagagcaacaatgacaacaataaacctggcggcagcgcaaaagatg

SEQ ID NO: 233551 - DNA, 103 bp, Artificial Sequence
  Synthetic Polynucleotide
taatacgactcactatagggcagctggggctgtgtggcttggtattgttgaacagaggagacaacaaatgcaagccacaaacctggcggcagcgcaaaagatg

SEQ ID NO: 233552 - DNA, 103 bp, Artificial Sequence
  Synthetic Polynucleotide
taatacgactcactatagggtttgaggctgcagctggggctgtgtggcttaacagaggagaaagccaatgagccccagcaacctggcggcagcgcaaaagatg

SEQ ID NO: 233553 - DNA, 103 bp, Artificial Sequence
  Synthetic Polynucleotide
taatacgactcactatagggtgctgttgtttttgaggctgcagctggggcaacagaggagagccccaatggcagcctcaaacctggcggcagcgcaaaagatg

SEQ ID NO: 233554 - DNA, 103 bp, Artificial Sequence
  Synthetic Polynucleotide
taatacgactcactatagggtggtggctgctgctgttgtttttgaggctgaacagaggagacagcctatgaaacaacagaacctggcggcagcgcaaaagatg

SEQ ID NO: 233555 - DNA, 103 bp, Artificial Sequence
  Synthetic Polynucleotide
taatacgactcactataggggctgtggaggtggtggctgctgctgttgttaacagaggagaaacaacatgagcagccacaacctggcggcagcgcaaaagatg

SEQ ID NO: 233556 - DNA, 103 bp, Artificial Sequence
  Synthetic Polynucleotide
taatacgactcactatagggtgctgctgctgctgtggaggtggtggctgcaacagaggagagcagccatgacctccacaaacctggcggcagcgcaaaagatg

SEQ ID NO: 233557 - DNA, 103 bp, Artificial Sequence
  Synthetic Polynucleotide
taatacgactcactatagggtgcctgctgttgctgctgctgctgtggaggaacagaggagacctccaatgcagcagcagaacctggcggcagcgcaaaagatg

SEQ ID NO: 233558 - DNA, 103 bp, Artificial Sequence
  Synthetic Polynucleotide
taatacgactcactatagggataatttgcttgcctgctgttgctgctgctaacagaggagaagcagcatgaacagcaggaacctggcggcagcgcaaaagatg

SEQ ID NO: 233559 - DNA, 103 bp, Artificial Sequence
  Synthetic Polynucleotide
taatacgactcactatagggtcttgtttcaataatttgcttgcctgctgtaacagaggagaacagcaatgaagcaaattaacctggcggcagcgcaaaagatg

SEQ ID NO: 233560 - DNA, 103 bp, Artificial Sequence
  Synthetic Polynucleotide
taatacgactcactatagggctgtgggtagaacgacataggtgcagaagcaacagaggagagcttctatgcctatgtcgaacctggcggcagcgcaaaagatg

SEQ ID NO: 233561 - DNA, 103 bp, Artificial Sequence
  Synthetic Polynucleotide
taatacgactcactataggggttactttgctcttgtttcaataatttgctaacagaggagaagcaaaatgttgaaacaaaacctggcggcagcgcaaaagatg

SEQ ID NO: 233562 - DNA, 103 bp, Artificial Sequence
  Synthetic Polynucleotide
taatacgactcactatagggcactcactatgttactttgctcttgtttcaaacagaggagatgaaacatgagcaaagtaaacctggcggcagcgcaaaagatg

SEQ ID NO: 233563 - DNA, 103 bp, Artificial Sequence
  Synthetic Polynucleotide
taatacgactcactatagggtggcagtctgcactcactatgttactttgcaacagaggagagcaaagatgcatagtgagaacctggcggcagcgcaaaagatg

SEQ ID NO: 233564 - DNA, 103 bp, Artificial Sequence
  Synthetic Polynucleotide
taatacgactcactatagggcttcatgatttggcagtctgcactcactataacagaggagaatagtgatggcagactgcaacctggcggcagcgcaaaagatg

SEQ ID NO: 233565 - DNA, 103 bp, Artificial Sequence
  Synthetic Polynucleotide
taatacgactcactatagggatggcacatccttcatgatttggcagtctgaacagaggagacagactatgaaatcatgaaacctggcggcagcgcaaaagatg

SEQ ID NO: 233566 - DNA, 103 bp, Artificial Sequence
  Synthetic Polynucleotide
taatacgactcactatagggtccttataagatggcacatccttcatgattaacagaggagaaatcatatgggatgtgccaacctggcggcagcgcaaaagatg

SEQ ID NO: 233567 - DNA, 103 bp, Artificial Sequence
  Synthetic Polynucleotide
taatacgactcactatagggatcttctgcctccttataagatggcacatcaacagaggagagatgtgatgtcttataagaacctggcggcagcgcaaaagatg

SEQ ID NO: 233568 - DNA, 103 bp, Artificial Sequence
  Synthetic Polynucleotide
taatacgactcactatagggtttcagaaatatcttctgcctccttataagaacagaggagacttataatgaggcagaagaacctggcggcagcgcaaaagatg

SEQ ID NO: 233569 - DNA, 103 bp, Artificial Sequence
  Synthetic Polynucleotide
taatacgactcactatagggttttctggcttttcagaaatatcttctgccaacagaggagaggcagaatgtatttctgaaacctggcggcagcgcaaaagatg

SEQ ID NO: 233570 - DNA, 103 bp, Artificial Sequence
  Synthetic Polynucleotide
taatacgactcactatagggctgctttggtttttctggcttttcagaaataacagaggagaatttctatgaagccagaaaacctggcggcagcgcaaaagatg

SEQ ID NO: 233571 - DNA, 103 bp, Artificial Sequence
  Synthetic Polynucleotide
taatacgactcactatagggtgttgatgatctgtgggtagaacgacatagaacagaggagactatgtatgtctacccacaacctggcggcagcgcaaaagatg

SEQ ID NO: 233572 - DNA, 103 bp, Artificial Sequence
  Synthetic Polynucleotide
taatacgactcactatagggttataaattcctgctttggtttttctggctaacagaggagaagccagatgaaccaaagcaacctggcggcagcgcaaaagatg

SEQ ID NO: 233573 - DNA, 103 bp, Artificial Sequence
  Synthetic Polynucleotide
taatacgactcactatagggtcaccttcacttataaattcctgctttggtaacagaggagaaccaaaatgggaatttataacctggcggcagcgcaaaagatg

SEQ ID NO: 233574 - DNA, 103 bp, Artificial Sequence
  Synthetic Polynucleotide
taatacgactcactatagggtttgagtccttcaccttcacttataaattcaacagaggagagaatttatgagtgaaggtaacctggcggcagcgcaaaagatg

SEQ ID NO: 233575 - DNA, 103 bp, Artificial Sequence
  Synthetic Polynucleotide
taatacgactcactatagggctttgccttctttgagtccttcaccttcacaacagaggagagtgaagatgaaggactcaaacctggcggcagcgcaaaagatg

SEQ ID NO: 233576 - DNA, 103 bp, Artificial Sequence
  Synthetic Polynucleotide
taatacgactcactatagggttctttgtgtctttgccttctttgagtcctaacagaggagaaggactatgagaaggcaaaacctggcggcagcgcaaaagatg

SEQ ID NO: 233577 - DNA, 103 bp, Artificial Sequence
  Synthetic Polynucleotide
taatacgactcactatagggggatttttgcttctttgtgtctttgccttcaacagaggagagaaggcatggacacaaagaacctggcggcagcgcaaaagatg

SEQ ID NO: 233578 - DNA, 103 bp, Artificial Sequence
  Synthetic Polynucleotide
taatacgactcactatagggatggttccaaggatttttgcttctttgtgtaacagaggagaacacaaatgagcaaaaataacctggcggcagcgcaaaagatg

SEQ ID NO: 233579 - DNA, 103 bp, Artificial Sequence
  Synthetic Polynucleotide
taatacgactcactatagggggtgggatggatggttccaaggatttttgcaacagaggagagcaaaaatgcttggaaccaacctggcggcagcgcaaaagatg

SEQ ID NO: 233580 - DNA, 103 bp, Artificial Sequence
  Synthetic Polynucleotide
taatacgactcactatagggtattcggggtggtgggatggatggttccaaaacagaggagattggaaatgtccatcccaaacctggcggcagcgcaaaagatg

SEQ ID NO: 233581 - DNA, 103 bp, Artificial Sequence
  Synthetic Polynucleotide
taatacgactcactatagggcccctgaagctattcggggtggtgggatggaacagaggagaccatccatgcaccccgaaaacctggcggcagcgcaaaagatg

SEQ ID NO: 233582 - DNA, 103 bp, Artificial Sequence
  Synthetic Polynucleotide
taatacgactcactatagggatatgaaaagtgttgatgatctgtgggtagaacagaggagactacccatggatcatcaaaacctggcggcagcgcaaaagatg

SEQ ID NO: 233583 - DNA, 103 bp, Artificial Sequence
  Synthetic Polynucleotide
taatacgactcactatagggtttcctctggcccctgaagctattcggggtaacagaggagaaccccgatgagcttcaggaacctggcggcagcgcaaaagatg

SEQ ID NO: 233584 - DNA, 103 bp, Artificial Sequence
  Synthetic Polynucleotide
taatacgactcactatagggtttggcagcatttcctctggcccctgaagcaacagaggagagcttcaatggccagaggaaacctggcggcagcgcaaaagatg

SEQ ID NO: 233585 - DNA, 103 bp, Artificial Sequence
  Synthetic Polynucleotide
taatacgactcactatagggccaataacgctttggcagcatttcctctggaacagaggagaccagagatgatgctgccaaacctggcggcagcgcaaaagatg

SEQ ID NO: 233586 - DNA, 103 bp, Artificial Sequence
  Synthetic Polynucleotide
taatacgactcactatagggccaaagttttccaataacgctttggcagcaaacagaggagatgctgcatgagcgttattaacctggcggcagcgcaaaagatg

SEQ ID NO: 233587 - DNA, 103 bp, Artificial Sequence
  Synthetic Polynucleotide
taatacgactcactatagggcagttcaaaaccaaagttttccaataacgcaacagaggagagcgttaatggaaaactttaacctggcggcagcgcaaaagatg

SEQ ID NO: 233588 - DNA, 103 bp, Artificial Sequence
  Synthetic Polynucleotide
taatacgactcactatagggactgaatgaccagttcaaaaccaaagttttaacagaggagaaaaactatggttttgaacaacctggcggcagcgcaaaagatg

SEQ ID NO: 233589 - DNA, 103 bp, Artificial Sequence
  Synthetic Polynucleotide
taatacgactcactatagggttttcgttatactgaatgaccagttcaaaaaacagaggagattttgaatgggtcattcaaacctggcggcagcgcaaaagatg

SEQ ID NO: 233590 - DNA, 103 bp, Artificial Sequence
  Synthetic Polynucleotide
taatacgactcactatagggcttctgcctgttttcgttatactgaatgacaacagaggagagtcattatgtataacgaaaacctggcggcagcgcaaaagatg

SEQ ID NO: 233591 - DNA, 103 bp, Artificial Sequence
  Synthetic Polynucleotide
taatacgactcactatagggtcttctgtaccttctgcctgttttcgttataacagaggagaataacgatgacaggcagaaacctggcggcagcgcaaaagatg

SEQ ID NO: 233592 - DNA, 103 bp, Artificial Sequence
  Synthetic Polynucleotide
taatacgactcactatagggcttttgcccttcttctgtaccttctgcctgaacagaggagacaggcaatgggtacagaaaacctggcggcagcgcaaaagatg

SEQ ID NO: 233593 - DNA, 103 bp, Artificial Sequence
  Synthetic Polynucleotide
taatacgactcactatagggggatgaagcgatatgaaaagtgttgatgataacagaggagaatcatcatgacttttcataacctggcggcagcgcaaaagatg

SEQ ID NO: 233594 - DNA, 103 bp, Artificial Sequence
  Synthetic Polynucleotide
taatacgactcactataggggccttcaccacttttgcccttcttctgtacaacagaggagagtacagatgaagggcaaaaacctggcggcagcgcaaaagatg

SEQ ID NO: 233595 - DNA, 103 bp, Artificial Sequence
  Synthetic Polynucleotide
taatacgactcactatagggcagtgttttcgccttcaccacttttgccctaacagaggagaagggcaatggtggtgaagaacctggcggcagcgcaaaagatg

SEQ ID NO: 233596 - DNA, 103 bp, Artificial Sequence
  Synthetic Polynucleotide
taatacgactcactatagggtctagtttgtcagtgttttcgccttcaccaaacagaggagatggtgaatgcgaaaacacaacctggcggcagcgcaaaagatg

SEQ ID NO: 233597 - DNA, 103 bp, Artificial Sequence
  Synthetic Polynucleotide
taatacgactcactatagggtgttccacattctagtttgtcagtgttttcaacagaggagagaaaacatggacaaactaaacctggcggcagcgcaaaagatg

SEQ ID NO: 233598 - DNA, 103 bp, Artificial Sequence
  Synthetic Polynucleotide
taatacgactcactatagggatttaccacatgttccacattctagtttgtaacagaggagaacaaacatgaatgtggaaaacctggcggcagcgcaaaagatg

SEQ ID NO: 233599 - DNA, 103 bp, Artificial Sequence
  Synthetic Polynucleotide
taatacgactcactatagggttggaaaacaatttaccacatgttccacataacagaggagaatgtggatgatgtggtaaaacctggcggcagcgcaaaagatg

SEQ ID NO: 233600 - DNA, 103 bp, Artificial Sequence
  Synthetic Polynucleotide
taatacgactcactatagggaataagaacattggaaaacaatttaccacaaacagaggagatgtggtatgttgttttccaacctggcggcagcgcaaaagatg

SEQ ID NO: 233601 - DNA, 103 bp, Artificial Sequence
  Synthetic Polynucleotide
taatacgactcactataggggactctttaaaataagaacattggaaaacaaacagaggagatgttttatgatgttcttaaacctggcggcagcgcaaaagatg

SEQ ID NO: 233602 - DNA, 103 bp, Artificial Sequence
  Synthetic Polynucleotide
taatacgactcactatagggtgttcttggtgactctttaaaataagaacaaacagaggagatgttctatgtttaaagagaacctggcggcagcgcaaaagatg

SEQ ID NO: 233603 - DNA, 103 bp, Artificial Sequence
  Synthetic Polynucleotide
taatacgactcactatagggcccatgtacatgttcttggtgactctttaaaacagaggagattaaagatgcaccaagaaaacctggcggcagcgcaaaagatg

SEQ ID NO: 233604 - DNA, 103 bp, Artificial Sequence
  Synthetic Polynucleotide
taatacgactcactataggggtttcccgagggatgaagcgatatgaaaagaacagaggagacttttcatgtcgcttcataacctggcggcagcgcaaaagatg

SEQ ID NO: 233605 - DNA, 103 bp, Artificial Sequence
  Synthetic Polynucleotide
taatacgactcactataggggaaaaaattgcccatgtacatgttcttggtaacagaggagaaccaagatgatgtacatgaacctggcggcagcgcaaaagatg

SEQ ID NO: 233606 - DNA, 103 bp, Artificial Sequence
  Synthetic Polynucleotide
taatacgactcactataggggctgcatatggaaaaaattgcccatgtacaaacagaggagatgtacaatggcaatttttaacctggcggcagcgcaaaagatg

SEQ ID NO: 233607 - DNA, 103 bp, Artificial Sequence
  Synthetic Polynucleotide
taatacgactcactatagggtttttctagcgctgcatatggaaaaaattgaacagaggagacaatttatgccatatgcaaacctggcggcagcgcaaaagatg

SEQ ID NO: 233608 - DNA, 103 bp, Artificial Sequence
  Synthetic Polynucleotide
taatacgactcactataggggacgagcaaatttttctagcgctgcatatgaacagaggagacatatgatgcgctagaaaaacctggcggcagcgcaaaagatg

SEQ ID NO: 233609 - DNA, 103 bp, Artificial Sequence
  Synthetic Polynucleotide
taatacgactcactatagggtccctgtattgacgagcaaatttttctagcaacagaggagagctagaatgatttgctcgaacctggcggcagcgcaaaagatg

SEQ ID NO: 233610 - DNA, 103 bp, Artificial Sequence
  Synthetic Polynucleotide
taatacgactcactataggggtcataggcctccctgtattgacgagcaaaaacagaggagatttgctatgcaatacaggaacctggcggcagcgcaaaagatg

SEQ ID NO: 233611 - DNA, 103 bp, Artificial Sequence
  Synthetic Polynucleotide
taatacgactcactataggggataaagcttgtcataggcctccctgtattaacagaggagaaatacaatgaggcctatgaacctggcggcagcgcaaaagatg

SEQ ID NO: 233612 - DNA, 103 bp, Artificial Sequence
  Synthetic Polynucleotide
taatacgactcactatagggggagaaattggataaagcttgtcataggccaacagaggagaggcctaatgcaagctttaaacctggcggcagcgcaaaagatg

SEQ ID NO: 233613 - DNA, 103 bp, Artificial Sequence
  Synthetic Polynucleotide
taatacgactcactatagggtggagaagatggagaaattggataaagcttaacagaggagaaagcttatgccaatttctaacctggcggcagcgcaaaagatg

SEQ ID NO: 233614 - DNA, 103 bp, Artificial Sequence
  Synthetic Polynucleotide
taatacgactcactataggggcggcgtttctggagaagatggagaaattgaacagaggagacaatttatgcatcttctcaacctggcggcagcgcaaaagatg

SEQ ID NO: 233615 - DNA, 103 bp, Artificial Sequence
  Synthetic Polynucleotide
taatacgactcactatagggagttgtgtcgttccacatagctttgatgtgaacagaggagacacatcatggctatgtggaacctggcggcagcgcaaaagatg

SEQ ID NO: 233616 - DNA, 103 bp, Artificial Sequence
  Synthetic Polynucleotide
taatacgactcactataggggctgtaaatggtttcccgagggatgaagcgaacagaggagacgcttcatgcctcgggaaaacctggcggcagcgcaaaagatg

SEQ ID NO: 233617 - DNA, 103 bp, Artificial Sequence
  Synthetic Polynucleotide
taatacgactcactatagggggtggcgggggcggcgtttctggagaagataacagaggagaatcttcatgagaaacgccaacctggcggcagcgcaaaagatg

SEQ ID NO: 233618 - DNA, 103 bp, Artificial Sequence
  Synthetic Polynucleotide
taatacgactcactatagggaggaggaggaggtggcgggggcggcgtttcaacagaggagagaaacgatgcccccgccaaacctggcggcagcgcaaaagatg

SEQ ID NO: 233619 - DNA, 103 bp, Artificial Sequence
  Synthetic Polynucleotide
taatacgactcactataggggaggcaagggaggaggaggaggtggcggggaacagaggagaccccgcatgctcctcctcaacctggcggcagcgcaaaagatg

SEQ ID NO: 233620 - DNA, 103 bp, Artificial Sequence
  Synthetic Polynucleotide
taatacgactcactatagggggaggagccggaggcaagggaggaggaggaaacagaggagatcctccatgtcccttgccaacctggcggcagcgcaaaagatg

SEQ ID NO: 233621 - DNA, 103 bp, Artificial Sequence
  Synthetic Polynucleotide
taatacgactcactatagggagaaggctgtggaggagccggaggcaagggaacagaggagacccttgatgccggctcctaacctggcggcagcgcaaaagatg

SEQ ID NO: 233622 - DNA, 103 bp, Artificial Sequence
  Synthetic Polynucleotide
taatacgactcactataggggacccatagaagaaggctgtggaggagccgaacagaggagacggctcatgcacagccttaacctggcggcagcgcaaaagatg

SEQ ID NO: 233623 - DNA, 103 bp, Artificial Sequence
  Synthetic Polynucleotide
taatacgactcactatagggatctttacaggacccatagaagaaggctgtaacagaggagaacagccatgttctatgggaacctggcggcagcgcaaaagatg

SEQ ID NO: 233624 - DNA, 103 bp, Artificial Sequence
  Synthetic Polynucleotide
taatacgactcactatagggcgtgttggggatctttacaggacccatagaaacagaggagatctatgatgcctgtaaagaacctggcggcagcgcaaaagatg

SEQ ID NO: 233625 - DNA, 103 bp, Artificial Sequence
  Synthetic Polynucleotide
taatacgactcactataggggagtagaaaccgtgttggggatctttacagaacagaggagactgtaaatgtccccaacaaacctggcggcagcgcaaaagatg

SEQ ID NO: 233626 - DNA, 103 bp, Artificial Sequence
  Synthetic Polynucleotide
taatacgactcactataggggcttgcagaggagtagaaaccgtgttggggaacagaggagaccccaaatgggtttctacaacctggcggcagcgcaaaagatg

SEQ ID NO: 233627 - DNA, 103 bp, Artificial Sequence
  Synthetic Polynucleotide
taatacgactcactatagggagcctgatcggctgtaaatggtttcccgagaacagaggagactcgggatgccatttacaaacctggcggcagcgcaaaagatg

SEQ ID NO: 233628 - DNA, 103 bp, Artificial Sequence
  Synthetic Polynucleotide
taatacgactcactataggggggtggtggagcttgcagaggagtagaaacaacagaggagagtttctatgcctctgcaaaacctggcggcagcgcaaaagatg

SEQ ID NO: 233629 - DNA, 103 bp, Artificial Sequence
  Synthetic Polynucleotide
taatacgactcactatagggggggaggagtgggtggtggagcttgcagagaacagaggagactctgcatgctccaccacaacctggcggcagcgcaaaagatg

SEQ ID NO: 233630 - DNA, 103 bp, Artificial Sequence
  Synthetic Polynucleotide
taatacgactcactatagggggtggtggtgggggaggagtgggtggtggaaacagaggagatccaccatgcactcctccaacctggcggcagcgcaaaagatg

SEQ ID NO: 233631 - DNA, 103 bp, Artificial Sequence
  Synthetic Polynucleotide
taatacgactcactatagggaggaggaggtggtggtggtgggggaggagtaacagaggagaactcctatgccaccaccaaacctggcggcagcgcaaaagatg

SEQ ID NO: 233632 - DNA, 103 bp, Artificial Sequence
  Synthetic Polynucleotide
taatacgactcactataggggaggaggaggaggaggaggtggtggtggtgaacagaggagacaccacatgcacctcctcaacctggcggcagcgcaaaagatg

SEQ ID NO: 233633 - DNA, 103 bp, Artificial Sequence
  Synthetic Polynucleotide
taatacgactcactatagggggggggggaggaggaggaggaggaggaggtaacagaggagaacctccatgtcctcctccaacctggcggcagcgcaaaagatg

SEQ ID NO: 233634 - DNA, 103 bp, Artificial Sequence
  Synthetic Polynucleotide
taatacgactcactatagggtggaggaggtggggggggaggaggaggaggaacagaggagacctcctatgcctccccccaacctggcggcagcgcaaaagatg

SEQ ID NO: 233635 - DNA, 103 bp, Artificial Sequence
  Synthetic Polynucleotide
taatacgactcactataggggagcagaaggtggaggaggtggggggggagaacagaggagactccccatgcacctcctcaacctggcggcagcgcaaaagatg

SEQ ID NO: 233636 - DNA, 103 bp, Artificial Sequence
  Synthetic Polynucleotide
taatacgactcactatagggacctgtggaggagcagaaggtggaggaggtaacagaggagaacctccatgaccttctgcaacctggcggcagcgcaaaagatg

SEQ ID NO: 233637 - DNA, 103 bp, Artificial Sequence
  Synthetic Polynucleotide
taatacgactcactatagggcggcagttggacctgtggaggagcagaaggaacagaggagaccttctatgcctccacagaacctggcggcagcgcaaaagatg

SEQ ID NO: 233638 - DNA, 103 bp, Artificial Sequence
  Synthetic Polynucleotide
taatacgactcactatagggtatttgggaaagcctgatcggctgtaaatgaacagaggagacatttaatgccgatcaggaacctggcggcagcgcaaaagatg

SEQ ID NO: 233639 - DNA, 103 bp, Artificial Sequence
  Synthetic Polynucleotide
taatacgactcactatagggccagagaaaccggcagttggacctgtggagaacagaggagactccacatgtccaactgcaacctggcggcagcgcaaaagatg

SEQ ID NO: 233640 - DNA, 103 bp, Artificial Sequence
  Synthetic Polynucleotide
taatacgactcactatagggagcggcaggtccagagaaaccggcagttggaacagaggagaccaactatgggtttctctaacctggcggcagcgcaaaagatg

SEQ ID NO: 233641 - DNA, 103 bp, Artificial Sequence
  Synthetic Polynucleotide
taatacgactcactatagggggaaggaaagagcggcaggtccagagaaacaacagaggagagtttctatggacctgccgaacctggcggcagcgcaaaagatg

SEQ ID NO: 233642 - DNA, 103 bp, Artificial Sequence
  Synthetic Polynucleotide
taatacgactcactataggggcatcataatggaaggaaagagcggcaggtaacagaggagaacctgcatgtctttccttaacctggcggcagcgcaaaagatg

SEQ ID NO: 233643 - DNA, 103 bp, Artificial Sequence
  Synthetic Polynucleotide
taatacgactcactatagggtgcacaggttgcatcataatggaaggaaagaacagaggagactttccatgcattatgataacctggcggcagcgcaaaagatg

SEQ ID NO: 233644 - DNA, 103 bp, Artificial Sequence
  Synthetic Polynucleotide
taatacgactcactatagggcgcagggtgttgcacaggttgcatcataataacagaggagaattatgatgcaacctgtgaacctggcggcagcgcaaaagatg

SEQ ID NO: 233645 - DNA, 103 bp, Artificial Sequence
  Synthetic Polynucleotide
taatacgactcactatagggggggaggaagcgcagggtgttgcacaggttaacagaggagaaacctgatgaacaccctgaacctggcggcagcgcaaaagatg

SEQ ID NO: 233646 - DNA, 103 bp, Artificial Sequence
  Synthetic Polynucleotide
taatacgactcactatagggagggcaagctggggaggaagcgcagggtgtaacagaggagaacacccatggcttcctccaacctggcggcagcgcaaaagatg

SEQ ID NO: 233647 - DNA, 103 bp, Artificial Sequence
  Synthetic Polynucleotide
taatacgactcactatagggtggcagctgcagggcaagctggggaggaagaacagaggagacttcctatgcagcttgccaacctggcggcagcgcaaaagatg

SEQ ID NO: 233648 - DNA, 103 bp, Artificial Sequence
  Synthetic Polynucleotide
taatacgactcactatagggcgtccatctgtggcagctgcagggcaagctaacagaggagaagcttgatgtgcagctgcaacctggcggcagcgcaaaagatg

SEQ ID NO: 233649 - DNA, 103 bp, Artificial Sequence
  Synthetic Polynucleotide
taatacgactcactatagggaatgctgaggtatttgggaaagcctgatcgaacagaggagacgatcaatgtttcccaaaaacctggcggcagcgcaaaagatg

SEQ ID NO: 233650 - DNA, 103 bp, Artificial Sequence
  Synthetic Polynucleotide
taatacgactcactataggggcagagagtgcgtccatctgtggcagctgcaacagaggagagcagctatgacagatggaaacctggcggcagcgcaaaagatg

SEQ ID NO: 233651 - DNA, 103 bp, Artificial Sequence
  Synthetic Polynucleotide
taatacgactcactatagggggtgaggtctgcagagagtgcgtccatctgaacagaggagacagatgatggcactctctaacctggcggcagcgcaaaagatg

SEQ ID NO: 233652 - DNA, 103 bp, Artificial Sequence
  Synthetic Polynucleotide
taatacgactcactatagggggcaaagttgggtgaggtctgcagagagtgaacagaggagacactctatgcagacctcaaacctggcggcagcgcaaaagatg

SEQ ID NO: 233653 - DNA, 103 bp, Artificial Sequence
  Synthetic Polynucleotide
taatacgactcactatagggagctgctgctggcaaagttgggtgaggtctaacagaggagaagacctatgccaactttgaacctggcggcagcgcaaaagatg

SEQ ID NO: 233654 - DNA, 103 bp, Artificial Sequence
  Synthetic Polynucleotide
taatacgactcactatagggatctaatccgagctgctgctggcaaagttgaacagaggagacaacttatgcagcagcagaacctggcggcagcgcaaaagatg

SEQ ID NO: 233655 - DNA, 103 bp, Artificial Sequence
  Synthetic Polynucleotide
taatacgactcactatagggagaagttgggatctaatccgagctgctgctaacagaggagaagcagcatgtcggattagaacctggcggcagcgcaaaagatg

SEQ ID NO: 233656 - DNA, 103 bp, Artificial Sequence
  Synthetic Polynucleotide
taatacgactcactataggggaatgtcttaagaagttgggatctaatccgaacagaggagacggattatgtcccaacttaacctggcggcagcgcaaaagatg

SEQ ID NO: 233657 - DNA, 103 bp, Artificial Sequence
  Synthetic Polynucleotide
taatacgactcactatagggtttgaactgagaatgtcttaagaagttgggaacagaggagacccaacatgttaagacataacctggcggcagcgcaaaagatg

SEQ ID NO: 233658 - DNA, 103 bp, Artificial Sequence
  Synthetic Polynucleotide
taatacgactcactatagggtccgtgggcgtttgaactgagaatgtcttaaacagaggagataagacatgctcagttcaaacctggcggcagcgcaaaagatg

SEQ ID NO: 233659 - DNA, 103 bp, Artificial Sequence
  Synthetic Polynucleotide
taatacgactcactataggggtaattcttgtccgtgggcgtttgaactgaaacagaggagatcagttatgacgcccacgaacctggcggcagcgcaaaagatg

SEQ ID NO: 233660 - DNA, 103 bp, Artificial Sequence
  Synthetic Polynucleotide
taatacgactcactatagggaactcctgctaatgctgaggtatttgggaaaacagaggagattcccaatgacctcagcaaacctggcggcagcgcaaaagatg

SEQ ID NO: 233661 - DNA, 103 bp, Artificial Sequence
  Synthetic Polynucleotide
taatacgactcactatagggctgatcatctgtaattcttgtccgtgggcgaacagaggagacgcccaatgacaagaattaacctggcggcagcgcaaaagatg

SEQ ID NO: 233662 - DNA, 103 bp, Artificial Sequence
  Synthetic Polynucleotide
taatacgactcactatagggggatttttagctgatcatctgtaattcttgaacagaggagacaagaaatgcagatgatcaacctggcggcagcgcaaaagatg

SEQ ID NO: 233663 - DNA, 103 bp, Artificial Sequence
  Synthetic Polynucleotide
taatacgactcactatagggtaagccctcaggatttttagctgatcatctaacagaggagaagatgaatggctaaaaataacctggcggcagcgcaaaagatg

SEQ ID NO: 233664 - DNA, 103 bp, Artificial Sequence
  Synthetic Polynucleotide
taatacgactcactatagggaatgtcaaaataagccctcaggatttttagaacagaggagactaaaaatgctgagggctaacctggcggcagcgcaaaagatg

SEQ ID NO: 233665 - DNA, 103 bp, Artificial Sequence
  Synthetic Polynucleotide
taatacgactcactataggggagaattattaatgtcaaaataagccctcaaacagaggagatgagggatgattttgacaaacctggcggcagcgcaaaagatg

SEQ ID NO: 233666 - DNA, 103 bp, Artificial Sequence
  Synthetic Polynucleotide
taatacgactcactatagggtcttcacttggagaattattaatgtcaaaaaacagaggagattttgaatgtaataattcaacctggcggcagcgcaaaagatg

SEQ ID NO: 233667 - DNA, 103 bp, Artificial Sequence
  Synthetic Polynucleotide
taatacgactcactatagggctggatctgttcttcacttggagaattattaacagaggagaaataatatgccaagtgaaaacctggcggcagcgcaaaagatg

SEQ ID NO: 233668 - DNA, 103 bp, Artificial Sequence
  Synthetic Polynucleotide
taatacgactcactatagggctgccatttcctggatctgttcttcacttgaacagaggagacaagtgatgaacagatccaacctggcggcagcgcaaaagatg

SEQ ID NO: 233669 - DNA, 103 bp, Artificial Sequence
  Synthetic Polynucleotide
taatacgactcactatagggccagatttctctgccatttcctggatctgtaacagaggagaacagatatgggaaatggcaacctggcggcagcgcaaaagatg

SEQ ID NO: 233670 - DNA, 103 bp, Artificial Sequence
  Synthetic Polynucleotide
taatacgactcactatagggttgggagaggccagatttctctgccatttcaacagaggagagaaatgatggagaaatctaacctggcggcagcgcaaaagatg

SEQ ID NO: 233671 - DNA, 103 bp, Artificial Sequence
  Synthetic Polynucleotide
taatacgactcactatagggacacaggaccaactcctgctaatgctgaggaacagaggagacctcagatgtagcaggagaacctggcggcagcgcaaaagatg

SEQ ID NO: 233672 - DNA, 103 bp, Artificial Sequence
  Synthetic Polynucleotide
taatacgactcactatagggtgataactttttgggagaggccagatttctaacagaggagaagaaatatggcctctcccaacctggcggcagcgcaaaagatg

SEQ ID NO: 233673 - DNA, 103 bp, Artificial Sequence
  Synthetic Polynucleotide
taatacgactcactatagggaaccagtgtttgataactttttgggagaggaacagaggagacctctcatgaaaagttataacctggcggcagcgcaaaagatg

SEQ ID NO: 233674 - DNA, 103 bp, Artificial Sequence
  Synthetic Polynucleotide
taatacgactcactatagggcgtatttctaaaccagtgtttgataactttaacagaggagaaaagttatgaaacactggaacctggcggcagcgcaaaagatg

SEQ ID NO: 233675 - DNA, 103 bp, Artificial Sequence
  Synthetic Polynucleotide
taatacgactcactatagggccttaaaaagcgtatttctaaaccagtgttaacagaggagaaacactatgttagaaataaacctggcggcagcgcaaaagatg

SEQ ID NO: 233676 - DNA, 103 bp, Artificial Sequence
  Synthetic Polynucleotide
taatacgactcactatagggctctgtcgttccttaaaaagcgtatttctaaacagaggagatagaaaatggctttttaaaacctggcggcagcgcaaaagatg

SEQ ID NO: 233677 - DNA, 103 bp, Artificial Sequence
  Synthetic Polynucleotide
taatacgactcactatagggatctttatttctctgtcgttccttaaaaagaacagaggagactttttatggaacgacagaacctggcggcagcgcaaaagatg

SEQ ID NO: 233678 - DNA, 103 bp, Artificial Sequence
  Synthetic Polynucleotide
taatacgactcactatagggtgtatggtgaatctttatttctctgtcgttaacagaggagaaacgacatggaaataaagaacctggcggcagcgcaaaagatg

SEQ ID NO: 233679 - DNA, 103 bp, Artificial Sequence
  Synthetic Polynucleotide
taatacgactcactatagggttactgaagttgtatggtgaatctttatttaacagaggagaaaataaatgttcaccataaacctggcggcagcgcaaaagatg

SEQ ID NO: 233680 - DNA, 103 bp, Artificial Sequence
  Synthetic Polynucleotide
taatacgactcactatagggtataggagggttactgaagttgtatggtgaaacagaggagatcaccaatgaacttcagtaacctggcggcagcgcaaaagatg

SEQ ID NO: 233681 - DNA, 103 bp, Artificial Sequence
  Synthetic Polynucleotide
taatacgactcactatagggctaaaaccgttataggagggttactgaagtaacagaggagaacttcaatgaccctcctaaacctggcggcagcgcaaaagatg

SEQ ID NO: 233682 - DNA, 103 bp, Artificial Sequence
  Synthetic Polynucleotide
taatacgactcactatagggaaactgtgcaacacaggaccaactcctgctaacagaggagaagcaggatgtggtcctgtaacctggcggcagcgcaaaagatg

SEQ ID NO: 233683 - DNA, 103 bp, Artificial Sequence
  Synthetic Polynucleotide
taatacgactcactatagggctgatatcttctaaaaccgttataggagggaacagaggagaccctccatgaacggttttaacctggcggcagcgcaaaagatg

SEQ ID NO: 233684 - DNA, 103 bp, Artificial Sequence
  Synthetic Polynucleotide
taatacgactcactatagggtggatcaattctgatatcttctaaaaccgtaacagaggagaacggttatggaagatatcaacctggcggcagcgcaaaagatg

SEQ ID NO: 233685 - DNA, 103 bp, Artificial Sequence
  Synthetic Polynucleotide
taatacgactcactatagggaggtgggctgtggatcaattctgatatcttaacagaggagaaagataatggaattgatcaacctggcggcagcgcaaaagatg

SEQ ID NO: 233686 - DNA, 103 bp, Artificial Sequence
  Synthetic Polynucleotide
taatacgactcactatagggtgttctaaagaggtgggctgtggatcaattaacagaggagaaattgaatgacagcccacaacctggcggcagcgcaaaagatg

SEQ ID NO: 233687 - DNA, 103 bp, Artificial Sequence
  Synthetic Polynucleotide
taatacgactcactatagggagatttgtaatgttctaaagaggtgggctgaacagaggagacagcccatgtctttagaaaacctggcggcagcgcaaaagatg

SEQ ID NO: 233688 - DNA, 103 bp, Artificial Sequence
  Synthetic Polynucleotide
taatacgactcactatagggatgatgcatcagatttgtaatgttctaaagaacagaggagactttagatgattacaaataacctggcggcagcgcaaaagatg

SEQ ID NO: 233689 - DNA, 103 bp, Artificial Sequence
  Synthetic Polynucleotide
taatacgactcactatagggcttttactgaatgatgcatcagatttgtaaaacagaggagattacaaatgtgatgcatcaacctggcggcagcgcaaaagatg

SEQ ID NO: 233690 - DNA, 103 bp, Artificial Sequence
  Synthetic Polynucleotide
taatacgactcactatagggtctagaagaccttttactgaatgatgcatcaacagaggagagatgcaatgttcagtaaaaacctggcggcagcgcaaaagatg

SEQ ID NO: 233691 - DNA, 103 bp, Artificial Sequence
  Synthetic Polynucleotide
taatacgactcactatagggtaaatctcgttctagaagaccttttactgaaacagaggagatcagtaatgggtcttctaaacctggcggcagcgcaaaagatg

SEQ ID NO: 233692 - DNA, 103 bp, Artificial Sequence
  Synthetic Polynucleotide
taatacgactcactatagggtggtagtcagtaaatctcgttctagaagacaacagaggagagtcttcatgaacgagattaacctggcggcagcgcaaaagatg

SEQ ID NO: 233693 - DNA, 103 bp, Artificial Sequence
  Synthetic Polynucleotide
taatacgactcactatagggatagacacggaaactgtgcaacacaggaccaacagaggagaggtcctatgttgcacagtaacctggcggcagcgcaaaagatg

SEQ ID NO: 233694 - DNA, 103 bp, Artificial Sequence
  Synthetic Polynucleotide
taatacgactcactatagggaaccctaagctggtagtcagtaaatctcgtaacagaggagaacgagaatgactgactacaacctggcggcagcgcaaaagatg

SEQ ID NO: 233695 - DNA, 103 bp, Artificial Sequence
  Synthetic Polynucleotide
taatacgactcactatagggagtcttgcagaaccctaagctggtagtcagaacagaggagactgactatgagcttagggaacctggcggcagcgcaaaagatg

SEQ ID NO: 233696 - DNA, 103 bp, Artificial Sequence
  Synthetic Polynucleotide
taatacgactcactataggggtgtcaaaaaagtcttgcagaaccctaagcaacagaggagagcttagatgtctgcaagaaacctggcggcagcgcaaaagatg

SEQ ID NO: 233697 - DNA, 103 bp, Artificial Sequence
  Synthetic Polynucleotide
taatacgactcactataggggtaagcgtttgtgtcaaaaaagtcttgcagaacagaggagactgcaaatgttttttgacaacctggcggcagcgcaaaagatg

SEQ ID NO: 233698 - DNA, 103 bp, Artificial Sequence
  Synthetic Polynucleotide
taatacgactcactatagggcatcttttgggtaagcgtttgtgtcaaaaaaacagaggagatttttgatgcaaacgcttaacctggcggcagcgcaaaagatg

SEQ ID NO: 233699 - DNA, 103 bp, Artificial Sequence
  Synthetic Polynucleotide
taatacgactcactatagggtctatttcatcatcttttgggtaagcgtttaacagaggagaaaacgcatgcccaaaagaaacctggcggcagcgcaaaagatg

SEQ ID NO: 233700 - DNA, 103 bp, Artificial Sequence
  Synthetic Polynucleotide
taatacgactcactatagggggagagttgttctatttcatcatcttttggaacagaggagaccaaaaatggatgaaataaacctggcggcagcgcaaaagatg

SEQ ID NO: 233701 - DNA, 103 bp, Artificial Sequence
  Synthetic Polynucleotide
taatacgactcactatagggtgagaacagtggagagttgttctatttcataacagaggagaatgaaaatgaacaactctaacctggcggcagcgcaaaagatg

SEQ ID NO: 233702 - DNA, 103 bp, Artificial Sequence
  Synthetic Polynucleotide
taatacgactcactataggggtaggcagattgagaacagtggagagttgtaacagaggagaacaactatgcactgttctaacctggcggcagcgcaaaagatg

SEQ ID NO: 233703 - DNA, 103 bp, Artificial Sequence
  Synthetic Polynucleotide
taatacgactcactatagggaataacccgggtaggcagattgagaacagtaacagaggagaactgttatgaatctgcctaacctggcggcagcgcaaaagatg

SEQ ID NO: 233704 - DNA, 103 bp, Artificial Sequence
  Synthetic Polynucleotide
taatacgactcactataggggtcggagatcatagacacggaaactgtgcaaacagaggagatgcacaatgtccgtgtctaacctggcggcagcgcaaaagatg

SEQ ID NO: 233705 - DNA, 103 bp, Artificial Sequence
  Synthetic Polynucleotide
taatacgactcactatagggaccatacaacaataacccgggtaggcagataacagaggagaatctgcatgcccgggttaaacctggcggcagcgcaaaagatg

SEQ ID NO: 233706 - DNA, 103 bp, Artificial Sequence
  Synthetic Polynucleotide
taatacgactcactataggggcattctggaaccatacaacaataacccggaacagaggagaccgggtatgtgttgtatgaacctggcggcagcgcaaaagatg

SEQ ID NO: 233707 - DNA, 103 bp, Artificial Sequence
  Synthetic Polynucleotide
taatacgactcactatagggtttctgacgagcattctggaaccatacaacaacagaggagagttgtaatgttccagaataacctggcggcagcgcaaaagatg

SEQ ID NO: 233708 - DNA, 103 bp, Artificial Sequence
  Synthetic Polynucleotide
taatacgactcactatagggtctttcgtgctttctgacgagcattctggaaacagaggagatccagaatgctcgtcagaaacctggcggcagcgcaaaagatg

SEQ ID NO: 233709 - DNA, 103 bp, Artificial Sequence
  Synthetic Polynucleotide
taatacgactcactatagggttctcataactctttcgtgctttctgacgaaacagaggagatcgtcaatgagcacgaaaaacctggcggcagcgcaaaagatg

SEQ ID NO: 233710 - DNA, 103 bp, Artificial Sequence
  Synthetic Polynucleotide
taatacgactcactatagggttctgcttgattctcataactctttcgtgcaacagaggagagcacgaatgagttatgagaacctggcggcagcgcaaaagatg

SEQ ID NO: 233711 - DNA, 103 bp, Artificial Sequence
  Synthetic Polynucleotide
taatacgactcactatagggtatcttttgtttctgcttgattctcataacaacagaggagagttatgatgatcaagcagaacctggcggcagcgcaaaagatg

SEQ ID NO: 233712 - DNA, 103 bp, Artificial Sequence
  Synthetic Polynucleotide
taatacgactcactatagggcttttttcattatcttttgtttctgcttgaaacagaggagatcaagcatgaacaaaagaaacctggcggcagcgcaaaagatg

SEQ ID NO: 233713 - DNA, 103 bp, Artificial Sequence
  Synthetic Polynucleotide
taatacgactcactatagggagtgagttctcttttttcattatcttttgtaacagaggagaacaaaaatgaatgaaaaaaacctggcggcagcgcaaaagatg

SEQ ID NO: 233714 - DNA, 103 bp, Artificial Sequence
  Synthetic Polynucleotide
taatacgactcactatagggaccgttcattagtgagttctcttttttcataacagaggagaatgaaaatggagaactcaaacctggcggcagcgcaaaagatg

SEQ ID NO: 233715 - DNA, 103 bp, Artificial Sequence
  Synthetic Polynucleotide
taatacgactcactatagggtctctcttgtgtcggagatcatagacacggaacagaggagaccgtgtatgtgatctccgaacctggcggcagcgcaaaagatg

SEQ ID NO: 233716 - DNA, 103 bp, Artificial Sequence
  Synthetic Polynucleotide
taatacgactcactataggggttcgaatgtaccgttcattagtgagttctaacagaggagaagaactatgtaatgaacgaacctggcggcagcgcaaaagatg

SEQ ID NO: 233717 - DNA, 103 bp, Artificial Sequence
  Synthetic Polynucleotide
taatacgactcactatagggcatgttgcttgttcgaatgtaccgttcattaacagaggagaaatgaaatgtacattcgaaacctggcggcagcgcaaaagatg

SEQ ID NO: 233718 - DNA, 103 bp, Artificial Sequence
  Synthetic Polynucleotide
taatacgactcactatagggactggtactgcatgttgcttgttcgaatgtaacagaggagaacattcatgcaagcaacaaacctggcggcagcgcaaaagatg

SEQ ID NO: 233719 - DNA, 103 bp, Artificial Sequence
  Synthetic Polynucleotide
taatacgactcactatagggcactttttacactggtactgcatgttgcttaacagaggagaaagcaaatggcagtaccaaacctggcggcagcgcaaaagatg

SEQ ID NO: 233720 - DNA, 103 bp, Artificial Sequence
  Synthetic Polynucleotide
taatacgactcactatagggaaccacattgcactttttacactggtactgaacagaggagacagtacatgtgtaaaaagaacctggcggcagcgcaaaagatg

SEQ ID NO: 233721 - DNA, 103 bp, Artificial Sequence
  Synthetic Polynucleotide
taatacgactcactatagggtcctggggaaaaccacattgcactttttacaacagaggagagtaaaaatggcaatgtggaacctggcggcagcgcaaaagatg

SEQ ID NO: 233722 - DNA, 103 bp, Artificial Sequence
  Synthetic Polynucleotide
taatacgactcactatagggaagtcaaagatcctggggaaaaccacattgaacagaggagacaatgtatgtttccccagaacctggcggcagcgcaaaagatg

SEQ ID NO: 233723 - DNA, 103 bp, Artificial Sequence
  Synthetic Polynucleotide
taatacgactcactatagggatgcgtaatcaagtcaaagatcctggggaaaacagaggagattccccatgatctttgacaacctggcggcagcgcaaaagatg

SEQ ID NO: 233724 - DNA, 103 bp, Artificial Sequence
  Synthetic Polynucleotide
taatacgactcactataggggctttttctgatgcgtaatcaagtcaaagaaacagaggagatctttgatgtgattacgcaacctggcggcagcgcaaaagatg

SEQ ID NO: 233725 - DNA, 103 bp, Artificial Sequence
  Synthetic Polynucleotide
taatacgactcactatagggttgtaacactgctttttctgatgcgtaatcaacagaggagagattacatgtcagaaaaaaacctggcggcagcgcaaaagatg

SEQ ID NO: 233726 - DNA, 103 bp, Artificial Sequence
  Synthetic Polynucleotide
taatacgactcactatagggctcattatcaagttgtgtcgttccacatagaacagaggagactatgtatgacgacacaaaacctggcggcagcgcaaaagatg

SEQ ID NO: 233727 - DNA, 103 bp, Artificial Sequence
  Synthetic Polynucleotide
taatacgactcactatagggatagtctttctctctcttgtgtcggagatcaacagaggagagatctcatgcacaagagaaacctggcggcagcgcaaaagatg

SEQ ID NO: 233728 - DNA, 103 bp, Artificial Sequence
  Synthetic Polynucleotide
taatacgactcactatagggatcttcatccttgtaacactgctttttctgaacagaggagacagaaaatgcagtgttacaacctggcggcagcgcaaaagatg

SEQ ID NO: 233729 - DNA, 103 bp, Artificial Sequence
  Synthetic Polynucleotide
taatacgactcactataggggggcatcatcatcttcatccttgtaacactaacagaggagaagtgttatgaggatgaagaacctggcggcagcgcaaaagatg

SEQ ID NO: 233730 - DNA, 103 bp, Artificial Sequence
  Synthetic Polynucleotide
taatacgactcactatagggctttcatcttgggcatcatcatcttcatccaacagaggagaggatgaatgtgatgatgcaacctggcggcagcgcaaaagatg

SEQ ID NO: 233731 - DNA, 103 bp, Artificial Sequence
  Synthetic Polynucleotide
taatacgactcactatagggttctgtttggctttcatcttgggcatcatcaacagaggagagatgatatgcaagatgaaaacctggcggcagcgcaaaagatg

SEQ ID NO: 233732 - DNA, 103 bp, Artificial Sequence
  Synthetic Polynucleotide
taatacgactcactatagggccatggagtcttctgtttggctttcatcttaacagaggagaaagatgatggccaaacagaacctggcggcagcgcaaaagatg

SEQ ID NO: 233733 - DNA, 103 bp, Artificial Sequence
  Synthetic Polynucleotide
taatacgactcactatagggtcagtggcatccatggagtcttctgtttggaacagaggagaccaaacatgagactccataacctggcggcagcgcaaaagatg

SEQ ID NO: 233734 - DNA, 103 bp, Artificial Sequence
  Synthetic Polynucleotide
taatacgactcactatagggtaccacttgatcagtggcatccatggagtcaacagaggagagactccatggatgccactaacctggcggcagcgcaaaagatg

SEQ ID NO: 233735 - DNA, 103 bp, Artificial Sequence
  Synthetic Polynucleotide
taatacgactcactatagggaatgcttgtataccacttgatcagtggcataacagaggagaatgccaatgatcaagtggaacctggcggcagcgcaaaagatg

SEQ ID NO: 233736 - DNA, 103 bp, Artificial Sequence
  Synthetic Polynucleotide
taatacgactcactataggggacactgtgcaatgcttgtataccacttgaaacagaggagatcaagtatgatacaagcaaacctggcggcagcgcaaaagatg

SEQ ID NO: 233737 - DNA, 103 bp, Artificial Sequence
  Synthetic Polynucleotide
taatacgactcactatagggcgtttggccagacactgtgcaatgcttgtaaacagaggagatacaagatgtgcacagtgaacctggcggcagcgcaaaagatg

SEQ ID NO: 233738 - DNA, 103 bp, Artificial Sequence
  Synthetic Polynucleotide
taatacgactcactatagggcactggttagatagtctttctctctcttgtaacagaggagaacaagaatgagaaagactaacctggcggcagcgcaaaagatg

SEQ ID NO: 233739 - DNA, 103 bp, Artificial Sequence
  Synthetic Polynucleotide
taatacgactcactatagggtagctgcatccgtttggccagacactgtgcaacagaggagagcacagatgctggccaaaaacctggcggcagcgcaaaagatg

SEQ ID NO: 233740 - DNA, 103 bp, Artificial Sequence
  Synthetic Polynucleotide
taatacgactcactataggggcagcgtttttagctgcatccgtttggccaaacagaggagatggccaatgggatgcagcaacctggcggcagcgcaaaagatg

SEQ ID NO: 233741 - DNA, 103 bp, Artificial Sequence
  Synthetic Polynucleotide
taatacgactcactatagggtgcaggggcagcagcgtttttagctgcatcaacagaggagagatgcaatgaaaaacgctaacctggcggcagcgcaaaagatg

SEQ ID NO: 233742 - DNA, 103 bp, Artificial Sequence
  Synthetic Polynucleotide
taatacgactcactatagggcagaacttgctgcaggggcagcagcgttttaacagaggagaaaaacgatgctgcccctgaacctggcggcagcgcaaaagatg

SEQ ID NO: 233743 - DNA, 103 bp, Artificial Sequence
  Synthetic Polynucleotide
taatacgactcactataggggtcccagagccagaacttgctgcaggggcaaacagaggagatgccccatgagcaagttcaacctggcggcagcgcaaaagatg

SEQ ID NO: 233744 - DNA, 103 bp, Artificial Sequence
  Synthetic Polynucleotide
taatacgactcactataggggggggtgctggtcccagagccagaacttgcaacagaggagagcaagtatgggctctgggaacctggcggcagcgcaaaagatg

SEQ ID NO: 233745 - DNA, 103 bp, Artificial Sequence
  Synthetic Polynucleotide
taatacgactcactatagggatggaatcaggggggtgctggtcccagagcaacagaggagagctctgatgccagcacccaacctggcggcagcgcaaaagatg

SEQ ID NO: 233746 - DNA, 103 bp, Artificial Sequence
  Synthetic Polynucleotide
taatacgactcactatagggggtttgggtgatggaatcaggggggtgctgaacagaggagacagcacatgcctgattccaacctggcggcagcgcaaaagatg

SEQ ID NO: 233747 - DNA, 103 bp, Artificial Sequence
  Synthetic Polynucleotide
taatacgactcactatagggctcaggttctggtttgggtgatggaatcagaacagaggagactgattatgtcacccaaaaacctggcggcagcgcaaaagatg

SEQ ID NO: 233748 - DNA, 103 bp, Artificial Sequence
  Synthetic Polynucleotide
taatacgactcactataggggagaagtcttctcaggttctggtttgggtgaacagaggagacacccaatgcagaacctgaacctggcggcagcgcaaaagatg

SEQ ID NO: 233749 - DNA, 103 bp, Artificial Sequence
  Synthetic Polynucleotide
taatacgactcactataggggctgagccatcactggttagatagtctttcaacagaggagagaaagaatgtctaaccagaacctggcggcagcgcaaaagatg

SEQ ID NO: 233750 - DNA, 103 bp, Artificial Sequence
  Synthetic Polynucleotide
taatacgactcactatagggtcaggttttggagaagtcttctcaggttctaacagaggagaagaaccatggaagacttcaacctggcggcagcgcaaaagatg

SEQ ID NO: 233751 - DNA, 103 bp, Artificial Sequence
  Synthetic Polynucleotide
taatacgactcactatagggtgcgggatattcaggttttggagaagtcttaacagaggagaaagactatgccaaaacctaacctggcggcagcgcaaaagatg

SEQ ID NO: 233752 - DNA, 103 bp, Artificial Sequence
  Synthetic Polynucleotide
taatacgactcactatagggttggcttttctgcgggatattcaggttttgaacagaggagacaaaacatgaatatcccgaacctggcggcagcgcaaaagatg

SEQ ID NO: 233753 - DNA, 103 bp, Artificial Sequence
  Synthetic Polynucleotide
taatacgactcactatagggtcactctgctttggcttttctgcgggatataacagaggagaatatccatgagaaaagccaacctggcggcagcgcaaaagatg

SEQ ID NO: 233754 - DNA, 103 bp, Artificial Sequence
  Synthetic Polynucleotide
taatacgactcactataggggggagaggggtcactctgctttggcttttcaacagaggagagaaaagatgaagcagagtaacctggcggcagcgcaaaagatg

SEQ ID NO: 233755 - DNA, 103 bp, Artificial Sequence
  Synthetic Polynucleotide
taatacgactcactatagggcttgagaagggggagaggggtcactctgctaacagaggagaagcagaatgacccctctcaacctggcggcagcgcaaaagatg

SEQ ID NO: 233756 - DNA, 103 bp, Artificial Sequence
  Synthetic Polynucleotide
taatacgactcactatagggggtttggtgccttgagaagggggagaggggaacagaggagacccctcatgcccttctcaaacctggcggcagcgcaaaagatg

SEQ ID NO: 233757 - DNA, 103 bp, Artificial Sequence
  Synthetic Polynucleotide
taatacgactcactatagggtggcagggctggtttggtgccttgagaaggaacagaggagaccttctatgggcaccaaaaacctggcggcagcgcaaaagatg

SEQ ID NO: 233758 - DNA, 103 bp, Artificial Sequence
  Synthetic Polynucleotide
taatacgactcactatagggtcgatgctaatggcagggctggtttggtgcaacagaggagagcaccaatgcagccctgcaacctggcggcagcgcaaaagatg

SEQ ID NO: 233759 - DNA, 103 bp, Artificial Sequence
  Synthetic Polynucleotide
taatacgactcactatagggtccgaggaagtcgatgctaatggcagggctaacagaggagaagccctatgattagcatcaacctggcggcagcgcaaaagatg

SEQ ID NO: 233760 - DNA, 103 bp, Artificial Sequence
  Synthetic Polynucleotide
taatacgactcactatagggggagtttttggctgagccatcactggttagaacagaggagactaaccatggatggctcaaacctggcggcagcgcaaaagatg

SEQ ID NO: 233761 - DNA, 103 bp, Artificial Sequence
  Synthetic Polynucleotide
taatacgactcactatagggctgtggtgggtccgaggaagtcgatgctaaaacagaggagattagcaatgacttcctcgaacctggcggcagcgcaaaagatg

SEQ ID NO: 233762 - DNA, 103 bp, Artificial Sequence
  Synthetic Polynucleotide
taatacgactcactatagggctgtggatgcctgtggtgggtccgaggaagaacagaggagacttcctatgacccaccacaacctggcggcagcgcaaaagatg

SEQ ID NO: 233763 - DNA, 103 bp, Artificial Sequence
  Synthetic Polynucleotide
taatacgactcactatagggtgtggctgggctgtggatgcctgtggtgggaacagaggagacccaccatgggcatccacaacctggcggcagcgcaaaagatg

SEQ ID NO: 233764 - DNA, 103 bp, Artificial Sequence
  Synthetic Polynucleotide
taatacgactcactatagggtggctgtggctgtggctgggctgtggatgcaacagaggagagcatccatggcccagccaaacctggcggcagcgcaaaagatg

SEQ ID NO: 233765 - DNA, 103 bp, Artificial Sequence
  Synthetic Polynucleotide
taatacgactcactatagggttggtggctgtggctgtggctgtggctgggaacagaggagacccagcatgagccacagcaacctggcggcagcgcaaaagatg

SEQ ID NO: 233766 - DNA, 103 bp, Artificial Sequence
  Synthetic Polynucleotide
taatacgactcactatagggtggggttgttttggtggctgtggctgtggcaacagaggagagccacaatgacagccaccaacctggcggcagcgcaaaagatg

SEQ ID NO: 233767 - DNA, 103 bp, Artificial Sequence
  Synthetic Polynucleotide
taatacgactcactatagggtccgataagttggggttgttttggtggctgaacagaggagacagccaatgaaacaacccaacctggcggcagcgcaaaagatg

SEQ ID NO: 233768 - DNA, 103 bp, Artificial Sequence
  Synthetic Polynucleotide
taatacgactcactatagggagggaggtcttccgataagttggggttgttaacagaggagaaacaacatgaacttatcgaacctggcggcagcgcaaaagatg

SEQ ID NO: 233769 - DNA, 103 bp, Artificial Sequence
  Synthetic Polynucleotide
taatacgactcactatagggtgagaggccgagggaggtcttccgataagtaacagaggagaacttatatgaagacctccaacctggcggcagcgcaaaagatg

SEQ ID NO: 233770 - DNA, 103 bp, Artificial Sequence
  Synthetic Polynucleotide
taatacgactcactataggggaccggtgtttgagaggccgagggaggtctaacagaggagaagacctatgtcggcctctaacctggcggcagcgcaaaagatg

SEQ ID NO: 233771 - DNA, 103 bp, Artificial Sequence
  Synthetic Polynucleotide
taatacgactcactatagggtggacacacaggagtttttggctgagccataacagaggagaatggctatgccaaaaactaacctggcggcagcgcaaaagatg

SEQ ID NO: 233772 - DNA, 103 bp, Artificial Sequence
  Synthetic Polynucleotide
taatacgactcactataggggactggaagggaccggtgtttgagaggccgaacagaggagacggcctatgaaacaccggaacctggcggcagcgcaaaagatg

SEQ ID NO: 233773 - DNA, 103 bp, Artificial Sequence
  Synthetic Polynucleotide
taatacgactcactatagggatttgcagtggactggaagggaccggtgttaacagaggagaaacaccatgcccttccagaacctggcggcagcgcaaaagatg

SEQ ID NO: 233774 - DNA, 103 bp, Artificial Sequence
  Synthetic Polynucleotide
taatacgactcactatagggcgtcatggaaatttgcagtggactggaaggaacagaggagaccttccatgccactgcaaaacctggcggcagcgcaaaagatg

SEQ ID NO: 233775 - DNA, 103 bp, Artificial Sequence
  Synthetic Polynucleotide
taatacgactcactatagggtctggagagacgtcatggaaatttgcagtgaacagaggagacactgcatgtttccatgaaacctggcggcagcgcaaaagatg

SEQ ID NO: 233776 - DNA, 103 bp, Artificial Sequence
  Synthetic Polynucleotide
taatacgactcactatagggggtagactgttctggagagacgtcatggaaaacagaggagattccatatggtctctccaaacctggcggcagcgcaaaagatg

SEQ ID NO: 233777 - DNA, 103 bp, Artificial Sequence
  Synthetic Polynucleotide
taatacgactcactatagggtaactgtggaggtagactgttctggagagaaacagaggagatctctcatgaacagtctaaacctggcggcagcgcaaaagatg

SEQ ID NO: 233778 - DNA, 103 bp, Artificial Sequence
  Synthetic Polynucleotide
taatacgactcactatagggggtattgtagtaactgtggaggtagactgtaacagaggagaacagtcatgctccacagtaacctggcggcagcgcaaaagatg

SEQ ID NO: 233779 - DNA, 103 bp, Artificial Sequence
  Synthetic Polynucleotide
taatacgactcactatagggtgatcacattggtattgtagtaactgtggaaacagaggagatccacaatgactacaataaacctggcggcagcgcaaaagatg

SEQ ID NO: 233780 - DNA, 103 bp, Artificial Sequence
  Synthetic Polynucleotide
taatacgactcactatagggaactgtacactgatcacattggtattgtagaacagaggagactacaaatgcaatgtgataacctggcggcagcgcaaaagatg

SEQ ID NO: 233781 - DNA, 103 bp, Artificial Sequence
  Synthetic Polynucleotide
taatacgactcactatagggttgggaaggcaactgtacactgatcacattaacagaggagaaatgtgatgagtgtacagaacctggcggcagcgcaaaagatg

SEQ ID NO: 233782 - DNA, 103 bp, Artificial Sequence
  Synthetic Polynucleotide
taatacgactcactataggggggacatctttggacacacaggagtttttgaacagaggagacaaaaaatgctgtgtgtcaacctggcggcagcgcaaaagatg

SEQ ID NO: 233783 - DNA, 103 bp, Artificial Sequence
  Synthetic Polynucleotide
taatacgactcactatagggagttccagagttgggaaggcaactgtacacaacagaggagagtgtacatgtgccttcccaacctggcggcagcgcaaaagatg

SEQ ID NO: 233784 - DNA, 103 bp, Artificial Sequence
  Synthetic Polynucleotide
taatacgactcactatagggttcctgccagagttccagagttgggaaggcaacagaggagagccttcatgactctggaaaacctggcggcagcgcaaaagatg

SEQ ID NO: 233785 - DNA, 103 bp, Artificial Sequence
  Synthetic Polynucleotide
taatacgactcactatagggtgtgctggtgttcctgccagagttccagagaacagaggagactctggatgtctggcaggaacctggcggcagcgcaaaagatg

SEQ ID NO: 233786 - DNA, 103 bp, Artificial Sequence
  Synthetic Polynucleotide
taatacgactcactatagggaggaagtgcatgtgctggtgttcctgccagaacagaggagactggcaatgacaccagcaaacctggcggcagcgcaaaagatg

SEQ ID NO: 233787 - DNA, 103 bp, Artificial Sequence
  Synthetic Polynucleotide
taatacgactcactatagggttgagcagcaaggaagtgcatgtgctggtgaacagaggagacaccagatgatgcacttcaacctggcggcagcgcaaaagatg

SEQ ID NO: 233788 - DNA, 103 bp, Artificial Sequence
  Synthetic Polynucleotide
taatacgactcactatagggggaattggttttgagcagcaaggaagtgcaaacagaggagatgcactatgttgctgctcaacctggcggcagcgcaaaagatg

SEQ ID NO: 233789 - DNA, 103 bp, Artificial Sequence
  Synthetic Polynucleotide
taatacgactcactatagggggagagtgaaggaattggttttgagcagcaaacagaggagatgctgcatgaaaccaattaacctggcggcagcgcaaaagatg

SEQ ID NO: 233790 - DNA, 103 bp, Artificial Sequence
  Synthetic Polynucleotide
taatacgactcactatagggttccaagaacggagagtgaaggaattggttaacagaggagaaaccaaatgcttcactctaacctggcggcagcgcaaaagatg

SEQ ID NO: 233791 - DNA, 103 bp, Artificial Sequence
  Synthetic Polynucleotide
taatacgactcactatagggccatgggcctttccaagaacggagagtgaaaacagaggagattcactatgcgttcttggaacctggcggcagcgcaaaagatg

SEQ ID NO: 233792 - DNA, 103 bp, Artificial Sequence
  Synthetic Polynucleotide
taatacgactcactatagggtagggcatgtccatgggcctttccaagaacaacagaggagagttcttatgaaggcccataacctggcggcagcgcaaaagatg

SEQ ID NO: 233793 - DNA, 103 bp, Artificial Sequence
  Synthetic Polynucleotide
taatacgactcactatagggcacattgttagggacatctttggacacacaaacagaggagatgtgtgatgaaagatgtcaacctggcggcagcgcaaaagatg

SEQ ID NO: 233794 - DNA, 103 bp, Artificial Sequence
  Synthetic Polynucleotide
taatacgactcactatagggaaatatcatgtagggcatgtccatgggcctaacagaggagaaggcccatggacatgcccaacctggcggcagcgcaaaagatg

SEQ ID NO: 233795 - DNA, 103 bp, Artificial Sequence
  Synthetic Polynucleotide
taatacgactcactatagggtgttggggtcaaatatcatgtagggcatgtaacagaggagaacatgcatgacatgatataacctggcggcagcgcaaaagatg

SEQ ID NO: 233796 - DNA, 103 bp, Artificial Sequence
  Synthetic Polynucleotide
taatacgactcactatagggatcagcggattgttggggtcaaatatcatgaacagaggagacatgatatgtgaccccaaaacctggcggcagcgcaaaagatg

SEQ ID NO: 233797 - DNA, 103 bp, Artificial Sequence
  Synthetic Polynucleotide
taatacgactcactatagggttgtccagtcatcagcggattgttggggtcaacagaggagagaccccatgaatccgctgaacctggcggcagcgcaaaagatg

SEQ ID NO: 233798 - DNA, 103 bp, Artificial Sequence
  Synthetic Polynucleotide
taatacgactcactatagggtgcccagcagttgtccagtcatcagcggataacagaggagaatccgcatgtgactggacaacctggcggcagcgcaaaagatg

SEQ ID NO: 233799 - DNA, 103 bp, Artificial Sequence
  Synthetic Polynucleotide
taatacgactcactataggggtgagggaactgcccagcagttgtccagtcaacagaggagagactggatgactgctgggaacctggcggcagcgcaaaagatg

SEQ ID NO: 233800 - DNA, 103 bp, Artificial Sequence
  Synthetic Polynucleotide
taatacgactcactataggggggcatttgagtgagggaactgcccagcagaacagaggagactgctgatgagttccctcaacctggcggcagcgcaaaagatg

SEQ ID NO: 233801 - DNA, 103 bp, Artificial Sequence
  Synthetic Polynucleotide
taatacgactcactatagggtggcctgagggggcatttgagtgagggaacaacagaggagagttcccatgctcaaatgcaacctggcggcagcgcaaaagatg

SEQ ID NO: 233802 - DNA, 103 bp, Artificial Sequence
  Synthetic Polynucleotide
taatacgactcactatagggtgggaggaactggcctgagggggcatttgaaacagaggagatcaaatatgccctcaggcaacctggcggcagcgcaaaagatg

SEQ ID NO: 233803 - DNA, 103 bp, Artificial Sequence
  Synthetic Polynucleotide
taatacgactcactatagggggctgtggtgtgggaggaactggcctgaggaacagaggagacctcagatgagttcctccaacctggcggcagcgcaaaagatg

SEQ ID NO: 233804 - DNA, 103 bp, Artificial Sequence
  Synthetic Polynucleotide
taatacgactcactatagggtggacaagtccacattgttagggacatcttaacagaggagaaagatgatgctaacaatgaacctggcggcagcgcaaaagatg

SEQ ID NO: 233805 - DNA, 103 bp, Artificial Sequence
  Synthetic Polynucleotide
taatacgactcactatagggccgttgtgggggctgtggtgtgggaggaacaacagaggagagttcctatgacaccacagaacctggcggcagcgcaaaagatg

SEQ ID NO: 233806 - DNA, 103 bp, Artificial Sequence
  Synthetic Polynucleotide
taatacgactcactataggggaagcagcaaccgttgtgggggctgtggtgaacagaggagacaccacatgccccacaacaacctggcggcagcgcaaaagatg

SEQ ID NO: 233807 - DNA, 103 bp, Artificial Sequence
  Synthetic Polynucleotide
taatacgactcactatagggcctttttagggaagcagcaaccgttgtgggaacagaggagacccacaatggttgctgctaacctggcggcagcgcaaaagatg

SEQ ID NO: 233808 - DNA, 103 bp, Artificial Sequence
  Synthetic Polynucleotide
taatacgactcactatagggcgtctagtttcctttttagggaagcagcaaaacagaggagattgctgatgccctaaaaaaacctggcggcagcgcaaaagatg

SEQ ID NO: 233809 - DNA, 103 bp, Artificial Sequence
  Synthetic Polynucleotide
taatacgactcactatagggtcttctttatcgtctagtttcctttttaggaacagaggagacctaaaatggaaactagaaacctggcggcagcgcaaaagatg

SEQ ID NO: 233810 - DNA, 103 bp, Artificial Sequence
  Synthetic Polynucleotide
taatacgactcactataggggcaattattatcttctttatcgtctagtttaacagaggagaaaactaatggataaagaaaacctggcggcagcgcaaaagatg

SEQ ID NO: 233811 - DNA, 103 bp, Artificial Sequence
  Synthetic Polynucleotide
taatacgactcactatagggctttttcactgcaattattatcttctttataacagaggagaataaagatgataataattaacctggcggcagcgcaaaagatg

SEQ ID NO: 233812 - DNA, 103 bp, Artificial Sequence
  Synthetic Polynucleotide
taatacgactcactatagggttccctccttctttttcactgcaattattaaacagaggagataataaatgcagtgaaaaaacctggcggcagcgcaaaagatg

SEQ ID NO: 233813 - DNA, 103 bp, Artificial Sequence
  Synthetic Polynucleotide
taatacgactcactatagggttcaccgctattccctccttctttttcactaacagaggagaagtgaaatggaaggagggaacctggcggcagcgcaaaagatg

SEQ ID NO: 233814 - DNA, 103 bp, Artificial Sequence
  Synthetic Polynucleotide
taatacgactcactatagggggtgttggtcttcaccgctattccctccttaacagaggagaaaggagatgatagcggtgaacctggcggcagcgcaaaagatg

SEQ ID NO: 233815 - DNA, 103 bp, Artificial Sequence
  Synthetic Polynucleotide
taatacgactcactatagggccatcgaatttggacaagtccacattgttaaacagaggagataacaaatgggacttgtcaacctggcggcagcgcaaaagatg

SEQ ID NO: 233816 - DNA, 103 bp, Artificial Sequence
  Synthetic Polynucleotide
taatacgactcactatagggcgtttatctcggtgttggtcttcaccgctaaacagaggagatagcggatgagaccaacaaacctggcggcagcgcaaaagatg

SEQ ID NO: 233817 - DNA, 103 bp, Artificial Sequence
  Synthetic Polynucleotide
taatacgactcactatagggggttctcaagcgtttatctcggtgttggtcaacagaggagagaccaaatgcgagataaaaacctggcggcagcgcaaaagatg

SEQ ID NO: 233818 - DNA, 103 bp, Artificial Sequence
  Synthetic Polynucleotide
taatacgactcactataggggggtgatcgtggttctcaagcgtttatctcaacagaggagagagataatggcttgagaaaacctggcggcagcgcaaaagatg

SEQ ID NO: 233819 - DNA, 103 bp, Artificial Sequence
  Synthetic Polynucleotide
taatacgactcactatagggagctgttccggggtgatcgtggttctcaagaacagaggagacttgagatgcacgatcacaacctggcggcagcgcaaaagatg

SEQ ID NO: 233820 - DNA, 103 bp, Artificial Sequence
  Synthetic Polynucleotide
taatacgactcactataggggagtatttccagctgttccggggtgatcgtaacagaggagaacgatcatgccggaacagaacctggcggcagcgcaaaagatg

SEQ ID NO: 233821 - DNA, 103 bp, Artificial Sequence
  Synthetic Polynucleotide
taatacgactcactatagggatttttcatagagtatttccagctgttccgaacagaggagacggaacatgtggaaatacaacctggcggcagcgcaaaagatg

SEQ ID NO: 233822 - DNA, 103 bp, Artificial Sequence
  Synthetic Polynucleotide
taatacgactcactatagggtccagcaagtatttttcatagagtatttccaacagaggagaggaaatatgctatgaaaaaacctggcggcagcgcaaaagatg

SEQ ID NO: 233823 - DNA, 103 bp, Artificial Sequence
  Synthetic Polynucleotide
taatacgactcactatagggaggattggaatccagcaagtatttttcataaacagaggagatatgaaatgtacttgctgaacctggcggcagcgcaaaagatg

SEQ ID NO: 233824 - DNA, 103 bp, Artificial Sequence
  Synthetic Polynucleotide
taatacgactcactatagggtttttctggtaggattggaatccagcaagtaacagaggagaacttgcatgattccaatcaacctggcggcagcgcaaaagatg

SEQ ID NO: 233825 - DNA, 103 bp, Artificial Sequence
  Synthetic Polynucleotide
taatacgactcactatagggtgatcaagcatttttctggtaggattggaaaacagaggagattccaaatgtaccagaaaaacctggcggcagcgcaaaagatg

SEQ ID NO: 233826 - DNA, 103 bp, Artificial Sequence
  Synthetic Polynucleotide
taatacgactcactataggggctaacacaaccatcgaatttggacaagtcaacagaggagagacttgatgaaattcgataacctggcggcagcgcaaaagatg

SEQ ID NO: 233827 - DNA, 103 bp, Artificial Sequence
  Synthetic Polynucleotide
taatacgactcactataggggcgggcaatatgatcaagcatttttctggtaacagaggagaaccagaatgatgcttgataacctggcggcagcgcaaaagatg

SEQ ID NO: 233828 - DNA, 103 bp, Artificial Sequence
  Synthetic Polynucleotide
taatacgactcactataggggcccgacttcgcgggcaatatgatcaagcaaacagaggagatgcttgatgatattgcccaacctggcggcagcgcaaaagatg

SEQ ID NO: 233829 - DNA, 103 bp, Artificial Sequence
  Synthetic Polynucleotide
taatacgactcactatagggctttttttcagcccgacttcgcgggcaataaacagaggagatattgcatgcgaagtcggaacctggcggcagcgcaaaagatg

SEQ ID NO: 233830 - DNA, 103 bp, Artificial Sequence
  Synthetic Polynucleotide
taatacgactcactatagggttgcacgaccctttttttcagcccgacttcaacagaggagagaagtcatgctgaaaaaaaacctggcggcagcgcaaaagatg

SEQ ID NO: 233831 - DNA, 103 bp, Artificial Sequence
  Synthetic Polynucleotide
taatacgactcactatagggggaaccagacttgcacgaccctttttttcaaacagaggagatgaaaaatggggtcgtgcaacctggcggcagcgcaaaagatg

SEQ ID NO: 233832 - DNA, 103 bp, Artificial Sequence
  Synthetic Polynucleotide
taatacgactcactatagggcgtgtattctggaaccagacttgcacgaccaacagaggagaggtcgtatgagtctggttaacctggcggcagcgcaaaagatg

SEQ ID NO: 233833 - DNA, 103 bp, Artificial Sequence
  Synthetic Polynucleotide
taatacgactcactatagggctcccgcgctcgtgtattctggaaccagacaacagaggagagtctggatgcagaatacaaacctggcggcagcgcaaaagatg

SEQ ID NO: 233834 - DNA, 103 bp, Artificial Sequence
  Synthetic Polynucleotide
taatacgactcactatagggggcctttcctctcccgcgctcgtgtattctaacagaggagaagaataatggagcgcgggaacctggcggcagcgcaaaagatg

SEQ ID NO: 233835 - DNA, 103 bp, Artificial Sequence
  Synthetic Polynucleotide
taatacgactcactataggggcccggaactggcctttcctctcccgcgctaacagaggagaagcgcgatggaggaaaggaacctggcggcagcgcaaaagatg

SEQ ID NO: 233836 - DNA, 103 bp, Artificial Sequence
  Synthetic Polynucleotide
taatacgactcactatagggtggacccaccgcccggaactggcctttcctaacagaggagaaggaaaatgcagttccggaacctggcggcagcgcaaaagatg

SEQ ID NO: 233837 - DNA, 103 bp, Artificial Sequence
  Synthetic Polynucleotide
taatacgactcactatagggtctctggcacctcattatcaagttgtgtcgaacagaggagacgacacatgttgataatgaacctggcggcagcgcaaaagatg

SEQ ID NO: 233838 - DNA, 103 bp, Artificial Sequence
  Synthetic Polynucleotide
taatacgactcactatagggttttcccatcgctaacacaaccatcgaattaacagaggagaaattcgatggttgtgttaaacctggcggcagcgcaaaagatg

SEQ ID NO: 233839 - DNA, 103 bp, Artificial Sequence
  Synthetic Polynucleotide
taatacgactcactataggggagactgtgctggacccaccgcccggaactaacagaggagaagttccatgcggtgggtcaacctggcggcagcgcaaaagatg

SEQ ID NO: 233840 - DNA, 103 bp, Artificial Sequence
  Synthetic Polynucleotide
taatacgactcactatagggcaccgtttatgagactgtgctggacccaccaacagaggagaggtgggatgagcacagtcaacctggcggcagcgcaaaagatg

SEQ ID NO: 233841 - DNA, 103 bp, Artificial Sequence
  Synthetic Polynucleotide
taatacgactcactataggggcaaaacggacaccgtttatgagactgtgcaacagaggagagcacagatgcataaacggaacctggcggcagcgcaaaagatg

SEQ ID NO: 233842 - DNA, 103 bp, Artificial Sequence
  Synthetic Polynucleotide
taatacgactcactatagggacagggctcggcaaaacggacaccgtttataacagaggagaataaacatggtccgttttaacctggcggcagcgcaaaagatg

SEQ ID NO: 233843 - DNA, 103 bp, Artificial Sequence
  Synthetic Polynucleotide
taatacgactcactatagggtttgctttaaacagggctcggcaaaacggaaacagaggagatccgttatgccgagccctaacctggcggcagcgcaaaagatg

SEQ ID NO: 233844 - DNA, 103 bp, Artificial Sequence
  Synthetic Polynucleotide
taatacgactcactatagggtaaggccgactttgctttaaacagggctcgaacagaggagacgagccatgtttaaagcaaacctggcggcagcgcaaaagatg

SEQ ID NO: 233845 - DNA, 103 bp, Artificial Sequence
  Synthetic Polynucleotide
taatacgactcactatagggtgtggctttctaaggccgactttgctttaaaacagaggagattaaagatgagtcggcctaacctggcggcagcgcaaaagatg

SEQ ID NO: 233846 - DNA, 103 bp, Artificial Sequence
  Synthetic Polynucleotide
taatacgactcactatagggcgagagcgaatgtggctttctaaggccgacaacagaggagagtcggcatgagaaagccaaacctggcggcagcgcaaaagatg

SEQ ID NO: 233847 - DNA, 103 bp, Artificial Sequence
  Synthetic Polynucleotide
taatacgactcactatagggattccagtgccgagagcgaatgtggctttcaacagaggagagaaagcatgattcgctctaacctggcggcagcgcaaaagatg

SEQ ID NO: 233848 - DNA, 103 bp, Artificial Sequence
  Synthetic Polynucleotide
taatacgactcactataggggctttccttcattccagtgccgagagcgaaaacagaggagattcgctatgggcactggaaacctggcggcagcgcaaaagatg

SEQ ID NO: 233849 - DNA, 103 bp, Artificial Sequence
  Synthetic Polynucleotide
taatacgactcactatagggacaggtttccttttcccatcgctaacacaaaacagaggagattgtgtatgcgatgggaaaacctggcggcagcgcaaaagatg

SEQ ID NO: 233850 - DNA, 103 bp, Artificial Sequence
  Synthetic Polynucleotide
taatacgactcactatagggtaacctgcctgctttccttcattccagtgcaacagaggagagcactgatgtgaaggaaaaacctggcggcagcgcaaaagatg

SEQ ID NO: 233851 - DNA, 103 bp, Artificial Sequence
  Synthetic Polynucleotide
taatacgactcactatagggtggcaagctgtaacctgcctgctttccttcaacagaggagagaaggaatgcaggcaggtaacctggcggcagcgcaaaagatg

SEQ ID NO: 233852 - DNA, 103 bp, Artificial Sequence
  Synthetic Polynucleotide
taatacgactcactatagggaagggcttggtggcaagctgtaacctgcctaacagaggagaaggcagatgacagcttgcaacctggcggcagcgcaaaagatg

SEQ ID NO: 233853 - DNA, 103 bp, Artificial Sequence
  Synthetic Polynucleotide
taatacgactcactataggggtggatattaaagggcttggtggcaagctgaacagaggagacagcttatgaccaagcccaacctggcggcagcgcaaaagatg

SEQ ID NO: 233854 - DNA, 103 bp, Artificial Sequence
  Synthetic Polynucleotide
taatacgactcactatagggcccatcttcggtggatattaaagggcttggaacagaggagaccaagcatgttaatatccaacctggcggcagcgcaaaagatg

SEQ ID NO: 233855 - DNA, 103 bp, Artificial Sequence
  Synthetic Polynucleotide
taatacgactcactatagggggctttctcccccatcttcggtggatattaaacagaggagataatatatgccgaagatgaacctggcggcagcgcaaaagatg

SEQ ID NO: 233856 - DNA, 103 bp, Artificial Sequence
  Synthetic Polynucleotide
taatacgactcactatagggtatttctgtgggctttctcccccatcttcgaacagaggagacgaagaatggggagaaagaacctggcggcagcgcaaaagatg

SEQ ID NO: 233857 - DNA, 103 bp, Artificial Sequence
  Synthetic Polynucleotide
taatacgactcactatagggaaaatagatgtatttctgtgggctttctccaacagaggagaggagaaatgccacagaaaaacctggcggcagcgcaaaagatg

SEQ ID NO: 233858 - DNA, 103 bp, Artificial Sequence
  Synthetic Polynucleotide
taatacgactcactatagggatgggtaatcaaaatagatgtatttctgtgaacagaggagacacagaatgacatctattaacctggcggcagcgcaaaagatg

SEQ ID NO: 233859 - DNA, 103 bp, Artificial Sequence
  Synthetic Polynucleotide
taatacgactcactatagggaatggcaaagatgggtaatcaaaatagatgaacagaggagacatctaatgtgattacccaacctggcggcagcgcaaaagatg

SEQ ID NO: 233860 - DNA, 103 bp, Artificial Sequence
  Synthetic Polynucleotide
taatacgactcactatagggacacattaaaacaggtttccttttcccatcaacagaggagagatgggatgaggaaacctaacctggcggcagcgcaaaagatg

SEQ ID NO: 233861 - DNA, 103 bp, Artificial Sequence
  Synthetic Polynucleotide
taatacgactcactatagggaattttagttaatggcaaagatgggtaatcaacagaggagagattacatgtctttgccaaacctggcggcagcgcaaaagatg

SEQ ID NO: 233862 - DNA, 103 bp, Artificial Sequence
  Synthetic Polynucleotide
taatacgactcactatagggttgatagatcaattttagttaatggcaaagaacagaggagactttgcatgtaactaaaaaacctggcggcagcgcaaaagatg

SEQ ID NO: 233863 - DNA, 103 bp, Artificial Sequence
  Synthetic Polynucleotide
taatacgactcactatagggtcattctcacttgatagatcaattttagttaacagaggagaaactaaatgtgatctatcaacctggcggcagcgcaaaagatg

SEQ ID NO: 233864 - DNA, 103 bp, Artificial Sequence
  Synthetic Polynucleotide
taatacgactcactatagggagaagccaattcattctcacttgatagatcaacagaggagagatctaatgagtgagaataacctggcggcagcgcaaaagatg

SEQ ID NO: 233865 - DNA, 103 bp, Artificial Sequence
  Synthetic Polynucleotide
taatacgactcactatagggttgacactgtagaagccaattcattctcacaacagaggagagtgagaatgaattggcttaacctggcggcagcgcaaaagatg

SEQ ID NO: 233866 - DNA, 103 bp, Artificial Sequence
  Synthetic Polynucleotide
taatacgactcactatagggctaacaggtgttgacactgtagaagccaataacagaggagaattggcatgtacagtgtcaacctggcggcagcgcaaaagatg

SEQ ID NO: 233867 - DNA, 103 bp, Artificial Sequence
  Synthetic Polynucleotide
taatacgactcactatagggtgctgttttactaacaggtgttgacactgtaacagaggagaacagtgatgacacctgttaacctggcggcagcgcaaaagatg

SEQ ID NO: 233868 - DNA, 103 bp, Artificial Sequence
  Synthetic Polynucleotide
taatacgactcactataggggtgacagctctgctgttttactaacaggtgaacagaggagacacctgatggtaaaacagaacctggcggcagcgcaaaagatg

SEQ ID NO: 233869 - DNA, 103 bp, Artificial Sequence
  Synthetic Polynucleotide
taatacgactcactatagggagattcttcggtgacagctctgctgttttaaacagaggagataaaacatgagagctgtcaacctggcggcagcgcaaaagatg

SEQ ID NO: 233870 - DNA, 103 bp, Artificial Sequence
  Synthetic Polynucleotide
taatacgactcactatagggagggcttaaaagattcttcggtgacagctcaacagaggagagagctgatgccgaagaataacctggcggcagcgcaaaagatg

SEQ ID NO: 233871 - DNA, 103 bp, Artificial Sequence
  Synthetic Polynucleotide
taatacgactcactatagggtgcacaagaaacacattaaaacaggtttccaacagaggagaggaaacatgttttaatgtaacctggcggcagcgcaaaagatg

SEQ ID NO: 233872 - DNA, 103 bp, Artificial Sequence
  Synthetic Polynucleotide
taatacgactcactatagggtaaaagaagaagggcttaaaagattcttcgaacagaggagacgaagaatgttttaagccaacctggcggcagcgcaaaagatg

SEQ ID NO: 233873 - DNA, 103 bp, Artificial Sequence
  Synthetic Polynucleotide
taatacgactcactatagggcactctgctttaaaagaagaagggcttaaaaacagaggagatttaagatgttcttctttaacctggcggcagcgcaaaagatg

SEQ ID NO: 233874 - DNA, 103 bp, Artificial Sequence
  Synthetic Polynucleotide
taatacgactcactatagggatcctcagaacactctgctttaaaagaagaaacagaggagatcttctatgaaagcagagaacctggcggcagcgcaaaagatg

SEQ ID NO: 233875 - DNA, 103 bp, Artificial Sequence
  Synthetic Polynucleotide
taatacgactcactatagggaattctctacatcctcagaacactctgcttaacagaggagaaagcagatggttctgaggaacctggcggcagcgcaaaagatg

SEQ ID NO: 233876 - DNA, 103 bp, Artificial Sequence
  Synthetic Polynucleotide
taatacgactcactatagggggggcatttaaattctctacatcctcagaaaacagaggagattctgaatgtgtagagaaaacctggcggcagcgcaaaagatg

SEQ ID NO: 233877 - DNA, 103 bp, Artificial Sequence
  Synthetic Polynucleotide
taatacgactcactatagggctcagcaggaggggcatttaaattctctacaacagaggagagtagagatgttaaatgccaacctggcggcagcgcaaaagatg

SEQ ID NO: 233878 - DNA, 103 bp, Artificial Sequence
  Synthetic Polynucleotide
taatacgactcactatagggcatacccagcctcagcaggaggggcatttaaacagaggagataaatgatgctcctgctgaacctggcggcagcgcaaaagatg

SEQ ID NO: 233879 - DNA, 103 bp, Artificial Sequence
  Synthetic Polynucleotide
taatacgactcactatagggttattttgatcatacccagcctcagcaggaaacagaggagatcctgcatgggctgggtaaacctggcggcagcgcaaaagatg

SEQ ID NO: 233880 - DNA, 103 bp, Artificial Sequence
  Synthetic Polynucleotide
taatacgactcactatagggaaaatcggttttattttgatcatacccagcaacagaggagagctgggatggatcaaaataacctggcggcagcgcaaaagatg

SEQ ID NO: 233881 - DNA, 103 bp, Artificial Sequence
  Synthetic Polynucleotide
taatacgactcactatagggaagtctcatcaaaatcggttttattttgataacagaggagaatcaaaatgaaaccgattaacctggcggcagcgcaaaagatg

SEQ ID NO: 233882 - DNA, 103 bp, Artificial Sequence
  Synthetic Polynucleotide
taatacgactcactatagggaaagacaacttgcacaagaaacacattaaaaacagaggagatttaatatgtttcttgtgaacctggcggcagcgcaaaagatg

SEQ ID NO: 233883 - DNA, 103 bp, Artificial Sequence
  Synthetic Polynucleotide
taatacgactcactatagggttaatcgatgaagtctcatcaaaatcggttaacagaggagaaaccgaatgtgatgagacaacctggcggcagcgcaaaagatg

SEQ ID NO: 233884 - DNA, 103 bp, Artificial Sequence
  Synthetic Polynucleotide
taatacgactcactataggggattgccgtattaatcgatgaagtctcatcaacagaggagagatgagatgtcatcgattaacctggcggcagcgcaaaagatg

SEQ ID NO: 233885 - DNA, 103 bp, Artificial Sequence
  Synthetic Polynucleotide
taatacgactcactatagggtggcgtcactgattgccgtattaatcgatgaacagaggagacatcgaatgatacggcaaaacctggcggcagcgcaaaagatg

SEQ ID NO: 233886 - DNA, 103 bp, Artificial Sequence
  Synthetic Polynucleotide
taatacgactcactatagggtctccggtggtggcgtcactgattgccgtaaacagaggagatacggcatgcagtgacgcaacctggcggcagcgcaaaagatg

SEQ ID NO: 233887 - DNA, 103 bp, Artificial Sequence
  Synthetic Polynucleotide
taatacgactcactataggggtttccctcgtctccggtggtggcgtcactaacagaggagaagtgacatgaccaccggaaacctggcggcagcgcaaaagatg

SEQ ID NO: 233888 - DNA, 103 bp, Artificial Sequence
  Synthetic Polynucleotide
taatacgactcactatagggccatttcagtgtttccctcgtctccggtggaacagaggagaccaccgatgacgagggaaaacctggcggcagcgcaaaagatg

SEQ ID NO: 233889 - DNA, 103 bp, Artificial Sequence
  Synthetic Polynucleotide
taatacgactcactataggggtggtgctttccatttcagtgtttccctcgaacagaggagacgagggatgcactgaaataacctggcggcagcgcaaaagatg

SEQ ID NO: 233890 - DNA, 103 bp, Artificial Sequence
  Synthetic Polynucleotide
taatacgactcactatagggggaacttcctgtggtgctttccatttcagtaacagaggagaactgaaatggaaagcaccaacctggcggcagcgcaaaagatg

SEQ ID NO: 233891 - DNA, 103 bp, Artificial Sequence
  Synthetic Polynucleotide
taatacgactcactatagggtcacatctccggaacttcctgtggtgctttaacagaggagaaaagcaatgcaggaagttaacctggcggcagcgcaaaagatg

SEQ ID NO: 233892 - DNA, 103 bp, Artificial Sequence
  Synthetic Polynucleotide
taatacgactcactatagggaaagccggtttcacatctccggaacttcctaacagaggagaaggaagatgcggagatgtaacctggcggcagcgcaaaagatg

SEQ ID NO: 233893 - DNA, 103 bp, Artificial Sequence
  Synthetic Polynucleotide
taatacgactcactataggggatataaccaaaagacaacttgcacaagaaaacagaggagattcttgatgaagttgtctaacctggcggcagcgcaaaagatg

SEQ ID NO: 233894 - DNA, 103 bp, Artificial Sequence
  Synthetic Polynucleotide
taatacgactcactatagggtttgggagacaaagccggtttcacatctccaacagaggagaggagatatgaaaccggctaacctggcggcagcgcaaaagatg

SEQ ID NO: 233895 - DNA, 103 bp, Artificial Sequence
  Synthetic Polynucleotide
taatacgactcactatagggtttttggctctttgggagacaaagccggttaacagaggagaaaccggatgtgtctcccaaacctggcggcagcgcaaaagatg

SEQ ID NO: 233896 - DNA, 103 bp, Artificial Sequence
  Synthetic Polynucleotide
taatacgactcactataggggtatccagagtttttggctctttgggagacaacagaggagagtctccatgagagccaaaaacctggcggcagcgcaaaagatg

SEQ ID NO: 233897 - DNA, 103 bp, Artificial Sequence
  Synthetic Polynucleotide
taatacgactcactatagggttttggcagagtatccagagtttttggctcaacagaggagagagccaatgactctggataacctggcggcagcgcaaaagatg

SEQ ID NO: 233898 - DNA, 103 bp, Artificial Sequence
  Synthetic Polynucleotide
taatacgactcactatagggtggttgcaggttttggcagagtatccagagaacagaggagactctggatgctctgccaaaacctggcggcagcgcaaaagatg

SEQ ID NO: 233899 - DNA, 103 bp, Artificial Sequence
  Synthetic Polynucleotide
taatacgactcactataggggtggtaggtgtggttgcaggttttggcagaaacagaggagatctgccatgacctgcaacaacctggcggcagcgcaaaagatg

SEQ ID NO: 233900 - DNA, 103 bp, Artificial Sequence
  Synthetic Polynucleotide
taatacgactcactataggggcagacctccgtggtaggtgtggttgcaggaacagaggagacctgcaatgacacctaccaacctggcggcagcgcaaaagatg

SEQ ID NO: 233901 - DNA, 103 bp, Artificial Sequence
  Synthetic Polynucleotide
taatacgactcactatagggatttgtcatcgcagacctccgtggtaggtgaacagaggagacacctaatgcggaggtctaacctggcggcagcgcaaaagatg

SEQ ID NO: 233902 - DNA, 103 bp, Artificial Sequence
  Synthetic Polynucleotide
taatacgactcactataggggaaaagagaaatttgtcatcgcagacctccaacagaggagaggaggtatgcgatgacaaaacctggcggcagcgcaaaagatg

SEQ ID NO: 233903 - DNA, 103 bp, Artificial Sequence
  Synthetic Polynucleotide
taatacgactcactataggggcttgtgagagaaaagagaaatttgtcatcaacagaggagagatgacatgtttctctttaacctggcggcagcgcaaaagatg

SEQ ID NO: 233904 - DNA, 103 bp, Artificial Sequence
  Synthetic Polynucleotide
taatacgactcactatagggcaaatgacctgatataaccaaaagacaactaacagaggagaagttgtatgttggttataaacctggcggcagcgcaaaagatg

SEQ ID NO: 233905 - DNA, 103 bp, Artificial Sequence
  Synthetic Polynucleotide
taatacgactcactatagggggatggatgggcttgtgagagaaaagagaaaacagaggagattctctatgctctcacaaaacctggcggcagcgcaaaagatg

SEQ ID NO: 233906 - DNA, 103 bp, Artificial Sequence
  Synthetic Polynucleotide
taatacgactcactatagggtcattgaaatggatggatgggcttgtgagaaacagaggagatctcacatgcccatccataacctggcggcagcgcaaaagatg

SEQ ID NO: 233907 - DNA, 103 bp, Artificial Sequence
  Synthetic Polynucleotide
taatacgactcactataggggccatctttgtcattgaaatggatggatggaacagaggagaccatccatgcatttcaataacctggcggcagcgcaaaagatg

SEQ ID NO: 233908 - DNA, 103 bp, Artificial Sequence
  Synthetic Polynucleotide
taatacgactcactatagggggtcgtggtcgccatctttgtcattgaaataacagaggagaatttcaatgacaaagatgaacctggcggcagcgcaaaagatg

SEQ ID NO: 233909 - DNA, 103 bp, Artificial Sequence
  Synthetic Polynucleotide
taatacgactcactatagggtaaaagctttggtcgtggtcgccatctttgaacagaggagacaaagaatgcgaccacgaaacctggcggcagcgcaaaagatg

SEQ ID NO: 233910 - DNA, 103 bp, Artificial Sequence
  Synthetic Polynucleotide
taatacgactcactatagggatctgtgatgtaaaagctttggtcgtggtcaacagaggagagaccacatgcaaagctttaacctggcggcagcgcaaaagatg

SEQ ID NO: 233911 - DNA, 103 bp, Artificial Sequence
  Synthetic Polynucleotide
taatacgactcactatagggcatccgggtcatctgtgatgtaaaagctttaacagaggagaaaagctatgacatcacagaacctggcggcagcgcaaaagatg

SEQ ID NO: 233912 - DNA, 103 bp, Artificial Sequence
  Synthetic Polynucleotide
taatacgactcactatagggtcggcgttgtcatccgggtcatctgtgatgaacagaggagacatcacatgtgacccggaaacctggcggcagcgcaaaagatg

SEQ ID NO: 233913 - DNA, 103 bp, Artificial Sequence
  Synthetic Polynucleotide
taatacgactcactatagggttcgctgcggtcggcgttgtcatccgggtcaacagaggagagacccgatggacaacgccaacctggcggcagcgcaaaagatg

SEQ ID NO: 233914 - DNA, 103 bp, Artificial Sequence
  Synthetic Polynucleotide
taatacgactcactatagggtgctggacgtttcgctgcggtcggcgttgtaacagaggagaacaacgatgaccgcagcgaacctggcggcagcgcaaaagatg

SEQ ID NO: 233915 - DNA, 103 bp, Artificial Sequence
  Synthetic Polynucleotide
taatacgactcactataggggcatgggttacaaatgacctgatataaccaaacagaggagatggttaatgcaggtcattaacctggcggcagcgcaaaagatg

SEQ ID NO: 233916 - DNA, 103 bp, Artificial Sequence
  Synthetic Polynucleotide
taatacgactcactataggggggtccgctatgctggacgtttcgctgcggaacagaggagaccgcagatgaacgtccagaacctggcggcagcgcaaaagatg

SEQ ID NO: 233917 - DNA, 103 bp, Artificial Sequence
  Synthetic Polynucleotide
taatacgactcactatagggtggggagctcgggtccgctatgctggacgtaacagaggagaacgtccatgatagcggacaacctggcggcagcgcaaaagatg

SEQ ID NO: 233918 - DNA, 103 bp, Artificial Sequence
  Synthetic Polynucleotide
taatacgactcactatagggcgaatggatttggggagctcgggtccgctaaacagaggagatagcggatgcgagctcccaacctggcggcagcgcaaaagatg

SEQ ID NO: 233919 - DNA, 103 bp, Artificial Sequence
  Synthetic Polynucleotide
taatacgactcactatagggttgctggatccgaatggatttggggagctcaacagaggagagagctcatgaaatccattaacctggcggcagcgcaaaagatg

SEQ ID NO: 233920 - DNA, 103 bp, Artificial Sequence
  Synthetic Polynucleotide
taatacgactcactatagggtttaaagggattgctggatccgaatggattaacagaggagaaatccaatgggatccagcaacctggcggcagcgcaaaagatg

SEQ ID NO: 233921 - DNA, 103 bp, Artificial Sequence
  Synthetic Polynucleotide
taatacgactcactatagggtacttttggatttaaagggattgctggatcaacagaggagagatccaatgatccctttaaacctggcggcagcgcaaaagatg

SEQ ID NO: 233922 - DNA, 103 bp, Artificial Sequence
  Synthetic Polynucleotide
taatacgactcactatagggggccgatcattacttttggatttaaagggaaacagaggagatcccttatgatccaaaagaacctggcggcagcgcaaaagatg

SEQ ID NO: 233923 - DNA, 103 bp, Artificial Sequence
  Synthetic Polynucleotide
taatacgactcactatagggcttgtgacccggccgatcattacttttggaaacagaggagatccaaaatgaatgatcggaacctggcggcagcgcaaaagatg

SEQ ID NO: 233924 - DNA, 103 bp, Artificial Sequence
  Synthetic Polynucleotide
taatacgactcactatagggttcgaaaacgcttgtgacccggccgatcataacagaggagaatgatcatgcgggtcacaaacctggcggcagcgcaaaagatg

SEQ ID NO: 233925 - DNA, 103 bp, Artificial Sequence
  Synthetic Polynucleotide
taatacgactcactatagggctcatttgcgttcgaaaacgcttgtgacccaacagaggagagggtcaatggcgttttcgaacctggcggcagcgcaaaagatg

SEQ ID NO: 233926 - DNA, 103 bp, Artificial Sequence
  Synthetic Polynucleotide
taatacgactcactatagggatcatgcacagcatgggttacaaatgacctaacagaggagaaggtcaatggtaacccataacctggcggcagcgcaaaagatg

SEQ ID NO: 233927 - DNA, 103 bp, Artificial Sequence
  Synthetic Polynucleotide
taatacgactcactatagggttgaagattgctcatttgcgttcgaaaacgaacagaggagacgttttatgacgcaaatgaacctggcggcagcgcaaaagatg

SEQ ID NO: 233928 - DNA, 103 bp, Artificial Sequence
  Synthetic Polynucleotide
taatacgactcactataggggaaccttgagttgaagattgctcatttgcgaacagaggagacgcaaaatggcaatcttcaacctggcggcagcgcaaaagatg

SEQ ID NO: 233929 - DNA, 103 bp, Artificial Sequence
  Synthetic Polynucleotide
taatacgactcactatagggcaagccttgagaaccttgagttgaagattgaacagaggagacaatctatgactcaaggtaacctggcggcagcgcaaaagatg

SEQ ID NO: 233930 - DNA, 103 bp, Artificial Sequence
  Synthetic Polynucleotide
taatacgactcactataggggtcactaaagcaagccttgagaaccttgagaacagaggagactcaagatgctcaaggctaacctggcggcagcgcaaaagatg

SEQ ID NO: 233931 - DNA, 103 bp, Artificial Sequence
  Synthetic Polynucleotide
taatacgactcactataggggagttcggtagtcactaaagcaagccttgaaacagaggagatcaaggatggctttagtgaacctggcggcagcgcaaaagatg

SEQ ID NO: 233932 - DNA, 103 bp, Artificial Sequence
  Synthetic Polynucleotide
taatacgactcactatagggtgcatggttggagttcggtagtcactaaagaacagaggagactttagatgctaccgaacaacctggcggcagcgcaaaagatg

SEQ ID NO: 233933 - DNA, 103 bp, Artificial Sequence
  Synthetic Polynucleotide
taatacgactcactatagggttcacattcttgcatggttggagttcggtaaacagaggagataccgaatgccaaccatgaacctggcggcagcgcaaaagatg

SEQ ID NO: 233934 - DNA, 103 bp, Artificial Sequence
  Synthetic Polynucleotide
taatacgactcactatagggtccctaacatttcacattcttgcatggttgaacagaggagacaaccaatgaagaatgtgaacctggcggcagcgcaaaagatg

SEQ ID NO: 233935 - DNA, 103 bp, Artificial Sequence
  Synthetic Polynucleotide
taatacgactcactatagggccaatctcattccctaacatttcacattctaacagaggagaagaatgatgaatgttaggaacctggcggcagcgcaaaagatg

SEQ ID NO: 233936 - DNA, 103 bp, Artificial Sequence
  Synthetic Polynucleotide
taatacgactcactatagggtttgggcagaccaatctcattccctaacataacagaggagaatgttaatgaatgagattaacctggcggcagcgcaaaagatg

SEQ ID NO: 233937 - DNA, 103 bp, Artificial Sequence
  Synthetic Polynucleotide
taatacgactcactatagggtcatccgatgatcatgcacagcatgggttaaacagaggagataacccatgctgtgcatgaacctggcggcagcgcaaaagatg

SEQ ID NO: 233938 - DNA, 103 bp, Artificial Sequence
  Synthetic Polynucleotide
taatacgactcactatagggggactacgcgtttgggcagaccaatctcataacagaggagaatgagaatggtctgcccaaacctggcggcagcgcaaaagatg

SEQ ID NO: 233939 - DNA, 103 bp, Artificial Sequence
  Synthetic Polynucleotide
taatacgactcactatagggaaccacacctggactacgcgtttgggcagaaacagaggagatctgccatgacgcgtagtaacctggcggcagcgcaaaagatg

SEQ ID NO: 233940 - DNA, 103 bp, Artificial Sequence
  Synthetic Polynucleotide
taatacgactcactatagggtgcattttggaaccacacctggactacgcgaacagaggagacgcgtaatgcaggtgtggaacctggcggcagcgcaaaagatg

SEQ ID NO: 233941 - DNA, 103 bp, Artificial Sequence
  Synthetic Polynucleotide
taatacgactcactatagggcctttgcccttgcattttggaaccacacctaacagaggagaaggtgtatgtccaaaatgaacctggcggcagcgcaaaagatg

SEQ ID NO: 233942 - DNA, 103 bp, Artificial Sequence
  Synthetic Polynucleotide
taatacgactcactatagggaatttcttttcctttgcccttgcattttggaacagaggagaccaaaaatgaagggcaaaaacctggcggcagcgcaaaagatg

SEQ ID NO: 233943 - DNA, 103 bp, Artificial Sequence
  Synthetic Polynucleotide
taatacgactcactataggggttaattttaaatttcttttcctttgccctaacagaggagaagggcaatggaaaagaaaaacctggcggcagcgcaaaagatg

SEQ ID NO: 233944 - DNA, 103 bp, Artificial Sequence
  Synthetic Polynucleotide
taatacgactcactataggggcttccctatgttaattttaaatttcttttaacagaggagaaaaagaatgttaaaattaaacctggcggcagcgcaaaagatg

SEQ ID NO: 233945 - DNA, 103 bp, Artificial Sequence
  Synthetic Polynucleotide
taatacgactcactatagggatcatgaaaggcttccctatgttaattttaaacagaggagataaaatatgcatagggaaaacctggcggcagcgcaaaagatg

SEQ ID NO: 233946 - DNA, 103 bp, Artificial Sequence
  Synthetic Polynucleotide
taatacgactcactataggggccttgattgatcatgaaaggcttccctataacagaggagaatagggatgcctttcatgaacctggcggcagcgcaaaagatg

SEQ ID NO: 233947 - DNA, 103 bp, Artificial Sequence
  Synthetic Polynucleotide
taatacgactcactatagggcttccgttccgccttgattgatcatgaaagaacagaggagactttcaatgtcaatcaagaacctggcggcagcgcaaaagatg

SEQ ID NO: 233948 - DNA, 103 bp, Artificial Sequence
  Synthetic Polynucleotide
taatacgactcactatagggcctgcaactttctctggcacctcattatcaaacagaggagatgataaatgggtgccagaaacctggcggcagcgcaaaagatg

SEQ ID NO: 233949 - DNA, 103 bp, Artificial Sequence
  Synthetic Polynucleotide
taatacgactcactatagggtcattgagggtcatccgatgatcatgcacaaacagaggagatgtgcaatgtcatcggataacctggcggcagcgcaaaagatg

SEQ ID NO: 233950 - DNA, 103 bp, Artificial Sequence
  Synthetic Polynucleotide
taatacgactcactatagggggtttggtgccttccgttccgccttgattgaacagaggagacaatcaatgcggaacggaaacctggcggcagcgcaaaagatg

SEQ ID NO: 233951 - DNA, 103 bp, Artificial Sequence
  Synthetic Polynucleotide
taatacgactcactatagggggtacactctggtttggtgccttccgttccaacagaggagaggaacgatgggcaccaaaaacctggcggcagcgcaaaagatg

SEQ ID NO: 233952 - DNA, 103 bp, Artificial Sequence
  Synthetic Polynucleotide
taatacgactcactatagggccccgcagagggtacactctggtttggtgcaacagaggagagcaccaatgcagagtgtaaacctggcggcagcgcaaaagatg

SEQ ID NO: 233953 - DNA, 103 bp, Artificial Sequence
  Synthetic Polynucleotide
taatacgactcactataggggagtacttcaccccgcagagggtacactctaacagaggagaagagtgatgcctctgcggaacctggcggcagcgcaaaagatg

SEQ ID NO: 233954 - DNA, 103 bp, Artificial Sequence
  Synthetic Polynucleotide
taatacgactcactatagggcaagcgggcagagtacttcaccccgcagagaacagaggagactctgcatggtgaagtacaacctggcggcagcgcaaaagatg

SEQ ID NO: 233955 - DNA, 103 bp, Artificial Sequence
  Synthetic Polynucleotide
taatacgactcactatagggctctgatggacaagcgggcagagtacttcaaacagaggagatgaagtatgctgcccgctaacctggcggcagcgcaaaagatg

SEQ ID NO: 233956 - DNA, 103 bp, Artificial Sequence
  Synthetic Polynucleotide
taatacgactcactatagggaaaatgtgatctctgatggacaagcgggcaaacagaggagatgcccgatggtccatcagaacctggcggcagcgcaaaagatg

SEQ ID NO: 233957 - DNA, 103 bp, Artificial Sequence
  Synthetic Polynucleotide
taatacgactcactatagggctgtttggagaaaatgtgatctctgatggaaacagaggagatccatcatggatcacattaacctggcggcagcgcaaaagatg

SEQ ID NO: 233958 - DNA, 103 bp, Artificial Sequence
  Synthetic Polynucleotide
taatacgactcactatagggttgaaatgtgctgtttggagaaaatgtgataacagaggagaatcacaatgtctccaaacaacctggcggcagcgcaaaagatg

SEQ ID NO: 233959 - DNA, 103 bp, Artificial Sequence
  Synthetic Polynucleotide
taatacgactcactatagggtccctcacttttgaaatgtgctgtttggagaacagaggagactccaaatggcacatttcaacctggcggcagcgcaaaagatg

SEQ ID NO: 233960 - DNA, 103 bp, Artificial Sequence
  Synthetic Polynucleotide
taatacgactcactatagggctgctcctcgtcattgagggtcatccgatgaacagaggagacatcggatgaccctcaataacctggcggcagcgcaaaagatg

SEQ ID NO: 233961 - DNA, 103 bp, Artificial Sequence
  Synthetic Polynucleotide
taatacgactcactataggggccaacggtctccctcacttttgaaatgtgaacagaggagacacattatgaaagtgaggaacctggcggcagcgcaaaagatg

SEQ ID NO: 233962 - DNA, 103 bp, Artificial Sequence
  Synthetic Polynucleotide
taatacgactcactatagggcgagctgactgccaacggtctccctcacttaacagaggagaaagtgaatgagaccgttgaacctggcggcagcgcaaaagatg

SEQ ID NO: 233963 - DNA, 103 bp, Artificial Sequence
  Synthetic Polynucleotide
taatacgactcactatagggttctcccgatcgagctgactgccaacggtcaacagaggagagaccgtatgcagtcagctaacctggcggcagcgcaaaagatg

SEQ ID NO: 233964 - DNA, 103 bp, Artificial Sequence
  Synthetic Polynucleotide
taatacgactcactatagggcaagtaatctttctcccgatcgagctgactaacagaggagaagtcagatggatcgggagaacctggcggcagcgcaaaagatg

SEQ ID NO: 233965 - DNA, 103 bp, Artificial Sequence
  Synthetic Polynucleotide
taatacgactcactatagggtggtcggagccaagtaatctttctcccgataacagaggagaatcgggatgaagattactaacctggcggcagcgcaaaagatg

SEQ ID NO: 233966 - DNA, 103 bp, Artificial Sequence
  Synthetic Polynucleotide
taatacgactcactatagggtgccgaaccgtggtcggagccaagtaatctaacagaggagaagattaatgggctccgacaacctggcggcagcgcaaaagatg

SEQ ID NO: 233967 - DNA, 103 bp, Artificial Sequence
  Synthetic Polynucleotide
taatacgactcactatagggtgccatcagctgccgaaccgtggtcggagcaacagaggagagctccgatgacggttcggaacctggcggcagcgcaaaagatg

SEQ ID NO: 233968 - DNA, 103 bp, Artificial Sequence
  Synthetic Polynucleotide
taatacgactcactataggggttcttgctgtgccatcagctgccgaaccgaacagaggagacggttcatgagctgatggaacctggcggcagcgcaaaagatg

SEQ ID NO: 233969 - DNA, 103 bp, Artificial Sequence
  Synthetic Polynucleotide
taatacgactcactatagggatacgatcaagttcttgctgtgccatcagcaacagaggagagctgatatgacagcaagaaacctggcggcagcgcaaaagatg

SEQ ID NO: 233970 - DNA, 103 bp, Artificial Sequence
  Synthetic Polynucleotide
taatacgactcactatagggagctttctttatacgatcaagttcttgctgaacagaggagacagcaaatgcttgatcgtaacctggcggcagcgcaaaagatg

SEQ ID NO: 233971 - DNA, 103 bp, Artificial Sequence
  Synthetic Polynucleotide
taatacgactcactatagggtgaggagcttctgctcctcgtcattgagggaacagaggagaccctcaatgacgaggagcaacctggcggcagcgcaaaagatg

SEQ ID NO: 233972 - DNA, 103 bp, Artificial Sequence
  Synthetic Polynucleotide
taatacgactcactataggggcacgtctgaagctttctttatacgatcaaaacagaggagattgatcatgtaaagaaagaacctggcggcagcgcaaaagatg

SEQ ID NO: 233973 - DNA, 103 bp, Artificial Sequence
  Synthetic Polynucleotide
taatacgactcactataggggtcaagcccagcacgtctgaagctttctttaacagaggagaaaagaaatgttcagacgtaacctggcggcagcgcaaaagatg

SEQ ID NO: 233974 - DNA, 103 bp, Artificial Sequence
  Synthetic Polynucleotide
taatacgactcactatagggctgctgtaccgtcaagcccagcacgtctgaaacagaggagatcagacatgctgggcttgaacctggcggcagcgcaaaagatg

SEQ ID NO: 233975 - DNA, 103 bp, Artificial Sequence
  Synthetic Polynucleotide
taatacgactcactatagggtcatgcctggctgctgtaccgtcaagcccaaacagaggagatgggctatgcggtacagcaacctggcggcagcgcaaaagatg

SEQ ID NO: 233976 - DNA, 103 bp, Artificial Sequence
  Synthetic Polynucleotide
taatacgactcactatagggctgctgtccatcatgcctggctgctgtaccaacagaggagaggtacaatggccaggcataacctggcggcagcgcaaaagatg

SEQ ID NO: 233977 - DNA, 103 bp, Artificial Sequence
  Synthetic Polynucleotide
taatacgactcactataggggtggagagaactgctgtccatcatgcctggaacagaggagaccaggcatgatggacagcaacctggcggcagcgcaaaagatg

SEQ ID NO: 233978 - DNA, 103 bp, Artificial Sequence
  Synthetic Polynucleotide
taatacgactcactatagggggctgatgccgtggagagaactgctgtccaaacagaggagatggacaatggttctctccaacctggcggcagcgcaaaagatg

SEQ ID NO: 233979 - DNA, 103 bp, Artificial Sequence
  Synthetic Polynucleotide
taatacgactcactataggggctgttggcaggctgatgccgtggagagaaaacagaggagattctctatgcggcatcagaacctggcggcagcgcaaaagatg

SEQ ID NO: 233980 - DNA, 103 bp, Artificial Sequence
  Synthetic Polynucleotide
taatacgactcactatagggtccggggtaggctgttggcaggctgatgccaacagaggagaggcatcatgctgccaacaaacctggcggcagcgcaaaagatg

SEQ ID NO: 233981 - DNA, 103 bp, Artificial Sequence
  Synthetic Polynucleotide
taatacgactcactatagggggccggggagtccggggtaggctgttggcaaacagaggagatgccaaatgcctaccccgaacctggcggcagcgcaaaagatg

SEQ ID NO: 233982 - DNA, 103 bp, Artificial Sequence
  Synthetic Polynucleotide
taatacgactcactatagggcatttattactgaggagcttctgctcctcgaacagaggagacgaggaatggaagctcctaacctggcggcagcgcaaaagatg

SEQ ID NO: 233983 - DNA, 103 bp, Artificial Sequence
  Synthetic Polynucleotide
taatacgactcactatagggactggaggaaggccggggagtccggggtagaacagaggagactacccatgactccccggaacctggcggcagcgcaaaagatg

SEQ ID NO: 233984 - DNA, 103 bp, Artificial Sequence
  Synthetic Polynucleotide
taatacgactcactatagggggggagaaggactggaggaaggccggggagaacagaggagactccccatgcttcctccaaacctggcggcagcgcaaaagatg

SEQ ID NO: 233985 - DNA, 103 bp, Artificial Sequence
  Synthetic Polynucleotide
taatacgactcactatagggcgttcattccggggagaaggactggaggaaaacagaggagattcctcatgtccttctccaacctggcggcagcgcaaaagatg

SEQ ID NO: 233986 - DNA, 103 bp, Artificial Sequence
  Synthetic Polynucleotide
taatacgactcactataggggaggatggaccgttcattccggggagaaggaacagaggagaccttctatgcggaatgaaaacctggcggcagcgcaaaagatg

SEQ ID NO: 233987 - DNA, 103 bp, Artificial Sequence
  Synthetic Polynucleotide
taatacgactcactatagggtcccggcaaggaggatggaccgttcattccaacagaggagaggaatgatgggtccatccaacctggcggcagcgcaaaagatg

SEQ ID NO: 233988 - DNA, 103 bp, Artificial Sequence
  Synthetic Polynucleotide
taatacgactcactatagggtttgtggaaatcccggcaaggaggatggacaacagaggagagtccatatgccttgccggaacctggcggcagcgcaaaagatg

SEQ ID NO: 233989 - DNA, 103 bp, Artificial Sequence
  Synthetic Polynucleotide
taatacgactcactataggggtgtttgaattttgtggaaatcccggcaagaacagaggagacttgccatgatttccacaaacctggcggcagcgcaaaagatg

SEQ ID NO: 233990 - DNA, 103 bp, Artificial Sequence
  Synthetic Polynucleotide
taatacgactcactatagggaggtgttaaagtgtttgaattttgtggaaaaacagaggagatttccaatgaattcaaacaacctggcggcagcgcaaaagatg

SEQ ID NO: 233991 - DNA, 103 bp, Artificial Sequence
  Synthetic Polynucleotide
taatacgactcactatagggctgcaccgggaggtgttaaagtgtttgaataacagaggagaattcaaatgctttaacacaacctggcggcagcgcaaaagatg

SEQ ID NO: 233992 - DNA, 103 bp, Artificial Sequence
  Synthetic Polynucleotide
taatacgactcactatagggccaagcatgcctgcaccgggaggtgttaaaaacagaggagatttaacatgtcccggtgcaacctggcggcagcgcaaaagatg

SEQ ID NO: 233993 - DNA, 103 bp, Artificial Sequence
  Synthetic Polynucleotide
taatacgactcactatagggggcggagacgcatttattactgaggagcttaacagaggagaaagctcatgagtaataaaaacctggcggcagcgcaaaagatg

SEQ ID NO: 233994 - DNA, 103 bp, Artificial Sequence
  Synthetic Polynucleotide
taatacgactcactatagggagtaggaaacccaagcatgcctgcaccgggaacagaggagacccggtatgggcatgcttaacctggcggcagcgcaaaagatg

SEQ ID NO: 233995 - DNA, 103 bp, Artificial Sequence
  Synthetic Polynucleotide
taatacgactcactatagggaagtagctgaagtaggaaacccaagcatgcaacagaggagagcatgcatgggtttcctaaacctggcggcagcgcaaaagatg

SEQ ID NO: 233996 - DNA, 103 bp, Artificial Sequence
  Synthetic Polynucleotide
taatacgactcactataggggcaggagacgaagtagctgaagtaggaaacaacagaggagagtttccatgttcagctacaacctggcggcagcgcaaaagatg

SEQ ID NO: 233997 - DNA, 103 bp, Artificial Sequence
  Synthetic Polynucleotide
taatacgactcactataggggagagacagggcaggagacgaagtagctgaaacagaggagatcagctatgtcgtctcctaacctggcggcagcgcaaaagatg

SEQ ID NO: 233998 - DNA, 103 bp, Artificial Sequence
  Synthetic Polynucleotide
taatacgactcactataggggggcactgctgagagacagggcaggagacgaacagaggagacgtctcatgccctgtctcaacctggcggcagcgcaaaagatg

SEQ ID NO: 233999 - DNA, 103 bp, Artificial Sequence
  Synthetic Polynucleotide
taatacgactcactatagggggtttggtgggggcactgctgagagacaggaacagaggagacctgtcatgcagcagtgcaacctggcggcagcgcaaaagatg

SEQ ID NO: 234000 - DNA, 103 bp, Artificial Sequence
  Synthetic Polynucleotide
taatacgactcactatagggctgcagcaaaggtttggtgggggcactgctaacagaggagaagcagtatgcccaccaaaaacctggcggcagcgcaaaagatg

SEQ ID NO: 234001 - DNA, 103 bp, Artificial Sequence
  Synthetic Polynucleotide
taatacgactcactataggggtggtggagtctgcagcaaaggtttggtggaacagaggagaccaccaatgctttgctgcaacctggcggcagcgcaaaagatg

SEQ ID NO: 234002 - DNA, 103 bp, Artificial Sequence
  Synthetic Polynucleotide
taatacgactcactatagggggtggtggaggtggtggagtctgcagcaaaaacagaggagatttgctatggactccaccaacctggcggcagcgcaaaagatg

SEQ ID NO: 234003 - DNA, 103 bp, Artificial Sequence
  Synthetic Polynucleotide
taatacgactcactatagggaggaggaggaggtggtggaggtggtggagtaacagaggagaactccaatgcctccaccaaacctggcggcagcgcaaaagatg

SEQ ID NO: 234004 - DNA, 103 bp, Artificial Sequence
  Synthetic Polynucleotide
taatacgactcactatagggcctgtattatggcggagacgcatttattacaacagaggagagtaataatggcgtctccgaacctggcggcagcgcaaaagatg

SEQ ID NO: 234005 - DNA, 103 bp, Artificial Sequence
  Synthetic Polynucleotide
taatacgactcactatagggaaggaggaggaggaggaggaggtggtggagaacagaggagactccacatgctcctcctcaacctggcggcagcgcaaaagatg

SEQ ID NO: 234006 - DNA, 103 bp, Artificial Sequence
  Synthetic Polynucleotide
taatacgactcactatagggagagaggatgaaggaggaggaggaggaggaaacagaggagatcctccatgtcctcctccaacctggcggcagcgcaaaagatg

SEQ ID NO: 234007 - DNA, 103 bp, Artificial Sequence
  Synthetic Polynucleotide
taatacgactcactatagggctgtcctgacagagaggatgaaggaggaggaacagaggagacctcctatgtcatcctctaacctggcggcagcgcaaaagatg

SEQ ID NO: 234008 - DNA, 103 bp, Artificial Sequence
  Synthetic Polynucleotide
taatacgactcactataggggctcggtctgctgtcctgacagagaggatgaacagaggagacatcctatgtgtcaggacaacctggcggcagcgcaaaagatg

SEQ ID NO: 234009 - DNA, 103 bp, Artificial Sequence
  Synthetic Polynucleotide
taatacgactcactatagggttgttctgttgctcggtctgctgtcctgacaacagaggagagtcaggatggcagaccgaaacctggcggcagcgcaaaagatg

SEQ ID NO: 234010 - DNA, 103 bp, Artificial Sequence
  Synthetic Polynucleotide
taatacgactcactatagggctcagattctttgttctgttgctcggtctgaacagaggagacagaccatgcaacagaacaacctggcggcagcgcaaaagatg

SEQ ID NO: 234011 - DNA, 103 bp, Artificial Sequence
  Synthetic Polynucleotide
taatacgactcactatagggtttgctttttctcagattctttgttctgttaacagaggagaaacagaatgaagaatctgaacctggcggcagcgcaaaagatg

SEQ ID NO: 234012 - DNA, 103 bp, Artificial Sequence
  Synthetic Polynucleotide
taatacgactcactatagggtttggcttagtttgctttttctcagattctaacagaggagaagaatcatggaaaaagcaaacctggcggcagcgcaaaagatg

SEQ ID NO: 234013 - DNA, 103 bp, Artificial Sequence
  Synthetic Polynucleotide
taatacgactcactatagggtttcaccttgtttggcttagtttgctttttaacagaggagaaaaaagatgactaagccaaacctggcggcagcgcaaaagatg

SEQ ID NO: 234014 - DNA, 103 bp, Artificial Sequence
  Synthetic Polynucleotide
taatacgactcactatagggctttgatttttttcaccttgtttggcttagaacagaggagactaagcatgacaaggtgaaacctggcggcagcgcaaaagatg

SEQ ID NO: 234015 - DNA, 103 bp, Artificial Sequence
  Synthetic Polynucleotide
taatacgactcactatagggttgccaatcccctgtattatggcggagacgaacagaggagacgtctcatgcataatacaaacctggcggcagcgcaaaagatg

SEQ ID NO: 234016 - DNA, 103 bp, Artificial Sequence
  Synthetic Polynucleotide
taatacgactcactatagggaattcctcctctttgatttttttcaccttgaacagaggagacaaggtatgaaaaatcaaaacctggcggcagcgcaaaagatg

SEQ ID NO: 234017 - DNA, 103 bp, Artificial Sequence
  Synthetic Polynucleotide
taatacgactcactatagggggtggcctctaattcctcctctttgattttaacagaggagaaaaatcatggaggaggaaaacctggcggcagcgcaaaagatg

SEQ ID NO: 234018 - DNA, 103 bp, Artificial Sequence
  Synthetic Polynucleotide
taatacgactcactatagggtttcgggtttggtggcctctaattcctcctaacagaggagaaggaggatgtagaggccaaacctggcggcagcgcaaaagatg

SEQ ID NO: 234019 - DNA, 103 bp, Artificial Sequence
  Synthetic Polynucleotide
taatacgactcactatagggttggggtgtttttcgggtttggtggcctctaacagaggagaagaggcatgcaaacccgaaacctggcggcagcgcaaaagatg

SEQ ID NO: 234020 - DNA, 103 bp, Artificial Sequence
  Synthetic Polynucleotide
taatacgactcactatagggttcctcttttttggggtgtttttcgggtttaacagaggagaaaacccatgaaacaccccaacctggcggcagcgcaaaagatg

SEQ ID NO: 234021 - DNA, 103 bp, Artificial Sequence
  Synthetic Polynucleotide
taatacgactcactatagggatgagattttttcctcttttttggggtgttaacagaggagaaacaccatgaaaaagaggaacctggcggcagcgcaaaagatg

SEQ ID NO: 234022 - DNA, 103 bp, Artificial Sequence
  Synthetic Polynucleotide
taatacgactcactataggggaaagagcagatgagattttttcctcttttaacagaggagaaaaagaatgaaaaatctcaacctggcggcagcgcaaaagatg

SEQ ID NO: 234023 - DNA, 103 bp, Artificial Sequence
  Synthetic Polynucleotide
taatacgactcactataggggcccaacactgaaagagcagatgagattttaacagaggagaaaaatcatgtctgctcttaacctggcggcagcgcaaaagatg

SEQ ID NO: 234024 - DNA, 103 bp, Artificial Sequence
  Synthetic Polynucleotide
taatacgactcactatagggctacaactttgcccaacactgaaagagcagaacagaggagactgctcatgcagtgttggaacctggcggcagcgcaaaagatg

SEQ ID NO: 234025 - DNA, 103 bp, Artificial Sequence
  Synthetic Polynucleotide
taatacgactcactatagggtgtgtttcacctacaactttgcccaacactaacagaggagaagtgttatgcaaagttgtaacctggcggcagcgcaaaagatg

SEQ ID NO: 234026 - DNA, 103 bp, Artificial Sequence
  Synthetic Polynucleotide
taatacgactcactatagggttctttgtctttgccaatcccctgtattataacagaggagaataataatggggattggcaacctggcggcagcgcaaaagatg

SEQ ID NO: 234027 - DNA, 103 bp, Artificial Sequence
  Synthetic Polynucleotide
taatacgactcactatagggaggatcgacatgtgtttcacctacaactttaacagaggagaaaagttatgggtgaaacaaacctggcggcagcgcaaaagatg

SEQ ID NO: 234028 - DNA, 103 bp, Artificial Sequence
  Synthetic Polynucleotide
taatacgactcactataggggcaactgaataggatcgacatgtgtttcacaacagaggagagtgaaaatgatgtcgatcaacctggcggcagcgcaaaagatg

SEQ ID NO: 234029 - DNA, 103 bp, Artificial Sequence
  Synthetic Polynucleotide
taatacgactcactatagggtgtaatgcctgcaactgaataggatcgacaaacagaggagatgtcgaatgtattcagttaacctggcggcagcgcaaaagatg

SEQ ID NO: 234030 - DNA, 103 bp, Artificial Sequence
  Synthetic Polynucleotide
taatacgactcactatagggaattgcattctgtaatgcctgcaactgaataacagaggagaattcagatgcaggcattaaacctggcggcagcgcaaaagatg

SEQ ID NO: 234031 - DNA, 103 bp, Artificial Sequence
  Synthetic Polynucleotide
taatacgactcactatagggggtcaccagcaattgcattctgtaatgcctaacagaggagaaggcatatgagaatgcaaaacctggcggcagcgcaaaagatg

SEQ ID NO: 234032 - DNA, 103 bp, Artificial Sequence
  Synthetic Polynucleotide
taatacgactcactatagggaaggaagctgggtcaccagcaattgcattcaacagaggagagaatgcatgtgctggtgaaacctggcggcagcgcaaaagatg

SEQ ID NO: 234033 - DNA, 103 bp, Artificial Sequence
  Synthetic Polynucleotide
taatacgactcactatagggtccgcctataaaggaagctgggtcaccagcaacagaggagagctggtatgccagcttccaacctggcggcagcgcaaaagatg

SEQ ID NO: 234034 - DNA, 103 bp, Artificial Sequence
  Synthetic Polynucleotide
taatacgactcactataggggcaagaactgtccgcctataaaggaagctgaacagaggagacagcttatgttataggcgaacctggcggcagcgcaaaagatg

SEQ ID NO: 234035 - DNA, 103 bp, Artificial Sequence
  Synthetic Polynucleotide
taatacgactcactatagggataaagtatggcaagaactgtccgcctataaacagaggagatataggatgacagttcttaacctggcggcagcgcaaaagatg

SEQ ID NO: 234036 - DNA, 103 bp, Artificial Sequence
  Synthetic Polynucleotide
taatacgactcactatagggaaacccagggataaagtatggcaagaactgaacagaggagacagttcatgccatactttaacctggcggcagcgcaaaagatg

SEQ ID NO: 234037 - DNA, 103 bp, Artificial Sequence
  Synthetic Polynucleotide
taatacgactcactatagggttataagaggttctttgtctttgccaatccaacagaggagaggattgatgaagacaaagaacctggcggcagcgcaaaagatg

SEQ ID NO: 234038 - DNA, 103 bp, Artificial Sequence
  Synthetic Polynucleotide
taatacgactcactatagggaataagaagcaaacccagggataaagtatgaacagaggagacatactatgtccctgggtaacctggcggcagcgcaaaagatg

SEQ ID NO: 234039 - DNA, 103 bp, Artificial Sequence
  Synthetic Polynucleotide
taatacgactcactatagggtgaggtgtaaaataagaagcaaacccagggaacagaggagaccctggatgtgcttcttaaacctggcggcagcgcaaaagatg

SEQ ID NO: 234040 - DNA, 103 bp, Artificial Sequence
  Synthetic Polynucleotide
taatacgactcactatagggtccagggagctgaggtgtaaaataagaagcaacagaggagagcttctatgtttacacctaacctggcggcagcgcaaaagatg

SEQ ID NO: 234041 - DNA, 103 bp, Artificial Sequence
  Synthetic Polynucleotide
taatacgactcactatagggcctgcactgttccagggagctgaggtgtaaaacagaggagattacacatgagctccctgaacctggcggcagcgcaaaagatg

SEQ ID NO: 234042 - DNA, 103 bp, Artificial Sequence
  Synthetic Polynucleotide
taatacgactcactatagggaagtatcccccctgcactgttccagggagcaacagaggagagctcccatgaacagtgcaaacctggcggcagcgcaaaagatg

SEQ ID NO: 234043 - DNA, 103 bp, Artificial Sequence
  Synthetic Polynucleotide
taatacgactcactataggggacaggtgggaagtatcccccctgcactgtaacagaggagaacagtgatggggggatacaacctggcggcagcgcaaaagatg

SEQ ID NO: 234044 - DNA, 103 bp, Artificial Sequence
  Synthetic Polynucleotide
taatacgactcactatagggccatgccacagacaggtgggaagtatccccaacagaggagaggggatatgtcccacctgaacctggcggcagcgcaaaagatg

SEQ ID NO: 234045 - DNA, 103 bp, Artificial Sequence
  Synthetic Polynucleotide
taatacgactcactatagggaagaggctctccatgccacagacaggtgggaacagaggagacccaccatgctgtggcataacctggcggcagcgcaaaagatg

SEQ ID NO: 234046 - DNA, 103 bp, Artificial Sequence
  Synthetic Polynucleotide
taatacgactcactataggggccataaggaaagaggctctccatgccacaaacagaggagatgtggcatggagagcctcaacctggcggcagcgcaaaagatg

SEQ ID NO: 234047 - DNA, 103 bp, Artificial Sequence
  Synthetic Polynucleotide
taatacgactcactataggggcattgtagggccataaggaaagaggctctaacagaggagaagagccatgttccttatgaacctggcggcagcgcaaaagatg

SEQ ID NO: 234048 - DNA, 103 bp, Artificial Sequence
  Synthetic Polynucleotide
taatacgactcactatagggtccagaaagcttataagaggttctttgtctaacagaggagaagacaaatgacctcttataacctggcggcagcgcaaaagatg

SEQ ID NO: 234049 - DNA, 103 bp, Artificial Sequence
  Synthetic Polynucleotide
taatacgactcactatagggagtgtctggggcattgtagggccataaggaaacagaggagatccttaatgccctacaataacctggcggcagcgcaaaagatg

SEQ ID NO: 234050 - DNA, 103 bp, Artificial Sequence
  Synthetic Polynucleotide
taatacgactcactatagggcagacctgccagtgtctggggcattgtaggaacagaggagacctacaatgccccagacaaacctggcggcagcgcaaaagatg

SEQ ID NO: 234051 - DNA, 103 bp, Artificial Sequence
  Synthetic Polynucleotide
taatacgactcactatagggcacctggggacagacctgccagtgtctgggaacagaggagacccagaatgtggcaggtcaacctggcggcagcgcaaaagatg

SEQ ID NO: 234052 - DNA, 103 bp, Artificial Sequence
  Synthetic Polynucleotide
taatacgactcactatagggtgcaacagtgcacctggggacagacctgccaacagaggagaggcaggatggtccccaggaacctggcggcagcgcaaaagatg

SEQ ID NO: 234053 - DNA, 103 bp, Artificial Sequence
  Synthetic Polynucleotide
taatacgactcactatagggttggtactgctgcaacagtgcacctggggaaacagaggagatccccaatggcactgttgaacctggcggcagcgcaaaagatg

SEQ ID NO: 234054 - DNA, 103 bp, Artificial Sequence
  Synthetic Polynucleotide
taatacgactcactataggggctgatactgttggtactgctgcaacagtgaacagaggagacactgtatgagcagtaccaacctggcggcagcgcaaaagatg

SEQ ID NO: 234055 - DNA, 103 bp, Artificial Sequence
  Synthetic Polynucleotide
taatacgactcactatagggtgcaggttctgctgatactgttggtactgcaacagaggagagcagtaatgacagtatcaaacctggcggcagcgcaaaagatg

SEQ ID NO: 234056 - DNA, 103 bp, Artificial Sequence
  Synthetic Polynucleotide
taatacgactcactatagggcagggactcctgcaggttctgctgatactgaacagaggagacagtatatgcagaacctgaacctggcggcagcgcaaaagatg

SEQ ID NO: 234057 - DNA, 103 bp, Artificial Sequence
  Synthetic Polynucleotide
taatacgactcactataggggctgcttttgcagggactcctgcaggttctaacagaggagaagaaccatgaggagtcccaacctggcggcagcgcaaaagatg

SEQ ID NO: 234058 - DNA, 103 bp, Artificial Sequence
  Synthetic Polynucleotide
taatacgactcactatagggtgttgcttttgctgcttttgcagggactccaacagaggagaggagtcatggcaaaagcaaacctggcggcagcgcaaaagatg

SEQ ID NO: 234059 - DNA, 103 bp, Artificial Sequence
  Synthetic Polynucleotide
taatacgactcactatagggctttgcccgtttcttcagttgctggctcataacagaggagaatgagcatgcaactgaagaacctggcggcagcgcaaaagatg

SEQ ID NO: 234060 - DNA, 103 bp, Artificial Sequence
  Synthetic Polynucleotide
taatacgactcactatagggtatttccgcctgcaggtcttggcttgacttaacagaggagaaagtcaatgcaagacctgaacctggcggcagcgcaaaagatg

SEQ ID NO: 234061 - DNA, 103 bp, Artificial Sequence
  Synthetic Polynucleotide
taatacgactcactatagggtgacaggttctatttccgcctgcaggtcttaacagaggagaaagaccatgaggcggaaaaacctggcggcagcgcaaaagatg

SEQ ID NO: 234062 - DNA, 103 bp, Artificial Sequence
  Synthetic Polynucleotide
taatacgactcactatagggcacaccgcgctgacaggttctatttccgccaacagaggagaggcggaatgagaacctgtaacctggcggcagcgcaaaagatg

SEQ ID NO: 234063 - DNA, 103 bp, Artificial Sequence
  Synthetic Polynucleotide
taatacgactcactatagggacataaggcccacaccgcgctgacaggttcaacagaggagagaacctatgagcgcggtgaacctggcggcagcgcaaaagatg

SEQ ID NO: 234064 - DNA, 103 bp, Artificial Sequence
  Synthetic Polynucleotide
taatacgactcactatagggcatagccatcacataaggcccacaccgcgcaacagaggagagcgcggatggggccttataacctggcggcagcgcaaaagatg

SEQ ID NO: 234065 - DNA, 103 bp, Artificial Sequence
  Synthetic Polynucleotide
taatacgactcactatagggtcatagcacacatagccatcacataaggccaacagaggagaggccttatgtgatggctaaacctggcggcagcgcaaaagatg

SEQ ID NO: 234066 - DNA, 103 bp, Artificial Sequence
  Synthetic Polynucleotide
taatacgactcactatagggagggccaggctcatagcacacatagccatcaacagaggagagatggcatggtgtgctataacctggcggcagcgcaaaagatg

SEQ ID NO: 234067 - DNA, 103 bp, Artificial Sequence
  Synthetic Polynucleotide
taatacgactcactatagggcgagagcctgagggccaggctcatagcacaaacagaggagatgtgctatgagcctggccaacctggcggcagcgcaaaagatg

SEQ ID NO: 234068 - DNA, 103 bp, Artificial Sequence
  Synthetic Polynucleotide
taatacgactcactatagggtcatcccctccgagagcctgagggccaggcaacagaggagagcctggatgtcaggctctaacctggcggcagcgcaaaagatg

SEQ ID NO: 234069 - DNA, 103 bp, Artificial Sequence
  Synthetic Polynucleotide
taatacgactcactataggggtctgagaaatcatcccctccgagagcctgaacagaggagacaggctatgggaggggataacctggcggcagcgcaaaagatg

SEQ ID NO: 234070 - DNA, 103 bp, Artificial Sequence
  Synthetic Polynucleotide
taatacgactcactatagggggtgtcttgtctttgcccgtttcttcagttaacagaggagaaactgaatgaacgggcaaaacctggcggcagcgcaaaagatg

SEQ ID NO: 234071 - DNA, 103 bp, Artificial Sequence
  Synthetic Polynucleotide
taatacgactcactatagggctatgtaacagtctgagaaatcatcccctcaacagaggagagaggggatgatttctcagaacctggcggcagcgcaaaagatg

SEQ ID NO: 234072 - DNA, 103 bp, Artificial Sequence
  Synthetic Polynucleotide
taatacgactcactatagggatgacgcattctatgtaacagtctgagaaaaacagaggagatttctcatgctgttacataacctggcggcagcgcaaaagatg

SEQ ID NO: 234073 - DNA, 103 bp, Artificial Sequence
  Synthetic Polynucleotide
taatacgactcactatagggctcaccccttatgacgcattctatgtaacaaacagaggagatgttacatggaatgcgtcaacctggcggcagcgcaaaagatg

SEQ ID NO: 234074 - DNA, 103 bp, Artificial Sequence
  Synthetic Polynucleotide
taatacgactcactataggggttgagaaaactcaccccttatgacgcattaacagaggagaaatgcgatgtaaggggtgaacctggcggcagcgcaaaagatg

SEQ ID NO: 234075 - DNA, 103 bp, Artificial Sequence
  Synthetic Polynucleotide
taatacgactcactatagggtccaggatgggttgagaaaactcaccccttaacagaggagaaaggggatggttttctcaaacctggcggcagcgcaaaagatg

SEQ ID NO: 234076 - DNA, 103 bp, Artificial Sequence
  Synthetic Polynucleotide
taatacgactcactatagggtgagtcctcttccaggatgggttgagaaaaaacagaggagattttctatgcccatcctgaacctggcggcagcgcaaaagatg

SEQ ID NO: 234077 - DNA, 103 bp, Artificial Sequence
  Synthetic Polynucleotide
taatacgactcactatagggactcaaaaagtgagtcctcttccaggatggaacagaggagaccatccatgaagaggactaacctggcggcagcgcaaaagatg

SEQ ID NO: 234078 - DNA, 103 bp, Artificial Sequence
  Synthetic Polynucleotide
taatacgactcactatagggtattccaaggactcaaaaagtgagtcctctaacagaggagaagaggaatgactttttgaaacctggcggcagcgcaaaagatg

SEQ ID NO: 234079 - DNA, 103 bp, Artificial Sequence
  Synthetic Polynucleotide
taatacgactcactatagggtttctttaggtattccaaggactcaaaaagaacagaggagactttttatgtccttggaaaacctggcggcagcgcaaaagatg

SEQ ID NO: 234080 - DNA, 103 bp, Artificial Sequence
  Synthetic Polynucleotide
taatacgactcactataggggttctgatcctttctttaggtattccaaggaacagaggagaccttggatgacctaaagaaacctggcggcagcgcaaaagatg

SEQ ID NO: 234081 - DNA, 103 bp, Artificial Sequence
  Synthetic Polynucleotide
taatacgactcactatagggaggcctttctggtgtcttgtctttgcccgtaacagaggagaacgggcatggacaagacaaacctggcggcagcgcaaaagatg

SEQ ID NO: 234082 - DNA, 103 bp, Artificial Sequence
  Synthetic Polynucleotide
taatacgactcactataggggaaagctgttgttctgatcctttctttaggaacagaggagacctaaaatgaggatcagaaacctggcggcagcgcaaaagatg

SEQ ID NO: 234083 - DNA, 103 bp, Artificial Sequence
  Synthetic Polynucleotide
taatacgactcactatagggaaccttttgagaaagctgttgttctgatccaacagaggagaggatcaatgcaacagcttaacctggcggcagcgcaaaagatg

SEQ ID NO: 234084 - DNA, 103 bp, Artificial Sequence
  Synthetic Polynucleotide
taatacgactcactatagggttgcttcgaaaaccttttgagaaagctgttaacagaggagaaacagcatgctcaaaaggaacctggcggcagcgcaaaagatg

SEQ ID NO: 234085 - DNA, 103 bp, Artificial Sequence
  Synthetic Polynucleotide
taatacgactcactatagggtcaagggagcttgcttcgaaaaccttttgaaacagaggagatcaaaaatgtttcgaagcaacctggcggcagcgcaaaagatg

SEQ ID NO: 234086 - DNA, 103 bp, Artificial Sequence
  Synthetic Polynucleotide
taatacgactcactatagggcaaagaacattcaagggagcttgcttcgaaaacagaggagattcgaaatgagctcccttaacctggcggcagcgcaaaagatg

SEQ ID NO: 234087 - DNA, 103 bp, Artificial Sequence
  Synthetic Polynucleotide
taatacgactcactatagggtcatgtattccaaagaacattcaagggagcaacagaggagagctcccatgaatgttcttaacctggcggcagcgcaaaagatg

SEQ ID NO: 234088 - DNA, 103 bp, Artificial Sequence
  Synthetic Polynucleotide
taatacgactcactatagggaccccttttttcatgtattccaaagaacataacagaggagaatgttcatgggaatacataacctggcggcagcgcaaaagatg

SEQ ID NO: 234089 - DNA, 103 bp, Artificial Sequence
  Synthetic Polynucleotide
taatacgactcactatagggctctttctttaccccttttttcatgtattcaacagaggagagaatacatgaaaaaagggaacctggcggcagcgcaaaagatg

SEQ ID NO: 234090 - DNA, 103 bp, Artificial Sequence
  Synthetic Polynucleotide
taatacgactcactatagggtttgtggaagctctttctttacccctttttaacagaggagaaaaaagatgtaaagaaagaacctggcggcagcgcaaaagatg

SEQ ID NO: 234091 - DNA, 103 bp, Artificial Sequence
  Synthetic Polynucleotide
taatacgactcactatagggccaactatcttttgtggaagctctttctttaacagaggagaaaagaaatggcttccacaaacctggcggcagcgcaaaagatg

SEQ ID NO: 234092 - DNA, 103 bp, Artificial Sequence
  Synthetic Polynucleotide
taatacgactcactatagggtcttccacccaggcctttctggtgtcttgtaacagaggagaacaagaatgcagaaaggcaacctggcggcagcgcaaaagatg

SEQ ID NO: 234093 - DNA, 103 bp, Artificial Sequence
  Synthetic Polynucleotide
taatacgactcactatagggcgaattctctccaactatcttttgtggaagaacagaggagacttccaatgaagatagttaacctggcggcagcgcaaaagatg

SEQ ID NO: 234094 - DNA, 103 bp, Artificial Sequence
  Synthetic Polynucleotide
taatacgactcactatagggaatactcaagcgaattctctccaactatctaacagaggagaagatagatggagagaattaacctggcggcagcgcaaaagatg

SEQ ID NO: 234095 - DNA, 103 bp, Artificial Sequence
  Synthetic Polynucleotide
taatacgactcactatagggatgtactcagaatactcaagcgaattctctaacagaggagaagagaaatggcttgagtaaacctggcggcagcgcaaaagatg

SEQ ID NO: 234096 - DNA, 103 bp, Artificial Sequence
  Synthetic Polynucleotide
taatacgactcactatagggcttgcctgtcatgtactcagaatactcaagaacagaggagacttgagatgtctgagtacaacctggcggcagcgcaaaagatg

SEQ ID NO: 234097 - DNA, 103 bp, Artificial Sequence
  Synthetic Polynucleotide
taatacgactcactataggggcggaagcttcttgcctgtcatgtactcagaacagaggagactgagtatgtgacaggcaaacctggcggcagcgcaaaagatg

SEQ ID NO: 234098 - DNA, 103 bp, Artificial Sequence
  Synthetic Polynucleotide
taatacgactcactatagggattcctccaggcggaagcttcttgcctgtcaacagaggagagacaggatggaagcttccaacctggcggcagcgcaaaagatg

SEQ ID NO: 234099 - DNA, 103 bp, Artificial Sequence
  Synthetic Polynucleotide
taatacgactcactatagggaatgccaggtattcctccaggcggaagcttaacagaggagaaagcttatgcctggaggaaacctggcggcagcgcaaaagatg

SEQ ID NO: 234100 - DNA, 103 bp, Artificial Sequence
  Synthetic Polynucleotide
taatacgactcactatagggctgataggtcaatgccaggtattcctccagaacagaggagactggagatgtacctggcaaacctggcggcagcgcaaaagatg

SEQ ID NO: 234101 - DNA, 103 bp, Artificial Sequence
  Synthetic Polynucleotide
taatacgactcactatagggtgtttaggatctgataggtcaatgccaggtaacagaggagaacctggatgtgacctatcaacctggcggcagcgcaaaagatg

SEQ ID NO: 234102 - DNA, 103 bp, Artificial Sequence
  Synthetic Polynucleotide
taatacgactcactatagggttctgcgagctgtttaggatctgataggtcaacagaggagagacctaatggatcctaaaaacctggcggcagcgcaaaagatg

SEQ ID NO: 234103 - DNA, 103 bp, Artificial Sequence
  Synthetic Polynucleotide
taatacgactcactatagggcactgggggctcttccacccaggcctttctaacagaggagaagaaagatgtgggtggaaaacctggcggcagcgcaaaagatg

SEQ ID NO: 234104 - DNA, 103 bp, Artificial Sequence
  Synthetic Polynucleotide
taatacgactcactatagggttctagcaaattctgcgagctgtttaggataacagaggagaatcctaatgagctcgcagaacctggcggcagcgcaaaagatg

SEQ ID NO: 234105 - DNA, 103 bp, Artificial Sequence
  Synthetic Polynucleotide
taatacgactcactataggggggggcttctttctagcaaattctgcgagcaacagaggagagctcgcatgatttgctagaacctggcggcagcgcaaaagatg

SEQ ID NO: 234106 - DNA, 103 bp, Artificial Sequence
  Synthetic Polynucleotide
taatacgactcactatagggtttatttatggggggcttctttctagcaaaaacagaggagatttgctatgaagaagcccaacctggcggcagcgcaaaagatg

SEQ ID NO: 234107 - DNA, 103 bp, Artificial Sequence
  Synthetic Polynucleotide
taatacgactcactatagggtgtcatattctttatttatggggggcttctaacagaggagaagaagcatgccataaataaacctggcggcagcgcaaaagatg

SEQ ID NO: 234108 - DNA, 103 bp, Artificial Sequence
  Synthetic Polynucleotide
taatacgactcactataggggcgctcagactgtcatattctttatttatgaacagaggagacataaaatgagaatatgaaacctggcggcagcgcaaaagatg

SEQ ID NO: 234109 - DNA, 103 bp, Artificial Sequence
  Synthetic Polynucleotide
taatacgactcactatagggacaagcgattgcgctcagactgtcatattcaacagaggagagaatatatgagtctgagcaacctggcggcagcgcaaaagatg

SEQ ID NO: 234110 - DNA, 103 bp, Artificial Sequence
  Synthetic Polynucleotide
taatacgactcactatagggcactctgaggacaagcgattgcgctcagacaacagaggagagtctgaatgcaatcgcttaacctggcggcagcgcaaaagatg

SEQ ID NO: 234111 - DNA, 103 bp, Artificial Sequence
  Synthetic Polynucleotide
taatacgactcactatagggctagtgcatccactctgaggacaagcgattaacagaggagaaatcgcatgtcctcagagaacctggcggcagcgcaaaagatg

SEQ ID NO: 234112 - DNA, 103 bp, Artificial Sequence
  Synthetic Polynucleotide
taatacgactcactatagggcctcaacttcctagtgcatccactctgaggaacagaggagacctcagatgggatgcactaacctggcggcagcgcaaaagatg

SEQ ID NO: 234113 - DNA, 103 bp, Artificial Sequence
  Synthetic Polynucleotide
taatacgactcactatagggcagctctattcctcaacttcctagtgcatcaacagaggagagatgcaatgggaagttgaaacctggcggcagcgcaaaagatg

SEQ ID NO: 234114 - DNA, 103 bp, Artificial Sequence
  Synthetic Polynucleotide
taatacgactcactatagggggcttagccccactgggggctcttccacccaacagaggagagggtggatgagcccccagaacctggcggcagcgcaaaagatg

SEQ ID NO: 234115 - DNA, 103 bp, Artificial Sequence
  Synthetic Polynucleotide
taatacgactcactatagggtttctcagggcagctctattcctcaacttcaacagaggagagaagttatggaatagagcaacctggcggcagcgcaaaagatg

SEQ ID NO: 234116 - DNA, 103 bp, Artificial Sequence
  Synthetic Polynucleotide
taatacgactcactataggggaggagatgctttctcagggcagctctattaacagaggagaaatagaatggccctgagaaacctggcggcagcgcaaaagatg

SEQ ID NO: 234117 - DNA, 103 bp, Artificial Sequence
  Synthetic Polynucleotide
taatacgactcactataggggaccatgaatgaggagatgctttctcagggaacagaggagaccctgaatgagcatctccaacctggcggcagcgcaaaagatg

SEQ ID NO: 234118 - DNA, 103 bp, Artificial Sequence
  Synthetic Polynucleotide
taatacgactcactatagggtggtctcggggaccatgaatgaggagatgcaacagaggagagcatctatgcattcatggaacctggcggcagcgcaaaagatg

SEQ ID NO: 234119 - DNA, 103 bp, Artificial Sequence
  Synthetic Polynucleotide
taatacgactcactatagggcgcacagacgtggtctcggggaccatgaataacagaggagaattcatatgccccgagacaacctggcggcagcgcaaaagatg

SEQ ID NO: 234120 - DNA, 103 bp, Artificial Sequence
  Synthetic Polynucleotide
taatacgactcactatagggtcccacattccgcacagacgtggtctcgggaacagaggagacccgagatgacgtctgtgaacctggcggcagcgcaaaagatg

SEQ ID NO: 234121 - DNA, 103 bp, Artificial Sequence
  Synthetic Polynucleotide
taatacgactcactatagggacgaacgctttcccacattccgcacagacgaacagaggagacgtctgatgggaatgtggaacctggcggcagcgcaaaagatg

SEQ ID NO: 234122 - DNA, 103 bp, Artificial Sequence
  Synthetic Polynucleotide
taatacgactcactatagggtgagctctcaacgaacgctttcccacattcaacagaggagagaatgtatgaaagcgttcaacctggcggcagcgcaaaagatg

SEQ ID NO: 234123 - DNA, 103 bp, Artificial Sequence
  Synthetic Polynucleotide
taatacgactcactatagggtctttagttttgagctctcaacgaacgcttaacagaggagaaagcgtatgttgagagctaacctggcggcagcgcaaaagatg

SEQ ID NO: 234124 - DNA, 103 bp, Artificial Sequence
  Synthetic Polynucleotide
taatacgactcactatagggaggaaatgtctctttagttttgagctctcaaacagaggagatgagagatgaaaactaaaaacctggcggcagcgcaaaagatg

SEQ ID NO: 234125 - DNA, 103 bp, Artificial Sequence
  Synthetic Polynucleotide
taatacgactcactataggggccttgcctgggcttagccccactgggggcaacagaggagagcccccatgggggctaagaacctggcggcagcgcaaaagatg

SEQ ID NO: 234126 - DNA, 103 bp, Artificial Sequence
  Synthetic Polynucleotide
taatacgactcactatagggagtatgaaccaggaaatgtctctttagtttaacagaggagaaaactaatgagacatttcaacctggcggcagcgcaaaagatg

SEQ ID NO: 234127 - DNA, 103 bp, Artificial Sequence
  Synthetic Polynucleotide
taatacgactcactataggggcttctctccagtatgaaccaggaaatgtcaacagaggagagacattatgtggttcataaacctggcggcagcgcaaaagatg

SEQ ID NO: 234128 - DNA, 103 bp, Artificial Sequence
  Synthetic Polynucleotide
taatacgactcactatagggcaccgaaacggcttctctccagtatgaaccaacagaggagaggttcaatgtggagagaaaacctggcggcagcgcaaaagatg

SEQ ID NO: 234129 - DNA, 103 bp, Artificial Sequence
  Synthetic Polynucleotide
taatacgactcactatagggttcaaaagtgcaccgaaacggcttctctccaacagaggagaggagagatgccgtttcggaacctggcggcagcgcaaaagatg

SEQ ID NO: 234130 - DNA, 103 bp, Artificial Sequence
  Synthetic Polynucleotide
taatacgactcactatagggttccgcacccttcaaaagtgcaccgaaacgaacagaggagacgtttcatggcacttttgaacctggcggcagcgcaaaagatg

SEQ ID NO: 234131 - DNA, 103 bp, Artificial Sequence
  Synthetic Polynucleotide
taatacgactcactataggggagaagcgctttccgcacccttcaaaagtgaacagaggagacactttatgagggtgcggaacctggcggcagcgcaaaagatg

SEQ ID NO: 234132 - DNA, 103 bp, Artificial Sequence
  Synthetic Polynucleotide
taatacgactcactatagggaaagtccagagagaagcgctttccgcacccaacagaggagagggtgcatgaagcgcttcaacctggcggcagcgcaaaagatg

SEQ ID NO: 234133 - DNA, 103 bp, Artificial Sequence
  Synthetic Polynucleotide
taatacgactcactatagggtacgcaaattaaagtccagagagaagcgctaacagaggagaagcgctatgctctggactaacctggcggcagcgcaaaagatg

SEQ ID NO: 234134 - DNA, 103 bp, Artificial Sequence
  Synthetic Polynucleotide
taatacgactcactatagggcgcacgtgcgtacgcaaattaaagtccagaaacagaggagatctggaatgtaatttgcgaacctggcggcagcgcaaaagatg

SEQ ID NO: 234135 - DNA, 103 bp, Artificial Sequence
  Synthetic Polynucleotide
taatacgactcactatagggcgtgtggatgcgcacgtgcgtacgcaaattaacagaggagaaatttgatgacgcacgtgaacctggcggcagcgcaaaagatg

SEQ ID NO: 234136 - DNA, 103 bp, Artificial Sequence
  Synthetic Polynucleotide
taatacgactcactatagggggcttgacttgccttgcctgggcttagcccaacagaggagagggctaatgccaggcaagaacctggcggcagcgcaaaagatg

SEQ ID NO: 234137 - DNA, 103 bp, Artificial Sequence
  Synthetic Polynucleotide
taatacgactcactataggggtttctcccccgtgtggatgcgcacgtgcgaacagaggagacgcacgatggcatccacaaacctggcggcagcgcaaaagatg

SEQ ID NO: 234138 - DNA, 103 bp, Artificial Sequence
  Synthetic Polynucleotide
taatacgactcactatagggcacacgaaacgtttctcccccgtgtggatgaacagaggagacatccaatggggggagaaaacctggcggcagcgcaaaagatg

SEQ ID NO: 234139 - DNA, 103 bp, Artificial Sequence
  Synthetic Polynucleotide
taatacgactcactatagggttgaaagggacacacgaaacgtttctccccaacagaggagaggggagatgcgtttcgtgaacctggcggcagcgcaaaagatg

SEQ ID NO: 234140 - DNA, 103 bp, Artificial Sequence
  Synthetic Polynucleotide
taatacgactcactatagggtgttgcagccttgaaagggacacacgaaacaacagaggagagtttcgatggtccctttcaacctggcggcagcgcaaaagatg

SEQ ID NO: 234141 - DNA, 103 bp, Artificial Sequence
  Synthetic Polynucleotide
taatacgactcactatagggataaacctcctgttgcagccttgaaagggaaacagaggagatcccttatgaggctgcaaaacctggcggcagcgcaaaagatg

SEQ ID NO: 234142 - DNA, 103 bp, Artificial Sequence
  Synthetic Polynucleotide
taatacgactcactatagggatttgactgaataaacctcctgttgcagccaacagaggagaggctgcatgaggaggtttaacctggcggcagcgcaaaagatg

SEQ ID NO: 234143 - DNA, 103 bp, Artificial Sequence
  Synthetic Polynucleotide
taatacgactcactatagggctttcaggttatttgactgaataaacctccaacagaggagaggaggtatgttcagtcaaaacctggcggcagcgcaaaagatg

SEQ ID NO: 234144 - DNA, 103 bp, Artificial Sequence
  Synthetic Polynucleotide
taatacgactcactatagggaggatgtgggctttcaggttatttgactgaaacagaggagatcagtcatgtaacctgaaaacctggcggcagcgcaaaagatg

SEQ ID NO: 234145 - DNA, 103 bp, Artificial Sequence
  Synthetic Polynucleotide
taatacgactcactatagggtgcatgcgttaggatgtgggctttcaggttaacagaggagaaacctgatggcccacatcaacctggcggcagcgcaaaagatg

SEQ ID NO: 234146 - DNA, 103 bp, Artificial Sequence
  Synthetic Polynucleotide
taatacgactcactatagggtgttcgtatttgcatgcgttaggatgtgggaacagaggagacccacaatgtaacgcatgaacctggcggcagcgcaaaagatg

SEQ ID NO: 234147 - DNA, 103 bp, Artificial Sequence
  Synthetic Polynucleotide
taatacgactcactatagggtgcaggtcttggcttgacttgccttgcctgaacagaggagacaggcaatgcaagtcaagaacctggcggcagcgcaaaagatg

SEQ ID NO: 234148 - DNA, 103 bp, Artificial Sequence
  Synthetic Polynucleotide
taatacgactcactatagggtgttcattcttgttcgtatttgcatgcgttaacagaggagaaacgcaatgaaatacgaaaacctggcggcagcgcaaaagatg

SEQ ID NO: 234149 - DNA, 103 bp, Artificial Sequence
  Synthetic Polynucleotide
taatacgactcactatagggctttccctcttgttcattcttgttcgtattaacagaggagaaatacgatgaagaatgaaaacctggcggcagcgcaaaagatg

SEQ ID NO: 234150 - DNA, 103 bp, Artificial Sequence
  Synthetic Polynucleotide
taatacgactcactatagggccgggggttgctctgtttccgcctggacataacagaggagaatgtccatgcggaaacagaacctggcggcagcgcaaaagatg

SEQ ID NO: 234151 - DNA, 103 bp, Artificial Sequence
  Synthetic Polynucleotide
taatacgactcactatagggaggtgccgtggccttttgctccatgtggctaacagaggagaagccacatggagcaaaagaacctggcggcagcgcaaaagatg

SEQ ID NO: 234152 - DNA, 103 bp, Artificial Sequence
  Synthetic Polynucleotide
taatacgactcactatagggcttgaggtgccgctcgcagttggccttggtaacagaggagaaccaagatgaactgcgagaacctggcggcagcgcaaaagatg

SEQ ID NO: 234153 - DNA, 103 bp, Artificial Sequence
  Synthetic Polynucleotide
taatacgactcactatagggccgtgtgcaccttgaggtgccgctcgcagtaacagaggagaactgcgatgggcacctcaaacctggcggcagcgcaaaagatg

SEQ ID NO: 234154 - DNA, 103 bp, Artificial Sequence
  Synthetic Polynucleotide
taatacgactcactatagggctcagcgtgtccgtgtgcaccttgaggtgcaacagaggagagcacctatgggtgcacacaacctggcggcagcgcaaaagatg

SEQ ID NO: 234155 - DNA, 103 bp, Artificial Sequence
  Synthetic Polynucleotide
taatacgactcactataggggcagacaccgctcagcgtgtccgtgtgcacaacagaggagagtgcacatggacacgctgaacctggcggcagcgcaaaagatg

SEQ ID NO: 234156 - DNA, 103 bp, Artificial Sequence
  Synthetic Polynucleotide
taatacgactcactatagggcacagctgtggcagacaccgctcagcgtgtaacagaggagaacacgcatggcggtgtctaacctggcggcagcgcaaaagatg

SEQ ID NO: 234157 - DNA, 103 bp, Artificial Sequence
  Synthetic Polynucleotide
taatacgactcactataggggagatgaagccacagctgtggcagacaccgaacagaggagacggtgtatgccacagctgaacctggcggcagcgcaaaagatg

SEQ ID NO: 234158 - DNA, 103 bp, Artificial Sequence
  Synthetic Polynucleotide
taatacgactcactatagggccttgtggtggagatgaagccacagctgtgaacagaggagacacagcatgggcttcatcaacctggcggcagcgcaaaagatg

SEQ ID NO: 234159 - DNA, 103 bp, Artificial Sequence
  Synthetic Polynucleotide
taatacgactcactatagggagaggatgtcccttgtggtggagatgaagcaacagaggagagcttcaatgccaccacaaaacctggcggcagcgcaaaagatg

SEQ ID NO: 234160 - DNA, 103 bp, Artificial Sequence
  Synthetic Polynucleotide
taatacgactcactatagggaagtggctgtagaggatgtcccttgtggtgaacagaggagacaccacatgggacatcctaacctggcggcagcgcaaaagatg

SEQ ID NO: 234161 - DNA, 103 bp, Artificial Sequence
  Synthetic Polynucleotide
taatacgactcactataggggttggtgaccaagtggctgtagaggatgtcaacagaggagagacatcatgtacagccacaacctggcggcagcgcaaaagatg

SEQ ID NO: 234162 - DNA, 103 bp, Artificial Sequence
  Synthetic Polynucleotide
taatacgactcactatagggtcggggcttcaggtgccgtggccttttgctaacagaggagaagcaaaatgccacggcacaacctggcggcagcgcaaaagatg

SEQ ID NO: 234163 - DNA, 103 bp, Artificial Sequence
  Synthetic Polynucleotide
taatacgactcactatagggagaccatgtggttggtgaccaagtggctgtaacagaggagaacagccatgtggtcaccaaacctggcggcagcgcaaaagatg

SEQ ID NO: 234164 - DNA, 103 bp, Artificial Sequence
  Synthetic Polynucleotide
taatacgactcactatagggccaggctggcagaccatgtggttggtgaccaacagaggagaggtcacatgccacatggtaacctggcggcagcgcaaaagatg

SEQ ID NO: 234165 - DNA, 103 bp, Artificial Sequence
  Synthetic Polynucleotide
taatacgactcactatagggacccttggagccaggctggcagaccatgtgaacagaggagacacatgatgtgccagcctaacctggcggcagcgcaaaagatg

SEQ ID NO: 234166 - DNA, 103 bp, Artificial Sequence
  Synthetic Polynucleotide
taatacgactcactatagggagtagatctcacccttggagccaggctggcaacagaggagagccagcatggctccaaggaacctggcggcagcgcaaaagatg

SEQ ID NO: 234167 - DNA, 103 bp, Artificial Sequence
  Synthetic Polynucleotide
taatacgactcactataggggcccctggcgagtagatctcacccttggagaacagaggagactccaaatgtgagatctaaacctggcggcagcgcaaaagatg

SEQ ID NO: 234168 - DNA, 103 bp, Artificial Sequence
  Synthetic Polynucleotide
taatacgactcactatagggtgggtgtccggcccctggcgagtagatctcaacagaggagagagatcatgtcgccagggaacctggcggcagcgcaaaagatg

SEQ ID NO: 234169 - DNA, 103 bp, Artificial Sequence
  Synthetic Polynucleotide
taatacgactcactataggggcttggttgctgggtgtccggcccctggcgaacagaggagacgccagatgccggacaccaacctggcggcagcgcaaaagatg

SEQ ID NO: 234170 - DNA, 103 bp, Artificial Sequence
  Synthetic Polynucleotide
taatacgactcactatagggtctgggggcagcttggttgctgggtgtccgaacagaggagacggacaatgagcaaccaaaacctggcggcagcgcaaaagatg

SEQ ID NO: 234171 - DNA, 103 bp, Artificial Sequence
  Synthetic Polynucleotide
taatacgactcactataggggcccagactgtctgggggcagcttggttgcaacagaggagagcaaccatgctgcccccaaacctggcggcagcgcaaaagatg

SEQ ID NO: 234172 - DNA, 103 bp, Artificial Sequence
  Synthetic Polynucleotide
taatacgactcactataggggctggaagctgcccagactgtctgggggcaaacagaggagatgccccatgacagtctggaacctggcggcagcgcaaaagatg

SEQ ID NO: 234173 - DNA, 103 bp, Artificial Sequence
  Synthetic Polynucleotide
taatacgactcactatagggctgggagggctcggggcttcaggtgccgtgaacagaggagacacggcatgtgaagccccaacctggcggcagcgcaaaagatg

SEQ ID NO: 234174 - DNA, 103 bp, Artificial Sequence
  Synthetic Polynucleotide
taatacgactcactataggggtgtgctgctgctggaagctgcccagactgaacagaggagacagtctatgcagcttccaaacctggcggcagcgcaaaagatg

SEQ ID NO: 234175 - DNA, 103 bp, Artificial Sequence
  Synthetic Polynucleotide
taatacgactcactatagggttgcagggccgtgtgctgctgctggaagctaacagaggagaagcttcatgcagcagcacaacctggcggcagcgcaaaagatg

SEQ ID NO: 234176 - DNA, 103 bp, Artificial Sequence
  Synthetic Polynucleotide
taatacgactcactatagggccagggggccttgcagggccgtgtgctgctaacagaggagaagcagcatgcggccctgcaacctggcggcagcgcaaaagatg

SEQ ID NO: 234177 - DNA, 103 bp, Artificial Sequence
  Synthetic Polynucleotide
taatacgactcactatagggtccgcggaggccagggggccttgcagggccaacagaggagaggccctatgaggccccctaacctggcggcagcgcaaaagatg

SEQ ID NO: 234178 - DNA, 103 bp, Artificial Sequence
  Synthetic Polynucleotide
taatacgactcactatagggcaggcccaggtccgcggaggccagggggccaacagaggagaggccccatggcctccgcgaacctggcggcagcgcaaaagatg

SEQ ID NO: 234179 - DNA, 103 bp, Artificial Sequence
  Synthetic Polynucleotide
taatacgactcactataggggggtgggcgccaggcccaggtccgcggaggaacagaggagacctccgatgacctgggccaacctggcggcagcgcaaaagatg

SEQ ID NO: 234180 - DNA, 103 bp, Artificial Sequence
  Synthetic Polynucleotide
taatacgactcactatagggcctggcgatggggtgggcgccaggcccaggaacagaggagacctgggatgggcgcccacaacctggcggcagcgcaaaagatg

SEQ ID NO: 234181 - DNA, 103 bp, Artificial Sequence
  Synthetic Polynucleotide
taatacgactcactatagggtctgtccagtcctggcgatggggtgggcgcaacagaggagagcgcccatgccatcgccaaacctggcggcagcgcaaaagatg

SEQ ID NO: 234182 - DNA, 103 bp, Artificial Sequence
  Synthetic Polynucleotide
taatacgactcactatagggccagggcctttctgtccagtcctggcgatgaacagaggagacatcgcatggactggacaaacctggcggcagcgcaaaagatg

SEQ ID NO: 234183 - DNA, 103 bp, Artificial Sequence
  Synthetic Polynucleotide
taatacgactcactataggggtggcctcggccagggcctttctgtccagtaacagaggagaactggaatgaaaggccctaacctggcggcagcgcaaaagatg

SEQ ID NO: 234184 - DNA, 103 bp, Artificial Sequence
  Synthetic Polynucleotide
taatacgactcactatagggaacatctgcgctgggagggctcggggcttcaacagaggagagaagccatgagccctcccaacctggcggcagcgcaaaagatg

SEQ ID NO: 234185 - DNA, 103 bp, Artificial Sequence
  Synthetic Polynucleotide
taatacgactcactatagggctctccgttggtggcctcggccagggccttaacagaggagaaaggccatggccgaggccaacctggcggcagcgcaaaagatg

SEQ ID NO: 234186 - DNA, 103 bp, Artificial Sequence
  Synthetic Polynucleotide
taatacgactcactatagggccgctctggcctctccgttggtggcctcggaacagaggagaccgaggatgccaacggagaacctggcggcagcgcaaaagatg

SEQ ID NO: 234187 - DNA, 103 bp, Artificial Sequence
  Synthetic Polynucleotide
taatacgactcactataggggccagaggctccgctctggcctctccgttgaacagaggagacaacggatgggccagagcaacctggcggcagcgcaaaagatg

SEQ ID NO: 234188 - DNA, 103 bp, Artificial Sequence
  Synthetic Polynucleotide
taatacgactcactatagggtccattctgggccagaggctccgctctggcaacagaggagagccagaatggagcctctgaacctggcggcagcgcaaaagatg

SEQ ID NO: 234189 - DNA, 103 bp, Artificial Sequence
  Synthetic Polynucleotide
taatacgactcactatagggcgctgctgcctccattctgggccagaggctaacagaggagaagcctcatgcccagaatgaacctggcggcagcgcaaaagatg

SEQ ID NO: 234190 - DNA, 103 bp, Artificial Sequence
  Synthetic Polynucleotide
taatacgactcactataggggccgggggctcgctgctgcctccattctggaacagaggagaccagaaatgaggcagcagaacctggcggcagcgcaaaagatg

SEQ ID NO: 234191 - DNA, 103 bp, Artificial Sequence
  Synthetic Polynucleotide
taatacgactcactatagggcctgggggccgccgggggctcgctgctgccaacagaggagaggcagcatggagcccccgaacctggcggcagcgcaaaagatg

SEQ ID NO: 234192 - DNA, 103 bp, Artificial Sequence
  Synthetic Polynucleotide
taatacgactcactatagggccttgatgctcctgggggccgccgggggctaacagaggagaagccccatgcggcccccaaacctggcggcagcgcaaaagatg

SEQ ID NO: 234193 - DNA, 103 bp, Artificial Sequence
  Synthetic Polynucleotide
taatacgactcactatagggaccgcctccaccttgatgctcctgggggccaacagaggagaggccccatggagcatcaaaacctggcggcagcgcaaaagatg

SEQ ID NO: 234194 - DNA, 103 bp, Artificial Sequence
  Synthetic Polynucleotide
taatacgactcactatagggcggctcctccaccgcctccaccttgatgctaacagaggagaagcatcatggtggaggcgaacctggcggcagcgcaaaagatg

SEQ ID NO: 234195 - DNA, 103 bp, Artificial Sequence
  Synthetic Polynucleotide
taatacgactcactatagggggggtgagttaacatctgcgctgggagggcaacagaggagagccctcatggcgcagatgaacctggcggcagcgcaaaagatg

SEQ ID NO: 234196 - DNA, 103 bp, Artificial Sequence
  Synthetic Polynucleotide
taatacgactcactataggggggccgcctccggctcctccaccgcctccaaacagaggagatggaggatgtggaggagcaacctggcggcagcgcaaaagatg

SEQ ID NO: 234197 - DNA, 103 bp, Artificial Sequence
  Synthetic Polynucleotide
taatacgactcactatagggcccaggatgggggccgcctccggctcctccaacagaggagaggaggaatgggaggcggcaacctggcggcagcgcaaaagatg

SEQ ID NO: 234198 - DNA, 103 bp, Artificial Sequence
  Synthetic Polynucleotide
taatacgactcactatagggctctccggggcccaggatgggggccgcctcaacagaggagagaggcgatgcccatcctgaacctggcggcagcgcaaaagatg

SEQ ID NO: 234199 - DNA, 103 bp, Artificial Sequence
  Synthetic Polynucleotide
taatacgactcactatagggggggcccaggctctccggggcccaggatggaacagaggagaccatccatggccccggagaacctggcggcagcgcaaaagatg

SEQ ID NO: 234200 - DNA, 103 bp, Artificial Sequence
  Synthetic Polynucleotide
taatacgactcactataggggacggggcctggggcccaggctctccggggaacagaggagaccccggatggcctgggccaacctggcggcagcgcaaaagatg

SEQ ID NO: 234201 - DNA, 103 bp, Artificial Sequence
  Synthetic Polynucleotide
taatacgactcactatagggcggcgtccgcgacggggcctggggcccaggaacagaggagacctgggatgcaggccccgaacctggcggcagcgcaaaagatg

SEQ ID NO: 234202 - DNA, 103 bp, Artificial Sequence
  Synthetic Polynucleotide
taatacgactcactatagggtgcgcggcgacggcgtccgcgacggggcctaacagaggagaaggcccatgcgcggacgcaacctggcggcagcgcaaaagatg

SEQ ID NO: 234203 - DNA, 103 bp, Artificial Sequence
  Synthetic Polynucleotide
taatacgactcactatagggggggcggggctgcgcggcgacggcgtccgcaacagaggagagcggacatggtcgccgcgaacctggcggcagcgcaaaagatg

SEQ ID NO: 234204 - DNA, 103 bp, Artificial Sequence
  Synthetic Polynucleotide
taatacgactcactataggggaccctggccggggcggggctgcgcggcgaaacagaggagatcgccgatgagccccgccaacctggcggcagcgcaaaagatg

SEQ ID NO: 234205 - DNA, 103 bp, Artificial Sequence
  Synthetic Polynucleotide
taatacgactcactataggggctcggccttgaccctggccggggcggggcaacagaggagagccccgatgcggccagggaacctggcggcagcgcaaaagatg

SEQ ID NO: 234206 - DNA, 103 bp, Artificial Sequence
  Synthetic Polynucleotide
taatacgactcactatagggggcagcggtgggggtgagttaacatctgcgaacagaggagacgcagaatgtaactcaccaacctggcggcagcgcaaaagatg

SEQ ID NO: 234207 - DNA, 103 bp, Artificial Sequence
  Synthetic Polynucleotide
taatacgactcactataggggggctggacagctcggccttgaccctggccaacagaggagaggccagatgcaaggccgaaacctggcggcagcgcaaaagatg

SEQ ID NO: 234208 - DNA, 103 bp, Artificial Sequence
  Synthetic Polynucleotide
taatacgactcactataggggcccggcgtggggctggacagctcggccttaacagaggagaaaggccatgctgtccagcaacctggcggcagcgcaaaagatg

SEQ ID NO: 234209 - DNA, 103 bp, Artificial Sequence
  Synthetic Polynucleotide
taatacgactcactatagggccgggctggagcccggcgtggggctggacaaacagaggagatgtccaatgccacgccggaacctggcggcagcgcaaaagatg

SEQ ID NO: 234210 - DNA, 103 bp, Artificial Sequence
  Synthetic Polynucleotide
taatacgactcactatagggtcgccgggcaccgggctggagcccggcgtgaacagaggagacacgccatgctccagcccaacctggcggcagcgcaaaagatg

SEQ ID NO: 234211 - DNA, 103 bp, Artificial Sequence
  Synthetic Polynucleotide
taatacgactcactatagggcaggcccagctcgccgggcaccgggctggaaacagaggagatccagcatggtgcccggcaacctggcggcagcgcaaaagatg

SEQ ID NO: 234212 - DNA, 103 bp, Artificial Sequence
  Synthetic Polynucleotide
taatacgactcactataggggggccccggccaggcccagctcgccgggcaaacagaggagatgcccgatgagctgggccaacctggcggcagcgcaaaagatg

SEQ ID NO: 234213 - DNA, 103 bp, Artificial Sequence
  Synthetic Polynucleotide
taatacgactcactatagggggaaggaacagggccccggccaggcccagcaacagaggagagctgggatgggccggggcaacctggcggcagcgcaaaagatg

SEQ ID NO: 234214 - DNA, 103 bp, Artificial Sequence
  Synthetic Polynucleotide
taatacgactcactatagggcacgtactgcggaaggaacagggccccggcaacagaggagagccgggatgctgttccttaacctggcggcagcgcaaaagatg

SEQ ID NO: 234215 - DNA, 103 bp, Artificial Sequence
  Synthetic Polynucleotide
taatacgactcactatagggcgggcccgaacacgtactgcggaaggaacaaacagaggagatgttccatgcgcagtacgaacctggcggcagcgcaaaagatg

SEQ ID NO: 234216 - DNA, 103 bp, Artificial Sequence
  Synthetic Polynucleotide
taatacgactcactatagggggcgccgcgtcgggcccgaacacgtactgcaacagaggagagcagtaatggttcgggccaacctggcggcagcgcaaaagatg

SEQ ID NO: 234217 - DNA, 103 bp, Artificial Sequence
  Synthetic Polynucleotide
taatacgactcactatagggtgtggggggcggcagcggtgggggtgagttaacagaggagaaactcaatgccaccgctgaacctggcggcagcgcaaaagatg

SEQ ID NO: 234218 - DNA, 103 bp, Artificial Sequence
  Synthetic Polynucleotide
taatacgactcactatagggcgaggcggggggcgccgcgtcgggcccgaaaacagaggagattcgggatggacgcggcgaacctggcggcagcgcaaaagatg

SEQ ID NO: 234219 - DNA, 103 bp, Artificial Sequence
  Synthetic Polynucleotide
taatacgactcactatagggccaggatctccgaggcggggggcgccgcgtaacagaggagaacgcggatgcccccgcctaacctggcggcagcgcaaaagatg

SEQ ID NO: 234220 - DNA, 103 bp, Artificial Sequence
  Synthetic Polynucleotide
taatacgactcactataggggacatcttggccaggatctccgaggcggggaacagaggagaccccgcatgggagatcctaacctggcggcagcgcaaaagatg

SEQ ID NO: 234221 - DNA, 103 bp, Artificial Sequence
  Synthetic Polynucleotide
taatacgactcactatagggcaccagctcggacatcttggccaggatctcaacagaggagagagatcatggccaagatgaacctggcggcagcgcaaaagatg

SEQ ID NO: 234222 - DNA, 103 bp, Artificial Sequence
  Synthetic Polynucleotide
taatacgactcactataggggccggctgtgcaccagctcggacatcttggaacagaggagaccaagaatgccgagctggaacctggcggcagcgcaaaagatg

SEQ ID NO: 234223 - DNA, 103 bp, Artificial Sequence
  Synthetic Polynucleotide
taatacgactcactatagggccctgctgcagccggctgtgcaccagctcgaacagaggagacgagctatggcacagccgaacctggcggcagcgcaaaagatg

SEQ ID NO: 234224 - DNA, 103 bp, Artificial Sequence
  Synthetic Polynucleotide
taatacgactcactatagggcgcgcccgcgccctgctgcagccggctgtgaacagaggagacacagcatgctgcagcagaacctggcggcagcgcaaaagatg

SEQ ID NO: 234225 - DNA, 103 bp, Artificial Sequence
  Synthetic Polynucleotide
taatacgactcactatagggcgccggcgcccgcgcccgcgccctgctgcaaacagaggagatgcagcatggcgcgggcgaacctggcggcagcgcaaaagatg

SEQ ID NO: 234226 - DNA, 103 bp, Artificial Sequence
  Synthetic Polynucleotide
taatacgactcactataggggtctgcgcgccgccggcgcccgcgcccgcgaacagaggagacgcgggatggggcgccggaacctggcggcagcgcaaaagatg

SEQ ID NO: 234227 - DNA, 103 bp, Artificial Sequence
  Synthetic Polynucleotide
taatacgactcactataggggaagagcccggtctgcgcgccgccggcgccaacagaggagaggcgccatgggcgcgcagaacctggcggcagcgcaaaagatg

SEQ ID NO: 234228 - DNA, 103 bp, Artificial Sequence
  Synthetic Polynucleotide
taatacgactcactatagggctcctggggatgtggggggcggcagcggtgaacagaggagacaccgcatgcgccccccaaacctggcggcagcgcaaaagatg

SEQ ID NO: 234229 - DNA, 103 bp, Artificial Sequence
  Synthetic Polynucleotide
taatacgactcactataggggggccccggggaagagcccggtctgcgcgcaacagaggagagcgcgcatgccgggctctaacctggcggcagcgcaaaagatg

SEQ ID NO: 234230 - DNA, 103 bp, Artificial Sequence
  Synthetic Polynucleotide
taatacgactcactataggggcgcccttgggggccccggggaagagcccgaacagaggagacgggctatgccccggggcaacctggcggcagcgcaaaagatg

SEQ ID NO: 234231 - DNA, 103 bp, Artificial Sequence
  Synthetic Polynucleotide
taatacgactcactataggggaagcacgtagcgcccttgggggccccgggaacagaggagacccgggatgcccaagggcaacctggcggcagcgcaaaagatg

SEQ ID NO: 234232 - DNA, 103 bp, Artificial Sequence
  Synthetic Polynucleotide
taatacgactcactatagggtctcgcactcgaagcacgtagcgcccttggaacagaggagaccaaggatgctacgtgctaacctggcggcagcgcaaaagatg

SEQ ID NO: 234233 - DNA, 103 bp, Artificial Sequence
  Synthetic Polynucleotide
taatacgactcactatagggctgaaggtgatctcgcactcgaagcacgtaaacagaggagatacgtgatgcgagtgcgaaacctggcggcagcgcaaaagatg

SEQ ID NO: 234234 - DNA, 103 bp, Artificial Sequence
  Synthetic Polynucleotide
taatacgactcactataggggttgacgttgctgaaggtgatctcgcactcaacagaggagagagtgcatgatcaccttcaacctggcggcagcgcaaaagatg

SEQ ID NO: 234235 - DNA, 103 bp, Artificial Sequence
  Synthetic Polynucleotide
taatacgactcactatagggcgtagtagttgttgacgttgctgaaggtgaaacagaggagatcacctatggcaacgtcaaacctggcggcagcgcaaaagatg

SEQ ID NO: 234236 - DNA, 103 bp, Artificial Sequence
  Synthetic Polynucleotide
taatacgactcactatagggcgcttgtgcacgtagtagttgttgacgttgaacagaggagacaacgtatgcaactactaaacctggcggcagcgcaaaagatg

SEQ ID NO: 234237 - DNA, 103 bp, Artificial Sequence
  Synthetic Polynucleotide
taatacgactcactatagggacagtagaggcgcttgtgcacgtagtagttaacagaggagaaactacatggtgcacaagaacctggcggcagcgcaaaagatg

SEQ ID NO: 234238 - DNA, 103 bp, Artificial Sequence
  Synthetic Polynucleotide
taatacgactcactatagggggcggcctgaacagtagaggcgcttgtgcaaacagaggagatgcacaatggcctctactaacctggcggcagcgcaaaagatg

SEQ ID NO: 234239 - DNA, 103 bp, Artificial Sequence
  Synthetic Polynucleotide
taatacgactcactatagggtccttggggcctcctggggatgtggggggcaacagaggagagcccccatgatccccaggaacctggcggcagcgcaaaagatg

SEQ ID NO: 234240 - DNA, 103 bp, Artificial Sequence
  Synthetic Polynucleotide
taatacgactcactatagggtcgggcgcacggcggcctgaacagtagaggaacagaggagacctctaatgttcaggccgaacctggcggcagcgcaaaagatg

SEQ ID NO: 234241 - DNA, 103 bp, Artificial Sequence
  Synthetic Polynucleotide
taatacgactcactatagggaggcgcgtcctcgggcgcacggcggcctgaaacagaggagatcaggcatgcgtgcgcccaacctggcggcagcgcaaaagatg

SEQ ID NO: 234242 - DNA, 103 bp, Artificial Sequence
  Synthetic Polynucleotide
taatacgactcactatagggtgcgcgcggcaggcgcgtcctcgggcgcacaacagaggagagtgcgcatgaggacgcgcaacctggcggcagcgcaaaagatg

SEQ ID NO: 234243 - DNA, 103 bp, Artificial Sequence
  Synthetic Polynucleotide
taatacgactcactataggggccttgggcctgcgcgcggcaggcgcgtccaacagaggagaggacgcatgtgccgcgcgaacctggcggcagcgcaaaagatg

SEQ ID NO: 234244 - DNA, 103 bp, Artificial Sequence
  Synthetic Polynucleotide
taatacgactcactataggggccggggggcgccttgggcctgcgcgcggcaacagaggagagccgcgatgaggcccaagaacctggcggcagcgcaaaagatg

SEQ ID NO: 234245 - DNA, 103 bp, Artificial Sequence
  Synthetic Polynucleotide
taatacgactcactatagggcgcgggccgggccggggggcgccttgggccaacagaggagaggcccaatgcgccccccgaacctggcggcagcgcaaaagatg

SEQ ID NO: 234246 - DNA, 103 bp, Artificial Sequence
  Synthetic Polynucleotide
taatacgactcactatagggccggggggcgcgcgggccgggccggggggcaacagaggagagcccccatgcccggcccgaacctggcggcagcgcaaaagatg

SEQ ID NO: 234247 - DNA, 103 bp, Artificial Sequence
  Synthetic Polynucleotide
taatacgactcactatagggggcgggctggccggggggcgcgcgggccggaacagaggagaccggccatggcgccccccaacctggcggcagcgcaaaagatg

SEQ ID NO: 234248 - DNA, 103 bp, Artificial Sequence
  Synthetic Polynucleotide
taatacgactcactatagggcgtcgggttcggcgggctggccggggggcgaacagaggagacgccccatggccagcccgaacctggcggcagcgcaaaagatg

SEQ ID NO: 234249 - DNA, 103 bp, Artificial Sequence
  Synthetic Polynucleotide
taatacgactcactataggggagcgcggcgcgtcgggttcggcgggctggaacagaggagaccagccatgcgaacccgaaacctggcggcagcgcaaaagatg

SEQ ID NO: 234250 - DNA, 103 bp, Artificial Sequence
  Synthetic Polynucleotide
taatacgactcactatagggtccttccagctccttggggcctcctggggaaacagaggagatccccaatgggccccaagaacctggcggcagcgcaaaagatg

SEQ ID NO: 234251 - DNA, 103 bp, Artificial Sequence
  Synthetic Polynucleotide
taatacgactcactataggggcccggggacgagcgcggcgcgtcgggttcaacagaggagagaacccatggcgccgcgcaacctggcggcagcgcaaaagatg

SEQ ID NO: 234252 - DNA, 103 bp, Artificial Sequence
  Synthetic Polynucleotide
taatacgactcactataggggcgctccggggcccggggacgagcgcggcgaacagaggagacgccgcatgcgtccccggaacctggcggcagcgcaaaagatg

SEQ ID NO: 234253 - DNA, 103 bp, Artificial Sequence
  Synthetic Polynucleotide
taatacgactcactatagggccctcctcgcgcgctccggggcccggggacaacagaggagagtccccatgccccggagcaacctggcggcagcgcaaaagatg

SEQ ID NO: 234254 - DNA, 103 bp, Artificial Sequence
  Synthetic Polynucleotide
taatacgactcactataggggcccccagccccctcctcgcgcgctccgggaacagaggagacccggaatgcgcgaggagaacctggcggcagcgcaaaagatg

SEQ ID NO: 234255 - DNA, 103 bp, Artificial Sequence
  Synthetic Polynucleotide
taatacgactcactataggggcgtggccgcgcccccagccccctcctcgcaacagaggagagcgaggatggggctggggaacctggcggcagcgcaaaagatg

SEQ ID NO: 234256 - DNA, 103 bp, Artificial Sequence
  Synthetic Polynucleotide
taatacgactcactatagggccgtcctcgggcgtggccgcgcccccagccaacagaggagaggctggatgcgcggccacaacctggcggcagcgcaaaagatg

SEQ ID NO: 234257 - DNA, 103 bp, Artificial Sequence
  Synthetic Polynucleotide
taatacgactcactataggggccgcccgcgccgtcctcgggcgtggccgcaacagaggagagcggccatgcccgaggacaacctggcggcagcgcaaaagatg

SEQ ID NO: 234258 - DNA, 103 bp, Artificial Sequence
  Synthetic Polynucleotide
taatacgactcactatagggcgctgccccggccgcccgcgccgtcctcggaacagaggagaccgaggatggcgcgggcgaacctggcggcagcgcaaaagatg

SEQ ID NO: 234259 - DNA, 103 bp, Artificial Sequence
  Synthetic Polynucleotide
taatacgactcactatagggtggctgccctcgctgccccggccgcccgcgaacagaggagacgcgggatgccggggcagaacctggcggcagcgcaaaagatg

SEQ ID NO: 234260 - DNA, 103 bp, Artificial Sequence
  Synthetic Polynucleotide
taatacgactcactatagggacccgggctctggctgccctcgctgccccgaacagaggagacggggcatggagggcagcaacctggcggcagcgcaaaagatg

SEQ ID NO: 234261 - DNA, 103 bp, Artificial Sequence
  Synthetic Polynucleotide
taatacgactcactataggggcttgatctgccgggggttgctctgtttccaacagaggagaggaaacatggcaacccccaacctggcggcagcgcaaaagatg

SEQ ID NO: 234262 - DNA, 103 bp, Artificial Sequence
  Synthetic Polynucleotide
taatacgactcactatagggctggttcctgtccttccagctccttggggcaacagaggagagccccaatgagctggaagaacctggcggcagcgcaaaagatg

SEQ ID NO: 234263 - DNA, 103 bp, Artificial Sequence
  Synthetic Polynucleotide
taatacgactcactatagggccacggagctacccgggctctggctgccctaacagaggagaagggcaatgagagcccggaacctggcggcagcgcaaaagatg

SEQ ID NO: 234264 - DNA, 103 bp, Artificial Sequence
  Synthetic Polynucleotide
taatacgactcactatagggtccgcgtcgtccacggagctacccgggctcaacagaggagagagcccatgtagctccgtaacctggcggcagcgcaaaagatg

SEQ ID NO: 234265 - DNA, 103 bp, Artificial Sequence
  Synthetic Polynucleotide
taatacgactcactatagggggggtcgtcctccgcgtcgtccacggagctaacagaggagaagctccatggacgacgcgaacctggcggcagcgcaaaagatg

SEQ ID NO: 234266 - DNA, 103 bp, Artificial Sequence
  Synthetic Polynucleotide
taatacgactcactataggggcgtgcggctggggtcgtcctccgcgtcgtaacagaggagaacgacgatgaggacgaccaacctggcggcagcgcaaaagatg

SEQ ID NO: 234267 - DNA, 103 bp, Artificial Sequence
  Synthetic Polynucleotide
taatacgactcactataggggcctcgcacagcgtgcggctggggtcgtccaacagaggagaggacgaatgcagccgcacaacctggcggcagcgcaaaagatg

SEQ ID NO: 234268 - DNA, 103 bp, Artificial Sequence
  Synthetic Polynucleotide
taatacgactcactataggggatgttgcaggcctcgcacagcgtgcggctaacagaggagaagccgcatgctgtgcgagaacctggcggcagcgcaaaagatg

SEQ ID NO: 234269 - DNA, 103 bp, Artificial Sequence
  Synthetic Polynucleotide
taatacgactcactatagggggctgaagcggatgttgcaggcctcgcacaaacagaggagatgtgcgatgcctgcaacaaacctggcggcagcgcaaaagatg

SEQ ID NO: 234270 - DNA, 103 bp, Artificial Sequence
  Synthetic Polynucleotide
taatacgactcactataggggtctcgtggcggctgaagcggatgttgcagaacagaggagactgcaaatgccgcttcagaacctggcggcagcgcaaaagatg

SEQ ID NO: 234271 - DNA, 103 bp, Artificial Sequence
  Synthetic Polynucleotide
taatacgactcactatagggcacggtgtaggtctcgtggcggctgaagcgaacagaggagacgcttcatgcgccacgagaacctggcggcagcgcaaaagatg

SEQ ID NO: 234272 - DNA, 103 bp, Artificial Sequence
  Synthetic Polynucleotide
taatacgactcactatagggaccgcttgtgcacggtgtaggtctcgtggcaacagaggagagccacgatgcctacaccgaacctggcggcagcgcaaaagatg

SEQ ID NO: 234273 - DNA, 103 bp, Artificial Sequence
  Synthetic Polynucleotide
taatacgactcactatagggggcctgggttctggttcctgtccttccagcaacagaggagagctggaatgacaggaaccaacctggcggcagcgcaaaagatg

SEQ ID NO: 234274 - DNA, 103 bp, Artificial Sequence
  Synthetic Polynucleotide
taatacgactcactataggggcgcagtagtaccgcttgtgcacggtgtagaacagaggagactacacatggcacaagcgaacctggcggcagcgcaaaagatg

SEQ ID NO: 234275 - DNA, 103 bp, Artificial Sequence
  Synthetic Polynucleotide
taatacgactcactataggggtggcgcgaggcgcagtagtaccgcttgtgaacagaggagacacaagatgtactactgcaacctggcggcagcgcaaaagatg

SEQ ID NO: 234276 - DNA, 103 bp, Artificial Sequence
  Synthetic Polynucleotide
taatacgactcactataggggcggcgggtcgtggcgcgaggcgcagtagtaacagaggagaactactatgcctcgcgccaacctggcggcagcgcaaaagatg

SEQ ID NO: 234277 - DNA, 103 bp, Artificial Sequence
  Synthetic Polynucleotide
taatacgactcactatagggggtcggcgcggcggcgggtcgtggcgcgagaacagaggagactcgcgatgcgacccgccaacctggcggcagcgcaaaagatg

SEQ ID NO: 234278 - DNA, 103 bp, Artificial Sequence
  Synthetic Polynucleotide
taatacgactcactataggggggcgcggccggtcggcgcggcggcgggtcaacagaggagagacccgatgccgcgccgaaacctggcggcagcgcaaaagatg

SEQ ID NO: 234279 - DNA, 103 bp, Artificial Sequence
  Synthetic Polynucleotide
taatacgactcactatagggggggtcccgggggcgcggccggtcggcgcgaacagaggagacgcgccatgcggccgcgcaacctggcggcagcgcaaaagatg

SEQ ID NO: 234280 - DNA, 103 bp, Artificial Sequence
  Synthetic Polynucleotide
taatacgactcactataggggccggcccagggggtcccgggggcgcggccaacagaggagaggccgcatgcccgggaccaacctggcggcagcgcaaaagatg

SEQ ID NO: 234281 - DNA, 103 bp, Artificial Sequence
  Synthetic Polynucleotide
taatacgactcactatagggcgggggcgcggccggcccagggggtcccggaacagaggagaccgggaatgcctgggccgaacctggcggcagcgcaaaagatg

SEQ ID NO: 234282 - DNA, 103 bp, Artificial Sequence
  Synthetic Polynucleotide
taatacgactcactataggggagagggggccgggggcgcggccggcccagaacagaggagactgggcatgccgcgccccaacctggcggcagcgcaaaagatg

SEQ ID NO: 234283 - DNA, 103 bp, Artificial Sequence
  Synthetic Polynucleotide
taatacgactcactatagggggcgcggcgggagagggggccgggggcgcgaacagaggagacgcgccatgggccccctcaacctggcggcagcgcaaaagatg

SEQ ID NO: 234284 - DNA, 103 bp, Artificial Sequence
  Synthetic Polynucleotide
taatacgactcactatagggttcctccgtgggcctgggttctggttcctgaacagaggagacaggaaatggaacccaggaacctggcggcagcgcaaaagatg

SEQ ID NO: 234285 - DNA, 103 bp, Artificial Sequence
  Synthetic Polynucleotide
taatacgactcactatagggcgtgcgcacaggcgcggcgggagagggggcaacagaggagagcccccatgcccgccgcgaacctggcggcagcgcaaaagatg

SEQ ID NO: 234286 - DNA, 103 bp, Artificial Sequence
  Synthetic Polynucleotide
taatacgactcactatagggggcgtctgcgcgtgcgcacaggcgcggcggaacagaggagaccgccgatgctgtgcgcaaacctggcggcagcgcaaaagatg

SEQ ID NO: 234287 - DNA, 103 bp, Artificial Sequence
  Synthetic Polynucleotide
taatacgactcactatagggtagagcttgcggcgtctgcgcgtgcgcacaaacagaggagatgtgcgatggcgcagacgaacctggcggcagcgcaaaagatg

SEQ ID NO: 234288 - DNA, 103 bp, Artificial Sequence
  Synthetic Polynucleotide
taatacgactcactataggggtgcagctcgtagagcttgcggcgtctgcgaacagaggagacgcagaatgcgcaagctcaacctggcggcagcgcaaaagatg

SEQ ID NO: 234289 - DNA, 103 bp, Artificial Sequence
  Synthetic Polynucleotide
taatacgactcactatagggcgccggccgcgtgcagctcgtagagcttgcaacagaggagagcaagcatgacgagctgcaacctggcggcagcgcaaaagatg

SEQ ID NO: 234290 - DNA, 103 bp, Artificial Sequence
  Synthetic Polynucleotide
taatacgactcactataggggggggcggggcgccggccgcgtgcagctcgaacagaggagacgagctatgcgcggccggaacctggcggcagcgcaaaagatg

SEQ ID NO: 234291 - DNA, 103 bp, Artificial Sequence
  Synthetic Polynucleotide
taatacgactcactataggggggcggcggggggggcggggcgccggccgcaacagaggagagcggccatggccccgcccaacctggcggcagcgcaaaagatg

SEQ ID NO: 234292 - DNA, 103 bp, Artificial Sequence
  Synthetic Polynucleotide
taatacgactcactataggggggcgtggccgggcggcggggggggcggggaacagaggagaccccgcatgccccgccgcaacctggcggcagcgcaaaagatg

SEQ ID NO: 234293 - DNA, 103 bp, Artificial Sequence
  Synthetic Polynucleotide
taatacgactcactatagggtcgggcgcgggggcgtggccgggcggcgggaacagaggagacccgccatgcggccacgcaacctggcggcagcgcaaaagatg

SEQ ID NO: 234294 - DNA, 103 bp, Artificial Sequence
  Synthetic Polynucleotide
taatacgactcactatagggccgcggcgactcgggcgcgggggcgtggccaacagaggagaggccacatgcccgcgcccaacctggcggcagcgcaaaagatg

SEQ ID NO: 234295 - DNA, 103 bp, Artificial Sequence
  Synthetic Polynucleotide
taatacgactcactatagggtgcccggctcttcctccgtgggcctgggttaacagaggagaaacccaatgccacggaggaacctggcggcagcgcaaaagatg

SEQ ID NO: 234296 - DNA, 103 bp, Artificial Sequence
  Synthetic Polynucleotide
taatacgactcactatagggcgcttccgggccgcggcgactcgggcgcggaacagaggagaccgcgcatgagtcgccgcaacctggcggcagcgcaaaagatg

SEQ ID NO: 234297 - DNA, 103 bp, Artificial Sequence
  Synthetic Polynucleotide
taatacgactcactatagggcttccgcttccgcttccgggccgcggcgacaacagaggagagtcgccatggcccggaagaacctggcggcagcgcaaaagatg

SEQ ID NO: 234298 - DNA, 103 bp, Artificial Sequence
  Synthetic Polynucleotide
taatacgactcactataggggccggggccgcttccgcttccgcttccgggaacagaggagacccggaatgggaagcggaaacctggcggcagcgcaaaagatg

SEQ ID NO: 234299 - DNA, 103 bp, Artificial Sequence
  Synthetic Polynucleotide
taatacgactcactatagggcaggggcgaggccggggccgcttccgcttcaacagaggagagaagcgatggcggccccgaacctggcggcagcgcaaaagatg

SEQ ID NO: 234300 - DNA, 103 bp, Artificial Sequence
  Synthetic Polynucleotide
taatacgactcactatagggggcgagcgcgcaggggcgaggccggggccgaacagaggagacggcccatgcctcgccccaacctggcggcagcgcaaaagatg

SEQ ID NO: 234301 - DNA, 103 bp, Artificial Sequence
  Synthetic Polynucleotide
taatacgactcactatagggcgcggggccgggcgagcgcgcaggggcgagaacagaggagactcgccatggcgcgctcgaacctggcggcagcgcaaaagatg

SEQ ID NO: 234302 - DNA, 103 bp, Artificial Sequence
  Synthetic Polynucleotide
taatacgactcactatagggggccgtcggccgcggggccgggcgagcgcgaacagaggagacgcgctatgccggccccgaacctggcggcagcgcaaaagatg

SEQ ID NO: 234303 - DNA, 103 bp, Artificial Sequence
  Synthetic Polynucleotide
taatacgactcactatagggaggtcgatggggccgtcggccgcggggccgaacagaggagacggcccatgggccgacggaacctggcggcagcgcaaaagatg

SEQ ID NO: 234304 - DNA, 103 bp, Artificial Sequence
  Synthetic Polynucleotide
taatacgactcactatagggcttcttgctcaggtcgatggggccgtcggcaacagaggagagccgacatgcccatcgacaacctggcggcagcgcaaaagatg

SEQ ID NO: 234305 - DNA, 103 bp, Artificial Sequence
  Synthetic Polynucleotide
taatacgactcactatagggggcgccgcggcttcttgctcaggtcgatggaacagaggagaccatcgatgtgagcaagaaacctggcggcagcgcaaaagatg

SEQ ID NO: 234306 - DNA, 103 bp, Artificial Sequence
  Synthetic Polynucleotide
taatacgactcactatagggctccagggactgcccggctcttcctccgtgaacagaggagacacggaatgagagccgggaacctggcggcagcgcaaaagatg

SEQ ID NO: 234307 - DNA, 103 bp, Artificial Sequence
  Synthetic Polynucleotide
taatacgactcactatagggccggggagcgggcgccgcggcttcttgctcaacagaggagagagcaaatggccgcggcgaacctggcggcagcgcaaaagatg

SEQ ID NO: 234308 - DNA, 103 bp, Artificial Sequence
  Synthetic Polynucleotide
taatacgactcactatagggtgccggggctccggggagcgggcgccgcggaacagaggagaccgcggatgccgctccccaacctggcggcagcgcaaaagatg

SEQ ID NO: 234309 - DNA, 103 bp, Artificial Sequence
  Synthetic Polynucleotide
taatacgactcactatagggccagcgccggtgccggggctccggggagcgaacagaggagacgctccatggagccccggaacctggcggcagcgcaaaagatg

SEQ ID NO: 234310 - DNA, 103 bp, Artificial Sequence
  Synthetic Polynucleotide
taatacgactcactatagggtggtagtcggccagcgccggtgccggggctaacagaggagaagccccatgaccggcgctaacctggcggcagcgcaaaagatg

SEQ ID NO: 234311 - DNA, 103 bp, Artificial Sequence
  Synthetic Polynucleotide
taatacgactcactatagggcgtgcactcgtggtagtcggccagcgccggaacagaggagaccggcgatggccgactacaacctggcggcagcgcaaaagatg

SEQ ID NO: 234312 - DNA, 103 bp, Artificial Sequence
  Synthetic Polynucleotide
taatacgactcactatagggcgcggcaggccgtgcactcgtggtagtcggaacagaggagaccgactatgacgagtgcaaacctggcggcagcgcaaaagatg

SEQ ID NO: 234313 - DNA, 103 bp, Artificial Sequence
  Synthetic Polynucleotide
taatacgactcactatagggtggaagctcacgcggcaggccgtgcactcgaacagaggagacgagtgatgggcctgccgaacctggcggcagcgcaaaagatg

SEQ ID NO: 234314 - DNA, 103 bp, Artificial Sequence
  Synthetic Polynucleotide
taatacgactcactatagggctcgaggctgtggaagctcacgcggcaggcaacagaggagagcctgcatggtgagcttcaacctggcggcagcgcaaaagatg

SEQ ID NO: 234315 - DNA, 103 bp, Artificial Sequence
  Synthetic Polynucleotide
taatacgactcactatagggccaggtaggcctcgaggctgtggaagctcaaacagaggagatgagctatgacagcctcgaacctggcggcagcgcaaaagatg

SEQ ID NO: 234316 - DNA, 103 bp, Artificial Sequence
  Synthetic Polynucleotide
taatacgactcactatagggttcttgtgcgccaggtaggcctcgaggctgaacagaggagacagcctatgggcctacctaacctggcggcagcgcaaaagatg

SEQ ID NO: 234317 - DNA, 103 bp, Artificial Sequence
  Synthetic Polynucleotide
taatacgactcactataggggtctggcccgctccagggactgcccggctcaacagaggagagagccgatgagtccctggaacctggcggcagcgcaaaagatg

SEQ ID NO: 234318 - DNA, 103 bp, Artificial Sequence
  Synthetic Polynucleotide
taatacgactcactataggggcacgagtacttcttgtgcgccaggtaggcaacagaggagagcctacatggcgcacaagaacctggcggcagcgcaaaagatg

SEQ ID NO: 234319 - DNA, 103 bp, Artificial Sequence
  Synthetic Polynucleotide
taatacgactcactataggggcgcagcggggcacgagtacttcttgtgcgaacagaggagacgcacaatgagtactcgtaacctggcggcagcgcaaaagatg

SEQ ID NO: 234320 - DNA, 103 bp, Artificial Sequence
  Synthetic Polynucleotide
taatacgactcactatagggccgggcggtggcgcagcggggcacgagtacaacagaggagagtactcatgccccgctgcaacctggcggcagcgcaaaagatg

SEQ ID NO: 234321 - DNA, 103 bp, Artificial Sequence
  Synthetic Polynucleotide
taatacgactcactataggggccgagcgcgccgggcggtggcgcagcgggaacagaggagacccgctatgccaccgcccaacctggcggcagcgcaaaagatg

SEQ ID NO: 234322 - DNA, 103 bp, Artificial Sequence
  Synthetic Polynucleotide
taatacgactcactatagggcggcgggcaggccgagcgcgccgggcggtgaacagaggagacaccgcatggcgcgctcgaacctggcggcagcgcaaaagatg

SEQ ID NO: 234323 - DNA, 103 bp, Artificial Sequence
  Synthetic Polynucleotide
taatacgactcactataggggggcaggcggcggcgggcaggccgagcgcgaacagaggagacgcgctatgcctgcccgcaacctggcggcagcgcaaaagatg

SEQ ID NO: 234324 - DNA, 103 bp, Artificial Sequence
  Synthetic Polynucleotide
taatacgactcactatagggggggcagtaggggcaggcggcggcgggcagaacagaggagactgcccatggccgcctgcaacctggcggcagcgcaaaagatg

SEQ ID NO: 234325 - DNA, 103 bp, Artificial Sequence
  Synthetic Polynucleotide
taatacgactcactatagggggccgttcggggggcagtaggggcaggcggaacagaggagaccgcctatgcctactgccaacctggcggcagcgcaaaagatg

SEQ ID NO: 234326 - DNA, 103 bp, Artificial Sequence
  Synthetic Polynucleotide
taatacgactcactatagggccgcgcaccgggccgttcggggggcagtagaacagaggagactactgatgcccgaacggaacctggcggcagcgcaaaagatg

SEQ ID NO: 234327 - DNA, 103 bp, Artificial Sequence
  Synthetic Polynucleotide
taatacgactcactatagggcagcaggtccccgcgcaccgggccgttcggaacagaggagaccgaacatgccggtgcgcaacctggcggcagcgcaaaagatg

SEQ ID NO: 234328 - DNA, 103 bp, Artificial Sequence
  Synthetic Polynucleotide
taatacgactcactataggggctccagctcgtctggcccgctccagggacaacagaggagagtccctatggcgggccagaacctggcggcagcgcaaaagatg

SEQ ID NO: 234329 - DNA, 103 bp, Artificial Sequence
  Synthetic Polynucleotide
taatacgactcactatagggggaaatgctccagcaggtccccgcgcaccgaacagaggagacggtgcatggggacctgcaacctggcggcagcgcaaaagatg

SEQ ID NO: 234330 - DNA, 103 bp, Artificial Sequence
  Synthetic Polynucleotide
taatacgactcactatagggtgcgccaggcggaaatgctccagcaggtccaacagaggagaggacctatgggagcatttaacctggcggcagcgcaaaagatg

SEQ ID NO: 234331 - DNA, 103 bp, Artificial Sequence
  Synthetic Polynucleotide
taatacgactcactatagggcagcaggccgtgcgccaggcggaaatgctcaacagaggagagagcatatgcgcctggcgaacctggcggcagcgcaaaagatg

SEQ ID NO: 234332 - DNA, 103 bp, Artificial Sequence
  Synthetic Polynucleotide
taatacgactcactataggggcgcgccgagcagcaggccgtgcgccaggcaacagaggagagcctggatgacggcctgcaacctggcggcagcgcaaaagatg

SEQ ID NO: 234333 - DNA, 103 bp, Artificial Sequence
  Synthetic Polynucleotide
taatacgactcactatagggccggccaggggcgcgccgagcagcaggccgaacagaggagacggcctatggctcggcgcaacctggcggcagcgcaaaagatg

SEQ ID NO: 234334 - DNA, 103 bp, Artificial Sequence
  Synthetic Polynucleotide
taatacgactcactataggggacccccgggccggccaggggcgcgccgagaacagaggagactcggcatgcccctggccaacctggcggcagcgcaaaagatg

SEQ ID NO: 234335 - DNA, 103 bp, Artificial Sequence
  Synthetic Polynucleotide
taatacgactcactatagggtccgggcctcgacccccgggccggccagggaacagaggagaccctggatggcccgggggaacctggcggcagcgcaaaagatg

SEQ ID NO: 234336 - DNA, 103 bp, Artificial Sequence
  Synthetic Polynucleotide
taatacgactcactatagggtcggccggcgtccgggcctcgacccccgggaacagaggagacccgggatgcgaggcccgaacctggcggcagcgcaaaagatg

SEQ ID NO: 234337 - DNA, 103 bp, Artificial Sequence
  Synthetic Polynucleotide
taatacgactcactatagggggggccgcggtcggccggcgtccgggcctcaacagaggagagaggccatgacgccggccaacctggcggcagcgcaaaagatg

SEQ ID NO: 234338 - DNA, 103 bp, Artificial Sequence
  Synthetic Polynucleotide
taatacgactcactataggggagcgggcgaggggccgcggtcggccggcgaacagaggagacgccggatgaccgcggccaacctggcggcagcgcaaaagatg

SEQ ID NO: 234339 - DNA, 103 bp, Artificial Sequence
  Synthetic Polynucleotide
taatacgactcactatagggtgcaccaccggctccagctcgtctggcccgaacagaggagacgggccatgcgagctggaaacctggcggcagcgcaaaagatg

SEQ ID NO: 234340 - DNA, 103 bp, Artificial Sequence
  Synthetic Polynucleotide
taatacgactcactataggggcgggggcgggagcgggcgaggggccgcggaacagaggagaccgcggatgctcgcccgcaacctggcggcagcgcaaaagatg

SEQ ID NO: 234341 - DNA, 103 bp, Artificial Sequence
  Synthetic Polynucleotide
taatacgactcactatagggcggggaggcggcgggggcgggagcgggcgaaacagaggagatcgcccatgcccgcccccaacctggcggcagcgcaaaagatg

SEQ ID NO: 234342 - DNA, 103 bp, Artificial Sequence
  Synthetic Polynucleotide
taatacgactcactatagggacccgggctgcggggaggcggcgggggcggaacagaggagaccgcccatgccgcctcccaacctggcggcagcgcaaaagatg

SEQ ID NO: 234343 - DNA, 103 bp, Artificial Sequence
  Synthetic Polynucleotide
taatacgactcactataggggggccacgggacccgggctgcggggaggcgaacagaggagacgcctcatggcagcccggaacctggcggcagcgcaaaagatg

SEQ ID NO: 234344 - DNA, 103 bp, Artificial Sequence
  Synthetic Polynucleotide
taatacgactcactataggggccgtcccgggggccacgggacccgggctgaacagaggagacagcccatgtcccgtggcaacctggcggcagcgcaaaagatg

SEQ ID NO: 234345 - DNA, 103 bp, Artificial Sequence
  Synthetic Polynucleotide
taatacgactcactatagggccgggccgaggccgtcccgggggccacgggaacagaggagacccgtgatgcccgggacgaacctggcggcagcgcaaaagatg

SEQ ID NO: 234346 - DNA, 103 bp, Artificial Sequence
  Synthetic Polynucleotide
taatacgactcactatagggtcctggggctccgggccgaggccgtcccggaacagaggagaccgggaatgcctcggcccaacctggcggcagcgcaaaagatg

SEQ ID NO: 234347 - DNA, 103 bp, Artificial Sequence
  Synthetic Polynucleotide
taatacgactcactataggggggcggcggctcctggggctccgggccgagaacagaggagactcggcatggagccccagaacctggcggcagcgcaaaagatg

SEQ ID NO: 234348 - DNA, 103 bp, Artificial Sequence
  Synthetic Polynucleotide
taatacgactcactatagggggggcgggccgggcggcggctcctggggctaacagaggagaagccccatgagccgccgcaacctggcggcagcgcaaaagatg

SEQ ID NO: 234349 - DNA, 103 bp, Artificial Sequence
  Synthetic Polynucleotide
taatacgactcactataggggccggggacgggggcgggccgggcggcggcaacagaggagagccgccatgcggcccgccaacctggcggcagcgcaaaagatg

SEQ ID NO: 234350 - DNA, 103 bp, Artificial Sequence
  Synthetic Polynucleotide
taatacgactcactatagggctgcccatcctgcaccaccggctccagctcaacagaggagagagctgatgccggtggtgaacctggcggcagcgcaaaagatg

SEQ ID NO: 234351 - DNA, 103 bp, Artificial Sequence
  Synthetic Polynucleotide
taatacgactcactataggggggcgcggcggccggggacgggggcgggccaacagaggagaggcccgatgccgtccccgaacctggcggcagcgcaaaagatg

SEQ ID NO: 234352 - DNA, 103 bp, Artificial Sequence
  Synthetic Polynucleotide
taatacgactcactataggggcacggcctcgggcgcggcggccggggacgaacagaggagacgtcccatgccgccgcgcaacctggcggcagcgcaaaagatg

SEQ ID NO: 234353 - DNA, 103 bp, Artificial Sequence
  Synthetic Polynucleotide
taatacgactcactatagggggcgggggcggcacggcctcgggcgcggcgaacagaggagacgccgcatgcgaggccgtaacctggcggcagcgcaaaagatg

SEQ ID NO: 234354 - DNA, 103 bp, Artificial Sequence
  Synthetic Polynucleotide
taatacgactcactatagggggggggcgccggcgggggcggcacggcctcaacagaggagagaggccatgccgcccccgaacctggcggcagcgcaaaagatg

SEQ ID NO: 234355 - DNA, 103 bp, Artificial Sequence
  Synthetic Polynucleotide
taatacgactcactatagggccgagtaggaggggggcgccggcgggggcgaacagaggagacgccccatgcggcgccccaacctggcggcagcgcaaaagatg

SEQ ID NO: 234356 - DNA, 103 bp, Artificial Sequence
  Synthetic Polynucleotide
taatacgactcactatagggacgcccttgtccgagtaggaggggggcgccaacagaggagaggcgccatgctcctactcaacctggcggcagcgcaaaagatg

SEQ ID NO: 234357 - DNA, 103 bp, Artificial Sequence
  Synthetic Polynucleotide
taatacgactcactataggggggagtctggacgcccttgtccgagtaggaaacagaggagatcctacatggacaagggcaacctggcggcagcgcaaaagatg

SEQ ID NO: 234358 - DNA, 103 bp, Artificial Sequence
  Synthetic Polynucleotide
taatacgactcactatagggtgcccttgctgggagtctggacgcccttgtaacagaggagaacaaggatgtccagactcaacctggcggcagcgcaaaagatg

SEQ ID NO: 234359 - DNA, 103 bp, Artificial Sequence
  Synthetic Polynucleotide
taatacgactcactatagggggcgccggcgtgcccttgctgggagtctggaacagaggagaccagacatgcagcaagggaacctggcggcagcgcaaaagatg

SEQ ID NO: 234360 - DNA, 103 bp, Artificial Sequence
  Synthetic Polynucleotide
taatacgactcactataggggttgggcagcggcgccggcgtgcccttgctaacagaggagaagcaagatgacgccggcgaacctggcggcagcgcaaaagatg

SEQ ID NO: 234361 - DNA, 103 bp, Artificial Sequence
  Synthetic Polynucleotide
taatacgactcactataggggtatgcgcctctgcccatcctgcaccaccgaacagaggagacggtggatgaggatgggcaacctggcggcagcgcaaaagatg

SEQ ID NO: 234362 - DNA, 103 bp, Artificial Sequence
  Synthetic Polynucleotide
taatacgactcactatagggggtggttgccgttgggcagcggcgccggcgaacagaggagacgccggatgcgctgcccaaacctggcggcagcgcaaaagatg

SEQ ID NO: 234363 - DNA, 103 bp, Artificial Sequence
  Synthetic Polynucleotide
taatacgactcactatagggcggcagtaccggtggttgccgttgggcagcaacagaggagagctgccatgcggcaaccaaacctggcggcagcgcaaaagatg

SEQ ID NO: 234364 - DNA, 103 bp, Artificial Sequence
  Synthetic Polynucleotide
taatacgactcactataggggttgcaaagacggcagtaccggtggttgccaacagaggagaggcaacatgcggtactgcaacctggcggcagcgcaaaagatg

SEQ ID NO: 234365 - DNA, 103 bp, Artificial Sequence
  Synthetic Polynucleotide
taatacgactcactatagggtgaacttgatgttgcaaagacggcagtaccaacagaggagaggtactatggtctttgcaaacctggcggcagcgcaaaagatg

SEQ ID NO: 234366 - DNA, 103 bp, Artificial Sequence
  Synthetic Polynucleotide
taatacgactcactataggggacaggctgctgaacttgatgttgcaaagaaacagaggagatctttgatgcatcaagttaacctggcggcagcgcaaaagatg

SEQ ID NO: 234367 - DNA, 103 bp, Artificial Sequence
  Synthetic Polynucleotide
taatacgactcactataggggatgaaggtggacaggctgctgaacttgataacagaggagaatcaagatgagcagcctgaacctggcggcagcgcaaaagatg

SEQ ID NO: 234368 - DNA, 103 bp, Artificial Sequence
  Synthetic Polynucleotide
taatacgactcactatagggtcttgtgggcgatgaaggtggacaggctgcaacagaggagagcagccatgccaccttcaaacctggcggcagcgcaaaagatg

SEQ ID NO: 234369 - DNA, 103 bp, Artificial Sequence
  Synthetic Polynucleotide
taatacgactcactatagggcagtaatacttcttgtgggcgatgaaggtgaacagaggagacaccttatgcgcccacaaaacctggcggcagcgcaaaagatg

SEQ ID NO: 234370 - DNA, 103 bp, Artificial Sequence
  Synthetic Polynucleotide
taatacgactcactataggggtgcgaggagcagtaatacttcttgtgggcaacagaggagagcccacatgaagtattacaacctggcggcagcgcaaaagatg

SEQ ID NO: 234371 - DNA, 103 bp, Artificial Sequence
  Synthetic Polynucleotide
taatacgactcactataggggctcggcggcgtgcgaggagcagtaatactaacagaggagaagtattatggctcctcgcaacctggcggcagcgcaaaagatg

SEQ ID NO: 234372 - DNA, 103 bp, Artificial Sequence
  Synthetic Polynucleotide
taatacgactcactatagggccgagggaacgcttgatctgccgggggttgaacagaggagacaacccatggcagatcaaaacctggcggcagcgcaaaagatg

SEQ ID NO: 234373 - DNA, 103 bp, Artificial Sequence
  Synthetic Polynucleotide
taatacgactcactatagggagtcgggcccgtatgcgcctctgcccatccaacagaggagaggatggatggaggcgcataacctggcggcagcgcaaaagatg

SEQ ID NO: 234374 - DNA, 103 bp, Artificial Sequence
  Synthetic Polynucleotide
taatacgactcactatagggcacttcacgtgctcggcggcgtgcgaggagaacagaggagactcctcatgcgccgccgaaacctggcggcagcgcaaaagatg

SEQ ID NO: 234375 - DNA, 103 bp, Artificial Sequence
  Synthetic Polynucleotide
taatacgactcactatagggggcgaggctgagtcgggcccgtatgcgcctaacagaggagaaggcgcatgcgggcccgaaacctggcggcagcgcaaaagatg

SEQ ID NO: 234376 - DNA, 103 bp, Artificial Sequence
  Synthetic Polynucleotide
taatacgactcactatagggacaggcccgtggcgaggctgagtcgggcccaacagaggagagggcccatgtcagcctcgaacctggcggcagcgcaaaagatg

SEQ ID NO: 234377 - DNA, 103 bp, Artificial Sequence
  Synthetic Polynucleotide
taatacgactcactataggggggccccaggacaggcccgtggcgaggctgaacagaggagacagcctatgcacgggcctaacctggcggcagcgcaaaagatg

SEQ ID NO: 234378 - DNA, 103 bp, Artificial Sequence
  Synthetic Polynucleotide
taatacgactcactatagggcccatggaacgggccccaggacaggcccgtaacagaggagaacgggcatgtcctggggcaacctggcggcagcgcaaaagatg

SEQ ID NO: 234379 - DNA, 103 bp, Artificial Sequence
  Synthetic Polynucleotide
taatacgactcactatagggtctggacactcccatggaacgggccccaggaacagaggagacctgggatgcgttccatgaacctggcggcagcgcaaaagatg

SEQ ID NO: 234380 - DNA, 103 bp, Artificial Sequence
  Synthetic Polynucleotide
taatacgactcactataggggaggctctggtctggacactcccatggaacaacagaggagagttccaatggagtgtccaaacctggcggcagcgcaaaagatg

SEQ ID NO: 234381 - DNA, 103 bp, Artificial Sequence
  Synthetic Polynucleotide
taatacgactcactatagggcctgggggatgaggctctggtctggacactaacagaggagaagtgtcatgaccagagccaacctggcggcagcgcaaaagatg

SEQ ID NO: 234382 - DNA, 103 bp, Artificial Sequence
  Synthetic Polynucleotide
taatacgactcactataggggctccgcctgcctgggggatgaggctctggaacagaggagaccagagatgcatcccccaaacctggcggcagcgcaaaagatg

SEQ ID NO: 234383 - DNA, 103 bp, Artificial Sequence
  Synthetic Polynucleotide
taatacgactcactataggggctgggctcggctccgcctgcctgggggataacagaggagaatccccatggcaggcggaaacctggcggcagcgcaaaagatg

SEQ ID NO: 234384 - DNA, 103 bp, Artificial Sequence
  Synthetic Polynucleotide
taatacgactcactatagggctccatgtctccgagggaacgcttgatctgaacagaggagacagatcatgcgttccctcaacctggcggcagcgcaaaagatg

SEQ ID NO: 234385 - DNA, 103 bp, Artificial Sequence
  Synthetic Polynucleotide
taatacgactcactatagggcagggtcagggctgggctcggctccgcctgaacagaggagacaggcgatgccgagcccaaacctggcggcagcgcaaaagatg

SEQ ID NO: 234386 - DNA, 103 bp, Artificial Sequence
  Synthetic Polynucleotide
taatacgactcactatagggccaccagcagcagggtcagggctgggctcgaacagaggagacgagccatgccctgacccaacctggcggcagcgcaaaagatg

SEQ ID NO: 234387 - DNA, 103 bp, Artificial Sequence
  Synthetic Polynucleotide
taatacgactcactatagggcaggcctcgtccaccagcagcagggtcaggaacagaggagacctgacatggctgctggtaacctggcggcagcgcaaaagatg

SEQ ID NO: 234388 - DNA, 103 bp, Artificial Sequence
  Synthetic Polynucleotide
taatacgactcactatagggcctcagccagcaggcctcgtccaccagcagaacagaggagactgctgatggacgaggccaacctggcggcagcgcaaaagatg

SEQ ID NO: 234389 - DNA, 103 bp, Artificial Sequence
  Synthetic Polynucleotide
taatacgactcactatagggggggcagcgtcctcagccagcaggcctcgtaacagaggagaacgaggatggctggctgaaacctggcggcagcgcaaaagatg

SEQ ID NO: 234390 - DNA, 103 bp, Artificial Sequence
  Synthetic Polynucleotide
taatacgactcactataggggtcagggcctggggcagcgtcctcagccagaacagaggagactggctatggacgctgccaacctggcggcagcgcaaaagatg

SEQ ID NO: 234391 - DNA, 103 bp, Artificial Sequence
  Synthetic Polynucleotide
taatacgactcactatagggctcggcctcagtcagggcctggggcagcgtaacagaggagaacgctgatgcaggccctgaacctggcggcagcgcaaaagatg

SEQ ID NO: 234392 - DNA, 103 bp, Artificial Sequence
  Synthetic Polynucleotide
taatacgactcactatagggctgtgttggcctcggcctcagtcagggcctaacagaggagaaggcccatgctgaggccgaacctggcggcagcgcaaaagatg

SEQ ID NO: 234393 - DNA, 103 bp, Artificial Sequence
  Synthetic Polynucleotide
taatacgactcactatagggctgtggatctctgtgttggcctcggcctcaaacagaggagatgaggcatgggccaacacaacctggcggcagcgcaaaagatg

SEQ ID NO: 234394 - DNA, 103 bp, Artificial Sequence
  Synthetic Polynucleotide
taatacgactcactataggggtcatccttcctgtggatctctgtgttggcaacagaggagagccaacatggagatccacaacctggcggcagcgcaaaagatg

SEQ ID NO: 234395 - DNA, 103 bp, Artificial Sequence
  Synthetic Polynucleotide
taatacgactcactatagggcctctctggcctccatgtctccgagggaacaacagaggagagttcccatggagacatggaacctggcggcagcgcaaaagatg

SEQ ID NO: 234396 - DNA, 103 bp, Artificial Sequence
  Synthetic Polynucleotide
taatacgactcactatagggaccagagtgcgtcatccttcctgtggatctaacagaggagaagatccatgggaaggatgaacctggcggcagcgcaaaagatg

SEQ ID NO: 234397 - DNA, 103 bp, Artificial Sequence
  Synthetic Polynucleotide
taatacgactcactataggggtgaccctgcaccagagtgcgtcatccttcaacagaggagagaaggaatgcgcactctgaacctggcggcagcgcaaaagatg

SEQ ID NO: 234398 - DNA, 103 bp, Artificial Sequence
  Synthetic Polynucleotide
taatacgactcactatagggcaccggcttggtgaccctgcaccagagtgcaacagaggagagcactcatgtgcagggtcaacctggcggcagcgcaaaagatg

SEQ ID NO: 234399 - DNA, 103 bp, Artificial Sequence
  Synthetic Polynucleotide
taatacgactcactatagggcccccgcaggcaccggcttggtgaccctgcaacagaggagagcagggatgccaagccggaacctggcggcagcgcaaaagatg

SEQ ID NO: 234400 - DNA, 103 bp, Artificial Sequence
  Synthetic Polynucleotide
taatacgactcactatagggctcaggagtccccccgcaggcaccggcttgaacagaggagacaagccatggcctgcgggaacctggcggcagcgcaaaagatg

SEQ ID NO: 234401 - DNA, 103 bp, Artificial Sequence
  Synthetic Polynucleotide
taatacgactcactataggggaggagcacgctcaggagtccccccgcaggaacagaggagacctgcgatgggactcctgaacctggcggcagcgcaaaagatg

SEQ ID NO: 234402 - DNA, 103 bp, Artificial Sequence
  Synthetic Polynucleotide
taatacgactcactataggggctcggccgtgaggagcacgctcaggagtcaacagaggagagactccatggcgtgctccaacctggcggcagcgcaaaagatg

SEQ ID NO: 234403 - DNA, 103 bp, Artificial Sequence
  Synthetic Polynucleotide
taatacgactcactataggggtgctgtggggctcggccgtgaggagcacgaacagaggagacgtgctatgcacggccgaaacctggcggcagcgcaaaagatg

SEQ ID NO: 234404 - DNA, 103 bp, Artificial Sequence
  Synthetic Polynucleotide
taatacgactcactataggggtggccgggggtgctgtggggctcggccgtaacagaggagaacggccatgccccacagcaacctggcggcagcgcaaaagatg

SEQ ID NO: 234405 - DNA, 103 bp, Artificial Sequence
  Synthetic Polynucleotide
taatacgactcactatagggtcttcacagggtggccgggggtgctgtgggaacagaggagacccacaatgcccccggccaacctggcggcagcgcaaaagatg

SEQ ID NO: 234406 - DNA, 103 bp, Artificial Sequence
  Synthetic Polynucleotide
taatacgactcactatagggaactgcacctcctctctggcctccatgtctaacagaggagaagacatatgggccagagaaacctggcggcagcgcaaaagatg

SEQ ID NO: 234407 - DNA, 103 bp, Artificial Sequence
  Synthetic Polynucleotide
taatacgactcactataggggctggctccttcttcacagggtggccggggaacagaggagaccccggatgccctgtgaaaacctggcggcagcgcaaaagatg

SEQ ID NO: 234408 - DNA, 103 bp, Artificial Sequence
  Synthetic Polynucleotide
taatacgactcactatagggcgtgggctctgctggctccttcttcacaggaacagaggagacctgtgatgaaggagccaaacctggcggcagcgcaaaagatg

SEQ ID NO: 234409 - DNA, 103 bp, Artificial Sequence
  Synthetic Polynucleotide
taatacgactcactataggggggccgggcacgtgggctctgctggctcctaacagaggagaaggagcatgcagagcccaaacctggcggcagcgcaaaagatg

SEQ ID NO: 234410 - DNA, 103 bp, Artificial Sequence
  Synthetic Polynucleotide
taatacgactcactatagggtcgtgtgcaggggccgggcacgtgggctctaacagaggagaagagccatggtgcccggcaacctggcggcagcgcaaaagatg

SEQ ID NO: 234411 - DNA, 103 bp, Artificial Sequence
  Synthetic Polynucleotide
taatacgactcactataggggagctggaggtcgtgtgcaggggccgggcaaacagaggagatgcccgatgcctgcacacaacctggcggcagcgcaaaagatg

SEQ ID NO: 234412 - DNA, 103 bp, Artificial Sequence
  Synthetic Polynucleotide
taatacgactcactataggggctggggcaggagctggaggtcgtgtgcagaacagaggagactgcacatgacctccagcaacctggcggcagcgcaaaagatg

SEQ ID NO: 234413 - DNA, 103 bp, Artificial Sequence
  Synthetic Polynucleotide
taatacgactcactatagggatcccggcctgctggggcaggagctggaggaacagaggagacctccaatgcctgccccaaacctggcggcagcgcaaaagatg

SEQ ID NO: 234414 - DNA, 103 bp, Artificial Sequence
  Synthetic Polynucleotide
taatacgactcactataggggatggaggccatcccggcctgctggggcagaacagaggagactgcccatgcaggccgggaacctggcggcagcgcaaaagatg

SEQ ID NO: 234415 - DNA, 103 bp, Artificial Sequence
  Synthetic Polynucleotide
taatacgactcactatagggcggtggcaaggatggaggccatcccggcctaacagaggagaaggccgatgtggcctccaaacctggcggcagcgcaaaagatg

SEQ ID NO: 234416 - DNA, 103 bp, Artificial Sequence
  Synthetic Polynucleotide
taatacgactcactatagggttgatcactgcggtggcaaggatggaggccaacagaggagaggcctcatgccttgccacaacctggcggcagcgcaaaagatg

SEQ ID NO: 234417 - DNA, 103 bp, Artificial Sequence
  Synthetic Polynucleotide
taatacgactcactatagggggcacccaccaactgcacctcctctctggcaacagaggagagccagaatggaggtgcagaacctggcggcagcgcaaaagatg

SEQ ID NO: 234418 - DNA, 103 bp, Artificial Sequence
  Synthetic Polynucleotide
taatacgactcactataggggacgtctttgttgatcactgcggtggcaagaacagaggagacttgccatggcagtgatcaacctggcggcagcgcaaaagatg

SEQ ID NO: 234419 - DNA, 103 bp, Artificial Sequence
  Synthetic Polynucleotide
taatacgactcactatagggtgcaggggaagacgtctttgttgatcactgaacagaggagacagtgaatgacaaagacgaacctggcggcagcgcaaaagatg

SEQ ID NO: 234420 - DNA, 103 bp, Artificial Sequence
  Synthetic Polynucleotide
taatacgactcactatagggccacagtccttgcaggggaagacgtctttgaacagaggagacaaagaatgcttcccctgaacctggcggcagcgcaaaagatg

SEQ ID NO: 234421 - DNA, 103 bp, Artificial Sequence
  Synthetic Polynucleotide
taatacgactcactataggggtaccagatgccacagtccttgcaggggaaaacagaggagattccccatgaaggactgtaacctggcggcagcgcaaaagatg

SEQ ID NO: 234422 - DNA, 103 bp, Artificial Sequence
  Synthetic Polynucleotide
taatacgactcactataggggctcgctgcggtaccagatgccacagtcctaacagaggagaaggactatggcatctggtaacctggcggcagcgcaaaagatg

SEQ ID NO: 234423 - DNA, 103 bp, Artificial Sequence
  Synthetic Polynucleotide
taatacgactcactatagggtgcaggttgcgctcgctgcggtaccagatgaacagaggagacatctgatgccgcagcgaaacctggcggcagcgcaaaagatg

SEQ ID NO: 234424 - DNA, 103 bp, Artificial Sequence
  Synthetic Polynucleotide
taatacgactcactatagggcaggtgcgcctgcaggttgcgctcgctgcgaacagaggagacgcagcatgcgcaacctgaacctggcggcagcgcaaaagatg

SEQ ID NO: 234425 - DNA, 103 bp, Artificial Sequence
  Synthetic Polynucleotide
taatacgactcactatagggagtagtagagcaggtgcgcctgcaggttgcaacagaggagagcaaccatgaggcgcaccaacctggcggcagcgcaaaagatg

SEQ ID NO: 234426 - DNA, 103 bp, Artificial Sequence
  Synthetic Polynucleotide
taatacgactcactatagggcggctggcgcagtagtagagcaggtgcgccaacagaggagaggcgcaatggctctactaaacctggcggcagcgcaaaagatg

SEQ ID NO: 234427 - DNA, 103 bp, Artificial Sequence
  Synthetic Polynucleotide
taatacgactcactatagggggtgccctggcggctggcgcagtagtagagaacagaggagactctacatgtgcgccagcaacctggcggcagcgcaaaagatg

SEQ ID NO: 234428 - DNA, 103 bp, Artificial Sequence
  Synthetic Polynucleotide
taatacgactcactatagggccatgtggctggcacccaccaactgcacctaacagaggagaaggtgcatgtggtgggtgaacctggcggcagcgcaaaagatg

SEQ ID NO: 234429 - DNA, 103 bp, Artificial Sequence
  Synthetic Polynucleotide
taatacgactcactatagggccggggagccggtgccctggcggctggcgcaacagaggagagcgccaatggccagggcaaacctggcggcagcgcaaaagatg

SEQ ID NO: 234430 - DNA, 103 bp, Artificial Sequence
  Synthetic Polynucleotide
taatacgactcactataggggcggctgcggccggggagccggtgccctggaacagaggagaccagggatgcggctccccaacctggcggcagcgcaaaagatg

SEQ ID NO: 234431 - DNA, 103 bp, Artificial Sequence
  Synthetic Polynucleotide
taatacgactcactatagggctcgtctgtggcggctgcggccggggagccaacagaggagaggctccatggccgcagccaacctggcggcagcgcaaaagatg

SEQ ID NO: 234432 - DNA, 103 bp, Artificial Sequence
  Synthetic Polynucleotide
taatacgactcactatagggctttgggcttctcgtctgtggcggctgcggaacagaggagaccgcagatgccacagacgaacctggcggcagcgcaaaagatg

SEQ ID NO: 234433 - DNA, 103 bp, Artificial Sequence
  Synthetic Polynucleotide
taatacgactcactataggggggtaggtctctttgggcttctcgtctgtgaacagaggagacacagaatggaagcccaaaacctggcggcagcgcaaaagatg

SEQ ID NO: 234434 - DNA, 103 bp, Artificial Sequence
  Synthetic Polynucleotide
taatacgactcactataggggcgctcgttggggtaggtctctttgggcttaacagaggagaaagcccatggagacctacaacctggcggcagcgcaaaagatg

SEQ ID NO: 234435 - DNA, 103 bp, Artificial Sequence
  Synthetic Polynucleotide
taatacgactcactatagggaggggcagacgcgctcgttggggtaggtctaacagaggagaagacctatgccaacgagcaacctggcggcagcgcaaaagatg

SEQ ID NO: 234436 - DNA, 103 bp, Artificial Sequence
  Synthetic Polynucleotide
taatacgactcactatagggcactgggggaaggggcagacgcgctcgttgaacagaggagacaacgaatgcgtctgcccaacctggcggcagcgcaaaagatg

SEQ ID NO: 234437 - DNA, 103 bp, Artificial Sequence
  Synthetic Polynucleotide
taatacgactcactataggggctcttgcggcactgggggaaggggcagacaacagaggagagtctgcatgttcccccagaacctggcggcagcgcaaaagatg

SEQ ID NO: 234438 - DNA, 103 bp, Artificial Sequence
  Synthetic Polynucleotide
taatacgactcactatagggcgctggggcagctcttgcggcactgggggaaacagaggagatcccccatggccgcaagaaacctggcggcagcgcaaaagatg

SEQ ID NO: 234439 - DNA, 103 bp, Artificial Sequence
  Synthetic Polynucleotide
taatacgactcactataggggccttttgctccatgtggctggcacccaccaacagaggagaggtgggatgcagccacataacctggcggcagcgcaaaagatg

SEQ ID NO: 234440 - DNA, 103 bp, Artificial Sequence
  Synthetic Polynucleotide
taatacgactcactatagggagggagctggcgctggggcagctcttgcggaacagaggagaccgcaaatgctgccccagaacctggcggcagcgcaaaagatg

SEQ ID NO: 234441 - DNA, 103 bp, Artificial Sequence
  Synthetic Polynucleotide
taatacgactcactataggggtggatctccagggagctggcgctggggcaaacagaggagatgccccatggccagctccaacctggcggcagcgcaaaagatg

SEQ ID NO: 234442 - DNA, 103 bp, Artificial Sequence
  Synthetic Polynucleotide
taatacgactcactatagggggctgcgcatgtggatctccagggagctggaacagaggagaccagctatgtggagatccaacctggcggcagcgcaaaagatg

SEQ ID NO: 234443 - DNA, 103 bp, Artificial Sequence
  Synthetic Polynucleotide
taatacgactcactatagggtctccgctgtggctgcgcatgtggatctccaacagaggagaggagatatgcatgcgcagaacctggcggcagcgcaaaagatg

SEQ ID NO: 234444 - DNA, 103 bp, Artificial Sequence
  Synthetic Polynucleotide
taatacgactcactataggggaagggccgctctccgctgtggctgcgcataacagaggagaatgcgcatgcacagcggaaacctggcggcagcgcaaaagatg

SEQ ID NO: 234445 - DNA, 103 bp, Artificial Sequence
  Synthetic Polynucleotide
taatacgactcactatagggtcaggcacacgaagggccgctctccgctgtaacagaggagaacagcgatgagcggccctaacctggcggcagcgcaaaagatg

SEQ ID NO: 234446 - DNA, 103 bp, Artificial Sequence
  Synthetic Polynucleotide
taatacgactcactataggggacaggcagatcaggcacacgaagggccgcaacagaggagagcggccatgcgtgtgcctaacctggcggcagcgcaaaagatg

SEQ ID NO: 234447 - DNA, 103 bp, Artificial Sequence
  Synthetic Polynucleotide
taatacgactcactatagggggtgaaggccgacaggcagatcaggcacacaacagaggagagtgtgcatgatctgcctgaacctggcggcagcgcaaaagatg

SEQ ID NO: 234448 - DNA, 103 bp, Artificial Sequence
  Synthetic Polynucleotide
taatacgactcactatagggtggccttggtggtgaaggccgacaggcagaaacagaggagatctgccatgcggccttcaaacctggcggcagcgcaaaagatg

SEQ ID NO: 234449 - DNA, 103 bp, Artificial Sequence
  Synthetic Polynucleotide
taatacgactcactatagggcgctcgcagttggccttggtggtgaaggccaacagaggagaggccttatgcaccaaggcaacctggcggcagcgcaaaagatg

SEQ ID NO: 234450 - DNA, 103 bp, Artificial Sequence
  Synthetic Polynucleotide
taatacgactcactatagggcaaggccgactccaggctctcctcgtccataacagaggagaatggacatggagagcctgaacctggcggcagcgcaaaagatg

SEQ ID NO: 234451 - DNA, 103 bp, Artificial Sequence
  Synthetic Polynucleotide
taatacgactcactatagggctgcagctggcgcaggtcagcctgctcagaaacagaggagatctgagatggctgacctgaacctggcggcagcgcaaaagatg

SEQ ID NO: 234452 - DNA, 103 bp, Artificial Sequence
  Synthetic Polynucleotide
taatacgactcactataggggagtctggagcctatacctcgcgtgtgcacaacagaggagagtgcacatgcgaggtataaacctggcggcagcgcaaaagatg

SEQ ID NO: 234453 - DNA, 103 bp, Artificial Sequence
  Synthetic Polynucleotide
taatacgactcactatagggtcttggtgaggagtctggagcctatacctcaacagaggagagaggtaatggctccagacaacctggcggcagcgcaaaagatg

SEQ ID NO: 234454 - DNA, 103 bp, Artificial Sequence
  Synthetic Polynucleotide
taatacgactcactatagggtcatagcccatcttggtgaggagtctggagaacagaggagactccagatgcctcaccaaaacctggcggcagcgcaaaagatg

SEQ ID NO: 234455 - DNA, 103 bp, Artificial Sequence
  Synthetic Polynucleotide
taatacgactcactatagggcttgccaaactcatagcccatcttggtgagaacagaggagactcaccatgatgggctataacctggcggcagcgcaaaagatg

SEQ ID NO: 234456 - DNA, 103 bp, Artificial Sequence
  Synthetic Polynucleotide
taatacgactcactatagggggcccaaacccttgccaaactcatagcccaaacagaggagatgggctatgagtttggcaaacctggcggcagcgcaaaagatg

SEQ ID NO: 234457 - DNA, 103 bp, Artificial Sequence
  Synthetic Polynucleotide
taatacgactcactatagggtccgcgtgtcggcccaaacccttgccaaacaacagaggagagtttggatggggtttgggaacctggcggcagcgcaaaagatg

SEQ ID NO: 234458 - DNA, 103 bp, Artificial Sequence
  Synthetic Polynucleotide
taatacgactcactatagggcacccggccttccgcgtgtcggcccaaaccaacagaggagaggtttgatgcgacacgcgaacctggcggcagcgcaaaagatg

SEQ ID NO: 234459 - DNA, 103 bp, Artificial Sequence
  Synthetic Polynucleotide
taatacgactcactatagggggatgggctccacccggccttccgcgtgtcaacagaggagagacacgatgaaggccgggaacctggcggcagcgcaaaagatg

SEQ ID NO: 234460 - DNA, 103 bp, Artificial Sequence
  Synthetic Polynucleotide
taatacgactcactatagggaccacagcatggatgggctccacccggcctaacagaggagaaggccgatgggagcccataacctggcggcagcgcaaaagatg

SEQ ID NO: 234461 - DNA, 103 bp, Artificial Sequence
  Synthetic Polynucleotide
taatacgactcactatagggtcgaggcaacaccacagcatggatgggctcaacagaggagagagcccatgcatgctgtgaacctggcggcagcgcaaaagatg

SEQ ID NO: 234462 - DNA, 103 bp, Artificial Sequence
  Synthetic Polynucleotide
taatacgactcactatagggtcaggtccccctgcagctggcgcaggtcagaacagaggagactgaccatggccagctgcaacctggcggcagcgcaaaagatg

SEQ ID NO: 234463 - DNA, 103 bp, Artificial Sequence
  Synthetic Polynucleotide
taatacgactcactataggggcgacttccctcgaggcaacaccacagcataacagaggagaatgctgatgtgttgcctcaacctggcggcagcgcaaaagatg

SEQ ID NO: 234464 - DNA, 103 bp, Artificial Sequence
  Synthetic Polynucleotide
taatacgactcactatagggcactggtccagcgacttccctcgaggcaacaacagaggagagttgccatgagggaagtcaacctggcggcagcgcaaaagatg

SEQ ID NO: 234465 - DNA, 103 bp, Artificial Sequence
  Synthetic Polynucleotide
taatacgactcactatagggggtctccacacactggtccagcgacttcccaacagaggagagggaagatgctggaccagaacctggcggcagcgcaaaagatg

SEQ ID NO: 234466 - DNA, 103 bp, Artificial Sequence
  Synthetic Polynucleotide
taatacgactcactataggggcttctgcagggtctccacacactggtccaaacagaggagatggaccatggtgtggagaaacctggcggcagcgcaaaagatg

SEQ ID NO: 234467 - DNA, 103 bp, Artificial Sequence
  Synthetic Polynucleotide
taatacgactcactatagggaccctggtctgcttctgcagggtctccacaaacagaggagatgtggaatgcctgcagaaaacctggcggcagcgcaaaagatg

SEQ ID NO: 234468 - DNA, 103 bp, Artificial Sequence
  Synthetic Polynucleotide
taatacgactcactatagggagccttgccaaccctggtctgcttctgcagaacagaggagactgcagatgcagaccaggaacctggcggcagcgcaaaagatg

SEQ ID NO: 234469 - DNA, 103 bp, Artificial Sequence
  Synthetic Polynucleotide
taatacgactcactatagggtgttggtgccagccttgccaaccctggtctaacagaggagaagaccaatgttggcaaggaacctggcggcagcgcaaaagatg

SEQ ID NO: 234470 - DNA, 103 bp, Artificial Sequence
  Synthetic Polynucleotide
taatacgactcactatagggctggggggcttgttggtgccagccttgccaaacagaggagatggcaaatgtggcaccaaaacctggcggcagcgcaaaagatg

SEQ ID NO: 234471 - DNA, 103 bp, Artificial Sequence
  Synthetic Polynucleotide
taatacgactcactatagggtccccggcacctggggggcttgttggtgccaacagaggagaggcaccatgaagccccccaacctggcggcagcgcaaaagatg

SEQ ID NO: 234472 - DNA, 103 bp, Artificial Sequence
  Synthetic Polynucleotide
taatacgactcactatagggtggcccctcttccccggcacctggggggctaacagaggagaagccccatgggtgccgggaacctggcggcagcgcaaaagatg

SEQ ID NO: 234473 - DNA, 103 bp, Artificial Sequence
  Synthetic Polynucleotide
taatacgactcactatagggatgagctccttcaggtccccctgcagctggaacagaggagaccagctatggggggacctaacctggcggcagcgcaaaagatg

SEQ ID NO: 234474 - DNA, 103 bp, Artificial Sequence
  Synthetic Polynucleotide
taatacgactcactatagggcccccaggcctggcccctcttccccggcacaacagaggagagtgccgatgaagaggggcaacctggcggcagcgcaaaagatg

SEQ ID NO: 234475 - DNA, 103 bp, Artificial Sequence
  Synthetic Polynucleotide
taatacgactcactatagggagctgggcggcccccaggcctggcccctctaacagaggagaagagggatgaggcctgggaacctggcggcagcgcaaaagatg

SEQ ID NO: 234476 - DNA, 103 bp, Artificial Sequence
  Synthetic Polynucleotide
taatacgactcactatagggcattccgaggagctgggcggcccccaggccaacagaggagaggcctgatggccgcccagaacctggcggcagcgcaaaagatg

SEQ ID NO: 234477 - DNA, 103 bp, Artificial Sequence
  Synthetic Polynucleotide
taatacgactcactatagggaagtcaaacacattccgaggagctgggcggaacagaggagaccgcccatgtcctcggaaaacctggcggcagcgcaaaagatg

SEQ ID NO: 234478 - DNA, 103 bp, Artificial Sequence
  Synthetic Polynucleotide
taatacgactcactatagggttcattgaggaagtcaaacacattccgaggaacagaggagacctcggatggtgtttgacaacctggcggcagcgcaaaagatg

SEQ ID NO: 234479 - DNA, 103 bp, Artificial Sequence
  Synthetic Polynucleotide
taatacgactcactatagggcttgcagcttttcattgaggaagtcaaacaaacagaggagatgtttgatgtcctcaatgaacctggcggcagcgcaaaagatg

SEQ ID NO: 234480 - DNA, 103 bp, Artificial Sequence
  Synthetic Polynucleotide
taatacgactcactatagggggagcctgaccttgcagcttttcattgaggaacagaggagacctcaaatgaaagctgcaaacctggcggcagcgcaaaagatg

SEQ ID NO: 234481 - DNA, 103 bp, Artificial Sequence
  Synthetic Polynucleotide
taatacgactcactatagggtagggccccaggagcctgaccttgcagcttaacagaggagaaagctgatgggtcaggctaacctggcggcagcgcaaaagatg

SEQ ID NO: 234482 - DNA, 103 bp, Artificial Sequence
  Synthetic Polynucleotide
taatacgactcactatagggccccggcttctagggccccaggagcctgacaacagaggagagtcaggatgctggggcccaacctggcggcagcgcaaaagatg

SEQ ID NO: 234483 - DNA, 103 bp, Artificial Sequence
  Synthetic Polynucleotide
taatacgactcactataggggctggggccgccccggcttctagggccccaaacagaggagatggggcatgagaagccggaacctggcggcagcgcaaaagatg

SEQ ID NO: 234484 - DNA, 103 bp, Artificial Sequence
  Synthetic Polynucleotide
taatacgactcactatagggggtgagctcgatgagctccttcaggtccccaacagaggagaggggacatgaaggagctcaacctggcggcagcgcaaaagatg

SEQ ID NO: 234485 - DNA, 103 bp, Artificial Sequence
  Synthetic Polynucleotide
taatacgactcactatagggcctcctccccgctggggccgccccggcttcaacagaggagagaagccatggcggccccaaacctggcggcagcgcaaaagatg

SEQ ID NO: 234486 - DNA, 103 bp, Artificial Sequence
  Synthetic Polynucleotide
taatacgactcactatagggtgtccttgctcctcctccccgctggggccgaacagaggagacggcccatgcggggaggaaacctggcggcagcgcaaaagatg

SEQ ID NO: 234487 - DNA, 103 bp, Artificial Sequence
  Synthetic Polynucleotide
taatacgactcactataggggcatggtacatgtccttgctcctcctccccaacagaggagaggggagatggagcaaggaaacctggcggcagcgcaaaagatg

SEQ ID NO: 234488 - DNA, 103 bp, Artificial Sequence
  Synthetic Polynucleotide
taatacgactcactatagggactcttgctggcatggtacatgtccttgctaacagaggagaagcaagatgatgtaccataacctggcggcagcgcaaaagatg

SEQ ID NO: 234489 - DNA, 103 bp, Artificial Sequence
  Synthetic Polynucleotide
taatacgactcactatagggcccgcttggcactcttgctggcatggtacaaacagaggagatgtaccatgccagcaagaaacctggcggcagcgcaaaagatg

SEQ ID NO: 234490 - DNA, 103 bp, Artificial Sequence
  Synthetic Polynucleotide
taatacgactcactatagggaggctcagggcccgcttggcactcttgctgaacagaggagacagcaaatgtgccaagcgaacctggcggcagcgcaaaagatg

SEQ ID NO: 234491 - DNA, 103 bp, Artificial Sequence
  Synthetic Polynucleotide
taatacgactcactataggggaagagccgcaggctcagggcccgcttggcaacagaggagagccaagatggccctgagcaacctggcggcagcgcaaaagatg

SEQ ID NO: 234492 - DNA, 103 bp, Artificial Sequence
  Synthetic Polynucleotide
taatacgactcactatagggcctcagtctggaagagccgcaggctcagggaacagaggagaccctgaatgtgcggctctaacctggcggcagcgcaaaagatg

SEQ ID NO: 234493 - DNA, 103 bp, Artificial Sequence
  Synthetic Polynucleotide
taatacgactcactatagggtcgatcttctcctcagtctggaagagccgcaacagaggagagcggctatgccagactgaaacctggcggcagcgcaaaagatg

SEQ ID NO: 234494 - DNA, 103 bp, Artificial Sequence
  Synthetic Polynucleotide
taatacgactcactatagggctgggttcgctcgatcttctcctcagtctgaacagaggagacagactatggagaagatcaacctggcggcagcgcaaaagatg

SEQ ID NO: 234495 - DNA, 103 bp, Artificial Sequence
  Synthetic Polynucleotide
taatacgactcactatagggggctggcctcggtgagctcgatgagctcctaacagaggagaaggagcatgtcgagctcaaacctggcggcagcgcaaaagatg

SEQ ID NO: 234496 - DNA, 103 bp, Artificial Sequence
  Synthetic Polynucleotide
taatacgactcactatagggtgatgtcccgctgggttcgctcgatcttctaacagaggagaagaagaatgagcgaacccaacctggcggcagcgcaaaagatg

SEQ ID NO: 234497 - DNA, 103 bp, Artificial Sequence
  Synthetic Polynucleotide
taatacgactcactatagggtggatgctcctgatgtcccgctgggttcgcaacagaggagagcgaacatggcgggacataacctggcggcagcgcaaaagatg

SEQ ID NO: 234498 - DNA, 103 bp, Artificial Sequence
  Synthetic Polynucleotide
taatacgactcactataggggagagcctcctggatgctcctgatgtcccgaacagaggagacgggacatgaggagcatcaacctggcggcagcgcaaaagatg

SEQ ID NO: 234499 - DNA, 103 bp, Artificial Sequence
  Synthetic Polynucleotide
taatacgactcactatagggcgttgcgggcgagagcctcctggatgctccaacagaggagaggagcaatgaggaggctcaacctggcggcagcgcaaaagatg

SEQ ID NO: 234500 - DNA, 103 bp, Artificial Sequence
  Synthetic Polynucleotide
taatacgactcactatagggtgccggccagcgttgcgggcgagagcctccaacagaggagaggaggcatgcgcccgcaaaacctggcggcagcgcaaaagatg

SEQ ID NO: 234501 - DNA, 103 bp, Artificial Sequence
  Synthetic Polynucleotide
taatacgactcactatagggcgccacgctatgccggccagcgttgcgggcaacagaggagagcccgcatggctggccggaacctggcggcagcgcaaaagatg

SEQ ID NO: 234502 - DNA, 103 bp, Artificial Sequence
  Synthetic Polynucleotide
taatacgactcactataggggctgggctgacgccacgctatgccggccagaacagaggagactggccatgatagcgtggaacctggcggcagcgcaaaagatg

SEQ ID NO: 234503 - DNA, 103 bp, Artificial Sequence
  Synthetic Polynucleotide
taatacgactcactatagggttctcctgcagctgggctgacgccacgctaaacagaggagatagcgtatggtcagcccaaacctggcggcagcgcaaaagatg

SEQ ID NO: 234504 - DNA, 103 bp, Artificial Sequence
  Synthetic Polynucleotide
taatacgactcactatagggtcctgccagcttctcctgcagctgggctgaaacagaggagatcagccatgctgcaggagaacctggcggcagcgcaaaagatg

SEQ ID NO: 234505 - DNA, 103 bp, Artificial Sequence
  Synthetic Polynucleotide
taatacgactcactatagggggcgctgggctcctgccagcttctcctgcaaacagaggagatgcaggatgagctggcagaacctggcggcagcgcaaaagatg

SEQ ID NO: 234506 - DNA, 103 bp, Artificial Sequence
  Synthetic Polynucleotide
taatacgactcactatagggacagacaccaggctggcctcggtgagctcgaacagaggagacgagctatgcgaggccagaacctggcggcagcgcaaaagatg

SEQ ID NO: 234507 - DNA, 103 bp, Artificial Sequence
  Synthetic Polynucleotide
taatacgactcactatagggtgccccagctggcgctgggctcctgccagcaacagaggagagctggcatgagcccagcgaacctggcggcagcgcaaaagatg

SEQ ID NO: 234508 - DNA, 103 bp, Artificial Sequence
  Synthetic Polynucleotide
taatacgactcactatagggagcccggagctgccccagctggcgctgggcaacagaggagagcccagatgcagctggggaacctggcggcagcgcaaaagatg

SEQ ID NO: 234509 - DNA, 103 bp, Artificial Sequence
  Synthetic Polynucleotide
taatacgactcactatagggcggcttcctgagcccggagctgccccagctaacagaggagaagctggatgagctccgggaacctggcggcagcgcaaaagatg

SEQ ID NO: 234510 - DNA, 103 bp, Artificial Sequence
  Synthetic Polynucleotide
taatacgactcactatagggtgctgcaggccggcttcctgagcccggagcaacagaggagagctccgatgtcaggaagcaacctggcggcagcgcaaaagatg

SEQ ID NO: 234511 - DNA, 103 bp, Artificial Sequence
  Synthetic Polynucleotide
taatacgactcactatagggcctctgctcctgctgcaggccggcttcctgaacagaggagacaggaaatgggcctgcagaacctggcggcagcgcaaaagatg

SEQ ID NO: 234512 - DNA, 103 bp, Artificial Sequence
  Synthetic Polynucleotide
taatacgactcactatagggtgtctgccttcctctgctcctgctgcaggcaacagaggagagcctgcatgaggagcagaaacctggcggcagcgcaaaagatg

SEQ ID NO: 234513 - DNA, 103 bp, Artificial Sequence
  Synthetic Polynucleotide
taatacgactcactatagggttcttgtgggtgtctgccttcctctgctccaacagaggagaggagcaatggaaggcagaaacctggcggcagcgcaaaagatg

SEQ ID NO: 234514 - DNA, 103 bp, Artificial Sequence
  Synthetic Polynucleotide
taatacgactcactatagggctcagtcatcttcttgtgggtgtctgccttaacagaggagaaaggcaatgacccacaagaacctggcggcagcgcaaaagatg

SEQ ID NO: 234515 - DNA, 103 bp, Artificial Sequence
  Synthetic Polynucleotide
taatacgactcactataggggctcttcctgacagacaccaggctggcctcaacagaggagagaggccatgctggtgtctaacctggcggcagcgcaaaagatg

SEQ ID NO: 234516 - DNA, 103 bp, Artificial Sequence
  Synthetic Polynucleotide
taatacgactcactatagggccaacaagctgctcttcctgacagacaccaaacagaggagatggtgtatgtcaggaagaaacctggcggcagcgcaaaagatg

SEQ ID NO: 234517 - DNA, 103 bp, Artificial Sequence
  Synthetic Polynucleotide
taatacgactcactatagggtccagcgcggccaacaagctgctcttcctgaacagaggagacaggaaatgcagcttgttaacctggcggcagcgcaaaagatg

SEQ ID NO: 234518 - DNA, 103 bp, Artificial Sequence
  Synthetic Polynucleotide
taatacgactcactataggggcgctcttcgtccagcgcggccaacaagctaacagaggagaagcttgatggccgcgctgaacctggcggcagcgcaaaagatg

SEQ ID NO: 234519 - DNA, 103 bp, Artificial Sequence
  Synthetic Polynucleotide
taatacgactcactatagggggtaggtctgcaaggccgactccaggctctaacagaggagaagagccatgagtcggcctaacctggcggcagcgcaaaagatg

SEQ ID NO: 234520 - DNA, 103 bp, Artificial Sequence
  Synthetic Polynucleotide
taatacgactcactatagggggcggcccgggcgctcttcgtccagcgcggaacagaggagaccgcgcatgacgaagagcaacctggcggcagcgcaaaagatg

SEQ ID NO: 234521 - DNA, 103 bp, Artificial Sequence
  Synthetic Polynucleotide
taatacgactcactataggggcatcttcctggcggcccgggcgctcttcgaacagaggagacgaagaatgcccgggccgaacctggcggcagcgcaaaagatg

SEQ ID NO: 234522 - DNA, 103 bp, Artificial Sequence
  Synthetic Polynucleotide
taatacgactcactatagggctggtactcagcatcttcctggcggcccggaacagaggagaccgggcatgcaggaagataacctggcggcagcgcaaaagatg

SEQ ID NO: 234523 - DNA, 103 bp, Artificial Sequence
  Synthetic Polynucleotide
taatacgactcactatagggcccggaaagcctggtactcagcatcttcctaacagaggagaaggaagatgctgagtaccaacctggcggcagcgcaaaagatg

SEQ ID NO: 234524 - DNA, 103 bp, Artificial Sequence
  Synthetic Polynucleotide
taatacgactcactataggggtgatggcctcccggaaagcctggtactcaaacagaggagatgagtaatgggctttccgaacctggcggcagcgcaaaagatg

SEQ ID NO: 234525 - DNA, 103 bp, Artificial Sequence
  Synthetic Polynucleotide
taatacgactcactatagggcaccgcctcagtgatggcctcccggaaagcaacagaggagagctttcatggaggccatcaacctggcggcagcgcaaaagatg

SEQ ID NO: 234526 - DNA, 103 bp, Artificial Sequence
  Synthetic Polynucleotide
taatacgactcactatagggctggtgcctccaccgcctcagtgatggcctaacagaggagaaggccaatgctgaggcggaacctggcggcagcgcaaaagatg

SEQ ID NO: 234527 - DNA, 103 bp, Artificial Sequence
  Synthetic Polynucleotide
taatacgactcactatagggcgggccgctgctggtgcctccaccgcctcaaacagaggagatgaggcatgggaggcaccaacctggcggcagcgcaaaagatg

SEQ ID NO: 234528 - DNA, 103 bp, Artificial Sequence
  Synthetic Polynucleotide
taatacgactcactatagggtccggacccacgggccgctgctggtgcctcaacagaggagagaggcaatggcagcggccaacctggcggcagcgcaaaagatg

SEQ ID NO: 234529 - DNA, 103 bp, Artificial Sequence
  Synthetic Polynucleotide
taatacgactcactatagggcggtctctgatccggacccacgggccgctgaacagaggagacagcggatggtgggtccgaacctggcggcagcgcaaaagatg

SEQ ID NO: 234530 - DNA, 103 bp, Artificial Sequence
  Synthetic Polynucleotide
taatacgactcactatagggagctgcgcacggtaggtctgcaaggccgacaacagaggagagtcggcatggcagacctaaacctggcggcagcgcaaaagatg

SEQ ID NO: 234531 - DNA, 103 bp, Artificial Sequence
  Synthetic Polynucleotide
taatacgactcactataggggctttaggaacggtctctgatccggacccaaacagaggagatgggtcatgatcagagacaacctggcggcagcgcaaaagatg

SEQ ID NO: 234532 - DNA, 103 bp, Artificial Sequence
  Synthetic Polynucleotide
taatacgactcactatagggccccgcctctgctttaggaacggtctctgaaacagaggagatcagagatggttcctaaaaacctggcggcagcgcaaaagatg

SEQ ID NO: 234533 - DNA, 103 bp, Artificial Sequence
  Synthetic Polynucleotide
taatacgactcactatagggcagattctggccccgcctctgctttaggaaaacagaggagattcctaatgcagaggcggaacctggcggcagcgcaaaagatg

SEQ ID NO: 234534 - DNA, 103 bp, Artificial Sequence
  Synthetic Polynucleotide
taatacgactcactatagggccacctgccgcagattctggccccgcctctaacagaggagaagaggcatggccagaatcaacctggcggcagcgcaaaagatg

SEQ ID NO: 234535 - DNA, 103 bp, Artificial Sequence
  Synthetic Polynucleotide
taatacgactcactatagggctcctcctgcccacctgccgcagattctggaacagaggagaccagaaatggcggcaggtaacctggcggcagcgcaaaagatg

SEQ ID NO: 234536 - DNA, 103 bp, Artificial Sequence
  Synthetic Polynucleotide
taatacgactcactatagggctccctcttcctcctcctgcccacctgccgaacagaggagacggcagatgggcaggaggaacctggcggcagcgcaaaagatg

SEQ ID NO: 234537 - DNA, 103 bp, Artificial Sequence
  Synthetic Polynucleotide
taatacgactcactatagggtcctcgtcctctccctcttcctcctcctgcaacagaggagagcaggaatgggaagagggaacctggcggcagcgcaaaagatg

SEQ ID NO: 234538 - DNA, 103 bp, Artificial Sequence
  Synthetic Polynucleotide
taatacgactcactatagggactcagctcttcctcgtcctctccctcttcaacagaggagagaagagatggaggacgagaacctggcggcagcgcaaaagatg

SEQ ID NO: 234539 - DNA, 103 bp, Artificial Sequence
  Synthetic Polynucleotide
taatacgactcactatagggcctttgtcccactcagctcttcctcgtcctaacagaggagaaggacgatgaagagctgaaacctggcggcagcgcaaaagatg

SEQ ID NO: 234540 - DNA, 103 bp, Artificial Sequence
  Synthetic Polynucleotide
taatacgactcactatagggggcgcgctcacctttgtcccactcagctctaacagaggagaagagctatgtgggacaaaaacctggcggcagcgcaaaagatg

SEQ ID NO: 234541 - DNA, 103 bp, Artificial Sequence
  Synthetic Polynucleotide
taatacgactcactatagggcacctgctgcagctgcgcacggtaggtctgaacagaggagacagaccatgcgtgcgcagaacctggcggcagcgcaaaagatg

SEQ ID NO: 234542 - DNA, 103 bp, Artificial Sequence
  Synthetic Polynucleotide
taatacgactcactataggggctgtagtagggcgcgctcacctttgtcccaacagaggagagggacaatggtgagcgcgaacctggcggcagcgcaaaagatg

SEQ ID NO: 234543 - DNA, 103 bp, Artificial Sequence
  Synthetic Polynucleotide
taatacgactcactatagggtgccccaggagctgtagtagggcgcgctcaaacagaggagatgagcgatgcctactacaaacctggcggcagcgcaaaagatg

SEQ ID NO: 234544 - DNA, 103 bp, Artificial Sequence
  Synthetic Polynucleotide
taatacgactcactatagggtactccagagtgccccaggagctgtagtagaacagaggagactactaatgctcctggggaacctggcggcagcgcaaaagatg

SEQ ID NO: 234545 - DNA, 103 bp, Artificial Sequence
  Synthetic Polynucleotide
taatacgactcactatagggggcgttgtgatactccagagtgccccaggaaacagaggagatcctggatgactctggagaacctggcggcagcgcaaaagatg

SEQ ID NO: 234546 - DNA, 103 bp, Artificial Sequence
  Synthetic Polynucleotide
taatacgactcactatagggccaccaccatggcgttgtgatactccagagaacagaggagactctggatgatcacaacgaacctggcggcagcgcaaaagatg

SEQ ID NO: 234547 - DNA, 103 bp, Artificial Sequence
  Synthetic Polynucleotide
taatacgactcactatagggtcttccgttcccaccaccatggcgttgtgaaacagaggagatcacaaatgcatggtggtaacctggcggcagcgcaaaagatg

SEQ ID NO: 234548 - DNA, 103 bp, Artificial Sequence
  Synthetic Polynucleotide
taatacgactcactatagggatcctccgcctcttccgttcccaccaccataacagaggagaatggtgatgggaacggaaaacctggcggcagcgcaaaagatg

SEQ ID NO: 234549 - DNA, 103 bp, Artificial Sequence
  Synthetic Polynucleotide
taatacgactcactatagggccgccgagccatcctccgcctcttccgttcaacagaggagagaacggatgaggcggaggaacctggcggcagcgcaaaagatg

SEQ ID NO: 234550 - DNA, 103 bp, Artificial Sequence
  Synthetic Polynucleotide
taatacgactcactatagggacacggacacccgccgagccatcctccgccaacagaggagaggcggaatgtggctcggcaacctggcggcagcgcaaaagatg

SEQ ID NO: 234551 - DNA, 103 bp, Artificial Sequence
  Synthetic Polynucleotide
taatacgactcactatagggcaggtaaagcacacggacacccgccgagccaacagaggagaggctcgatgggtgtccgtaacctggcggcagcgcaaaagatg

SEQ ID NO: 234552 - DNA, 103 bp, Artificial Sequence
  Synthetic Polynucleotide
taatacgactcactatagggaggccagctccacctgctgcagctgcgcacaacagaggagagtgcgcatgtgcagcaggaacctggcggcagcgcaaaagatg

SEQ ID NO: 234553 - DNA, 103 bp, Artificial Sequence
  Synthetic Polynucleotide
taatacgactcactataggggagtggggtacaggtaaagcacacggacacaacagaggagagtgtccatgtgctttaccaacctggcggcagcgcaaaagatg

SEQ ID NO: 234554 - DNA, 103 bp, Artificial Sequence
  Synthetic Polynucleotide
taatacgactcactatagggagagacttgtgagtggggtacaggtaaagcaacagaggagagctttaatggtaccccacaacctggcggcagcgcaaaagatg

SEQ ID NO: 234555 - DNA, 103 bp, Artificial Sequence
  Synthetic Polynucleotide
taatacgactcactataggggcacggcttcagagacttgtgagtggggtaaacagaggagataccccatgcacaagtctaacctggcggcagcgcaaaagatg

SEQ ID NO: 234556 - DNA, 103 bp, Artificial Sequence
  Synthetic Polynucleotide
taatacgactcactatagggggaagaacgggcacggcttcagagacttgtaacagaggagaacaagtatgtgaagccgtaacctggcggcagcgcaaaagatg

SEQ ID NO: 234557 - DNA, 103 bp, Artificial Sequence
  Synthetic Polynucleotide
taatacgactcactatagggtttccctccaggaagaacgggcacggcttcaacagaggagagaagccatgcccgttcttaacctggcggcagcgcaaaagatg

SEQ ID NO: 234558 - DNA, 103 bp, Artificial Sequence
  Synthetic Polynucleotide
taatacgactcactatagggaaagcggcactttccctccaggaagaacggaacagaggagaccgttcatgctggagggaaacctggcggcagcgcaaaagatg

SEQ ID NO: 234559 - DNA, 103 bp, Artificial Sequence
  Synthetic Polynucleotide
taatacgactcactatagggagttctccttaaagcggcactttccctccaaacagaggagatggaggatgagtgccgctaacctggcggcagcgcaaaagatg

SEQ ID NO: 234560 - DNA, 103 bp, Artificial Sequence
  Synthetic Polynucleotide
taatacgactcactataggggagaacctgcagttctccttaaagcggcacaacagaggagagtgccgatgtaaggagaaaacctggcggcagcgcaaaagatg

SEQ ID NO: 234561 - DNA, 103 bp, Artificial Sequence
  Synthetic Polynucleotide
taatacgactcactatagggctgcccatgggagaacctgcagttctccttaacagaggagaaaggagatgtgcaggttcaacctggcggcagcgcaaaagatg

SEQ ID NO: 234562 - DNA, 103 bp, Artificial Sequence
  Synthetic Polynucleotide
taatacgactcactataggggagagaccacctgcccatgggagaacctgcaacagaggagagcaggtatgcccatgggcaacctggcggcagcgcaaaagatg

SEQ ID NO: 234563 - DNA, 103 bp, Artificial Sequence
  Synthetic Polynucleotide
taatacgactcactatagggccggcgcccaaggccagctccacctgctgcaacagaggagagcagcaatgggagctggcaacctggcggcagcgcaaaagatg

SEQ ID NO: 234564 - DNA, 103 bp, Artificial Sequence
  Synthetic Polynucleotide
taatacgactcactatagggagctcatccagagagaccacctgcccatggaacagaggagaccatggatgggtggtctcaacctggcggcagcgcaaaagatg

SEQ ID NO: 234565 - DNA, 103 bp, Artificial Sequence
  Synthetic Polynucleotide
taatacgactcactataggggaaggggcgcagctcatccagagagaccacaacagaggagagtggtcatgctggatgagaacctggcggcagcgcaaaagatg

SEQ ID NO: 234566 - DNA, 103 bp, Artificial Sequence
  Synthetic Polynucleotide
taatacgactcactatagggctgggtcctggaaggggcgcagctcatccaaacagaggagatggatgatgtgcgcccctaacctggcggcagcgcaaaagatg

SEQ ID NO: 234567 - DNA, 103 bp, Artificial Sequence
  Synthetic Polynucleotide
taatacgactcactataggggagctcaggtctgggtcctggaaggggcgcaacagaggagagcgcccatgccaggacccaacctggcggcagcgcaaaagatg

SEQ ID NO: 234568 - DNA, 103 bp, Artificial Sequence
  Synthetic Polynucleotide
taatacgactcactatagggggcctgcagggagctcaggtctgggtcctgaacagaggagacaggacatggacctgagcaacctggcggcagcgcaaaagatg

SEQ ID NO: 234569 - DNA, 103 bp, Artificial Sequence
  Synthetic Polynucleotide
taatacgactcactatagggacgcagagccggcctgcagggagctcaggtaacagaggagaacctgaatgccctgcaggaacctggcggcagcgcaaaagatg

SEQ ID NO: 234570 - DNA, 103 bp, Artificial Sequence
  Synthetic Polynucleotide
taatacgactcactatagggttggccagacacgcagagccggcctgcaggaacagaggagacctgcaatgcggctctgcaacctggcggcagcgcaaaagatg

SEQ ID NO: 234571 - DNA, 103 bp, Artificial Sequence
  Synthetic Polynucleotide
taatacgactcactatagggatcctggtgcttggccagacacgcagagccaacagaggagaggctctatgtgtctggccaacctggcggcagcgcaaaagatg

SEQ ID NO: 234572 - DNA, 103 bp, Artificial Sequence
  Synthetic Polynucleotide
taatacgactcactataggggccagaggccatcctggtgcttggccagacaacagaggagagtctggatgagcaccaggaacctggcggcagcgcaaaagatg

SEQ ID NO: 234573 - DNA, 103 bp, Artificial Sequence
  Synthetic Polynucleotide
taatacgactcactatagggcgtgctgcgtgccagaggccatcctggtgcaacagaggagagcaccaatgtggcctctgaacctggcggcagcgcaaaagatg

SEQ ID NO: 234574 - DNA, 103 bp, Artificial Sequence
  Synthetic Polynucleotide
taatacgactcactatagggcgaatccaggccggcgcccaaggccagctcaacagaggagagagctgatgttgggcgccaacctggcggcagcgcaaaagatg

SEQ ID NO: 234575 - DNA, 103 bp, Artificial Sequence
  Synthetic Polynucleotide
taatacgactcactatagggatcggtgatgcgtgctgcgtgccagaggccaacagaggagaggcctcatgcacgcagcaaacctggcggcagcgcaaaagatg

SEQ ID NO: 234576 - DNA, 103 bp, Artificial Sequence
  Synthetic Polynucleotide
taatacgactcactatagggcgttgtccacatcggtgatgcgtgctgcgtaacagaggagaacgcagatggcatcaccgaacctggcggcagcgcaaaagatg

SEQ ID NO: 234577 - DNA, 103 bp, Artificial Sequence
  Synthetic Polynucleotide
taatacgactcactataggggtgtagtagccgttgtccacatcggtgatgaacagaggagacatcacatgtgtggacaaaacctggcggcagcgcaaaagatg

SEQ ID NO: 234578 - DNA, 103 bp, Artificial Sequence
  Synthetic Polynucleotide
taatacgactcactatagggaaacttgactgtgtagtagccgttgtccacaacagaggagagtggacatgggctactacaacctggcggcagcgcaaaagatg

SEQ ID NO: 234579 - DNA, 103 bp, Artificial Sequence
  Synthetic Polynucleotide
taatacgactcactataggggcagcgagtcaaacttgactgtgtagtagcaacagaggagagctactatgcagtcaagtaacctggcggcagcgcaaaagatg

SEQ ID NO: 234580 - DNA, 103 bp, Artificial Sequence
  Synthetic Polynucleotide
taatacgactcactatagggtccctcagcagcagcgagtcaaacttgactaacagaggagaagtcaaatgtgactcgctaacctggcggcagcgcaaaagatg

SEQ ID NO: 234581 - DNA, 103 bp, Artificial Sequence
  Synthetic Polynucleotide
taatacgactcactatagggcaccacggcctccctcagcagcagcgagtcaacagaggagagactcgatgctgctgaggaacctggcggcagcgcaaaagatg

SEQ ID NO: 234582 - DNA, 103 bp, Artificial Sequence
  Synthetic Polynucleotide
taatacgactcactatagggcgtccccctccaccacggcctccctcagcaaacagaggagatgctgaatgaggccgtggaacctggcggcagcgcaaaagatg

SEQ ID NO: 234583 - DNA, 103 bp, Artificial Sequence
  Synthetic Polynucleotide
taatacgactcactatagggggcaggatgccgtccccctccaccacggccaacagaggagaggccgtatgggagggggaaacctggcggcagcgcaaaagatg

SEQ ID NO: 234584 - DNA, 103 bp, Artificial Sequence
  Synthetic Polynucleotide
taatacgactcactataggggcgcagtgggggcaggatgccgtccccctcaacagaggagagaggggatgggcatcctgaacctggcggcagcgcaaaagatg

SEQ ID NO: 234585 - DNA, 103 bp, Artificial Sequence
  Synthetic Polynucleotide
taatacgactcactatagggcctgctcagacgaatccaggccggcgcccaaacagaggagatgggcgatggcctggattaacctggcggcagcgcaaaagatg

SEQ ID NO: 234586 - DNA, 103 bp, Artificial Sequence
  Synthetic Polynucleotide
taatacgactcactatagggtggcctctgtgcgcagtgggggcaggatgcaacagaggagagcatccatgccccactgcaacctggcggcagcgcaaaagatg

SEQ ID NO: 234587 - DNA, 103 bp, Artificial Sequence
  Synthetic Polynucleotide
taatacgactcactatagggtcggactctgtggcctctgtgcgcagtgggaacagaggagacccactatgcacagaggcaacctggcggcagcgcaaaagatg

SEQ ID NO: 234588 - DNA, 103 bp, Artificial Sequence
  Synthetic Polynucleotide
taatacgactcactataggggctgtctgagtcggactctgtggcctctgtaacagaggagaacagagatgacagagtccaacctggcggcagcgcaaaagatg

SEQ ID NO: 234589 - DNA, 103 bp, Artificial Sequence
  Synthetic Polynucleotide
taatacgactcactatagggccgtaccgtcgctgtctgagtcggactctgaacagaggagacagagtatgactcagacaaacctggcggcagcgcaaaagatg

SEQ ID NO: 234590 - DNA, 103 bp, Artificial Sequence
  Synthetic Polynucleotide
taatacgactcactatagggctggagtcacccgtaccgtcgctgtctgagaacagaggagactcagaatgcgacggtacaacctggcggcagcgcaaaagatg

SEQ ID NO: 234591 - DNA, 103 bp, Artificial Sequence
  Synthetic Polynucleotide
taatacgactcactatagggtctggcatagctggagtcacccgtaccgtcaacagaggagagacggtatgggtgactccaacctggcggcagcgcaaaagatg

SEQ ID NO: 234592 - DNA, 103 bp, Artificial Sequence
  Synthetic Polynucleotide
taatacgactcactatagggaccccaccactctggcatagctggagtcacaacagaggagagtgactatggctatgccaaacctggcggcagcgcaaaagatg

SEQ ID NO: 234593 - DNA, 103 bp, Artificial Sequence
  Synthetic Polynucleotide
taatacgactcactatagggacggcgtccgaccccaccactctggcatagaacagaggagactatgcatgagtggtgggaacctggcggcagcgcaaaagatg

SEQ ID NO: 234594 - DNA, 103 bp, Artificial Sequence
  Synthetic Polynucleotide
taatacgactcactatagggtgcagagtccacggcgtccgaccccaccacaacagaggagagtggtgatgtcggacgccaacctggcggcagcgcaaaagatg

SEQ ID NO: 234595 - DNA, 103 bp, Artificial Sequence
  Synthetic Polynucleotide
taatacgactcactatagggcagaggactgtgcagagtccacggcgtccgaacagaggagacggacgatgtggactctgaacctggcggcagcgcaaaagatg

SEQ ID NO: 234596 - DNA, 103 bp, Artificial Sequence
  Synthetic Polynucleotide
taatacgactcactatagggcgcaggtcagcctgctcagacgaatccaggaacagaggagacctggaatggtctgagcaaacctggcggcagcgcaaaagatg

SEQ ID NO: 234597 - DNA, 103 bp, Artificial Sequence
  Synthetic Polynucleotide
taatacgactcactatagggggacagagggcagaggactgtgcagagtccaacagaggagaggactcatgacagtcctcaacctggcggcagcgcaaaagatg

SEQ ID NO: 234598 - DNA, 103 bp, Artificial Sequence
  Synthetic Polynucleotide
taatacgactcactatagggtgcaagagacggacagagggcagaggactgaacagaggagacagtccatggccctctgtaacctggcggcagcgcaaaagatg

SEQ ID NO: 234599 - DNA, 103 bp, Artificial Sequence
  Synthetic Polynucleotide
taatacgactcactatagggaccccaccactgcaagagacggacagagggaacagaggagaccctctatgcgtctcttgaacctggcggcagcgcaaaagatg

SEQ ID NO: 234600 - DNA, 103 bp, Artificial Sequence
  Synthetic Polynucleotide
taatacgactcactatagggacagcatctgaccccaccactgcaagagacaacagaggagagtctctatgagtggtgggaacctggcggcagcgcaaaagatg

SEQ ID NO: 234601 - DNA, 103 bp, Artificial Sequence
  Synthetic Polynucleotide
taatacgactcactatagggcccagagtccacagcatctgaccccaccacaacagaggagagtggtgatgtcagatgctaacctggcggcagcgcaaaagatg

SEQ ID NO: 234602 - DNA, 103 bp, Artificial Sequence
  Synthetic Polynucleotide
taatacgactcactatagggagctgcaggtcccagagtccacagcatctgaacagaggagacagatgatgtggactctgaacctggcggcagcgcaaaagatg

SEQ ID NO: 234603 - DNA, 103 bp, Artificial Sequence
  Synthetic Polynucleotide
taatacgactcactataggggcaaaggcagagctgcaggtcccagagtccaacagaggagaggactcatggacctgcagaacctggcggcagcgcaaaagatg

SEQ ID NO: 234604 - DNA, 103 bp, Artificial Sequence
  Synthetic Polynucleotide
taatacgactcactatagggctcccagccagcaaaggcagagctgcaggtaacagaggagaacctgcatgtctgcctttaacctggcggcagcgcaaaagatg

SEQ ID NO: 234605 - DNA, 103 bp, Artificial Sequence
  Synthetic Polynucleotide
taatacgactcactataggggcgtgtgcacctcccagccagcaaaggcagaacagaggagactgcctatgctggctgggaacctggcggcagcgcaaaagatg

SEQ ID NO: 234606 - DNA, 103 bp, Artificial Sequence
  Synthetic Polynucleotide
taatacgactcactatagggcctatacctcgcgtgtgcacctcccagccaaacagaggagatggctgatgggtgcacacaacctggcggcagcgcaaaagatg

SEQ ID NO: 234607 - DNA, 103 bp, Artificial Sequence
  Synthetic Polynucleotide
taatacgactcactatagggtggtgtggtggatttcctcttgctggccataacagaggagaatggccatgaagaggaaaaacctggcggcagcgcaaaagatg

SEQ ID NO: 234608 - DNA, 103 bp, Artificial Sequence
  Synthetic Polynucleotide
taatacgactcactatagggatcctgctggggtccttcaggcaaggtctcaacagaggagagagaccatgcctgaaggaaacctggcggcagcgcaaaagatg

SEQ ID NO: 234609 - DNA, 103 bp, Artificial Sequence
  Synthetic Polynucleotide
taatacgactcactatagggcaccacagtcaaatagcagagctcggctttaacagaggagaaaagccatgctctgctataacctggcggcagcgcaaaagatg

SEQ ID NO: 234610 - DNA, 103 bp, Artificial Sequence
  Synthetic Polynucleotide
taatacgactcactataggggatacttggtcaccacagtcaaatagcagaaacagaggagatctgctatgtgactgtggaacctggcggcagcgcaaaagatg

SEQ ID NO: 234611 - DNA, 103 bp, Artificial Sequence
  Synthetic Polynucleotide
taatacgactcactatagggtgttcttctggatacttggtcaccacagtcaacagaggagagactgtatggaccaagtaaacctggcggcagcgcaaaagatg

SEQ ID NO: 234612 - DNA, 103 bp, Artificial Sequence
  Synthetic Polynucleotide
taatacgactcactataggggatcttgagctgttcttctggatacttggtaacagaggagaaccaagatgccagaagaaaacctggcggcagcgcaaaagatg

SEQ ID NO: 234613 - DNA, 103 bp, Artificial Sequence
  Synthetic Polynucleotide
taatacgactcactatagggctgtgaaccagatcttgagctgttcttctgaacagaggagacagaagatgagctcaagaaacctggcggcagcgcaaaagatg

SEQ ID NO: 234614 - DNA, 103 bp, Artificial Sequence
  Synthetic Polynucleotide
taatacgactcactatagggagcctttgggctgtgaaccagatcttgagcaacagaggagagctcaaatgctggttcacaacctggcggcagcgcaaaagatg

SEQ ID NO: 234615 - DNA, 103 bp, Artificial Sequence
  Synthetic Polynucleotide
taatacgactcactatagggcccctgcttcagcctttgggctgtgaaccaaacagaggagatggttcatggcccaaaggaacctggcggcagcgcaaaagatg

SEQ ID NO: 234616 - DNA, 103 bp, Artificial Sequence
  Synthetic Polynucleotide
taatacgactcactatagggaccagctgatcccctgcttcagcctttgggaacagaggagacccaaaatgtgaagcaggaacctggcggcagcgcaaaagatg

SEQ ID NO: 234617 - DNA, 103 bp, Artificial Sequence
  Synthetic Polynucleotide
taatacgactcactatagggtcctcaggggaccagctgatcccctgcttcaacagaggagagaagcaatggatcagctgaacctggcggcagcgcaaaagatg

SEQ ID NO: 234618 - DNA, 103 bp, Artificial Sequence
  Synthetic Polynucleotide
taatacgactcactatagggatcctcaatctcctcaggggaccagctgataacagaggagaatcagcatgtcccctgagaacctggcggcagcgcaaaagatg

SEQ ID NO: 234619 - DNA, 103 bp, Artificial Sequence
  Synthetic Polynucleotide
taatacgactcactatagggctgggggcagatcctgctggggtccttcagaacagaggagactgaagatgcccagcaggaacctggcggcagcgcaaaagatg

SEQ ID NO: 234620 - DNA, 103 bp, Artificial Sequence
  Synthetic Polynucleotide
taatacgactcactatagggttttccgggcatcctcaatctcctcaggggaacagaggagacccctgatgagattgaggaacctggcggcagcgcaaaagatg

SEQ ID NO: 234621 - DNA, 103 bp, Artificial Sequence
  Synthetic Polynucleotide
taatacgactcactatagggttgaacatctttttccgggcatcctcaatcaacagaggagagattgaatgtgcccggaaaacctggcggcagcgcaaaagatg

SEQ ID NO: 234622 - DNA, 103 bp, Artificial Sequence
  Synthetic Polynucleotide
taatacgactcactataggggatgactgtattgaacatctttttccgggcaacagaggagagcccggatgaagatgttcaacctggcggcagcgcaaaagatg

SEQ ID NO: 234623 - DNA, 103 bp, Artificial Sequence
  Synthetic Polynucleotide
taatacgactcactataggggcacagactggatgactgtattgaacatctaacagaggagaagatgtatgatacagtcaaacctggcggcagcgcaaaagatg

SEQ ID NO: 234624 - DNA, 103 bp, Artificial Sequence
  Synthetic Polynucleotide
taatacgactcactataggggtgggctgaggcacagactggatgactgtaaacagaggagatacagtatgccagtctgtaacctggcggcagcgcaaaagatg

SEQ ID NO: 234625 - DNA, 103 bp, Artificial Sequence
  Synthetic Polynucleotide
taatacgactcactatagggaaccgtaattgtgggctgaggcacagactgaacagaggagacagtctatgcctcagcccaacctggcggcagcgcaaaagatg

SEQ ID NO: 234626 - DNA, 103 bp, Artificial Sequence
  Synthetic Polynucleotide
taatacgactcactataggggggtatttagaaccgtaattgtgggctgagaacagaggagactcagcatgcaattacggaacctggcggcagcgcaaaagatg

SEQ ID NO: 234627 - DNA, 103 bp, Artificial Sequence
  Synthetic Polynucleotide
taatacgactcactataggggcgacgagtggggtatttagaaccgtaattaacagaggagaaattacatgtctaaatacaacctggcggcagcgcaaaagatg

SEQ ID NO: 234628 - DNA, 103 bp, Artificial Sequence
  Synthetic Polynucleotide
taatacgactcactataggggccagcactggcgacgagtggggtatttagaacagaggagactaaatatgccactcgtcaacctggcggcagcgcaaaagatg

SEQ ID NO: 234629 - DNA, 103 bp, Artificial Sequence
  Synthetic Polynucleotide
taatacgactcactataggggctggacattgccagcactggcgacgagtgaacagaggagacactcgatgccagtgctgaacctggcggcagcgcaaaagatg

SEQ ID NO: 234630 - DNA, 103 bp, Artificial Sequence
  Synthetic Polynucleotide
taatacgactcactataggggcagatgcttctgggggcagatcctgctggaacagaggagaccagcaatgtctgcccccaacctggcggcagcgcaaaagatg

SEQ ID NO: 234631 - DNA, 103 bp, Artificial Sequence
  Synthetic Polynucleotide
taatacgactcactatagggtggatgagatgctggacattgccagcactgaacagaggagacagtgcatgcaatgtccaaacctggcggcagcgcaaaagatg

SEQ ID NO: 234632 - DNA, 103 bp, Artificial Sequence
  Synthetic Polynucleotide
taatacgactcactatagggaagagcggcctggatgagatgctggacattaacagaggagaaatgtcatgcatctcatcaacctggcggcagcgcaaaagatg

SEQ ID NO: 234633 - DNA, 103 bp, Artificial Sequence
  Synthetic Polynucleotide
taatacgactcactatagggcgtgacctggaagagcggcctggatgagataacagaggagaatctcaatgaggccgctcaacctggcggcagcgcaaaagatg

SEQ ID NO: 234634 - DNA, 103 bp, Artificial Sequence
  Synthetic Polynucleotide
taatacgactcactatagggtgccccacaacgtgacctggaagagcggccaacagaggagaggccgcatgtccaggtcaaacctggcggcagcgcaaaagatg

SEQ ID NO: 234635 - DNA, 103 bp, Artificial Sequence
  Synthetic Polynucleotide
taatacgactcactatagggaccctctggctgccccacaacgtgacctggaacagaggagaccaggtatggttgtggggaacctggcggcagcgcaaaagatg

SEQ ID NO: 234636 - DNA, 103 bp, Artificial Sequence
  Synthetic Polynucleotide
taatacgactcactatagggcccctcctgtaccctctggctgccccacaaaacagaggagattgtggatgagccagaggaacctggcggcagcgcaaaagatg

SEQ ID NO: 234637 - DNA, 103 bp, Artificial Sequence
  Synthetic Polynucleotide
taatacgactcactatagggaccagaagtccccctcctgtaccctctggcaacagaggagagccagaatgtacaggaggaacctggcggcagcgcaaaagatg

SEQ ID NO: 234638 - DNA, 103 bp, Artificial Sequence
  Synthetic Polynucleotide
taatacgactcactatagggtggctgagtgaccagaagtccccctcctgtaacagaggagaacaggaatgggacttctgaacctggcggcagcgcaaaagatg

SEQ ID NO: 234639 - DNA, 103 bp, Artificial Sequence
  Synthetic Polynucleotide
taatacgactcactatagggtggccatcaatggctgagtgaccagaagtcaacagaggagagacttcatgtcactcagcaacctggcggcagcgcaaaagatg

SEQ ID NO: 234640 - DNA, 103 bp, Artificial Sequence
  Synthetic Polynucleotide
taatacgactcactatagggtgcaacccattggccatcaatggctgagtgaacagaggagacactcaatgattgatggcaacctggcggcagcgcaaaagatg

SEQ ID NO: 234641 - DNA, 103 bp, Artificial Sequence
  Synthetic Polynucleotide
taatacgactcactatagggactgctggcagcagatgcttctgggggcagaacagaggagactgcccatggaagcatctaacctggcggcagcgcaaaagatg

SEQ ID NO: 234642 - DNA, 103 bp, Artificial Sequence
  Synthetic Polynucleotide
taatacgactcactatagggacttgttgcttgcaacccattggccatcaaaacagaggagattgatgatgaatgggttgaacctggcggcagcgcaaaagatg

SEQ ID NO: 234643 - DNA, 103 bp, Artificial Sequence
  Synthetic Polynucleotide
taatacgactcactatagggggagaggggaacttgttgcttgcaacccataacagaggagaatgggtatgaagcaacaaaacctggcggcagcgcaaaagatg

SEQ ID NO: 234644 - DNA, 103 bp, Artificial Sequence
  Synthetic Polynucleotide
taatacgactcactatagggaccgtgagggggagaggggaacttgttgctaacagaggagaagcaacatgttcccctctaacctggcggcagcgcaaaagatg

SEQ ID NO: 234645 - DNA, 103 bp, Artificial Sequence
  Synthetic Polynucleotide
taatacgactcactataggggacggatgtcaccgtgagggggagaggggaaacagaggagatcccctatgcccctcacgaacctggcggcagcgcaaaagatg

SEQ ID NO: 234646 - DNA, 103 bp, Artificial Sequence
  Synthetic Polynucleotide
taatacgactcactataggggctgcttggggacggatgtcaccgtgagggaacagaggagaccctcaatgtgacatccgaacctggcggcagcgcaaaagatg

SEQ ID NO: 234647 - DNA, 103 bp, Artificial Sequence
  Synthetic Polynucleotide
taatacgactcactataggggccacacctggctgcttggggacggatgtcaacagaggagagacatcatgccccaagcaaacctggcggcagcgcaaaagatg

SEQ ID NO: 234648 - DNA, 103 bp, Artificial Sequence
  Synthetic Polynucleotide
taatacgactcactataggggttaatgggtgccacacctggctgcttgggaacagaggagacccaagatgccaggtgtgaacctggcggcagcgcaaaagatg

SEQ ID NO: 234649 - DNA, 103 bp, Artificial Sequence
  Synthetic Polynucleotide
taatacgactcactatagggaacacacagtgttaatgggtgccacacctgaacagaggagacaggtgatgcacccattaaacctggcggcagcgcaaaagatg

SEQ ID NO: 234650 - DNA, 103 bp, Artificial Sequence
  Synthetic Polynucleotide
taatacgactcactataggggttgtatttgaacacacagtgttaatgggtaacagaggagaacccatatgcactgtgtgaacctggcggcagcgcaaaagatg

SEQ ID NO: 234651 - DNA, 103 bp, Artificial Sequence
  Synthetic Polynucleotide
taatacgactcactatagggcacagctgacgttgtatttgaacacacagtaacagaggagaactgtgatgtcaaatacaaacctggcggcagcgcaaaagatg

SEQ ID NO: 234652 - DNA, 103 bp, Artificial Sequence
  Synthetic Polynucleotide
taatacgactcactataggggtgctgcctcactgctggcagcagatgcttaacagaggagaaagcatatgctgccagcaaacctggcggcagcgcaaaagatg

SEQ ID NO: 234653 - DNA, 103 bp, Artificial Sequence
  Synthetic Polynucleotide
taatacgactcactatagggtgaccaccttcacagctgacgttgtatttgaacagaggagacaaataatgcgtcagctgaacctggcggcagcgcaaaagatg

SEQ ID NO: 234654 - DNA, 103 bp, Artificial Sequence
  Synthetic Polynucleotide
taatacgactcactatagggtgggccgcattgaccaccttcacagctgacaacagaggagagtcagcatggaaggtggtaacctggcggcagcgcaaaagatg

SEQ ID NO: 234655 - DNA, 103 bp, Artificial Sequence
  Synthetic Polynucleotide
taatacgactcactataggggaggagcgactgggccgcattgaccaccttaacagaggagaaaggtgatgaatgcggccaacctggcggcagcgcaaaagatg

SEQ ID NO: 234656 - DNA, 103 bp, Artificial Sequence
  Synthetic Polynucleotide
taatacgactcactatagggggcaggccgtgaggagcgactgggccgcataacagaggagaatgcggatgagtcgctccaacctggcggcagcgcaaaagatg

SEQ ID NO: 234657 - DNA, 103 bp, Artificial Sequence
  Synthetic Polynucleotide
taatacgactcactataggggttatgctggggcaggccgtgaggagcgacaacagaggagagtcgctatgcacggcctgaacctggcggcagcgcaaaagatg

SEQ ID NO: 234658 - DNA, 103 bp, Artificial Sequence
  Synthetic Polynucleotide
taatacgactcactatagggggcttgggaggttatgctggggcaggccgtaacagaggagaacggccatgcccagcataaacctggcggcagcgcaaaagatg

SEQ ID NO: 234659 - DNA, 103 bp, Artificial Sequence
  Synthetic Polynucleotide
taatacgactcactatagggcatcaaggaaggcttgggaggttatgctggaacagaggagaccagcaatgcctcccaagaacctggcggcagcgcaaaagatg

SEQ ID NO: 234660 - DNA, 103 bp, Artificial Sequence
  Synthetic Polynucleotide
taatacgactcactatagggtagatgctagcatcaaggaaggcttgggagaacagaggagactcccaatgcttccttgaaacctggcggcagcgcaaaagatg

SEQ ID NO: 234661 - DNA, 103 bp, Artificial Sequence
  Synthetic Polynucleotide
taatacgactcactatagggcttatttttgtagatgctagcatcaaggaaaacagaggagattccttatggctagcatcaacctggcggcagcgcaaaagatg

SEQ ID NO: 234662 - DNA, 103 bp, Artificial Sequence
  Synthetic Polynucleotide
taatacgactcactatagggcatgagatttcttatttttgtagatgctagaacagaggagactagcaatgacaaaaataaacctggcggcagcgcaaaagatg

SEQ ID NO: 234663 - DNA, 103 bp, Artificial Sequence
  Synthetic Polynucleotide
taatacgactcactatagggctggggttctgtgctgcctcactgctggcaaacagaggagatgccagatgtgaggcagcaacctggcggcagcgcaaaagatg

SEQ ID NO: 234664 - DNA, 103 bp, Artificial Sequence
  Synthetic Polynucleotide
taatacgactcactataggggacagctgttcatgagatttcttatttttgaacagaggagacaaaaaatggaaatctcaaacctggcggcagcgcaaaagatg

SEQ ID NO: 234665 - DNA, 103 bp, Artificial Sequence
  Synthetic Polynucleotide
taatacgactcactatagggtttcagagctgacagctgttcatgagatttaacagaggagaaaatctatggaacagctgaacctggcggcagcgcaaaagatg

SEQ ID NO: 234666 - DNA, 103 bp, Artificial Sequence
  Synthetic Polynucleotide
taatacgactcactatagggagaagctccctttcagagctgacagctgttaacagaggagaaacagcatgcagctctgaaacctggcggcagcgcaaaagatg

SEQ ID NO: 234667 - DNA, 103 bp, Artificial Sequence
  Synthetic Polynucleotide
taatacgactcactatagggtggttccgacagaagctccctttcagagctaacagaggagaagctctatgagggagcttaacctggcggcagcgcaaaagatg

SEQ ID NO: 234668 - DNA, 103 bp, Artificial Sequence
  Synthetic Polynucleotide
taatacgactcactatagggccctgggaactggttccgacagaagctcccaacagaggagagggagcatgtgtcggaacaacctggcggcagcgcaaaagatg

SEQ ID NO: 234669 - DNA, 103 bp, Artificial Sequence
  Synthetic Polynucleotide
taatacgactcactatagggcttcgctctgccctgggaactggttccgacaacagaggagagtcggaatgagttcccagaacctggcggcagcgcaaaagatg

SEQ ID NO: 234670 - DNA, 103 bp, Artificial Sequence
  Synthetic Polynucleotide
taatacgactcactatagggagatgttcaacttcgctctgccctgggaacaacagaggagagttcccatggcagagcgaaacctggcggcagcgcaaaagatg

SEQ ID NO: 234671 - DNA, 103 bp, Artificial Sequence
  Synthetic Polynucleotide
taatacgactcactatagggcacttttgtgagatgttcaacttcgctctgaacagaggagacagagcatggttgaacataacctggcggcagcgcaaaagatg

SEQ ID NO: 234672 - DNA, 103 bp, Artificial Sequence
  Synthetic Polynucleotide
taatacgactcactatagggtgaggcccgtcacttttgtgagatgttcaaaacagaggagattgaacatgtcacaaaagaacctggcggcagcgcaaaagatg

SEQ ID NO: 234673 - DNA, 103 bp, Artificial Sequence
  Synthetic Polynucleotide
taatacgactcactatagggtctctggtactgaggcccgtcacttttgtgaacagaggagacacaaaatggacgggcctaacctggcggcagcgcaaaagatg

SEQ ID NO: 234674 - DNA, 103 bp, Artificial Sequence
  Synthetic Polynucleotide
taatacgactcactatagggatcagtactgctggggttctgtgctgcctcaacagaggagagaggcaatgcagaaccccaacctggcggcagcgcaaaagatg

SEQ ID NO: 234675 - DNA, 103 bp, Artificial Sequence
  Synthetic Polynucleotide
taatacgactcactatagggtttccgcacctctctggtactgaggcccgtaacagaggagaacgggcatgagtaccagaaacctggcggcagcgcaaaagatg

SEQ ID NO: 234676 - DNA, 103 bp, Artificial Sequence
  Synthetic Polynucleotide
taatacgactcactatagggcactgaaccatttccgcacctctctggtacaacagaggagagtaccaatgaggtgcggaaacctggcggcagcgcaaaagatg

SEQ ID NO: 234677 - DNA, 103 bp, Artificial Sequence
  Synthetic Polynucleotide
taatacgactcactatagggtatctacgatcactgaaccatttccgcaccaacagaggagaggtgcgatgatggttcagaacctggcggcagcgcaaaagatg

SEQ ID NO: 234678 - DNA, 103 bp, Artificial Sequence
  Synthetic Polynucleotide
taatacgactcactatagggccggcagtggtatctacgatcactgaaccaaacagaggagatggttcatggatcgtagaaacctggcggcagcgcaaaagatg

SEQ ID NO: 234679 - DNA, 103 bp, Artificial Sequence
  Synthetic Polynucleotide
taatacgactcactatagggccttcaagttccggcagtggtatctacgataacagaggagaatcgtaatgaccactgccaacctggcggcagcgcaaaagatg

SEQ ID NO: 234680 - DNA, 103 bp, Artificial Sequence
  Synthetic Polynucleotide
taatacgactcactataggggctctggagcccttcaagttccggcagtggaacagaggagaccactgatggaacttgaaaacctggcggcagcgcaaaagatg

SEQ ID NO: 234681 - DNA, 103 bp, Artificial Sequence
  Synthetic Polynucleotide
taatacgactcactatagggaggtatcatcgctctggagcccttcaagttaacagaggagaaacttgatgggctccagaaacctggcggcagcgcaaaagatg

SEQ ID NO: 234682 - DNA, 103 bp, Artificial Sequence
  Synthetic Polynucleotide
taatacgactcactatagggtgtgatctccaggtatcatcgctctggagcaacagaggagagctccaatgcgatgatacaacctggcggcagcgcaaaagatg

SEQ ID NO: 234683 - DNA, 103 bp, Artificial Sequence
  Synthetic Polynucleotide
taatacgactcactatagggatgatggaactgtgatctccaggtatcatcaacagaggagagatgatatgtggagatcaaacctggcggcagcgcaaaagatg

SEQ ID NO: 234684 - DNA, 103 bp, Artificial Sequence
  Synthetic Polynucleotide
taatacgactcactatagggagagtcaatgatgatggaactgtgatctccaacagaggagaggagatatgagttccatcaacctggcggcagcgcaaaagatg

SEQ ID NO: 234685 - DNA, 103 bp, Artificial Sequence
  Synthetic Polynucleotide
taatacgactcactataggggtgtagagccatcagtactgctggggttctaacagaggagaagaaccatggcagtactgaacctggcggcagcgcaaaagatg

SEQ ID NO: 234686 - DNA, 103 bp, Artificial Sequence
  Synthetic Polynucleotide
taatacgactcactatagggcctctggcacagagtcaatgatgatggaacaacagaggagagttccaatgtcattgactaacctggcggcagcgcaaaagatg

SEQ ID NO: 234687 - DNA, 103 bp, Artificial Sequence
  Synthetic Polynucleotide
taatacgactcactataggggagaaggacacctctggcacagagtcaatgaacagaggagacattgaatgtgtgccagaaacctggcggcagcgcaaaagatg

SEQ ID NO: 234688 - DNA, 103 bp, Artificial Sequence
  Synthetic Polynucleotide
taatacgactcactatagggggacgatggggagaaggacacctctggcacaacagaggagagtgccaatggtgtccttcaacctggcggcagcgcaaaagatg

SEQ ID NO: 234689 - DNA, 103 bp, Artificial Sequence
  Synthetic Polynucleotide
taatacgactcactatagggcagggaccttggacgatggggagaaggacaaacagaggagatgtcctatgccccatcgtaacctggcggcagcgcaaaagatg

SEQ ID NO: 234690 - DNA, 103 bp, Artificial Sequence
  Synthetic Polynucleotide
taatacgactcactatagggcaggttacctcagggaccttggacgatgggaacagaggagacccatcatgcaaggtcccaacctggcggcagcgcaaaagatg

SEQ ID NO: 234691 - DNA, 103 bp, Artificial Sequence
  Synthetic Polynucleotide
taatacgactcactatagggtgtcggaatgcaggttacctcagggaccttaacagaggagaaaggtcatggaggtaaccaacctggcggcagcgcaaaagatg

SEQ ID NO: 234692 - DNA, 103 bp, Artificial Sequence
  Synthetic Polynucleotide
taatacgactcactataggggtgtggctgttgtcggaatgcaggttacctaacagaggagaaggtaaatggcattccgaaacctggcggcagcgcaaaagatg

SEQ ID NO: 234693 - DNA, 103 bp, Artificial Sequence
  Synthetic Polynucleotide
taatacgactcactatagggtgggttgctagtgtggctgttgtcggaatgaacagaggagacattccatgaacagccacaacctggcggcagcgcaaaagatg

SEQ ID NO: 234694 - DNA, 103 bp, Artificial Sequence
  Synthetic Polynucleotide
taatacgactcactatagggggcagaagggtgggttgctagtgtggctgtaacagaggagaacagccatgctagcaaccaacctggcggcagcgcaaaagatg

SEQ ID NO: 234695 - DNA, 103 bp, Artificial Sequence
  Synthetic Polynucleotide
taatacgactcactatagggattgtcgtttggcagaagggtgggttgctaaacagaggagatagcaaatgacccttctgaacctggcggcagcgcaaaagatg

SEQ ID NO: 234696 - DNA, 103 bp, Artificial Sequence
  Synthetic Polynucleotide
taatacgactcactatagggccattggccagtgtagagccatcagtactgaacagaggagacagtacatgtggctctacaacctggcggcagcgcaaaagatg

SEQ ID NO: 234697 - DNA, 103 bp, Artificial Sequence
  Synthetic Polynucleotide
taatacgactcactatagggtggtgccaagattgtcgtttggcagaagggaacagaggagacccttcatgcaaacgacaaacctggcggcagcgcaaaagatg

SEQ ID NO: 234698 - DNA, 103 bp, Artificial Sequence
  Synthetic Polynucleotide
taatacgactcactataggggtcaggagtctggtgccaagattgtcgtttaacagaggagaaaacgaatgtcttggcacaacctggcggcagcgcaaaagatg

SEQ ID NO: 234699 - DNA, 103 bp, Artificial Sequence
  Synthetic Polynucleotide
taatacgactcactatagggttggtgtgaagtcaggagtctggtgccaagaacagaggagacttggcatgagactcctgaacctggcggcagcgcaaaagatg

SEQ ID NO: 234700 - DNA, 103 bp, Artificial Sequence
  Synthetic Polynucleotide
taatacgactcactatagggttgtatttggttggtgtgaagtcaggagtcaacagaggagagactccatgcttcacaccaacctggcggcagcgcaaaagatg

SEQ ID NO: 234701 - DNA, 103 bp, Artificial Sequence
  Synthetic Polynucleotide
taatacgactcactatagggggctctctccttgtatttggttggtgtgaaaacagaggagattcacaatgaccaaatacaacctggcggcagcgcaaaagatg

SEQ ID NO: 234702 - DNA, 103 bp, Artificial Sequence
  Synthetic Polynucleotide
taatacgactcactataggggctgctcaggggctctctccttgtatttggaacagaggagaccaaatatgaggagagagaacctggcggcagcgcaaaagatg

SEQ ID NO: 234703 - DNA, 103 bp, Artificial Sequence
  Synthetic Polynucleotide
taatacgactcactatagggagggctctgagctgctcaggggctctctccaacagaggagaggagagatgccctgagcaaacctggcggcagcgcaaaagatg

SEQ ID NO: 234704 - DNA, 103 bp, Artificial Sequence
  Synthetic Polynucleotide
taatacgactcactatagggactgctctccagggctctgagctgctcaggaacagaggagacctgagatgctcagagccaacctggcggcagcgcaaaagatg

SEQ ID NO: 234705 - DNA, 103 bp, Artificial Sequence
  Synthetic Polynucleotide
taatacgactcactatagggtttgtgcaaaactgctctccagggctctgaaacagaggagatcagagatgtggagagcaaacctggcggcagcgcaaaagatg

SEQ ID NO: 234706 - DNA, 103 bp, Artificial Sequence
  Synthetic Polynucleotide
taatacgactcactatagggggaagagggttttgtgcaaaactgctctccaacagaggagaggagagatgttttgcacaaacctggcggcagcgcaaaagatg

SEQ ID NO: 234707 - DNA, 103 bp, Artificial Sequence
  Synthetic Polynucleotide
taatacgactcactataggggctccgatgcccattggccagtgtagagccaacagaggagaggctctatgctggccaataacctggcggcagcgcaaaagatg

SEQ ID NO: 234708 - DNA, 103 bp, Artificial Sequence
  Synthetic Polynucleotide
taatacgactcactatagggctcatcaagaggaagagggttttgtgcaaaaacagaggagatttgcaatgaaccctcttaacctggcggcagcgcaaaagatg

SEQ ID NO: 234709 - DNA, 103 bp, Artificial Sequence
  Synthetic Polynucleotide
taatacgactcactatagggggtccagttcctcatcaagaggaagagggtaacagaggagaaccctcatgctcttgatgaacctggcggcagcgcaaaagatg

SEQ ID NO: 234710 - DNA, 103 bp, Artificial Sequence
  Synthetic Polynucleotide
taatacgactcactatagggcttctcaggcggtccagttcctcatcaagaaacagaggagatcttgaatgggaactggaaacctggcggcagcgcaaaagatg

SEQ ID NO: 234711 - DNA, 103 bp, Artificial Sequence
  Synthetic Polynucleotide
taatacgactcactatagggtttggtttcacttctcaggcggtccagttcaacagaggagagaactgatgcgcctgagaaacctggcggcagcgcaaaagatg

SEQ ID NO: 234712 - DNA, 103 bp, Artificial Sequence
  Synthetic Polynucleotide
taatacgactcactataggggtcgggtcattttggtttcacttctcaggcaacagaggagagcctgaatggtgaaaccaaacctggcggcagcgcaaaagatg

SEQ ID NO: 234713 - DNA, 103 bp, Artificial Sequence
  Synthetic Polynucleotide
taatacgactcactatagggtcaatttctcgtcgggtcattttggtttcaaacagaggagatgaaacatgaatgacccgaacctggcggcagcgcaaaagatg

SEQ ID NO: 234714 - DNA, 103 bp, Artificial Sequence
  Synthetic Polynucleotide
taatacgactcactatagggaaaccagctatcaatttctcgtcgggtcataacagaggagaatgaccatgcgagaaattaacctggcggcagcgcaaaagatg

SEQ ID NO: 234715 - DNA, 103 bp, Artificial Sequence
  Synthetic Polynucleotide
taatacgactcactataggggtctctctgaaaaccagctatcaatttctcaacagaggagagagaaaatgatagctggtaacctggcggcagcgcaaaagatg

SEQ ID NO: 234716 - DNA, 103 bp, Artificial Sequence
  Synthetic Polynucleotide
taatacgactcactatagggacttttttccgtctctctgaaaaccagctaaacagaggagatagctgatgttcagagagaacctggcggcagcgcaaaagatg

SEQ ID NO: 234717 - DNA, 103 bp, Artificial Sequence
  Synthetic Polynucleotide
taatacgactcactatagggctcagcattcacttttttccgtctctctgaaacagaggagatcagagatgcggaaaaaaaacctggcggcagcgcaaaagatg

SEQ ID NO: 234718 - DNA, 103 bp, Artificial Sequence
  Synthetic Polynucleotide
taatacgactcactatagggggatcatgcatggtgtggtggatttcctctaacagaggagaagaggaatgccaccacacaacctggcggcagcgcaaaagatg

SEQ ID NO: 234719 - DNA, 103 bp, Artificial Sequence
  Synthetic Polynucleotide
taatacgactcactatagggcatctaaagtgctccgatgcccattggccaaacagaggagatggccaatgggcatcggaaacctggcggcagcgcaaaagatg

SEQ ID NO: 234720 - DNA, 103 bp, Artificial Sequence
  Synthetic Polynucleotide
taatacgactcactatagggtcttggtctcctcagcattcacttttttccaacagaggagaggaaaaatgtgaatgctgaacctggcggcagcgcaaaagatg

SEQ ID NO: 234721 - DNA, 103 bp, Artificial Sequence
  Synthetic Polynucleotide
taatacgactcactatagggtcctcagccttcttggtctcctcagcattcaacagaggagagaatgcatgggagaccaaaacctggcggcagcgcaaaagatg

SEQ ID NO: 234722 - DNA, 103 bp, Artificial Sequence
  Synthetic Polynucleotide
taatacgactcactatagggagaggcattctcctcagccttcttggtctcaacagaggagagagaccatgaaggctgagaacctggcggcagcgcaaaagatg

SEQ ID NO: 234723 - DNA, 103 bp, Artificial Sequence
  Synthetic Polynucleotide
taatacgactcactatagggcttcctcctgagaggcattctcctcagcctaacagaggagaaggctgatgagaatgcctaacctggcggcagcgcaaaagatg

SEQ ID NO: 234724 - DNA, 103 bp, Artificial Sequence
  Synthetic Polynucleotide
taatacgactcactataggggcagcctcctcttcctcctgagaggcattcaacagaggagagaatgcatgtcaggaggaaacctggcggcagcgcaaaagatg

SEQ ID NO: 234725 - DNA, 103 bp, Artificial Sequence
  Synthetic Polynucleotide
taatacgactcactatagggctcatcctcagcagcctcctcttcctcctgaacagaggagacaggagatggaggaggctaacctggcggcagcgcaaaagatg

SEQ ID NO: 234726 - DNA, 103 bp, Artificial Sequence
  Synthetic Polynucleotide
taatacgactcactatagggcttctccaccctcatcctcagcagcctcctaacagaggagaaggaggatgctgaggatgaacctggcggcagcgcaaaagatg

SEQ ID NO: 234727 - DNA, 103 bp, Artificial Sequence
  Synthetic Polynucleotide
taatacgactcactataggggccaaatcctcttctccaccctcatcctcaaacagaggagatgaggaatggggtggagaaacctggcggcagcgcaaaagatg

SEQ ID NO: 234728 - DNA, 103 bp, Artificial Sequence
  Synthetic Polynucleotide
taatacgactcactatagggtagctcactggccaaatcctcttctccaccaacagaggagaggtggaatggaggatttgaacctggcggcagcgcaaaagatg

SEQ ID NO: 234729 - DNA, 103 bp, Artificial Sequence
  Synthetic Polynucleotide
taatacgactcactatagggcagagacccttagctcactggccaaatcctaacagaggagaaggattatgccagtgagcaacctggcggcagcgcaaaagatg

SEQ ID NO: 234730 - DNA, 103 bp, Artificial Sequence
  Synthetic Polynucleotide
taatacgactcactatagggtataaatagccatctaaagtgctccgatgcaacagaggagagcatcgatgcactttagaaacctggcggcagcgcaaaagatg

SEQ ID NO: 234731 - DNA, 103 bp, Artificial Sequence
  Synthetic Polynucleotide
taatacgactcactatagggccattttcaccagagacccttagctcactgaacagaggagacagtgaatgaagggtctcaacctggcggcagcgcaaaagatg

SEQ ID NO: 234732 - DNA, 103 bp, Artificial Sequence
  Synthetic Polynucleotide
taatacgactcactatagggttccagagagccattttcaccagagaccctaacagaggagaagggtcatgggtgaaaataacctggcggcagcgcaaaagatg

SEQ ID NO: 234733 - DNA, 103 bp, Artificial Sequence
  Synthetic Polynucleotide
taatacgactcactatagggtgctgggcatttccagagagccattttcacaacagaggagagtgaaaatggctctctggaacctggcggcagcgcaaaagatg

SEQ ID NO: 234734 - DNA, 103 bp, Artificial Sequence
  Synthetic Polynucleotide
taatacgactcactatagggaagatatggctgctgggcatttccagagagaacagaggagactctctatgaatgcccagaacctggcggcagcgcaaaagatg

SEQ ID NO: 234735 - DNA, 103 bp, Artificial Sequence
  Synthetic Polynucleotide
taatacgactcactataggggcgctctgccaagatatggctgctgggcataacagaggagaatgcccatgagccatatcaacctggcggcagcgcaaaagatg

SEQ ID NO: 234736 - DNA, 103 bp, Artificial Sequence
  Synthetic Polynucleotide
taatacgactcactatagggggctgactttgcgctctgccaagatatggcaacagaggagagccataatgtggcagagcaacctggcggcagcgcaaaagatg

SEQ ID NO: 234737 - DNA, 103 bp, Artificial Sequence
  Synthetic Polynucleotide
taatacgactcactatagggattttaatggggctgactttgcgctctgccaacagaggagaggcagaatgcaaagtcagaacctggcggcagcgcaaaagatg

SEQ ID NO: 234738 - DNA, 103 bp, Artificial Sequence
  Synthetic Polynucleotide
taatacgactcactatagggcttcaggttgattttaatggggctgactttaacagaggagaaaagtcatgcccattaaaaacctggcggcagcgcaaaagatg

SEQ ID NO: 234739 - DNA, 103 bp, Artificial Sequence
  Synthetic Polynucleotide
taatacgactcactatagggccctcaggttcttcaggttgattttaatggaacagaggagaccattaatgtcaacctgaaacctggcggcagcgcaaaagatg

SEQ ID NO: 234740 - DNA, 103 bp, Artificial Sequence
  Synthetic Polynucleotide
taatacgactcactataggggcttcagtgaccctcaggttcttcaggttgaacagaggagacaacctatggaacctgagaacctggcggcagcgcaaaagatg

SEQ ID NO: 234741 - DNA, 103 bp, Artificial Sequence
  Synthetic Polynucleotide
taatacgactcactatagggtttacaggaatataaatagccatctaaagtaacagaggagaactttaatgggctatttaaacctggcggcagcgcaaaagatg

SEQ ID NO: 234742 - DNA, 103 bp, Artificial Sequence
  Synthetic Polynucleotide
taatacgactcactatagggcctgccattggcttcagtgaccctcaggttaacagaggagaaacctgatggtcactgaaaacctggcggcagcgcaaaagatg

SEQ ID NO: 234743 - DNA, 103 bp, Artificial Sequence
  Synthetic Polynucleotide
taatacgactcactataggggaatctcgttcctgccattggcttcagtgaaacagaggagatcactgatgccaatggcaaacctggcggcagcgcaaaagatg

SEQ ID NO: 234744 - DNA, 103 bp, Artificial Sequence
  Synthetic Polynucleotide
taatacgactcactatagggcccagccctggaatctcgttcctgccattgaacagaggagacaatggatggaacgagataacctggcggcagcgcaaaagatg

SEQ ID NO: 234745 - DNA, 103 bp, Artificial Sequence
  Synthetic Polynucleotide
taatacgactcactataggggtcacaggcacccagccctggaatctcgttaacagaggagaaacgagatgccagggctgaacctggcggcagcgcaaaagatg

SEQ ID NO: 234746 - DNA, 103 bp, Artificial Sequence
  Synthetic Polynucleotide
taatacgactcactatagggcatcctcagggtcacaggcacccagccctgaacagaggagacagggcatggtgcctgtgaacctggcggcagcgcaaaagatg

SEQ ID NO: 234747 - DNA, 103 bp, Artificial Sequence
  Synthetic Polynucleotide
taatacgactcactatagggtttgactcatcatcctcagggtcacaggcaaacagaggagatgcctgatgccctgaggaaacctggcggcagcgcaaaagatg

SEQ ID NO: 234748 - DNA, 103 bp, Artificial Sequence
  Synthetic Polynucleotide
taatacgactcactatagggtgccagtttgtttgactcatcatcctcaggaacagaggagacctgagatggatgagtcaaacctggcggcagcgcaaaagatg

SEQ ID NO: 234749 - DNA, 103 bp, Artificial Sequence
  Synthetic Polynucleotide
taatacgactcactatagggggagctgctctgccagtttgtttgactcataacagaggagaatgagtatgacaaactggaacctggcggcagcgcaaaagatg

SEQ ID NO: 234750 - DNA, 103 bp, Artificial Sequence
  Synthetic Polynucleotide
taatacgactcactatagggactttgcctgggagctgctctgccagtttgaacagaggagacaaactatgagagcagctaacctggcggcagcgcaaaagatg

SEQ ID NO: 234751 - DNA, 103 bp, Artificial Sequence
  Synthetic Polynucleotide
taatacgactcactatagggtttgcagctcactttgcctgggagctgctcaacagaggagagagcagatgccaggcaaaaacctggcggcagcgcaaaagatg

SEQ ID NO: 234752 - DNA, 103 bp, Artificial Sequence
  Synthetic Polynucleotide
taatacgactcactatagggaatcgcagtatttacaggaatataaatagcaacagaggagagctattatgattcctgtaaacctggcggcagcgcaaaagatg

SEQ ID NO: 234753 - DNA, 103 bp, Artificial Sequence
  Synthetic Polynucleotide
taatacgactcactataggggggcagtctttttgcagctcactttgcctgaacagaggagacaggcaatgtgagctgcaaacctggcggcagcgcaaaagatg

SEQ ID NO: 234754 - DNA, 103 bp, Artificial Sequence
  Synthetic Polynucleotide
taatacgactcactatagggtgccgctgctgggcagtctttttgcagctcaacagaggagagagctgatgaaagactgcaacctggcggcagcgcaaaagatg

SEQ ID NO: 234755 - DNA, 103 bp, Artificial Sequence
  Synthetic Polynucleotide
taatacgactcactatagggccgcagcaagtgccgctgctgggcagtcttaacagaggagaaagactatgcagcagcggaacctggcggcagcgcaaaagatg

SEQ ID NO: 234756 - DNA, 103 bp, Artificial Sequence
  Synthetic Polynucleotide
taatacgactcactatagggcaaagagctgccgcagcaagtgccgctgctaacagaggagaagcagcatgacttgctgcaacctggcggcagcgcaaaagatg

SEQ ID NO: 234757 - DNA, 103 bp, Artificial Sequence
  Synthetic Polynucleotide
taatacgactcactatagggtgtgtctggacaaagagctgccgcagcaagaacagaggagacttgctatggcagctcttaacctggcggcagcgcaaaagatg

SEQ ID NO: 234758 - DNA, 103 bp, Artificial Sequence
  Synthetic Polynucleotide
taatacgactcactataggggcttggccactgtgtctggacaaagagctgaacagaggagacagctcatggtccagacaaacctggcggcagcgcaaaagatg

SEQ ID NO: 234759 - DNA, 103 bp, Artificial Sequence
  Synthetic Polynucleotide
taatacgactcactatagggagtcctggttgcttggccactgtgtctggaaacagaggagatccagaatgagtggccaaaacctggcggcagcgcaaaagatg

SEQ ID NO: 234760 - DNA, 103 bp, Artificial Sequence
  Synthetic Polynucleotide
taatacgactcactatagggatggagtcatagtcctggttgcttggccacaacagaggagagtggccatgcaaccaggaaacctggcggcagcgcaaaagatg

SEQ ID NO: 234761 - DNA, 103 bp, Artificial Sequence
  Synthetic Polynucleotide
taatacgactcactatagggctgggccatgatggagtcatagtcctggttaacagaggagaaaccagatgtatgactccaacctggcggcagcgcaaaagatg

SEQ ID NO: 234762 - DNA, 103 bp, Artificial Sequence
  Synthetic Polynucleotide
taatacgactcactataggggcagacccgtctgggccatgatggagtcataacagaggagaatgactatgtcatggcccaacctggcggcagcgcaaaagatg

SEQ ID NO: 234763 - DNA, 103 bp, Artificial Sequence
  Synthetic Polynucleotide
taatacgactcactatagggtgggatctgaaatcgcagtatttacaggaaaacagaggagattcctgatgatactgcgaaacctggcggcagcgcaaaagatg

SEQ ID NO: 234764 - DNA, 103 bp, Artificial Sequence
  Synthetic Polynucleotide
taatacgactcactatagggtctggccgtggcagacccgtctgggccatgaacagaggagacatggcatggacgggtctaacctggcggcagcgcaaaagatg

SEQ ID NO: 234765 - DNA, 103 bp, Artificial Sequence
  Synthetic Polynucleotide
taatacgactcactataggggcgcaccacctctggccgtggcagacccgtaacagaggagaacgggtatgccacggccaaacctggcggcagcgcaaaagatg

SEQ ID NO: 234766 - DNA, 103 bp, Artificial Sequence
  Synthetic Polynucleotide
taatacgactcactatagggctccaaaccagcgcaccacctctggccgtgaacagaggagacacggcatgaggtggtgcaacctggcggcagcgcaaaagatg

SEQ ID NO: 234767 - DNA, 103 bp, Artificial Sequence
  Synthetic Polynucleotide
taatacgactcactatagggtacctgctatctccaaaccagcgcaccaccaacagaggagaggtggtatgctggtttggaacctggcggcagcgcaaaagatg

SEQ ID NO: 234768 - DNA, 103 bp, Artificial Sequence
  Synthetic Polynucleotide
taatacgactcactatagggcttcagtgcgtacctgctatctccaaaccaaacagaggagatggtttatggatagcaggaacctggcggcagcgcaaaagatg

SEQ ID NO: 234769 - DNA, 103 bp, Artificial Sequence
  Synthetic Polynucleotide
taatacgactcactataggggttggccgttcttcagtgcgtacctgctataacagaggagaatagcaatgacgcactgaaacctggcggcagcgcaaaagatg

SEQ ID NO: 234770 - DNA, 103 bp, Artificial Sequence
  Synthetic Polynucleotide
taatacgactcactatagggtaccatttgagttggccgttcttcagtgcgaacagaggagacgcactatggaacggccaaacctggcggcagcgcaaaagatg

SEQ ID NO: 234771 - DNA, 103 bp, Artificial Sequence
  Synthetic Polynucleotide
taatacgactcactatagggatagtcttcgtaccatttgagttggccgttaacagaggagaaacggcatgctcaaatggaacctggcggcagcgcaaaagatg

SEQ ID NO: 234772 - DNA, 103 bp, Artificial Sequence
  Synthetic Polynucleotide
taatacgactcactatagggtgcctcgcttatagtcttcgtaccatttgaaacagaggagatcaaatatgacgaagactaacctggcggcagcgcaaaagatg

SEQ ID NO: 234773 - DNA, 103 bp, Artificial Sequence
  Synthetic Polynucleotide
taatacgactcactatagggggtgggaagttgcctcgcttatagtcttcgaacagaggagacgaagaatgtaagcgaggaacctggcggcagcgcaaaagatg

SEQ ID NO: 234774 - DNA, 103 bp, Artificial Sequence
  Synthetic Polynucleotide
taatacgactcactatagggggtcatgtcatgggatctgaaatcgcagtaaacagaggagatactgcatgttcagatccaacctggcggcagcgcaaaagatg

SEQ ID NO: 234775 - DNA, 103 bp, Artificial Sequence
  Synthetic Polynucleotide
taatacgactcactatagggcagtagccctggtgggaagttgcctcgcttaacagaggagaaagcgaatgaacttcccaaacctggcggcagcgcaaaagatg

SEQ ID NO: 234776 - DNA, 103 bp, Artificial Sequence
  Synthetic Polynucleotide
taatacgactcactataggggggcaatgaccagtagccctggtgggaagtaacagaggagaacttccatgcagggctacaacctggcggcagcgcaaaagatg

SEQ ID NO: 234777 - DNA, 103 bp, Artificial Sequence
  Synthetic Polynucleotide
taatacgactcactatagggcggttgccaggggcaatgaccagtagccctaacagaggagaagggctatgggtcattgcaacctggcggcagcgcaaaagatg

SEQ ID NO: 234778 - DNA, 103 bp, Artificial Sequence
  Synthetic Polynucleotide
taatacgactcactatagggcaggagctcccggttgccaggggcaatgacaacagaggagagtcattatgcctggcaacaacctggcggcagcgcaaaagatg

SEQ ID NO: 234779 - DNA, 103 bp, Artificial Sequence
  Synthetic Polynucleotide
taatacgactcactatagggaatagtcctgcaggagctcccggttgccagaacagaggagactggcaatggggagctccaacctggcggcagcgcaaaagatg

SEQ ID NO: 234780 - DNA, 103 bp, Artificial Sequence
  Synthetic Polynucleotide
taatacgactcactatagggtgtgtcatgtaatagtcctgcaggagctccaacagaggagaggagctatggcaggactaaacctggcggcagcgcaaaagatg

SEQ ID NO: 234781 - DNA, 103 bp, Artificial Sequence
  Synthetic Polynucleotide
taatacgactcactatagggcagcatcttgtgtgtcatgtaatagtcctgaacagaggagacaggacatgtacatgacaaacctggcggcagcgcaaaagatg

SEQ ID NO: 234782 - DNA, 103 bp, Artificial Sequence
  Synthetic Polynucleotide
taatacgactcactatagggcctcttcatacagcatcttgtgtgtcatgtaacagaggagaacatgaatgacaagatgcaacctggcggcagcgcaaaagatg

SEQ ID NO: 234783 - DNA, 103 bp, Artificial Sequence
  Synthetic Polynucleotide
taatacgactcactatagggttctgcaggtcctcttcatacagcatcttgaacagaggagacaagatatggtatgaagaaacctggcggcagcgcaaaagatg

SEQ ID NO: 234784 - DNA, 103 bp, Artificial Sequence
  Synthetic Polynucleotide
taatacgactcactataggggtcacagaggttctgcaggtcctcttcataaacagaggagatatgaaatggacctgcagaacctggcggcagcgcaaaagatg

SEQ ID NO: 234785 - DNA, 103 bp, Artificial Sequence
  Synthetic Polynucleotide
taatacgactcactatagggccacaaattgggtcatgtcatgggatctgaaacagaggagatcagatatgatgacatgaaacctggcggcagcgcaaaagatg

SEQ ID NO: 234786 - DNA, 103 bp, Artificial Sequence
  Synthetic Polynucleotide
taatacgactcactatagggtctgggtcttgtcacagaggttctgcaggtaacagaggagaacctgcatgacctctgtgaacctggcggcagcgcaaaagatg

SEQ ID NO: 234787 - DNA, 103 bp, Artificial Sequence
  Synthetic Polynucleotide
taatacgactcactatagggtgggagctcatctgggtcttgtcacagaggaacagaggagacctctgatgcaagacccaaacctggcggcagcgcaaaagatg

SEQ ID NO: 234788 - DNA, 103 bp, Artificial Sequence
  Synthetic Polynucleotide
taatacgactcactatagggcttgacctgctgggagctcatctgggtcttaacagaggagaaagaccatgatgagctccaacctggcggcagcgcaaaagatg

SEQ ID NO: 234789 - DNA, 103 bp, Artificial Sequence
  Synthetic Polynucleotide
taatacgactcactatagggcaaaccactgcttgacctgctgggagctcaaacagaggagatgagctatgagcaggtcaaacctggcggcagcgcaaaagatg

SEQ ID NO: 234790 - DNA, 103 bp, Artificial Sequence
  Synthetic Polynucleotide
taatacgactcactatagggattttctcagcaaaccactgcttgacctgcaacagaggagagcaggtatggcagtggttaacctggcggcagcgcaaaagatg

SEQ ID NO: 234791 - DNA, 103 bp, Artificial Sequence
  Synthetic Polynucleotide
taatacgactcactatagggctcctcccccattttctcagcaaaccactgaacagaggagacagtggatggctgagaaaaacctggcggcagcgcaaaagatg

SEQ ID NO: 234792 - DNA, 103 bp, Artificial Sequence
  Synthetic Polynucleotide
taatacgactcactatagggcggctctggtctcctcccccattttctcagaacagaggagactgagaatgtgggggaggaacctggcggcagcgcaaaagatg

SEQ ID NO: 234793 - DNA, 103 bp, Artificial Sequence
  Synthetic Polynucleotide
taatacgactcactataggggtgtctgccacggctctggtctcctcccccaacagaggagagggggaatggaccagagcaacctggcggcagcgcaaaagatg

SEQ ID NO: 234794 - DNA, 103 bp, Artificial Sequence
  Synthetic Polynucleotide
taatacgactcactatagggctcactgcctgtgtctgccacggctctggtaacagaggagaaccagaatggtggcagacaacctggcggcagcgcaaaagatg

SEQ ID NO: 234795 - DNA, 103 bp, Artificial Sequence
  Synthetic Polynucleotide
taatacgactcactatagggggccctggtcctcactgcctgtgtctgccaaacagaggagatggcagatgcaggcagtgaacctggcggcagcgcaaaagatg

SEQ ID NO: 234796 - DNA, 103 bp, Artificial Sequence
  Synthetic Polynucleotide
taatacgactcactatagggttcatatgtcccacaaattgggtcatgtcaaacagaggagatgacatatgccaatttgtaacctggcggcagcgcaaaagatg

SEQ ID NO: 234797 - DNA, 103 bp, Artificial Sequence
  Synthetic Polynucleotide
taatacgactcactatagggccagtaccagggccctggtcctcactgcctaacagaggagaaggcagatgggaccagggaacctggcggcagcgcaaaagatg

SEQ ID NO: 234798 - DNA, 103 bp, Artificial Sequence
  Synthetic Polynucleotide
taatacgactcactatagggtgtgagctcaccagtaccagggccctggtcaacagaggagagaccagatgcctggtactaacctggcggcagcgcaaaagatg

SEQ ID NO: 234799 - DNA, 103 bp, Artificial Sequence
  Synthetic Polynucleotide
taatacgactcactatagggtgtgaactgctgtgagctcaccagtaccagaacagaggagactggtaatggtgagctcaaacctggcggcagcgcaaaagatg

SEQ ID NO: 234800 - DNA, 103 bp, Artificial Sequence
  Synthetic Polynucleotide
taatacgactcactatagggcccatccctttgtgaactgctgtgagctcaaacagaggagatgagctatgagcagttcaaacctggcggcagcgcaaaagatg

SEQ ID NO: 234801 - DNA, 103 bp, Artificial Sequence
  Synthetic Polynucleotide
taatacgactcactatagggataggtgtcacccatccctttgtgaactgcaacagaggagagcagttatgaaagggatgaacctggcggcagcgcaaaagatg

SEQ ID NO: 234802 - DNA, 103 bp, Artificial Sequence
  Synthetic Polynucleotide
taatacgactcactatagggacacctctgaataggtgtcacccatcccttaacagaggagaaagggaatggtgacacctaacctggcggcagcgcaaaagatg

SEQ ID NO: 234803 - DNA, 103 bp, Artificial Sequence
  Synthetic Polynucleotide
taatacgactcactatagggctgttctcagacacctctgaataggtgtcaaacagaggagatgacacatgttcagaggtaacctggcggcagcgcaaaagatg

SEQ ID NO: 234804 - DNA, 103 bp, Artificial Sequence
  Synthetic Polynucleotide
taatacgactcactatagggccacgactcactgttctcagacacctctgaaacagaggagatcagagatgtctgagaacaacctggcggcagcgcaaaagatg

SEQ ID NO: 234805 - DNA, 103 bp, Artificial Sequence
  Synthetic Polynucleotide
taatacgactcactatagggcacggggctcccacgactcactgttctcagaacagaggagactgagaatggtgagtcgtaacctggcggcagcgcaaaagatg

SEQ ID NO: 234806 - DNA, 103 bp, Artificial Sequence
  Synthetic Polynucleotide
taatacgactcactataggggcctcagggacacggggctcccacgactcaaacagaggagatgagtcatgggagccccgaacctggcggcagcgcaaaagatg

SEQ ID NO: 234807 - DNA, 103 bp, Artificial Sequence
  Synthetic Polynucleotide
taatacgactcactataggggtgctctgagttcatatgtcccacaaattgaacagaggagacaatttatgggacatatgaacctggcggcagcgcaaaagatg

SEQ ID NO: 234808 - DNA, 103 bp, Artificial Sequence
  Synthetic Polynucleotide
taatacgactcactatagggctctgagctggcctcagggacacggggctcaacagaggagagagcccatggtccctgagaacctggcggcagcgcaaaagatg

SEQ ID NO: 234809 - DNA, 103 bp, Artificial Sequence
  Synthetic Polynucleotide
taatacgactcactatagggtgtcaaagggctctgagctggcctcagggaaacagaggagatccctgatgccagctcagaacctggcggcagcgcaaaagatg

SEQ ID NO: 234810 - DNA, 103 bp, Artificial Sequence
  Synthetic Polynucleotide
taatacgactcactatagggggactcgatgtgtcaaagggctctgagctgaacagaggagacagctcatggccctttgaaacctggcggcagcgcaaaagatg

SEQ ID NO: 234811 - DNA, 103 bp, Artificial Sequence
  Synthetic Polynucleotide
taatacgactcactatagggtccagcctggggactcgatgtgtcaaagggaacagaggagaccctttatgacatcgagtaacctggcggcagcgcaaaagatg

SEQ ID NO: 234812 - DNA, 103 bp, Artificial Sequence
  Synthetic Polynucleotide
taatacgactcactatagggcgagctgacgtccagcctggggactcgatgaacagaggagacatcgaatgcccaggctgaacctggcggcagcgcaaaagatg

SEQ ID NO: 234813 - DNA, 103 bp, Artificial Sequence
  Synthetic Polynucleotide
taatacgactcactatagggcagtctgtttcgagctgacgtccagcctggaacagaggagaccaggcatgacgtcagctaacctggcggcagcgcaaaagatg

SEQ ID NO: 234814 - DNA, 103 bp, Artificial Sequence
  Synthetic Polynucleotide
taatacgactcactatagggtaaagtctgtgtgctctgagttcatatgtcaacagaggagagacataatgactcagagcaacctggcggcagcgcaaaagatg

SEQ ID NO: 234815 - DNA, 103 bp, Artificial Sequence
  Synthetic Polynucleotide
taatacgactcactataggggtcttcactgggatcatgcatggtgtggtgaacagaggagacaccacatgatgcatgataacctggcggcagcgcaaaagatg

SEQ ID NO: 234816 - DNA, 103 bp, Artificial Sequence
  Synthetic Polynucleotide
taatacgactcactataggggggtctttattaaagtctgtgtgctctgagaacagaggagactcagaatgcacagacttaacctggcggcagcgcaaaagatg

SEQ ID NO: 234817 - DNA, 103 bp, Artificial Sequence
  Synthetic Polynucleotide
taatacgactcactatagggtacaaaggttgggtctttattaaagtctgtaacagaggagaacagacatgaataaagacaacctggcggcagcgcaaaagatg

SEQ ID NO: 234818 - DNA, 103 bp, Artificial Sequence
  Synthetic Polynucleotide
taatacgactcactatagggacccactgcatacaaaggttgggtctttataacagaggagaataaagatgcaacctttgaacctggcggcagcgcaaaagatg

SEQ ID NO: 234819 - DNA, 103 bp, Artificial Sequence
  Synthetic Polynucleotide
taatacgactcactatagggagaaaactgcacccactgcatacaaaggttaacagaggagaaaccttatgatgcagtggaacctggcggcagcgcaaaagatg

SEQ ID NO: 234820 - DNA, 103 bp, Artificial Sequence
  Synthetic Polynucleotide
taatacgactcactatagggggtttttgccagaaaactgcacccactgcaaacagaggagatgcagtatgtgcagttttaacctggcggcagcgcaaaagatg

SEQ ID NO: 234821 - DNA, 103 bp, Artificial Sequence
  Synthetic Polynucleotide
taatacgactcactataggggcccctcaggggtttttgccagaaaactgcaacagaggagagcagttatgtggcaaaaaaacctggcggcagcgcaaaagatg

SEQ ID NO: 234822 - DNA, 103 bp, Artificial Sequence
  Synthetic Polynucleotide
taatacgactcactatagggtgcaaggaaagcccctcaggggtttttgccaacagaggagaggcaaaatgccctgagggaacctggcggcagcgcaaaagatg

SEQ ID NO: 234823 - DNA, 103 bp, Artificial Sequence
  Synthetic Polynucleotide
taatacgactcactatagggtgtggcattgtgcaaggaaagcccctcaggaacagaggagacctgagatgctttccttgaacctggcggcagcgcaaaagatg

SEQ ID NO: 234824 - DNA, 103 bp, Artificial Sequence
  Synthetic Polynucleotide
taatacgactcactatagggcggagtgacatgtggcattgtgcaaggaaaaacagaggagatttcctatgacaatgccaaacctggcggcagcgcaaaagatg

SEQ ID NO: 234825 - DNA, 103 bp, Artificial Sequence
  Synthetic Polynucleotide
taatacgactcactatagggctggcttccccggagtgacatgtggcattgaacagaggagacaatgcatgatgtcactcaacctggcggcagcgcaaaagatg

SEQ ID NO: 234826 - DNA, 103 bp, Artificial Sequence
  Synthetic Polynucleotide
taatacgactcactatagggcaacaccacagtcttcactgggatcatgcaaacagaggagatgcatgatgccagtgaagaacctggcggcagcgcaaaagatg

SEQ ID NO: 234827 - DNA, 103 bp, Artificial Sequence
  Synthetic Polynucleotide
taatacgactcactatagggccacacaaagctggcttccccggagtgacaaacagaggagatgtcacatgggggaagccaacctggcggcagcgcaaaagatg

SEQ ID NO: 234828 - DNA, 103 bp, Artificial Sequence
  Synthetic Polynucleotide
taatacgactcactatagggtggccacgttccacacaaagctggcttcccaacagaggagagggaagatggctttgtgtaacctggcggcagcgcaaaagatg

SEQ ID NO: 234829 - DNA, 103 bp, Artificial Sequence
  Synthetic Polynucleotide
taatacgactcactatagggttgtctggcttggccacgttccacacaaagaacagaggagactttgtatggaacgtggcaacctggcggcagcgcaaaagatg

SEQ ID NO: 234830 - DNA, 103 bp, Artificial Sequence
  Synthetic Polynucleotide
taatacgactcactatagggaaccacatgattgtctggcttggccacgttaacagaggagaaacgtgatgaagccagacaacctggcggcagcgcaaaagatg

SEQ ID NO: 234831 - DNA, 103 bp, Artificial Sequence
  Synthetic Polynucleotide
taatacgactcactatagggtctgctccacaaccacatgattgtctggctaacagaggagaagccagatgatcatgtggaacctggcggcagcgcaaaagatg

SEQ ID NO: 234832 - DNA, 103 bp, Artificial Sequence
  Synthetic Polynucleotide
taatacgactcactatagggtcagggatgctctgctccacaaccacatgaaacagaggagatcatgtatgtgtggagcaaacctggcggcagcgcaaaagatg

SEQ ID NO: 234833 - DNA, 103 bp, Artificial Sequence
  Synthetic Polynucleotide
taatacgactcactataggggctggtgctctcagggatgctctgctccacaacagaggagagtggagatgagcatccctaacctggcggcagcgcaaaagatg

SEQ ID NO: 234834 - DNA, 103 bp, Artificial Sequence
  Synthetic Polynucleotide
taatacgactcactatagggggtcaggagtgctggtgctctcagggatgcaacagaggagagcatccatgagagcaccaaacctggcggcagcgcaaaagatg

SEQ ID NO: 234835 - DNA, 103 bp, Artificial Sequence
  Synthetic Polynucleotide
taatacgactcactatagggtcacccgctaggtcaggagtgctggtgctcaacagaggagagagcacatgcactcctgaaacctggcggcagcgcaaaagatg

SEQ ID NO: 234836 - DNA, 103 bp, Artificial Sequence
  Synthetic Polynucleotide
taatacgactcactatagggagcactgggctcacccgctaggtcaggagtaacagaggagaactcctatgctagcgggtaacctggcggcagcgcaaaagatg

SEQ ID NO: 234837 - DNA, 103 bp, Artificial Sequence
  Synthetic Polynucleotide
taatacgactcactatagggtggcatcttgcaacaccacagtcttcactgaacagaggagacagtgaatgctgtggtgtaacctggcggcagcgcaaaagatg

SEQ ID NO: 234838 - DNA, 103 bp, Artificial Sequence
  Synthetic Polynucleotide
taatacgactcactatagggcagccccttcagcactgggctcacccgctaaacagaggagatagcggatgagcccagtgaacctggcggcagcgcaaaagatg

SEQ ID NO: 234839 - DNA, 103 bp, Artificial Sequence
  Synthetic Polynucleotide
taatacgactcactataggggcctgtccatcagccccttcagcactgggcaacagaggagagcccagatgtgaaggggcaacctggcggcagcgcaaaagatg

SEQ ID NO: 234840 - DNA, 103 bp, Artificial Sequence
  Synthetic Polynucleotide
taatacgactcactataggggatgatttctgcctgtccatcagccccttcaacagaggagagaagggatggatggacagaacctggcggcagcgcaaaagatg

SEQ ID NO: 234841 - DNA, 103 bp, Artificial Sequence
  Synthetic Polynucleotide
taatacgactcactatagggttttggtaatgatgatttctgcctgtccataacagaggagaatggacatgcagaaatcaaacctggcggcagcgcaaaagatg

SEQ ID NO: 234842 - DNA, 103 bp, Artificial Sequence
  Synthetic Polynucleotide
taatacgactcactatagggatgattggagttttggtaatgatgatttctaacagaggagaagaaatatgcattaccaaaacctggcggcagcgcaaaagatg

SEQ ID NO: 234843 - DNA, 103 bp, Artificial Sequence
  Synthetic Polynucleotide
taatacgactcactatagggcattatcttcatgattggagttttggtaataacagaggagaattaccatgactccaatcaacctggcggcagcgcaaaagatg

SEQ ID NO: 234844 - DNA, 103 bp, Artificial Sequence
  Synthetic Polynucleotide
taatacgactcactatagggctttgcctttcattatcttcatgattggagaacagaggagactccaaatgtgaagataaaacctggcggcagcgcaaaagatg

SEQ ID NO: 234845 - DNA, 103 bp, Artificial Sequence
  Synthetic Polynucleotide
taatacgactcactatagggttggcttcagctttgcctttcattatcttcaacagaggagagaagatatggaaaggcaaaacctggcggcagcgcaaaagatg

SEQ ID NO: 234846 - DNA, 103 bp, Artificial Sequence
  Synthetic Polynucleotide
taatacgactcactatagggatgaatttttttggcttcagctttgcctttaacagaggagaaaaggcatggctgaagccaacctggcggcagcgcaaaagatg

SEQ ID NO: 234847 - DNA, 103 bp, Artificial Sequence
  Synthetic Polynucleotide
taatacgactcactatagggccttgagtgtatgaatttttttggcttcagaacagaggagactgaagatgaaaaaattcaacctggcggcagcgcaaaagatg

SEQ ID NO: 234848 - DNA, 103 bp, Artificial Sequence
  Synthetic Polynucleotide
taatacgactcactataggggcctccatgctggcatcttgcaacaccacaaacagaggagatgtggtatggcaagatgcaacctggcggcagcgcaaaagatg

SEQ ID NO: 234849 - DNA, 103 bp, Artificial Sequence
  Synthetic Polynucleotide
taatacgactcactataggggggacattctccttgagtgtatgaatttttaacagaggagaaaaaatatgtacactcaaaacctggcggcagcgcaaaagatg

SEQ ID NO: 234850 - DNA, 103 bp, Artificial Sequence
  Synthetic Polynucleotide
taatacgactcactatagggaggctggctagggacattctccttgagtgtaacagaggagaacactcatggagaatgtcaacctggcggcagcgcaaaagatg

SEQ ID NO: 234851 - DNA, 103 bp, Artificial Sequence
  Synthetic Polynucleotide
taatacgactcactatagggcctcacccacaggctggctagggacattctaacagaggagaagaatgatgctagccagcaacctggcggcagcgcaaaagatg

SEQ ID NO: 234852 - DNA, 103 bp, Artificial Sequence
  Synthetic Polynucleotide
taatacgactcactatagggtttggtaaggcctcacccacaggctggctaaacagaggagatagccaatgtgtgggtgaaacctggcggcagcgcaaaagatg

SEQ ID NO: 234853 - DNA, 103 bp, Artificial Sequence
  Synthetic Polynucleotide
taatacgactcactatagggagtcgacagctttggtaaggcctcacccacaacagaggagagtgggtatggccttaccaaacctggcggcagcgcaaaagatg

SEQ ID NO: 234854 - DNA, 103 bp, Artificial Sequence
  Synthetic Polynucleotide
taatacgactcactatagggccatttctccagtcgacagctttggtaaggaacagaggagaccttacatgagctgtcgaaacctggcggcagcgcaaaagatg

SEQ ID NO: 234855 - DNA, 103 bp, Artificial Sequence
  Synthetic Polynucleotide
taatacgactcactatagggtctctcacctccatttctccagtcgacagcaacagaggagagctgtcatgtggagaaataacctggcggcagcgcaaaagatg

SEQ ID NO: 234856 - DNA, 103 bp, Artificial Sequence
  Synthetic Polynucleotide
taatacgactcactatagggatggtccccctctctcacctccatttctccaacagaggagaggagaaatggaggtgagaaacctggcggcagcgcaaaagatg

SEQ ID NO: 234857 - DNA, 103 bp, Artificial Sequence
  Synthetic Polynucleotide
taatacgactcactatagggtgatgaaggaatggtccccctctctcacctaacagaggagaaggtgaatgagggggaccaacctggcggcagcgcaaaagatg

SEQ ID NO: 234858 - DNA, 103 bp, Artificial Sequence
  Synthetic Polynucleotide
taatacgactcactatagggactgccccattgatgaaggaatggtcccccaacagaggagagggggaatgttccttcataacctggcggcagcgcaaaagatg

SEQ ID NO: 234859 - DNA, 103 bp, Artificial Sequence
  Synthetic Polynucleotide
taatacgactcactatagggagcgggctgggcctccatgctggcatcttgaacagaggagacaagatatgagcatggagaacctggcggcagcgcaaaagatg

SEQ ID NO: 234860 - DNA, 103 bp, Artificial Sequence
  Synthetic Polynucleotide
taatacgactcactataggggctgactggaactgccccattgatgaaggaaacagaggagatccttcatgaatggggcaaacctggcggcagcgcaaaagatg

SEQ ID NO: 234861 - DNA, 103 bp, Artificial Sequence
  Synthetic Polynucleotide
taatacgactcactatagggcagatgcctggctgactggaactgccccataacagaggagaatggggatgttccagtcaaacctggcggcagcgcaaaagatg

SEQ ID NO: 234862 - DNA, 103 bp, Artificial Sequence
  Synthetic Polynucleotide
taatacgactcactataggggcagagctggcagatgcctggctgactggaaacagaggagatccagtatgccaggcatcaacctggcggcagcgcaaaagatg

SEQ ID NO: 234863 - DNA, 103 bp, Artificial Sequence
  Synthetic Polynucleotide
taatacgactcactatagggggggttttttgcagagctggcagatgcctgaacagaggagacaggcaatggccagctctaacctggcggcagcgcaaaagatg

SEQ ID NO: 234864 - DNA, 103 bp, Artificial Sequence
  Synthetic Polynucleotide
taatacgactcactatagggtggcggcatgggggttttttgcagagctggaacagaggagaccagctatgcaaaaaaccaacctggcggcagcgcaaaagatg

SEQ ID NO: 234865 - DNA, 103 bp, Artificial Sequence
  Synthetic Polynucleotide
taatacgactcactatagggaggggcccgttggcggcatgggggttttttaacagaggagaaaaaaaatgccatgccgcaacctggcggcagcgcaaaagatg

SEQ ID NO: 234866 - DNA, 103 bp, Artificial Sequence
  Synthetic Polynucleotide
taatacgactcactatagggtgttcctatcaggggcccgttggcggcatgaacagaggagacatgccatgaacgggcccaacctggcggcagcgcaaaagatg

SEQ ID NO: 234867 - DNA, 103 bp, Artificial Sequence
  Synthetic Polynucleotide
taatacgactcactatagggaaactggcactgttcctatcaggggcccgtaacagaggagaacgggcatgtgataggaaaacctggcggcagcgcaaaagatg

SEQ ID NO: 234868 - DNA, 103 bp, Artificial Sequence
  Synthetic Polynucleotide
taatacgactcactatagggccagctggcaaaactggcactgttcctatcaacagaggagagataggatgagtgccagtaacctggcggcagcgcaaaagatg

SEQ ID NO: 234869 - DNA, 103 bp, Artificial Sequence
  Synthetic Polynucleotide
taatacgactcactatagggctgtgctatgccagctggcaaaactggcacaacagaggagagtgccaatgttgccagctaacctggcggcagcgcaaaagatg

SEQ ID NO: 234870 - DNA, 103 bp, Artificial Sequence
  Synthetic Polynucleotide
taatacgactcactataggggcaaggtctcagcgggctgggcctccatgcaacagaggagagcatggatgcccagcccgaacctggcggcagcgcaaaagatg

SEQ ID NO: 234871 - DNA, 103 bp, Artificial Sequence
  Synthetic Polynucleotide
taatacgactcactataggggggagaggaactgtgctatgccagctggcaaacagaggagatgccagatggcatagcacaacctggcggcagcgcaaaagatg

SEQ ID NO: 234872 - DNA, 103 bp, Artificial Sequence
  Synthetic Polynucleotide
taatacgactcactatagggtgctgctggagggagaggaactgtgctatgaacagaggagacatagcatggttcctctcaacctggcggcagcgcaaaagatg

SEQ ID NO: 234873 - DNA, 103 bp, Artificial Sequence
  Synthetic Polynucleotide
taatacgactcactatagggcactgggggctgctgctggagggagaggaaaacagaggagattcctcatgctccagcagaacctggcggcagcgcaaaagatg

SEQ ID NO: 234874 - DNA, 103 bp, Artificial Sequence
  Synthetic Polynucleotide
taatacgactcactataggggttgggcatgcactgggggctgctgctggaaacagaggagatccagcatgagcccccagaacctggcggcagcgcaaaagatg

SEQ ID NO: 234875 - DNA, 103 bp, Artificial Sequence
  Synthetic Polynucleotide
taatacgactcactatagggtggacatggtgttgggcatgcactgggggcaacagaggagagcccccatggcatgcccaaacctggcggcagcgcaaaagatg

SEQ ID NO: 234876 - DNA, 103 bp, Artificial Sequence
  Synthetic Polynucleotide
taatacgactcactatagggcagtggctggtggacatggtgttgggcatgaacagaggagacatgccatgcaccatgtcaacctggcggcagcgcaaaagatg

SEQ ID NO: 234877 - DNA, 103 bp, Artificial Sequence
  Synthetic Polynucleotide
taatacgactcactatagggtggccgtgggcagtggctggtggacatggtaacagaggagaaccatgatgaccagccacaacctggcggcagcgcaaaagatg

SEQ ID NO: 234878 - DNA, 103 bp, Artificial Sequence
  Synthetic Polynucleotide
taatacgactcactatagggggaagggccttggccgtgggcagtggctggaacagaggagaccagccatggcccacggcaacctggcggcagcgcaaaagatg

SEQ ID NO: 234879 - DNA, 103 bp, Artificial Sequence
  Synthetic Polynucleotide
taatacgactcactatagggcatcactttgggaagggccttggccgtgggaacagaggagacccacgatgaaggcccttaacctggcggcagcgcaaaagatg

SEQ ID NO: 234880 - DNA, 103 bp, Artificial Sequence
  Synthetic Polynucleotide
taatacgactcactatagggtcagggggatcatcactttgggaagggcctaacagaggagaaggcccatgccaaagtgaaacctggcggcagcgcaaaagatg

SEQ ID NO: 234881 - DNA, 103 bp, Artificial Sequence
  Synthetic Polynucleotide
taatacgactcactatagggggtccttcaggcaaggtctcagcgggctggaacagaggagaccagccatgtgagaccttaacctggcggcagcgcaaaagatg

SEQ ID NO: 234882 - DNA, 103 bp, Artificial Sequence
  Synthetic Polynucleotide
taatacgactcactatagggggaatgctgctcagggggatcatcactttgaacagaggagacaaagtatggatccccctaacctggcggcagcgcaaaagatg

SEQ ID NO: 234883 - DNA, 103 bp, Artificial Sequence
  Synthetic Polynucleotide
taatacgactcactatagggattgtacgttggaatgctgctcagggggataacagaggagaatccccatgagcagcattaacctggcggcagcgcaaaagatg

SEQ ID NO: 234884 - DNA, 103 bp, Artificial Sequence
  Synthetic Polynucleotide
taatacgactcactatagggccatggctgcattgtacgttggaatgctgcaacagaggagagcagcaatgcaacgtacaaacctggcggcagcgcaaaagatg

SEQ ID NO: 234885 - DNA, 103 bp, Artificial Sequence
  Synthetic Polynucleotide
taatacgactcactatagggctgttagagtccatggctgcattgtacgttaacagaggagaaacgtaatgtgcagccataacctggcggcagcgcaaaagatg

SEQ ID NO: 234886 - DNA, 103 bp, Artificial Sequence
  Synthetic Polynucleotide
taatacgactcactatagggcttcaggaagctgttagagtccatggctgcaacagaggagagcagccatggactctaacaacctggcggcagcgcaaaagatg

SEQ ID NO: 234887 - DNA, 103 bp, Artificial Sequence
  Synthetic Polynucleotide
taatacgactcactatagggggaaggagttcttcaggaagctgttagagtaacagaggagaactctaatggcttcctgaaacctggcggcagcgcaaaagatg

SEQ ID NO: 234888 - DNA, 103 bp, Artificial Sequence
  Synthetic Polynucleotide
taatacgactcactataggggggaacttgtggaaggagttcttcaggaagaacagaggagacttcctatggaactccttaacctggcggcagcgcaaaagatg

SEQ ID NO: 234889 - DNA, 103 bp, Artificial Sequence
  Synthetic Polynucleotide
taatacgactcactatagggggtggggtaggggaacttgtggaaggagttaacagaggagaaactccatgcacaagttcaacctggcggcagcgcaaaagatg

SEQ ID NO: 234890 - DNA, 103 bp, Artificial Sequence
  Synthetic Polynucleotide
taatacgactcactataggggctcggctttggtggggtaggggaacttgtaacagaggagaacaagtatgcctaccccaaacctggcggcagcgcaaaagatg

SEQ ID NO: 234891 - DNA, 103 bp, Artificial Sequence
  Synthetic Polynucleotide
taatacgactcactatagggaaatagcagagctcggctttggtggggtagaacagaggagactacccatgcaaagccgaaacctggcggcagcgcaaaagatg

SEQ ID NO: 234892 - DNA, 103 bp, Artificial Sequence
  Synthetic Polynucleotide
taatacgactcactatagggtgggtactgggggccggcgtccaggagcataacagaggagaatgctcatggacgccggcaacctggcggcagcgcaaaagatg

SEQ ID NO: 234893 - DNA, 103 bp, Artificial Sequence
  Synthetic Polynucleotide
taatacgactcactataggggaacgggttgatgcccaggcccacgtctcgaacagaggagacgagacatgggcctgggcaacctggcggcagcgcaaaagatg

SEQ ID NO: 234894 - DNA, 103 bp, Artificial Sequence
  Synthetic Polynucleotide
taatacgactcactataggggtcacagccctcaaactcgcacttgaagggaacagaggagacccttcatgtgcgagtttaacctggcggcagcgcaaaagatg

SEQ ID NO: 234895 - DNA, 103 bp, Artificial Sequence
  Synthetic Polynucleotide
taatacgactcactatagggcgaagcgccggtcacagccctcaaactcgcaacagaggagagcgagtatgagggctgtgaacctggcggcagcgcaaaagatg

SEQ ID NO: 234896 - DNA, 103 bp, Artificial Sequence
  Synthetic Polynucleotide
taatacgactcactatagggctgctgttagcgaagcgccggtcacagcccaacagaggagagggctgatgccggcgcttaacctggcggcagcgcaaaagatg

SEQ ID NO: 234897 - DNA, 103 bp, Artificial Sequence
  Synthetic Polynucleotide
taatacgactcactatagggcttgcggtcgctgctgttagcgaagcgccgaacagaggagacggcgcatggctaacagcaacctggcggcagcgcaaaagatg

SEQ ID NO: 234898 - DNA, 103 bp, Artificial Sequence
  Synthetic Polynucleotide
taatacgactcactataggggcatgtgcttcttgcggtcgctgctgttagaacagaggagactaacaatggcgaccgcaaacctggcggcagcgcaaaagatg

SEQ ID NO: 234899 - DNA, 103 bp, Artificial Sequence
  Synthetic Polynucleotide
taatacgactcactataggggtgtgcacgtgcatgtgcttcttgcggtcgaacagaggagacgaccgatggaagcacataacctggcggcagcgcaaaagatg

SEQ ID NO: 234900 - DNA, 103 bp, Artificial Sequence
  Synthetic Polynucleotide
taatacgactcactatagggcttgtcgctcgtgtgcacgtgcatgtgcttaacagaggagaaagcacatgcacgtgcacaacctggcggcagcgcaaaagatg

SEQ ID NO: 234901 - DNA, 103 bp, Artificial Sequence
  Synthetic Polynucleotide
taatacgactcactatagggaaagatagggcttgtcgctcgtgtgcacgtaacagaggagaacgtgcatgcgagcgacaaacctggcggcagcgcaaaagatg

SEQ ID NO: 234902 - DNA, 103 bp, Artificial Sequence
  Synthetic Polynucleotide
taatacgactcactatagggcacatcttgcaaagatagggcttgtcgctcaacagaggagagagcgaatggccctatctaacctggcggcagcgcaaaagatg

SEQ ID NO: 234903 - DNA, 103 bp, Artificial Sequence
  Synthetic Polynucleotide
taatacgactcactatagggggacttgtcgcacatcttgcaaagatagggaacagaggagaccctatatgtgcaagatgaacctggcggcagcgcaaaagatg

SEQ ID NO: 234904 - DNA, 103 bp, Artificial Sequence
  Synthetic Polynucleotide
taatacgactcactatagggtgccgtcggcgaacgggttgatgcccaggcaacagaggagagcctggatgtcaacccgtaacctggcggcagcgcaaaagatg

SEQ ID NO: 234905 - DNA, 103 bp, Artificial Sequence
  Synthetic Polynucleotide
taatacgactcactataggggatgcgtgtaggacttgtcgcacatcttgcaacagaggagagcaagaatggcgacaagtaacctggcggcagcgcaaaagatg

SEQ ID NO: 234906 - DNA, 103 bp, Artificial Sequence
  Synthetic Polynucleotide
taatacgactcactatagggagcgaactgggatgcgtgtaggacttgtcgaacagaggagacgacaaatgctacacgcaaacctggcggcagcgcaaaagatg

SEQ ID NO: 234907 - DNA, 103 bp, Artificial Sequence
  Synthetic Polynucleotide
taatacgactcactataggggtgtttgcgcagcgaactgggatgcgtgtaaacagaggagatacacgatgcccagttcgaacctggcggcagcgcaaaagatg

SEQ ID NO: 234908 - DNA, 103 bp, Artificial Sequence
  Synthetic Polynucleotide
taatacgactcactatagggggaccttcatgtgtttgcgcagcgaactggaacagaggagaccagttatgtgcgcaaacaacctggcggcagcgcaaaagatg

SEQ ID NO: 234909 - DNA, 103 bp, Artificial Sequence
  Synthetic Polynucleotide
taatacgactcactataggggaggattcgtggaccttcatgtgtttgcgcaacagaggagagcgcaaatgcatgaaggtaacctggcggcagcgcaaaagatg

SEQ ID NO: 234910 - DNA, 103 bp, Artificial Sequence
  Synthetic Polynucleotide
taatacgactcactataggggccctgcgaggaggattcgtggaccttcataacagaggagaatgaagatgcacgaatccaacctggcggcagcgcaaaagatg

SEQ ID NO: 234911 - DNA, 103 bp, Artificial Sequence
  Synthetic Polynucleotide
taatacgactcactatagggaaggctgcgagccctgcgaggaggattcgtaacagaggagaacgaatatgcctcgcaggaacctggcggcagcgcaaaagatg

SEQ ID NO: 234912 - DNA, 103 bp, Artificial Sequence
  Synthetic Polynucleotide
taatacgactcactataggggcggccggcgaaggctgcgagccctgcgagaacagaggagactcgcaatgctcgcagccaacctggcggcagcgcaaaagatg

SEQ ID NO: 234913 - DNA, 103 bp, Artificial Sequence
  Synthetic Polynucleotide
taatacgactcactataggggccagagctggcggccggcgaaggctgcgaaacagaggagatcgcagatgtcgccggccaacctggcggcagcgcaaaagatg

SEQ ID NO: 234914 - DNA, 103 bp, Artificial Sequence
  Synthetic Polynucleotide
taatacgactcactatagggaggattcgtagccagagctggcggccggcgaacagaggagacgccggatgccagctctgaacctggcggcagcgcaaaagatg

SEQ ID NO: 234915 - DNA, 103 bp, Artificial Sequence
  Synthetic Polynucleotide
taatacgactcactatagggaaggcgcccatgccgtcggcgaacgggttgaacagaggagacaacccatgcgccgacggaacctggcggcagcgcaaaagatg

SEQ ID NO: 234916 - DNA, 103 bp, Artificial Sequence
  Synthetic Polynucleotide
taatacgactcactatagggggaggcgtggaggattcgtagccagagctgaacagaggagacagctcatgctacgaatcaacctggcggcagcgcaaaagatg

SEQ ID NO: 234917 - DNA, 103 bp, Artificial Sequence
  Synthetic Polynucleotide
taatacgactcactatagggcacgatggtgggaggcgtggaggattcgtaaacagaggagatacgaaatgtccacgcctaacctggcggcagcgcaaaagatg

SEQ ID NO: 234918 - DNA, 103 bp, Artificial Sequence
  Synthetic Polynucleotide
taatacgactcactatagggtggagggagacacgatggtgggaggcgtggaacagaggagaccacgcatgccaccatcgaacctggcggcagcgcaaaagatg

SEQ ID NO: 234919 - DNA, 103 bp, Artificial Sequence
  Synthetic Polynucleotide
taatacgactcactataggggggttgtctgtggagggagacacgatggtgaacagaggagacaccatatggtctccctcaacctggcggcagcgcaaaagatg

SEQ ID NO: 234920 - DNA, 103 bp, Artificial Sequence
  Synthetic Polynucleotide
taatacgactcactataggggcttgtggtcgggttgtctgtggagggagaaacagaggagatctcccatgacagacaacaacctggcggcagcgcaaaagatg

SEQ ID NO: 234921 - DNA, 103 bp, Artificial Sequence
  Synthetic Polynucleotide
taatacgactcactataggggcgataaggagcttgtggtcgggttgtctgaacagaggagacagacaatgcgaccacaaaacctggcggcagcgcaaaagatg

SEQ ID NO: 234922 - DNA, 103 bp, Artificial Sequence
  Synthetic Polynucleotide
taatacgactcactataggggaggaggagggcgataaggagcttgtggtcaacagaggagagaccacatgctccttatcaacctggcggcagcgcaaaagatg

SEQ ID NO: 234923 - DNA, 103 bp, Artificial Sequence
  Synthetic Polynucleotide
taatacgactcactataggggtggactgcggaggaggagggcgataaggaaacagaggagatccttaatgccctcctccaacctggcggcagcgcaaaagatg

SEQ ID NO: 234924 - DNA, 103 bp, Artificial Sequence
  Synthetic Polynucleotide
taatacgactcactatagggcggctgtgtggtggactgcggaggaggaggaacagaggagacctcctatgccgcagtccaacctggcggcagcgcaaaagatg

SEQ ID NO: 234925 - DNA, 103 bp, Artificial Sequence
  Synthetic Polynucleotide
taatacgactcactataggggcactgtggccggctgtgtggtggactgcgaacagaggagacgcagtatgccacacagcaacctggcggcagcgcaaaagatg

SEQ ID NO: 234926 - DNA, 103 bp, Artificial Sequence
  Synthetic Polynucleotide
taatacgactcactataggggttgagcttgaaggcgcccatgccgtcggcaacagaggagagccgacatgatgggcgccaacctggcggcagcgcaaaagatg

SEQ ID NO: 234927 - DNA, 103 bp, Artificial Sequence
  Synthetic Polynucleotide
taatacgactcactatagggggaagagagcgcactgtggccggctgtgtgaacagaggagacacacaatgggccacagtaacctggcggcagcgcaaaagatg

SEQ ID NO: 234928 - DNA, 103 bp, Artificial Sequence
  Synthetic Polynucleotide
taatacgactcactatagggcgttaaaattggaagagagcgcactgtggcaacagaggagagccacaatgcgctctcttaacctggcggcagcgcaaaagatg

SEQ ID NO: 234929 - DNA, 103 bp, Artificial Sequence
  Synthetic Polynucleotide
taatacgactcactatagggacgtaccattcgttaaaattggaagagagcaacagaggagagctctcatgcaattttaaaacctggcggcagcgcaaaagatg

SEQ ID NO: 234930 - DNA, 103 bp, Artificial Sequence
  Synthetic Polynucleotide
taatacgactcactataggggcgaactggggttgagcttgaaggcgcccaaacagaggagatgggcgatgtcaagctcaaacctggcggcagcgcaaaagatg

SEQ ID NO: 234931 - DNA, 103 bp, Artificial Sequence
  Synthetic Polynucleotide
taatacgactcactataggggccagctcgtgcgaactggggttgagcttgaacagaggagacaagctatgccccagttcaacctggcggcagcgcaaaagatg

SEQ ID NO: 234932 - DNA, 103 bp, Artificial Sequence
  Synthetic Polynucleotide
taatacgactcactataggggccggccgaagccagctcgtgcgaactgggaacagaggagacccagtatgcacgagctgaacctggcggcagcgcaaaagatg

SEQ ID NO: 234933 - DNA, 103 bp, Artificial Sequence
  Synthetic Polynucleotide
taatacgactcactatagggaggccgtctggccggccgaagccagctcgtaacagaggagaacgagcatgcttcggccgaacctggcggcagcgcaaaagatg

SEQ ID NO: 234934 - DNA, 103 bp, Artificial Sequence
  Synthetic Polynucleotide
taatacgactcactatagggtgcgacgtgaaggccgtctggccggccgaaaacagaggagattcggcatgccagacggcaacctggcggcagcgcaaaagatg

SEQ ID NO: 234935 - DNA, 103 bp, Artificial Sequence
  Synthetic Polynucleotide
taatacgactcactataggggcctggcgcctgcgacgtgaaggccgtctgaacagaggagacagacgatgttcacgtcgaacctggcggcagcgcaaaagatg

SEQ ID NO: 234936 - DNA, 103 bp, Artificial Sequence
  Synthetic Polynucleotide
taatacgactcactatagggcgccgatcgctgggtactgggggccggcgtaacagaggagaacgccgatgcccagtaccaacctggcggcagcgcaaaagatg

SEQ ID NO: 234937 - DNA, 103 bp, Artificial Sequence
  Synthetic Polynucleotide
taatacgactcactatagggcagccgcgtagcctggcgcctgcgacgtgaaacagaggagatcacgtatgaggcgccagaacctggcggcagcgcaaaagatg

SEQ ID NO: 234938 - DNA, 103 bp, Artificial Sequence
  Synthetic Polynucleotide
taatacgactcactatagggagggccgcagcagccgcgtagcctggcgccaacagaggagaggcgccatgctacgcggcaacctggcggcagcgcaaaagatg

SEQ ID NO: 234939 - DNA, 103 bp, Artificial Sequence
  Synthetic Polynucleotide
taatacgactcactataggggtgatggcccagggccgcagcagccgcgtaaacagaggagatacgcgatggctgcggccaacctggcggcagcgcaaaagatg

SEQ ID NO: 234940 - DNA, 103 bp, Artificial Sequence
  Synthetic Polynucleotide
taatacgactcactatagggccgggtgatggtgatggcccagggccgcagaacagaggagactgcggatgtgggccatcaacctggcggcagcgcaaaagatg

SEQ ID NO: 234941 - DNA, 103 bp, Artificial Sequence
  Synthetic Polynucleotide
taatacgactcactatagggccgacgtggcccgggtgatggtgatggcccaacagaggagagggccaatgccatcacccaacctggcggcagcgcaaaagatg

SEQ ID NO: 234942 - DNA, 103 bp, Artificial Sequence
  Synthetic Polynucleotide
taatacgactcactatagggggaataggagccgacgtggcccgggtgatgaacagaggagacatcacatgggccacgtcaacctggcggcagcgcaaaagatg

SEQ ID NO: 234943 - DNA, 103 bp, Artificial Sequence
  Synthetic Polynucleotide
taatacgactcactatagggaggctgcgctggaataggagccgacgtggcaacagaggagagccacgatggctcctattaacctggcggcagcgcaaaagatg

SEQ ID NO: 234944 - DNA, 103 bp, Artificial Sequence
  Synthetic Polynucleotide
taatacgactcactataggggtggagttgaaggctgcgctggaataggagaacagaggagactcctaatgcagcgcagcaacctggcggcagcgcaaaagatg

SEQ ID NO: 234945 - DNA, 103 bp, Artificial Sequence
  Synthetic Polynucleotide
taatacgactcactatagggaaagtcccgcgtggagttgaaggctgcgctaacagaggagaagcgcaatgttcaactccaacctggcggcagcgcaaaagatg

SEQ ID NO: 234946 - DNA, 103 bp, Artificial Sequence
  Synthetic Polynucleotide
taatacgactcactatagggtgcggaacagaaagtcccgcgtggagttgaaacagaggagatcaactatgcgcgggactaacctggcggcagcgcaaaagatg

SEQ ID NO: 234947 - DNA, 103 bp, Artificial Sequence
  Synthetic Polynucleotide
taatacgactcactatagggaaggtggtcacgccgatcgctgggtactggaacagaggagaccagtaatgagcgatcggaacctggcggcagcgcaaaagatg

SEQ ID NO: 234948 - DNA, 103 bp, Artificial Sequence
  Synthetic Polynucleotide
taatacgactcactatagggaaaccccggttgcggaacagaaagtcccgcaacagaggagagcgggaatgtctgttccgaacctggcggcagcgcaaaagatg

SEQ ID NO: 234949 - DNA, 103 bp, Artificial Sequence
  Synthetic Polynucleotide
taatacgactcactatagggcgcgtcgccaaaaccccggttgcggaacagaacagaggagactgttcatgaaccggggtaacctggcggcagcgcaaaagatg

SEQ ID NO: 234950 - DNA, 103 bp, Artificial Sequence
  Synthetic Polynucleotide
taatacgactcactatagggctgccgccgccgcgtcgccaaaaccccggtaacagaggagaaccgggatgttggcgacgaacctggcggcagcgcaaaagatg

SEQ ID NO: 234951 - DNA, 103 bp, Artificial Sequence
  Synthetic Polynucleotide
taatacgactcactatagggtgtgcgctggctgccgccgccgcgtcgccaaacagaggagatggcgaatgggcggcggcaacctggcggcagcgcaaaagatg

SEQ ID NO: 234952 - DNA, 103 bp, Artificial Sequence
  Synthetic Polynucleotide
taatacgactcactataggggaggctgtgctgtgcgctggctgccgccgcaacagaggagagcggcgatggccagcgcaaacctggcggcagcgcaaaagatg

SEQ ID NO: 234953 - DNA, 103 bp, Artificial Sequence
  Synthetic Polynucleotide
taatacgactcactatagggatgcagcaaagaggctgtgctgtgcgctggaacagaggagaccagcgatgagcacagccaacctggcggcagcgcaaaagatg

SEQ ID NO: 234954 - DNA, 103 bp, Artificial Sequence
  Synthetic Polynucleotide
taatacgactcactatagggcccccggccgatgcagcaaagaggctgtgcaacagaggagagcacagatgctttgctgcaacctggcggcagcgcaaaagatg

SEQ ID NO: 234955 - DNA, 103 bp, Artificial Sequence
  Synthetic Polynucleotide
taatacgactcactataggggcccccgaagcccccggccgatgcagcaaaaacagaggagatttgctatgtcggccgggaacctggcggcagcgcaaaagatg

SEQ ID NO: 234956 - DNA, 103 bp, Artificial Sequence
  Synthetic Polynucleotide
taatacgactcactatagggggccgtgtgggcccccgaagcccccggccgaacagaggagacggccgatggcttcggggaacctggcggcagcgcaaaagatg

SEQ ID NO: 234957 - DNA, 103 bp, Artificial Sequence
  Synthetic Polynucleotide
taatacgactcactataggggcgtccgtgtggccgtgtgggcccccgaagaacagaggagacttcggatgcccacacggaacctggcggcagcgcaaaagatg

SEQ ID NO: 234958 - DNA, 103 bp, Artificial Sequence
  Synthetic Polynucleotide
taatacgactcactatagggggacgcgccaaaggtggtcacgccgatcgcaacagaggagagcgatcatggtgaccaccaacctggcggcagcgcaaaagatg

SEQ ID NO: 234959 - DNA, 103 bp, Artificial Sequence
  Synthetic Polynucleotide
taatacgactcactataggggtggcccgcggcgtccgtgtggccgtgtggaacagaggagaccacacatgcacacggacaacctggcggcagcgcaaaagatg

SEQ ID NO: 234960 - DNA, 103 bp, Artificial Sequence
  Synthetic Polynucleotide
taatacgactcactatagggggaagaggaggtggcccgcggcgtccgtgtaacagaggagaacacggatgccgcgggccaacctggcggcagcgcaaaagatg

SEQ ID NO: 234961 - DNA, 103 bp, Artificial Sequence
  Synthetic Polynucleotide
taatacgactcactatagggtgaagcccggggaagaggaggtggcccgcgaacagaggagacgcgggatgcctcctcttaacctggcggcagcgcaaaagatg

SEQ ID NO: 234962 - DNA, 103 bp, Artificial Sequence
  Synthetic Polynucleotide
taatacgactcactatagggagcctgctcgtgaagcccggggaagaggagaacagaggagactcctcatgcccgggcttaacctggcggcagcgcaaaagatg

SEQ ID NO: 234963 - DNA, 103 bp, Artificial Sequence
  Synthetic Polynucleotide
taatacgactcactatagggcgtggccggcagcctgctcgtgaagcccggaacagaggagaccgggcatgacgagcaggaacctggcggcagcgcaaaagatg

SEQ ID NO: 234964 - DNA, 103 bp, Artificial Sequence
  Synthetic Polynucleotide
taatacgactcactatagggttaggcgacgcgtggccggcagcctgctcgaacagaggagacgagcaatgtgccggccaaacctggcggcagcgcaaaagatg

SEQ ID NO: 234965 - DNA, 103 bp, Artificial Sequence
  Synthetic Polynucleotide
taatacgactcactataggggttgaccacgttaggcgacgcgtggccggcaacagaggagagccggcatggcgtcgcctaacctggcggcagcgcaaaagatg

SEQ ID NO: 234966 - DNA, 103 bp, Artificial Sequence
  Synthetic Polynucleotide
taatacgactcactatagggtcatctgcccgttgaccacgttaggcgacgaacagaggagacgtcgcatgacgtggtcaaacctggcggcagcgcaaaagatg

SEQ ID NO: 234967 - DNA, 103 bp, Artificial Sequence
  Synthetic Polynucleotide
taatacgactcactatagggaagccgagcctcatctgcccgttgaccacgaacagaggagacgtggtatgcgggcagataacctggcggcagcgcaaaagatg

SEQ ID NO: 234968 - DNA, 103 bp, Artificial Sequence
  Synthetic Polynucleotide
taatacgactcactataggggtcccccgagaagccgagcctcatctgcccaacagaggagagggcagatgaggctcggcaacctggcggcagcgcaaaagatg

SEQ ID NO: 234969 - DNA, 103 bp, Artificial Sequence
  Synthetic Polynucleotide
taatacgactcactatagggagtggtggcgggacgcgccaaaggtggtcaaacagaggagatgaccaatgttggcgcgtaacctggcggcagcgcaaaagatg

SEQ ID NO: 234970 - DNA, 103 bp, Artificial Sequence
  Synthetic Polynucleotide
taatacgactcactataggggcgggtacatgtcccccgagaagccgagccaacagaggagaggctcgatgtctcgggggaacctggcggcagcgcaaaagatg

SEQ ID NO: 234971 - DNA, 103 bp, Artificial Sequence
  Synthetic Polynucleotide
taatacgactcactatagggtgctccggtcgcgggtacatgtcccccgagaacagaggagactcgggatgcatgtacccaacctggcggcagcgcaaaagatg

SEQ ID NO: 234972 - DNA, 103 bp, Artificial Sequence
  Synthetic Polynucleotide
taatacgactcactatagggctggccgtactgctccggtcgcgggtacataacagaggagaatgtacatgcgaccggagaacctggcggcagcgcaaaagatg

SEQ ID NO: 234973 - DNA, 103 bp, Artificial Sequence
  Synthetic Polynucleotide
taatacgactcactatagggggctggtcacctggccgtactgctccggtcaacagaggagagaccggatgagtacggccaacctggcggcagcgcaaaagatg

SEQ ID NO: 234974 - DNA, 103 bp, Artificial Sequence
  Synthetic Polynucleotide
taatacgactcactatagggtccgaacgcgggctggtcacctggccgtacaacagaggagagtacggatgggtgaccagaacctggcggcagcgcaaaagatg

SEQ ID NO: 234975 - DNA, 103 bp, Artificial Sequence
  Synthetic Polynucleotide
taatacgactcactatagggagcatagtgctccgaacgcgggctggtcacaacagaggagagtgaccatgccgcgttcgaacctggcggcagcgcaaaagatg

SEQ ID NO: 234976 - DNA, 103 bp, Artificial Sequence
  Synthetic Polynucleotide
taatacgactcactataggggctgcggcgcagcatagtgctccgaacgcgaacagaggagacgcgttatgagcactatgaacctggcggcagcgcaaaagatg

SEQ ID NO: 234977 - DNA, 103 bp, Artificial Sequence
  Synthetic Polynucleotide
taatacgactcactatagggtagccgtgcagctgcggcgcagcatagtgcaacagaggagagcactaatgtgcgccgcaaacctggcggcagcgcaaaagatg

SEQ ID NO: 234978 - DNA, 103 bp, Artificial Sequence
  Synthetic Polynucleotide
taatacgactcactatagggcatgggcccgtagccgtgcagctgcggcgcaacagaggagagcgccgatgctgcacggcaacctggcggcagcgcaaaagatg

SEQ ID NO: 234979 - DNA, 103 bp, Artificial Sequence
  Synthetic Polynucleotide
taatacgactcactatagggtgttcacgttcatgggcccgtagccgtgcaaacagaggagatgcacgatgacgggcccaaacctggcggcagcgcaaaagatg

SEQ ID NO: 234980 - DNA, 103 bp, Artificial Sequence
  Synthetic Polynucleotide
taatacgactcactatagggtcgcccgcggagtggtggcgggacgcgccaaacagaggagatggcgcatgccgccaccaaacctggcggcagcgcaaaagatg

SEQ ID NO: 234981 - DNA, 103 bp, Artificial Sequence
  Synthetic Polynucleotide
taatacgactcactatagggtgcgcggccatgttcacgttcatgggcccgaacagaggagacgggccatggaacgtgaaaacctggcggcagcgcaaaagatg

SEQ ID NO: 234982 - DNA, 103 bp, Artificial Sequence
  Synthetic Polynucleotide
taatacgactcactatagggggcgccgtgatgcgcggccatgttcacgttaacagaggagaaacgtgatgatggccgcgaacctggcggcagcgcaaaagatg

SEQ ID NO: 234983 - DNA, 103 bp, Artificial Sequence
  Synthetic Polynucleotide
taatacgactcactatagggagaaggcgccggcgccgtgatgcgcggccaaacagaggagatggccgatgatcacggcgaacctggcggcagcgcaaaagatg

SEQ ID NO: 234984 - DNA, 103 bp, Artificial Sequence
  Synthetic Polynucleotide
taatacgactcactatagggatgtagcggaagaaggcgccggcgccgtgaaacagaggagatcacggatgcggcgccttaacctggcggcagcgcaaaagatg

SEQ ID NO: 234985 - DNA, 103 bp, Artificial Sequence
  Synthetic Polynucleotide
taatacgactcactataggggggttggcgcatgtagcggaagaaggcgccaacagaggagaggcgccatgttccgctacaacctggcggcagcgcaaaagatg

SEQ ID NO: 234986 - DNA, 103 bp, Artificial Sequence
  Synthetic Polynucleotide
taatacgactcactatagggcttgcttgatgggttggcgcatgtagcggaaacagaggagatccgctatgtgcgccaacaacctggcggcagcgcaaaagatg

SEQ ID NO: 234987 - DNA, 103 bp, Artificial Sequence
  Synthetic Polynucleotide
taatacgactcactatagggcagatgagctcttgcttgatgggttggcgcaacagaggagagcgccaatgcatcaagcaaacctggcggcagcgcaaaagatg

SEQ ID NO: 234988 - DNA, 103 bp, Artificial Sequence
  Synthetic Polynucleotide
taatacgactcactataggggatccacttgcagatgagctcttgcttgataacagaggagaatcaagatggagctcatcaacctggcggcagcgcaaaagatg

SEQ ID NO: 234989 - DNA, 103 bp, Artificial Sequence
  Synthetic Polynucleotide
taatacgactcactataggggctcgggctcgatccacttgcagatgagctaacagaggagaagctcaatggcaagtggaaacctggcggcagcgcaaaagatg

SEQ ID NO: 234990 - DNA, 103 bp, Artificial Sequence
  Synthetic Polynucleotide
taatacgactcactatagggttggccagctgctcgggctcgatccacttgaacagaggagacaagtgatgcgagcccgaaacctggcggcagcgcaaaagatg

SEQ ID NO: 234991 - DNA, 103 bp, Artificial Sequence
  Synthetic Polynucleotide
taatacgactcactatagggttcggccacgtcgcccgcggagtggtggcgaacagaggagacgccacatgtccgcgggcaacctggcggcagcgcaaaagatg

SEQ ID NO: 234992 - DNA, 103 bp, Artificial Sequence
  Synthetic Polynucleotide
taatacgactcactatagggctttttggggttggccagctgctcgggctcaacagaggagagagcccatgcagctggccaacctggcggcagcgcaaaagatg

SEQ ID NO: 234993 - DNA, 103 bp, Artificial Sequence
  Synthetic Polynucleotide
taatacgactcactatagggtgttgcacgactttttggggttggccagctaacagaggagaagctggatgaccccaaaaaacctggcggcagcgcaaaagatg

SEQ ID NO: 234994 - DNA, 103 bp, Artificial Sequence
  Synthetic Polynucleotide
taatacgactcactatagggctgaaagttttgttgcacgactttttggggaacagaggagaccccaaatggtcgtgcaaaacctggcggcagcgcaaaagatg

SEQ ID NO: 234995 - DNA, 103 bp, Artificial Sequence
  Synthetic Polynucleotide
taatacgactcactataggggtgcatggtgctgaaagttttgttgcacgaaacagaggagatcgtgcatgaaaactttcaacctggcggcagcgcaaaagatg

SEQ ID NO: 234996 - DNA, 103 bp, Artificial Sequence
  Synthetic Polynucleotide
taatacgactcactatagggtaactagctcgtgcatggtgctgaaagtttaacagaggagaaaacttatggcaccatgcaacctggcggcagcgcaaaagatg

SEQ ID NO: 234997 - DNA, 103 bp, Artificial Sequence
  Synthetic Polynucleotide
taatacgactcactataggggtgacgtgcgtaactagctcgtgcatggtgaacagaggagacaccatatgcgagctagtaacctggcggcagcgcaaaagatg

SEQ ID NO: 234998 - DNA, 103 bp, Artificial Sequence
  Synthetic Polynucleotide
taatacgactcactataggggtgctccacggtgacgtgcgtaactagctcaacagaggagagagctaatgacgcacgtcaacctggcggcagcgcaaaagatg

SEQ ID NO: 234999 - DNA, 103 bp, Artificial Sequence
  Synthetic Polynucleotide
taatacgactcactatagggggccacctacgtgctccacggtgacgtgcgaacagaggagacgcacgatgccgtggagcaacctggcggcagcgcaaaagatg

SEQ ID NO: 235000 - DNA, 103 bp, Artificial Sequence
  Synthetic Polynucleotide
taatacgactcactatagggctctgctccgggccacctacgtgctccacgaacagaggagacgtggaatgcgtaggtggaacctggcggcagcgcaaaagatg

SEQ ID NO: 235001 - DNA, 103 bp, Artificial Sequence
  Synthetic Polynucleotide
taatacgactcactataggggatgtgattactctgctccgggccacctacaacagaggagagtaggtatgccggagcagaacctggcggcagcgcaaaagatg

SEQ ID NO: 235002 - DNA, 103 bp, Artificial Sequence
  Synthetic Polynucleotide
taatacgactcactatagggccacgtctcgttcggccacgtcgcccgcggaacagaggagaccgcggatgacgtggccgaacctggcggcagcgcaaaagatg

SEQ ID NO: 235003 - DNA, 103 bp, Artificial Sequence
  Synthetic Polynucleotide
taatacgactcactatagggcccagaagcagatgtgattactctgctccgaacagaggagacggagcatggtaatcacaaacctggcggcagcgcaaaagatg

SEQ ID NO: 235004 - DNA, 103 bp, Artificial Sequence
  Synthetic Polynucleotide
taatacgactcactatagggggacactcctcccagaagcagatgtgattaaacagaggagataatcaatgctgcttctgaacctggcggcagcgcaaaagatg

SEQ ID NO: 235005 - DNA, 103 bp, Artificial Sequence
  Synthetic Polynucleotide
taatacgactcactataggggccctcgcgcggacactcctcccagaagcaaacagaggagatgcttcatggaggagtgtaacctggcggcagcgcaaaagatg

SEQ ID NO: 235006 - DNA, 103 bp, Artificial Sequence
  Synthetic Polynucleotide
taatacgactcactatagggtgaagggcttgccctcgcgcggacactcctaacagaggagaaggagtatgcgcgcgaggaacctggcggcagcgcaaaagatg

SEQ ID NO: 235007 - DNA, 103 bp, Artificial Sequence
  Synthetic Polynucleotide
taatacgactcactatagggtatttggctttgaagggcttgccctcgcgcaacagaggagagcgcgaatgcaagcccttaacctggcggcagcgcaaaagatg

SEQ ID NO: 235008 - DNA, 103 bp, Artificial Sequence
  Synthetic Polynucleotide
taatacgactcactatagggaaccagtttgtatttggctttgaagggcttaacagaggagaaagcccatgaaagccaaaaacctggcggcagcgcaaaagatg

SEQ ID NO: 235009 - DNA, 103 bp, Artificial Sequence
  Synthetic Polynucleotide
taatacgactcactatagggggatgtggttaaccagtttgtatttggcttaacagaggagaaagccaatgacaaactggaacctggcggcagcgcaaaagatg

SEQ ID NO: 235010 - DNA, 103 bp, Artificial Sequence
  Synthetic Polynucleotide
taatacgactcactataggggtgtgcacgcggatgtggttaaccagtttgaacagaggagacaaactatgtaaccacataacctggcggcagcgcaaaagatg

SEQ ID NO: 235011 - DNA, 103 bp, Artificial Sequence
  Synthetic Polynucleotide
taatacgactcactatagggcttctcgcccgtgtgcacgcggatgtggttaacagaggagaaaccacatgcgcgtgcacaacctggcggcagcgcaaaagatg

SEQ ID NO: 235012 - DNA, 103 bp, Artificial Sequence
  Synthetic Polynucleotide
taatacgactcactatagggagggaaagggcttctcgcccgtgtgcacgcaacagaggagagcgtgcatgcgggcgagaaacctggcggcagcgcaaaagatg

SEQ ID NO: 235013 - DNA, 103 bp, Artificial Sequence
  Synthetic Polynucleotide
taatacgactcactatagggatgcccaggcccacgtctcgttcggccacgaacagaggagacgtggcatgacgagacgtaacctggcggcagcgcaaaagatg

SEQ ID NO: 235014 - DNA, 103 bp, Artificial Sequence
  Synthetic Polynucleotide
taatacgactcactataggggggaaggggcagggaaagggcttctcgcccaacagaggagagggcgaatggccctttccaacctggcggcagcgcaaaagatg

SEQ ID NO: 235015 - DNA, 103 bp, Artificial Sequence
  Synthetic Polynucleotide
taatacgactcactataggggccacagccagggaaggggcagggaaagggaacagaggagaccctttatgtgccccttcaacctggcggcagcgcaaaagatg

SEQ ID NO: 235016 - DNA, 103 bp, Artificial Sequence
  Synthetic Polynucleotide
taatacgactcactatagggcgaagaccttgccacagccagggaaggggcaacagaggagagcccctatgctggctgtgaacctggcggcagcgcaaaagatg

SEQ ID NO: 235017 - DNA, 103 bp, Artificial Sequence
  Synthetic Polynucleotide
taatacgactcactatagggtcggagcgcgcgaagaccttgccacagccaaacagaggagatggctgatgcaaggtcttaacctggcggcagcgcaaaagatg

SEQ ID NO: 235018 - DNA, 103 bp, Artificial Sequence
  Synthetic Polynucleotide
taatacgactcactatagggctttaaattctcggagcgcgcgaagaccttaacagaggagaaaggtcatggcgcgctccaacctggcggcagcgcaaaagatg

SEQ ID NO: 235019 - DNA, 103 bp, Artificial Sequence
  Synthetic Polynucleotide
taatacgactcactatagggttttgtggatctttaaattctcggagcgcgaacagaggagacgcgctatgagaatttaaaacctggcggcagcgcaaaagatg

SEQ ID NO: 235020 - DNA, 103 bp, Artificial Sequence
  Synthetic Polynucleotide
taatacgactcactataggggtgtgcgtccttttgtggatctttaaattcaacagaggagagaatttatggatccacaaaacctggcggcagcgcaaaagatg

SEQ ID NO: 235021 - DNA, 103 bp, Artificial Sequence
  Synthetic Polynucleotide
taatacgactcactatagggcttctcccctgtgtgcgtccttttgtggataacagaggagaatccacatgaggacgcacaacctggcggcagcgcaaaagatg

SEQ ID NO: 235022 - DNA, 103 bp, Artificial Sequence
  Synthetic Polynucleotide
taatacgactcactatagggacttgaagggcttctcccctgtgtgcgtccaacagaggagaggacgcatgcaggggagaaacctggcggcagcgcaaaagatg

SEQ ID NO: 235023 - DNA, 103 bp, Artificial Sequence
  Synthetic Polynucleotide
taatacgactcactatagggtcaaactcgcacttgaagggcttctcccctaacagaggagaaggggaatggcccttcaaaacctggcggcagcgcaaaagatg

SEQ ID NO: 235024 - DNA, 103 bp, Artificial Sequence
  Synthetic Polynucleotide
taatacgactcactatagggcgggaactgcggacccgcgtccaggagcataacagaggagaatgctcatggacgcgggtaacctggcggcagcgcaaaagatg

SEQ ID NO: 235025 - DNA, 103 bp, Artificial Sequence
  Synthetic Polynucleotide
taatacgactcactatagggcagttcacggtcctgcatctcggcggcagcaacagaggagagctgccatggagatgcagaacctggcggcagcgcaaaagatg

SEQ ID NO: 235026 - DNA, 103 bp, Artificial Sequence
  Synthetic Polynucleotide
taatacgactcactatagggacagcccgggaaggggcaggggaagggtttaacagaggagaaaacccatgccctgccccaacctggcggcagcgcaaaagatg

SEQ ID NO: 235027 - DNA, 103 bp, Artificial Sequence
  Synthetic Polynucleotide
taatacgactcactatagggagactttgccacagcccgggaaggggcaggaacagaggagacctgccatgtcccgggctaacctggcggcagcgcaaaagatg

SEQ ID NO: 235028 - DNA, 103 bp, Artificial Sequence
  Synthetic Polynucleotide
taatacgactcactataggggagcgcgcgaagactttgccacagcccgggaacagaggagacccgggatgtggcaaagtaacctggcggcagcgcaaaagatg

SEQ ID NO: 235029 - DNA, 103 bp, Artificial Sequence
  Synthetic Polynucleotide
taatacgactcactataggggaggttctcggagcgcgcgaagactttgccaacagaggagaggcaaaatgttcgcgcgcaacctggcggcagcgcaaaagatg

SEQ ID NO: 235030 - DNA, 103 bp, Artificial Sequence
  Synthetic Polynucleotide
taatacgactcactatagggtgtggatcttgaggttctcggagcgcgcgaaacagaggagatcgcgcatgccgagaaccaacctggcggcagcgcaaaagatg

SEQ ID NO: 235031 - DNA, 103 bp, Artificial Sequence
  Synthetic Polynucleotide
taatacgactcactatagggtgggtccttttgtggatcttgaggttctcgaacagaggagacgagaaatgcaagatccaaacctggcggcagcgcaaaagatg

SEQ ID NO: 235032 - DNA, 103 bp, Artificial Sequence
  Synthetic Polynucleotide
taatacgactcactatagggctcccctgtgtgggtccttttgtggatcttaacagaggagaaagatcatgaaaaggaccaacctggcggcagcgcaaaagatg

SEQ ID NO: 235033 - DNA, 103 bp, Artificial Sequence
  Synthetic Polynucleotide
taatacgactcactatagggggaacggcttctcccctgtgtgggtcctttaacagaggagaaaaggaatgacacaggggaacctggcggcagcgcaaaagatg

SEQ ID NO: 235034 - DNA, 103 bp, Artificial Sequence
  Synthetic Polynucleotide
taatacgactcactatagggaactcacactggaacggcttctcccctgtgaacagaggagacacaggatggaagccgttaacctggcggcagcgcaaaagatg

SEQ ID NO: 235035 - DNA, 103 bp, Artificial Sequence
  Synthetic Polynucleotide
taatacgactcactataggggcagccctcaaactcacactggaacggcttaacagaggagaaagccgatgcagtgtgagaacctggcggcagcgcaaaagatg

SEQ ID NO: 235036 - DNA, 103 bp, Artificial Sequence
  Synthetic Polynucleotide
taatacgactcactatagggccgccaggctcagttcacggtcctgcatctaacagaggagaagatgcatgaccgtgaacaacctggcggcagcgcaaaagatg

SEQ ID NO: 235037 - DNA, 103 bp, Artificial Sequence
  Synthetic Polynucleotide
taatacgactcactatagggagcgccggtcgcagccctcaaactcacactaacagaggagaagtgtgatgttgagggctaacctggcggcagcgcaaaagatg

SEQ ID NO: 235038 - DNA, 103 bp, Artificial Sequence
  Synthetic Polynucleotide
taatacgactcactatagggctgttggcgaagcgccggtcgcagccctcaaacagaggagatgagggatgcgaccggcgaacctggcggcagcgcaaaagatg

SEQ ID NO: 235039 - DNA, 103 bp, Artificial Sequence
  Synthetic Polynucleotide
taatacgactcactatagggcctgtcgctgctgttggcgaagcgccggtcaacagaggagagaccggatgttcgccaacaacctggcggcagcgcaaaagatg

SEQ ID NO: 235040 - DNA, 103 bp, Artificial Sequence
  Synthetic Polynucleotide
taatacgactcactatagggtgtgcttcttcctgtcgctgctgttggcgaaacagaggagatcgccaatggcagcgacaaacctggcggcagcgcaaaagatg

SEQ ID NO: 235041 - DNA, 103 bp, Artificial Sequence
  Synthetic Polynucleotide
taatacgactcactatagggtggacgtgcatgtgcttcttcctgtcgctgaacagaggagacagcgaatggaagaagcaaacctggcggcagcgcaaaagatg

SEQ ID NO: 235042 - DNA, 103 bp, Artificial Sequence
  Synthetic Polynucleotide
taatacgactcactatagggatcggaggtgtggacgtgcatgtgcttcttaacagaggagaaagaagatgatgcacgtcaacctggcggcagcgcaaaagatg

SEQ ID NO: 235043 - DNA, 103 bp, Artificial Sequence
  Synthetic Polynucleotide
taatacgactcactataggggatagggcttatcggaggtgtggacgtgcaaacagaggagatgcacgatgacacctccgaacctggcggcagcgcaaaagatg

SEQ ID NO: 235044 - DNA, 103 bp, Artificial Sequence
  Synthetic Polynucleotide
taatacgactcactatagggatcttgcagagatagggcttatcggaggtgaacagaggagacacctcatgtaagccctaaacctggcggcagcgcaaaagatg

SEQ ID NO: 235045 - DNA, 103 bp, Artificial Sequence
  Synthetic Polynucleotide
taatacgactcactatagggcttgtcgcacatcttgcagagatagggcttaacagaggagaaagcccatgctctgcaagaacctggcggcagcgcaaaagatg

SEQ ID NO: 235046 - DNA, 103 bp, Artificial Sequence
  Synthetic Polynucleotide
taatacgactcactataggggcgtgtaggacttgtcgcacatcttgcagaaacagaggagatctgcaatgtgtgcgacaaacctggcggcagcgcaaaagatg

SEQ ID NO: 235047 - DNA, 103 bp, Artificial Sequence
  Synthetic Polynucleotide
taatacgactcactatagggttctgcgccgccgccaggctcagttcacggaacagaggagaccgtgaatggagcctggcaacctggcggcagcgcaaaagatg

SEQ ID NO: 235048 - DNA, 103 bp, Artificial Sequence
  Synthetic Polynucleotide
taatacgactcactataggggagctggggtgcgtgtaggacttgtcgcacaacagaggagagtgcgaatggtcctacacaacctggcggcagcgcaaaagatg

SEQ ID NO: 235049 - DNA, 103 bp, Artificial Sequence
  Synthetic Polynucleotide
taatacgactcactatagggcttccgcagcgagctggggtgcgtgtaggaaacagaggagatcctacatgcaccccagcaacctggcggcagcgcaaaagatg

SEQ ID NO: 235050 - DNA, 103 bp, Artificial Sequence
  Synthetic Polynucleotide
taatacgactcactatagggccttcatgtgcttccgcagcgagctggggtaacagaggagaaccccaatgcgctgcggaaacctggcggcagcgcaaaagatg

SEQ ID NO: 235051 - DNA, 103 bp, Artificial Sequence
  Synthetic Polynucleotide
taatacgactcactataggggactcatggaccttcatgtgcttccgcagcaacagaggagagctgcgatggcacatgaaaacctggcggcagcgcaaaagatg

SEQ ID NO: 235052 - DNA, 103 bp, Artificial Sequence
  Synthetic Polynucleotide
taatacgactcactatagggctgcggggaggactcatggaccttcatgtgaacagaggagacacatgatggtccatgagaacctggcggcagcgcaaaagatg

SEQ ID NO: 235053 - DNA, 103 bp, Artificial Sequence
  Synthetic Polynucleotide
taatacgactcactatagggattcagagccctgcggggaggactcatggaaacagaggagatccatgatgcctccccgcaacctggcggcagcgcaaaagatg

SEQ ID NO: 235054 - DNA, 103 bp, Artificial Sequence
  Synthetic Polynucleotide
taatacgactcactataggggccggggaggattcagagccctgcggggagaacagaggagactccccatggggctctgaaacctggcggcagcgcaaaagatg

SEQ ID NO: 235055 - DNA, 103 bp, Artificial Sequence
  Synthetic Polynucleotide
taatacgactcactatagggggagctggcggccggggaggattcagagccaacagaggagaggctctatgtcctccccgaacctggcggcagcgcaaaagatg

SEQ ID NO: 235056 - DNA, 103 bp, Artificial Sequence
  Synthetic Polynucleotide
taatacgactcactatagggactcatagccggagctggcggccggggaggaacagaggagacctcccatgccgccagctaacctggcggcagcgcaaaagatg

SEQ ID NO: 235057 - DNA, 103 bp, Artificial Sequence
  Synthetic Polynucleotide
taatacgactcactatagggggcgtggacgactcatagccggagctggcgaacagaggagacgccagatgcggctatgaaacctggcggcagcgcaaaagatg

SEQ ID NO: 235058 - DNA, 103 bp, Artificial Sequence
  Synthetic Polynucleotide
taatacgactcactatagggaacgaagccgttctgcgccgccgccaggctaacagaggagaagcctgatggcggcgcagaacctggcggcagcgcaaaagatg

SEQ ID NO: 235059 - DNA, 103 bp, Artificial Sequence
  Synthetic Polynucleotide
taatacgactcactatagggcagccccgggggcgtggacgactcatagccaacagaggagaggctatatgtcgtccacgaacctggcggcagcgcaaaagatg

SEQ ID NO: 235060 - DNA, 103 bp, Artificial Sequence
  Synthetic Polynucleotide
taatacgactcactatagggtgggggacaccagccccgggggcgtggacgaacagaggagacgtccaatgccccggggcaacctggcggcagcgcaaaagatg

SEQ ID NO: 235061 - DNA, 103 bp, Artificial Sequence
  Synthetic Polynucleotide
taatacgactcactatagggggctcggcgctgggggacaccagccccgggaacagaggagacccgggatgggtgtccccaacctggcggcagcgcaaaagatg

SEQ ID NO: 235062 - DNA, 103 bp, Artificial Sequence
  Synthetic Polynucleotide
taatacgactcactataggggctgctctggggctcggcgctgggggacacaacagaggagagtgtccatgagcgccgagaacctggcggcagcgcaaaagatg

SEQ ID NO: 235063 - DNA, 103 bp, Artificial Sequence
  Synthetic Polynucleotide
taatacgactcactatagggacaggttggagctgctctggggctcggcgcaacagaggagagcgccgatgcccagagcaaacctggcggcagcgcaaaagatg

SEQ ID NO: 235064 - DNA, 103 bp, Artificial Sequence
  Synthetic Polynucleotide
taatacgactcactataggggccgctggggacaggttggagctgctctggaacagaggagaccagagatgctccaacctaacctggcggcagcgcaaaagatg

SEQ ID NO: 235065 - DNA, 103 bp, Artificial Sequence
  Synthetic Polynucleotide
taatacgactcactatagggcgctgccgccgccgctggggacaggttggaaacagaggagatccaacatgtccccagcgaacctggcggcagcgcaaaagatg

SEQ ID NO: 235066 - DNA, 103 bp, Artificial Sequence
  Synthetic Polynucleotide
taatacgactcactatagggccgccgccgccgctgccgccgccgctggggaacagaggagaccccagatgcggcggcagaacctggcggcagcgcaaaagatg

SEQ ID NO: 235067 - DNA, 103 bp, Artificial Sequence
  Synthetic Polynucleotide
taatacgactcactataggggccgccgcagccgccgccgccgctgccgccaacagaggagaggcggcatgggcggcggcaacctggcggcagcgcaaaagatg

SEQ ID NO: 235068 - DNA, 103 bp, Artificial Sequence
  Synthetic Polynucleotide
taatacgactcactatagggcgcggccgccgccgccgcagccgccgccgcaacagaggagagcggcgatggctgcggcgaacctggcggcagcgcaaaagatg

SEQ ID NO: 235069 - DNA, 103 bp, Artificial Sequence
  Synthetic Polynucleotide
taatacgactcactatagggcggcggagtcaacgaagccgttctgcgccgaacagaggagacggcgcatgacggcttcgaacctggcggcagcgcaaaagatg

SEQ ID NO: 235070 - DNA, 103 bp, Artificial Sequence
  Synthetic Polynucleotide
taatacgactcactatagggccgcggacaccgcggccgccgccgccgcagaacagaggagactgcggatgcggcggccgaacctggcggcagcgcaaaagatg

SEQ ID NO: 235071 - DNA, 103 bp, Artificial Sequence
  Synthetic Polynucleotide
taatacgactcactatagggccccggtgcaccgcggacaccgcggccgccaacagaggagaggcggcatgggtgtccgcaacctggcggcagcgcaaaagatg

SEQ ID NO: 235072 - DNA, 103 bp, Artificial Sequence
  Synthetic Polynucleotide
taatacgactcactatagggcgagcctccgccccggtgcaccgcggacacaacagaggagagtgtccatggtgcaccggaacctggcggcagcgcaaaagatg

SEQ ID NO: 235073 - DNA, 103 bp, Artificial Sequence
  Synthetic Polynucleotide
taatacgactcactatagggcgccactgcccgagcctccgccccggtgcaaacagaggagatgcaccatggcggaggctaacctggcggcagcgcaaaagatg

SEQ ID NO: 235074 - DNA, 103 bp, Artificial Sequence
  Synthetic Polynucleotide
taatacgactcactatagggcctcccgcgccgccactgcccgagcctccgaacagaggagacggaggatggggcagtggaacctggcggcagcgcaaaagatg

SEQ ID NO: 235075 - DNA, 103 bp, Artificial Sequence
  Synthetic Polynucleotide
taatacgactcactataggggcctgagccgcctcccgcgccgccactgccaacagaggagaggcagtatgggcgcgggaaacctggcggcagcgcaaaagatg

SEQ ID NO: 235076 - DNA, 103 bp, Artificial Sequence
  Synthetic Polynucleotide
taatacgactcactatagggcgctgccgccgcctgagccgcctcccgcgcaacagaggagagcgcggatggcggctcagaacctggcggcagcgcaaaagatg

SEQ ID NO: 235077 - DNA, 103 bp, Artificial Sequence
  Synthetic Polynucleotide
taatacgactcactatagggccgccactgccgctgccgccgcctgagccgaacagaggagacggctcatgcggcggcagaacctggcggcagcgcaaaagatg

SEQ ID NO: 235078 - DNA, 103 bp, Artificial Sequence
  Synthetic Polynucleotide
taatacgactcactataggggccgccgcccccgccactgccgctgccgccaacagaggagaggcggcatgggcagtggcaacctggcggcagcgcaaaagatg

SEQ ID NO: 235079 - DNA, 103 bp, Artificial Sequence
  Synthetic Polynucleotide
taatacgactcactatagggcgcccgccccgccgccgcccccgccactgcaacagaggagagcagtgatgggggcggcgaacctggcggcagcgcaaaagatg

SEQ ID NO: 235080 - DNA, 103 bp, Artificial Sequence
  Synthetic Polynucleotide
taatacgactcactatagggatgtgcgcggcggcggagtcaacgaagccgaacagaggagacggcttatgtgactccgcaacctggcggcagcgcaaaagatg

SEQ ID NO: 235081 - DNA, 103 bp, Artificial Sequence
  Synthetic Polynucleotide
taatacgactcactatagggccgcccccgccgcccgccccgccgccgcccaacagaggagagggcggatgcggggcgggaacctggcggcagcgcaaaagatg

SEQ ID NO: 235082 - DNA, 103 bp, Artificial Sequence
  Synthetic Polynucleotide
taatacgactcactatagggagagctgccgccgcccccgccgcccgccccaacagaggagaggggcgatgggcgggggcaacctggcggcagcgcaaaagatg

SEQ ID NO: 235083 - DNA, 103 bp, Artificial Sequence
  Synthetic Polynucleotide
taatacgactcactatagggtgcccccgccagagctgccgccgcccccgcaacagaggagagcggggatggcggcagctaacctggcggcagcgcaaaagatg

SEQ ID NO: 235084 - DNA, 103 bp, Artificial Sequence
  Synthetic Polynucleotide
taatacgactcactataggggctgtcccgctgcccccgccagagctgccgaacagaggagacggcagatgtggcgggggaacctggcggcagcgcaaaagatg

SEQ ID NO: 235085 - DNA, 103 bp, Artificial Sequence
  Synthetic Polynucleotide
taatacgactcactataggggtgacccccggctgtcccgctgcccccgccaacagaggagaggcgggatgagcgggacaaacctggcggcagcgcaaaagatg

SEQ ID NO: 235086 - DNA, 103 bp, Artificial Sequence
  Synthetic Polynucleotide
taatacgactcactatagggagaggccgctgtgacccccggctgtcccgcaacagaggagagcgggaatgccgggggtcaacctggcggcagcgcaaaagatg

SEQ ID NO: 235087 - DNA, 103 bp, Artificial Sequence
  Synthetic Polynucleotide
taatacgactcactatagggaagttggaggagaggccgctgtgacccccgaacagaggagacgggggatgcagcggcctaacctggcggcagcgcaaaagatg

SEQ ID NO: 235088 - DNA, 103 bp, Artificial Sequence
  Synthetic Polynucleotide
taatacgactcactatagggccattcattgaagttggaggagaggccgctaacagaggagaagcggcatgtcctccaacaacctggcggcagcgcaaaagatg

SEQ ID NO: 235089 - DNA, 103 bp, Artificial Sequence
  Synthetic Polynucleotide
taatacgactcactataggggaaggctcccatgtgcgcggcggcggagtcaacagaggagagactccatggccgcgcacaacctggcggcagcgcaaaagatg

SEQ ID NO: 235090 - DNA, 103 bp, Artificial Sequence
  Synthetic Polynucleotide
taatacgactcactatagggggttgagcttgaaggctcccatgtgcgcggaacagaggagaccgcgcatgtgggagcctaacctggcggcagcgcaaaagatg

SEQ ID NO: 235091 - DNA, 103 bp, Artificial Sequence
  Synthetic Polynucleotide
taatacgactcactatagggtgcgcgcccgggttgagcttgaaggctcccaacagaggagagggagcatgcaagctcaaaacctggcggcagcgcaaaagatg

SEQ ID NO: 235092 - DNA, 103 bp, Artificial Sequence
  Synthetic Polynucleotide
taatacgactcactatagggggacagctcgtgcgcgcccgggttgagcttaacagaggagaaagctcatgccgggcgcgaacctggcggcagcgcaaaagatg

SEQ ID NO: 235093 - DNA, 103 bp, Artificial Sequence
  Synthetic Polynucleotide
taatacgactcactatagggccccgatggccgggaactgcggacccgcgtaacagaggagaacgcggatgcgcagttccaacctggcggcagcgcaaaagatg

SEQ ID NO: 235094 - DNA, 103 bp, Artificial Sequence
  Synthetic Polynucleotide
taatacgactcactatagggtctggcccggggacagctcgtgcgcgcccgaacagaggagacgggcgatgacgagctgtaacctggcggcagcgcaaaagatg

SEQ ID NO: 235095 - DNA, 103 bp, Artificial Sequence
  Synthetic Polynucleotide
taatacgactcactatagggaacgccgagctctggcccggggacagctcgaacagaggagacgagctatgcccgggccaaacctggcggcagcgcaaaagatg

SEQ ID NO: 235096 - DNA, 103 bp, Artificial Sequence
  Synthetic Polynucleotide
taatacgactcactatagggctgcgacgtgaacgccgagctctggcccggaacagaggagaccgggcatgagctcggcgaacctggcggcagcgcaaaagatg

SEQ ID NO: 235097 - DNA, 103 bp, Artificial Sequence
  Synthetic Polynucleotide
taatacgactcactatagggcgccggggccctgcgacgtgaacgccgagcaacagaggagagctcggatgtcacgtcgcaacctggcggcagcgcaaaagatg

SEQ ID NO: 235098 - DNA, 103 bp, Artificial Sequence
  Synthetic Polynucleotide
taatacgactcactatagggccggggtaggcgccggggccctgcgacgtgaacagaggagacacgtcatggggccccggaacctggcggcagcgcaaaagatg

SEQ ID NO: 235099 - DNA, 103 bp, Artificial Sequence
  Synthetic Polynucleotide
taatacgactcactatagggcgcagcggagccggggtaggcgccggggccaacagaggagaggccccatggcctaccccaacctggcggcagcgcaaaagatg

SEQ ID NO: 235100 - DNA, 103 bp, Artificial Sequence
  Synthetic Polynucleotide
taatacgactcactatagggcagcggcagccgcagcggagccggggtaggaacagaggagacctaccatggctccgctgaacctggcggcagcgcaaaagatg

SEQ ID NO: 235101 - DNA, 103 bp, Artificial Sequence
  Synthetic Polynucleotide
taatacgactcactataggggctgcggccgcagcggcagccgcagcggagaacagaggagactccgcatgggctgccgcaacctggcggcagcgcaaaagatg

SEQ ID NO: 235102 - DNA, 103 bp, Artificial Sequence
  Synthetic Polynucleotide
taatacgactcactataggggggcccgagcgctgcggccgcagcggcagcaacagaggagagctgccatggcggccgcaaacctggcggcagcgcaaaagatg

SEQ ID NO: 235103 - DNA, 103 bp, Artificial Sequence
  Synthetic Polynucleotide
taatacgactcactataggggcgcggcgtggggcccgagcgctgcggccgaacagaggagacggccgatgcgctcgggcaacctggcggcagcgcaaaagatg

SEQ ID NO: 235104 - DNA, 103 bp, Artificial Sequence
  Synthetic Polynucleotide
taatacgactcactatagggaagctgcccaccccgatggccgggaactgcaacagaggagagcagttatgggccatcggaacctggcggcagcgcaaaagatg

SEQ ID NO: 235105 - DNA, 103 bp, Artificial Sequence
  Synthetic Polynucleotide
taatacgactcactataggggagccaacgtgcgcggcgtggggcccgagcaacagaggagagctcggatgccacgccgcaacctggcggcagcgcaaaagatg

SEQ ID NO: 235106 - DNA, 103 bp, Artificial Sequence
  Synthetic Polynucleotide
taatacgactcactatagggcccagagtaggagccaacgtgcgcggcgtgaacagaggagacacgccatgcacgttggcaacctggcggcagcgcaaaagatg

SEQ ID NO: 235107 - DNA, 103 bp, Artificial Sequence
  Synthetic Polynucleotide
taatacgactcactatagggtgaagggcggcccagagtaggagccaacgtaacagaggagaacgttgatgcctactctgaacctggcggcagcgcaaaagatg

SEQ ID NO: 235108 - DNA, 103 bp, Artificial Sequence
  Synthetic Polynucleotide
taatacgactcactatagggcgggtggagttgaagggcggcccagagtagaacagaggagactactcatggccgcccttaacctggcggcagcgcaaaagatg

SEQ ID NO: 235109 - DNA, 103 bp, Artificial Sequence
  Synthetic Polynucleotide
taatacgactcactatagggcaggaagtcccgggtggagttgaagggcggaacagaggagaccgcccatgaactccaccaacctggcggcagcgcaaaagatg

SEQ ID NO: 235110 - DNA, 103 bp, Artificial Sequence
  Synthetic Polynucleotide
taatacgactcactatagggggctgcggaacaggaagtcccgggtggagtaacagaggagaactccaatggggacttccaacctggcggcagcgcaaaagatg

SEQ ID NO: 235111 - DNA, 103 bp, Artificial Sequence
  Synthetic Polynucleotide
taatacgactcactatagggccgaagccgcggctgcggaacaggaagtccaacagaggagaggacttatggttccgcagaacctggcggcagcgcaaaagatg

SEQ ID NO: 235112 - DNA, 103 bp, Artificial Sequence
  Synthetic Polynucleotide
taatacgactcactatagggcgccgagtccccgaagccgcggctgcggaaaacagaggagattccgcatgcgcggcttcaacctggcggcagcgcaaaagatg

SEQ ID NO: 235113 - DNA, 103 bp, Artificial Sequence
  Synthetic Polynucleotide
taatacgactcactatagggcgccgcccggcgccgagtccccgaagccgcaacagaggagagcggctatggggactcggaacctggcggcagcgcaaaagatg

SEQ ID NO: 235114 - DNA, 103 bp, Artificial Sequence
  Synthetic Polynucleotide
taatacgactcactatagggccgtgctgcccgccgcccggcgccgagtccaacagaggagaggactcatggccgggcggaacctggcggcagcgcaaaagatg

SEQ ID NO: 235115 - DNA, 103 bp, Artificial Sequence
  Synthetic Polynucleotide
taatacgactcactataggggtggcgcgcgaagctgcccaccccgatggcaacagaggagagccatcatggtgggcagcaacctggcggcagcgcaaaagatg

SEQ ID NO: 235116 - DNA, 103 bp, Artificial Sequence
  Synthetic Polynucleotide
taatacgactcactatagggcccgaacagcccgtgctgcccgccgcccggaacagaggagaccgggcatggggcagcacaacctggcggcagcgcaaaagatg

SEQ ID NO: 235117 - DNA, 103 bp, Artificial Sequence
  Synthetic Polynucleotide
taatacgactcactatagggccgcgcccggcccgaacagcccgtgctgccaacagaggagaggcagcatgggctgttcgaacctggcggcagcgcaaaagatg

SEQ ID NO: 235118 - DNA, 103 bp, Artificial Sequence
  Synthetic Polynucleotide
taatacgactcactatagggtgcaggccgcccgcgcccggcccgaacagcaacagaggagagctgttatggccgggcgcaacctggcggcagcgcaaaagatg

SEQ ID NO: 235119 - DNA, 103 bp, Artificial Sequence
  Synthetic Polynucleotide
taatacgactcactataggggtgcgcgtggtgcaggccgcccgcgcccggaacagaggagaccgggcatgggcggcctgaacctggcggcagcgcaaaagatg

SEQ ID NO: 235120 - DNA, 103 bp, Artificial Sequence
  Synthetic Polynucleotide
taatacgactcactataggggcgcgtccgagtgcgcgtggtgcaggccgcaacagaggagagcggccatgaccacgcgcaacctggcggcagcgcaaaagatg

SEQ ID NO: 235121 - DNA, 103 bp, Artificial Sequence
  Synthetic Polynucleotide
taatacgactcactatagggaggtggccctgcgcgtccgagtgcgcgtggaacagaggagaccacgcatgctcggacgcaacctggcggcagcgcaaaagatg

SEQ ID NO: 235122 - DNA, 103 bp, Artificial Sequence
  Synthetic Polynucleotide
taatacgactcactatagggcgggaagaggaggtggccctgcgcgtccgaaacagaggagatcggacatgcagggccacaacctggcggcagcgcaaaagatg

SEQ ID NO: 235123 - DNA, 103 bp, Artificial Sequence
  Synthetic Polynucleotide
taatacgactcactatagggctggcaggcccgggaagaggaggtggccctaacagaggagaagggccatgtcctcttccaacctggcggcagcgcaaaagatg

SEQ ID NO: 235124 - DNA, 103 bp, Artificial Sequence
  Synthetic Polynucleotide
taatacgactcactatagggccgtgctgctctggcaggcccgggaagaggaacagaggagacctcttatggggcctgccaacctggcggcagcgcaaaagatg

SEQ ID NO: 235125 - DNA, 103 bp, Artificial Sequence
  Synthetic Polynucleotide
taatacgactcactataggggccgtgcggcccgtgctgctctggcaggccaacagaggagaggcctgatggagcagcacaacctggcggcagcgcaaaagatg

SEQ ID NO: 235126 - DNA, 103 bp, Artificial Sequence
  Synthetic Polynucleotide
taatacgactcactatagggagtggtgatggtggcgcgcgaagctgcccaaacagaggagatgggcaatgtcgcgcgccaacctggcggcagcgcaaaagatg

SEQ ID NO: 235127 - DNA, 103 bp, Artificial Sequence
  Synthetic Polynucleotide
taatacgactcactatagggcattctgcgagccgtgcggcccgtgctgctaacagaggagaagcagcatgggccgcacgaacctggcggcagcgcaaaagatg

SEQ ID NO: 235128 - DNA, 103 bp, Artificial Sequence
  Synthetic Polynucleotide
taatacgactcactatagggccgttgagcacattctgcgagccgtgcggcaacagaggagagccgcaatgctcgcagaaaacctggcggcagcgcaaaagatg

SEQ ID NO: 235129 - DNA, 103 bp, Artificial Sequence
  Synthetic Polynucleotide
taatacgactcactataggggcgcatctgcccgttgagcacattctgcgaaacagaggagatcgcagatggtgctcaacaacctggcggcagcgcaaaagatg

SEQ ID NO: 235130 - DNA, 103 bp, Artificial Sequence
  Synthetic Polynucleotide
taatacgactcactataggggcagcccgaggcgcatctgcccgttgagcaaacagaggagatgctcaatgggcagatgcaacctggcggcagcgcaaaagatg

SEQ ID NO: 235131 - DNA, 103 bp, Artificial Sequence
  Synthetic Polynucleotide
taatacgactcactatagggacctcgccgggcagcccgaggcgcatctgcaacagaggagagcagatatgcctcgggctaacctggcggcagcgcaaaagatg

SEQ ID NO: 235132 - DNA, 103 bp, Artificial Sequence
  Synthetic Polynucleotide
taatacgactcactataggggcgcccgaacacctcgccgggcagcccgagaacagaggagactcgggatgcccggcgagaacctggcggcagcgcaaaagatg

SEQ ID NO: 235133 - DNA, 103 bp, Artificial Sequence
  Synthetic Polynucleotide
taatacgactcactatagggattgctccgagcgcccgaacacctcgccggaacagaggagaccggcgatgtgttcgggcaacctggcggcagcgcaaaagatg

SEQ ID NO: 235134 - DNA, 103 bp, Artificial Sequence
  Synthetic Polynucleotide
taatacgactcactatagggacctggcggtattgctccgagcgcccgaacaacagaggagagttcggatgctcggagcaaacctggcggcagcgcaaaagatg

SEQ ID NO: 235135 - DNA, 103 bp, Artificial Sequence
  Synthetic Polynucleotide
taatacgactcactatagggcgggctggccacctggcggtattgctccgaaacagaggagatcggagatgtaccgccagaacctggcggcagcgcaaaagatg

SEQ ID NO: 235136 - DNA, 103 bp, Artificial Sequence
  Synthetic Polynucleotide
taatacgactcactatagggggtcggtccgcgggctggccacctggcggtaacagaggagaaccgccatgtggccagccaacctggcggcagcgcaaaagatg

SEQ ID NO: 235137 - DNA, 103 bp, Artificial Sequence
  Synthetic Polynucleotide
taatacgactcactataggggccgcggcggagtggtgatggtggcgcgcgaacagaggagacgcgcgatgccatcaccaaacctggcggcagcgcaaaagatg

SEQ ID NO: 235138 - DNA, 103 bp, Artificial Sequence
  Synthetic Polynucleotide
taatacgactcactataggggccgagtaggggtcggtccgcgggctggccaacagaggagaggccagatggcggaccgaaacctggcggcagcgcaaaagatg

SEQ ID NO: 235139 - DNA, 103 bp, Artificial Sequence
  Synthetic Polynucleotide
taatacgactcactataggggagttgcgccgccgagtaggggtcggtccgaacagaggagacggaccatgccctactcgaacctggcggcagcgcaaaagatg

SEQ ID NO: 235140 - DNA, 103 bp, Artificial Sequence
  Synthetic Polynucleotide
taatacgactcactatagggactggttgtggagttgcgccgccgagtaggaacagaggagacctactatgcggcgcaacaacctggcggcagcgcaaaagatg

SEQ ID NO: 235141 - DNA, 103 bp, Artificial Sequence
  Synthetic Polynucleotide
taatacgactcactatagggatggggccgtactggttgtggagttgcgccaacagaggagaggcgcaatgccacaaccaaacctggcggcagcgcaaaagatg

SEQ ID NO: 235142 - DNA, 103 bp, Artificial Sequence
  Synthetic Polynucleotide
taatacgactcactataggggttcatattcatggggccgtactggttgtgaacagaggagacacaacatgtacggccccaacctggcggcagcgcaaaagatg

SEQ ID NO: 235143 - DNA, 103 bp, Artificial Sequence
  Synthetic Polynucleotide
taatacgactcactatagggtcatacccatgttcatattcatggggccgtaacagaggagaacggccatgtgaatatgaaacctggcggcagcgcaaaagatg

SEQ ID NO: 235144 - DNA, 103 bp, Artificial Sequence
  Synthetic Polynucleotide
taatacgactcactataggggctgccatgttcatacccatgttcatattcaacagaggagagaatatatgcatgggtataacctggcggcagcgcaaaagatg

SEQ ID NO: 235145 - DNA, 103 bp, Artificial Sequence
  Synthetic Polynucleotide
taatacgactcactatagggggccgcggctgctgccatgttcatacccataacagaggagaatgggtatgaacatggcaaacctggcggcagcgcaaaagatg

SEQ ID NO: 235146 - DNA, 103 bp, Artificial Sequence
  Synthetic Polynucleotide
taatacgactcactatagggggtggtggtgggccgcggctgctgccatgtaacagaggagaacatggatgcagccgcggaacctggcggcagcgcaaaagatg

SEQ ID NO: 235147 - DNA, 103 bp, Artificial Sequence
  Synthetic Polynucleotide
taatacgactcactatagggtggtggtggtggtggtggtgggccgcggctaacagaggagaagccgcatgccaccaccaaacctggcggcagcgcaaaagatg

SEQ ID NO: 235148 - DNA, 103 bp, Artificial Sequence
  Synthetic Polynucleotide
taatacgactcactatagggcgccgccgccgccgcggcggagtggtgatgaacagaggagacatcacatgtccgccgcgaacctggcggcagcgcaaaagatg

SEQ ID NO: 235149 - DNA, 103 bp, Artificial Sequence
  Synthetic Polynucleotide
taatacgactcactatagggggggtggtggtggtggtggtggtggtggtgaacagaggagacaccacatgcaccaccacaacctggcggcagcgcaaaagatg

SEQ ID NO: 235150 - DNA, 103 bp, Artificial Sequence
  Synthetic Polynucleotide
taatacgactcactatagggaaaaggcaccggggtggtggtggtggtggtaacagaggagaaccaccatgaccaccaccaacctggcggcagcgcaaaagatg

SEQ ID NO: 235151 - DNA, 103 bp, Artificial Sequence
  Synthetic Polynucleotide
taatacgactcactatagggatatagcggaaaaaggcaccggggtggtggaacagaggagaccaccaatgcggtgccttaacctggcggcagcgcaaaagatg

SEQ ID NO: 235152 - DNA, 103 bp, Artificial Sequence
  Synthetic Polynucleotide
taatacgactcactatagggctgctgccgcatatagcggaaaaaggcaccaacagaggagaggtgccatgttccgctataacctggcggcagcgcaaaagatg

SEQ ID NO: 235153 - DNA, 103 bp, Artificial Sequence
  Synthetic Polynucleotide
taatacgactcactataggggcttgatgcactgctgccgcatatagcggaaacagaggagatccgctatgtgcggcagcaacctggcggcagcgcaaaagatg

SEQ ID NO: 235154 - DNA, 103 bp, Artificial Sequence
  Synthetic Polynucleotide
taatacgactcactatagggattagctcctgcttgatgcactgctgccgcaacagaggagagcggcaatggtgcatcaaaacctggcggcagcgcaaaagatg

SEQ ID NO: 235155 - DNA, 103 bp, Artificial Sequence
  Synthetic Polynucleotide
taatacgactcactatagggccacttgcagattagctcctgcttgatgcaaacagaggagatgcatcatgcaggagctaaacctggcggcagcgcaaaagatg

SEQ ID NO: 235156 - DNA, 103 bp, Artificial Sequence
  Synthetic Polynucleotide
taatacgactcactatagggcggggtcgatccacttgcagattagctcctaacagaggagaaggagcatgtctgcaagtaacctggcggcagcgcaaaagatg

SEQ ID NO: 235157 - DNA, 103 bp, Artificial Sequence
  Synthetic Polynucleotide
taatacgactcactatagggctcagttgctcggggtcgatccacttgcagaacagaggagactgcaaatggatcgacccaacctggcggcagcgcaaaagatg

SEQ ID NO: 235158 - DNA, 103 bp, Artificial Sequence
  Synthetic Polynucleotide
taatacgactcactatagggcttgggattgctcagttgctcggggtcgataacagaggagaatcgacatggagcaactgaacctggcggcagcgcaaaagatg

SEQ ID NO: 235159 - DNA, 103 bp, Artificial Sequence
  Synthetic Polynucleotide
taatacgactcactatagggcggcggcagccgccgccgccgccgcggcggaacagaggagaccgccgatgcggcggcggaacctggcggcagcgcaaaagatg

SEQ ID NO: 235160 - DNA, 103 bp, Artificial Sequence
  Synthetic Polynucleotide
taatacgactcactatagggtgcagctcttcttgggattgctcagttgctaacagaggagaagcaacatggcaatcccaaacctggcggcagcgcaaaagatg

SEQ ID NO: 235161 - DNA, 103 bp, Artificial Sequence
  Synthetic Polynucleotide
taatacgactcactatagggaaagttttgttgcagctcttcttgggattgaacagaggagacaatccatggaagagctgaacctggcggcagcgcaaaagatg

SEQ ID NO: 235162 - DNA, 103 bp, Artificial Sequence
  Synthetic Polynucleotide
taatacgactcactatagggcatggtgctgaaagttttgttgcagctcttaacagaggagaaagagcatgaacaaaactaacctggcggcagcgcaaaagatg

SEQ ID NO: 235163 - DNA, 103 bp, Artificial Sequence
  Synthetic Polynucleotide
taatacgactcactatagggccagctcgtgcatggtgctgaaagttttgtaacagaggagaacaaaaatgtcagcaccaaacctggcggcagcgcaaaagatg

SEQ ID NO: 235164 - DNA, 103 bp, Artificial Sequence
  Synthetic Polynucleotide
taatacgactcactatagggacgtgtgtcaccagctcgtgcatggtgctgaacagaggagacagcacatggcacgagctaacctggcggcagcgcaaaagatg

SEQ ID NO: 235165 - DNA, 103 bp, Artificial Sequence
  Synthetic Polynucleotide
taatacgactcactatagggctccaccgagacgtgtgtcaccagctcgtgaacagaggagacacgagatggtgacacacaacctggcggcagcgcaaaagatg

SEQ ID NO: 235166 - DNA, 103 bp, Artificial Sequence
  Synthetic Polynucleotide
taatacgactcactatagggcgccgacgtgctccaccgagacgtgtgtcaaacagaggagatgacacatgtctcggtggaacctggcggcagcgcaaaagatg

SEQ ID NO: 235167 - DNA, 103 bp, Artificial Sequence
  Synthetic Polynucleotide
taatacgactcactatagggtgctccgggccgccgacgtgctccaccgagaacagaggagactcggtatggcacgtcggaacctggcggcagcgcaaaagatg

SEQ ID NO: 235168 - DNA, 103 bp, Artificial Sequence
  Synthetic Polynucleotide
taatacgactcactataggggtggttgctctgctccgggccgccgacgtgaacagaggagacacgtcatgggcccggagaacctggcggcagcgcaaaagatg

SEQ ID NO: 235169 - DNA, 103 bp, Artificial Sequence
  Synthetic Polynucleotide
taatacgactcactatagggagaagcagacgtggttgctctgctccgggcaacagaggagagcccggatgagagcaaccaacctggcggcagcgcaaaagatg

SEQ ID NO: 235170 - DNA, 103 bp, Artificial Sequence
  Synthetic Polynucleotide
taatacgactcactatagggtcctgcatctcggcggcagccgccgccgccaacagaggagaggcggcatgggctgccgcaacctggcggcagcgcaaaagatg

SEQ ID NO: 235171 - DNA, 103 bp, Artificial Sequence
  Synthetic Polynucleotide
taatacgactcactatagggcactcctcccagaagcagacgtggttgctcaacagaggagagagcaaatgcgtctgcttaacctggcggcagcgcaaaagatg

SEQ ID NO: 235172 - DNA, 103 bp, Artificial Sequence
  Synthetic Polynucleotide
taatacgactcactatagggctcgcgcggacactcctcccagaagcagacaacagaggagagtctgcatgtgggaggagaacctggcggcagcgcaaaagatg

SEQ ID NO: 235173 - DNA, 103 bp, Artificial Sequence
  Synthetic Polynucleotide
taatacgactcactatagggagggcttgccctcgcgcggacactcctcccaacagaggagagggaggatggtccgcgcgaacctggcggcagcgcaaaagatg

SEQ ID NO: 235174 - DNA, 103 bp, Artificial Sequence
  Synthetic Polynucleotide
taatacgactcactatagggttggccttgaagggcttgccctcgcgcggaaacagaggagatccgcgatggggcaagccaacctggcggcagcgcaaaagatg

SEQ ID NO: 235175 - DNA, 103 bp, Artificial Sequence
  Synthetic Polynucleotide
taatacgactcactatagggcagtttgtatttggccttgaagggcttgccaacagaggagaggcaagatgttcaaggccaacctggcggcagcgcaaaagatg

SEQ ID NO: 235176 - DNA, 103 bp, Artificial Sequence
  Synthetic Polynucleotide
taatacgactcactatagggtgtggttgaccagtttgtatttggccttgaaacagaggagatcaaggatgaatacaaacaacctggcggcagcgcaaaagatg

SEQ ID NO: 235177 - DNA, 103 bp, Artificial Sequence
  Synthetic Polynucleotide
taatacgactcactatagggtgcacgcggatgtggttgaccagtttgtataacagaggagaatacaaatgggtcaaccaaacctggcggcagcgcaaaagatg

SEQ ID NO: 235178 - DNA, 103 bp, Artificial Sequence
  Synthetic Polynucleotide
taatacgactcactatagggctcgcctgtgtgcacgcggatgtggttgacaacagaggagagtcaacatgatccgcgtgaacctggcggcagcgcaaaagatg

SEQ ID NO: 235179 - DNA, 103 bp, Artificial Sequence
  Synthetic Polynucleotide
taatacgactcactatagggggaagggtttctcgcctgtgtgcacgcggaaacagaggagatccgcgatgacacaggcgaacctggcggcagcgcaaaagatg

SEQ ID NO: 235180 - DNA, 103 bp, Artificial Sequence
  Synthetic Polynucleotide
taatacgactcactatagggaaggggcaggggaagggtttctcgcctgtgaacagaggagacacaggatggaaacccttaacctggcggcagcgcaaaagatg

SEQ ID NO: 235181 - DNA, 103 bp, Artificial Sequence
  Synthetic Polynucleotide
taatacgactcactatagggctgcgggcctccgtccaggagcatcgtcataacagaggagaatgacgatgctcctggacaacctggcggcagcgcaaaagatg

SEQ ID NO: 235182 - DNA, 103 bp, Artificial Sequence
  Synthetic Polynucleotide
taatacgactcactataggggaagggattcagccccatgcctgccggctcaacagaggagagagccgatgggcatggggaacctggcggcagcgcaaaagatg

SEQ ID NO: 235183 - DNA, 103 bp, Artificial Sequence
  Synthetic Polynucleotide
taatacgactcactatagggggcaaagatcttcccgcagcccgggaagggaacagaggagacccttcatgggctgcgggaacctggcggcagcgcaaaagatg

SEQ ID NO: 235184 - DNA, 103 bp, Artificial Sequence
  Synthetic Polynucleotide
taatacgactcactatagggtctcagaacgggcaaagatcttcccgcagcaacagaggagagctgcgatgagatctttgaacctggcggcagcgcaaaagatg

SEQ ID NO: 235185 - DNA, 103 bp, Artificial Sequence
  Synthetic Polynucleotide
taatacgactcactatagggatcttgaggttctcagaacgggcaaagatcaacagaggagagatcttatgccgttctgaaacctggcggcagcgcaaaagatg

SEQ ID NO: 235186 - DNA, 103 bp, Artificial Sequence
  Synthetic Polynucleotide
taatacgactcactatagggcctcttgtggatcttgaggttctcagaacgaacagaggagacgttctatgaacctcaagaacctggcggcagcgcaaaagatg

SEQ ID NO: 235187 - DNA, 103 bp, Artificial Sequence
  Synthetic Polynucleotide
taatacgactcactatagggctgtgtgggtcctcttgtggatcttgaggtaacagaggagaacctcaatgtccacaagaaacctggcggcagcgcaaaagatg

SEQ ID NO: 235188 - DNA, 103 bp, Artificial Sequence
  Synthetic Polynucleotide
taatacgactcactatagggggtttctcacctgtgtgggtcctcttgtggaacagaggagaccacaaatggacccacacaacctggcggcagcgcaaaagatg

SEQ ID NO: 235189 - DNA, 103 bp, Artificial Sequence
  Synthetic Polynucleotide
taatacgactcactatagggacatttgaaaggtttctcacctgtgtgggtaacagaggagaacccacatgggtgagaaaaacctggcggcagcgcaaaagatg

SEQ ID NO: 235190 - DNA, 103 bp, Artificial Sequence
  Synthetic Polynucleotide
taatacgactcactatagggcttcaaattcacatttgaaaggtttctcacaacagaggagagtgagaatgctttcaaataacctggcggcagcgcaaaagatg

SEQ ID NO: 235191 - DNA, 103 bp, Artificial Sequence
  Synthetic Polynucleotide
taatacgactcactatagggctgtcacagccttcaaattcacatttgaaaaacagaggagatttcaaatgtgaatttgaaacctggcggcagcgcaaaagatg

SEQ ID NO: 235192 - DNA, 103 bp, Artificial Sequence
  Synthetic Polynucleotide
taatacgactcactatagggggcaaagcgtctgtcacagccttcaaattcaacagaggagagaatttatgggctgtgacaacctggcggcagcgcaaaagatg

SEQ ID NO: 235193 - DNA, 103 bp, Artificial Sequence
  Synthetic Polynucleotide
taatacgactcactatagggttgagtccccgaagggattcagccccatgcaacagaggagagcatggatgtgaatccctaacctggcggcagcgcaaaagatg

SEQ ID NO: 235194 - DNA, 103 bp, Artificial Sequence
  Synthetic Polynucleotide
taatacgactcactatagggcgctgctgttggcaaagcgtctgtcacagcaacagaggagagctgtgatggacgctttgaacctggcggcagcgcaaaagatg

SEQ ID NO: 235195 - DNA, 103 bp, Artificial Sequence
  Synthetic Polynucleotide
taatacgactcactatagggttcttacggtcgctgctgttggcaaagcgtaacagaggagaacgcttatgcaacagcagaacctggcggcagcgcaaaagatg

SEQ ID NO: 235196 - DNA, 103 bp, Artificial Sequence
  Synthetic Polynucleotide
taatacgactcactatagggatgcatgtgcttcttacggtcgctgctgttaacagaggagaaacagcatggaccgtaagaacctggcggcagcgcaaaagatg

SEQ ID NO: 235197 - DNA, 103 bp, Artificial Sequence
  Synthetic Polynucleotide
taatacgactcactatagggaggtatgcacatgcatgtgcttcttacggtaacagaggagaaccgtaatgagcacatgcaacctggcggcagcgcaaaagatg

SEQ ID NO: 235198 - DNA, 103 bp, Artificial Sequence
  Synthetic Polynucleotide
taatacgactcactatagggggcttgtccgaggtatgcacatgcatgtgcaacagaggagagcacatatgtgtgcatacaacctggcggcagcgcaaaagatg

SEQ ID NO: 235199 - DNA, 103 bp, Artificial Sequence
  Synthetic Polynucleotide
taatacgactcactataggggcagatatagggcttgtccgaggtatgcacaacagaggagagtgcatatgtcggacaagaacctggcggcagcgcaaaagatg

SEQ ID NO: 235200 - DNA, 103 bp, Artificial Sequence
  Synthetic Polynucleotide
taatacgactcactatagggcgcacactttgcagatatagggcttgtccgaacagaggagacggacaatgcctatatctaacctggcggcagcgcaaaagatg

SEQ ID NO: 235201 - DNA, 103 bp, Artificial Sequence
  Synthetic Polynucleotide
taatacgactcactatagggtaggacttgtcgcacactttgcagatatagaacagaggagactatatatgcaaagtgtgaacctggcggcagcgcaaaagatg

SEQ ID NO: 235202 - DNA, 103 bp, Artificial Sequence
  Synthetic Polynucleotide
taatacgactcactatagggcgggtgcgtgtaggacttgtcgcacactttaacagaggagaaaagtgatggacaagtccaacctggcggcagcgcaaaagatg

SEQ ID NO: 235203 - DNA, 103 bp, Artificial Sequence
  Synthetic Polynucleotide
taatacgactcactataggggcagggagctcgggtgcgtgtaggacttgtaacagaggagaacaagtatgacacgcaccaacctggcggcagcgcaaaagatg

SEQ ID NO: 235204 - DNA, 103 bp, Artificial Sequence
  Synthetic Polynucleotide
taatacgactcactataggggcggcgtgggttgagtccccgaagggattcaacagaggagagaatccatgcggggactcaacctggcggcagcgcaaaagatg

SEQ ID NO: 235205 - DNA, 103 bp, Artificial Sequence
  Synthetic Polynucleotide
taatacgactcactatagggatgtgtttgcgcagggagctcgggtgcgtgaacagaggagacacgcaatggagctccctaacctggcggcagcgcaaaagatg

SEQ ID NO: 235206 - DNA, 103 bp, Artificial Sequence
  Synthetic Polynucleotide
taatacgactcactatagggatgaaccttcatgtgtttgcgcagggagctaacagaggagaagctccatgcgcaaacacaacctggcggcagcgcaaaagatg

SEQ ID NO: 235207 - DNA, 103 bp, Artificial Sequence
  Synthetic Polynucleotide
taatacgactcactatagggcttgagattcatgaaccttcatgtgtttgcaacagaggagagcaaacatgtgaaggttcaacctggcggcagcgcaaaagatg

SEQ ID NO: 235208 - DNA, 103 bp, Artificial Sequence
  Synthetic Polynucleotide
taatacgactcactataggggaatctgacccttgagattcatgaaccttcaacagaggagagaaggtatgtgaatctcaaacctggcggcagcgcaaaagatg

SEQ ID NO: 235209 - DNA, 103 bp, Artificial Sequence
  Synthetic Polynucleotide
taatacgactcactatagggagcaggggaggaatctgacccttgagattcaacagaggagagaatctatggggtcagataacctggcggcagcgcaaaagatg

SEQ ID NO: 235210 - DNA, 103 bp, Artificial Sequence
  Synthetic Polynucleotide
taatacgactcactatagggctgaactggcagcaggggaggaatctgaccaacagaggagaggtcagatgcctcccctgaacctggcggcagcgcaaaagatg

SEQ ID NO: 235211 - DNA, 103 bp, Artificial Sequence
  Synthetic Polynucleotide
taatacgactcactataggggattcatagcctgaactggcagcaggggagaacagaggagactccccatgtgccagttcaacctggcggcagcgcaaaagatg

SEQ ID NO: 235212 - DNA, 103 bp, Artificial Sequence
  Synthetic Polynucleotide
taatacgactcactatagggtggagtggaagattcatagcctgaactggcaacagaggagagccagtatgggctatgaaaacctggcggcagcgcaaaagatg

SEQ ID NO: 235213 - DNA, 103 bp, Artificial Sequence
  Synthetic Polynucleotide
taatacgactcactatagggctatagcgggtggagtggaagattcatagcaacagaggagagctatgatgcttccactcaacctggcggcagcgcaaaagatg

SEQ ID NO: 235214 - DNA, 103 bp, Artificial Sequence
  Synthetic Polynucleotide
taatacgactcactatagggtttgcagaagctatagcgggtggagtggaaaacagaggagattccacatgacccgctataacctggcggcagcgcaaaagatg

SEQ ID NO: 235215 - DNA, 103 bp, Artificial Sequence
  Synthetic Polynucleotide
taatacgactcactatagggggcggcggcggcggcgtgggttgagtccccaacagaggagaggggacatgacccacgccaacctggcggcagcgcaaaagatg

SEQ ID NO: 235216 - DNA, 103 bp, Artificial Sequence
  Synthetic Polynucleotide
taatacgactcactatagggatctttactgtttgcagaagctatagcgggaacagaggagacccgctatggcttctgcaaacctggcggcagcgcaaaagatg

SEQ ID NO: 235217 - DNA, 103 bp, Artificial Sequence
  Synthetic Polynucleotide
taatacgactcactatagggttttagtggtatctttactgtttgcagaagaacagaggagacttctgatgacagtaaagaacctggcggcagcgcaaaagatg

SEQ ID NO: 235218 - DNA, 103 bp, Artificial Sequence
  Synthetic Polynucleotide
taatacgactcactataggggcagaaggggttttagtggtatctttactgaacagaggagacagtaaatgtaccactaaaacctggcggcagcgcaaaagatg

SEQ ID NO: 235219 - DNA, 103 bp, Artificial Sequence
  Synthetic Polynucleotide
taatacgactcactatagggagtttgaactgcagaaggggttttagtggtaacagaggagaaccactatgaccccttctaacctggcggcagcgcaaaagatg

SEQ ID NO: 235220 - DNA, 103 bp, Artificial Sequence
  Synthetic Polynucleotide
taatacgactcactatagggggctggtgctagtttgaactgcagaaggggaacagaggagaccccttatgcagttcaaaaacctggcggcagcgcaaaagatg

SEQ ID NO: 235221 - DNA, 103 bp, Artificial Sequence
  Synthetic Polynucleotide
taatacgactcactatagggccagggttgtggctggtgctagtttgaactaacagaggagaagttcaatgtagcaccagaacctggcggcagcgcaaaagatg

SEQ ID NO: 235222 - DNA, 103 bp, Artificial Sequence
  Synthetic Polynucleotide
taatacgactcactatagggaggaggaagtccagggttgtggctggtgctaacagaggagaagcaccatgcacaaccctaacctggcggcagcgcaaaagatg

SEQ ID NO: 235223 - DNA, 103 bp, Artificial Sequence
  Synthetic Polynucleotide
taatacgactcactatagggcgttaaaattaggaggaagtccagggttgtaacagaggagaacaaccatggacttcctcaacctggcggcagcgcaaaagatg

SEQ ID NO: 235224 - DNA, 103 bp, Artificial Sequence
  Synthetic Polynucleotide
taatacgactcactatagggacgtaccattcgttaaaattaggaggaagtaacagaggagaacttccatgtaattttaaaacctggcggcagcgcaaaagatg

SEQ ID NO: 235225 - DNA, 103 bp, Artificial Sequence
  Synthetic Polynucleotide
taatacgactcactatagggcggcggcggcggcggcggcggcggcgtgggaacagaggagacccacgatgccgccgccgaacctggcggcagcgcaaaagatg

SEQ ID NO: 235226 - DNA, 103 bp, Artificial Sequence
  Synthetic Polynucleotide
taatacgactcactatagggttgaaggcagcggcggcggcggcggcggcgaacagaggagacgccgcatgcgccgccgcaacctggcggcagcgcaaaagatg

SEQ ID NO: 235227 - DNA, 103 bp, Artificial Sequence
  Synthetic Polynucleotide
taatacgactcactatagggagggctcagcttgaaggcagcggcggcggcaacagaggagagccgccatggctgccttcaacctggcggcagcgcaaaagatg

SEQ ID NO: 235228 - DNA, 103 bp, Artificial Sequence
  Synthetic Polynucleotide
taatacgactcactataggggcgccgcggcagggctcagcttgaaggcagaacagaggagactgcctatgagctgagccaacctggcggcagcgcaaaagatg

SEQ ID NO: 235229 - DNA, 103 bp, Artificial Sequence
  Synthetic Polynucleotide
taatacgactcactataggggatagatcgtgcgccgcggcagggctcagcaacagaggagagctgagatgtgccgcggcaacctggcggcagcgcaaaagatg

SEQ ID NO: 235230 - DNA, 103 bp, Artificial Sequence
  Synthetic Polynucleotide
taatacgactcactatagggctggcctgaagatagatcgtgcgccgcggcaacagaggagagccgcgatgcacgatctaaacctggcggcagcgcaaaagatg

SEQ ID NO: 235231 - DNA, 103 bp, Artificial Sequence
  Synthetic Polynucleotide
taatacgactcactataggggcccagggaactgcgggcctccgtccaggaaacagaggagatcctggatggaggcccgcaacctggcggcagcgcaaaagatg

SEQ ID NO: 235232 - DNA, 103 bp, Artificial Sequence
  Synthetic Polynucleotide
taatacgactcactatagggaagccgagctctggcctgaagatagatcgtaacagaggagaacgatcatgcttcaggccaacctggcggcagcgcaaaagatg

SEQ ID NO: 235233 - DNA, 103 bp, Artificial Sequence
  Synthetic Polynucleotide
taatacgactcactatagggtgcggcgtgaaagccgagctctggcctgaaaacagaggagattcaggatggagctcggcaacctggcggcagcgcaaaagatg

SEQ ID NO: 235234 - DNA, 103 bp, Artificial Sequence
  Synthetic Polynucleotide
taatacgactcactataggggcccgaaccctgcggcgtgaaagccgagctaacagaggagaagctcgatgttcacgccgaacctggcggcagcgcaaaagatg

SEQ ID NO: 235235 - DNA, 103 bp, Artificial Sequence
  Synthetic Polynucleotide
taatacgactcactatagggcgttggcgtagcccgaaccctgcggcgtgaaacagaggagatcacgcatgagggttcggaacctggcggcagcgcaaaagatg

SEQ ID NO: 235236 - DNA, 103 bp, Artificial Sequence
  Synthetic Polynucleotide
taatacgactcactatagggtggcccagggcgttggcgtagcccgaacccaacagaggagagggttcatgctacgccaaaacctggcggcagcgcaaaagatg

SEQ ID NO: 235237 - DNA, 103 bp, Artificial Sequence
  Synthetic Polynucleotide
taatacgactcactataggggtggtgatggtggcccagggcgttggcgtaaacagaggagatacgccatggccctgggcaacctggcggcagcgcaaaagatg

SEQ ID NO: 235238 - DNA, 103 bp, Artificial Sequence
  Synthetic Polynucleotide
taatacgactcactatagggggtgatggtggtggtgatggtggcccagggaacagaggagaccctggatgaccatcaccaacctggcggcagcgcaaaagatg

SEQ ID NO: 235239 - DNA, 103 bp, Artificial Sequence
  Synthetic Polynucleotide
taatacgactcactatagggtggtgatgatggtgatggtggtggtgatggaacagaggagaccatcaatgccaccatcaaacctggcggcagcgcaaaagatg

SEQ ID NO: 235240 - DNA, 103 bp, Artificial Sequence
  Synthetic Polynucleotide
taatacgactcactatagggctggctggtgtggtgatgatggtgatggtgaacagaggagacaccatatgcatcatcacaacctggcggcagcgcaaaagatg

SEQ ID NO: 235241 - DNA, 103 bp, Artificial Sequence
  Synthetic Polynucleotide
taatacgactcactatagggagctgggcacctggctggtgtggtgatgataacagaggagaatcatcatgacaccagccaacctggcggcagcgcaaaagatg

SEQ ID NO: 235242 - DNA, 103 bp, Artificial Sequence
  Synthetic Polynucleotide
taatacgactcactatagggcccactcccagcccagggaactgcgggcctaacagaggagaaggcccatggttccctggaacctggcggcagcgcaaaagatg

SEQ ID NO: 235243 - DNA, 103 bp, Artificial Sequence
  Synthetic Polynucleotide
taatacgactcactataggggcgccaccgtagctgggcacctggctggtgaacagaggagacaccagatgggtgcccagaacctggcggcagcgcaaaagatg

SEQ ID NO: 235244 - DNA, 103 bp, Artificial Sequence
  Synthetic Polynucleotide
taatacgactcactatagggggcagaggcagcgccaccgtagctgggcacaacagaggagagtgcccatgtacggtggcaacctggcggcagcgcaaaagatg

SEQ ID NO: 235245 - DNA, 103 bp, Artificial Sequence
  Synthetic Polynucleotide
taatacgactcactatagggagttgaaggcggcagaggcagcgccaccgtaacagaggagaacggtgatgctgcctctgaacctggcggcagcgcaaaagatg

SEQ ID NO: 235246 - DNA, 103 bp, Artificial Sequence
  Synthetic Polynucleotide
taatacgactcactatagggtcgcgcgttgagttgaaggcggcagaggcaaacagaggagatgcctcatgcgccttcaaaacctggcggcagcgcaaaagatg

SEQ ID NO: 235247 - DNA, 103 bp, Artificial Sequence
  Synthetic Polynucleotide
taatacgactcactataggggaacagaaactcgcgcgttgagttgaaggcaacagaggagagccttcatgtcaacgcgcaacctggcggcagcgcaaaagatg

SEQ ID NO: 235248 - DNA, 103 bp, Artificial Sequence
  Synthetic Polynucleotide
taatacgactcactatagggtgcgctggcggaacagaaactcgcgcgttgaacagaggagacaacgcatgagtttctgtaacctggcggcagcgcaaaagatg

SEQ ID NO: 235249 - DNA, 103 bp, Artificial Sequence
  Synthetic Polynucleotide
taatacgactcactatagggagcccggagctgcgctggcggaacagaaacaacagaggagagtttctatgccgccagcgaacctggcggcagcgcaaaagatg

SEQ ID NO: 235250 - DNA, 103 bp, Artificial Sequence
  Synthetic Polynucleotide
taatacgactcactatagggcgcctcactgagcccggagctgcgctggcgaacagaggagacgccagatgagctccgggaacctggcggcagcgcaaaagatg

SEQ ID NO: 235251 - DNA, 103 bp, Artificial Sequence
  Synthetic Polynucleotide
taatacgactcactatagggcacccgaggccgcctcactgagcccggagcaacagaggagagctccgatgtcagtgaggaacctggcggcagcgcaaaagatg

SEQ ID NO: 235252 - DNA, 103 bp, Artificial Sequence
  Synthetic Polynucleotide
taatacgactcactatagggtgctgcccgccacccgaggccgcctcactgaacagaggagacagtgaatgggcctcgggaacctggcggcagcgcaaaagatg

SEQ ID NO: 235253 - DNA, 103 bp, Artificial Sequence
  Synthetic Polynucleotide
taatacgactcactataggggccgaagctgcccactcccagcccagggaaaacagaggagattccctatgctgggagtgaacctggcggcagcgcaaaagatg

SEQ ID NO: 235254 - DNA, 103 bp, Artificial Sequence
  Synthetic Polynucleotide
taatacgactcactataggggaagagcccgtgctgcccgccacccgaggcaacagaggagagcctcgatgggcgggcagaacctggcggcagcgcaaaagatg

SEQ ID NO: 235255 - DNA, 103 bp, Artificial Sequence
  Synthetic Polynucleotide
taatacgactcactatagggccgagccggcgaagagcccgtgctgcccgcaacagaggagagcgggcatgacgggctctaacctggcggcagcgcaaaagatg

SEQ ID NO: 235256 - DNA, 103 bp, Artificial Sequence
  Synthetic Polynucleotide
taatacgactcactatagggaggctgctcgccgagccggcgaagagcccgaacagaggagacgggctatgcgccggctcaacctggcggcagcgcaaaagatg

SEQ ID NO: 235257 - DNA, 103 bp, Artificial Sequence
  Synthetic Polynucleotide
taatacgactcactatagggtggagcatgcaggctgctcgccgagccggcaacagaggagagccggcatggcgagcagcaacctggcggcagcgcaaaagatg

SEQ ID NO: 235258 - DNA, 103 bp, Artificial Sequence
  Synthetic Polynucleotide
taatacgactcactatagggggatgccagctggagcatgcaggctgctcgaacagaggagacgagcaatgtgcatgctcaacctggcggcagcgcaaaagatg

SEQ ID NO: 235259 - DNA, 103 bp, Artificial Sequence
  Synthetic Polynucleotide
taatacgactcactataggggggggctcggggatgccagctggagcatgcaacagaggagagcatgcatgagctggcataacctggcggcagcgcaaaagatg

SEQ ID NO: 235260 - DNA, 103 bp, Artificial Sequence
  Synthetic Polynucleotide
taatacgactcactatagggcaagtagctagggggctcggggatgccagcaacagaggagagctggcatgcccgagcccaacctggcggcagcgcaaaagatg

SEQ ID NO: 235261 - DNA, 103 bp, Artificial Sequence
  Synthetic Polynucleotide
taatacgactcactatagggcgggaaacagcaagtagctagggggctcggaacagaggagaccgagcatgctagctactaacctggcggcagcgcaaaagatg

SEQ ID NO: 235262 - DNA, 103 bp, Artificial Sequence
  Synthetic Polynucleotide
taatacgactcactatagggtcatgcagcccgggaaacagcaagtagctaaacagaggagatagctaatggctgtttccaacctggcggcagcgcaaaagatg

SEQ ID NO: 235263 - DNA, 103 bp, Artificial Sequence
  Synthetic Polynucleotide
taatacgactcactatagggagcgccctgctcatgcagcccgggaaacagaacagaggagactgtttatggggctgcataacctggcggcagcgcaaaagatg

SEQ ID NO: 235264 - DNA, 103 bp, Artificial Sequence
  Synthetic Polynucleotide
taatacgactcactatagggggcgcggcgcgccgaagctgcccactcccaaacagaggagatgggagatggcagcttcgaacctggcggcagcgcaaaagatg

SEQ ID NO: 235265 - DNA, 103 bp, Artificial Sequence
  Synthetic Polynucleotide
taatacgactcactatagggacgggtgcccagcgccctgctcatgcagccaacagaggagaggctgcatgagcagggcgaacctggcggcagcgcaaaagatg

SEQ ID NO: 235266 - DNA, 103 bp, Artificial Sequence
  Synthetic Polynucleotide
taatacgactcactatagggcctgtgggcgacgggtgcccagcgccctgcaacagaggagagcagggatgtgggcacccaacctggcggcagcgcaaaagatg

SEQ ID NO: 235267 - DNA, 103 bp, Artificial Sequence
  Synthetic Polynucleotide
taatacgactcactataggggtccacgtgccctgtgggcgacgggtgcccaacagaggagagggcacatgtcgcccacaaacctggcggcagcgcaaaagatg

SEQ ID NO: 235268 - DNA, 103 bp, Artificial Sequence
  Synthetic Polynucleotide
taatacgactcactatagggcctggttgttgtccacgtgccctgtgggcgaacagaggagacgcccaatgggcacgtggaacctggcggcagcgcaaaagatg

SEQ ID NO: 235269 - DNA, 103 bp, Artificial Sequence
  Synthetic Polynucleotide
taatacgactcactatagggcccaggtggacctggttgttgtccacgtgcaacagaggagagcacgtatgcaacaaccaaacctggcggcagcgcaaaagatg

SEQ ID NO: 235270 - DNA, 103 bp, Artificial Sequence
  Synthetic Polynucleotide
taatacgactcactatagggcccacgcagccccaggtggacctggttgttaacagaggagaaacaacatggtccacctgaacctggcggcagcgcaaaagatg

SEQ ID NO: 235271 - DNA, 103 bp, Artificial Sequence
  Synthetic Polynucleotide
taatacgactcactatagggcgaacagctccccacgcagccccaggtggaaacagaggagatccaccatgggctgcgtgaacctggcggcagcgcaaaagatg

SEQ ID NO: 235272 - DNA, 103 bp, Artificial Sequence
  Synthetic Polynucleotide
taatacgactcactatagggtcagcacggccgaacagctccccacgcagcaacagaggagagctgcgatgggagctgttaacctggcggcagcgcaaaagatg

SEQ ID NO: 235273 - DNA, 103 bp, Artificial Sequence
  Synthetic Polynucleotide
taatacgactcactataggggcggtatgggtcagcacggccgaacagctcaacagaggagagagctgatgggccgtgctaacctggcggcagcgcaaaagatg

SEQ ID NO: 235274 - DNA, 103 bp, Artificial Sequence
  Synthetic Polynucleotide
taatacgactcactatagggtggccactgggcggtatgggtcagcacggcaacagaggagagccgtgatgacccataccaacctggcggcagcgcaaaagatg

SEQ ID NO: 235275 - DNA, 103 bp, Artificial Sequence
  Synthetic Polynucleotide
taatacgactcactatagggatctcgtggtggcgcggcgcgccgaagctgaacagaggagacagcttatgcgcgccgcgaacctggcggcagcgcaaaagatg

SEQ ID NO: 235276 - DNA, 103 bp, Artificial Sequence
  Synthetic Polynucleotide
taatacgactcactataggggtgcgcgggctggccactgggcggtatgggaacagaggagacccataatgcccagtggcaacctggcggcagcgcaaaagatg

SEQ ID NO: 235277 - DNA, 103 bp, Artificial Sequence
  Synthetic Polynucleotide
taatacgactcactataggggtaggggtccgtgcgcgggctggccactggaacagaggagaccagtgatgagcccgcgcaacctggcggcagcgcaaaagatg

SEQ ID NO: 235278 - DNA, 103 bp, Artificial Sequence
  Synthetic Polynucleotide
taatacgactcactatagggcgccggccgcgtaggggtccgtgcgcgggcaacagaggagagcccgcatgcggacccctaacctggcggcagcgcaaaagatg

SEQ ID NO: 235279 - DNA, 103 bp, Artificial Sequence
  Synthetic Polynucleotide
taatacgactcactatagggggaaactgagcgccggccgcgtaggggtccaacagaggagaggacccatgcgcggccggaacctggcggcagcgcaaaagatg

SEQ ID NO: 235280 - DNA, 103 bp, Artificial Sequence
  Synthetic Polynucleotide
taatacgactcactataggggctgtagttaggaaactgagcgccggccgcaacagaggagagcggccatggctcagtttaacctggcggcagcgcaaaagatg

SEQ ID NO: 235281 - DNA, 103 bp, Artificial Sequence
  Synthetic Polynucleotide
taatacgactcactatagggtgttcatggggctgtagttaggaaactgagaacagaggagactcagtatgctaactacaaacctggcggcagcgcaaaagatg

SEQ ID NO: 235282 - DNA, 103 bp, Artificial Sequence
  Synthetic Polynucleotide
taatacgactcactatagggcccatgttcatgttcatggggctgtagttaaacagaggagataactaatgccccatgaaaacctggcggcagcgcaaaagatg

SEQ ID NO: 235283 - DNA, 103 bp, Artificial Sequence
  Synthetic Polynucleotide
taatacgactcactatagggcacgttcactcccatgttcatgttcatgggaacagaggagacccatgatgatgaacatgaacctggcggcagcgcaaaagatg

SEQ ID NO: 235284 - DNA, 103 bp, Artificial Sequence
  Synthetic Polynucleotide
taatacgactcactatagggggtgggccgccacgttcactcccatgttcaaacagaggagatgaacaatggagtgaacgaacctggcggcagcgcaaaagatg

SEQ ID NO: 235285 - DNA, 103 bp, Artificial Sequence
  Synthetic Polynucleotide
taatacgactcactatagggccgggcccgtggtgggccgccacgttcactaacagaggagaagtgaaatgggcggcccaaacctggcggcagcgcaaaagatg

SEQ ID NO: 235286 - DNA, 103 bp, Artificial Sequence
  Synthetic Polynucleotide
taatacgactcactatagggacggttgggcatctcgtggtggcgcggcgcaacagaggagagcgccgatgcaccacgagaacctggcggcagcgcaaaagatg

SEQ ID NO: 235287 - DNA, 103 bp, Artificial Sequence
  Synthetic Polynucleotide
taatacgactcactataggggaagaaggcgccgggcccgtggtgggccgcaacagaggagagcggccatgcacgggcccaacctggcggcagcgcaaaagatg

SEQ ID NO: 235288 - DNA, 103 bp, Artificial Sequence
  Synthetic Polynucleotide
taatacgactcactataggggcatataacggaagaaggcgccgggcccgtaacagaggagaacgggcatggcgccttctaacctggcggcagcgcaaaagatg

SEQ ID NO: 235289 - DNA, 103 bp, Artificial Sequence
  Synthetic Polynucleotide
taatacgactcactatagggataggctgccgcatataacggaagaaggcgaacagaggagacgccttatgccgttatataacctggcggcagcgcaaaagatg

SEQ ID NO: 235290 - DNA, 103 bp, Artificial Sequence
  Synthetic Polynucleotide
taatacgactcactatagggctcctgcttgataggctgccgcatataacgaacagaggagacgttatatgcggcagcctaacctggcggcagcgcaaaagatg

SEQ ID NO: 235291 - DNA, 103 bp, Artificial Sequence
  Synthetic Polynucleotide
taatacgactcactatagggtgcacgacagctcctgcttgataggctgccaacagaggagaggcagcatgtcaagcaggaacctggcggcagcgcaaaagatg

SEQ ID NO: 235292 - DNA, 103 bp, Artificial Sequence
  Synthetic Polynucleotide
taatacgactcactatagggtcgatccacttgcacgacagctcctgcttgaacagaggagacaagcaatggctgtcgtgaacctggcggcagcgcaaaagatg

SEQ ID NO: 235293 - DNA, 103 bp, Artificial Sequence
  Synthetic Polynucleotide
taatacgactcactatagggctgagcctcgtcgatccacttgcacgacagaacagaggagactgtcgatgaagtggatcaacctggcggcagcgcaaaagatg

SEQ ID NO: 235294 - DNA, 103 bp, Artificial Sequence
  Synthetic Polynucleotide
taatacgactcactataggggccggctcagctgagcctcgtcgatccactaacagaggagaagtggaatgacgaggctcaacctggcggcagcgcaaaagatg

SEQ ID NO: 235295 - DNA, 103 bp, Artificial Sequence
  Synthetic Polynucleotide
taatacgactcactatagggctcttcttgggccggctcagctgagcctcgaacagaggagacgaggcatggctgagccgaacctggcggcagcgcaaaagatg

SEQ ID NO: 235296 - DNA, 103 bp, Artificial Sequence
  Synthetic Polynucleotide
taatacgactcactatagggccggtcgcagctcttcttgggccggctcagaacagaggagactgagcatgcccaagaagaacctggcggcagcgcaaaagatg

SEQ ID NO: 235297 - DNA, 103 bp, Artificial Sequence
  Synthetic Polynucleotide
taatacgactcactatagggctgccggctcacggttgggcatctcgtggtaacagaggagaaccacgatgtgcccaaccaacctggcggcagcgcaaaagatg

SEQ ID NO: 235298 - DNA, 103 bp, Artificial Sequence
  Synthetic Polynucleotide
taatacgactcactatagggtgctgaaggtccggtcgcagctcttcttggaacagaggagaccaagaatggctgcgaccaacctggcggcagcgcaaaagatg

SEQ ID NO: 235299 - DNA, 103 bp, Artificial Sequence
  Synthetic Polynucleotide
taatacgactcactatagggtcatgcatggtgctgaaggtccggtcgcagaacagaggagactgcgaatggaccttcagaacctggcggcagcgcaaaagatg

SEQ ID NO: 235300 - DNA, 103 bp, Artificial Sequence
  Synthetic Polynucleotide
taatacgactcactatagggtgtcaccagctcatgcatggtgctgaaggtaacagaggagaaccttcatgaccatgcataacctggcggcagcgcaaaagatg

SEQ ID NO: 235301 - DNA, 103 bp, Artificial Sequence
  Synthetic Polynucleotide
taatacgactcactatagggtggtgacatgtgtcaccagctcatgcatggaacagaggagaccatgcatgagctggtgaaacctggcggcagcgcaaaagatg

SEQ ID NO: 235302 - DNA, 103 bp, Artificial Sequence
  Synthetic Polynucleotide
taatacgactcactatagggacatgctccatggtgacatgtgtcaccagcaacagaggagagctggtatgacatgtcacaacctggcggcagcgcaaaagatg

SEQ ID NO: 235303 - DNA, 103 bp, Artificial Sequence
  Synthetic Polynucleotide
taatacgactcactatagggcgggccccccacatgctccatggtgacatgaacagaggagacatgtcatgatggagcataacctggcggcagcgcaaaagatg

SEQ ID NO: 235304 - DNA, 103 bp, Artificial Sequence
  Synthetic Polynucleotide
taatacgactcactatagggtgttctgctccgggccccccacatgctccaaacagaggagatggagcatgtggggggccaacctggcggcagcgcaaaagatg

SEQ ID NO: 235305 - DNA, 103 bp, Artificial Sequence
  Synthetic Polynucleotide
taatacgactcactatagggcagacgtggttgttctgctccgggccccccaacagaggagaggggggatgggagcagaaaacctggcggcagcgcaaaagatg

SEQ ID NO: 235306 - DNA, 103 bp, Artificial Sequence
  Synthetic Polynucleotide
taatacgactcactatagggctcccagtagcagacgtggttgttctgctcaacagaggagagagcagatgaaccacgtcaacctggcggcagcgcaaaagatg

SEQ ID NO: 235307 - DNA, 103 bp, Artificial Sequence
  Synthetic Polynucleotide
taatacgactcactataggggggggcactcctcccagtagcagacgtggtaacagaggagaaccacgatggctactgggaacctggcggcagcgcaaaagatg

SEQ ID NO: 235308 - DNA, 103 bp, Artificial Sequence
  Synthetic Polynucleotide
taatacgactcactatagggagccccatgcctgccggctcacggttgggcaacagaggagagcccaaatgtgagccggcaacctggcggcagcgcaaaagatg

SEQ ID NO: 235309 - DNA, 103 bp, Artificial Sequence
  Synthetic Polynucleotide
taatacgactcactatagggttgccctcccgggggcactcctcccagtagaacagaggagactactgatgggagtgcccaacctggcggcagcgcaaaagatg

SEQ ID NO: 235310 - DNA, 103 bp, Artificial Sequence
  Synthetic Polynucleotide
taatacgactcactatagggcttgaaagacttgccctcccgggggcactcaacagaggagagagtgcatgcgggagggcaacctggcggcagcgcaaaagatg

SEQ ID NO: 235311 - DNA, 103 bp, Artificial Sequence
  Synthetic Polynucleotide
taatacgactcactatagggtgtacttcgccttgaaagacttgccctcccaacagaggagagggaggatgagtctttcaaacctggcggcagcgcaaaagatg

SEQ ID NO: 235312 - DNA, 103 bp, Artificial Sequence
  Synthetic Polynucleotide
taatacgactcactatagggttgaccagtttgtacttcgccttgaaagacaacagaggagagtctttatgggcgaagtaaacctggcggcagcgcaaaagatg

SEQ ID NO: 235313 - DNA, 103 bp, Artificial Sequence
  Synthetic Polynucleotide
taatacgactcactatagggtcggatgtggttgaccagtttgtacttcgcaacagaggagagcgaagatgaaactggtcaacctggcggcagcgcaaaagatg

SEQ ID NO: 235314 - DNA, 103 bp, Artificial Sequence
  Synthetic Polynucleotide
taatacgactcactatagggccgtgtgcactcggatgtggttgaccagttaacagaggagaaactggatgaccacatccaacctggcggcagcgcaaaagatg

SEQ ID NO: 235315 - DNA, 103 bp, Artificial Sequence
  Synthetic Polynucleotide
taatacgactcactatagggggcttctcgcccgtgtgcactcggatgtggaacagaggagaccacatatgagtgcacacaacctggcggcagcgcaaaagatg

SEQ ID NO: 235316 - DNA, 103 bp, Artificial Sequence
  Synthetic Polynucleotide
taatacgactcactataggggcatgggaagggcttctcgcccgtgtgcacaacagaggagagtgcacatgggcgagaagaacctggcggcagcgcaaaagatg

SEQ ID NO: 235317 - DNA, 103 bp, Artificial Sequence
  Synthetic Polynucleotide
taatacgactcactatagggccgggaaggggcatgggaagggcttctcgcaacagaggagagcgagaatgccttcccataacctggcggcagcgcaaaagatg

SEQ ID NO: 235318 - DNA, 103 bp, Artificial Sequence
  Synthetic Polynucleotide
taatacgactcactatagggttcccgcagcccgggaaggggcatgggaagaacagaggagacttcccatgccccttcccaacctggcggcagcgcaaaagatg

SEQ ID NO: 235319 - DNA, 103 bp, Artificial Sequence
  Synthetic Polynucleotide
taatacgactcactatagggtttcctaagactttgacatgggccattcataacagaggagaatgaatatgccatgtcaaaacctggcggcagcgcaaaagatg

SEQ ID NO: 235320 - DNA, 103 bp, Artificial Sequence
  Synthetic Polynucleotide
taatacgactcactatagggtctcattttctgactttgagccttggaatcaacagaggagagattccatggctcaaagtaacctggcggcagcgcaaaagatg

SEQ ID NO: 235321 - DNA, 103 bp, Artificial Sequence
  Synthetic Polynucleotide
taatacgactcactatagggtgtagccgaatcgtagccagagctgggcggaacagaggagaccgcccatgtctggctacaacctggcggcagcgcaaaagatg

SEQ ID NO: 235322 - DNA, 103 bp, Artificial Sequence
  Synthetic Polynucleotide
taatacgactcactataggggggcagacggtgtagccgaatcgtagccagaacagaggagactggctatgattcggctaaacctggcggcagcgcaaaagatg

SEQ ID NO: 235323 - DNA, 103 bp, Artificial Sequence
  Synthetic Polynucleotide
taatacgactcactatagggggcgacacgagggcagacggtgtagccgaaaacagaggagattcggcatgaccgtctgcaacctggcggcagcgcaaaagatg

SEQ ID NO: 235324 - DNA, 103 bp, Artificial Sequence
  Synthetic Polynucleotide
taatacgactcactataggggtccgacgagggcgacacgagggcagacggaacagaggagaccgtctatgctcgtgtcgaacctggcggcagcgcaaaagatg

SEQ ID NO: 235325 - DNA, 103 bp, Artificial Sequence
  Synthetic Polynucleotide
taatacgactcactatagggtgtggccgcagtccgacgagggcgacacgaaacagaggagatcgtgtatgcctcgtcggaacctggcggcagcgcaaaagatg

SEQ ID NO: 235326 - DNA, 103 bp, Artificial Sequence
  Synthetic Polynucleotide
taatacgactcactatagggacctgggacttgtggccgcagtccgacgagaacagaggagactcgtcatgctgcggccaaacctggcggcagcgcaaaagatg

SEQ ID NO: 235327 - DNA, 103 bp, Artificial Sequence
  Synthetic Polynucleotide
taatacgactcactatagggcgaggaggccacctgggacttgtggccgcaaacagaggagatgcggcatgaagtcccagaacctggcggcagcgcaaaagatg

SEQ ID NO: 235328 - DNA, 103 bp, Artificial Sequence
  Synthetic Polynucleotide
taatacgactcactatagggccaccgccgccgaggaggccacctgggactaacagaggagaagtcccatgtggcctcctaacctggcggcagcgcaaaagatg

SEQ ID NO: 235329 - DNA, 103 bp, Artificial Sequence
  Synthetic Polynucleotide
taatacgactcactataggggtacgcgccgccaccgccgccgaggaggccaacagaggagaggcctcatgggcggcggtaacctggcggcagcgcaaaagatg

SEQ ID NO: 235330 - DNA, 103 bp, Artificial Sequence
  Synthetic Polynucleotide
taatacgactcactatagggcaagtcggcggtacgcgccgccaccgccgcaacagaggagagcggcgatggcggcgcgtaacctggcggcagcgcaaaagatg

SEQ ID NO: 235331 - DNA, 103 bp, Artificial Sequence
  Synthetic Polynucleotide
taatacgactcactatagggatgtcttgtatctcattttctgactttgagaacagaggagactcaaaatgagaaaatgaaacctggcggcagcgcaaaagatg

SEQ ID NO: 235332 - DNA, 103 bp, Artificial Sequence
  Synthetic Polynucleotide
taatacgactcactatagggatcaccaaggatgtcttgtatctcattttcaacagaggagagaaaatatgatacaagacaacctggcggcagcgcaaaagatg

SEQ ID NO: 235333 - DNA, 103 bp, Artificial Sequence
  Synthetic Polynucleotide
taatacgactcactatagggtcgtttcctcatcaccaaggatgtcttgtaaacagaggagatacaagatgtccttggtgaacctggcggcagcgcaaaagatg

SEQ ID NO: 235334 - DNA, 103 bp, Artificial Sequence
  Synthetic Polynucleotide
taatacgactcactatagggaaagccgtaatcgtttcctcatcaccaaggaacagaggagaccttggatgtgaggaaacaacctggcggcagcgcaaaagatg

SEQ ID NO: 235335 - DNA, 103 bp, Artificial Sequence
  Synthetic Polynucleotide
taatacgactcactataggggtgtttcggtaaagccgtaatcgtttcctcaacagaggagagaggaaatgattacggctaacctggcggcagcgcaaaagatg

SEQ ID NO: 235336 - DNA, 103 bp, Artificial Sequence
  Synthetic Polynucleotide
taatacgactcactatagggctctttaagagtgtttcggtaaagccgtaaaacagaggagattacggatgtaccgaaacaacctggcggcagcgcaaaagatg

SEQ ID NO: 235337 - DNA, 103 bp, Artificial Sequence
  Synthetic Polynucleotide
taatacgactcactatagggtgctacttgactctttaagagtgtttcggtaacagaggagaaccgaaatgctcttaaagaacctggcggcagcgcaaaagatg

SEQ ID NO: 235338 - DNA, 103 bp, Artificial Sequence
  Synthetic Polynucleotide
taatacgactcactatagggtgtccagagctgctacttgactctttaagaaacagaggagatcttaaatggtcaagtagaacctggcggcagcgcaaaagatg

SEQ ID NO: 235339 - DNA, 103 bp, Artificial Sequence
  Synthetic Polynucleotide
taatacgactcactatagggggggccatggtgtccagagctgctacttgaaacagaggagatcaagtatgagctctggaaacctggcggcagcgcaaaagatg

SEQ ID NO: 235340 - DNA, 103 bp, Artificial Sequence
  Synthetic Polynucleotide
taatacgactcactataggggcccctccgctttcctaagactttgacatgaacagaggagacatgtcatggtcttaggaaacctggcggcagcgcaaaagatg

SEQ ID NO: 235341 - DNA, 103 bp, Artificial Sequence
  Synthetic Polynucleotide
taatacgactcactatagggcggtgagctgggggccatggtgtccagagcaacagaggagagctctgatgaccatggccaacctggcggcagcgcaaaagatg

SEQ ID NO: 235342 - DNA, 103 bp, Artificial Sequence
  Synthetic Polynucleotide
taatacgactcactatagggctggaggcggcggtgagctgggggccatggaacagaggagaccatggatgccagctcacaacctggcggcagcgcaaaagatg

SEQ ID NO: 235343 - DNA, 103 bp, Artificial Sequence
  Synthetic Polynucleotide
taatacgactcactatagggcaccgaggggctggaggcggcggtgagctgaacagaggagacagctcatggccgcctccaacctggcggcagcgcaaaagatg

SEQ ID NO: 235344 - DNA, 103 bp, Artificial Sequence
  Synthetic Polynucleotide
taatacgactcactatagggggcccgggaacaccgaggggctggaggcggaacagaggagaccgcctatggcccctcggaacctggcggcagcgcaaaagatg

SEQ ID NO: 235345 - DNA, 103 bp, Artificial Sequence
  Synthetic Polynucleotide
taatacgactcactatagggtcctcgtggaggcccgggaacaccgaggggaacagaggagacccctcatggttcccgggaacctggcggcagcgcaaaagatg

SEQ ID NO: 235346 - DNA, 103 bp, Artificial Sequence
  Synthetic Polynucleotide
taatacgactcactatagggctggggaggctcctcgtggaggcccgggaaaacagaggagattcccgatgctccacgagaacctggcggcagcgcaaaagatg

SEQ ID NO: 235347 - DNA, 103 bp, Artificial Sequence
  Synthetic Polynucleotide
taatacgactcactatagggtgggggaggcctggggaggctcctcgtggaaacagaggagatccacgatgagcctccccaacctggcggcagcgcaaaagatg

SEQ ID NO: 235348 - DNA, 103 bp, Artificial Sequence
  Synthetic Polynucleotide
taatacgactcactatagggaaaggacggctgggggaggcctggggaggcaacagaggagagcctccatgggcctccccaacctggcggcagcgcaaaagatg

SEQ ID NO: 235349 - DNA, 103 bp, Artificial Sequence
  Synthetic Polynucleotide
taatacgactcactataggggagtccattcaaaggacggctgggggaggcaacagaggagagcctccatgagccgtcctaacctggcggcagcgcaaaagatg

SEQ ID NO: 235350 - DNA, 103 bp, Artificial Sequence
  Synthetic Polynucleotide
taatacgactcactatagggccagacgcaggagtccattcaaaggacggcaacagaggagagccgtcatgtgaatggacaacctggcggcagcgcaaaagatg

SEQ ID NO: 235351 - DNA, 103 bp, Artificial Sequence
  Synthetic Polynucleotide
taatacgactcactatagggccctccaaaagcccctccgctttcctaagaaacagaggagatcttagatgagcggagggaacctggcggcagcgcaaaagatg

SEQ ID NO: 235352 - DNA, 103 bp, Artificial Sequence
  Synthetic Polynucleotide
taatacgactcactatagggccagggagccccagacgcaggagtccattcaacagaggagagaatggatgcctgcgtctaacctggcggcagcgcaaaagatg

SEQ ID NO: 235353 - DNA, 103 bp, Artificial Sequence
  Synthetic Polynucleotide
taatacgactcactataggggtacatgtctccagggagccccagacgcagaacagaggagactgcgtatggggctccctaacctggcggcagcgcaaaagatg

SEQ ID NO: 235354 - DNA, 103 bp, Artificial Sequence
  Synthetic Polynucleotide
taatacgactcactatagggccggccgcgcgtacatgtctccagggagccaacagaggagaggctccatggagacatgtaacctggcggcagcgcaaaagatg

SEQ ID NO: 235355 - DNA, 103 bp, Artificial Sequence
  Synthetic Polynucleotide
taatacgactcactataggggggaagggctccggccgcgcgtacatgtctaacagaggagaagacatatgcgcgcggccaacctggcggcagcgcaaaagatg

SEQ ID NO: 235356 - DNA, 103 bp, Artificial Sequence
  Synthetic Polynucleotide
taatacgactcactatagggaggccctggcgggaagggctccggccgcgcaacagaggagagcgcggatggagcccttcaacctggcggcagcgcaaaagatg

SEQ ID NO: 235357 - DNA, 103 bp, Artificial Sequence
  Synthetic Polynucleotide
taatacgactcactatagggtgcgggccgcaggccctggcgggaagggctaacagaggagaagccctatgcgccagggcaacctggcggcagcgcaaaagatg

SEQ ID NO: 235358 - DNA, 103 bp, Artificial Sequence
  Synthetic Polynucleotide
taatacgactcactatagggagggcgtcgctgcgggccgcaggccctggcaacagaggagagccaggatgtgcggcccgaacctggcggcagcgcaaaagatg

SEQ ID NO: 235359 - DNA, 103 bp, Artificial Sequence
  Synthetic Polynucleotide
taatacgactcactatagggggcagctgccagggcgtcgctgcgggccgcaacagaggagagcggccatgagcgacgccaacctggcggcagcgcaaaagatg

SEQ ID NO: 235360 - DNA, 103 bp, Artificial Sequence
  Synthetic Polynucleotide
taatacgactcactataggggcagggctgcggcagctgccagggcgtcgcaacagaggagagcgacgatgtggcagctgaacctggcggcagcgcaaaagatg

SEQ ID NO: 235361 - DNA, 103 bp, Artificial Sequence
  Synthetic Polynucleotide
taatacgactcactatagggccgtagccatgcagggctgcggcagctgccaacagaggagaggcagcatgcgcagccctaacctggcggcagcgcaaaagatg

SEQ ID NO: 235362 - DNA, 103 bp, Artificial Sequence
  Synthetic Polynucleotide
taatacgactcactatagggcgaagtgcaaccctccaaaagcccctccgcaacagaggagagcggagatgcttttggagaacctggcggcagcgcaaaagatg

SEQ ID NO: 235363 - DNA, 103 bp, Artificial Sequence
  Synthetic Polynucleotide
taatacgactcactataggggttcatgcccccgtagccatgcagggctgcaacagaggagagcagccatgcatggctacaacctggcggcagcgcaaaagatg

SEQ ID NO: 235364 - DNA, 103 bp, Artificial Sequence
  Synthetic Polynucleotide
taatacgactcactatagggtcaccgtcaggttcatgcccccgtagccataacagaggagaatggctatgggggcatgaaacctggcggcagcgcaaaagatg

SEQ ID NO: 235365 - DNA, 103 bp, Artificial Sequence
  Synthetic Polynucleotide
taatacgactcactataggggcagcgaggttcaccgtcaggttcatgcccaacagaggagagggcatatgcctgacggtaacctggcggcagcgcaaaagatg

SEQ ID NO: 235366 - DNA, 103 bp, Artificial Sequence
  Synthetic Polynucleotide
taatacgactcactatagggaccgtggggcgcagcgaggttcaccgtcagaacagaggagactgacgatgaacctcgctaacctggcggcagcgcaaaagatg

SEQ ID NO: 235367 - DNA, 103 bp, Artificial Sequence
  Synthetic Polynucleotide
taatacgactcactatagggaagcgccaggaccgtggggcgcagcgaggtaacagaggagaacctcgatgcgccccacgaacctggcggcagcgcaaaagatg

SEQ ID NO: 235368 - DNA, 103 bp, Artificial Sequence
  Synthetic Polynucleotide
taatacgactcactatagggtagcggaagaaagcgccaggaccgtggggcaacagaggagagccccaatgtcctggcgcaacctggcggcagcgcaaaagatg

SEQ ID NO: 235369 - DNA, 103 bp, Artificial Sequence
  Synthetic Polynucleotide
taatacgactcactatagggctggcgcatgtagcggaagaaagcgccaggaacagaggagacctggcatgttcttccgcaacctggcggcagcgcaaaagatg

SEQ ID NO: 235370 - DNA, 103 bp, Artificial Sequence
  Synthetic Polynucleotide
taatacgactcactataggggtttgatgggctggcgcatgtagcggaagaaacagaggagatcttccatgacatgcgccaacctggcggcagcgcaaaagatg

SEQ ID NO: 235371 - DNA, 103 bp, Artificial Sequence
  Synthetic Polynucleotide
taatacgactcactatagggatgagctcctgtttgatgggctggcgcatgaacagaggagacatgcgatggcccatcaaaacctggcggcagcgcaaaagatg

SEQ ID NO: 235372 - DNA, 103 bp, Artificial Sequence
  Synthetic Polynucleotide
taatacgactcactatagggccacttgcagatgagctcctgtttgatgggaacagaggagacccatcatgcaggagctcaacctggcggcagcgcaaaagatg

SEQ ID NO: 235373 - DNA, 103 bp, Artificial Sequence
  Synthetic Polynucleotide
taatacgactcactatagggcggtgacggccgaagtgcaaccctccaaaaaacagaggagattttggatggttgcacttaacctggcggcagcgcaaaagatg

SEQ ID NO: 235374 - DNA, 103 bp, Artificial Sequence
  Synthetic Polynucleotide
taatacgactcactatagggcggccgccagccacttgcagatgagctcctaacagaggagaaggagcatgtctgcaagtaacctggcggcagcgcaaaagatg

SEQ ID NO: 235375 - DNA, 103 bp, Artificial Sequence
  Synthetic Polynucleotide
taatacgactcactataggggcggtgccgtcggccgccagccacttgcagaacagaggagactgcaaatggctggcggcaacctggcggcagcgcaaaagatg

SEQ ID NO: 235376 - DNA, 103 bp, Artificial Sequence
  Synthetic Polynucleotide
taatacgactcactataggggctcggggtcgcggtgccgtcggccgccagaacagaggagactggcgatggacggcaccaacctggcggcagcgcaaaagatg

SEQ ID NO: 235377 - DNA, 103 bp, Artificial Sequence
  Synthetic Polynucleotide
taatacgactcactatagggtggagcagaggctcggggtcgcggtgccgtaacagaggagaacggcaatgcgaccccgaaacctggcggcagcgcaaaagatg

SEQ ID NO: 235378 - DNA, 103 bp, Artificial Sequence
  Synthetic Polynucleotide
taatacgactcactatagggctgaaagttttggagcagaggctcggggtcaacagaggagagaccccatgcctctgctcaacctggcggcagcgcaaaagatg

SEQ ID NO: 235379 - DNA, 103 bp, Artificial Sequence
  Synthetic Polynucleotide
taatacgactcactataggggtgcatggtgctgaaagttttggagcagagaacagaggagactctgcatgaaaactttcaacctggcggcagcgcaaaagatg

SEQ ID NO: 235380 - DNA, 103 bp, Artificial Sequence
  Synthetic Polynucleotide
taatacgactcactatagggtgaccagctcgtgcatggtgctgaaagtttaacagaggagaaaacttatggcaccatgcaacctggcggcagcgcaaaagatg

SEQ ID NO: 235381 - DNA, 103 bp, Artificial Sequence
  Synthetic Polynucleotide
taatacgactcactataggggtgacgtgcgtgaccagctcgtgcatggtgaacagaggagacaccatatgcgagctggtaacctggcggcagcgcaaaagatg

SEQ ID NO: 235382 - DNA, 103 bp, Artificial Sequence
  Synthetic Polynucleotide
taatacgactcactataggggtgctccacggtgacgtgcgtgaccagctcaacagaggagagagctgatgacgcacgtcaacctggcggcagcgcaaaagatg

SEQ ID NO: 235383 - DNA, 103 bp, Artificial Sequence
  Synthetic Polynucleotide
taatacgactcactatagggggccgccgacgtgctccacggtgacgtgcgaacagaggagacgcacgatgccgtggagcaacctggcggcagcgcaaaagatg

SEQ ID NO: 235384 - DNA, 103 bp, Artificial Sequence
  Synthetic Polynucleotide
taatacgactcactatagggttcctgaagacggtgacggccgaagtgcaaaacagaggagattgcacatgggccgtcacaacctggcggcagcgcaaaagatg

SEQ ID NO: 235385 - DNA, 103 bp, Artificial Sequence
  Synthetic Polynucleotide
taatacgactcactataggggcctgttccgggccgccgacgtgctccacgaacagaggagacgtggaatgcgtcggcggaacctggcggcagcgcaaaagatg

SEQ ID NO: 235386 - DNA, 103 bp, Artificial Sequence
  Synthetic Polynucleotide
taatacgactcactatagggaatgtggttggcctgttccgggccgccgacaacagaggagagtcggcatgccggaacagaacctggcggcagcgcaaaagatg

SEQ ID NO: 235387 - DNA, 103 bp, Artificial Sequence
  Synthetic Polynucleotide
taatacgactcactatagggcccagaagcaaatgtggttggcctgttccgaacagaggagacggaacatgccaaccacaaacctggcggcagcgcaaaagatg

SEQ ID NO: 235388 - DNA, 103 bp, Artificial Sequence
  Synthetic Polynucleotide
taatacgactcactatagggggacactcctcccagaagcaaatgtggttgaacagaggagacaaccaatgttgcttctgaacctggcggcagcgcaaaagatg

SEQ ID NO: 235389 - DNA, 103 bp, Artificial Sequence
  Synthetic Polynucleotide
taatacgactcactatagggtccctggcgcggacactcctcccagaagcaaacagaggagatgcttcatggaggagtgtaacctggcggcagcgcaaaagatg

SEQ ID NO: 235390 - DNA, 103 bp, Artificial Sequence
  Synthetic Polynucleotide
taatacgactcactatagggtgaagggctttccctggcgcggacactcctaacagaggagaaggagtatgcgcgccaggaacctggcggcagcgcaaaagatg

SEQ ID NO: 235391 - DNA, 103 bp, Artificial Sequence
  Synthetic Polynucleotide
taatacgactcactatagggtatttggctttgaagggctttccctggcgcaacagaggagagcgccaatgaaagcccttaacctggcggcagcgcaaaagatg

SEQ ID NO: 235392 - DNA, 103 bp, Artificial Sequence
  Synthetic Polynucleotide
taatacgactcactatagggtacaagtttgtatttggctttgaagggcttaacagaggagaaagcccatgaaagccaaaaacctggcggcagcgcaaaagatg

SEQ ID NO: 235393 - DNA, 103 bp, Artificial Sequence
  Synthetic Polynucleotide
taatacgactcactatagggggatgtgatttacaagtttgtatttggcttaacagaggagaaagccaatgacaaacttgaacctggcggcagcgcaaaagatg

SEQ ID NO: 235394 - DNA, 103 bp, Artificial Sequence
  Synthetic Polynucleotide
taatacgactcactataggggtgtgcacgcggatgtgatttacaagtttgaacagaggagacaaactatgaaatcacataacctggcggcagcgcaaaagatg

SEQ ID NO: 235395 - DNA, 103 bp, Artificial Sequence
  Synthetic Polynucleotide
taatacgactcactatagggcaaagggagtttcctgaagacggtgacggcaacagaggagagccgtcatggtcttcaggaacctggcggcagcgcaaaagatg

SEQ ID NO: 235396 - DNA, 103 bp, Artificial Sequence
  Synthetic Polynucleotide
taatacgactcactatagggcttctcgcccgtgtgcacgcggatgtgattaacagaggagaaatcacatgcgcgtgcacaacctggcggcagcgcaaaagatg

SEQ ID NO: 235397 - DNA, 103 bp, Artificial Sequence
  Synthetic Polynucleotide
taatacgactcactatagggaagggaagggcttctcgcccgtgtgcacgcaacagaggagagcgtgcatgcgggcgagaaacctggcggcagcgcaaaagatg

SEQ ID NO: 235398 - DNA, 103 bp, Artificial Sequence
  Synthetic Polynucleotide
taatacgactcactataggggggaaaggacaagggaagggcttctcgcccaacagaggagagggcgaatggcccttcccaacctggcggcagcgcaaaagatg

SEQ ID NO: 235399 - DNA, 103 bp, Artificial Sequence
  Synthetic Polynucleotide
taatacgactcactatagggcccacaccccgggaaaggacaagggaagggaacagaggagacccttcatgtgtcctttcaacctggcggcagcgcaaaagatg

SEQ ID NO: 235400 - DNA, 103 bp, Artificial Sequence
  Synthetic Polynucleotide
taatacgactcactatagggcaaagaccttcccacaccccgggaaaggacaacagaggagagtccttatgcggggtgtgaacctggcggcagcgcaaaagatg

SEQ ID NO: 235401 - DNA, 103 bp, Artificial Sequence
  Synthetic Polynucleotide
taatacgactcactatagggtctgatctagcaaagaccttcccacaccccaacagaggagaggggtgatggaaggtcttaacctggcggcagcgcaaaagatg

SEQ ID NO: 235402 - DNA, 103 bp, Artificial Sequence
  Synthetic Polynucleotide
taatacgactcactatagggtttgagattttctgatctagcaaagaccttaacagaggagaaaggtcatggctagatcaaacctggcggcagcgcaaaagatg

SEQ ID NO: 235403 - DNA, 103 bp, Artificial Sequence
  Synthetic Polynucleotide
taatacgactcactataggggtttgtgtattttgagattttctgatctagaacagaggagactagatatgaaaatctcaaacctggcggcagcgcaaaagatg

SEQ ID NO: 235404 - DNA, 103 bp, Artificial Sequence
  Synthetic Polynucleotide
taatacgactcactataggggtgtgagttcgtttgtgtattttgagatttaacagaggagaaaatctatgaatacacaaaacctggcggcagcgcaaaagatg

SEQ ID NO: 235405 - DNA, 103 bp, Artificial Sequence
  Synthetic Polynucleotide
taatacgactcactatagggcttctcgcctgtgtgagttcgtttgtgtataacagaggagaatacacatgcgaactcacaacctggcggcagcgcaaaagatg

SEQ ID NO: 235406 - DNA, 103 bp, Artificial Sequence
  Synthetic Polynucleotide
taatacgactcactatagggccttggaatccaaagggagtttcctgaagaaacagaggagatcttcaatgaactcccttaacctggcggcagcgcaaaagatg

SEQ ID NO: 235407 - DNA, 103 bp, Artificial Sequence
  Synthetic Polynucleotide
taatacgactcactatagggatctgaagggcttctcgcctgtgtgagttcaacagaggagagaactcatgcaggcgagaaacctggcggcagcgcaaaagatg

SEQ ID NO: 235408 - DNA, 103 bp, Artificial Sequence
  Synthetic Polynucleotide
taatacgactcactatagggtcgaactcgcatctgaagggcttctcgcctaacagaggagaaggcgaatggcccttcagaacctggcggcagcgcaaaagatg

SEQ ID NO: 235409 - DNA, 103 bp, Artificial Sequence
  Synthetic Polynucleotide
taatacgactcactatagggctcgcagccctcgaactcgcatctgaagggaacagaggagacccttcatgtgcgagttcaacctggcggcagcgcaaaagatg

SEQ ID NO: 235410 - DNA, 103 bp, Artificial Sequence
  Synthetic Polynucleotide
taatacgactcactatagggcgaagcgccgctcgcagccctcgaactcgcaacagaggagagcgagtatgagggctgcgaacctggcggcagcgcaaaagatg

SEQ ID NO: 235411 - DNA, 103 bp, Artificial Sequence
  Synthetic Polynucleotide
taatacgactcactatagggctgctgttggcgaagcgccgctcgcagcccaacagaggagagggctgatggcggcgcttaacctggcggcagcgcaaaagatg

SEQ ID NO: 235412 - DNA, 103 bp, Artificial Sequence
  Synthetic Polynucleotide
taatacgactcactatagggcttacggtcgctgctgttggcgaagcgccgaacagaggagacggcgcatggccaacagcaacctggcggcagcgcaaaagatg

SEQ ID NO: 235413 - DNA, 103 bp, Artificial Sequence
  Synthetic Polynucleotide
taatacgactcactataggggcgaatgcttcttacggtcgctgctgttggaacagaggagaccaacaatggcgaccgtaaacctggcggcagcgcaaaagatg

SEQ ID NO: 235414 - DNA, 103 bp, Artificial Sequence
  Synthetic Polynucleotide
taatacgactcactataggggtgtgcacgtgcgaatgcttcttacggtcgaacagaggagacgaccgatggaagcattcaacctggcggcagcgcaaaagatg

SEQ ID NO: 235415 - DNA, 103 bp, Artificial Sequence
  Synthetic Polynucleotide
taatacgactcactatagggcttgtcgctagtgtgcacgtgcgaatgcttaacagaggagaaagcatatgcacgtgcacaacctggcggcagcgcaaaagatg

SEQ ID NO: 235416 - DNA, 103 bp, Artificial Sequence
  Synthetic Polynucleotide
taatacgactcactatagggacgtgtatggcttgtcgctagtgtgcacgtaacagaggagaacgtgcatgctagcgacaaacctggcggcagcgcaaaagatg

SEQ ID NO: 235417 - DNA, 103 bp, Artificial Sequence
  Synthetic Polynucleotide
taatacgactcactatagggtgactttgagccttggaatccaaagggagtaacagaggagaactcccatgggattccaaaacctggcggcagcgcaaaagatg

SEQ ID NO: 235418 - DNA, 103 bp, Artificial Sequence
  Synthetic Polynucleotide
taatacgactcactatagggcgcaccttgcacgtgtatggcttgtcgctaaacagaggagatagcgaatggccatacacaacctggcggcagcgcaaaagatg

SEQ ID NO: 235419 - DNA, 103 bp, Artificial Sequence
  Synthetic Polynucleotide
taatacgactcactataggggtcgcagccccgcaccttgcacgtgtatggaacagaggagaccatacatgtgcaaggtgaacctggcggcagcgcaaaagatg

SEQ ID NO: 235420 - DNA, 103 bp, Artificial Sequence
  Synthetic Polynucleotide
taatacgactcactatagggtgtagcacttgtcgcagccccgcaccttgcaacagaggagagcaaggatgggggctgcgaacctggcggcagcgcaaaagatg

SEQ ID NO: 235421 - DNA, 103 bp, Artificial Sequence
  Synthetic Polynucleotide
taatacgactcactatagggctggggtgcgtgtagcacttgtcgcagcccaacagaggagagggctgatgcaagtgctaaacctggcggcagcgcaaaagatg

SEQ ID NO: 235422 - DNA, 103 bp, Artificial Sequence
  Synthetic Polynucleotide
taatacgactcactatagggacgcagcgagctggggtgcgtgtagcacttaacagaggagaaagtgcatgacgcaccccaacctggcggcagcgcaaaagatg

SEQ ID NO: 235423 - DNA, 103 bp, Artificial Sequence
  Synthetic Polynucleotide
taatacgactcactatagggtcatgtgcttacgcagcgagctggggtgcgaacagaggagacgcaccatggctcgctgcaacctggcggcagcgcaaaagatg

SEQ ID NO: 235424 - DNA, 103 bp, Artificial Sequence
  Synthetic Polynucleotide
taatacgactcactatagggccgtgcaccttcatgtgcttacgcagcgagaacagaggagactcgctatgtaagcacataacctggcggcagcgcaaaagatg

SEQ ID NO: 235425 - DNA, 103 bp, Artificial Sequence
  Synthetic Polynucleotide
taatacgactcactatagggcggcgagcgcccgtgcaccttcatgtgcttaacagaggagaaagcacatgaaggtgcacaacctggcggcagcgcaaaagatg

SEQ ID NO: 235426 - DNA, 103 bp, Artificial Sequence
  Synthetic Polynucleotide
taatacgactcactatagggagctgggcggcggcgagcgcccgtgcacctaacagaggagaaggtgcatgggcgctcgcaacctggcggcagcgcaaaagatg

SEQ ID NO: 235427 - DNA, 103 bp, Artificial Sequence
  Synthetic Polynucleotide
taatacgactcactatagggtcgtagccagagctgggcggcggcgagcgcaacagaggagagcgctcatggccgcccagaacctggcggcagcgcaaaagatg

SEQ ID NO: 235428 - DNA, 103 bp, Artificial Sequence
  Synthetic Polynucleotide
taatacgactcactatagggtttattccctctgcccgccttcaaaaacataacagaggagaatgtttatgaaggcgggcaacctggcggcagcgcaaaagatg

SEQ ID NO: 235429 - DNA, 103 bp, Artificial Sequence
  Synthetic Polynucleotide
taatacgactcactatagggcgctaatctcagcgctggcgggttcctcttaacagaggagaaagaggatgccgccagcgaacctggcggcagcgcaaaagatg

SEQ ID NO: 235430 - DNA, 103 bp, Artificial Sequence
  Synthetic Polynucleotide
taatacgactcactatagggcgccgcagccgccaggttcaggtttaagttaacagaggagaaacttaatgctgaacctgaacctggcggcagcgcaaaagatg

SEQ ID NO: 235431 - DNA, 103 bp, Artificial Sequence
  Synthetic Polynucleotide
taatacgactcactatagggctgctgcggccgccgcagccgccaggttcaaacagaggagatgaaccatgcggctgcggaacctggcggcagcgcaaaagatg

SEQ ID NO: 235432 - DNA, 103 bp, Artificial Sequence
  Synthetic Polynucleotide
taatacgactcactatagggggcccggccgctgctgcggccgccgcagccaacagaggagaggctgcatgggccgcagcaacctggcggcagcgcaaaagatg

SEQ ID NO: 235433 - DNA, 103 bp, Artificial Sequence
  Synthetic Polynucleotide
taatacgactcactataggggtggggcccgggcccggccgctgctgcggcaacagaggagagccgcaatggcggccgggaacctggcggcagcgcaaaagatg

SEQ ID NO: 235434 - DNA, 103 bp, Artificial Sequence
  Synthetic Polynucleotide
taatacgactcactatagggggtgctgcaggtggggcccgggcccggccgaacagaggagacggccgatgccgggccccaacctggcggcagcgcaaaagatg

SEQ ID NO: 235435 - DNA, 103 bp, Artificial Sequence
  Synthetic Polynucleotide
taatacgactcactatagggggcggcgcgtggtgctgcaggtggggcccgaacagaggagacgggccatgcctgcagcaaacctggcggcagcgcaaaagatg

SEQ ID NO: 235436 - DNA, 103 bp, Artificial Sequence
  Synthetic Polynucleotide
taatacgactcactatagggcggcgccgggggcggcgcgtggtgctgcagaacagaggagactgcagatgcacgcgccgaacctggcggcagcgcaaaagatg

SEQ ID NO: 235437 - DNA, 103 bp, Artificial Sequence
  Synthetic Polynucleotide
taatacgactcactataggggcggcggcggcggcgccgggggcggcgcgtaacagaggagaacgcgcatgccccggcgcaacctggcggcagcgcaaaagatg

SEQ ID NO: 235438 - DNA, 103 bp, Artificial Sequence
  Synthetic Polynucleotide
taatacgactcactataggggcgggcgccggcggcggcggcggcgccgggaacagaggagacccggcatggccgccgccaacctggcggcagcgcaaaagatg

SEQ ID NO: 235439 - DNA, 103 bp, Artificial Sequence
  Synthetic Polynucleotide
taatacgactcactatagggcgggtgctgcgcgggcgccggcggcggcggaacagaggagaccgccgatgccggcgcccaacctggcggcagcgcaaaagatg

SEQ ID NO: 235440 - DNA, 103 bp, Artificial Sequence
  Synthetic Polynucleotide
taatacgactcactatagggttgccaaatccgctaatctcagcgctggcgaacagaggagacgccagatgtgagattagaacctggcggcagcgcaaaagatg

SEQ ID NO: 235441 - DNA, 103 bp, Artificial Sequence
  Synthetic Polynucleotide
taatacgactcactatagggggtgctggtgcgggtgctgcgcgggcgccgaacagaggagacggcgcatgcgcagcaccaacctggcggcagcgcaaaagatg

SEQ ID NO: 235442 - DNA, 103 bp, Artificial Sequence
  Synthetic Polynucleotide
taatacgactcactatagggaggtgggggtggtgctggtgcgggtgctgcaacagaggagagcagcaatggcaccagcaaacctggcggcagcgcaaaagatg

SEQ ID NO: 235443 - DNA, 103 bp, Artificial Sequence
  Synthetic Polynucleotide
taatacgactcactatagggcgcccctgggaggtgggggtggtgctggtgaacagaggagacaccagatgcacccccacaacctggcggcagcgcaaaagatg

SEQ ID NO: 235444 - DNA, 103 bp, Artificial Sequence
  Synthetic Polynucleotide
taatacgactcactatagggaggccccagccgcccctgggaggtgggggtaacagaggagaacccccatgtcccaggggaacctggcggcagcgcaaaagatg

SEQ ID NO: 235445 - DNA, 103 bp, Artificial Sequence
  Synthetic Polynucleotide
taatacgactcactatagggtagcgcaggaaggccccagccgcccctgggaacagaggagacccaggatgggctggggcaacctggcggcagcgcaaaagatg

SEQ ID NO: 235446 - DNA, 103 bp, Artificial Sequence
  Synthetic Polynucleotide
taatacgactcactatagggctgccgcatgtagcgcaggaaggccccagcaacagaggagagctgggatgttcctgcgcaacctggcggcagcgcaaaagatg

SEQ ID NO: 235447 - DNA, 103 bp, Artificial Sequence
  Synthetic Polynucleotide
taatacgactcactataggggcttgattggctgccgcatgtagcgcaggaaacagaggagatcctgcatgacatgcggcaacctggcggcagcgcaaaagatg

SEQ ID NO: 235448 - DNA, 103 bp, Artificial Sequence
  Synthetic Polynucleotide
taatacgactcactatagggatgagctcctgcttgattggctgccgcatgaacagaggagacatgcgatggccaatcaaaacctggcggcagcgcaaaagatg

SEQ ID NO: 235449 - DNA, 103 bp, Artificial Sequence
  Synthetic Polynucleotide
taatacgactcactatagggccacttgcagatgagctcctgcttgattggaacagaggagaccaatcatgcaggagctcaacctggcggcagcgcaaaagatg

SEQ ID NO: 235450 - DNA, 103 bp, Artificial Sequence
  Synthetic Polynucleotide
taatacgactcactatagggcggggtcgatccacttgcagatgagctcctaacagaggagaaggagcatgtctgcaagtaacctggcggcagcgcaaaagatg

SEQ ID NO: 235451 - DNA, 103 bp, Artificial Sequence
  Synthetic Polynucleotide
taatacgactcactatagggacctgagccgttgccaaatccgctaatctcaacagaggagagagattatgggatttggcaacctggcggcagcgcaaaagatg

SEQ ID NO: 235452 - DNA, 103 bp, Artificial Sequence
  Synthetic Polynucleotide
taatacgactcactataggggccagctcgtcggggtcgatccacttgcagaacagaggagactgcaaatggatcgacccaacctggcggcagcgcaaaagatg

SEQ ID NO: 235453 - DNA, 103 bp, Artificial Sequence
  Synthetic Polynucleotide
taatacgactcactatagggcggcagcccggccagctcgtcggggtcgataacagaggagaatcgacatggacgagctgaacctggcggcagcgcaaaagatg

SEQ ID NO: 235454 - DNA, 103 bp, Artificial Sequence
  Synthetic Polynucleotide
taatacgactcactataggggcggcggcggcggcagcccggccagctcgtaacagaggagaacgagcatgccgggctgcaacctggcggcagcgcaaaagatg

SEQ ID NO: 235455 - DNA, 103 bp, Artificial Sequence
  Synthetic Polynucleotide
taatacgactcactatagggggcggcggcggcggcggcggcggcagcccgaacagaggagacgggctatggccgccgccaacctggcggcagcgcaaaagatg

SEQ ID NO: 235456 - DNA, 103 bp, Artificial Sequence
  Synthetic Polynucleotide
taatacgactcactatagggcggcggcggcggcggcggcggcggcggcggaacagaggagaccgccgatgccgccgccgaacctggcggcagcgcaaaagatg

SEQ ID NO: 235457 - DNA, 103 bp, Artificial Sequence
  Synthetic Polynucleotide
taatacgactcactatagggggggcggtggcggcggcggcggcggcggcgaacagaggagacgccgcatgcgccgccgcaacctggcggcagcgcaaaagatg

SEQ ID NO: 235458 - DNA, 103 bp, Artificial Sequence
  Synthetic Polynucleotide
taatacgactcactatagggccgccggccgggggcggtggcggcggcggcaacagaggagagccgccatggccaccgccaacctggcggcagcgcaaaagatg

SEQ ID NO: 235459 - DNA, 103 bp, Artificial Sequence
  Synthetic Polynucleotide
taatacgactcactataggggggcttggcgccgccggccgggggcggtggaacagaggagaccaccgatgccggccggcaacctggcggcagcgcaaaagatg

SEQ ID NO: 235460 - DNA, 103 bp, Artificial Sequence
  Synthetic Polynucleotide
taatacgactcactatagggttttggagcagggcttggcgccgccggccgaacagaggagacggccgatggcgccaagcaacctggcggcagcgcaaaagatg

SEQ ID NO: 235461 - DNA, 103 bp, Artificial Sequence
  Synthetic Polynucleotide
taatacgactcactataggggtgccgaaagttttggagcagggcttggcgaacagaggagacgccaaatgctgctccaaaacctggcggcagcgcaaaagatg

SEQ ID NO: 235462 - DNA, 103 bp, Artificial Sequence
  Synthetic Polynucleotide
taatacgactcactatagggaagcggctggacctgagccgttgccaaatcaacagaggagagatttgatgacggctcagaacctggcggcagcgcaaaagatg

SEQ ID NO: 235463 - DNA, 103 bp, Artificial Sequence
  Synthetic Polynucleotide
taatacgactcactatagggctcgtgcatggtgccgaaagttttggagcaaacagaggagatgctccatgactttcggcaacctggcggcagcgcaaaagatg

SEQ ID NO: 235464 - DNA, 103 bp, Artificial Sequence
  Synthetic Polynucleotide
taatacgactcactataggggattcaccagctcgtgcatggtgccgaaagaacagaggagactttcgatgccatgcacgaacctggcggcagcgcaaaagatg

SEQ ID NO: 235465 - DNA, 103 bp, Artificial Sequence
  Synthetic Polynucleotide
taatacgactcactatagggaccgtgacgtgattcaccagctcgtgcatgaacagaggagacatgcaatggctggtgaaaacctggcggcagcgcaaaagatg

SEQ ID NO: 235466 - DNA, 103 bp, Artificial Sequence
  Synthetic Polynucleotide
taatacgactcactatagggcacgtgctccaccgtgacgtgattcaccagaacagaggagactggtgatgcacgtcacgaacctggcggcagcgcaaaagatg

SEQ ID NO: 235467 - DNA, 103 bp, Artificial Sequence
  Synthetic Polynucleotide
taatacgactcactatagggcggggcctcccacgtgctccaccgtgacgtaacagaggagaacgtcaatgtggagcacgaacctggcggcagcgcaaaagatg

SEQ ID NO: 235468 - DNA, 103 bp, Artificial Sequence
  Synthetic Polynucleotide
taatacgactcactatagggctgctctgctcggggcctcccacgtgctccaacagaggagaggagcaatggggaggcccaacctggcggcagcgcaaaagatg

SEQ ID NO: 235469 - DNA, 103 bp, Artificial Sequence
  Synthetic Polynucleotide
taatacgactcactataggggcagacgtggctgctctgctcggggcctccaacagaggagaggaggcatggagcagagcaacctggcggcagcgcaaaagatg

SEQ ID NO: 235470 - DNA, 103 bp, Artificial Sequence
  Synthetic Polynucleotide
taatacgactcactatagggcctcccagaagcagacgtggctgctctgctaacagaggagaagcagaatggccacgtctaacctggcggcagcgcaaaagatg

SEQ ID NO: 235471 - DNA, 103 bp, Artificial Sequence
  Synthetic Polynucleotide
taatacgactcactatagggcgcggacagtcctcccagaagcagacgtggaacagaggagaccacgtatgcttctgggaaacctggcggcagcgcaaaagatg

SEQ ID NO: 235472 - DNA, 103 bp, Artificial Sequence
  Synthetic Polynucleotide
taatacgactcactatagggcttgccctcgcgcggacagtcctcccagaaaacagaggagattctggatggactgtccgaacctggcggcagcgcaaaagatg

SEQ ID NO: 235473 - DNA, 103 bp, Artificial Sequence
  Synthetic Polynucleotide
taatacgactcactatagggtcatattctgaagcggctggacctgagccgaacagaggagacggctcatgtccagccgcaacctggcggcagcgcaaaagatg

SEQ ID NO: 235474 - DNA, 103 bp, Artificial Sequence
  Synthetic Polynucleotide
taatacgactcactatagggccttgaagggcttgccctcgcgcggacagtaacagaggagaactgtcatggcgagggcaaacctggcggcagcgcaaaagatg

SEQ ID NO: 235475 - DNA, 103 bp, Artificial Sequence
  Synthetic Polynucleotide
taatacgactcactatagggttgtatttggccttgaagggcttgccctcgaacagaggagacgagggatggcccttcaaaacctggcggcagcgcaaaagatg

SEQ ID NO: 235476 - DNA, 103 bp, Artificial Sequence
  Synthetic Polynucleotide
taatacgactcactataggggttgatgagcttgtatttggccttgaagggaacagaggagacccttcatggccaaatacaacctggcggcagcgcaaaagatg

SEQ ID NO: 235477 - DNA, 103 bp, Artificial Sequence
  Synthetic Polynucleotide
taatacgactcactatagggcgcggatgtggttgatgagcttgtatttggaacagaggagaccaaatatgagctcatcaaacctggcggcagcgcaaaagatg

SEQ ID NO: 235478 - DNA, 103 bp, Artificial Sequence
  Synthetic Polynucleotide
taatacgactcactatagggccggtgtgcacgcggatgtggttgatgagcaacagaggagagctcatatgccacatccgaacctggcggcagcgcaaaagatg

SEQ ID NO: 235479 - DNA, 103 bp, Artificial Sequence
  Synthetic Polynucleotide
taatacgactcactataggggggcttctcgccggtgtgcacgcggatgtgaacagaggagacacatcatggtgcacaccaacctggcggcagcgcaaaagatg

SEQ ID NO: 235480 - DNA, 103 bp, Artificial Sequence
  Synthetic Polynucleotide
taatacgactcactatagggggcagggaaagggcttctcgccggtgtgcaaacagaggagatgcacaatggcgagaagcaacctggcggcagcgcaaaagatg

SEQ ID NO: 235481 - DNA, 103 bp, Artificial Sequence
  Synthetic Polynucleotide
taatacgactcactatagggccggggaaagggcagggaaagggcttctcgaacagaggagacgagaaatgctttccctgaacctggcggcagcgcaaaagatg

SEQ ID NO: 235482 - DNA, 103 bp, Artificial Sequence
  Synthetic Polynucleotide
taatacgactcactatagggcttgccgcagccggggaaagggcagggaaaaacagaggagatttcccatgcctttccccaacctggcggcagcgcaaaagatg

SEQ ID NO: 235483 - DNA, 103 bp, Artificial Sequence
  Synthetic Polynucleotide
taatacgactcactataggggcgcgaagaccttgccgcagccggggaaagaacagaggagactttccatggctgcggcaaacctggcggcagcgcaaaagatg

SEQ ID NO: 235484 - DNA, 103 bp, Artificial Sequence
  Synthetic Polynucleotide
taatacgactcactataggggggaagcctgtcatattctgaagcggctggaacagaggagaccagccatgtcagaatataacctggcggcagcgcaaaagatg

SEQ ID NO: 235485 - DNA, 103 bp, Artificial Sequence
  Synthetic Polynucleotide
taatacgactcactatagggttctcggagcgcgcgaagaccttgccgcagaacagaggagactgcggatgggtcttcgcaacctggcggcagcgcaaaagatg

SEQ ID NO: 235486 - DNA, 103 bp, Artificial Sequence
  Synthetic Polynucleotide
taatacgactcactataggggatcttgaggttctcggagcgcgcgaagacaacagaggagagtcttcatgcgctccgagaacctggcggcagcgcaaaagatg

SEQ ID NO: 235487 - DNA, 103 bp, Artificial Sequence
  Synthetic Polynucleotide
taatacgactcactatagggtacgcttgtggatcttgaggttctcggagcaacagaggagagctccgatgacctcaagaaacctggcggcagcgcaaaagatg

SEQ ID NO: 235488 - DNA, 103 bp, Artificial Sequence
  Synthetic Polynucleotide
taatacgactcactatagggcctgtatgagtacgcttgtggatcttgaggaacagaggagacctcaaatgccacaagcgaacctggcggcagcgcaaaagatg

SEQ ID NO: 235489 - DNA, 103 bp, Artificial Sequence
  Synthetic Polynucleotide
taatacgactcactatagggaggcttttcccctgtatgagtacgcttgtgaacagaggagacacaagatgactcatacaaacctggcggcagcgcaaaagatg

SEQ ID NO: 235490 - DNA, 103 bp, Artificial Sequence
  Synthetic Polynucleotide
taatacgactcactatagggcacatttgaaaggcttttcccctgtatgagaacagaggagactcataatggggaaaagcaacctggcggcagcgcaaaagatg

SEQ ID NO: 235491 - DNA, 103 bp, Artificial Sequence
  Synthetic Polynucleotide
taatacgactcactatagggccatcaaattcacatttgaaaggcttttccaacagaggagaggaaaaatgtttcaaatgaacctggcggcagcgcaaaagatg

SEQ ID NO: 235492 - DNA, 103 bp, Artificial Sequence
  Synthetic Polynucleotide
taatacgactcactatagggcctgtcacagccatcaaattcacatttgaaaacagaggagattcaaaatggaatttgataacctggcggcagcgcaaaagatg

SEQ ID NO: 235493 - DNA, 103 bp, Artificial Sequence
  Synthetic Polynucleotide
taatacgactcactatagggtggcaaacttcctgtcacagccatcaaattaacagaggagaaatttgatggctgtgacaaacctggcggcagcgcaaaagatg

SEQ ID NO: 235494 - DNA, 103 bp, Artificial Sequence
  Synthetic Polynucleotide
taatacgactcactatagggtcactgctattggcaaacttcctgtcacagaacagaggagactgtgaatggaagtttgcaacctggcggcagcgcaaaagatg

SEQ ID NO: 235495 - DNA, 103 bp, Artificial Sequence
  Synthetic Polynucleotide
taatacgactcactatagggggccagcgccgggaagcctgtcatattctgaacagaggagacagaatatgacaggcttcaacctggcggcagcgcaaaagatg

SEQ ID NO: 235496 - DNA, 103 bp, Artificial Sequence
  Synthetic Polynucleotide
taatacgactcactatagggtttcttccgatcactgctattggcaaacttaacagaggagaaagtttatgaatagcagtaacctggcggcagcgcaaaagatg

SEQ ID NO: 235497 - DNA, 103 bp, Artificial Sequence
  Synthetic Polynucleotide
taatacgactcactatagggcatgggaatgtttcttccgatcactgctataacagaggagaatagcaatgatcggaagaaacctggcggcagcgcaaaagatg

SEQ ID NO: 235498 - DNA, 103 bp, Artificial Sequence
  Synthetic Polynucleotide
taatacgactcactatagggctggtgtggacatgggaatgtttcttccgaaacagaggagatcggaaatgacattcccaaacctggcggcagcgcaaaagatg

SEQ ID NO: 235499 - DNA, 103 bp, Artificial Sequence
  Synthetic Polynucleotide
taatacgactcactataggggggcttgtcactggtgtggacatgggaatgaacagaggagacattccatggtccacaccaacctggcggcagcgcaaaagatg

SEQ ID NO: 235500 - DNA, 103 bp, Artificial Sequence
  Synthetic Polynucleotide
taatacgactcactatagggtgcagtagtagggcttgtcactggtgtggaaacagaggagatccacaatggtgacaagcaacctggcggcagcgcaaaagatg

SEQ ID NO: 235501 - DNA, 103 bp, Artificial Sequence
  Synthetic Polynucleotide
taatacgactcactatagggcctcgaatcttgcagtagtagggcttgtcaaacagaggagatgacaaatgctactactgaacctggcggcagcgcaaaagatg

SEQ ID NO: 235502 - DNA, 103 bp, Artificial Sequence
  Synthetic Polynucleotide
taatacgactcactatagggtttgtcacagcctcgaatcttgcagtagtaaacagaggagatactacatgaagattcgaaacctggcggcagcgcaaaagatg

SEQ ID NO: 235503 - DNA, 103 bp, Artificial Sequence
  Synthetic Polynucleotide
taatacgactcactataggggagtgtaggatttgtcacagcctcgaatctaacagaggagaagattcatggctgtgacaaacctggcggcagcgcaaaagatg

SEQ ID NO: 235504 - DNA, 103 bp, Artificial Sequence
  Synthetic Polynucleotide
taatacgactcactataggggagcttgggtgagtgtaggatttgtcacagaacagaggagactgtgaatgatcctacacaacctggcggcagcgcaaaagatg

SEQ ID NO: 235505 - DNA, 103 bp, Artificial Sequence
  Synthetic Polynucleotide
taatacgactcactatagggcttcctcagggagcttgggtgagtgtaggaaacagaggagatcctacatgcacccaagcaacctggcggcagcgcaaaagatg

SEQ ID NO: 235506 - DNA, 103 bp, Artificial Sequence
  Synthetic Polynucleotide
taatacgactcactatagggcgggcgggccggccagcgccgggaagcctgaacagaggagacaggctatgcggcgctggaacctggcggcagcgcaaaagatg

SEQ ID NO: 235507 - DNA, 103 bp, Artificial Sequence
  Synthetic Polynucleotide
taatacgactcactatagggtcttcatgtgcttcctcagggagcttgggtaacagaggagaacccaaatgccctgaggaaacctggcggcagcgcaaaagatg

SEQ ID NO: 235508 - DNA, 103 bp, Artificial Sequence
  Synthetic Polynucleotide
taatacgactcactatagggttgcagtgaatcttcatgtgcttcctcaggaacagaggagacctgagatggcacatgaaaacctggcggcagcgcaaaagatg

SEQ ID NO: 235509 - DNA, 103 bp, Artificial Sequence
  Synthetic Polynucleotide
taatacgactcactatagggtggcggggacttgcagtgaatcttcatgtgaacagaggagacacatgatgattcactgcaacctggcggcagcgcaaaagatg

SEQ ID NO: 235510 - DNA, 103 bp, Artificial Sequence
  Synthetic Polynucleotide
taatacgactcactatagggctggagaaggtggcggggacttgcagtgaaaacagaggagattcactatgagtccccgcaacctggcggcagcgcaaaagatg

SEQ ID NO: 235511 - DNA, 103 bp, Artificial Sequence
  Synthetic Polynucleotide
taatacgactcactatagggccaaggggtcctggagaaggtggcggggacaacagaggagagtccccatgaccttctccaacctggcggcagcgcaaaagatg

SEQ ID NO: 235512 - DNA, 103 bp, Artificial Sequence
  Synthetic Polynucleotide
taatacgactcactatagggtgatgagtaaccaaggggtcctggagaaggaacagaggagaccttctatgggaccccttaacctggcggcagcgcaaaagatg

SEQ ID NO: 235513 - DNA, 103 bp, Artificial Sequence
  Synthetic Polynucleotide
taatacgactcactataggggagtccccactgatgagtaaccaaggggtcaacagaggagagaccccatggttactcataacctggcggcagcgcaaaagatg

SEQ ID NO: 235514 - DNA, 103 bp, Artificial Sequence
  Synthetic Polynucleotide
taatacgactcactataggggcgcccactggagtccccactgatgagtaaaacagaggagattactcatgagtggggacaacctggcggcagcgcaaaagatg

SEQ ID NO: 235515 - DNA, 103 bp, Artificial Sequence
  Synthetic Polynucleotide
taatacgactcactatagggggacaagggggcgcccactggagtccccacaacagaggagagtggggatgccagtgggcaacctggcggcagcgcaaaagatg

SEQ ID NO: 235516 - DNA, 103 bp, Artificial Sequence
  Synthetic Polynucleotide
taatacgactcactatagggccagcacaggggacaagggggcgcccactgaacagaggagacagtggatgcccccttgtaacctggcggcagcgcaaaagatg

SEQ ID NO: 235517 - DNA, 103 bp, Artificial Sequence
  Synthetic Polynucleotide
taatacgactcactatagggtgggagtgggcgggcgggccggccagcgccaacagaggagaggcgctatgcggcccgccaacctggcggcagcgcaaaagatg

SEQ ID NO: 235518 - DNA, 103 bp, Artificial Sequence
  Synthetic Polynucleotide
taatacgactcactatagggctggctgggtccagcacaggggacaaggggaacagaggagaccccttatgccctgtgctaacctggcggcagcgcaaaagatg

SEQ ID NO: 235519 - DNA, 103 bp, Artificial Sequence
  Synthetic Polynucleotide
taatacgactcactatagggggagtgactcctggctgggtccagcacaggaacagaggagacctgtgatggacccagccaacctggcggcagcgcaaaagatg

SEQ ID NO: 235520 - DNA, 103 bp, Artificial Sequence
  Synthetic Polynucleotide
taatacgactcactatagggacagagtgctggagtgactcctggctgggtaacagaggagaacccagatgggagtcactaacctggcggcagcgcaaaagatg

SEQ ID NO: 235521 - DNA, 103 bp, Artificial Sequence
  Synthetic Polynucleotide
taatacgactcactatagggacctgaggggacagagtgctggagtgactcaacagaggagagagtcaatgcagcactctaacctggcggcagcgcaaaagatg

SEQ ID NO: 235522 - DNA, 103 bp, Artificial Sequence
  Synthetic Polynucleotide
taatacgactcactataggggaggttggtcacctgaggggacagagtgctaacagaggagaagcactatgtcccctcagaacctggcggcagcgcaaaagatg

SEQ ID NO: 235523 - DNA, 103 bp, Artificial Sequence
  Synthetic Polynucleotide
taatacgactcactatagggaccactcattgaggttggtcacctgaggggaacagaggagacccctcatgtgaccaaccaacctggcggcagcgcaaaagatg

SEQ ID NO: 235524 - DNA, 103 bp, Artificial Sequence
  Synthetic Polynucleotide
taatacgactcactatagggtggcaaacgtaccactcattgaggttggtcaacagaggagagaccaaatgcaatgagtgaacctggcggcagcgcaaaagatg

SEQ ID NO: 235525 - DNA, 103 bp, Artificial Sequence
  Synthetic Polynucleotide
taatacgactcactatagggcccactggcctggcaaacgtaccactcattaacagaggagaaatgagatgtacgtttgcaacctggcggcagcgcaaaagatg

SEQ ID NO: 235526 - DNA, 103 bp, Artificial Sequence
  Synthetic Polynucleotide
taatacgactcactatagggggctgggggccccactggcctggcaaacgtaacagaggagaacgtttatgaggccagtgaacctggcggcagcgcaaaagatg

SEQ ID NO: 235527 - DNA, 103 bp, Artificial Sequence
  Synthetic Polynucleotide
taatacgactcactataggggtgtggaggtggctgggggccccactggccaacagaggagaggccagatgggcccccagaacctggcggcagcgcaaaagatg

SEQ ID NO: 235528 - DNA, 103 bp, Artificial Sequence
  Synthetic Polynucleotide
taatacgactcactatagggggcccggagttgggagtgggcgggcgggccaacagaggagaggcccgatggcccactccaacctggcggcagcgcaaaagatg

SEQ ID NO: 235529 - DNA, 103 bp, Artificial Sequence
  Synthetic Polynucleotide
taatacgactcactataggggctggaaggggtgtggaggtggctgggggcaacagaggagagcccccatgcacctccacaacctggcggcagcgcaaaagatg

SEQ ID NO: 235530 - DNA, 103 bp, Artificial Sequence
  Synthetic Polynucleotide
taatacgactcactatagggtggttccgttgctggaaggggtgtggaggtaacagaggagaacctccatgccccttccaaacctggcggcagcgcaaaagatg

SEQ ID NO: 235531 - DNA, 103 bp, Artificial Sequence
  Synthetic Polynucleotide
taatacgactcactataggggtctcagaggtggttccgttgctggaagggaacagaggagacccttcatgcaacggaacaacctggcggcagcgcaaaagatg

SEQ ID NO: 235532 - DNA, 103 bp, Artificial Sequence
  Synthetic Polynucleotide
taatacgactcactatagggctcatcttcagtctcagaggtggttccgttaacagaggagaaacggaatgacctctgagaacctggcggcagcgcaaaagatg

SEQ ID NO: 235533 - DNA, 103 bp, Artificial Sequence
  Synthetic Polynucleotide
taatacgactcactatagggcgtaaatttcctcatcttcagtctcagaggaacagaggagacctctgatgctgaagatgaacctggcggcagcgcaaaagatg

SEQ ID NO: 235534 - DNA, 103 bp, Artificial Sequence
  Synthetic Polynucleotide
taatacgactcactatagggtcagggttcccgtaaatttcctcatcttcaaacagaggagatgaagaatgggaaatttaaacctggcggcagcgcaaaagatg

SEQ ID NO: 235535 - DNA, 103 bp, Artificial Sequence
  Synthetic Polynucleotide
taatacgactcactatagggccgcacaacttcagggttcccgtaaatttcaacagaggagagaaattatggggaaccctaacctggcggcagcgcaaaagatg

SEQ ID NO: 235536 - DNA, 103 bp, Artificial Sequence
  Synthetic Polynucleotide
taatacgactcactatagggaatgtatcgtccgcacaacttcagggttccaacagaggagaggaaccatgaagttgtgcaacctggcggcagcgcaaaagatg

SEQ ID NO: 235537 - DNA, 103 bp, Artificial Sequence
  Synthetic Polynucleotide
taatacgactcactatagggctggggggactttattccctctgcccgcctaacagaggagaaggcggatggagggaataaacctggcggcagcgcaaaagatg

SEQ ID NO: 235538 - DNA, 103 bp, Artificial Sequence
  Synthetic Polynucleotide
taatacgactcactataggggcgcgacggcggcccggagttgggagtgggaacagaggagacccactatgaactccgggaacctggcggcagcgcaaaagatg

SEQ ID NO: 235539 - DNA, 103 bp, Artificial Sequence
  Synthetic Polynucleotide
taatacgactcactatagggaggcggaggtgcgcgacggcggcccggagtaacagaggagaactccgatgcgccgtcgcaacctggcggcagcgcaaaagatg

SEQ ID NO: 235540 - DNA, 103 bp, Artificial Sequence
  Synthetic Polynucleotide
taatacgactcactatagggcaggtcccgcaggcggaggtgcgcgacggcaacagaggagagccgtcatgcacctccgcaacctggcggcagcgcaaaagatg

SEQ ID NO: 235541 - DNA, 103 bp, Artificial Sequence
  Synthetic Polynucleotide
taatacgactcactatagggggtcagcgcccaggtcccgcaggcggaggtaacagaggagaacctccatgtgcgggaccaacctggcggcagcgcaaaagatg

SEQ ID NO: 235542 - DNA, 103 bp, Artificial Sequence
  Synthetic Polynucleotide
taatacgactcactataggggccacgccggggtcagcgcccaggtcccgcaacagaggagagcgggaatggggcgctgaaacctggcggcagcgcaaaagatg

SEQ ID NO: 235543 - DNA, 103 bp, Artificial Sequence
  Synthetic Polynucleotide
taatacgactcactatagggcggagtggtggccacgccggggtcagcgccaacagaggagaggcgctatgcccggcgtgaacctggcggcagcgcaaaagatg

SEQ ID NO: 235544 - DNA, 103 bp, Artificial Sequence
  Synthetic Polynucleotide
taatacgactcactatagggcgggtccgagcggagtggtggccacgccggaacagaggagaccggcgatgccaccactcaacctggcggcagcgcaaaagatg

SEQ ID NO: 235545 - DNA, 103 bp, Artificial Sequence
  Synthetic Polynucleotide
taatacgactcactataggggccatgtgctcgggtccgagcggagtggtgaacagaggagacaccacatggctcggaccaacctggcggcagcgcaaaagatg

SEQ ID NO: 235546 - DNA, 103 bp, Artificial Sequence
  Synthetic Polynucleotide
taatacgactcactataggggctcgcctgggccatgtgctcgggtccgagaacagaggagactcggaatggagcacatgaacctggcggcagcgcaaaagatg

SEQ ID NO: 235547 - DNA, 103 bp, Artificial Sequence
  Synthetic Polynucleotide
taatacgactcactatagggggcccagcgtgctcgcctgggccatgtgctaacagaggagaagcacaatgcccaggcgaaacctggcggcagcgcaaaagatg

SEQ ID NO: 235548 - DNA, 103 bp, Artificial Sequence
  Synthetic Polynucleotide
taatacgactcactatagggtagaccctcactggggggactttattccctaacagaggagaagggaaatgagtccccccaacctggcggcagcgcaaaagatg

SEQ ID NO: 235549 - DNA, 103 bp, Artificial Sequence
  Synthetic Polynucleotide
taatacgactcactatagggggagggctgaggcccagcgtgctcgcctggaacagaggagaccaggcatgcacgctgggaacctggcggcagcgcaaaagatg

SEQ ID NO: 235550 - DNA, 103 bp, Artificial Sequence
  Synthetic Polynucleotide
taatacgactcactatagggcgcctgggagggagggctgaggcccagcgtaacagaggagaacgctgatgctcagccctaacctggcggcagcgcaaaagatg

SEQ ID NO: 235551 - DNA, 103 bp, Artificial Sequence
  Synthetic Polynucleotide
taatacgactcactataggggtgccgggaacgcctgggagggagggctgaaacagaggagatcagccatgcctcccaggaacctggcggcagcgcaaaagatg

SEQ ID NO: 235552 - DNA, 103 bp, Artificial Sequence
  Synthetic Polynucleotide
taatacgactcactataggggcctccgggtgtgccgggaacgcctgggagaacagaggagactcccaatggttcccggcaacctggcggcagcgcaaaagatg

SEQ ID NO: 235553 - DNA, 103 bp, Artificial Sequence
  Synthetic Polynucleotide
taatacgactcactatagggggctgccggagcctccgggtgtgccgggaaaacagaggagattcccgatgcacccggagaacctggcggcagcgcaaaagatg

SEQ ID NO: 235554 - DNA, 103 bp, Artificial Sequence
  Synthetic Polynucleotide
taatacgactcactatagggcacgggcggcggctgccggagcctccgggtaacagaggagaacccggatgctccggcagaacctggcggcagcgcaaaagatg

SEQ ID NO: 235555 - DNA, 103 bp, Artificial Sequence
  Synthetic Polynucleotide
taatacgactcactatagggaaggctgcagcacgggcggcggctgccggaaacagaggagatccggcatgcgccgcccgaacctggcggcagcgcaaaagatg

SEQ ID NO: 235556 - DNA, 103 bp, Artificial Sequence
  Synthetic Polynucleotide
taatacgactcactataggggtgcgcgaccaaggctgcagcacgggcggcaacagaggagagccgccatggctgcagccaacctggcggcagcgcaaaagatg

SEQ ID NO: 235557 - DNA, 103 bp, Artificial Sequence
  Synthetic Polynucleotide
taatacgactcactatagggccgcgccggggtgcgcgaccaaggctgcagaacagaggagactgcagatgtggtcgcgcaacctggcggcagcgcaaaagatg

SEQ ID NO: 235558 - DNA, 103 bp, Artificial Sequence
  Synthetic Polynucleotide
taatacgactcactataggggggtagctgcccgcgccggggtgcgcgaccaacagaggagaggtcgcatgccccggcgcaacctggcggcagcgcaaaagatg

SEQ ID NO: 235559 - DNA, 103 bp, Artificial Sequence
  Synthetic Polynucleotide
taatacgactcactatagggatcaggcccatagaccctcactggggggacaacagaggagagtccccatggtgagggtcaacctggcggcagcgcaaaagatg

SEQ ID NO: 235560 - DNA, 103 bp, Artificial Sequence
  Synthetic Polynucleotide
taatacgactcactatagggcccgccgcaggggtagctgcccgcgccgggaacagaggagacccggcatgggcagctacaacctggcggcagcgcaaaagatg

SEQ ID NO: 235561 - DNA, 103 bp, Artificial Sequence
  Synthetic Polynucleotide
taatacgactcactatagggcactgctgcccccgccgcaggggtagctgcaacagaggagagcagctatgcctgcggcgaacctggcggcagcgcaaaagatg

SEQ ID NO: 235562 - DNA, 103 bp, Artificial Sequence
  Synthetic Polynucleotide
taatacgactcactatagggggctgcgcgccactgctgcccccgccgcagaacagaggagactgcggatggggcagcagaacctggcggcagcgcaaaagatg

SEQ ID NO: 235563 - DNA, 103 bp, Artificial Sequence
  Synthetic Polynucleotide
taatacgactcactataggggggcgcggagggctgcgcgccactgctgccaacagaggagaggcagcatgggcgcgcagaacctggcggcagcgcaaaagatg

SEQ ID NO: 235564 - DNA, 103 bp, Artificial Sequence
  Synthetic Polynucleotide
taatacgactcactatagggctgggggcgggggcgcggagggctgcgcgcaacagaggagagcgcgcatgcctccgcgcaacctggcggcagcgcaaaagatg

SEQ ID NO: 235565 - DNA, 103 bp, Artificial Sequence
  Synthetic Polynucleotide
taatacgactcactatagggagaggaggggctgggggcgggggcgcggagaacagaggagactccgcatgcccgcccccaacctggcggcagcgcaaaagatg

SEQ ID NO: 235566 - DNA, 103 bp, Artificial Sequence
  Synthetic Polynucleotide
taatacgactcactatagggggtgggaggaagaggaggggctgggggcggaacagaggagaccgcccatggcccctcctaacctggcggcagcgcaaaagatg

SEQ ID NO: 235567 - DNA, 103 bp, Artificial Sequence
  Synthetic Polynucleotide
taatacgactcactatagggggggtgaaggggtgggaggaagaggaggggaacagaggagacccctcatgttcctcccaaacctggcggcagcgcaaaagatg

SEQ ID NO: 235568 - DNA, 103 bp, Artificial Sequence
  Synthetic Polynucleotide
taatacgactcactatagggggagggggagggggtgaaggggtgggaggaaacagaggagatcctccatgcccttcaccaacctggcggcagcgcaaaagatg

SEQ ID NO: 235569 - DNA, 103 bp, Artificial Sequence
  Synthetic Polynucleotide
taatacgactcactatagggaggaggcgggggagggggagggggtgaaggaacagaggagaccttcaatgcctccccctaacctggcggcagcgcaaaagatg

SEQ ID NO: 235570 - DNA, 103 bp, Artificial Sequence
  Synthetic Polynucleotide
taatacgactcactataggggaactacacaatcaggcccatagaccctcaaacagaggagatgagggatgatgggcctgaacctggcggcagcgcaaaagatg

SEQ ID NO: 235571 - DNA, 103 bp, Artificial Sequence
  Synthetic Polynucleotide
taatacgactcactatagggcaggaggaggaggaggcgggggagggggagaacagaggagactccccatgccccgcctcaacctggcggcagcgcaaaagatg

SEQ ID NO: 235572 - DNA, 103 bp, Artificial Sequence
  Synthetic Polynucleotide
taatacgactcactatagggcccgagagggcaggaggaggaggaggcgggaacagaggagacccgccatgtcctcctccaacctggcggcagcgcaaaagatg

SEQ ID NO: 235573 - DNA, 103 bp, Artificial Sequence
  Synthetic Polynucleotide
taatacgactcactatagggggtggtgtagcccgagagggcaggaggaggaacagaggagacctcctatggccctctcgaacctggcggcagcgcaaaagatg

SEQ ID NO: 235574 - DNA, 103 bp, Artificial Sequence
  Synthetic Polynucleotide
taatacgactcactatagggcactgttggtggtggtgtagcccgagagggaacagaggagaccctctatggctacaccaaacctggcggcagcgcaaaagatg

SEQ ID NO: 235575 - DNA, 103 bp, Artificial Sequence
  Synthetic Polynucleotide
taatacgactcactatagggccgccgccgccactgttggtggtggtgtagaacagaggagactacacatgcaccaacagaacctggcggcagcgcaaaagatg

SEQ ID NO: 235576 - DNA, 103 bp, Artificial Sequence
  Synthetic Polynucleotide
taatacgactcactataggggccgctgctgccgccgccgccactgttggtaacagaggagaaccaacatgggcggcggcaacctggcggcagcgcaaaagatg

SEQ ID NO: 235577 - DNA, 103 bp, Artificial Sequence
  Synthetic Polynucleotide
taatacgactcactatagggtgtggcctttgccgctgctgccgccgccgcaacagaggagagcggcgatggcagcagcgaacctggcggcagcgcaaaagatg

SEQ ID NO: 235578 - DNA, 103 bp, Artificial Sequence
  Synthetic Polynucleotide
taatacgactcactatagggaagtccctgctgtggcctttgccgctgctgaacagaggagacagcagatgcaaaggccaaacctggcggcagcgcaaaagatg

SEQ ID NO: 235579 - DNA, 103 bp, Artificial Sequence
  Synthetic Polynucleotide
taatacgactcactatagggccggaggacgaagtccctgctgtggcctttaacagaggagaaaaggcatgagcagggacaacctggcggcagcgcaaaagatg

SEQ ID NO: 235580 - DNA, 103 bp, Artificial Sequence
  Synthetic Polynucleotide
taatacgactcactatagggaaaggtccctccggaggacgaagtccctgcaacagaggagagcagggatgtcgtcctccaacctggcggcagcgcaaaagatg

SEQ ID NO: 235581 - DNA, 103 bp, Artificial Sequence
  Synthetic Polynucleotide
taatacgactcactatagggggctccatcagaactacacaatcaggcccaaacagaggagatgggccatgttgtgtagtaacctggcggcagcgcaaaagatg

SEQ ID NO: 235582 - DNA, 103 bp, Artificial Sequence
  Synthetic Polynucleotide
taatacgactcactataggggccgtggcggaaaggtccctccggaggacgaacagaggagacgtcctatggagggacctaacctggcggcagcgcaaaagatg

SEQ ID NO: 235583 - DNA, 103 bp, Artificial Sequence
  Synthetic Polynucleotide
taatacgactcactatagggcgccgcgggggccgtggcggaaaggtccctaacagaggagaagggacatgtccgccacgaacctggcggcagcgcaaaagatg

SEQ ID NO: 235584 - DNA, 103 bp, Artificial Sequence
  Synthetic Polynucleotide
taatacgactcactatagggcgtgcatggccgccgcgggggccgtggcggaacagaggagaccgccaatgcccccgcggaacctggcggcagcgcaaaagatg

SEQ ID NO: 235585 - DNA, 103 bp, Artificial Sequence
  Synthetic Polynucleotide
taatacgactcactatagggagcggggccccgtgcatggccgccgcggggaacagaggagaccccgcatgggccatgcaaacctggcggcagcgcaaaagatg

SEQ ID NO: 235586 - DNA, 103 bp, Artificial Sequence
  Synthetic Polynucleotide
taatacgactcactatagggctcccctccgagcggggccccgtgcatggcaacagaggagagccatgatgggggccccgaacctggcggcagcgcaaaagatg

SEQ ID NO: 235587 - DNA, 103 bp, Artificial Sequence
  Synthetic Polynucleotide
taatacgactcactatagggcggaccgctgctcccctccgagcggggcccaacagaggagagggcccatgtcggaggggaacctggcggcagcgcaaaagatg

SEQ ID NO: 235588 - DNA, 103 bp, Artificial Sequence
  Synthetic Polynucleotide
taatacgactcactataggggagccggtgccggaccgctgctcccctccgaacagaggagacggaggatggcagcggtcaacctggcggcagcgcaaaagatg

SEQ ID NO: 235589 - DNA, 103 bp, Artificial Sequence
  Synthetic Polynucleotide
taatacgactcactataggggtgctggggggagccggtgccggaccgctgaacagaggagacagcggatgggcaccggcaacctggcggcagcgcaaaagatg

SEQ ID NO: 235590 - DNA, 103 bp, Artificial Sequence
  Synthetic Polynucleotide
taatacgactcactataggggcggggccgggtgctggggggagccggtgcaacagaggagagcaccgatgccccccagcaacctggcggcagcgcaaaagatg

SEQ ID NO: 235591 - DNA, 103 bp, Artificial Sequence
  Synthetic Polynucleotide
taatacgactcactataggggagtggggaggcggggccgggtgctgggggaacagaggagacccccaatgcccggccccaacctggcggcagcgcaaaagatg

SEQ ID NO: 235592 - DNA, 103 bp, Artificial Sequence
  Synthetic Polynucleotide
taatacgactcactataggggctcaaagggggctccatcagaactacacaaacagaggagatgtgtaatgctgatggagaacctggcggcagcgcaaaagatg

SEQ ID NO: 235593 - DNA, 103 bp, Artificial Sequence
  Synthetic Polynucleotide
taatacgactcactatagggcatgccggccgagtggggaggcggggccggaacagaggagaccggccatgcctccccacaacctggcggcagcgcaaaagatg

SEQ ID NO: 235594 - DNA, 103 bp, Artificial Sequence
  Synthetic Polynucleotide
taatacgactcactatagggcggagatgaacatgccggccgagtggggagaacagaggagactccccatgcggccggcaaacctggcggcagcgcaaaagatg

SEQ ID NO: 235595 - DNA, 103 bp, Artificial Sequence
  Synthetic Polynucleotide
taatacgactcactataggggtgccgctggcggagatgaacatgccggccaacagaggagaggccggatggttcatctcaacctggcggcagcgcaaaagatg

SEQ ID NO: 235596 - DNA, 103 bp, Artificial Sequence
  Synthetic Polynucleotide
taatacgactcactataggggcccgcgtaggtgccgctggcggagatgaaaacagaggagattcatcatggccagcggcaacctggcggcagcgcaaaagatg

SEQ ID NO: 235597 - DNA, 103 bp, Artificial Sequence
  Synthetic Polynucleotide
taatacgactcactatagggtgccgtccgggcccgcgtaggtgccgctggaacagaggagaccagcgatgcctacgcggaacctggcggcagcgcaaaagatg

SEQ ID NO: 235598 - DNA, 103 bp, Artificial Sequence
  Synthetic Polynucleotide
taatacgactcactataggggggccgccgctgccgtccgggcccgcgtagaacagaggagactacgcatgcccggacggaacctggcggcagcgcaaaagatg

SEQ ID NO: 235599 - DNA, 103 bp, Artificial Sequence
  Synthetic Polynucleotide
taatacgactcactataggggaagagcgccgggccgccgctgccgtccggaacagaggagaccggacatgagcggcggcaacctggcggcagcgcaaaagatg

SEQ ID NO: 235600 - DNA, 103 bp, Artificial Sequence
  Synthetic Polynucleotide
taatacgactcactataggggcagcgcggggaagagcgccgggccgccgcaacagaggagagcggcgatgcggcgctctaacctggcggcagcgcaaaagatg

SEQ ID NO: 235601 - DNA, 103 bp, Artificial Sequence
  Synthetic Polynucleotide
taatacgactcactatagggggcgtgtcgtgcagcgcggggaagagcgccaacagaggagaggcgctatgccccgcgctaacctggcggcagcgcaaaagatg

SEQ ID NO: 235602 - DNA, 103 bp, Artificial Sequence
  Synthetic Polynucleotide
taatacgactcactatagggtggggcccccggcgtgtcgtgcagcgcgggaacagaggagacccgcgatgcacgacacgaacctggcggcagcgcaaaagatg

SEQ ID NO: 235603 - DNA, 103 bp, Artificial Sequence
  Synthetic Polynucleotide
taatacgactcactatagggggttcctcttgctcaaagggggctccatcaaacagaggagatgatggatgcccctttgaaacctggcggcagcgcaaaagatg

SEQ ID NO: 235604 - DNA, 103 bp, Artificial Sequence
  Synthetic Polynucleotide
taatacgactcactatagggggtggccgcctggggcccccggcgtgtcgtaacagaggagaacgacaatgcgggggcccaacctggcggcagcgcaaaagatg

SEQ ID NO: 235605 - DNA, 103 bp, Artificial Sequence
  Synthetic Polynucleotide
taatacgactcactatagggagcgggtgcgggtggccgcctggggcccccaacagaggagagggggcatgaggcggccaaacctggcggcagcgcaaaagatg

SEQ ID NO: 235606 - DNA, 103 bp, Artificial Sequence
  Synthetic Polynucleotide
taatacgactcactatagggctggccgttgagcgggtgcgggtggccgccaacagaggagaggcggcatgccgcacccgaacctggcggcagcgcaaaagatg

SEQ ID NO: 235607 - DNA, 103 bp, Artificial Sequence
  Synthetic Polynucleotide
taatacgactcactatagggccaggcgcatctggccgttgagcgggtgcgaacagaggagacgcaccatgtcaacggccaacctggcggcagcgcaaaagatg

SEQ ID NO: 235608 - DNA, 103 bp, Artificial Sequence
  Synthetic Polynucleotide
taatacgactcactataggggccgccagccccaggcgcatctggccgttgaacagaggagacaacggatggatgcgcctaacctggcggcagcgcaaaagatg

SEQ ID NO: 235609 - DNA, 103 bp, Artificial Sequence
  Synthetic Polynucleotide
taatacgactcactatagggtgccgctgccgccgccagccccaggcgcataacagaggagaatgcgcatggggctggcgaacctggcggcagcgcaaaagatg

SEQ ID NO: 235610 - DNA, 103 bp, Artificial Sequence
  Synthetic Polynucleotide
taatacgactcactatagggccgccgcggctgccgctgccgccgccagccaacagaggagaggctggatgcggcagcggaacctggcggcagcgcaaaagatg

SEQ ID NO: 235611 - DNA, 103 bp, Artificial Sequence
  Synthetic Polynucleotide
taatacgactcactatagggtacagctcagccgccgcggctgccgctgccaacagaggagaggcagcatgagccgcggcaacctggcggcagcgcaaaagatg

SEQ ID NO: 235612 - DNA, 103 bp, Artificial Sequence
  Synthetic Polynucleotide
taatacgactcactatagggggcgcggccgtacagctcagccgccgcggcaacagaggagagccgcgatggctgagctgaacctggcggcagcgcaaaagatg

SEQ ID NO: 235613 - DNA, 103 bp, Artificial Sequence
  Synthetic Polynucleotide
taatacgactcactatagggagggcggttcggcgcggccgtacagctcagaacagaggagactgagcatgacggccgcgaacctggcggcagcgcaaaagatg

SEQ ID NO: 235614 - DNA, 103 bp, Artificial Sequence
  Synthetic Polynucleotide
taatacgactcactatagggagcgctggcgggttcctcttgctcaaagggaacagaggagaccctttatgcaagaggaaaacctggcggcagcgcaaaagatg

SEQ ID NO: 235615 - DNA, 103 bp, Artificial Sequence
  Synthetic Polynucleotide
taatacgactcactatagggcgcggcgcgaagggcggttcggcgcggccgaacagaggagacggccgatgcgaaccgccaacctggcggcagcgcaaaagatg

SEQ ID NO: 235616 - DNA, 103 bp, Artificial Sequence
  Synthetic Polynucleotide
taatacgactcactataggggtccccagagcgcggcgcgaagggcggttcaacagaggagagaaccgatgttcgcgccgaacctggcggcagcgcaaaagatg

SEQ ID NO: 235617 - DNA, 103 bp, Artificial Sequence
  Synthetic Polynucleotide
taatacgactcactatagggcgtagtgcgcgtccccagagcgcggcgcgaaacagaggagatcgcgcatggctctggggaacctggcggcagcgcaaaagatg

SEQ ID NO: 235618 - DNA, 103 bp, Artificial Sequence
  Synthetic Polynucleotide
taatacgactcactataggggcaaccgccccgtagtgcgcgtccccagagaacagaggagactctggatgcgcgcactaaacctggcggcagcgcaaaagatg

SEQ ID NO: 235619 - DNA, 103 bp, Artificial Sequence
  Synthetic Polynucleotide
taatacgactcactatagggcgctgcggccgcaaccgccccgtagtgcgcaacagaggagagcgcacatgggggcggttaacctggcggcagcgcaaaagatg

SEQ ID NO: 235620 - DNA, 103 bp, Artificial Sequence
  Synthetic Polynucleotide
taatacgactcactataggggggcggccgccgctgcggccgcaaccgcccaacagaggagagggcggatgcggccgcagaacctggcggcagcgcaaaagatg

SEQ ID NO: 235621 - DNA, 103 bp, Artificial Sequence
  Synthetic Polynucleotide
taatacgactcactatagggtagccgtgcagggcggccgccgctgcggccaacagaggagaggccgcatgggcggccgcaacctggcggcagcgcaaaagatg

SEQ ID NO: 235622 - DNA, 103 bp, Artificial Sequence
  Synthetic Polynucleotide
taatacgactcactatagggcacggctccgtagccgtgcagggcggccgcaacagaggagagcggccatgctgcacggcaacctggcggcagcgcaaaagatg

SEQ ID NO: 235623 - DNA, 103 bp, Artificial Sequence
  Synthetic Polynucleotide
taatacgactcactatagggggtttaagttcacggctccgtagccgtgcaaacagaggagatgcacgatgacggagccgaacctggcggcagcgcaaaagatg

SEQ ID NO: 235624 - DNA, 103 bp, Artificial Sequence
  Synthetic Polynucleotide
taatacgactcactataggggccaggttcaggtttaagttcacggctccgaacagaggagacggagcatggaacttaaaaacctggcggcagcgcaaaagatg

SEQ ID NO: 235625 - DNA, 103 bp, Artificial Sequence
  Synthetic Polynucleotide
taatacgactcactatagggggctgtgctttcacttaattctctagccataacagaggagaatggctatggaattaagtaacctggcggcagcgcaaaagatg

SEQ ID NO: 235626 - DNA, 103 bp, Artificial Sequence
  Synthetic Polynucleotide
taatacgactcactatagggcagatctgggctactgggaaaaccggcttcaacagaggagagaagccatgtttcccagtaacctggcggcagcgcaaaagatg

SEQ ID NO: 235627 - DNA, 103 bp, Artificial Sequence
  Synthetic Polynucleotide
taatacgactcactatagggtttctcaccagtgtggattctcctgtgtttaacagaggagaaaacacatgagaatccacaacctggcggcagcgcaaaagatg

SEQ ID NO: 235628 - DNA, 103 bp, Artificial Sequence
  Synthetic Polynucleotide
taatacgactcactatagggattcgtagggtttctcaccagtgtggattcaacagaggagagaatccatgctggtgagaaacctggcggcagcgcaaaagatg

SEQ ID NO: 235629 - DNA, 103 bp, Artificial Sequence
  Synthetic Polynucleotide
taatacgactcactatagggcactcttcacattcgtagggtttctcaccaaacagaggagatggtgaatgaccctacgaaacctggcggcagcgcaaaagatg

SEQ ID NO: 235630 - DNA, 103 bp, Artificial Sequence
  Synthetic Polynucleotide
taatacgactcactatagggggctttgccacactcttcacattcgtagggaacagaggagaccctacatgtgtgaagagaacctggcggcagcgcaaaagatg

SEQ ID NO: 235631 - DNA, 103 bp, Artificial Sequence
  Synthetic Polynucleotide
taatacgactcactatagggtcccaatgaaggctttgccacactcttcacaacagaggagagtgaagatggtggcaaagaacctggcggcagcgcaaaagatg

SEQ ID NO: 235632 - DNA, 103 bp, Artificial Sequence
  Synthetic Polynucleotide
taatacgactcactatagggagggcagagctcccaatgaaggctttgccaaacagaggagatggcaaatgcttcattggaacctggcggcagcgcaaaagatg

SEQ ID NO: 235633 - DNA, 103 bp, Artificial Sequence
  Synthetic Polynucleotide
taatacgactcactatagggatgaatgacaagggcagagctcccaatgaaaacagaggagattcattatgagctctgccaacctggcggcagcgcaaaagatg

SEQ ID NO: 235634 - DNA, 103 bp, Artificial Sequence
  Synthetic Polynucleotide
taatacgactcactatagggggactctctgatgaatgacaagggcagagcaacagaggagagctctgatgttgtcattcaacctggcggcagcgcaaaagatg

SEQ ID NO: 235635 - DNA, 103 bp, Artificial Sequence
  Synthetic Polynucleotide
taatacgactcactatagggtcaccagtgtggactctctgatgaatgacaaacagaggagatgtcatatgtcagagagtaacctggcggcagcgcaaaagatg

SEQ ID NO: 235636 - DNA, 103 bp, Artificial Sequence
  Synthetic Polynucleotide
taatacgactcactatagggatatggcttctcaccagtgtggactctctgaacagaggagacagagaatgcacactggtaacctggcggcagcgcaaaagatg

SEQ ID NO: 235637 - DNA, 103 bp, Artificial Sequence
  Synthetic Polynucleotide
taatacgactcactatagggcctcagaacccagatctgggctactgggaaaacagaggagattcccaatggcccagatcaacctggcggcagcgcaaaagatg

SEQ ID NO: 235638 - DNA, 103 bp, Artificial Sequence
  Synthetic Polynucleotide
taatacgactcactatagggcttcacactcatatggcttctcaccagtgtaacagaggagaacactgatgagaagccataacctggcggcagcgcaaaagatg

SEQ ID NO: 235639 - DNA, 103 bp, Artificial Sequence
  Synthetic Polynucleotide
taatacgactcactatagggttaccacattcttcacactcatatggcttcaacagaggagagaagccatgtgagtgtgaaacctggcggcagcgcaaaagatg

SEQ ID NO: 235640 - DNA, 103 bp, Artificial Sequence
  Synthetic Polynucleotide
taatacgactcactatagggactgaaggccttaccacattcttcacactcaacagaggagagagtgtatggaatgtggtaacctggcggcagcgcaaaagatg

SEQ ID NO: 235641 - DNA, 103 bp, Artificial Sequence
  Synthetic Polynucleotide
taatacgactcactatagggctgagctatgactgaaggccttaccacattaacagaggagaaatgtgatgaggccttcaaacctggcggcagcgcaaaagatg

SEQ ID NO: 235642 - DNA, 103 bp, Artificial Sequence
  Synthetic Polynucleotide
taatacgactcactatagggttgataaggtctgagctatgactgaaggccaacagaggagaggccttatgtcatagctcaacctggcggcagcgcaaaagatg

SEQ ID NO: 235643 - DNA, 103 bp, Artificial Sequence
  Synthetic Polynucleotide
taatacgactcactatagggtctctgatgcttgataaggtctgagctatgaacagaggagacatagcatggaccttatcaacctggcggcagcgcaaaagatg

SEQ ID NO: 235644 - DNA, 103 bp, Artificial Sequence
  Synthetic Polynucleotide
taatacgactcactatagggcagtgtgggttctctgatgcttgataaggtaacagaggagaaccttaatgagcatcagaaacctggcggcagcgcaaaagatg

SEQ ID NO: 235645 - DNA, 103 bp, Artificial Sequence
  Synthetic Polynucleotide
taatacgactcactatagggggcttctccccagtgtgggttctctgatgcaacagaggagagcatcaatgaacccacacaacctggcggcagcgcaaaagatg

SEQ ID NO: 235646 - DNA, 103 bp, Artificial Sequence
  Synthetic Polynucleotide
taatacgactcactatagggacactcatagggcttctccccagtgtgggtaacagaggagaacccacatgggggagaagaacctggcggcagcgcaaaagatg

SEQ ID NO: 235647 - DNA, 103 bp, Artificial Sequence
  Synthetic Polynucleotide
taatacgactcactatagggcacagtcatcacactcatagggcttctcccaacagaggagagggagaatgcctatgagtaacctggcggcagcgcaaaagatg

SEQ ID NO: 235648 - DNA, 103 bp, Artificial Sequence
  Synthetic Polynucleotide
taatacgactcactatagggtcgcgggagccctcagaacccagatctgggaacagaggagacccagaatggggttctgaaacctggcggcagcgcaaaagatg

SEQ ID NO: 235649 - DNA, 103 bp, Artificial Sequence
  Synthetic Polynucleotide
taatacgactcactatagggaaggtcttcccacagtcatcacactcatagaacagaggagactatgaatgtgatgactgaacctggcggcagcgcaaaagatg

SEQ ID NO: 235650 - DNA, 103 bp, Artificial Sequence
  Synthetic Polynucleotide
taatacgactcactataggggctctggctgaaggtcttcccacagtcatcaacagaggagagatgacatggggaagaccaacctggcggcagcgcaaaagatg

SEQ ID NO: 235651 - DNA, 103 bp, Artificial Sequence
  Synthetic Polynucleotide
taatacgactcactatagggggaggctgcagctctggctgaaggtcttccaacagaggagaggaagaatgtcagccagaaacctggcggcagcgcaaaagatg

SEQ ID NO: 235652 - DNA, 103 bp, Artificial Sequence
  Synthetic Polynucleotide
taatacgactcactatagggtgatgttcaaggaggctgcagctctggctgaacagaggagacagccaatgctgcagcctaacctggcggcagcgcaaaagatg

SEQ ID NO: 235653 - DNA, 103 bp, Artificial Sequence
  Synthetic Polynucleotide
taatacgactcactataggggtggattctgtgatgttcaaggaggctgcaaacagaggagatgcagcatgcttgaacataacctggcggcagcgcaaaagatg

SEQ ID NO: 235654 - DNA, 103 bp, Artificial Sequence
  Synthetic Polynucleotide
taatacgactcactatagggtctccccagtgtggattctgtgatgttcaaaacagaggagattgaacatgacagaatccaacctggcggcagcgcaaaagatg

SEQ ID NO: 235655 - DNA, 103 bp, Artificial Sequence
  Synthetic Polynucleotide
taatacgactcactatagggtgatacggcttctccccagtgtggattctgaacagaggagacagaatatgcactggggaaacctggcggcagcgcaaaagatg

SEQ ID NO: 235656 - DNA, 103 bp, Artificial Sequence
  Synthetic Polynucleotide
taatacgactcactatagggcatactgcactgatacggcttctccccagtaacagaggagaactgggatgaagccgtataacctggcggcagcgcaaaagatg

SEQ ID NO: 235657 - DNA, 103 bp, Artificial Sequence
  Synthetic Polynucleotide
taatacgactcactatagggctttgccacacatactgcactgatacggctaacagaggagaagccgtatgagtgcagtaaacctggcggcagcgcaaaagatg

SEQ ID NO: 235658 - DNA, 103 bp, Artificial Sequence
  Synthetic Polynucleotide
taatacgactcactatagggcgcctaaaggctttgccacacatactgcacaacagaggagagtgcagatggtgtggcaaaacctggcggcagcgcaaaagatg

SEQ ID NO: 235659 - DNA, 103 bp, Artificial Sequence
  Synthetic Polynucleotide
taatacgactcactatagggtcggaagcgctcgcgggagccctcagaaccaacagaggagaggttctatgggctcccgcaacctggcggcagcgcaaaagatg

SEQ ID NO: 235660 - DNA, 103 bp, Artificial Sequence
  Synthetic Polynucleotide
taatacgactcactatagggatgtgaacttcgcctaaaggctttgccacaaacagaggagatgtggcatggcctttaggaacctggcggcagcgcaaaagatg

SEQ ID NO: 235661 - DNA, 103 bp, Artificial Sequence
  Synthetic Polynucleotide
taatacgactcactataggggtctcaggagatgtgaacttcgcctaaaggaacagaggagacctttaatggaagttcacaacctggcggcagcgcaaaagatg

SEQ ID NO: 235662 - DNA, 103 bp, Artificial Sequence
  Synthetic Polynucleotide
taatacgactcactatagggatcctctgatgtctcaggagatgtgaacttaacagaggagaaagttcatgtctcctgagaacctggcggcagcgcaaaagatg

SEQ ID NO: 235663 - DNA, 103 bp, Artificial Sequence
  Synthetic Polynucleotide
taatacgactcactatagggcccagtatggatcctctgatgtctcaggagaacagaggagactcctgatgcatcagaggaacctggcggcagcgcaaaagatg

SEQ ID NO: 235664 - DNA, 103 bp, Artificial Sequence
  Synthetic Polynucleotide
taatacgactcactatagggcatttttatccccagtatggatcctctgataacagaggagaatcagaatgtccatactgaacctggcggcagcgcaaaagatg

SEQ ID NO: 235665 - DNA, 103 bp, Artificial Sequence
  Synthetic Polynucleotide
taatacgactcactatagggggttcctgaacatttttatccccagtatggaacagaggagaccatacatgggataaaaaaacctggcggcagcgcaaaagatg

SEQ ID NO: 235666 - DNA, 103 bp, Artificial Sequence
  Synthetic Polynucleotide
taatacgactcactatagggtccctgctcaggttcctgaacatttttatcaacagaggagagataaaatggttcaggaaaacctggcggcagcgcaaaagatg

SEQ ID NO: 235667 - DNA, 103 bp, Artificial Sequence
  Synthetic Polynucleotide
taatacgactcactatagggtccaggcctctccctgctcaggttcctgaaaacagaggagattcaggatgctgagcaggaacctggcggcagcgcaaaagatg

SEQ ID NO: 235668 - DNA, 103 bp, Artificial Sequence
  Synthetic Polynucleotide
taatacgactcactatagggatcctacttttccaggcctctccctgctcaaacagaggagatgagcaatgagaggcctgaacctggcggcagcgcaaaagatg

SEQ ID NO: 235669 - DNA, 103 bp, Artificial Sequence
  Synthetic Polynucleotide
taatacgactcactatagggctggctttccatcctacttttccaggcctcaacagaggagagaggccatgaaaagtaggaacctggcggcagcgcaaaagatg

SEQ ID NO: 235670 - DNA, 103 bp, Artificial Sequence
  Synthetic Polynucleotide
taatacgactcactatagggagcggaagcctcggaagcgctcgcgggagcaacagaggagagctcccatgagcgcttccaacctggcggcagcgcaaaagatg

SEQ ID NO: 235671 - DNA, 103 bp, Artificial Sequence
  Synthetic Polynucleotide
taatacgactcactatagggcattttccaactggctttccatcctactttaacagaggagaaaagtaatgtggaaagccaacctggcggcagcgcaaaagatg

SEQ ID NO: 235672 - DNA, 103 bp, Artificial Sequence
  Synthetic Polynucleotide
taatacgactcactatagggggagtttcaacattttccaactggctttccaacagaggagaggaaagatggttggaaaaaacctggcggcagcgcaaaagatg

SEQ ID NO: 235673 - DNA, 103 bp, Artificial Sequence
  Synthetic Polynucleotide
taatacgactcactatagggataagacatgggagtttcaacattttccaaaacagaggagattggaaatggttgaaactaacctggcggcagcgcaaaagatg

SEQ ID NO: 235674 - DNA, 103 bp, Artificial Sequence
  Synthetic Polynucleotide
taatacgactcactatagggcattacatttataagacatgggagtttcaaaacagaggagattgaaaatgccatgtcttaacctggcggcagcgcaaaagatg

SEQ ID NO: 235675 - DNA, 103 bp, Artificial Sequence
  Synthetic Polynucleotide
taatacgactcactatagggctttcacactcattacatttataagacatgaacagaggagacatgtcatgtaaatgtaaaacctggcggcagcgcaaaagatg

SEQ ID NO: 235676 - DNA, 103 bp, Artificial Sequence
  Synthetic Polynucleotide
taatacgactcactatagggagtgaaacttctttcacactcattacatttaacagaggagaaaatgtatggagtgtgaaaacctggcggcagcgcaaaagatg

SEQ ID NO: 235677 - DNA, 103 bp, Artificial Sequence
  Synthetic Polynucleotide
taatacgactcactatagggctgtattctgagtgaaacttctttcacactaacagaggagaagtgtgatggaagtttcaaacctggcggcagcgcaaaagatg

SEQ ID NO: 235678 - DNA, 103 bp, Artificial Sequence
  Synthetic Polynucleotide
taatacgactcactatagggtcaatgaggcctgtattctgagtgaaacttaacagaggagaaagtttatgtcagaatacaacctggcggcagcgcaaaagatg

SEQ ID NO: 235679 - DNA, 103 bp, Artificial Sequence
  Synthetic Polynucleotide
taatacgactcactatagggtttttgatgttcaatgaggcctgtattctgaacagaggagacagaatatgggcctcattaacctggcggcagcgcaaaagatg

SEQ ID NO: 235680 - DNA, 103 bp, Artificial Sequence
  Synthetic Polynucleotide
taatacgactcactatagggcagtgtggattttttgatgttcaatgaggcaacagaggagagcctcaatgaacatcaaaaacctggcggcagcgcaaaagatg

SEQ ID NO: 235681 - DNA, 103 bp, Artificial Sequence
  Synthetic Polynucleotide
taatacgactcactataggggcctccgggtagcggaagcctcggaagcgcaacagaggagagcgcttatgaggcttccgaacctggcggcagcgcaaaagatg

SEQ ID NO: 235682 - DNA, 103 bp, Artificial Sequence
  Synthetic Polynucleotide
taatacgactcactatagggggtttctcaccagtgtggattttttgatgtaacagaggagaacatcaatgaatccacacaacctggcggcagcgcaaaagatg

SEQ ID NO: 235683 - DNA, 103 bp, Artificial Sequence
  Synthetic Polynucleotide
taatacgactcactatagggacactgatagggtttctcaccagtgtggataacagaggagaatccacatgggtgagaaaaacctggcggcagcgcaaaagatg

SEQ ID NO: 235684 - DNA, 103 bp, Artificial Sequence
  Synthetic Polynucleotide
taatacgactcactatagggcacacgcattacactgatagggtttctcacaacagaggagagtgagaatgcctatcagtaacctggcggcagcgcaaaagatg

SEQ ID NO: 235685 - DNA, 103 bp, Artificial Sequence
  Synthetic Polynucleotide
taatacgactcactatagggaagccttttccacacgcattacactgatagaacagaggagactatcaatgtaatgcgtgaacctggcggcagcgcaaaagatg

SEQ ID NO: 235686 - DNA, 103 bp, Artificial Sequence
  Synthetic Polynucleotide
taatacgactcactatagggaattcgggtgaagccttttccacacgcattaacagaggagaaatgcgatgggaaaaggcaacctggcggcagcgcaaaagatg

SEQ ID NO: 235687 - DNA, 103 bp, Artificial Sequence
  Synthetic Polynucleotide
taatacgactcactatagggcaaggtatgaaattcgggtgaagccttttcaacagaggagagaaaagatgtcacccgaaaacctggcggcagcgcaaaagatg

SEQ ID NO: 235688 - DNA, 103 bp, Artificial Sequence
  Synthetic Polynucleotide
taatacgactcactatagggtgatgttgaacaaggtatgaaattcgggtgaacagaggagacacccgatgttcatacctaacctggcggcagcgcaaaagatg

SEQ ID NO: 235689 - DNA, 103 bp, Artificial Sequence
  Synthetic Polynucleotide
taatacgactcactatagggatggcttctctgatgttgaacaaggtatgaaacagaggagatcatacatggttcaacataacctggcggcagcgcaaaagatg

SEQ ID NO: 235690 - DNA, 103 bp, Artificial Sequence
  Synthetic Polynucleotide
taatacgactcactatagggttttccctacatggcttctctgatgttgaaaacagaggagattcaacatgagagaagccaacctggcggcagcgcaaaagatg

SEQ ID NO: 235691 - DNA, 103 bp, Artificial Sequence
  Synthetic Polynucleotide
taatacgactcactataggggataggatgtttttccctacatggcttctcaacagaggagagagaagatgtgtagggaaaacctggcggcagcgcaaaagatg

SEQ ID NO: 235692 - DNA, 103 bp, Artificial Sequence
  Synthetic Polynucleotide
taatacgactcactatagggggggcctgcagcctccgggtagcggaagccaacagaggagaggcttcatgtacccggagaacctggcggcagcgcaaaagatg

SEQ ID NO: 235693 - DNA, 103 bp, Artificial Sequence
  Synthetic Polynucleotide
taatacgactcactataggggcgcctcgcgggggcctgcagcctccgggtaacagaggagaacccggatgctgcaggccaacctggcggcagcgcaaaagatg

SEQ ID NO: 235694 - DNA, 103 bp, Artificial Sequence
  Synthetic Polynucleotide
taatacgactcactatagggagccgactcagcgcctcgcgggggcctgcaaacagaggagatgcaggatgccgcgaggcaacctggcggcagcgcaaaagatg

SEQ ID NO: 235695 - DNA, 103 bp, Artificial Sequence
  Synthetic Polynucleotide
taatacgactcactataggggagctctcggagccgactcagcgcctcgcgaacagaggagacgcgagatgctgagtcggaacctggcggcagcgcaaaagatg

SEQ ID NO: 235696 - DNA, 103 bp, Artificial Sequence
  Synthetic Polynucleotide
taatacgactcactataggggggcatccagggctgtgctttcacttaattaacagaggagaaattaaatgaaagcacagaacctggcggcagcgcaaaagatg

SEQ ID NO: 235697 - DNA, 103 bp, Artificial Sequence
  Synthetic Polynucleotide
taatacgactcactatagggactgtcggcagagctctcggagccgactcaaacagaggagatgagtcatgtccgagagcaacctggcggcagcgcaaaagatg

SEQ ID NO: 235698 - DNA, 103 bp, Artificial Sequence
  Synthetic Polynucleotide
taatacgactcactatagggggctgcagccactgtcggcagagctctcggaacagaggagaccgagaatgctgccgacaaacctggcggcagcgcaaaagatg

SEQ ID NO: 235699 - DNA, 103 bp, Artificial Sequence
  Synthetic Polynucleotide
taatacgactcactataggggtgcatctcaggctgcagccactgtcggcaaacagaggagatgccgaatgtggctgcagaacctggcggcagcgcaaaagatg

SEQ ID NO: 235700 - DNA, 103 bp, Artificial Sequence
  Synthetic Polynucleotide
taatacgactcactataggggctccttgctgtgcatctcaggctgcagccaacagaggagaggctgcatgctgagatgcaacctggcggcagcgcaaaagatg

SEQ ID NO: 235701 - DNA, 103 bp, Artificial Sequence
  Synthetic Polynucleotide
taatacgactcactatagggtccaggatctgctccttgctgtgcatctcaaacagaggagatgagatatgcagcaaggaaacctggcggcagcgcaaaagatg

SEQ ID NO: 235702 - DNA, 103 bp, Artificial Sequence
  Synthetic Polynucleotide
taatacgactcactatagggcaccagcagctccaggatctgctccttgctaacagaggagaagcaagatgcagatcctgaacctggcggcagcgcaaaagatg

SEQ ID NO: 235703 - DNA, 103 bp, Artificial Sequence
  Synthetic Polynucleotide
taatacgactcactatagggactgctccagcaccagcagctccaggatctaacagaggagaagatccatgagctgctggaacctggcggcagcgcaaaagatg

SEQ ID NO: 235704 - DNA, 103 bp, Artificial Sequence
  Synthetic Polynucleotide
taatacgactcactatagggatggtcaggaactgctccagcaccagcagcaacagaggagagctgctatggctggagcaaacctggcggcagcgcaaaagatg

SEQ ID NO: 235705 - DNA, 103 bp, Artificial Sequence
  Synthetic Polynucleotide
taatacgactcactatagggccccggcaggatggtcaggaactgctccagaacagaggagactggagatgttcctgaccaacctggcggcagcgcaaaagatg

SEQ ID NO: 235706 - DNA, 103 bp, Artificial Sequence
  Synthetic Polynucleotide
taatacgactcactatagggtctgcagattccccggcaggatggtcaggaaacagaggagatcctgaatgtcctgccggaacctggcggcagcgcaaaagatg

SEQ ID NO: 235707 - DNA, 103 bp, Artificial Sequence
  Synthetic Polynucleotide
taatacgactcactatagggtctgtagactgggcatccagggctgtgcttaacagaggagaaagcacatgcctggatgcaacctggcggcagcgcaaaagatg

SEQ ID NO: 235708 - DNA, 103 bp, Artificial Sequence
  Synthetic Polynucleotide
taatacgactcactatagggcgcacccagctctgcagattccccggcaggaacagaggagacctgccatggaatctgcaaacctggcggcagcgcaaaagatg

SEQ ID NO: 235709 - DNA, 103 bp, Artificial Sequence
  Synthetic Polynucleotide
taatacgactcactatagggatgctgctcccgcacccagctctgcagattaacagaggagaaatctgatgagctgggtgaacctggcggcagcgcaaaagatg

SEQ ID NO: 235710 - DNA, 103 bp, Artificial Sequence
  Synthetic Polynucleotide
taatacgactcactatagggcgctctctggatgctgctcccgcacccagcaacagaggagagctgggatggggagcagcaacctggcggcagcgcaaaagatg

SEQ ID NO: 235711 - DNA, 103 bp, Artificial Sequence
  Synthetic Polynucleotide
taatacgactcactatagggacctcctccccgctctctggatgctgctccaacagaggagaggagcaatgtccagagagaacctggcggcagcgcaaaagatg

SEQ ID NO: 235712 - DNA, 103 bp, Artificial Sequence
  Synthetic Polynucleotide
taatacgactcactatagggtagcaccaccacctcctccccgctctctggaacagaggagaccagagatgggggaggagaacctggcggcagcgcaaaagatg

SEQ ID NO: 235713 - DNA, 103 bp, Artificial Sequence
  Synthetic Polynucleotide
taatacgactcactatagggaatactccaatagcaccaccacctcctcccaacagaggagagggaggatgtggtggtgcaacctggcggcagcgcaaaagatg

SEQ ID NO: 235714 - DNA, 103 bp, Artificial Sequence
  Synthetic Polynucleotide
taatacgactcactatagggtgcctctccaaatactccaatagcaccaccaacagaggagaggtggtatgattggagtaaacctggcggcagcgcaaaagatg

SEQ ID NO: 235715 - DNA, 103 bp, Artificial Sequence
  Synthetic Polynucleotide
taatacgactcactatagggctcatccagctgcctctccaaatactccaaaacagaggagattggagatgttggagaggaacctggcggcagcgcaaaagatg

SEQ ID NO: 235716 - DNA, 103 bp, Artificial Sequence
  Synthetic Polynucleotide
taatacgactcactataggggcggcgccggctcatccagctgcctctccaaacagaggagatggagaatgagctggatgaacctggcggcagcgcaaaagatg

SEQ ID NO: 235717 - DNA, 103 bp, Artificial Sequence
  Synthetic Polynucleotide
taatacgactcactatagggcctgaaacctgcggcgccggctcatccagcaacagaggagagctggaatggccggcgccaacctggcggcagcgcaaaagatg

SEQ ID NO: 235718 - DNA, 103 bp, Artificial Sequence
  Synthetic Polynucleotide
taatacgactcactatagggcatctggtcttctgtagactgggcatccagaacagaggagactggatatgcagtctacaaacctggcggcagcgcaaaagatg

SEQ ID NO: 235719 - DNA, 103 bp, Artificial Sequence
  Synthetic Polynucleotide
taatacgactcactatagggctggtcaacacctgaaacctgcggcgccggaacagaggagaccggcgatgcaggtttcaaacctggcggcagcgcaaaagatg

SEQ ID NO: 235720 - DNA, 103 bp, Artificial Sequence
  Synthetic Polynucleotide
taatacgactcactataggggttcttgcccctggtcaacacctgaaacctaacagaggagaaggtttatggtgttgaccaacctggcggcagcgcaaaagatg

SEQ ID NO: 235721 - DNA, 103 bp, Artificial Sequence
  Synthetic Polynucleotide
taatacgactcactatagggcaacagagcagttcttgcccctggtcaacaaacagaggagatgttgaatgggggcaagaaacctggcggcagcgcaaaagatg

SEQ ID NO: 235722 - DNA, 103 bp, Artificial Sequence
  Synthetic Polynucleotide
taatacgactcactatagggtgccatcttgcaacagagcagttcttgcccaacagaggagagggcaaatgctgctctgtaacctggcggcagcgcaaaagatg

SEQ ID NO: 235723 - DNA, 103 bp, Artificial Sequence
  Synthetic Polynucleotide
taatacgactcactataggggtgtcaatagtgccatcttgcaacagagcaaacagaggagatgctctatggcaagatggaacctggcggcagcgcaaaagatg

SEQ ID NO: 235724 - DNA, 103 bp, Artificial Sequence
  Synthetic Polynucleotide
taatacgactcactatagggcctggggctggtgtcaatagtgccatcttgaacagaggagacaagatatgactattgacaacctggcggcagcgcaaaagatg

SEQ ID NO: 235725 - DNA, 103 bp, Artificial Sequence
  Synthetic Polynucleotide
taatacgactcactatagggactttgtgaccctggggctggtgtcaatagaacagaggagactattgatgccagccccaaacctggcggcagcgcaaaagatg

SEQ ID NO: 235726 - DNA, 103 bp, Artificial Sequence
  Synthetic Polynucleotide
taatacgactcactataggggaaattggctactttgtgaccctggggctgaacagaggagacagcccatgggtcacaaaaacctggcggcagcgcaaaagatg

SEQ ID NO: 235727 - DNA, 103 bp, Artificial Sequence
  Synthetic Polynucleotide
taatacgactcactatagggttcattagctgaaattggctactttgtgacaacagaggagagtcacaatgtagccaattaacctggcggcagcgcaaaagatg

SEQ ID NO: 235728 - DNA, 103 bp, Artificial Sequence
  Synthetic Polynucleotide
taatacgactcactataggggagcagagccttcattagctgaaattggctaacagaggagaagccaaatgcagctaatgaacctggcggcagcgcaaaagatg

SEQ ID NO: 235729 - DNA, 103 bp, Artificial Sequence
  Synthetic Polynucleotide
taatacgactcactatagggccagaagctccatctggtcttctgtagactaacagaggagaagtctaatgaagaccagaaacctggcggcagcgcaaaagatg

SEQ ID NO: 235730 - DNA, 103 bp, Artificial Sequence
  Synthetic Polynucleotide
taatacgactcactatagggattcatgcttgagcagagccttcattagctaacagaggagaagctaaatgaggctctgcaacctggcggcagcgcaaaagatg

SEQ ID NO: 235731 - DNA, 103 bp, Artificial Sequence
  Synthetic Polynucleotide
taatacgactcactataggggatcccacagattcatgcttgagcagagccaacagaggagaggctctatgcaagcatgaaacctggcggcagcgcaaaagatg

SEQ ID NO: 235732 - DNA, 103 bp, Artificial Sequence
  Synthetic Polynucleotide
taatacgactcactatagggtaaaggctgggatcccacagattcatgcttaacagaggagaaagcatatgtctgtgggaaacctggcggcagcgcaaaagatg

SEQ ID NO: 235733 - DNA, 103 bp, Artificial Sequence
  Synthetic Polynucleotide
taatacgactcactatagggctctatcttgtaaaggctgggatcccacagaacagaggagactgtggatgcccagccttaacctggcggcagcgcaaaagatg

SEQ ID NO: 235734 - DNA, 103 bp, Artificial Sequence
  Synthetic Polynucleotide
taatacgactcactatagggacctggagaactctatcttgtaaaggctggaacagaggagaccagccatgacaagatagaacctggcggcagcgcaaaagatg

SEQ ID NO: 235735 - DNA, 103 bp, Artificial Sequence
  Synthetic Polynucleotide
taatacgactcactatagggaagcacggggacctggagaactctatcttgaacagaggagacaagatatggttctccagaacctggcggcagcgcaaaagatg

SEQ ID NO: 235736 - DNA, 103 bp, Artificial Sequence
  Synthetic Polynucleotide
taatacgactcactatagggctccatgggcaagcacggggacctggagaaaacagaggagattctccatgtccccgtgcaacctggcggcagcgcaaaagatg

SEQ ID NO: 235737 - DNA, 103 bp, Artificial Sequence
  Synthetic Polynucleotide
taatacgactcactatagggctgcagcatcctccatgggcaagcacggggaacagaggagaccccgtatgtgcccatggaacctggcggcagcgcaaaagatg

SEQ ID NO: 235738 - DNA, 103 bp, Artificial Sequence
  Synthetic Polynucleotide
taatacgactcactatagggtttatcttctctgcagcatcctccatgggcaacagaggagagcccatatgggatgctgcaacctggcggcagcgcaaaagatg

SEQ ID NO: 235739 - DNA, 103 bp, Artificial Sequence
  Synthetic Polynucleotide
taatacgactcactatagggaagctaccactttatcttctctgcagcatcaacagaggagagatgctatggagaagataaacctggcggcagcgcaaaagatg

SEQ ID NO: 235740 - DNA, 103 bp, Artificial Sequence
  Synthetic Polynucleotide
taatacgactcactatagggacctttatgaccagaagctccatctggtctaacagaggagaagaccaatgggagcttctaacctggcggcagcgcaaaagatg

SEQ ID NO: 235741 - DNA, 103 bp, Artificial Sequence
  Synthetic Polynucleotide
taatacgactcactataggggtaagcctagaagctaccactttatcttctaacagaggagaagaagaatgagtggtagcaacctggcggcagcgcaaaagatg

SEQ ID NO: 235742 - DNA, 103 bp, Artificial Sequence
  Synthetic Polynucleotide
taatacgactcactatagggggactctggagtaagcctagaagctaccacaacagaggagagtggtaatgtctaggcttaacctggcggcagcgcaaaagatg

SEQ ID NO: 235743 - DNA, 103 bp, Artificial Sequence
  Synthetic Polynucleotide
taatacgactcactatagggacaacccctgggactctggagtaagcctagaacagaggagactaggcatgctccagagtaacctggcggcagcgcaaaagatg

SEQ ID NO: 235744 - DNA, 103 bp, Artificial Sequence
  Synthetic Polynucleotide
taatacgactcactatagggtccactttcaacaacccctgggactctggaaacagaggagatccagaatgccaggggttaacctggcggcagcgcaaaagatg

SEQ ID NO: 235745 - DNA, 103 bp, Artificial Sequence
  Synthetic Polynucleotide
taatacgactcactatagggggccacatcttccactttcaacaacccctgaacagaggagacaggggatgttgaaagtgaacctggcggcagcgcaaaagatg

SEQ ID NO: 235746 - DNA, 103 bp, Artificial Sequence
  Synthetic Polynucleotide
taatacgactcactatagggtgagggtcagggccacatcttccactttcaaacagaggagatgaaagatgaagatgtggaacctggcggcagcgcaaaagatg

SEQ ID NO: 235747 - DNA, 103 bp, Artificial Sequence
  Synthetic Polynucleotide
taatacgactcactatagggcattcaggggtgagggtcagggccacatctaacagaggagaagatgtatgcctgaccctaacctggcggcagcgcaaaagatg

SEQ ID NO: 235748 - DNA, 103 bp, Artificial Sequence
  Synthetic Polynucleotide
taatacgactcactatagggctgctgtgtccattcaggggtgagggtcagaacagaggagactgaccatgacccctgaaaacctggcggcagcgcaaaagatg

SEQ ID NO: 235749 - DNA, 103 bp, Artificial Sequence
  Synthetic Polynucleotide
taatacgactcactataggggagatgaatcctgctgtgtccattcaggggaacagaggagacccctgatgggacacagcaacctggcggcagcgcaaaagatg

SEQ ID NO: 235750 - DNA, 103 bp, Artificial Sequence
  Synthetic Polynucleotide
taatacgactcactatagggagattcccctgagatgaatcctgctgtgtcaacagaggagagacacaatgggattcatcaacctggcggcagcgcaaaagatg

SEQ ID NO: 235751 - DNA, 103 bp, Artificial Sequence
  Synthetic Polynucleotide
taatacgactcactatagggttcttcctccacctttatgaccagaagctcaacagaggagagagcttatggtcataaagaacctggcggcagcgcaaaagatg

SEQ ID NO: 235752 - DNA, 103 bp, Artificial Sequence
  Synthetic Polynucleotide
taatacgactcactatagggatctctacagagattcccctgagatgaatcaacagaggagagattcaatgcaggggaataacctggcggcagcgcaaaagatg

SEQ ID NO: 235753 - DNA, 103 bp, Artificial Sequence
  Synthetic Polynucleotide
taatacgactcactatagggcctgcttttcatctctacagagattcccctaacagaggagaaggggaatgtctgtagagaacctggcggcagcgcaaaagatg

SEQ ID NO: 235754 - DNA, 103 bp, Artificial Sequence
  Synthetic Polynucleotide
taatacgactcactatagggccatggttctcctgcttttcatctctacagaacagaggagactgtagatgtgaaaagcaaacctggcggcagcgcaaaagatg

SEQ ID NO: 235755 - DNA, 103 bp, Artificial Sequence
  Synthetic Polynucleotide
taatacgactcactataggggaccaggctgccatggttctcctgcttttcaacagaggagagaaaagatggagaaccataacctggcggcagcgcaaaagatg

SEQ ID NO: 235756 - DNA, 103 bp, Artificial Sequence
  Synthetic Polynucleotide
taatacgactcactatagggcacccagggagaccaggctgccatggttctaacagaggagaagaaccatggcagcctggaacctggcggcagcgcaaaagatg

SEQ ID NO: 235757 - DNA, 103 bp, Artificial Sequence
  Synthetic Polynucleotide
taatacgactcactatagggtgtttttcatcacccagggagaccaggctgaacagaggagacagcctatgctccctgggaacctggcggcagcgcaaaagatg

SEQ ID NO: 235758 - DNA, 103 bp, Artificial Sequence
  Synthetic Polynucleotide
taatacgactcactataggggctcttagtctgtttttcatcacccagggaaacagaggagatccctgatggatgaaaaaaacctggcggcagcgcaaaagatg

SEQ ID NO: 235759 - DNA, 103 bp, Artificial Sequence
  Synthetic Polynucleotide
taatacgactcactataggggcaagtccctgctcttagtctgtttttcataacagaggagaatgaaaatgagactaagaaacctggcggcagcgcaaaagatg

SEQ ID NO: 235760 - DNA, 103 bp, Artificial Sequence
  Synthetic Polynucleotide
taatacgactcactatagggtcagctggaggcaagtccctgctcttagtcaacagaggagagactaaatgcagggacttaacctggcggcagcgcaaaagatg

SEQ ID NO: 235761 - DNA, 103 bp, Artificial Sequence
  Synthetic Polynucleotide
taatacgactcactatagggtggaagctcctcagctggaggcaagtccctaacagaggagaagggacatgcctccagctaacctggcggcagcgcaaaagatg

SEQ ID NO: 235762 - DNA, 103 bp, Artificial Sequence
  Synthetic Polynucleotide
taatacgactcactatagggaaccggcttcttcttcctccacctttatgaaacagaggagatcataaatgtggaggaagaacctggcggcagcgcaaaagatg

SEQ ID NO: 235763 - DNA, 103 bp, Artificial Sequence
  Synthetic Polynucleotide
taatacgactcactataggggctccttttctggaagctcctcagctggagaacagaggagactccagatgaggagcttcaacctggcggcagcgcaaaagatg

SEQ ID NO: 235764 - DNA, 103 bp, Artificial Sequence
  Synthetic Polynucleotide
taatacgactcactatagggatcttcccatgctccttttctggaagctccaacagaggagaggagctatgagaaaaggaaacctggcggcagcgcaaaagatg

SEQ ID NO: 235765 - DNA, 103 bp, Artificial Sequence
  Synthetic Polynucleotide
taatacgactcactataggggtggcacgatatcttcccatgctccttttcaacagaggagagaaaagatgcatgggaagaacctggcggcagcgcaaaagatg

SEQ ID NO: 235766 - DNA, 103 bp, Artificial Sequence
  Synthetic Polynucleotide
taatacgactcactatagggcttctctcaggtggcacgatatcttcccataacagaggagaatgggaatgtatcgtgccaacctggcggcagcgcaaaagatg

SEQ ID NO: 235767 - DNA, 103 bp, Artificial Sequence
  Synthetic Polynucleotide
taatacgactcactatagggtgggcaatgtcttctctcaggtggcacgataacagaggagaatcgtgatgcctgagagaaacctggcggcagcgcaaaagatg

SEQ ID NO: 235768 - DNA, 103 bp, Artificial Sequence
  Synthetic Polynucleotide
taatacgactcactatagggtgtaggaatctgggcaatgtcttctctcagaacagaggagactgagaatggacattgccaacctggcggcagcgcaaaagatg

SEQ ID NO: 235769 - DNA, 103 bp, Artificial Sequence
  Synthetic Polynucleotide
taatacgactcactatagggcttctgcacatgtaggaatctgggcaatgtaacagaggagaacattgatgagattcctaaacctggcggcagcgcaaaagatg

SEQ ID NO: 235770 - DNA, 103 bp, Artificial Sequence
  Synthetic Polynucleotide
taatacgactcactatagggtgttcaccagcttctgcacatgtaggaatcaacagaggagagattccatgatgtgcagaaacctggcggcagcgcaaaagatg

SEQ ID NO: 235771 - DNA, 103 bp, Artificial Sequence
  Synthetic Polynucleotide
taatacgactcactatagggcctgccctcctgttcaccagcttctgcacaaacagaggagatgtgcaatggctggtgaaaacctggcggcagcgcaaaagatg

SEQ ID NO: 235772 - DNA, 103 bp, Artificial Sequence
  Synthetic Polynucleotide
taatacgactcactatagggttctttgtagcctgccctcctgttcaccagaacagaggagactggtgatgaggagggcaaacctggcggcagcgcaaaagatg

SEQ ID NO: 235773 - DNA, 103 bp, Artificial Sequence
  Synthetic Polynucleotide
taatacgactcactatagggctactgggaaaaccggcttcttcttcctccaacagaggagaggaggaatgagaagccggaacctggcggcagcgcaaaagatg

SEQ ID NO: 235774 - DNA, 103 bp, Artificial Sequence
  Synthetic Polynucleotide
taatacgactcactatagggtttttctgctttctttgtagcctgccctccaacagaggagaggagggatggctacaaagaacctggcggcagcgcaaaagatg

SEQ ID NO: 235775 - DNA, 103 bp, Artificial Sequence
  Synthetic Polynucleotide
taatacgactcactatagggtcctgtggcatttttctgctttctttgtagaacagaggagactacaaatgaagcagaaaaacctggcggcagcgcaaaagatg

SEQ ID NO: 235776 - DNA, 103 bp, Artificial Sequence
  Synthetic Polynucleotide
taatacgactcactataggggccgcctccctcctgtggcatttttctgctaacagaggagaagcagaatgatgccacagaacctggcggcagcgcaaaagatg

SEQ ID NO: 235777 - DNA, 103 bp, Artificial Sequence
  Synthetic Polynucleotide
taatacgactcactatagggtggcagatgtgccgcctccctcctgtggcaaacagaggagatgccacatgagggaggcgaacctggcggcagcgcaaaagatg

SEQ ID NO: 235778 - DNA, 103 bp, Artificial Sequence
  Synthetic Polynucleotide
taatacgactcactatagggtccacattcatggcagatgtgccgcctcccaacagaggagagggaggatgcacatctgcaacctggcggcagcgcaaaagatg

SEQ ID NO: 235779 - DNA, 103 bp, Artificial Sequence
  Synthetic Polynucleotide
taatacgactcactatagggcaaaactctttccacattcatggcagatgtaacagaggagaacatctatgatgaatgtgaacctggcggcagcgcaaaagatg

SEQ ID NO: 235780 - DNA, 103 bp, Artificial Sequence
  Synthetic Polynucleotide
taatacgactcactataggggagctttgagcaaaactctttccacattcaaacagaggagatgaatgatgaaagagtttaacctggcggcagcgcaaaagatg

SEQ ID NO: 235781 - DNA, 103 bp, Artificial Sequence
  Synthetic Polynucleotide
taatacgactcactatagggactcaggcctgagctttgagcaaaactcttaacagaggagaaagagtatggctcaaagcaacctggcggcagcgcaaaagatg

SEQ ID NO: 235782 - DNA, 103 bp, Artificial Sequence
  Synthetic Polynucleotide
taatacgactcactatagggtcctgtgtttactcaggcctgagctttgagaacagaggagactcaaaatgcaggcctgaaacctggcggcagcgcaaaagatg

SEQ ID NO: 235783 - DNA, 103 bp, Artificial Sequence
  Synthetic Polynucleotide
taatacgactcactataggggtgtggattctcctgtgtttactcaggcctaacagaggagaaggcctatgtaaacacagaacctggcggcagcgcaaaagatg

SEQ ID NO: 235784 - DNA, 103 bp, Artificial Sequence
  Synthetic Polynucleotide
taatacgactcactatagggaaggcattccatcgtctcttcagcctccataacagaggagaatggagatggaagagacgaacctggcggcagcgcaaaagatg

SEQ ID NO: 235785 - DNA, 103 bp, Artificial Sequence
  Synthetic Polynucleotide
taatacgactcactataggggacaattagggtgatgtcagtaaaccggtcaacagaggagagaccggatgactgacatcaacctggcggcagcgcaaaagatg

SEQ ID NO: 235786 - DNA, 103 bp, Artificial Sequence
  Synthetic Polynucleotide
taatacgactcactataggggtgacatttcagagtgctatttctagcaaaaacagaggagatttgctatgaatagcactaacctggcggcagcgcaaaagatg

SEQ ID NO: 235787 - DNA, 103 bp, Artificial Sequence
  Synthetic Polynucleotide
taatacgactcactatagggatgcagtgaggtgacatttcagagtgctataacagaggagaatagcaatgtgaaatgtcaacctggcggcagcgcaaaagatg

SEQ ID NO: 235788 - DNA, 103 bp, Artificial Sequence
  Synthetic Polynucleotide
taatacgactcactatagggccagtttggcatgcagtgaggtgacatttcaacagaggagagaaatgatgcctcactgcaacctggcggcagcgcaaaagatg

SEQ ID NO: 235789 - DNA, 103 bp, Artificial Sequence
  Synthetic Polynucleotide
taatacgactcactatagggtgcccctactccagtttggcatgcagtgagaacagaggagactcactatgtgccaaactaacctggcggcagcgcaaaagatg

SEQ ID NO: 235790 - DNA, 103 bp, Artificial Sequence
  Synthetic Polynucleotide
taatacgactcactatagggttcctttttttgcccctactccagtttggcaacagaggagagccaaaatggagtaggggaacctggcggcagcgcaaaagatg

SEQ ID NO: 235791 - DNA, 103 bp, Artificial Sequence
  Synthetic Polynucleotide
taatacgactcactatagggagcttcttccttcctttttttgcccctactaacagaggagaagtaggatgaaaaaaaggaacctggcggcagcgcaaaagatg

SEQ ID NO: 235792 - DNA, 103 bp, Artificial Sequence
  Synthetic Polynucleotide
taatacgactcactataggggcattcgtagagcttcttccttccttttttaacagaggagaaaaaaaatgaggaagaagaacctggcggcagcgcaaaagatg

SEQ ID NO: 235793 - DNA, 103 bp, Artificial Sequence
  Synthetic Polynucleotide
taatacgactcactatagggtgcagacctggcattcgtagagcttcttccaacagaggagaggaagaatgtctacgaataacctggcggcagcgcaaaagatg

SEQ ID NO: 235794 - DNA, 103 bp, Artificial Sequence
  Synthetic Polynucleotide
taatacgactcactatagggaacacactgttgcagacctggcattcgtagaacagaggagactacgaatgccaggtctgaacctggcggcagcgcaaaagatg

SEQ ID NO: 235795 - DNA, 103 bp, Artificial Sequence
  Synthetic Polynucleotide
taatacgactcactatagggccagctgttaaacacactgttgcagacctgaacagaggagacaggtcatgaacagtgtgaacctggcggcagcgcaaaagatg

SEQ ID NO: 235796 - DNA, 103 bp, Artificial Sequence
  Synthetic Polynucleotide
taatacgactcactatagggggtgtccgtcgacaattagggtgatgtcagaacagaggagactgacaatgccctaattgaacctggcggcagcgcaaaagatg

SEQ ID NO: 235797 - DNA, 103 bp, Artificial Sequence
  Synthetic Polynucleotide
taatacgactcactatagggtgaactggtcccagctgttaaacacactgtaacagaggagaacagtgatgttaacagctaacctggcggcagcgcaaaagatg

SEQ ID NO: 235798 - DNA, 103 bp, Artificial Sequence
  Synthetic Polynucleotide
taatacgactcactatagggaagtgatctttgaactggtcccagctgttaaacagaggagataacagatgggaccagttaacctggcggcagcgcaaaagatg

SEQ ID NO: 235799 - DNA, 103 bp, Artificial Sequence
  Synthetic Polynucleotide
taatacgactcactataggggtgtattaccaagtgatctttgaactggtcaacagaggagagaccagatgaaagatcacaacctggcggcagcgcaaaagatg

SEQ ID NO: 235800 - DNA, 103 bp, Artificial Sequence
  Synthetic Polynucleotide
taatacgactcactatagggtatctccagtgtgtattaccaagtgatcttaacagaggagaaagatcatgtggtaatacaacctggcggcagcgcaaaagatg

SEQ ID NO: 235801 - DNA, 103 bp, Artificial Sequence
  Synthetic Polynucleotide
taatacgactcactatagggtggttgggtttatctccagtgtgtattaccaacagaggagaggtaatatgcactggagaaacctggcggcagcgcaaaagatg

SEQ ID NO: 235802 - DNA, 103 bp, Artificial Sequence
  Synthetic Polynucleotide
taatacgactcactatagggtaaagtacaatggttgggtttatctccagtaacagaggagaactggaatgaaacccaacaacctggcggcagcgcaaaagatg

SEQ ID NO: 235803 - DNA, 103 bp, Artificial Sequence
  Synthetic Polynucleotide
taatacgactcactatagggacaaatcacataaagtacaatggttgggttaacagaggagaaacccaatgattgtacttaacctggcggcagcgcaaaagatg

SEQ ID NO: 235804 - DNA, 103 bp, Artificial Sequence
  Synthetic Polynucleotide
taatacgactcactatagggtgcataaaccacaaatcacataaagtacaaaacagaggagattgtacatgatgtgatttaacctggcggcagcgcaaaagatg

SEQ ID NO: 235805 - DNA, 103 bp, Artificial Sequence
  Synthetic Polynucleotide
taatacgactcactatagggttcatttccttgcataaaccacaaatcacaaacagaggagatgtgatatgtggtttatgaacctggcggcagcgcaaaagatg

SEQ ID NO: 235806 - DNA, 103 bp, Artificial Sequence
  Synthetic Polynucleotide
taatacgactcactataggggcctccttaattcatttccttgcataaaccaacagaggagaggtttaatgaaggaaatgaacctggcggcagcgcaaaagatg

SEQ ID NO: 235807 - DNA, 103 bp, Artificial Sequence
  Synthetic Polynucleotide
taatacgactcactataggggccttaaaatggtgtccgtcgacaattaggaacagaggagacctaatatgcgacggacaaacctggcggcagcgcaaaagatg

SEQ ID NO: 235808 - DNA, 103 bp, Artificial Sequence
  Synthetic Polynucleotide
taatacgactcactatagggtcactgagatgcctccttaattcatttcctaacagaggagaaggaaaatgattaaggagaacctggcggcagcgcaaaagatg

SEQ ID NO: 235809 - DNA, 103 bp, Artificial Sequence
  Synthetic Polynucleotide
taatacgactcactatagggattgtgagcatcactgagatgcctccttaaaacagaggagattaaggatgcatctcagtaacctggcggcagcgcaaaagatg

SEQ ID NO: 235810 - DNA, 103 bp, Artificial Sequence
  Synthetic Polynucleotide
taatacgactcactataggggctctgaaatattgtgagcatcactgagataacagaggagaatctcaatgatgctcacaaacctggcggcagcgcaaaagatg

SEQ ID NO: 235811 - DNA, 103 bp, Artificial Sequence
  Synthetic Polynucleotide
taatacgactcactataggggttactagacgctctgaaatattgtgagcaaacagaggagatgctcaatgtatttcagaaacctggcggcagcgcaaaagatg

SEQ ID NO: 235812 - DNA, 103 bp, Artificial Sequence
  Synthetic Polynucleotide
taatacgactcactatagggaacttcttccgttactagacgctctgaaataacagaggagaatttcaatgcgtctagtaaacctggcggcagcgcaaaagatg

SEQ ID NO: 235813 - DNA, 103 bp, Artificial Sequence
  Synthetic Polynucleotide
taatacgactcactatagggctactgaaagaacttcttccgttactagacaacagaggagagtctagatgcggaagaagaacctggcggcagcgcaaaagatg

SEQ ID NO: 235814 - DNA, 103 bp, Artificial Sequence
  Synthetic Polynucleotide
taatacgactcactatagggacacgtgtttctactgaaagaacttcttccaacagaggagaggaagaatgtctttcagtaacctggcggcagcgcaaaagatg

SEQ ID NO: 235815 - DNA, 103 bp, Artificial Sequence
  Synthetic Polynucleotide
taatacgactcactatagggttcagtttgcacacgtgtttctactgaaagaacagaggagactttcaatggaaacacgtaacctggcggcagcgcaaaagatg

SEQ ID NO: 235816 - DNA, 103 bp, Artificial Sequence
  Synthetic Polynucleotide
taatacgactcactatagggatgttacaggttcagtttgcacacgtgtttaacagaggagaaaacacatgtgcaaactgaacctggcggcagcgcaaaagatg

SEQ ID NO: 235817 - DNA, 103 bp, Artificial Sequence
  Synthetic Polynucleotide
taatacgactcactatagggatagtcattgatgttacaggttcagtttgcaacagaggagagcaaacatgacctgtaacaacctggcggcagcgcaaaagatg

SEQ ID NO: 235818 - DNA, 103 bp, Artificial Sequence
  Synthetic Polynucleotide
taatacgactcactatagggagccttgtgagccttaaaatggtgtccgtcaacagaggagagacggaatgcattttaagaacctggcggcagcgcaaaagatg

SEQ ID NO: 235819 - DNA, 103 bp, Artificial Sequence
  Synthetic Polynucleotide
taatacgactcactatagggttgttctataatagtcattgatgttacaggaacagaggagacctgtaatgtcaatgactaacctggcggcagcgcaaaagatg

SEQ ID NO: 235820 - DNA, 103 bp, Artificial Sequence
  Synthetic Polynucleotide
taatacgactcactatagggccttcccaacttgttctataatagtcattgaacagaggagacaatgaatgttatagaacaacctggcggcagcgcaaaagatg

SEQ ID NO: 235821 - DNA, 103 bp, Artificial Sequence
  Synthetic Polynucleotide
taatacgactcactatagggagcacatgcaccttcccaacttgttctataaacagaggagatatagaatgagttgggaaaacctggcggcagcgcaaaagatg

SEQ ID NO: 235822 - DNA, 103 bp, Artificial Sequence
  Synthetic Polynucleotide
taatacgactcactatagggaagcaatggtagcacatgcaccttcccaacaacagaggagagttgggatggtgcatgtgaacctggcggcagcgcaaaagatg

SEQ ID NO: 235823 - DNA, 103 bp, Artificial Sequence
  Synthetic Polynucleotide
taatacgactcactatagggcctgaacctgaagcaatggtagcacatgcaaacagaggagatgcatgatgtaccattgcaacctggcggcagcgcaaaagatg

SEQ ID NO: 235824 - DNA, 103 bp, Artificial Sequence
  Synthetic Polynucleotide
taatacgactcactataggggctgaatccacctgaacctgaagcaatggtaacagaggagaaccattatgtcaggttcaaacctggcggcagcgcaaaagatg

SEQ ID NO: 235825 - DNA, 103 bp, Artificial Sequence
  Synthetic Polynucleotide
taatacgactcactatagggagtcacttgtgctgaatccacctgaacctgaacagaggagacaggttatggtggattcaaacctggcggcagcgcaaaagatg

SEQ ID NO: 235826 - DNA, 103 bp, Artificial Sequence
  Synthetic Polynucleotide
taatacgactcactatagggcttgttccacagtcacttgtgctgaatccaaacagaggagatggattatgcacaagtgaaacctggcggcagcgcaaaagatg

SEQ ID NO: 235827 - DNA, 103 bp, Artificial Sequence
  Synthetic Polynucleotide
taatacgactcactatagggtctggatggacttgttccacagtcacttgtaacagaggagaacaagtatgtgtggaacaaacctggcggcagcgcaaaagatg

SEQ ID NO: 235828 - DNA, 103 bp, Artificial Sequence
  Synthetic Polynucleotide
taatacgactcactatagggctggagcagatctggatggacttgttccacaacagaggagagtggaaatggtccatccaaacctggcggcagcgcaaaagatg

SEQ ID NO: 235829 - DNA, 103 bp, Artificial Sequence
  Synthetic Polynucleotide
taatacgactcactatagggcagccaaaacagccttgtgagccttaaaataacagaggagaattttaatgctcacaaggaacctggcggcagcgcaaaagatg

SEQ ID NO: 235830 - DNA, 103 bp, Artificial Sequence
  Synthetic Polynucleotide
taatacgactcactatagggcctggctgtcctggagcagatctggatggaaacagaggagatccatcatgatctgctccaacctggcggcagcgcaaaagatg

SEQ ID NO: 235831 - DNA, 103 bp, Artificial Sequence
  Synthetic Polynucleotide
taatacgactcactataggggaatcgtgcacctggctgtcctggagcagaaacagaggagatctgctatgggacagccaaacctggcggcagcgcaaaagatg

SEQ ID NO: 235832 - DNA, 103 bp, Artificial Sequence
  Synthetic Polynucleotide
taatacgactcactatagggactcatgtgtgaatcgtgcacctggctgtcaacagaggagagacagcatggtgcacgataacctggcggcagcgcaaaagatg

SEQ ID NO: 235833 - DNA, 103 bp, Artificial Sequence
  Synthetic Polynucleotide
taatacgactcactatagggctggaagctcactcatgtgtgaatcgtgcaaacagaggagatgcacgatgcacacatgaaacctggcggcagcgcaaaagatg

SEQ ID NO: 235834 - DNA, 103 bp, Artificial Sequence
  Synthetic Polynucleotide
taatacgactcactatagggtggacctgctctggaagctcactcatgtgtaacagaggagaacacatatgtgagcttccaacctggcggcagcgcaaaagatg

SEQ ID NO: 235835 - DNA, 103 bp, Artificial Sequence
  Synthetic Polynucleotide
taatacgactcactatagggataactcacttggacctgctctggaagctcaacagaggagagagcttatggagcaggtcaacctggcggcagcgcaaaagatg

SEQ ID NO: 235836 - DNA, 103 bp, Artificial Sequence
  Synthetic Polynucleotide
taatacgactcactatagggccacttctagataactcacttggacctgctaacagaggagaagcaggatgaagtgagttaacctggcggcagcgcaaaagatg

SEQ ID NO: 235837 - DNA, 103 bp, Artificial Sequence
  Synthetic Polynucleotide
taatacgactcactatagggtgaattcggcccacttctagataactcactaacagaggagaagtgagatgtctagaagtaacctggcggcagcgcaaaagatg

SEQ ID NO: 235838 - DNA, 103 bp, Artificial Sequence
  Synthetic Polynucleotide
taatacgactcactatagggttcttcagtctgaattcggcccacttctagaacagaggagactagaaatgggccgaattaacctggcggcagcgcaaaagatg

SEQ ID NO: 235839 - DNA, 103 bp, Artificial Sequence
  Synthetic Polynucleotide
taatacgactcactatagggcttcagtaccttcttcagtctgaattcggcaacagaggagagccgaaatgagactgaagaacctggcggcagcgcaaaagatg

SEQ ID NO: 235840 - DNA, 103 bp, Artificial Sequence
  Synthetic Polynucleotide
taatacgactcactatagggttactacaagcagccaaaacagccttgtgaaacagaggagatcacaaatgtgttttggcaacctggcggcagcgcaaaagatg

SEQ ID NO: 235841 - DNA, 103 bp, Artificial Sequence
  Synthetic Polynucleotide
taatacgactcactatagggtctacatgtacttcagtaccttcttcagtcaacagaggagagactgaatgaggtactgaaacctggcggcagcgcaaaagatg

SEQ ID NO: 235842 - DNA, 103 bp, Artificial Sequence
  Synthetic Polynucleotide
taatacgactcactatagggatgcagctcctctacatgtacttcagtaccaacagaggagaggtactatggtacatgtaaacctggcggcagcgcaaaagatg

SEQ ID NO: 235843 - DNA, 103 bp, Artificial Sequence
  Synthetic Polynucleotide
taatacgactcactatagggcccgttcaacatgcagctcctctacatgtaaacagaggagatacatgatgaggagctgcaacctggcggcagcgcaaaagatg

SEQ ID NO: 235844 - DNA, 103 bp, Artificial Sequence
  Synthetic Polynucleotide
taatacgactcactatagggatttgattgacccgttcaacatgcagctccaacagaggagaggagctatgtgttgaacgaacctggcggcagcgcaaaagatg

SEQ ID NO: 235845 - DNA, 103 bp, Artificial Sequence
  Synthetic Polynucleotide
taatacgactcactatagggttccactggcatttgattgacccgttcaacaacagaggagagttgaaatggtcaatcaaaacctggcggcagcgcaaaagatg

SEQ ID NO: 235846 - DNA, 103 bp, Artificial Sequence
  Synthetic Polynucleotide
taatacgactcactatagggcagtttgtacttccactggcatttgattgaaacagaggagatcaatcatgtgccagtggaacctggcggcagcgcaaaagatg

SEQ ID NO: 235847 - DNA, 103 bp, Artificial Sequence
  Synthetic Polynucleotide
taatacgactcactatagggtctagaagttcagtttgtacttccactggcaacagaggagagccagtatgagtacaaacaacctggcggcagcgcaaaagatg

SEQ ID NO: 235848 - DNA, 103 bp, Artificial Sequence
  Synthetic Polynucleotide
taatacgactcactatagggcaaatctgcttctagaagttcagtttgtacaacagaggagagtacaaatggaacttctaaacctggcggcagcgcaaaagatg

SEQ ID NO: 235849 - DNA, 103 bp, Artificial Sequence
  Synthetic Polynucleotide
taatacgactcactatagggtcacgtggtccaaatctgcttctagaagttaacagaggagaaacttcatgaagcagattaacctggcggcagcgcaaaagatg

SEQ ID NO: 235850 - DNA, 103 bp, Artificial Sequence
  Synthetic Polynucleotide
taatacgactcactatagggatttctggggtcacgtggtccaaatctgctaacagaggagaagcagaatgggaccacgtaacctggcggcagcgcaaaagatg

SEQ ID NO: 235851 - DNA, 103 bp, Artificial Sequence
  Synthetic Polynucleotide
taatacgactcactataggggtagaagaacttactacaagcagccaaaacaacagaggagagttttgatggcttgtagtaacctggcggcagcgcaaaagatg

SEQ ID NO: 235852 - DNA, 103 bp, Artificial Sequence
  Synthetic Polynucleotide
taatacgactcactatagggttggttcatgatttctggggtcacgtggtcaacagaggagagaccacatgaccccagaaaacctggcggcagcgcaaaagatg

SEQ ID NO: 235853 - DNA, 103 bp, Artificial Sequence
  Synthetic Polynucleotide
taatacgactcactatagggctctctcctcttggttcatgatttctggggaacagaggagaccccagatgtcatgaaccaacctggcggcagcgcaaaagatg

SEQ ID NO: 235854 - DNA, 103 bp, Artificial Sequence
  Synthetic Polynucleotide
taatacgactcactatagggtggctagactctctctcctcttggttcatgaacagaggagacatgaaatgagaggagagaacctggcggcagcgcaaaagatg

SEQ ID NO: 235855 - DNA, 103 bp, Artificial Sequence
  Synthetic Polynucleotide
taatacgactcactatagggagcatctgcttggctagactctctctcctcaacagaggagagaggagatggagtctagcaacctggcggcagcgcaaaagatg

SEQ ID NO: 235856 - DNA, 103 bp, Artificial Sequence
  Synthetic Polynucleotide
taatacgactcactatagggcagcctcagcagcatctgcttggctagactaacagaggagaagtctaatgaagcagatgaacctggcggcagcgcaaaagatg

SEQ ID NO: 235857 - DNA, 103 bp, Artificial Sequence
  Synthetic Polynucleotide
taatacgactcactatagggtcttccctggcagcctcagcagcatctgctaacagaggagaagcagaatgtgctgaggcaacctggcggcagcgcaaaagatg

SEQ ID NO: 235858 - DNA, 103 bp, Artificial Sequence
  Synthetic Polynucleotide
taatacgactcactatagggatcttcgtgatcttccctggcagcctcagcaacagaggagagctgagatggccagggaaaacctggcggcagcgcaaaagatg

SEQ ID NO: 235859 - DNA, 103 bp, Artificial Sequence
  Synthetic Polynucleotide
taatacgactcactatagggaatcctcagcatcttcgtgatcttccctggaacagaggagaccagggatgatcacgaagaacctggcggcagcgcaaaagatg

SEQ ID NO: 235860 - DNA, 103 bp, Artificial Sequence
  Synthetic Polynucleotide
taatacgactcactatagggttggtctctaaatcctcagcatcttcgtgaaacagaggagatcacgaatgtgctgaggaaacctggcggcagcgcaaaagatg

SEQ ID NO: 235861 - DNA, 103 bp, Artificial Sequence
  Synthetic Polynucleotide
taatacgactcactatagggcactgttggcttggtctctaaatcctcagcaacagaggagagctgagatgttagagaccaacctggcggcagcgcaaaagatg

SEQ ID NO: 235862 - DNA, 103 bp, Artificial Sequence
  Synthetic Polynucleotide
taatacgactcactataggggaaagaatttgtagaagaacttactacaagaacagaggagacttgtaatgagttcttctaacctggcggcagcgcaaaagatg

SEQ ID NO: 235863 - DNA, 103 bp, Artificial Sequence
  Synthetic Polynucleotide
taatacgactcactatagggcttcagaatccactgttggcttggtctctaaacagaggagatagagaatgagccaacagaacctggcggcagcgcaaaagatg

SEQ ID NO: 235864 - DNA, 103 bp, Artificial Sequence
  Synthetic Polynucleotide
taatacgactcactataggggccttttctgcttcagaatccactgttggcaacagaggagagccaacatgggattctgaaacctggcggcagcgcaaaagatg

SEQ ID NO: 235865 - DNA, 103 bp, Artificial Sequence
  Synthetic Polynucleotide
taatacgactcactatagggctcattctctgccttttctgcttcagaatcaacagaggagagattctatggcagaaaagaacctggcggcagcgcaaaagatg

SEQ ID NO: 235866 - DNA, 103 bp, Artificial Sequence
  Synthetic Polynucleotide
taatacgactcactatagggctgttctgtcctcattctctgccttttctgaacagaggagacagaaaatgcagagaatgaacctggcggcagcgcaaaagatg

SEQ ID NO: 235867 - DNA, 103 bp, Artificial Sequence
  Synthetic Polynucleotide
taatacgactcactatagggactggcagagctgttctgtcctcattctctaacagaggagaagagaaatgggacagaacaacctggcggcagcgcaaaagatg

SEQ ID NO: 235868 - DNA, 103 bp, Artificial Sequence
  Synthetic Polynucleotide
taatacgactcactatagggtcattctaaaactggcagagctgttctgtcaacagaggagagacagaatggctctgccaaacctggcggcagcgcaaaagatg

SEQ ID NO: 235869 - DNA, 103 bp, Artificial Sequence
  Synthetic Polynucleotide
taatacgactcactataggggtaaactcctgaaagaatttgtagaagaacaacagaggagagttcttatgcaaattcttaacctggcggcagcgcaaaagatg

SEQ ID NO: 235870 - DNA, 103 bp, Artificial Sequence
  Synthetic Polynucleotide
taatacgactcactatagggtggttcttgggtaaactcctgaaagaatttaacagaggagaaaattcatgcaggagtttaacctggcggcagcgcaaaagatg

SEQ ID NO: 235871 - DNA, 103 bp, Artificial Sequence
  Synthetic Polynucleotide
taatacgactcactatagggggaactcctgaaggcattccatcgtctcttaacagaggagaaagagaatgtggaatgccaacctggcggcagcgcaaaagatg

SEQ ID NO: 235872 - DNA, 103 bp, Artificial Sequence
  Synthetic Polynucleotide
taatacgactcactatagggtctccaccaatggttcttgggtaaactcctaacagaggagaaggagtatgcccaagaacaacctggcggcagcgcaaaagatg

SEQ ID NO: 235873 - DNA, 103 bp, Artificial Sequence
  Synthetic Polynucleotide
taatacgactcactatagggacaccttctatctccaccaatggttcttggaacagaggagaccaagaatgattggtggaaacctggcggcagcgcaaaagatg

SEQ ID NO: 235874 - DNA, 103 bp, Artificial Sequence
  Synthetic Polynucleotide
taatacgactcactatagggcattttactaacaccttctatctccaccaaaacagaggagattggtgatgatagaaggtaacctggcggcagcgcaaaagatg

SEQ ID NO: 235875 - DNA, 103 bp, Artificial Sequence
  Synthetic Polynucleotide
taatacgactcactatagggggcgaaaggccattttactaacaccttctaaacagaggagatagaagatgttagtaaaaaacctggcggcagcgcaaaagatg

SEQ ID NO: 235876 - DNA, 103 bp, Artificial Sequence
  Synthetic Polynucleotide
taatacgactcactatagggtcaattaaatggcgaaaggccattttactaaacagaggagatagtaaatgggcctttcgaacctggcggcagcgcaaaagatg

SEQ ID NO: 235877 - DNA, 103 bp, Artificial Sequence
  Synthetic Polynucleotide
taatacgactcactatagggatatgtgaactcaattaaatggcgaaaggcaacagaggagagcctttatgcatttaattaacctggcggcagcgcaaaagatg

SEQ ID NO: 235878 - DNA, 103 bp, Artificial Sequence
  Synthetic Polynucleotide
taatacgactcactatagggattttgctgtatatgtgaactcaattaaataacagaggagaatttaaatgagttcacataacctggcggcagcgcaaaagatg

SEQ ID NO: 235879 - DNA, 103 bp, Artificial Sequence
  Synthetic Polynucleotide
taatacgactcactatagggtgtatcattaattttgctgtatatgtgaacaacagaggagagttcacatgtacagcaaaaacctggcggcagcgcaaaagatg

SEQ ID NO: 235880 - DNA, 103 bp, Artificial Sequence
  Synthetic Polynucleotide
taatacgactcactatagggttcttctccttgtatcattaattttgctgtaacagaggagaacagcaatgttaatgataaacctggcggcagcgcaaaagatg

SEQ ID NO: 235881 - DNA, 103 bp, Artificial Sequence
  Synthetic Polynucleotide
taatacgactcactatagggcattggcttcttcttctccttgtatcattaaacagaggagataatgaatgaaggagaagaacctggcggcagcgcaaaagatg

SEQ ID NO: 235882 - DNA, 103 bp, Artificial Sequence
  Synthetic Polynucleotide
taatacgactcactatagggtgatgttcagggaactcctgaaggcattccaacagaggagaggaatgatgtcaggagttaacctggcggcagcgcaaaagatg

SEQ ID NO: 235883 - DNA, 103 bp, Artificial Sequence
  Synthetic Polynucleotide
taatacgactcactatagggttccatacatcattggcttcttcttctcctaacagaggagaaggagaatgagaagccaaaacctggcggcagcgcaaaagatg

SEQ ID NO: 235884 - DNA, 103 bp, Artificial Sequence
  Synthetic Polynucleotide
taatacgactcactatagggctctgctgctttccatacatcattggcttcaacagaggagagaagccatggatgtatggaacctggcggcagcgcaaaagatg

SEQ ID NO: 235885 - DNA, 103 bp, Artificial Sequence
  Synthetic Polynucleotide
taatacgactcactatagggtttgtagaaactctgctgctttccatacataacagaggagaatgtatatgaagcagcagaacctggcggcagcgcaaaagatg

SEQ ID NO: 235886 - DNA, 103 bp, Artificial Sequence
  Synthetic Polynucleotide
taatacgactcactataggggcttctagcatttgtagaaactctgctgctaacagaggagaagcagcatggtttctacaaacctggcggcagcgcaaaagatg

SEQ ID NO: 235887 - DNA, 103 bp, Artificial Sequence
  Synthetic Polynucleotide
taatacgactcactatagggggctttgatagcttctagcatttgtagaaaaacagaggagatttctaatgatgctagaaaacctggcggcagcgcaaaagatg

SEQ ID NO: 235888 - DNA, 103 bp, Artificial Sequence
  Synthetic Polynucleotide
taatacgactcactatagggtgacttcaagggctttgatagcttctagcaaacagaggagatgctagatgctatcaaagaacctggcggcagcgcaaaagatg

SEQ ID NO: 235889 - DNA, 103 bp, Artificial Sequence
  Synthetic Polynucleotide
taatacgactcactatagggtctttgttcctgacttcaagggctttgataaacagaggagatatcaaatgccttgaagtaacctggcggcagcgcaaaagatg

SEQ ID NO: 235890 - DNA, 103 bp, Artificial Sequence
  Synthetic Polynucleotide
taatacgactcactatagggagctgagttttctttgttcctgacttcaagaacagaggagacttgaaatgaggaacaaaaacctggcggcagcgcaaaagatg

SEQ ID NO: 235891 - DNA, 103 bp, Artificial Sequence
  Synthetic Polynucleotide
taatacgactcactatagggcctctaagggagctgagttttctttgttccaacagaggagaggaacaatgaaaactcagaacctggcggcagcgcaaaagatg

SEQ ID NO: 235892 - DNA, 103 bp, Artificial Sequence
  Synthetic Polynucleotide
taatacgactcactataggggtggtattttcctctaagggagctgagtttaacagaggagaaaactcatgtcccttagaaacctggcggcagcgcaaaagatg

SEQ ID NO: 235893 - DNA, 103 bp, Artificial Sequence
  Synthetic Polynucleotide
taatacgactcactataggggatcattttatgatgttcagggaactcctgaacagaggagacaggagatgcctgaacataacctggcggcagcgcaaaagatg

SEQ ID NO: 235894 - DNA, 103 bp, Artificial Sequence
  Synthetic Polynucleotide
taatacgactcactatagggattttttcctgtggtattttcctctaagggaacagaggagacccttaatggaaaataccaacctggcggcagcgcaaaagatg

SEQ ID NO: 235895 - DNA, 103 bp, Artificial Sequence
  Synthetic Polynucleotide
taatacgactcactatagggttttggcctcattttttcctgtggtattttaacagaggagaaaaataatgcaggaaaaaaacctggcggcagcgcaaaagatg

SEQ ID NO: 235896 - DNA, 103 bp, Artificial Sequence
  Synthetic Polynucleotide
taatacgactcactatagggatcttcctttttttggcctcattttttcctaacagaggagaaggaaaatgtgaggccaaaacctggcggcagcgcaaaagatg

SEQ ID NO: 235897 - DNA, 103 bp, Artificial Sequence
  Synthetic Polynucleotide
taatacgactcactatagggagtttctgcaatcttcctttttttggcctcaacagaggagagaggccatgaaaaggaagaacctggcggcagcgcaaaagatg

SEQ ID NO: 235898 - DNA, 103 bp, Artificial Sequence
  Synthetic Polynucleotide
taatacgactcactatagggtaacatttgaagtttctgcaatcttcctttaacagaggagaaaaggaatgttgcagaaaaacctggcggcagcgcaaaagatg

SEQ ID NO: 235899 - DNA, 103 bp, Artificial Sequence
  Synthetic Polynucleotide
taatacgactcactataggggactcagtgataacatttgaagtttctgcaaacagaggagatgcagaatgttcaaatgtaacctggcggcagcgcaaaagatg

SEQ ID NO: 235900 - DNA, 103 bp, Artificial Sequence
  Synthetic Polynucleotide
taatacgactcactatagggagatggcaatgactcagtgataacatttgaaacagaggagatcaaatatgatcactgagaacctggcggcagcgcaaaagatg

SEQ ID NO: 235901 - DNA, 103 bp, Artificial Sequence
  Synthetic Polynucleotide
taatacgactcactatagggctgattctgcagatggcaatgactcagtgaaacagaggagatcactgatgcattgccataacctggcggcagcgcaaaagatg

SEQ ID NO: 235902 - DNA, 103 bp, Artificial Sequence
  Synthetic Polynucleotide
taatacgactcactatagggtcaacaggttctgattctgcagatggcaataacagaggagaattgccatgtgcagaatcaacctggcggcagcgcaaaagatg

SEQ ID NO: 235903 - DNA, 103 bp, Artificial Sequence
  Synthetic Polynucleotide
taatacgactcactatagggtacctcaatttcaacaggttctgattctgcaacagaggagagcagaaatggaacctgttaacctggcggcagcgcaaaagatg

SEQ ID NO: 235904 - DNA, 103 bp, Artificial Sequence
  Synthetic Polynucleotide
taatacgactcactatagggatcggtcgaggatcattttatgatgttcagaacagaggagactgaacatgataaaatgaaacctggcggcagcgcaaaagatg

SEQ ID NO: 235905 - DNA, 103 bp, Artificial Sequence
  Synthetic Polynucleotide
taatacgactcactatagggcggcaatctctacctcaatttcaacaggttaacagaggagaaacctgatgaaattgaggaacctggcggcagcgcaaaagatg

SEQ ID NO: 235906 - DNA, 103 bp, Artificial Sequence
  Synthetic Polynucleotide
taatacgactcactatagggatggtgccttcggcaatctctacctcaattaacagaggagaaattgaatgagagattgcaacctggcggcagcgcaaaagatg

SEQ ID NO: 235907 - DNA, 103 bp, Artificial Sequence
  Synthetic Polynucleotide
taatacgactcactatagggttccacttcaatggtgccttcggcaatctcaacagaggagagagattatggaaggcaccaacctggcggcagcgcaaaagatg

SEQ ID NO: 235908 - DNA, 103 bp, Artificial Sequence
  Synthetic Polynucleotide
taatacgactcactatagggtgccttcatcttccacttcaatggtgccttaacagaggagaaaggcaatgttgaagtggaacctggcggcagcgcaaaagatg

SEQ ID NO: 235909 - DNA, 103 bp, Artificial Sequence
  Synthetic Polynucleotide
taatacgactcactatagggaatgtttcgatgccttcatcttccacttcaaacagaggagatgaagtatgagatgaaggaacctggcggcagcgcaaaagatg

SEQ ID NO: 235910 - DNA, 103 bp, Artificial Sequence
  Synthetic Polynucleotide
taatacgactcactatagggcacttcctctaatgtttcgatgccttcatcaacagaggagagatgaaatgatcgaaacaaacctggcggcagcgcaaaagatg

SEQ ID NO: 235911 - DNA, 103 bp, Artificial Sequence
  Synthetic Polynucleotide
taatacgactcactatagggtggcagaagccacttcctctaatgtttcgaaacagaggagatcgaaaatgtagaggaagaacctggcggcagcgcaaaagatg

SEQ ID NO: 235912 - DNA, 103 bp, Artificial Sequence
  Synthetic Polynucleotide
taatacgactcactatagggacggactgcttggcagaagccacttcctctaacagaggagaagaggaatgggcttctgcaacctggcggcagcgcaaaagatg

SEQ ID NO: 235913 - DNA, 103 bp, Artificial Sequence
  Synthetic Polynucleotide
taatacgactcactatagggtatgtactttacggactgcttggcagaagcaacagaggagagcttctatgaagcagtccaacctggcggcagcgcaaaagatg

SEQ ID NO: 235914 - DNA, 103 bp, Artificial Sequence
  Synthetic Polynucleotide
taatacgactcactatagggctgtgctctgtatgtactttacggactgctaacagaggagaagcagtatgtaaagtacaaacctggcggcagcgcaaaagatg

SEQ ID NO: 235915 - DNA, 103 bp, Artificial Sequence
  Synthetic Polynucleotide
taatacgactcactatagggtgttcattcaatcggtcgaggatcattttaaacagaggagataaaatatgcctcgaccgaacctggcggcagcgcaaaagatg

SEQ ID NO: 235916 - DNA, 103 bp, Artificial Sequence
  Synthetic Polynucleotide
taatacgactcactatagggtcagaggaacctgtgctctgtatgtactttaacagaggagaaaagtaatgacagagcacaacctggcggcagcgcaaaagatg

SEQ ID NO: 235917 - DNA, 103 bp, Artificial Sequence
  Synthetic Polynucleotide
taatacgactcactatagggagcagaatcatcagaggaacctgtgctctgaacagaggagacagagcatgggttcctctaacctggcggcagcgcaaaagatg

SEQ ID NO: 235918 - DNA, 103 bp, Artificial Sequence
  Synthetic Polynucleotide
taatacgactcactatagggacagtgctagagcagaatcatcagaggaacaacagaggagagttcctatgatgattctgaacctggcggcagcgcaaaagatg

SEQ ID NO: 235919 - DNA, 103 bp, Artificial Sequence
  Synthetic Polynucleotide
taatacgactcactatagggatatctgccaacagtgctagagcagaatcaaacagaggagatgattcatgtctagcactaacctggcggcagcgcaaaagatg

SEQ ID NO: 235920 - DNA, 103 bp, Artificial Sequence
  Synthetic Polynucleotide
taatacgactcactatagggcttgctggtaatatctgccaacagtgctagaacagaggagactagcaatgttggcagataacctggcggcagcgcaaaagatg

SEQ ID NO: 235921 - DNA, 103 bp, Artificial Sequence
  Synthetic Polynucleotide
taatacgactcactatagggcttgacggtacttgctggtaatatctgccaaacagaggagatggcagatgttaccagcaaacctggcggcagcgcaaaagatg

SEQ ID NO: 235922 - DNA, 103 bp, Artificial Sequence
  Synthetic Polynucleotide
taatacgactcactatagggtttctgtcaccttgacggtacttgctggtaaacagaggagataccagatggtaccgtcaaacctggcggcagcgcaaaagatg

SEQ ID NO: 235923 - DNA, 103 bp, Artificial Sequence
  Synthetic Polynucleotide
taatacgactcactatagggaatctgcccttttctgtcaccttgacggtaaacagaggagataccgtatgggtgacagaaacctggcggcagcgcaaaagatg

SEQ ID NO: 235924 - DNA, 103 bp, Artificial Sequence
  Synthetic Polynucleotide
taatacgactcactatagggcatcttctttaatctgcccttttctgtcacaacagaggagagtgacaatgaagggcagaaacctggcggcagcgcaaaagatg

SEQ ID NO: 235925 - DNA, 103 bp, Artificial Sequence
  Synthetic Polynucleotide
taatacgactcactataggggatggacagccatcttctttaatctgccctaacagaggagaagggcaatgtaaagaagaaacctggcggcagcgcaaaagatg

SEQ ID NO: 235926 - DNA, 103 bp, Artificial Sequence
  Synthetic Polynucleotide
taatacgactcactatagggctgctctcgctgttcattcaatcggtcgagaacagaggagactcgacatgttgaatgaaaacctggcggcagcgcaaaagatg

SEQ ID NO: 235927 - DNA, 103 bp, Artificial Sequence
  Synthetic Polynucleotide
taatacgactcactatagggcgtggggtcagatggacagccatcttctttaacagaggagaaaagaaatgggctgtccaaacctggcggcagcgcaaaagatg

SEQ ID NO: 235928 - DNA, 103 bp, Artificial Sequence
  Synthetic Polynucleotide
taatacgactcactatagggcctgtttgctcgtggggtcagatggacagcaacagaggagagctgtcatgctgaccccaaacctggcggcagcgcaaaagatg

SEQ ID NO: 235929 - DNA, 103 bp, Artificial Sequence
  Synthetic Polynucleotide
taatacgactcactatagggttcatgtgctcctgtttgctcgtggggtcaaacagaggagatgacccatggagcaaacaaacctggcggcagcgcaaaagatg

SEQ ID NO: 235930 - DNA, 103 bp, Artificial Sequence
  Synthetic Polynucleotide
taatacgactcactatagggggagtgtgatttcatgtgctcctgtttgctaacagaggagaagcaaaatggagcacatgaacctggcggcagcgcaaaagatg

SEQ ID NO: 235931 - DNA, 103 bp, Artificial Sequence
  Synthetic Polynucleotide
taatacgactcactatagggaactctcagtggagtgtgatttcatgtgctaacagaggagaagcacaatgaatcacactaacctggcggcagcgcaaaagatg

SEQ ID NO: 235932 - DNA, 103 bp, Artificial Sequence
  Synthetic Polynucleotide
taatacgactcactatagggtcacacttgaaactctcagtggagtgtgataacagaggagaatcacaatgcactgagagaacctggcggcagcgcaaaagatg

SEQ ID NO: 235933 - DNA, 103 bp, Artificial Sequence
  Synthetic Polynucleotide
taatacgactcactatagggattgcatatttcacacttgaaactctcagtaacagaggagaactgagatgttcaagtgtaacctggcggcagcgcaaaagatg

SEQ ID NO: 235934 - DNA, 103 bp, Artificial Sequence
  Synthetic Polynucleotide
taatacgactcactataggggatatcgtttattgcatatttcacacttgaaacagaggagatcaagtatgaaatatgcaaacctggcggcagcgcaaaagatg

SEQ ID NO: 235935 - DNA, 103 bp, Artificial Sequence
  Synthetic Polynucleotide
taatacgactcactatagggctctctcgaagatatcgtttattgcatattaacagaggagaaatatgatgtaaacgataaacctggcggcagcgcaaaagatg

SEQ ID NO: 235936 - DNA, 103 bp, Artificial Sequence
  Synthetic Polynucleotide
taatacgactcactatagggtttccatgcgctctctcgaagatatcgtttaacagaggagaaaacgaatgcttcgagagaacctggcggcagcgcaaaagatg

SEQ ID NO: 235937 - DNA, 103 bp, Artificial Sequence
  Synthetic Polynucleotide
taatacgactcactatagggtaaaccggtcctgctctcgctgttcattcaaacagaggagatgaatgatgagcgagagcaacctggcggcagcgcaaaagatg

SEQ ID NO: 235938 - DNA, 103 bp, Artificial Sequence
  Synthetic Polynucleotide
taatacgactcactatagggttaggtgctgtttccatgcgctctctcgaaaacagaggagattcgagatggcgcatggaaacctggcggcagcgcaaaagatg

SEQ ID NO: 235939 - DNA, 103 bp, Artificial Sequence
  Synthetic Polynucleotide
taatacgactcactatagggtggtaacaatttaggtgctgtttccatgcgaacagaggagacgcatgatgacagcacctaacctggcggcagcgcaaaagatg

SEQ ID NO: 235940 - DNA, 103 bp, Artificial Sequence
  Synthetic Polynucleotide
taatacgactcactatagggttcttcaaggtggtaacaatttaggtgctgaacagaggagacagcacatgaattgttacaacctggcggcagcgcaaaagatg

SEQ ID NO: 235941 - DNA, 103 bp, Artificial Sequence
  Synthetic Polynucleotide
taatacgactcactatagggtgactccaccttcttcaaggtggtaacaataacagaggagaattgttatgaccttgaagaacctggcggcagcgcaaaagatg

SEQ ID NO: 235942 - DNA, 103 bp, Artificial Sequence
  Synthetic Polynucleotide
taatacgactcactatagggtgcttcttactgactccaccttcttcaaggaacagaggagaccttgaatgaggtggagtaacctggcggcagcgcaaaagatg

SEQ ID NO: 235943 - DNA, 103 bp, Artificial Sequence
  Synthetic Polynucleotide
taatacgactcactatagggcccagttctttgcttcttactgactccaccaacagaggagaggtggaatgagtaagaagaacctggcggcagcgcaaaagatg

SEQ ID NO: 235944 - DNA, 103 bp, Artificial Sequence
  Synthetic Polynucleotide
taatacgactcactataggggaatttttttcccagttctttgcttcttacaacagaggagagtaagaatgaaagaactgaacctggcggcagcgcaaaagatg

SEQ ID NO: 235945 - DNA, 103 bp, Artificial Sequence
  Synthetic Polynucleotide
taatacgactcactatagggtgacatacatgaatttttttcccagttcttaacagaggagaaagaacatggaaaaaaataacctggcggcagcgcaaaagatg

SEQ ID NO: 235946 - DNA, 103 bp, Artificial Sequence
  Synthetic Polynucleotide
taatacgactcactatagggctcacagtactgacatacatgaatttttttaacagaggagaaaaaaaatgcatgtatgtaacctggcggcagcgcaaaagatg

SEQ ID NO: 235947 - DNA, 103 bp, Artificial Sequence
  Synthetic Polynucleotide
taatacgactcactatagggcaaactgtttctcacagtactgacatacataacagaggagaatgtatatgagtactgtgaacctggcggcagcgcaaaagatg

SEQ ID NO: 235948 - DNA, 103 bp, Artificial Sequence
  Synthetic Polynucleotide
taatacgactcactataggggtgatgtcagtaaaccggtcctgctctcgcaacagaggagagcgagaatgggaccggttaacctggcggcagcgcaaaagatg

SEQ ID NO: 235949 - DNA, 103 bp, Artificial Sequence
  Synthetic Polynucleotide
taatacgactcactatagggccaaaatggtcaaactgtttctcacagtacaacagaggagagtactgatggaaacagttaacctggcggcagcgcaaaagatg

SEQ ID NO: 235950 - DNA, 103 bp, Artificial Sequence
  Synthetic Polynucleotide
taatacgactcactatagggtttaaaatgtccaaaatggtcaaactgtttaacagaggagaaaacagatggaccattttaacctggcggcagcgcaaaagatg

SEQ ID NO: 235951 - DNA, 103 bp, Artificial Sequence
  Synthetic Polynucleotide
taatacgactcactataggggaagatgttctttaaaatgtccaaaatggtaacagaggagaaccattatggacattttaaacctggcggcagcgcaaaagatg

SEQ ID NO: 235952 - DNA, 103 bp, Artificial Sequence
  Synthetic Polynucleotide
taatacgactcactataggggtatgttttcgaagatgttctttaaaatgtaacagaggagaacatttatgagaacatctaacctggcggcagcgcaaaagatg

SEQ ID NO: 235953 - DNA, 103 bp, Artificial Sequence
  Synthetic Polynucleotide
taatacgactcactatagggtttttcacctgtatgttttcgaagatgttcaacagaggagagaacatatgcgaaaacataacctggcggcagcgcaaaagatg

SEQ ID NO: 235954 - DNA, 103 bp, Artificial Sequence
  Synthetic Polynucleotide
taatacgactcactatagggattcaaaaggtttttcacctgtatgttttcaacagaggagagaaaacatgcaggtgaaaaacctggcggcagcgcaaaagatg

SEQ ID NO: 235955 - DNA, 103 bp, Artificial Sequence
  Synthetic Polynucleotide
taatacgactcactatagggcaatttggacattcaaaaggtttttcacctaacagaggagaaggtgaatgaccttttgaaacctggcggcagcgcaaaagatg

SEQ ID NO: 235956 - DNA, 103 bp, Artificial Sequence
  Synthetic Polynucleotide
taatacgactcactatagggtcgttcatgacaatttggacattcaaaaggaacagaggagaccttttatgtgtccaaataacctggcggcagcgcaaaagatg

SEQ ID NO: 235957 - DNA, 103 bp, Artificial Sequence
  Synthetic Polynucleotide
taatacgactcactatagggttctagcaaatcgttcatgacaatttggacaacagaggagagtccaaatggtcatgaacaacctggcggcagcgcaaaagatg

SEQ ID NO: 235958 - DNA, 103 bp, Artificial Sequence
  Synthetic Polynucleotide
taatacgactcactatagggagagtgctatttctagcaaatcgttcatgaaacagaggagatcatgaatgatttgctagaacctggcggcagcgcaaaagatg

SEQ ID NO: 235959 - DNA, 103 bp, Artificial Sequence
  Synthetic Polynucleotide
taatacgactcactatagggagaatctcgatttatttgggctaacaacataacagaggagaatgttgatggcccaaataaacctggcggcagcgcaaaagatg

SEQ ID NO: 235960 - DNA, 103 bp, Artificial Sequence
  Synthetic Polynucleotide
taatacgactcactatagggttttgcatctgccacggtgactgcctctgtaacagaggagaacagagatggtcaccgtgaacctggcggcagcgcaaaagatg

SEQ ID NO: 235961 - DNA, 103 bp, Artificial Sequence
  Synthetic Polynucleotide
taatacgactcactatagggtgcactggcaaatgccctcccacatcctggaacagaggagaccaggaatggggagggcaaacctggcggcagcgcaaaagatg

SEQ ID NO: 235962 - DNA, 103 bp, Artificial Sequence
  Synthetic Polynucleotide
taatacgactcactatagggtataatttgttgcactggcaaatgccctccaacagaggagaggagggatgttgccagtgaacctggcggcagcgcaaaagatg

SEQ ID NO: 235963 - DNA, 103 bp, Artificial Sequence
  Synthetic Polynucleotide
taatacgactcactatagggacatggtttttataatttgttgcactggcaaacagaggagatgccagatgaacaaattaaacctggcggcagcgcaaaagatg

SEQ ID NO: 235964 - DNA, 103 bp, Artificial Sequence
  Synthetic Polynucleotide
taatacgactcactataggggtgtatcctcacatggtttttataatttgtaacagaggagaacaaatatgaaaaaccataacctggcggcagcgcaaaagatg

SEQ ID NO: 235965 - DNA, 103 bp, Artificial Sequence
  Synthetic Polynucleotide
taatacgactcactatagggtttctcctgtgtgtatcctcacatggttttaacagaggagaaaaaccatgtgaggatacaacctggcggcagcgcaaaagatg

SEQ ID NO: 235966 - DNA, 103 bp, Artificial Sequence
  Synthetic Polynucleotide
taatacgactcactatagggacatatggcttttctcctgtgtgtatcctcaacagaggagagaggatatgcacaggagaaacctggcggcagcgcaaaagatg

SEQ ID NO: 235967 - DNA, 103 bp, Artificial Sequence
  Synthetic Polynucleotide
taatacgactcactatagggaactgtacaaacatatggcttttctcctgtaacagaggagaacaggaatgaagccatataacctggcggcagcgcaaaagatg

SEQ ID NO: 235968 - DNA, 103 bp, Artificial Sequence
  Synthetic Polynucleotide
taatacgactcactatagggcacacccaggaactgtacaaacatatggctaacagaggagaagccatatgtttgtacagaacctggcggcagcgcaaaagatg

SEQ ID NO: 235969 - DNA, 103 bp, Artificial Sequence
  Synthetic Polynucleotide
taatacgactcactatagggaaccttttgtcacacccaggaactgtacaaaacagaggagattgtacatgtcctgggtgaacctggcggcagcgcaaaagatg

SEQ ID NO: 235970 - DNA, 103 bp, Artificial Sequence
  Synthetic Polynucleotide
taatacgactcactatagggatattctgtaaaccttttgtcacacccaggaacagaggagacctgggatggacaaaaggaacctggcggcagcgcaaaagatg

SEQ ID NO: 235971 - DNA, 103 bp, Artificial Sequence
  Synthetic Polynucleotide
taatacgactcactatagggcatctatgagttttgcatctgccacggtgaaacagaggagatcaccgatgcagatgcaaaacctggcggcagcgcaaaagatg

SEQ ID NO: 235972 - DNA, 103 bp, Artificial Sequence
  Synthetic Polynucleotide
taatacgactcactatagggacaaactggaatattctgtaaaccttttgtaacagaggagaacaaaaatgttacagaataacctggcggcagcgcaaaagatg

SEQ ID NO: 235973 - DNA, 103 bp, Artificial Sequence
  Synthetic Polynucleotide
taatacgactcactatagggtgatgtttgtacaaactggaatattctgtaaacagaggagatacagaatgttccagtttaacctggcggcagcgcaaaagatg

SEQ ID NO: 235974 - DNA, 103 bp, Artificial Sequence
  Synthetic Polynucleotide
taatacgactcactataggggtggacaacatgatgtttgtacaaactggaaacagaggagatccagtatgtacaaacataacctggcggcagcgcaaaagatg

SEQ ID NO: 235975 - DNA, 103 bp, Artificial Sequence
  Synthetic Polynucleotide
taatacgactcactatagggtggaatgagtgtggacaacatgatgtttgtaacagaggagaacaaacatgatgttgtccaacctggcggcagcgcaaaagatg

SEQ ID NO: 235976 - DNA, 103 bp, Artificial Sequence
  Synthetic Polynucleotide
taatacgactcactatagggttgtaaggtttggaatgagtgtggacaacaaacagaggagatgttgtatgcactcattcaacctggcggcagcgcaaaagatg

SEQ ID NO: 235977 - DNA, 103 bp, Artificial Sequence
  Synthetic Polynucleotide
taatacgactcactataggggtggttacagttgtaaggtttggaatgagtaacagaggagaactcatatgaaaccttacaacctggcggcagcgcaaaagatg

SEQ ID NO: 235978 - DNA, 103 bp, Artificial Sequence
  Synthetic Polynucleotide
taatacgactcactatagggtcttcccacagtggttacagttgtaaggttaacagaggagaaaccttatgactgtaaccaacctggcggcagcgcaaaagatg

SEQ ID NO: 235979 - DNA, 103 bp, Artificial Sequence
  Synthetic Polynucleotide
taatacgactcactatagggtgcttgtatgtcttcccacagtggttacagaacagaggagactgtaaatgctgtgggaaaacctggcggcagcgcaaaagatg

SEQ ID NO: 235980 - DNA, 103 bp, Artificial Sequence
  Synthetic Polynucleotide
taatacgactcactatagggcgtggagatctgcttgtatgtcttcccacaaacagaggagatgtgggatgacatacaagaacctggcggcagcgcaaaagatg

SEQ ID NO: 235981 - DNA, 103 bp, Artificial Sequence
  Synthetic Polynucleotide
taatacgactcactataggggcatggccagcgtggagatctgcttgtatgaacagaggagacatacaatgagatctccaaacctggcggcagcgcaaaagatg

SEQ ID NO: 235982 - DNA, 103 bp, Artificial Sequence
  Synthetic Polynucleotide
taatacgactcactatagggatgacctggccatctatgagttttgcatctaacagaggagaagatgcatgactcatagaaacctggcggcagcgcaaaagatg

SEQ ID NO: 235983 - DNA, 103 bp, Artificial Sequence
  Synthetic Polynucleotide
taatacgactcactataggggtccgtttgtgcatggccagcgtggagatcaacagaggagagatctcatggctggccataacctggcggcagcgcaaaagatg

SEQ ID NO: 235984 - DNA, 103 bp, Artificial Sequence
  Synthetic Polynucleotide
taatacgactcactataggggttgtgggctgtccgtttgtgcatggccagaacagaggagactggccatgcacaaacggaacctggcggcagcgcaaaagatg

SEQ ID NO: 235985 - DNA, 103 bp, Artificial Sequence
  Synthetic Polynucleotide
taatacgactcactataggggctcagtgtcgttgtgggctgtccgtttgtaacagaggagaacaaacatgcagcccacaaacctggcggcagcgcaaaagatg

SEQ ID NO: 235986 - DNA, 103 bp, Artificial Sequence
  Synthetic Polynucleotide
taatacgactcactatagggtcctcgatgggctcagtgtcgttgtgggctaacagaggagaagcccaatgcgacactgaaacctggcggcagcgcaaaagatg

SEQ ID NO: 235987 - DNA, 103 bp, Artificial Sequence
  Synthetic Polynucleotide
taatacgactcactatagggttcctgctcctcctcgatgggctcagtgtcaacagaggagagacactatgcccatcgagaacctggcggcagcgcaaaagatg

SEQ ID NO: 235988 - DNA, 103 bp, Artificial Sequence
  Synthetic Polynucleotide
taatacgactcactatagggcaaagaaggcttcctgctcctcctcgatggaacagaggagaccatcgatgaggagcaggaacctggcggcagcgcaaaagatg

SEQ ID NO: 235989 - DNA, 103 bp, Artificial Sequence
  Synthetic Polynucleotide
taatacgactcactataggggggggcggctcaaagaaggcttcctgctccaacagaggagaggagcaatgagccttcttaacctggcggcagcgcaaaagatg

SEQ ID NO: 235990 - DNA, 103 bp, Artificial Sequence
  Synthetic Polynucleotide
taatacgactcactatagggaccttgacctgggggcggctcaaagaaggcaacagaggagagccttcatggagccgcccaacctggcggcagcgcaaaagatg

SEQ ID NO: 235991 - DNA, 103 bp, Artificial Sequence
  Synthetic Polynucleotide
taatacgactcactataggggaacatcttcaccttgacctgggggcggctaacagaggagaagccgcatgcaggtcaagaacctggcggcagcgcaaaagatg

SEQ ID NO: 235992 - DNA, 103 bp, Artificial Sequence
  Synthetic Polynucleotide
taatacgactcactataggggaccctttaagaacatcttcaccttgacctaacagaggagaaggtcaatgtgaagatgtaacctggcggcagcgcaaaagatg

SEQ ID NO: 235993 - DNA, 103 bp, Artificial Sequence
  Synthetic Polynucleotide
taatacgactcactatagggttccaactgaatgacctggccatctatgagaacagaggagactcataatgggccaggtcaacctggcggcagcgcaaaagatg

SEQ ID NO: 235994 - DNA, 103 bp, Artificial Sequence
  Synthetic Polynucleotide
taatacgactcactatagggcgtaatctgggaccctttaagaacatcttcaacagaggagagaagatatgcttaaagggaacctggcggcagcgcaaaagatg

SEQ ID NO: 235995 - DNA, 103 bp, Artificial Sequence
  Synthetic Polynucleotide
taatacgactcactatagggctgtaacatacgtaatctgggaccctttaaaacagaggagattaaagatgcccagattaaacctggcggcagcgcaaaagatg

SEQ ID NO: 235996 - DNA, 103 bp, Artificial Sequence
  Synthetic Polynucleotide
taatacgactcactatagggccttctacacctgtaacatacgtaatctggaacagaggagaccagatatggtatgttacaacctggcggcagcgcaaaagatg

SEQ ID NO: 235997 - DNA, 103 bp, Artificial Sequence
  Synthetic Polynucleotide
taatacgactcactatagggaacgtcgtccccttctacacctgtaacataaacagaggagatatgttatgggtgtagaaaacctggcggcagcgcaaaagatg

SEQ ID NO: 235998 - DNA, 103 bp, Artificial Sequence
  Synthetic Polynucleotide
taatacgactcactataggggtgtagaaacaacgtcgtccccttctacacaacagaggagagtgtagatggggacgacgaacctggcggcagcgcaaaagatg

SEQ ID NO: 235999 - DNA, 103 bp, Artificial Sequence
  Synthetic Polynucleotide
taatacgactcactataggggtggctacttgtgtagaaacaacgtcgtccaacagaggagaggacgaatgtgtttctacaacctggcggcagcgcaaaagatg

SEQ ID NO: 236000 - DNA, 103 bp, Artificial Sequence
  Synthetic Polynucleotide
taatacgactcactatagggttgggttactgtggctacttgtgtagaaacaacagaggagagtttctatgcaagtagccaacctggcggcagcgcaaaagatg

SEQ ID NO: 236001 - DNA, 103 bp, Artificial Sequence
  Synthetic Polynucleotide
taatacgactcactatagggtcagtccagattgggttactgtggctacttaacagaggagaaagtagatgcagtaacccaacctggcggcagcgcaaaagatg

SEQ ID NO: 236002 - DNA, 103 bp, Artificial Sequence
  Synthetic Polynucleotide
taatacgactcactatagggacttgttgactcagtccagattgggttactaacagaggagaagtaacatgatctggactaacctggcggcagcgcaaaagatg

SEQ ID NO: 236003 - DNA, 103 bp, Artificial Sequence
  Synthetic Polynucleotide
taatacgactcactatagggtatgagtgtaacttgttgactcagtccagaaacagaggagatctggaatgagtcaacaaaacctggcggcagcgcaaaagatg

SEQ ID NO: 236004 - DNA, 103 bp, Artificial Sequence
  Synthetic Polynucleotide
taatacgactcactatagggcagaaccatcttccaactgaatgacctggcaacagaggagagccaggatgttcagttggaacctggcggcagcgcaaaagatg

SEQ ID NO: 236005 - DNA, 103 bp, Artificial Sequence
  Synthetic Polynucleotide
taatacgactcactatagggcatcctgggatatgagtgtaacttgttgacaacagaggagagtcaacatgttacactcaaacctggcggcagcgcaaaagatg

SEQ ID NO: 236006 - DNA, 103 bp, Artificial Sequence
  Synthetic Polynucleotide
taatacgactcactatagggtgctgagtcccatcctgggatatgagtgtaaacagaggagatacactatgatcccaggaaacctggcggcagcgcaaaagatg

SEQ ID NO: 236007 - DNA, 103 bp, Artificial Sequence
  Synthetic Polynucleotide
taatacgactcactatagggtatgttgacatgctgagtcccatcctgggaaacagaggagatcccagatggggactcagaacctggcggcagcgcaaaagatg

SEQ ID NO: 236008 - DNA, 103 bp, Artificial Sequence
  Synthetic Polynucleotide
taatacgactcactatagggcagcttgagatatgttgacatgctgagtccaacagaggagaggactcatgatgtcaacaaacctggcggcagcgcaaaagatg

SEQ ID NO: 236009 - DNA, 103 bp, Artificial Sequence
  Synthetic Polynucleotide
taatacgactcactataggggcctgcatgtcagcttgagatatgttgacaaacagaggagatgtcaaatgatctcaagcaacctggcggcagcgcaaaagatg

SEQ ID NO: 236010 - DNA, 103 bp, Artificial Sequence
  Synthetic Polynucleotide
taatacgactcactataggggttgccaatggcctgcatgtcagcttgagaaacagaggagatctcaaatggacatgcagaacctggcggcagcgcaaaagatg

SEQ ID NO: 236011 - DNA, 103 bp, Artificial Sequence
  Synthetic Polynucleotide
taatacgactcactatagggttgtgatggtgttgccaatggcctgcatgtaacagaggagaacatgcatgccattggcaaacctggcggcagcgcaaaagatg

SEQ ID NO: 236012 - DNA, 103 bp, Artificial Sequence
  Synthetic Polynucleotide
taatacgactcactatagggtgcgttaccattgtgatggtgttgccaatgaacagaggagacattggatgcaccatcacaacctggcggcagcgcaaaagatg

SEQ ID NO: 236013 - DNA, 103 bp, Artificial Sequence
  Synthetic Polynucleotide
taatacgactcactatagggcgtgccatcctgcgttaccattgtgatggtaacagaggagaaccatcatgatggtaacgaacctggcggcagcgcaaaagatg

SEQ ID NO: 236014 - DNA, 103 bp, Artificial Sequence
  Synthetic Polynucleotide
taatacgactcactatagggctgtgatgggcgtgccatcctgcgttaccaaacagaggagatggtaaatgaggatggcaaacctggcggcagcgcaaaagatg

SEQ ID NO: 236015 - DNA, 103 bp, Artificial Sequence
  Synthetic Polynucleotide
taatacgactcactatagggacataggccgcagaaccatcttccaactgaaacagaggagatcagttatgagatggttcaacctggcggcagcgcaaaagatg

SEQ ID NO: 236016 - DNA, 103 bp, Artificial Sequence
  Synthetic Polynucleotide
taatacgactcactatagggtgggcggggactgtgatgggcgtgccatccaacagaggagaggatggatggcccatcacaacctggcggcagcgcaaaagatg

SEQ ID NO: 236017 - DNA, 103 bp, Artificial Sequence
  Synthetic Polynucleotide
taatacgactcactataggggactgcatcatgggcggggactgtgatgggaacagaggagacccatcatggtccccgccaacctggcggcagcgcaaaagatg

SEQ ID NO: 236018 - DNA, 103 bp, Artificial Sequence
  Synthetic Polynucleotide
taatacgactcactatagggctgaggagatgactgcatcatgggcggggaaacagaggagatccccgatgatgatgcagaacctggcggcagcgcaaaagatg

SEQ ID NO: 236019 - DNA, 103 bp, Artificial Sequence
  Synthetic Polynucleotide
taatacgactcactatagggtgcgttcctgctgaggagatgactgcatcaaacagaggagatgatgcatgcatctcctcaacctggcggcagcgcaaaagatg

SEQ ID NO: 236020 - DNA, 103 bp, Artificial Sequence
  Synthetic Polynucleotide
taatacgactcactatagggagcaacagagtgcgttcctgctgaggagataacagaggagaatctccatggcaggaacgaacctggcggcagcgcaaaagatg

SEQ ID NO: 236021 - DNA, 103 bp, Artificial Sequence
  Synthetic Polynucleotide
taatacgactcactatagggcagtaaccatagcaacagagtgcgttcctgaacagaggagacaggaaatgactctgttgaacctggcggcagcgcaaaagatg

SEQ ID NO: 236022 - DNA, 103 bp, Artificial Sequence
  Synthetic Polynucleotide
taatacgactcactataggggtaccctcagcagtaaccatagcaacagagaacagaggagactctgtatgtatggttacaacctggcggcagcgcaaaagatg

SEQ ID NO: 236023 - DNA, 103 bp, Artificial Sequence
  Synthetic Polynucleotide
taatacgactcactatagggttccccttctgtaccctcagcagtaaccataacagaggagaatggttatggctgagggtaacctggcggcagcgcaaaagatg

SEQ ID NO: 236024 - DNA, 103 bp, Artificial Sequence
  Synthetic Polynucleotide
taatacgactcactatagggttgcaacctgttccccttctgtaccctcagaacagaggagactgaggatgcagaaggggaacctggcggcagcgcaaaagatg

SEQ ID NO: 236025 - DNA, 103 bp, Artificial Sequence
  Synthetic Polynucleotide
taatacgactcactatagggtgagctacaattgcaacctgttccccttctaacagaggagaagaaggatgacaggttgcaacctggcggcagcgcaaaagatg

SEQ ID NO: 236026 - DNA, 103 bp, Artificial Sequence
  Synthetic Polynucleotide
taatacgactcactatagggtacatgttgaacataggccgcagaaccatcaacagaggagagatggtatggcggcctataacctggcggcagcgcaaaagatg

SEQ ID NO: 236027 - DNA, 103 bp, Artificial Sequence
  Synthetic Polynucleotide
taatacgactcactatagggtgccaagtcttgagctacaattgcaacctgaacagaggagacaggttatgattgtagctaacctggcggcagcgcaaaagatg

SEQ ID NO: 236028 - DNA, 103 bp, Artificial Sequence
  Synthetic Polynucleotide
taatacgactcactatagggtatggaatgctgccaagtcttgagctacaaaacagaggagattgtagatgaagacttggaacctggcggcagcgcaaaagatg

SEQ ID NO: 236029 - DNA, 103 bp, Artificial Sequence
  Synthetic Polynucleotide
taatacgactcactataggggatgaggcagtatggaatgctgccaagtctaacagaggagaagacttatgagcattccaaacctggcggcagcgcaaaagatg

SEQ ID NO: 236030 - DNA, 103 bp, Artificial Sequence
  Synthetic Polynucleotide
taatacgactcactatagggccccatttctgatgaggcagtatggaatgcaacagaggagagcattcatgactgcctcaaacctggcggcagcgcaaaagatg

SEQ ID NO: 236031 - DNA, 103 bp, Artificial Sequence
  Synthetic Polynucleotide
taatacgactcactataggggctgctggtgccccatttctgatgaggcagaacagaggagactgcctatgcagaaatggaacctggcggcagcgcaaaagatg

SEQ ID NO: 236032 - DNA, 103 bp, Artificial Sequence
  Synthetic Polynucleotide
taatacgactcactatagggtgatggctatgctgctggtgccccatttctaacagaggagaagaaatatggcaccagcaaacctggcggcagcgcaaaagatg

SEQ ID NO: 236033 - DNA, 103 bp, Artificial Sequence
  Synthetic Polynucleotide
taatacgactcactatagggggttactaagtgatggctatgctgctggtgaacagaggagacaccagatgcatagccataacctggcggcagcgcaaaagatg

SEQ ID NO: 236034 - DNA, 103 bp, Artificial Sequence
  Synthetic Polynucleotide
taatacgactcactatagggtggtttctgtggttactaagtgatggctataacagaggagaatagccatgacttagtaaaacctggcggcagcgcaaaagatg

SEQ ID NO: 236035 - DNA, 103 bp, Artificial Sequence
  Synthetic Polynucleotide
taatacgactcactataggggtcagaggtctggtttctgtggttactaagaacagaggagacttagtatgcacagaaacaacctggcggcagcgcaaaagatg

SEQ ID NO: 236036 - DNA, 103 bp, Artificial Sequence
  Synthetic Polynucleotide
taatacgactcactatagggtgctactaaggtcagaggtctggtttctgtaacagaggagaacagaaatgagacctctgaacctggcggcagcgcaaaagatg

SEQ ID NO: 236037 - DNA, 103 bp, Artificial Sequence
  Synthetic Polynucleotide
taatacgactcactatagggtaggtatgggtacatgttgaacataggccgaacagaggagacggcctatgttcaacatgaacctggcggcagcgcaaaagatg

SEQ ID NO: 236038 - DNA, 103 bp, Artificial Sequence
  Synthetic Polynucleotide
taatacgactcactatagggcattggatgttgctactaaggtcagaggtcaacagaggagagacctcatgccttagtagaacctggcggcagcgcaaaagatg

SEQ ID NO: 236039 - DNA, 103 bp, Artificial Sequence
  Synthetic Polynucleotide
taatacgactcactatagggatctgggtgccattggatgttgctactaagaacagaggagacttagtatgaacatccaaaacctggcggcagcgcaaaagatg

SEQ ID NO: 236040 - DNA, 103 bp, Artificial Sequence
  Synthetic Polynucleotide
taatacgactcactatagggctgaactgcaatctgggtgccattggatgtaacagaggagaacatccatgggcacccagaacctggcggcagcgcaaaagatg

SEQ ID NO: 236041 - DNA, 103 bp, Artificial Sequence
  Synthetic Polynucleotide
taatacgactcactataggggttctccaagctgaactgcaatctgggtgcaacagaggagagcacccatgttgcagttcaacctggcggcagcgcaaaagatg

SEQ ID NO: 236042 - DNA, 103 bp, Artificial Sequence
  Synthetic Polynucleotide
taatacgactcactatagggagagatggctgttctccaagctgaactgcaaacagaggagatgcagtatggcttggagaaacctggcggcagcgcaaaagatg

SEQ ID NO: 236043 - DNA, 103 bp, Artificial Sequence
  Synthetic Polynucleotide
taatacgactcactatagggggcttcttccagagatggctgttctccaagaacagaggagacttggaatgcagccatctaacctggcggcagcgcaaaagatg

SEQ ID NO: 236044 - DNA, 103 bp, Artificial Sequence
  Synthetic Polynucleotide
taatacgactcactatagggctattctgatggcttcttccagagatggctaacagaggagaagccatatgtggaagaagaacctggcggcagcgcaaaagatg

SEQ ID NO: 236045 - DNA, 103 bp, Artificial Sequence
  Synthetic Polynucleotide
taatacgactcactatagggattctagacgctattctgatggcttcttccaacagaggagaggaagaatgcatcagaataacctggcggcagcgcaaaagatg

SEQ ID NO: 236046 - DNA, 103 bp, Artificial Sequence
  Synthetic Polynucleotide
taatacgactcactatagggtccttgttggattctagacgctattctgataacagaggagaatcagaatggcgtctagaaacctggcggcagcgcaaaagatg

SEQ ID NO: 236047 - DNA, 103 bp, Artificial Sequence
  Synthetic Polynucleotide
taatacgactcactatagggctggcgtttctccttgttggattctagacgaacagaggagacgtctaatgtccaacaagaacctggcggcagcgcaaaagatg

SEQ ID NO: 236048 - DNA, 103 bp, Artificial Sequence
  Synthetic Polynucleotide
taatacgactcactatagggcctgtacttttaggtatgggtacatgttgaaacagaggagatcaacaatgacccataccaacctggcggcagcgcaaaagatg

SEQ ID NO: 236049 - DNA, 103 bp, Artificial Sequence
  Synthetic Polynucleotide
taatacgactcactatagggtcatccaaccctggcgtttctccttgttggaacagaggagaccaacaatgagaaacgccaacctggcggcagcgcaaaagatg

SEQ ID NO: 236050 - DNA, 103 bp, Artificial Sequence
  Synthetic Polynucleotide
taatacgactcactatagggcaaactgtcccctgtacttttaggtatgggaacagaggagacccataatgaaaagtacaaacctggcggcagcgcaaaagatg

SEQ ID NO: 236051 - DNA, 103 bp, Artificial Sequence
  Synthetic Polynucleotide
taatacgactcactatagggtcattccctgagaatctcgatttatttgggaacagaggagacccaaaatgatcgagattaacctggcggcagcgcaaaagatg

SEQ ID NO: 236052 - DNA, 103 bp, Artificial Sequence
  Synthetic Polynucleotide
taatacgactcactatagggcctctagacgcaaactgtcccctgtactttaacagaggagaaaagtaatggggacagttaacctggcggcagcgcaaaagatg

SEQ ID NO: 236053 - DNA, 103 bp, Artificial Sequence
  Synthetic Polynucleotide
taatacgactcactataggggcttgaccatcctctagacgcaaactgtccaacagaggagaggacagatggcgtctagaaacctggcggcagcgcaaaagatg

SEQ ID NO: 236054 - DNA, 103 bp, Artificial Sequence
  Synthetic Polynucleotide
taatacgactcactatagggtaactgtactgcttgaccatcctctagacgaacagaggagacgtctaatggatggtcaaaacctggcggcagcgcaaaagatg

SEQ ID NO: 236055 - DNA, 103 bp, Artificial Sequence
  Synthetic Polynucleotide
taatacgactcactatagggtaccatcttctaactgtactgcttgaccataacagaggagaatggtcatgcagtacagtaacctggcggcagcgcaaaagatg

SEQ ID NO: 236056 - DNA, 103 bp, Artificial Sequence
  Synthetic Polynucleotide
taatacgactcactatagggaatgctgtggtaccatcttctaactgtactaacagaggagaagtacaatgagaagatggaacctggcggcagcgcaaaagatg

SEQ ID NO: 236057 - DNA, 103 bp, Artificial Sequence
  Synthetic Polynucleotide
taatacgactcactataggggtggtgaataaatgctgtggtaccatcttcaacagaggagagaagatatgaccacagcaaacctggcggcagcgcaaaagatg

SEQ ID NO: 236058 - DNA, 103 bp, Artificial Sequence
  Synthetic Polynucleotide
taatacgactcactatagggctttggaggtgtggtgaataaatgctgtggaacagaggagaccacagatgttattcaccaacctggcggcagcgcaaaagatg

SEQ ID NO: 236059 - DNA, 103 bp, Artificial Sequence
  Synthetic Polynucleotide
taatacgactcactatagggtcataactatctttggaggtgtggtgaataaacagaggagatattcaatgcacctccaaaacctggcggcagcgcaaaagatg

SEQ ID NO: 236060 - DNA, 103 bp, Artificial Sequence
  Synthetic Polynucleotide
taatacgactcactatagggtgcactctggtcataactatctttggaggtaacagaggagaacctccatggatagttataacctggcggcagcgcaaaagatg

SEQ ID NO: 236061 - DNA, 103 bp, Artificial Sequence
  Synthetic Polynucleotide
taatacgactcactatagggccgcctgtaatgcactctggtcataactataacagaggagaatagttatgaccagagtgaacctggcggcagcgcaaaagatg

SEQ ID NO: 236062 - DNA, 103 bp, Artificial Sequence
  Synthetic Polynucleotide
taatacgactcactatagggggaaactctgtcattccctgagaatctcgaaacagaggagatcgagaatgtcagggaataacctggcggcagcgcaaaagatg

SEQ ID NO: 236063 - DNA, 103 bp, Artificial Sequence
  Synthetic Polynucleotide
taatacgactcactatagggtccagctgaaccgcctgtaatgcactctggaacagaggagaccagagatgattacaggcaacctggcggcagcgcaaaagatg

SEQ ID NO: 236064 - DNA, 103 bp, Artificial Sequence
  Synthetic Polynucleotide
taatacgactcactatagggggtaccatcttccagctgaaccgcctgtaaaacagaggagattacagatggttcagctgaacctggcggcagcgcaaaagatg

SEQ ID NO: 236065 - DNA, 103 bp, Artificial Sequence
  Synthetic Polynucleotide
taatacgactcactatagggtataagctgtggtaccatcttccagctgaaaacagaggagattcagcatgaagatggtaaacctggcggcagcgcaaaagatg

SEQ ID NO: 236066 - DNA, 103 bp, Artificial Sequence
  Synthetic Polynucleotide
taatacgactcactataggggcatggtggatataagctgtggtaccatctaacagaggagaagatggatgcacagcttaaacctggcggcagcgcaaaagatg

SEQ ID NO: 236067 - DNA, 103 bp, Artificial Sequence
  Synthetic Polynucleotide
taatacgactcactataggggacttgcactgcatggtggatataagctgtaacagaggagaacagctatgatccaccataacctggcggcagcgcaaaagatg

SEQ ID NO: 236068 - DNA, 103 bp, Artificial Sequence
  Synthetic Polynucleotide
taatacgactcactatagggcagactgcgggacttgcactgcatggtggaaacagaggagatccaccatgcagtgcaagaacctggcggcagcgcaaaagatg

SEQ ID NO: 236069 - DNA, 103 bp, Artificial Sequence
  Synthetic Polynucleotide
taatacgactcactatagggaagatggtgtcagactgcgggacttgcactaacagaggagaagtgcaatgcccgcagtcaacctggcggcagcgcaaaagatg

SEQ ID NO: 236070 - DNA, 103 bp, Artificial Sequence
  Synthetic Polynucleotide
taatacgactcactatagggctgaattgccaagatggtgtcagactgcggaacagaggagaccgcagatggacaccatcaacctggcggcagcgcaaaagatg

SEQ ID NO: 236071 - DNA, 103 bp, Artificial Sequence
  Synthetic Polynucleotide
taatacgactcactatagggtcccatcagcctgaattgccaagatggtgtaacagaggagaacaccaatgtggcaattcaacctggcggcagcgcaaaagatg

SEQ ID NO: 236072 - DNA, 103 bp, Artificial Sequence
  Synthetic Polynucleotide
taatacgactcactatagggcctgccactgtcccatcagcctgaattgccaacagaggagaggcaatatgggctgatggaacctggcggcagcgcaaaagatg

SEQ ID NO: 236073 - DNA, 103 bp, Artificial Sequence
  Synthetic Polynucleotide
taatacgactcactatagggccctcctccaggaaactctgtcattccctgaacagaggagacagggaatgacagagtttaacctggcggcagcgcaaaagatg

SEQ ID NO: 236074 - DNA, 103 bp, Artificial Sequence
  Synthetic Polynucleotide
taatacgactcactatagggagtgtgcagacctgccactgtcccatcagcaacagaggagagctgatatgacagtggcaaacctggcggcagcgcaaaagatg

SEQ ID NO: 236075 - DNA, 103 bp, Artificial Sequence
  Synthetic Polynucleotide
taatacgactcactatagggtagcatccccagtgtgcagacctgccactgaacagaggagacagtggatggtctgcacaaacctggcggcagcgcaaaagatg

SEQ ID NO: 236076 - DNA, 103 bp, Artificial Sequence
  Synthetic Polynucleotide
taatacgactcactataggggggtcaattgtagcatccccagtgtgcagaaacagaggagatctgcaatgtggggatgcaacctggcggcagcgcaaaagatg

SEQ ID NO: 236077 - DNA, 103 bp, Artificial Sequence
  Synthetic Polynucleotide
taatacgactcactataggggatggtgtcagggtcaattgtagcatccccaacagaggagaggggatatgacaattgacaacctggcggcagcgcaaaagatg

SEQ ID NO: 236078 - DNA, 103 bp, Artificial Sequence
  Synthetic Polynucleotide
taatacgactcactatagggccaaagcactgatggtgtcagggtcaattgaacagaggagacaattgatgctgacaccaaacctggcggcagcgcaaaagatg

SEQ ID NO: 236079 - DNA, 103 bp, Artificial Sequence
  Synthetic Polynucleotide
taatacgactcactataggggcatactgttccaaagcactgatggtgtcaaacagaggagatgacacatgcagtgctttaacctggcggcagcgcaaaagatg

SEQ ID NO: 236080 - DNA, 103 bp, Artificial Sequence
  Synthetic Polynucleotide
taatacgactcactatagggcacctttgctgcatactgttccaaagcactaacagaggagaagtgctatggaacagtataacctggcggcagcgcaaaagatg

SEQ ID NO: 236081 - DNA, 103 bp, Artificial Sequence
  Synthetic Polynucleotide
taatacgactcactatagggcatcaatggacacctttgctgcatactgttaacagaggagaaacagtatgcagcaaaggaacctggcggcagcgcaaaagatg

SEQ ID NO: 236082 - DNA, 103 bp, Artificial Sequence
  Synthetic Polynucleotide
taatacgactcactatagggctttcacttccatcaatggacacctttgctaacagaggagaagcaaaatggtccattgaaacctggcggcagcgcaaaagatg

SEQ ID NO: 236083 - DNA, 103 bp, Artificial Sequence
  Synthetic Polynucleotide
taatacgactcactatagggacctgctacactttcacttccatcaatggaaacagaggagatccattatgggaagtgaaaacctggcggcagcgcaaaagatg

SEQ ID NO: 236084 - DNA, 103 bp, Artificial Sequence
  Synthetic Polynucleotide
taatacgactcactataggggcgcctccatccctcctccaggaaactctgaacagaggagacagagtatgctggaggagaacctggcggcagcgcaaaagatg

SEQ ID NO: 236085 - DNA, 103 bp, Artificial Sequence
  Synthetic Polynucleotide
taatacgactcactatagggtcattccagtacctgctacactttcacttcaacagaggagagaagtgatggtgtagcagaacctggcggcagcgcaaaagatg

SEQ ID NO: 236086 - DNA, 103 bp, Artificial Sequence
  Synthetic Polynucleotide
taatacgactcactatagggttttctccaatcattccagtacctgctacaaacagaggagatgtagcatgtactggaataacctggcggcagcgcaaaagatg

SEQ ID NO: 236087 - DNA, 103 bp, Artificial Sequence
  Synthetic Polynucleotide
taatacgactcactatagggctcttgctcattttctccaatcattccagtaacagaggagaactggaatgattggagaaaacctggcggcagcgcaaaagatg

SEQ ID NO: 236088 - DNA, 103 bp, Artificial Sequence
  Synthetic Polynucleotide
taatacgactcactataggggcatttttttctcttgctcattttctccaaaacagaggagattggagatgatgagcaagaacctggcggcagcgcaaaagatg

SEQ ID NO: 236089 - DNA, 103 bp, Artificial Sequence
  Synthetic Polynucleotide
taatacgactcactatagggaaaacaatctgcatttttttctcttgctcaaacagaggagatgagcaatggaaaaaaataacctggcggcagcgcaaaagatg

SEQ ID NO: 236090 - DNA, 103 bp, Artificial Sequence
  Synthetic Polynucleotide
taatacgactcactatagggatgtccttgtaaaacaatctgcatttttttaacagaggagaaaaaaaatgcagattgttaacctggcggcagcgcaaaagatg

SEQ ID NO: 236091 - DNA, 103 bp, Artificial Sequence
  Synthetic Polynucleotide
taatacgactcactatagggctcttgtagcatgtccttgtaaaacaatctaacagaggagaagattgatgtacaaggacaacctggcggcagcgcaaaagatg

SEQ ID NO: 236092 - DNA, 103 bp, Artificial Sequence
  Synthetic Polynucleotide
taatacgactcactatagggttagcagttactcttgtagcatgtccttgtaacagaggagaacaaggatgtgctacaagaacctggcggcagcgcaaaagatg

SEQ ID NO: 236093 - DNA, 103 bp, Artificial Sequence
  Synthetic Polynucleotide
taatacgactcactatagggctgttgagatttagcagttactcttgtagcaacagaggagagctacaatggtaactgctaacctggcggcagcgcaaaagatg

SEQ ID NO: 236094 - DNA, 103 bp, Artificial Sequence
  Synthetic Polynucleotide
taatacgactcactatagggtctctccactctgttgagatttagcagttaaacagaggagataactgatgaatctcaacaacctggcggcagcgcaaaagatg

SEQ ID NO: 236095 - DNA, 103 bp, Artificial Sequence
  Synthetic Polynucleotide
taatacgactcactataggggtaacatgttgcgcctccatccctcctccaaacagaggagatggaggatggatggaggcaacctggcggcagcgcaaaagatg

SEQ ID NO: 236096 - DNA, 103 bp, Artificial Sequence
  Synthetic Polynucleotide
taatacgactcactatagggcgaaatgccttctctccactctgttgagataacagaggagaatctcaatggagtggagaaacctggcggcagcgcaaaagatg

SEQ ID NO: 236097 - DNA, 103 bp, Artificial Sequence
  Synthetic Polynucleotide
taatacgactcactatagggatattcacatcgaaatgccttctctccactaacagaggagaagtggaatgaaggcatttaacctggcggcagcgcaaaagatg

SEQ ID NO: 236098 - DNA, 103 bp, Artificial Sequence
  Synthetic Polynucleotide
taatacgactcactatagggcacatccatcatattcacatcgaaatgcctaacagaggagaaggcatatggatgtgaataacctggcggcagcgcaaaagatg

SEQ ID NO: 236099 - DNA, 103 bp, Artificial Sequence
  Synthetic Polynucleotide
taatacgactcactatagggtataattttccacatccatcatattcacataacagaggagaatgtgaatgtgatggatgaacctggcggcagcgcaaaagatg

SEQ ID NO: 236100 - DNA, 103 bp, Artificial Sequence
  Synthetic Polynucleotide
taatacgactcactatagggagctgttgtatataattttccacatccatcaacagaggagagatggaatgggaaaattaaacctggcggcagcgcaaaagatg

SEQ ID NO: 236101 - DNA, 103 bp, Artificial Sequence
  Synthetic Polynucleotide
taatacgactcactatagggtgagatgatgagctgttgtatataattttcaacagaggagagaaaatatgatacaacagaacctggcggcagcgcaaaagatg

SEQ ID NO: 236102 - DNA, 103 bp, Artificial Sequence
  Synthetic Polynucleotide
taatacgactcactatagggtcatggaccttgagatgatgagctgttgtaaacagaggagatacaacatgtcatcatctaacctggcggcagcgcaaaagatg

SEQ ID NO: 236103 - DNA, 103 bp, Artificial Sequence
  Synthetic Polynucleotide
taatacgactcactataggggtgtgacctctcatggaccttgagatgatgaacagaggagacatcatatgaaggtccataacctggcggcagcgcaaaagatg

SEQ ID NO: 236104 - DNA, 103 bp, Artificial Sequence
  Synthetic Polynucleotide
taatacgactcactataggggatctcctgtgtgtgacctctcatggacctaacagaggagaaggtccatgagaggtcacaacctggcggcagcgcaaaagatg

SEQ ID NO: 236105 - DNA, 103 bp, Artificial Sequence
  Synthetic Polynucleotide
taatacgactcactatagggtgataaggccgatctcctgtgtgtgacctcaacagaggagagaggtcatgcacaggagaaacctggcggcagcgcaaaagatg

SEQ ID NO: 236106 - DNA, 103 bp, Artificial Sequence
  Synthetic Polynucleotide
taatacgactcactatagggcaagcacagcgtaacatgttgcgcctccataacagaggagaatggagatgcaacatgttaacctggcggcagcgcaaaagatg

SEQ ID NO: 236107 - DNA, 103 bp, Artificial Sequence
  Synthetic Polynucleotide
taatacgactcactatagggatgctcacactgataaggccgatctcctgtaacagaggagaacaggaatgcggccttataacctggcggcagcgcaaaagatg

SEQ ID NO: 236108 - DNA, 103 bp, Artificial Sequence
  Synthetic Polynucleotide
taatacgactcactatagggcacagcctgcatgctcacactgataaggccaacagaggagaggccttatgagtgtgagcaacctggcggcagcgcaaaagatg

SEQ ID NO: 236109 - DNA, 103 bp, Artificial Sequence
  Synthetic Polynucleotide
taatacgactcactatagggaatgccttcccacagcctgcatgctcacacaacagaggagagtgtgaatgtgcaggctgaacctggcggcagcgcaaaagatg

SEQ ID NO: 236110 - DNA, 103 bp, Artificial Sequence
  Synthetic Polynucleotide
taatacgactcactatagggacctgttgcaaatgccttcccacagcctgcaacagaggagagcaggcatggggaaggcaaacctggcggcagcgcaaaagatg

SEQ ID NO: 236111 - DNA, 103 bp, Artificial Sequence
  Synthetic Polynucleotide
taatacgactcactatagggttaatccataacctgttgcaaatgccttccaacagaggagaggaaggatgttgcaacagaacctggcggcagcgcaaaagatg

SEQ ID NO: 236112 - DNA, 103 bp, Artificial Sequence
  Synthetic Polynucleotide
taatacgactcactatagggacgtgactttttaatccataacctgttgcaaacagaggagatgcaacatgttatggattaacctggcggcagcgcaaaagatg

SEQ ID NO: 236113 - DNA, 103 bp, Artificial Sequence
  Synthetic Polynucleotide
taatacgactcactatagggatgagttctgacgtgactttttaatccataaacagaggagatatggaatgaaaagtcacaacctggcggcagcgcaaaagatg

SEQ ID NO: 236114 - DNA, 103 bp, Artificial Sequence
  Synthetic Polynucleotide
taatacgactcactatagggtttctcctgtatgagttctgacgtgactttaacagaggagaaaagtcatgtcagaactcaacctggcggcagcgcaaaagatg

SEQ ID NO: 236115 - DNA, 103 bp, Artificial Sequence
  Synthetic Polynucleotide
taatacgactcactatagggcgatatggcttttctcctgtatgagttctgaacagaggagacagaacatgtacaggagaaacctggcggcagcgcaaaagatg

SEQ ID NO: 236116 - DNA, 103 bp, Artificial Sequence
  Synthetic Polynucleotide
taatacgactcactatagggttccgaacaccgatatggcttttctcctgtaacagaggagaacaggaatgaagccatataacctggcggcagcgcaaaagatg

SEQ ID NO: 236117 - DNA, 103 bp, Artificial Sequence
  Synthetic Polynucleotide
taatacgactcactatagggctgcctctgtcaagcacagcgtaacatgttaacagaggagaaacatgatgcgctgtgctaacctggcggcagcgcaaaagatg

SEQ ID NO: 236118 - DNA, 103 bp, Artificial Sequence
  Synthetic Polynucleotide
taatacgactcactatagggtacaattatcttccgaacaccgatatggctaacagaggagaagccatatgggtgttcggaacctggcggcagcgcaaaagatg

SEQ ID NO: 236119 - DNA, 103 bp, Artificial Sequence
  Synthetic Polynucleotide
taatacgactcactatagggaaagatttagtacaattatcttccgaacacaacagaggagagtgttcatgagataattgaacctggcggcagcgcaaaagatg

SEQ ID NO: 236120 - DNA, 103 bp, Artificial Sequence
  Synthetic Polynucleotide
taatacgactcactatagggtgaagttttgaaagatttagtacaattatcaacagaggagagataatatgactaaatctaacctggcggcagcgcaaaagatg

SEQ ID NO: 236121 - DNA, 103 bp, Artificial Sequence
  Synthetic Polynucleotide
taatacgactcactataggggtagatctcctgaagttttgaaagatttagaacagaggagactaaatatgtcaaaacttaacctggcggcagcgcaaaagatg

SEQ ID NO: 236122 - DNA, 103 bp, Artificial Sequence
  Synthetic Polynucleotide
taatacgactcactatagggatgtgtttctgtagatctcctgaagttttgaacagaggagacaaaacatgaggagatctaacctggcggcagcgcaaaagatg

SEQ ID NO: 236123 - DNA, 103 bp, Artificial Sequence
  Synthetic Polynucleotide
taatacgactcactatagggatgagttctgatgtgtttctgtagatctccaacagaggagaggagatatgcagaaacacaacctggcggcagcgcaaaagatg

SEQ ID NO: 236124 - DNA, 103 bp, Artificial Sequence
  Synthetic Polynucleotide
taatacgactcactatagggtttctcctgtatgagttctgatgtgtttctaacagaggagaagaaacatgtcagaactcaacctggcggcagcgcaaaagatg

SEQ ID NO: 236125 - DNA, 103 bp, Artificial Sequence
  Synthetic Polynucleotide
taatacgactcactatagggttaaagggcctttctcctgtatgagttctgaacagaggagacagaacatgtacaggagaaacctggcggcagcgcaaaagatg

SEQ ID NO: 236126 - DNA, 103 bp, Artificial Sequence
  Synthetic Polynucleotide
taatacgactcactataggggaagggacacttaaagggcctttctcctgtaacagaggagaacaggaatgaggccctttaacctggcggcagcgcaaaagatg

SEQ ID NO: 236127 - DNA, 103 bp, Artificial Sequence
  Synthetic Polynucleotide
taatacgactcactatagggcgcagccttcgaagggacacttaaagggccaacagaggagaggccctatgagtgtccctaacctggcggcagcgcaaaagatg

SEQ ID NO: 236128 - DNA, 103 bp, Artificial Sequence
  Synthetic Polynucleotide
taatacgactcactataggggccacggtgactgcctctgtcaagcacagcaacagaggagagctgtgatggacagaggcaacctggcggcagcgcaaaagatg

SEQ ID NO: 236129 - DNA, 103 bp, Artificial Sequence
  Synthetic Polynucleotide
taatacgactcactatagggaaggaccgaccgcagccttcgaagggacacaacagaggagagtgtccatgcgaaggctgaacctggcggcagcgcaaaagatg

SEQ ID NO: 236130 - DNA, 103 bp, Artificial Sequence
  Synthetic Polynucleotide
taatacgactcactatagggtgatgttgtaaaggaccgaccgcagccttcaacagaggagagaaggcatgggtcggtccaacctggcggcagcgcaaaagatg

SEQ ID NO: 236131 - DNA, 103 bp, Artificial Sequence
  Synthetic Polynucleotide
taatacgactcactatagggttctgatatttgatgttgtaaaggaccgacaacagaggagagtcggtatgttacaacataacctggcggcagcgcaaaagatg

SEQ ID NO: 236132 - DNA, 103 bp, Artificial Sequence
  Synthetic Polynucleotide
taatacgactcactatagggacgtgcacttttctgatatttgatgttgtaaacagaggagatacaacatgaaatatcagaacctggcggcagcgcaaaagatg

SEQ ID NO: 236133 - DNA, 103 bp, Artificial Sequence
  Synthetic Polynucleotide
taatacgactcactataggggtgtgtcctaacgtgcacttttctgatattaacagaggagaaatatcatgaaagtgcacaacctggcggcagcgcaaaagatg

SEQ ID NO: 236134 - DNA, 103 bp, Artificial Sequence
  Synthetic Polynucleotide
taatacgactcactatagggtttctcctgtgtgtgtcctaacgtgcacttaacagaggagaaagtgcatgttaggacacaacctggcggcagcgcaaaagatg

SEQ ID NO: 236135 - DNA, 103 bp, Artificial Sequence
  Synthetic Polynucleotide
taatacgactcactatagggtaataaggtctttctcctgtgtgtgtcctaaacagaggagataggacatgcacaggagaaacctggcggcagcgcaaaagatg

SEQ ID NO: 236136 - DNA, 103 bp, Artificial Sequence
  Synthetic Polynucleotide
taatacgactcactatagggctctgtgcagtaataaggtctttctcctgtaacagaggagaacaggaatgagaccttataacctggcggcagcgcaaaagatg

SEQ ID NO: 236137 - DNA, 103 bp, Artificial Sequence
  Synthetic Polynucleotide
taatacgactcactatagggcacatcctggctctgtgcagtaataaggtcaacagaggagagaccttatgactgcacagaacctggcggcagcgcaaaagatg

SEQ ID NO: 236138 - DNA, 103 bp, Artificial Sequence
  Synthetic Polynucleotide
taatacgactcactatagggaatgccctcccacatcctggctctgtgcagaacagaggagactgcacatggccaggatgaacctggcggcagcgcaaaagatg

SEQ ID NO: 236139 - DNA, 103 bp, Artificial Sequence
  Synthetic Polynucleotide
taatacgactcactatagggcaatccttccagtttgtcgtcaatgttcataacagaggagaatgaacatggacgacaaaaacctggcggcagcgcaaaagatg

SEQ ID NO: 236140 - DNA, 103 bp, Artificial Sequence
  Synthetic Polynucleotide
taatacgactcactatagggtccagacacagtagactggccagacactccaacagaggagaggagtgatgggccagtctaacctggcggcagcgcaaaagatg

SEQ ID NO: 236141 - DNA, 103 bp, Artificial Sequence
  Synthetic Polynucleotide
taatacgactcactatagggttttttcaggtcagatttgtccaaagcactaacagaggagaagtgctatggacaaatctaacctggcggcagcgcaaaagatg

SEQ ID NO: 236142 - DNA, 103 bp, Artificial Sequence
  Synthetic Polynucleotide
taatacgactcactatagggcatttttgtcttttttcaggtcagatttgtaacagaggagaacaaatatgacctgaaaaaacctggcggcagcgcaaaagatg

SEQ ID NO: 236143 - DNA, 103 bp, Artificial Sequence
  Synthetic Polynucleotide
taatacgactcactatagggggcaagtaatcatttttgtcttttttcaggaacagaggagacctgaaatgagacaaaaaaacctggcggcagcgcaaaagatg

SEQ ID NO: 236144 - DNA, 103 bp, Artificial Sequence
  Synthetic Polynucleotide
taatacgactcactatagggagaataaagaggcaagtaatcatttttgtcaacagaggagagacaaaatggattacttgaacctggcggcagcgcaaaagatg

SEQ ID NO: 236145 - DNA, 103 bp, Artificial Sequence
  Synthetic Polynucleotide
taatacgactcactatagggtagtacttgaagaataaagaggcaagtaataacagaggagaattactatgctctttattaacctggcggcagcgcaaaagatg

SEQ ID NO: 236146 - DNA, 103 bp, Artificial Sequence
  Synthetic Polynucleotide
taatacgactcactatagggtcttttactttagtacttgaagaataaagaaacagaggagatctttaatgttcaagtacaacctggcggcagcgcaaaagatg

SEQ ID NO: 236147 - DNA, 103 bp, Artificial Sequence
  Synthetic Polynucleotide
taatacgactcactatagggcatatactcatcttttactttagtacttgaaacagaggagatcaagtatgaaagtaaaaaacctggcggcagcgcaaaagatg

SEQ ID NO: 236148 - DNA, 103 bp, Artificial Sequence
  Synthetic Polynucleotide
taatacgactcactatagggattctgcaaccatatactcatcttttacttaacagaggagaaagtaaatgatgagtataaacctggcggcagcgcaaaagatg

SEQ ID NO: 236149 - DNA, 103 bp, Artificial Sequence
  Synthetic Polynucleotide
taatacgactcactatagggtcaacagcatattctgcaaccatatactcaaacagaggagatgagtaatgggttgcagaaacctggcggcagcgcaaaagatg

SEQ ID NO: 236150 - DNA, 103 bp, Artificial Sequence
  Synthetic Polynucleotide
taatacgactcactatagggatgtggcatttcaacagcatattctgcaacaacagaggagagttgcaatgtatgctgttaacctggcggcagcgcaaaagatg

SEQ ID NO: 236151 - DNA, 103 bp, Artificial Sequence
  Synthetic Polynucleotide
taatacgactcactatagggcctgtagctctccagacacagtagactggcaacagaggagagccagtatgctgtgtctgaacctggcggcagcgcaaaagatg

SEQ ID NO: 236152 - DNA, 103 bp, Artificial Sequence
  Synthetic Polynucleotide
taatacgactcactatagggcaactgacgaatgtggcatttcaacagcataacagaggagaatgctgatgaaatgccacaacctggcggcagcgcaaaagatg

SEQ ID NO: 236153 - DNA, 103 bp, Artificial Sequence
  Synthetic Polynucleotide
taatacgactcactatagggtgcgagcccccaactgacgaatgtggcattaacagaggagaaatgccatgttcgtcagtaacctggcggcagcgcaaaagatg

SEQ ID NO: 236154 - DNA, 103 bp, Artificial Sequence
  Synthetic Polynucleotide
taatacgactcactatagggatcttctaaatgcgagcccccaactgacgaaacagaggagatcgtcaatggggggctcgaacctggcggcagcgcaaaagatg

SEQ ID NO: 236155 - DNA, 103 bp, Artificial Sequence
  Synthetic Polynucleotide
taatacgactcactatagggctcctgacgcatcttctaaatgcgagccccaacagaggagaggggctatgatttagaagaacctggcggcagcgcaaaagatg

SEQ ID NO: 236156 - DNA, 103 bp, Artificial Sequence
  Synthetic Polynucleotide
taatacgactcactataggggggtgtatttctcctgacgcatcttctaaaaacagaggagatttagaatgtgcgtcaggaacctggcggcagcgcaaaagatg

SEQ ID NO: 236157 - DNA, 103 bp, Artificial Sequence
  Synthetic Polynucleotide
taatacgactcactatagggtaacttaggtgggtgtatttctcctgacgcaacagaggagagcgtcaatggaaatacacaacctggcggcagcgcaaaagatg

SEQ ID NO: 236158 - DNA, 103 bp, Artificial Sequence
  Synthetic Polynucleotide
taatacgactcactatagggttttgagaactaacttaggtgggtgtatttaacagaggagaaaatacatgcacctaagtaacctggcggcagcgcaaaagatg

SEQ ID NO: 236159 - DNA, 103 bp, Artificial Sequence
  Synthetic Polynucleotide
taatacgactcactatagggctattaatttttttgagaactaacttaggtaacagaggagaacctaaatgagttctcaaaacctggcggcagcgcaaaagatg

SEQ ID NO: 236160 - DNA, 103 bp, Artificial Sequence
  Synthetic Polynucleotide
taatacgactcactatagggacttctcttactattaatttttttgagaacaacagaggagagttctcatgaaaattaataacctggcggcagcgcaaaagatg

SEQ ID NO: 236161 - DNA, 103 bp, Artificial Sequence
  Synthetic Polynucleotide
taatacgactcactataggggctgtttcagacttctcttactattaatttaacagaggagaaaattaatggtaagagaaaacctggcggcagcgcaaaagatg

SEQ ID NO: 236162 - DNA, 103 bp, Artificial Sequence
  Synthetic Polynucleotide
taatacgactcactatagggagtactgaatcctgtagctctccagacacaaacagaggagatgtgtcatgagagctacaaacctggcggcagcgcaaaagatg

SEQ ID NO: 236163 - DNA, 103 bp, Artificial Sequence
  Synthetic Polynucleotide
taatacgactcactatagggtgctccagtggctgtttcagacttctcttaaacagaggagataagagatgtctgaaacaaacctggcggcagcgcaaaagatg

SEQ ID NO: 236164 - DNA, 103 bp, Artificial Sequence
  Synthetic Polynucleotide
taatacgactcactatagggtgtttgattttgctccagtggctgtttcagaacagaggagactgaaaatgccactggagaacctggcggcagcgcaaaagatg

SEQ ID NO: 236165 - DNA, 103 bp, Artificial Sequence
  Synthetic Polynucleotide
taatacgactcactatagggaaggtgaaattgtttgattttgctccagtgaacagaggagacactggatgaaaatcaaaaacctggcggcagcgcaaaagatg

SEQ ID NO: 236166 - DNA, 103 bp, Artificial Sequence
  Synthetic Polynucleotide
taatacgactcactatagggtatgtggataaaggtgaaattgtttgatttaacagaggagaaaatcaatgaatttcaccaacctggcggcagcgcaaaagatg

SEQ ID NO: 236167 - DNA, 103 bp, Artificial Sequence
  Synthetic Polynucleotide
taatacgactcactataggggctctcttcatatgtggataaaggtgaaataacagaggagaatttcaatgttatccacaaacctggcggcagcgcaaaagatg

SEQ ID NO: 236168 - DNA, 103 bp, Artificial Sequence
  Synthetic Polynucleotide
taatacgactcactatagggttgaaactttgctctcttcatatgtggataaacagaggagatatccaatgatgaagagaaacctggcggcagcgcaaaagatg

SEQ ID NO: 236169 - DNA, 103 bp, Artificial Sequence
  Synthetic Polynucleotide
taatacgactcactatagggaaagcatactttgaaactttgctctcttcaaacagaggagatgaagaatgcaaagtttcaacctggcggcagcgcaaaagatg

SEQ ID NO: 236170 - DNA, 103 bp, Artificial Sequence
  Synthetic Polynucleotide
taatacgactcactatagggcacaagttcaaaagcatactttgaaactttaacagaggagaaaagttatgaagtatgctaacctggcggcagcgcaaaagatg

SEQ ID NO: 236171 - DNA, 103 bp, Artificial Sequence
  Synthetic Polynucleotide
taatacgactcactatagggcctgtttatccacaagttcaaaagcatactaacagaggagaagtatgatgttgaacttgaacctggcggcagcgcaaaagatg

SEQ ID NO: 236172 - DNA, 103 bp, Artificial Sequence
  Synthetic Polynucleotide
taatacgactcactatagggtccagtaaagcctgtttatccacaagttcaaacagaggagatgaactatgggataaacaaacctggcggcagcgcaaaagatg

SEQ ID NO: 236173 - DNA, 103 bp, Artificial Sequence
  Synthetic Polynucleotide
taatacgactcactatagggtcgatcttgaagtactgaatcctgtagctcaacagaggagagagctaatggattcagtaaacctggcggcagcgcaaaagatg

SEQ ID NO: 236174 - DNA, 103 bp, Artificial Sequence
  Synthetic Polynucleotide
taatacgactcactataggggccttctgagtccagtaaagcctgtttatcaacagaggagagataaaatggctttactgaacctggcggcagcgcaaaagatg

SEQ ID NO: 236175 - DNA, 103 bp, Artificial Sequence
  Synthetic Polynucleotide
taatacgactcactatagggtgtcagcattgccttctgagtccagtaaagaacagaggagactttacatgactcagaagaacctggcggcagcgcaaaagatg

SEQ ID NO: 236176 - DNA, 103 bp, Artificial Sequence
  Synthetic Polynucleotide
taatacgactcactatagggacctgatcaatgtcagcattgccttctgagaacagaggagactcagaatgcaatgctgaaacctggcggcagcgcaaaagatg

SEQ ID NO: 236177 - DNA, 103 bp, Artificial Sequence
  Synthetic Polynucleotide
taatacgactcactatagggcaaattatcaacctgatcaatgtcagcattaacagaggagaaatgctatgattgatcagaacctggcggcagcgcaaaagatg

SEQ ID NO: 236178 - DNA, 103 bp, Artificial Sequence
  Synthetic Polynucleotide
taatacgactcactataggggcccctcctgcaaattatcaacctgatcaaaacagaggagattgatcatgttgataattaacctggcggcagcgcaaaagatg

SEQ ID NO: 236179 - DNA, 103 bp, Artificial Sequence
  Synthetic Polynucleotide
taatacgactcactatagggggtttactgggcccctcctgcaaattatcaaacagaggagatgataaatggcaggagggaacctggcggcagcgcaaaagatg

SEQ ID NO: 236180 - DNA, 103 bp, Artificial Sequence
  Synthetic Polynucleotide
taatacgactcactatagggactatgcacaggtttactgggcccctcctgaacagaggagacaggagatgcccagtaaaaacctggcggcagcgcaaaagatg

SEQ ID NO: 236181 - DNA, 103 bp, Artificial Sequence
  Synthetic Polynucleotide
taatacgactcactatagggaattagtactactatgcacaggtttactggaacagaggagaccagtaatgctgtgcataaacctggcggcagcgcaaaagatg

SEQ ID NO: 236182 - DNA, 103 bp, Artificial Sequence
  Synthetic Polynucleotide
taatacgactcactataggggcatcatcataattagtactactatgcacaaacagaggagatgtgcaatgtagtactaaaacctggcggcagcgcaaaagatg

SEQ ID NO: 236183 - DNA, 103 bp, Artificial Sequence
  Synthetic Polynucleotide
taatacgactcactatagggaaactgcatggcatcatcataattagtactaacagaggagaagtactatgtatgatgataacctggcggcagcgcaaaagatg

SEQ ID NO: 236184 - DNA, 103 bp, Artificial Sequence
  Synthetic Polynucleotide
taatacgactcactataggggaggcatacttcgatcttgaagtactgaataacagaggagaattcagatgttcaagatcaacctggcggcagcgcaaaagatg

SEQ ID NO: 236185 - DNA, 103 bp, Artificial Sequence
  Synthetic Polynucleotide
taatacgactcactatagggtcttcttcaaaaactgcatggcatcatcataacagaggagaatgatgatgccatgcagtaacctggcggcagcgcaaaagatg

SEQ ID NO: 236186 - DNA, 103 bp, Artificial Sequence
  Synthetic Polynucleotide
taatacgactcactatagggagataccgcttcttcttcaaaaactgcatgaacagaggagacatgcaatgtttgaagaaaacctggcggcagcgcaaaagatg

SEQ ID NO: 236187 - DNA, 103 bp, Artificial Sequence
  Synthetic Polynucleotide
taatacgactcactatagggtgctgcttgaagataccgcttcttcttcaaaacagaggagattgaagatgaagcggtataacctggcggcagcgcaaaagatg

SEQ ID NO: 236188 - DNA, 103 bp, Artificial Sequence
  Synthetic Polynucleotide
taatacgactcactatagggtgttgttacttgctgcttgaagataccgctaacagaggagaagcggtatgttcaagcagaacctggcggcagcgcaaaagatg

SEQ ID NO: 236189 - DNA, 103 bp, Artificial Sequence
  Synthetic Polynucleotide
taatacgactcactatagggtattccctgctgttgttacttgctgcttgaaacagaggagatcaagcatgaagtaacaaaacctggcggcagcgcaaaagatg

SEQ ID NO: 236190 - DNA, 103 bp, Artificial Sequence
  Synthetic Polynucleotide
taatacgactcactatagggattcagcgcatattccctgctgttgttactaacagaggagaagtaacatgagcagggaaaacctggcggcagcgcaaaagatg

SEQ ID NO: 236191 - DNA, 103 bp, Artificial Sequence
  Synthetic Polynucleotide
taatacgactcactatagggtggtacccacattcagcgcatattccctgcaacagaggagagcagggatgatgcgctgaaacctggcggcagcgcaaaagatg

SEQ ID NO: 236192 - DNA, 103 bp, Artificial Sequence
  Synthetic Polynucleotide
taatacgactcactatagggtgagaagctatggtacccacattcagcgcaaacagaggagatgcgctatgtgtgggtacaacctggcggcagcgcaaaagatg

SEQ ID NO: 236193 - DNA, 103 bp, Artificial Sequence
  Synthetic Polynucleotide
taatacgactcactatagggtacagaaggctgagaagctatggtacccacaacagaggagagtgggtatgatagcttctaacctggcggcagcgcaaaagatg

SEQ ID NO: 236194 - DNA, 103 bp, Artificial Sequence
  Synthetic Polynucleotide
taatacgactcactatagggctgcttgtgttacagaaggctgagaagctaaacagaggagatagcttatgagccttctgaacctggcggcagcgcaaaagatg

SEQ ID NO: 236195 - DNA, 103 bp, Artificial Sequence
  Synthetic Polynucleotide
taatacgactcactatagggatctcctggtgaggcatacttcgatcttgaaacagaggagatcaagaatgaagtatgccaacctggcggcagcgcaaaagatg

SEQ ID NO: 236196 - DNA, 103 bp, Artificial Sequence
  Synthetic Polynucleotide
taatacgactcactatagggcttgccacagctgcttgtgttacagaaggcaacagaggagagccttcatgaacacaagcaacctggcggcagcgcaaaagatg

SEQ ID NO: 236197 - DNA, 103 bp, Artificial Sequence
  Synthetic Polynucleotide
taatacgactcactatagggatcaatgacacttgccacagctgcttgtgtaacagaggagaacacaaatggctgtggcaaacctggcggcagcgcaaaagatg

SEQ ID NO: 236198 - DNA, 103 bp, Artificial Sequence
  Synthetic Polynucleotide
taatacgactcactatagggtggtactttcatcaatgacacttgccacagaacagaggagactgtggatggtgtcattgaacctggcggcagcgcaaaagatg

SEQ ID NO: 236199 - DNA, 103 bp, Artificial Sequence
  Synthetic Polynucleotide
taatacgactcactatagggatggatgccgtggtactttcatcaatgacaaacagaggagatgtcatatgtgaaagtacaacctggcggcagcgcaaaagatg

SEQ ID NO: 236200 - DNA, 103 bp, Artificial Sequence
  Synthetic Polynucleotide
taatacgactcactatagggtgactctaatatggatgccgtggtactttcaacagaggagagaaagtatgacggcatccaacctggcggcagcgcaaaagatg

SEQ ID NO: 236201 - DNA, 103 bp, Artificial Sequence
  Synthetic Polynucleotide
taatacgactcactatagggtcagtgcctgtgactctaatatggatgccgaacagaggagacggcatatgtattagagtaacctggcggcagcgcaaaagatg

SEQ ID NO: 236202 - DNA, 103 bp, Artificial Sequence
  Synthetic Polynucleotide
taatacgactcactatagggatctccacattcagtgcctgtgactctaataacagaggagaattagaatgacaggcactaacctggcggcagcgcaaaagatg

SEQ ID NO: 236203 - DNA, 103 bp, Artificial Sequence
  Synthetic Polynucleotide
taatacgactcactatagggattactcttaatctccacattcagtgcctgaacagaggagacaggcaatgaatgtggagaacctggcggcagcgcaaaagatg

SEQ ID NO: 236204 - DNA, 103 bp, Artificial Sequence
  Synthetic Polynucleotide
taatacgactcactatagggttttgtcatgattactcttaatctccacataacagaggagaatgtggatgttaagagtaaacctggcggcagcgcaaaagatg

SEQ ID NO: 236205 - DNA, 103 bp, Artificial Sequence
  Synthetic Polynucleotide
taatacgactcactatagggggaataacatttttgtcatgattactcttaaacagaggagataagagatgtcatgacaaaacctggcggcagcgcaaaagatg

SEQ ID NO: 236206 - DNA, 103 bp, Artificial Sequence
  Synthetic Polynucleotide
taatacgactcactatagggtgcagcaaggatctcctggtgaggcatactaacagaggagaagtatgatgcaccaggagaacctggcggcagcgcaaaagatg

SEQ ID NO: 236207 - DNA, 103 bp, Artificial Sequence
  Synthetic Polynucleotide
taatacgactcactatagggtacctcatctggaataacatttttgtcatgaacagaggagacatgacatgaatgttattaacctggcggcagcgcaaaagatg

SEQ ID NO: 236208 - DNA, 103 bp, Artificial Sequence
  Synthetic Polynucleotide
taatacgactcactataggggagtctgcagtacctcatctggaataacataacagaggagaatgttaatgcagatgaggaacctggcggcagcgcaaaagatg

SEQ ID NO: 236209 - DNA, 103 bp, Artificial Sequence
  Synthetic Polynucleotide
taatacgactcactatagggtgatccaacagagtctgcagtacctcatctaacagaggagaagatgaatgactgcagacaacctggcggcagcgcaaaagatg

SEQ ID NO: 236210 - DNA, 103 bp, Artificial Sequence
  Synthetic Polynucleotide
taatacgactcactataggggtgggaataatgatccaacagagtctgcagaacagaggagactgcagatgctgttggataacctggcggcagcgcaaaagatg

SEQ ID NO: 236211 - DNA, 103 bp, Artificial Sequence
  Synthetic Polynucleotide
taatacgactcactatagggcattagctttgtgggaataatgatccaacaaacagaggagatgttggatgattattcccaacctggcggcagcgcaaaagatg

SEQ ID NO: 236212 - DNA, 103 bp, Artificial Sequence
  Synthetic Polynucleotide
taatacgactcactatagggtcatgctgtccattagctttgtgggaataaaacagaggagattattcatgcaaagctaaaacctggcggcagcgcaaaagatg

SEQ ID NO: 236213 - DNA, 103 bp, Artificial Sequence
  Synthetic Polynucleotide
taatacgactcactataggggaaggatatctcatgctgtccattagctttaacagaggagaaaagctatgggacagcataacctggcggcagcgcaaaagatg

SEQ ID NO: 236214 - DNA, 103 bp, Artificial Sequence
  Synthetic Polynucleotide
taatacgactcactatagggctgcaacactgaaggatatctcatgctgtcaacagaggagagacagcatgagatatcctaacctggcggcagcgcaaaagatg

SEQ ID NO: 236215 - DNA, 103 bp, Artificial Sequence
  Synthetic Polynucleotide
taatacgactcactatagggacttcagtatctgcaacactgaaggatatcaacagaggagagatatcatgcagtgttgcaacctggcggcagcgcaaaagatg

SEQ ID NO: 236216 - DNA, 103 bp, Artificial Sequence
  Synthetic Polynucleotide
taatacgactcactataggggctagaagtcacttcagtatctgcaacactaacagaggagaagtgttatggatactgaaaacctggcggcagcgcaaaagatg

SEQ ID NO: 236217 - DNA, 103 bp, Artificial Sequence
  Synthetic Polynucleotide
taatacgactcactatagggacacttcatctgcagcaaggatctcctggtaacagaggagaaccaggatgtccttgctgaacctggcggcagcgcaaaagatg

SEQ ID NO: 236218 - DNA, 103 bp, Artificial Sequence
  Synthetic Polynucleotide
taatacgactcactatagggttattgatatgctagaagtcacttcagtataacagaggagaatactgatgtgacttctaaacctggcggcagcgcaaaagatg

SEQ ID NO: 236219 - DNA, 103 bp, Artificial Sequence
  Synthetic Polynucleotide
taatacgactcactatagggtctgaagaatttattgatatgctagaagtcaacagaggagagacttcatgcatatcaataacctggcggcagcgcaaaagatg

SEQ ID NO: 236220 - DNA, 103 bp, Artificial Sequence
  Synthetic Polynucleotide
taatacgactcactatagggctctggtacttctgaagaatttattgatataacagaggagaatatcaatgaattcttcaaacctggcggcagcgcaaaagatg

SEQ ID NO: 236221 - DNA, 103 bp, Artificial Sequence
  Synthetic Polynucleotide
taatacgactcactatagggacggggtgacctctggtacttctgaagaataacagaggagaattcttatgaagtaccagaacctggcggcagcgcaaaagatg

SEQ ID NO: 236222 - DNA, 103 bp, Artificial Sequence
  Synthetic Polynucleotide
taatacgactcactatagggacattctctgacggggtgacctctggtactaacagaggagaagtaccatgggtcaccccaacctggcggcagcgcaaaagatg

SEQ ID NO: 236223 - DNA, 103 bp, Artificial Sequence
  Synthetic Polynucleotide
taatacgactcactataggggcttgatccaacattctctgacggggtgacaacagaggagagtcaccatgtcagagaataacctggcggcagcgcaaaagatg

SEQ ID NO: 236224 - DNA, 103 bp, Artificial Sequence
  Synthetic Polynucleotide
taatacgactcactatagggatgcttgggagcttgatccaacattctctgaacagaggagacagagaatgttggatcaaaacctggcggcagcgcaaaagatg

SEQ ID NO: 236225 - DNA, 103 bp, Artificial Sequence
  Synthetic Polynucleotide
taatacgactcactatagggtctgatgaggatgcttgggagcttgatccaaacagaggagatggatcatgctcccaagcaacctggcggcagcgcaaaagatg

SEQ ID NO: 236226 - DNA, 103 bp, Artificial Sequence
  Synthetic Polynucleotide
taatacgactcactataggggttggctttatctgatgaggatgcttgggaaacagaggagatcccaaatgtcctcatcaaacctggcggcagcgcaaaagatg

SEQ ID NO: 236227 - DNA, 103 bp, Artificial Sequence
  Synthetic Polynucleotide
taatacgactcactatagggcctgcaacatgttggctttatctgatgaggaacagaggagacctcatatgataaagccaaacctggcggcagcgcaaaagatg

SEQ ID NO: 236228 - DNA, 103 bp, Artificial Sequence
  Synthetic Polynucleotide
taatacgactcactatagggctttcttgtaacacttcatctgcagcaaggaacagaggagaccttgcatgagatgaagtaacctggcggcagcgcaaaagatg

SEQ ID NO: 236229 - DNA, 103 bp, Artificial Sequence
  Synthetic Polynucleotide
taatacgactcactatagggttggagtattcctgcaacatgttggctttaaacagaggagataaagcatgcatgttgcaaacctggcggcagcgcaaaagatg

SEQ ID NO: 236230 - DNA, 103 bp, Artificial Sequence
  Synthetic Polynucleotide
taatacgactcactatagggctgcagaaacttggagtattcctgcaacataacagaggagaatgttgatggaatactccaacctggcggcagcgcaaaagatg

SEQ ID NO: 236231 - DNA, 103 bp, Artificial Sequence
  Synthetic Polynucleotide
taatacgactcactatagggccaaagcctgctgcagaaacttggagtattaacagaggagaaatactatgagtttctgcaacctggcggcagcgcaaaagatg

SEQ ID NO: 236232 - DNA, 103 bp, Artificial Sequence
  Synthetic Polynucleotide
taatacgactcactatagggctagttctgtccaaagcctgctgcagaaacaacagaggagagtttctatggcaggctttaacctggcggcagcgcaaaagatg

SEQ ID NO: 236233 - DNA, 103 bp, Artificial Sequence
  Synthetic Polynucleotide
taatacgactcactatagggatcattttggctagttctgtccaaagcctgaacagaggagacaggctatggacagaactaacctggcggcagcgcaaaagatg

SEQ ID NO: 236234 - DNA, 103 bp, Artificial Sequence
  Synthetic Polynucleotide
taatacgactcactatagggtcaaataggcatcattttggctagttctgtaacagaggagaacagaaatggccaaaatgaacctggcggcagcgcaaaagatg

SEQ ID NO: 236235 - DNA, 103 bp, Artificial Sequence
  Synthetic Polynucleotide
taatacgactcactatagggctcgggctattcaaataggcatcattttggaacagaggagaccaaaaatgtgcctatttaacctggcggcagcgcaaaagatg

SEQ ID NO: 236236 - DNA, 103 bp, Artificial Sequence
  Synthetic Polynucleotide
taatacgactcactatagggaaagttaaggctcgggctattcaaataggcaacagaggagagcctatatgaatagcccgaacctggcggcagcgcaaaagatg

SEQ ID NO: 236237 - DNA, 103 bp, Artificial Sequence
  Synthetic Polynucleotide
taatacgactcactatagggtatcagtcacaaagttaaggctcgggctataacagaggagaatagccatggccttaactaacctggcggcagcgcaaaagatg

SEQ ID NO: 236238 - DNA, 103 bp, Artificial Sequence
  Synthetic Polynucleotide
taatacgactcactatagggagggtctggttatcagtcacaaagttaaggaacagaggagaccttaaatgtgtgactgaaacctggcggcagcgcaaaagatg

SEQ ID NO: 236239 - DNA, 103 bp, Artificial Sequence
  Synthetic Polynucleotide
taatacgactcactatagggtctcatttcactttcttgtaacacttcatcaacagaggagagatgaaatgttacaagaaaacctggcggcagcgcaaaagatg

SEQ ID NO: 236240 - DNA, 103 bp, Artificial Sequence
  Synthetic Polynucleotide
taatacgactcactatagggctgatttgggagggtctggttatcagtcacaacagaggagagtgactatgaaccagaccaacctggcggcagcgcaaaagatg

SEQ ID NO: 236241 - DNA, 103 bp, Artificial Sequence
  Synthetic Polynucleotide
taatacgactcactatagggagaatgctggctgatttgggagggtctggtaacagaggagaaccagaatgtcccaaatcaacctggcggcagcgcaaaagatg

SEQ ID NO: 236242 - DNA, 103 bp, Artificial Sequence
  Synthetic Polynucleotide
taatacgactcactatagggtctatggaagagaatgctggctgatttgggaacagaggagacccaaaatggccagcattaacctggcggcagcgcaaaagatg

SEQ ID NO: 236243 - DNA, 103 bp, Artificial Sequence
  Synthetic Polynucleotide
taatacgactcactataggggacctgcttgtctatggaagagaatgctggaacagaggagaccagcaatgtcttccataaacctggcggcagcgcaaaagatg

SEQ ID NO: 236244 - DNA, 103 bp, Artificial Sequence
  Synthetic Polynucleotide
taatacgactcactatagggtggtggcatagacctgcttgtctatggaagaacagaggagacttccaatgacaagcaggaacctggcggcagcgcaaaagatg

SEQ ID NO: 236245 - DNA, 103 bp, Artificial Sequence
  Synthetic Polynucleotide
taatacgactcactatagggttgatgggcatggtggcatagacctgcttgaacagaggagacaagcaatgctatgccacaacctggcggcagcgcaaaagatg

SEQ ID NO: 236246 - DNA, 103 bp, Artificial Sequence
  Synthetic Polynucleotide
taatacgactcactatagggtcgaaagctattgatgggcatggtggcataaacagaggagatatgccatgatgcccatcaacctggcggcagcgcaaaagatg

SEQ ID NO: 236247 - DNA, 103 bp, Artificial Sequence
  Synthetic Polynucleotide
taatacgactcactatagggtcattcctgatcgaaagctattgatgggcaaacagaggagatgcccaatgatagctttcaacctggcggcagcgcaaaagatg

SEQ ID NO: 236248 - DNA, 103 bp, Artificial Sequence
  Synthetic Polynucleotide
taatacgactcactatagggagtggagaattcattcctgatcgaaagctaaacagaggagatagcttatgatcaggaataacctggcggcagcgcaaaagatg

SEQ ID NO: 236249 - DNA, 103 bp, Artificial Sequence
  Synthetic Polynucleotide
taatacgactcactatagggagttgttcttagtggagaattcattcctgaaacagaggagatcaggaatgaattctccaaacctggcggcagcgcaaaagatg

SEQ ID NO: 236250 - DNA, 103 bp, Artificial Sequence
  Synthetic Polynucleotide
taatacgactcactatagggatttaagaaacaatccttccagtttgtcgtaacagaggagaacgacaatgtggaaggataacctggcggcagcgcaaaagatg

SEQ ID NO: 236251 - DNA, 103 bp, Artificial Sequence
  Synthetic Polynucleotide
taatacgactcactatagggtatcctgttgtctcatttcactttcttgtaaacagaggagatacaagatggtgaaatgaaacctggcggcagcgcaaaagatg

SEQ ID NO: 236252 - DNA, 103 bp, Artificial Sequence
  Synthetic Polynucleotide
taatacgactcactatagggacttatctggagttgttcttagtggagaataacagaggagaattctcatgtaagaacaaaacctggcggcagcgcaaaagatg

SEQ ID NO: 236253 - DNA, 103 bp, Artificial Sequence
  Synthetic Polynucleotide
taatacgactcactatagggccaaagtgggacttatctggagttgttcttaacagaggagaaagaacatgtccagataaaacctggcggcagcgcaaaagatg

SEQ ID NO: 236254 - DNA, 103 bp, Artificial Sequence
  Synthetic Polynucleotide
taatacgactcactatagggaactattagtccaaagtgggacttatctggaacagaggagaccagatatgtcccactttaacctggcggcagcgcaaaagatg

SEQ ID NO: 236255 - DNA, 103 bp, Artificial Sequence
  Synthetic Polynucleotide
taatacgactcactataggggtgaatcaccaactattagtccaaagtgggaacagaggagacccactatggactaatagaacctggcggcagcgcaaaagatg

SEQ ID NO: 236256 - DNA, 103 bp, Artificial Sequence
  Synthetic Polynucleotide
taatacgactcactatagggaatgagtgctgtgaatcaccaactattagtaacagaggagaactaatatgtggtgattcaacctggcggcagcgcaaaagatg

SEQ ID NO: 236257 - DNA, 103 bp, Artificial Sequence
  Synthetic Polynucleotide
taatacgactcactatagggtgaaaagggaaatgagtgctgtgaatcaccaacagaggagaggtgatatgcagcactcaaacctggcggcagcgcaaaagatg

SEQ ID NO: 236258 - DNA, 103 bp, Artificial Sequence
  Synthetic Polynucleotide
taatacgactcactatagggtctcatcacctgaaaagggaaatgagtgctaacagaggagaagcactatgttcccttttaacctggcggcagcgcaaaagatg

SEQ ID NO: 236259 - DNA, 103 bp, Artificial Sequence
  Synthetic Polynucleotide
taatacgactcactataggggcatggtttgtctcatcacctgaaaagggaaacagaggagatcccttatgaggtgatgaaacctggcggcagcgcaaaagatg

SEQ ID NO: 236260 - DNA, 103 bp, Artificial Sequence
  Synthetic Polynucleotide
taatacgactcactatagggtgtggcagaagcatggtttgtctcatcaccaacagaggagaggtgatatgacaaaccataacctggcggcagcgcaaaagatg

SEQ ID NO: 236261 - DNA, 103 bp, Artificial Sequence
  Synthetic Polynucleotide
taatacgactcactatagggcctgtgttgatgtggcagaagcatggtttgaacagaggagacaaaccatgcttctgccaaacctggcggcagcgcaaaagatg

SEQ ID NO: 236262 - DNA, 103 bp, Artificial Sequence
  Synthetic Polynucleotide
taatacgactcactatagggtgtgatatcatatcctgttgtctcatttcaaacagaggagatgaaatatgacaacaggaaacctggcggcagcgcaaaagatg

SEQ ID NO: 236263 - DNA, 103 bp, Artificial Sequence
  Synthetic Polynucleotide
taatacgactcactatagggtccagaaagtcctgtgttgatgtggcagaaaacagaggagattctgcatgatcaacacaaacctggcggcagcgcaaaagatg

SEQ ID NO: 236264 - DNA, 103 bp, Artificial Sequence
  Synthetic Polynucleotide
taatacgactcactatagggagtcacttgatccagaaagtcctgtgttgaaacagaggagatcaacaatggactttctgaacctggcggcagcgcaaaagatg

SEQ ID NO: 236265 - DNA, 103 bp, Artificial Sequence
  Synthetic Polynucleotide
taatacgactcactatagggtcttctgagaagtcacttgatccagaaagtaacagaggagaactttcatgatcaagtgaaacctggcggcagcgcaaaagatg

SEQ ID NO: 236266 - DNA, 103 bp, Artificial Sequence
  Synthetic Polynucleotide
taatacgactcactataggggcctcagctttcttctgagaagtcacttgaaacagaggagatcaagtatgttctcagaaaacctggcggcagcgcaaaagatg

SEQ ID NO: 236267 - DNA, 103 bp, Artificial Sequence
  Synthetic Polynucleotide
taatacgactcactataggggacaggctgggcctcagctttcttctgagaaacagaggagatctcagatgaaagctgagaacctggcggcagcgcaaaagatg

SEQ ID NO: 236268 - DNA, 103 bp, Artificial Sequence
  Synthetic Polynucleotide
taatacgactcactatagggaagcttggtggacaggctgggcctcagcttaacagaggagaaagctgatgcccagcctgaacctggcggcagcgcaaaagatg

SEQ ID NO: 236269 - DNA, 103 bp, Artificial Sequence
  Synthetic Polynucleotide
taatacgactcactatagggctcatttggtaagcttggtggacaggctggaacagaggagaccagccatgccaccaagcaacctggcggcagcgcaaaagatg

SEQ ID NO: 236270 - DNA, 103 bp, Artificial Sequence
  Synthetic Polynucleotide
taatacgactcactatagggttcaaaggagctcatttggtaagcttggtgaacagaggagacaccaaatgtaccaaatgaacctggcggcagcgcaaaagatg

SEQ ID NO: 236271 - DNA, 103 bp, Artificial Sequence
  Synthetic Polynucleotide
taatacgactcactatagggggaagggctgttcaaaggagctcatttggtaacagaggagaaccaaaatggctcctttgaacctggcggcagcgcaaaagatg

SEQ ID NO: 236272 - DNA, 103 bp, Artificial Sequence
  Synthetic Polynucleotide
taatacgactcactatagggtagggagcacggaagggctgttcaaaggagaacagaggagactccttatgacagcccttaacctggcggcagcgcaaaagatg

SEQ ID NO: 236273 - DNA, 103 bp, Artificial Sequence
  Synthetic Polynucleotide
taatacgactcactataggggagttcatcatgtgatatcatatcctgttgaacagaggagacaacagatgatgatatcaaacctggcggcagcgcaaaagatg

SEQ ID NO: 236274 - DNA, 103 bp, Artificial Sequence
  Synthetic Polynucleotide
taatacgactcactatagggtgatccatgatagggagcacggaagggctgaacagaggagacagcccatgcgtgctcccaacctggcggcagcgcaaaagatg

SEQ ID NO: 236275 - DNA, 103 bp, Artificial Sequence
  Synthetic Polynucleotide
taatacgactcactatagggttccagctcttgatccatgatagggagcacaacagaggagagtgctcatgatcatggataacctggcggcagcgcaaaagatg

SEQ ID NO: 236276 - DNA, 103 bp, Artificial Sequence
  Synthetic Polynucleotide
taatacgactcactatagggtgagtagctattccagctcttgatccatgaaacagaggagatcatggatgaagagctggaacctggcggcagcgcaaaagatg

SEQ ID NO: 236277 - DNA, 103 bp, Artificial Sequence
  Synthetic Polynucleotide
taatacgactcactatagggagtgctaaattgagtagctattccagctctaacagaggagaagagctatgatagctactaacctggcggcagcgcaaaagatg

SEQ ID NO: 236278 - DNA, 103 bp, Artificial Sequence
  Synthetic Polynucleotide
taatacgactcactataggggtccattggcagtgctaaattgagtagctaaacagaggagatagctaatgaatttagcaaacctggcggcagcgcaaaagatg

SEQ ID NO: 236279 - DNA, 103 bp, Artificial Sequence
  Synthetic Polynucleotide
taatacgactcactatagggaggttcacctgtccattggcagtgctaaataacagaggagaatttagatgtgccaatggaacctggcggcagcgcaaaagatg

SEQ ID NO: 236280 - DNA, 103 bp, Artificial Sequence
  Synthetic Polynucleotide
taatacgactcactatagggtggtccccgaaggttcacctgtccattggcaacagaggagagccaatatgcaggtgaacaacctggcggcagcgcaaaagatg

SEQ ID NO: 236281 - DNA, 103 bp, Artificial Sequence
  Synthetic Polynucleotide
taatacgactcactatagggcacttgtccctggtccccgaaggttcacctaacagaggagaaggtgaatgttcggggacaacctggcggcagcgcaaaagatg

SEQ ID NO: 236282 - DNA, 103 bp, Artificial Sequence
  Synthetic Polynucleotide
taatacgactcactataggggaaaattcagcacttgtccctggtccccgaaacagaggagatcggggatgagggacaagaacctggcggcagcgcaaaagatg

SEQ ID NO: 236283 - DNA, 103 bp, Artificial Sequence
  Synthetic Polynucleotide
taatacgactcactataggggggaaattctgaaaattcagcacttgtcccaacagaggagagggacaatggctgaatttaacctggcggcagcgcaaaagatg

SEQ ID NO: 236284 - DNA, 103 bp, Artificial Sequence
  Synthetic Polynucleotide
taatacgactcactatagggcatggaccatgagttcatcatgtgatatcaaacagaggagatgatatatgatgatgaacaacctggcggcagcgcaaaagatg

SEQ ID NO: 236285 - DNA, 103 bp, Artificial Sequence
  Synthetic Polynucleotide
taatacgactcactatagggcattcaccaagggaaattctgaaaattcagaacagaggagactgaatatgcagaatttcaacctggcggcagcgcaaaagatg

SEQ ID NO: 236286 - DNA, 103 bp, Artificial Sequence
  Synthetic Polynucleotide
taatacgactcactatagggttatcatttacattcaccaagggaaattctaacagaggagaagaattatgcttggtgaaaacctggcggcagcgcaaaagatg

SEQ ID NO: 236287 - DNA, 103 bp, Artificial Sequence
  Synthetic Polynucleotide
taatacgactcactatagggcccagctctattatcatttacattcaccaaaacagaggagattggtgatggtaaatgataacctggcggcagcgcaaaagatg

SEQ ID NO: 236288 - DNA, 103 bp, Artificial Sequence
  Synthetic Polynucleotide
taatacgactcactatagggaagatgtcatcccagctctattatcatttaaacagaggagataaatgatgatagagctgaacctggcggcagcgcaaaagatg

SEQ ID NO: 236289 - DNA, 103 bp, Artificial Sequence
  Synthetic Polynucleotide
taatacgactcactataggggcatcaggtgaagatgtcatcccagctctaaacagaggagatagagcatggatgacatcaacctggcggcagcgcaaaagatg

SEQ ID NO: 236290 - DNA, 103 bp, Artificial Sequence
  Synthetic Polynucleotide
taatacgactcactataggggccagttgtggcatcaggtgaagatgtcataacagaggagaatgacaatgtcacctgataacctggcggcagcgcaaaagatg

SEQ ID NO: 236291 - DNA, 103 bp, Artificial Sequence
  Synthetic Polynucleotide
taatacgactcactatagggcaaaagtctggccagttgtggcatcaggtgaacagaggagacacctgatgccacaactgaacctggcggcagcgcaaaagatg

SEQ ID NO: 236292 - DNA, 103 bp, Artificial Sequence
  Synthetic Polynucleotide
taatacgactcactatagggactgtctcctcatggaccatgagttcatcaaacagaggagatgatgaatgcatggtccaaacctggcggcagcgcaaaagatg

SEQ ID NO: 236293 - DNA, 103 bp, Artificial Sequence
  Synthetic Polynucleotide
taatacgactcactatagggatcatttttcactgtctcctcatggaccataacagaggagaatggtcatggaggagacaaacctggcggcagcgcaaaagatg

SEQ ID NO: 236294 - DNA, 103 bp, Artificial Sequence
  Synthetic Polynucleotide
taatacgactcactatagggtctgctcttcatcatttttcactgtctcctaacagaggagaaggagaatgtgaaaaatgaacctggcggcagcgcaaaagatg

SEQ ID NO: 236295 - DNA, 103 bp, Artificial Sequence
  Synthetic Polynucleotide
taatacgactcactatagggtgtgtttccatctgctcttcatcatttttcaacagaggagagaaaaaatgtgaagagcaaacctggcggcagcgcaaaagatg

SEQ ID NO: 236296 - DNA, 103 bp, Artificial Sequence
  Synthetic Polynucleotide
taatacgactcactatagggaagtctttcatgtgtttccatctgctcttcaacagaggagagaagagatgatggaaacaaacctggcggcagcgcaaaagatg

SEQ ID NO: 236297 - DNA, 103 bp, Artificial Sequence
  Synthetic Polynucleotide
taatacgactcactataggggtccttgaggaagtctttcatgtgtttccaaacagaggagatggaaaatgatgaaagacaacctggcggcagcgcaaaagatg

SEQ ID NO: 236298 - DNA, 103 bp, Artificial Sequence
  Synthetic Polynucleotide
taatacgactcactatagggatgccgccacatttaagaaacaatccttccaacagaggagaggaaggatggtttcttaaaacctggcggcagcgcaaaagatg

SEQ ID NO: 236299 - DNA, 103 bp, Artificial Sequence
  Synthetic Polynucleotide
taatacgactcactataggggcatactgtagtccttgaggaagtctttcaaacagaggagatgaaagatgtcctcaaggaacctggcggcagcgcaaaagatg

SEQ ID NO: 236300 - DNA, 103 bp, Artificial Sequence
  Synthetic Polynucleotide
taatacgactcactataggggacattaagtgcatactgtagtccttgaggaacagaggagacctcaaatgctacagtataacctggcggcagcgcaaaagatg

SEQ ID NO: 236301 - DNA, 103 bp, Artificial Sequence
  Synthetic Polynucleotide
taatacgactcactatagggcgcttatagggacattaagtgcatactgtaaacagaggagatacagtatgcacttaatgaacctggcggcagcgcaaaagatg

SEQ ID NO: 236302 - DNA, 103 bp, Artificial Sequence
  Synthetic Polynucleotide
taatacgactcactatagggtcctgctttacgcttatagggacattaagtaacagaggagaacttaaatgccctataagaacctggcggcagcgcaaaagatg

SEQ ID NO: 236303 - DNA, 103 bp, Artificial Sequence
  Synthetic Polynucleotide
taatacgactcactatagggaaaagtaatttcctgctttacgcttataggaacagaggagacctataatggtaaagcagaacctggcggcagcgcaaaagatg

SEQ ID NO: 236304 - DNA, 103 bp, Artificial Sequence
  Synthetic Polynucleotide
taatacgactcactatagggatacatcagtaaaagtaatttcctgctttaaacagaggagataaagcatgaaattacttaacctggcggcagcgcaaaagatg

SEQ ID NO: 236305 - DNA, 103 bp, Artificial Sequence
  Synthetic Polynucleotide
taatacgactcactatagggagttgctcagatacatcagtaaaagtaattaacagaggagaaattacatgtactgatgtaacctggcggcagcgcaaaagatg

SEQ ID NO: 236306 - DNA, 103 bp, Artificial Sequence
  Synthetic Polynucleotide
taatacgactcactataggggtctctcatcagttgctcagatacatcagtaacagaggagaactgatatgtctgagcaaaacctggcggcagcgcaaaagatg

SEQ ID NO: 236307 - DNA, 103 bp, Artificial Sequence
  Synthetic Polynucleotide
taatacgactcactatagggtttgttttttgtctctcatcagttgctcagaacagaggagactgagcatgtgatgagagaacctggcggcagcgcaaaagatg

SEQ ID NO: 236308 - DNA, 103 bp, Artificial Sequence
  Synthetic Polynucleotide
taatacgactcactatagggggctctctgatttgttttttgtctctcatcaacagaggagagatgagatgcaaaaaacaaacctggcggcagcgcaaaagatg

SEQ ID NO: 236309 - DNA, 103 bp, Artificial Sequence
  Synthetic Polynucleotide
taatacgactcactatagggcatttcgtctatgccgccacatttaagaaaaacagaggagatttcttatgtgtggcggcaacctggcggcagcgcaaaagatg

SEQ ID NO: 236310 - DNA, 103 bp, Artificial Sequence
  Synthetic Polynucleotide
taatacgactcactatagggtaagtctactggctctctgatttgttttttaacagaggagaaaaaaaatgatcagagagaacctggcggcagcgcaaaagatg

SEQ ID NO: 236311 - DNA, 103 bp, Artificial Sequence
  Synthetic Polynucleotide
taatacgactcactatagggtctttttctgtaagtctactggctctctgaaacagaggagatcagagatgcagtagactaacctggcggcagcgcaaaagatg

SEQ ID NO: 236312 - DNA, 103 bp, Artificial Sequence
  Synthetic Polynucleotide
taatacgactcactatagggttccgcttcttctttttctgtaagtctactaacagaggagaagtagaatgacagaaaaaaacctggcggcagcgcaaaagatg

SEQ ID NO: 236313 - DNA, 103 bp, Artificial Sequence
  Synthetic Polynucleotide
taatacgactcactatagggagaacgttgtttccgcttcttctttttctgaacagaggagacagaaaatgaagaagcggaacctggcggcagcgcaaaagatg

SEQ ID NO: 236314 - DNA, 103 bp, Artificial Sequence
  Synthetic Polynucleotide
taatacgactcactatagggtttttgcgggagaacgttgtttccgcttctaacagaggagaagaagcatgaacaacgttaacctggcggcagcgcaaaagatg

SEQ ID NO: 236315 - DNA, 103 bp, Artificial Sequence
  Synthetic Polynucleotide
taatacgactcactatagggattgtaaggatttttgcgggagaacgttgtaacagaggagaacaacgatgtcccgcaaaaacctggcggcagcgcaaaagatg

SEQ ID NO: 236316 - DNA, 103 bp, Artificial Sequence
  Synthetic Polynucleotide
taatacgactcactatagggatcctcatttattgtaaggatttttgcgggaacagaggagacccgcaatgatccttacaaacctggcggcagcgcaaaagatg

SEQ ID NO: 236317 - DNA, 103 bp, Artificial Sequence
  Synthetic Polynucleotide
taatacgactcactatagggcaagtgatccatcctcatttattgtaaggaaacagaggagatccttaatgtaaatgaggaacctggcggcagcgcaaaagatg

SEQ ID NO: 236318 - DNA, 103 bp, Artificial Sequence
  Synthetic Polynucleotide
taatacgactcactataggggttttcaaaccaagtgatccatcctcatttaacagaggagaaaatgaatgtggatcactaacctggcggcagcgcaaaagatg

SEQ ID NO: 236319 - DNA, 103 bp, Artificial Sequence
  Synthetic Polynucleotide
taatacgactcactatagggagatttaggggttttcaaaccaagtgatccaacagaggagaggatcaatgggtttgaaaaacctggcggcagcgcaaaagatg

SEQ ID NO: 236320 - DNA, 103 bp, Artificial Sequence
  Synthetic Polynucleotide
taatacgactcactatagggtggaagactgcatttcgtctatgccgccacaacagaggagagtggcgatgtagacgaaaaacctggcggcagcgcaaaagatg

SEQ ID NO: 236321 - DNA, 103 bp, Artificial Sequence
  Synthetic Polynucleotide
taatacgactcactatagggcacaaacgtgagatttaggggttttcaaacaacagaggagagtttgaatgcccctaaataacctggcggcagcgcaaaagatg

SEQ ID NO: 236322 - DNA, 103 bp, Artificial Sequence
  Synthetic Polynucleotide
taatacgactcactatagggttgcagtgctcacaaacgtgagatttagggaacagaggagaccctaaatgtcacgtttgaacctggcggcagcgcaaaagatg

SEQ ID NO: 236323 - DNA, 103 bp, Artificial Sequence
  Synthetic Polynucleotide
taatacgactcactatagggaaaggcagcattgcagtgctcacaaacgtgaacagaggagacacgttatggagcactgcaacctggcggcagcgcaaaagatg

SEQ ID NO: 236324 - DNA, 103 bp, Artificial Sequence
  Synthetic Polynucleotide
taatacgactcactatagggagttcgttctaaaggcagcattgcagtgctaacagaggagaagcactatgatgctgcctaacctggcggcagcgcaaaagatg

SEQ ID NO: 236325 - DNA, 103 bp, Artificial Sequence
  Synthetic Polynucleotide
taatacgactcactatagggtgtaagtgatagttcgttctaaaggcagcaaacagaggagatgctgcatgtagaacgaaaacctggcggcagcgcaaaagatg

SEQ ID NO: 236326 - DNA, 103 bp, Artificial Sequence
  Synthetic Polynucleotide
taatacgactcactataggggacatgtctctgtaagtgatagttcgttctaacagaggagaagaacgatgtatcacttaaacctggcggcagcgcaaaagatg

SEQ ID NO: 236327 - DNA, 103 bp, Artificial Sequence
  Synthetic Polynucleotide
taatacgactcactatagggtatgaatgaagacatgtctctgtaagtgataacagaggagaatcactatgagagacatgaacctggcggcagcgcaaaagatg

SEQ ID NO: 236328 - DNA, 103 bp, Artificial Sequence
  Synthetic Polynucleotide
taatacgactcactatagggttttcacctgtatgaatgaagacatgtctcaacagaggagagagacaatgcttcattcaaacctggcggcagcgcaaaagatg

SEQ ID NO: 236329 - DNA, 103 bp, Artificial Sequence
  Synthetic Polynucleotide
taatacgactcactatagggttgaaatggtttttcacctgtatgaatgaaaacagaggagattcattatgacaggtgaaaacctggcggcagcgcaaaagatg

SEQ ID NO: 236330 - DNA, 103 bp, Artificial Sequence
  Synthetic Polynucleotide
taatacgactcactatagggattgactacattgaaatggtttttcacctgaacagaggagacaggtgatgaaccatttcaacctggcggcagcgcaaaagatg

SEQ ID NO: 236331 - DNA, 103 bp, Artificial Sequence
  Synthetic Polynucleotide
taatacgactcactatagggaccattgtcctggaagactgcatttcgtctaacagaggagaagacgaatggcagtcttcaacctggcggcagcgcaaaagatg

SEQ ID NO: 236332 - DNA, 103 bp, Artificial Sequence
  Synthetic Polynucleotide
taatacgactcactatagggcgcatgtcacattgactacattgaaatggtaacagaggagaaccattatgatgtagtcaaacctggcggcagcgcaaaagatg

SEQ ID NO: 236333 - DNA, 103 bp, Artificial Sequence
  Synthetic Polynucleotide
taatacgactcactatagggctgtatgaaacgcatgtcacattgactacaaacagaggagatgtagtatgtgtgacatgaacctggcggcagcgcaaaagatg

SEQ ID NO: 236334 - DNA, 103 bp, Artificial Sequence
  Synthetic Polynucleotide
taatacgactcactataggggcaggtacttctgtatgaaacgcatgtcacaacagaggagagtgacaatggtttcatacaacctggcggcagcgcaaaagatg

SEQ ID NO: 236335 - DNA, 103 bp, Artificial Sequence
  Synthetic Polynucleotide
taatacgactcactatagggtgtctctgaagcaggtacttctgtatgaaaaacagaggagatttcatatggaagtacctaacctggcggcagcgcaaaagatg

SEQ ID NO: 236336 - DNA, 103 bp, Artificial Sequence
  Synthetic Polynucleotide
taatacgactcactatagggaatcttctcatgtctctgaagcaggtacttaacagaggagaaagtacatgcttcagagaaacctggcggcagcgcaaaagatg

SEQ ID NO: 236337 - DNA, 103 bp, Artificial Sequence
  Synthetic Polynucleotide
taatacgactcactatagggcaccagtatgaatcttctcatgtctctgaaaacagaggagattcagaatgatgagaagaaacctggcggcagcgcaaaagatg

SEQ ID NO: 236338 - DNA, 103 bp, Artificial Sequence
  Synthetic Polynucleotide
taatacgactcactatagggaatggtttttcaccagtatgaatcttctcaaacagaggagatgagaaatgtcatactggaacctggcggcagcgcaaaagatg

SEQ ID NO: 236339 - DNA, 103 bp, Artificial Sequence
  Synthetic Polynucleotide
taatacgactcactatagggatcacagcgaaatggtttttcaccagtatgaacagaggagacatactatggaaaaaccaaacctggcggcagcgcaaaagatg

SEQ ID NO: 236340 - DNA, 103 bp, Artificial Sequence
  Synthetic Polynucleotide
taatacgactcactatagggtaccacattcatcacagcgaaatggtttttaacagaggagaaaaaacatgttcgctgtgaacctggcggcagcgcaaaagatg

SEQ ID NO: 236341 - DNA, 103 bp, Artificial Sequence
  Synthetic Polynucleotide
taatacgactcactatagggatgaatctcataccacattcatcacagcgaaacagaggagatcgctgatgtgaatgtggaacctggcggcagcgcaaaagatg

SEQ ID NO: 236342 - DNA, 103 bp, Artificial Sequence
  Synthetic Polynucleotide
taatacgactcactatagggacccattacaaccattgtcctggaagactgaacagaggagacagtctatgaggacaatgaacctggcggcagcgcaaaagatg

SEQ ID NO: 236343 - DNA, 103 bp, Artificial Sequence
  Synthetic Polynucleotide
taatacgactcactatagggatatttttgtatgaatctcataccacattcaacagaggagagaatgtatgatgagattcaacctggcggcagcgcaaaagatg

SEQ ID NO: 236344 - DNA, 103 bp, Artificial Sequence
  Synthetic Polynucleotide
taatacgactcactatagggtttccatatgatatttttgtatgaatctcaaacagaggagatgagatatgtacaaaaataacctggcggcagcgcaaaagatg

SEQ ID NO: 236345 - DNA, 103 bp, Artificial Sequence
  Synthetic Polynucleotide
taatacgactcactatagggctcttatgcctttccatatgatatttttgtaacagaggagaacaaaaatgtcatatggaaacctggcggcagcgcaaaagatg

SEQ ID NO: 236346 - DNA, 103 bp, Artificial Sequence
  Synthetic Polynucleotide
taatacgactcactatagggactatgagttctcttatgcctttccatatgaacagaggagacatatgatgaggcataagaacctggcggcagcgcaaaagatg

SEQ ID NO: 236347 - DNA, 103 bp, Artificial Sequence
  Synthetic Polynucleotide
taatacgactcactataggggtttttctccactatgagttctcttatgccaacagaggagaggcataatggaactcataaacctggcggcagcgcaaaagatg

SEQ ID NO: 236348 - DNA, 103 bp, Artificial Sequence
  Synthetic Polynucleotide
taatacgactcactatagggcactggtaaggtttttctccactatgagttaacagaggagaaactcaatgtggagaaaaaacctggcggcagcgcaaaagatg

SEQ ID NO: 236349 - DNA, 103 bp, Artificial Sequence
  Synthetic Polynucleotide
taatacgactcactatagggacagtattcacactggtaaggtttttctccaacagaggagaggagaaatgccttaccagaacctggcggcagcgcaaaagatg

SEQ ID NO: 236350 - DNA, 103 bp, Artificial Sequence
  Synthetic Polynucleotide
taatacgactcactatagggaatactgtaaacagtattcacactggtaagaacagaggagacttaccatggtgaatactaacctggcggcagcgcaaaagatg

SEQ ID NO: 236351 - DNA, 103 bp, Artificial Sequence
  Synthetic Polynucleotide
taatacgactcactataggggttctggaaaaatactgtaaacagtattcaaacagaggagatgaataatgtttacagtaaacctggcggcagcgcaaaagatg

SEQ ID NO: 236352 - DNA, 103 bp, Artificial Sequence
  Synthetic Polynucleotide
taatacgactcactatagggtacacgatctgttctggaaaaatactgtaaaacagaggagattacagatgttttccagaaacctggcggcagcgcaaaagatg

SEQ ID NO: 236353 - DNA, 103 bp, Artificial Sequence
  Synthetic Polynucleotide
taatacgactcactatagggcagacactccacccattacaaccattgtccaacagaggagaggacaaatgttgtaatggaacctggcggcagcgcaaaagatg

SEQ ID NO: 236354 - DNA, 103 bp, Artificial Sequence
  Synthetic Polynucleotide
taatacgactcactatagggtatgtttcaatacacgatctgttctggaaaaacagaggagatttccaatgcagatcgtgaacctggcggcagcgcaaaagatg

SEQ ID NO: 236355 - DNA, 103 bp, Artificial Sequence
  Synthetic Polynucleotide
taatacgactcactatagggcacatacgtttatgtttcaatacacgatctaacagaggagaagatcgatgattgaaacaaacctggcggcagcgcaaaagatg

SEQ ID NO: 236356 - DNA, 103 bp, Artificial Sequence
  Synthetic Polynucleotide
taatacgactcactatagggattttcatggcacatacgtttatgtttcaaaacagaggagattgaaaatgaaacgtatgaacctggcggcagcgcaaaagatg

SEQ ID NO: 236357 - DNA, 103 bp, Artificial Sequence
  Synthetic Polynucleotide
taatacgactcactatagggttttgtcatgattttcatggcacatacgttaacagaggagaaacgtaatggccatgaaaaacctggcggcagcgcaaaagatg

SEQ ID NO: 236358 - DNA, 103 bp, Artificial Sequence
  Synthetic Polynucleotide
taatacgactcactatagggctatttagttttttgtcatgattttcatggaacagaggagaccatgaatgtcatgacaaaacctggcggcagcgcaaaagatg

SEQ ID NO: 236359 - DNA, 103 bp, Artificial Sequence
  Synthetic Polynucleotide
taatacgactcactataggggatggcacatctatttagttttttgtcatgaacagaggagacatgacatgaaactaaataacctggcggcagcgcaaaagatg

SEQ ID NO: 236360 - DNA, 103 bp, Artificial Sequence
  Synthetic Polynucleotide
taatacgactcactatagggggccacctttgatggcacatctatttagttaacagaggagaaactaaatggatgtgccaaacctggcggcagcgcaaaagatg

SEQ ID NO: 236361 - DNA, 103 bp, Artificial Sequence
  Synthetic Polynucleotide
taatacgactcactataggggatgtcagaaggccacctttgatggcacataacagaggagaatgtgcatgcaaaggtggaacctggcggcagcgcaaaagatg

SEQ ID NO: 236362 - DNA, 103 bp, Artificial Sequence
  Synthetic Polynucleotide
taatacgactcactatagggatcttcctcagatgtcagaaggccacctttaacagaggagaaaaggtatgcttctgacaaacctggcggcagcgcaaaagatg

SEQ ID NO: 236363 - DNA, 103 bp, Artificial Sequence
  Synthetic Polynucleotide
taatacgactcactatagggaaaagccagaatcttcctcagatgtcagaaaacagaggagattctgaatgctgaggaagaacctggcggcagcgcaaaagatg

SEQ ID NO: 236364 - DNA, 103 bp, Artificial Sequence
  Synthetic Polynucleotide
taatacgactcactataggggtagactggccagacactccacccattacaaacagaggagatgtaatatgtggagtgtcaacctggcggcagcgcaaaagatg

SEQ ID NO: 236365 - DNA, 103 bp, Artificial Sequence
  Synthetic Polynucleotide
taatacgactcactatagggggtgatgtagaaaagccagaatcttcctcaaacagaggagatgaggaatgttctggcttaacctggcggcagcgcaaaagatg

SEQ ID NO: 236366 - DNA, 103 bp, Artificial Sequence
  Synthetic Polynucleotide
taatacgactcactataggggttgtcttttggtgatgtagaaaagccagaaacagaggagatctggcatgtctacatcaaacctggcggcagcgcaaaagatg

SEQ ID NO: 236367 - DNA, 103 bp, Artificial Sequence
  Synthetic Polynucleotide
taatacgactcactatagggttggcagtgagttgtcttttggtgatgtagaacagaggagactacatatgcaaaagacaaacctggcggcagcgcaaaagatg

SEQ ID NO: 236368 - DNA, 103 bp, Artificial Sequence
  Synthetic Polynucleotide
taatacgactcactatagggcttttcttttttggcagtgagttgtcttttaacagaggagaaaaagaatgctcactgccaacctggcggcagcgcaaaagatg

SEQ ID NO: 236369 - DNA, 103 bp, Artificial Sequence
  Synthetic Polynucleotide
taatacgactcactatagggcgttttctgccttttcttttttggcagtgaaacagaggagatcactgatgaaaaagaaaaacctggcggcagcgcaaaagatg

SEQ ID NO: 236370 - DNA, 103 bp, Artificial Sequence
  Synthetic Polynucleotide
taatacgactcactatagggattttttctccgttttctgccttttcttttaacagaggagaaaaagaatgggcagaaaaaacctggcggcagcgcaaaagatg

SEQ ID NO: 236371 - DNA, 103 bp, Artificial Sequence
  Synthetic Polynucleotide
taatacgactcactatagggattccagatgattttttctccgttttctgcaacagaggagagcagaaatgggagaaaaaaacctggcggcagcgcaaaagatg

SEQ ID NO: 236372 - DNA, 103 bp, Artificial Sequence
  Synthetic Polynucleotide
taatacgactcactatagggctctttgtccattccagatgattttttctcaacagaggagagagaaaatgtcatctggaaacctggcggcagcgcaaaagatg

SEQ ID NO: 236373 - DNA, 103 bp, Artificial Sequence
  Synthetic Polynucleotide
taatacgactcactatagggccaaagcactctctttgtccattccagatgaacagaggagacatctgatgtggacaaagaacctggcggcagcgcaaaagatg

SEQ ID NO: 236374 - DNA, 103 bp, Artificial Sequence
  Synthetic Polynucleotide
taatacgactcactatagggtcagatttgtccaaagcactctctttgtccaacagaggagaggacaaatggagtgctttaacctggcggcagcgcaaaagatg

SEQ ID NO: 236375 - DNA, 103 bp, Artificial Sequence
  Synthetic Polynucleotide
taatacgactcactataggggcttaaagttatctccattttagctgccataacagaggagaatggcaatgaaaatggagaacctggcggcagcgcaaaagatg

SEQ ID NO: 236376 - DNA, 103 bp, Artificial Sequence
  Synthetic Polynucleotide
taatacgactcactatagggtgggcagtttttttgcagaggagggccccgaacagaggagacggggcatgcctctgcaaaacctggcggcagcgcaaaagatg

SEQ ID NO: 236377 - DNA, 103 bp, Artificial Sequence
  Synthetic Polynucleotide
taatacgactcactatagggctctgaattccacgtgaagcttttcccacaaacagaggagatgtgggatgagcttcacgaacctggcggcagcgcaaaagatg

SEQ ID NO: 236378 - DNA, 103 bp, Artificial Sequence
  Synthetic Polynucleotide
taatacgactcactataggggtctcttcagctctgaattccacgtgaagcaacagaggagagcttcaatgggaattcagaacctggcggcagcgcaaaagatg

SEQ ID NO: 236379 - DNA, 103 bp, Artificial Sequence
  Synthetic Polynucleotide
taatacgactcactatagggactctcttgtgtctcttcagctctgaattcaacagaggagagaattcatggctgaagagaacctggcggcagcgcaaaagatg

SEQ ID NO: 236380 - DNA, 103 bp, Artificial Sequence
  Synthetic Polynucleotide
taatacgactcactatagggtcctgtgtggactctcttgtgtctcttcagaacagaggagactgaagatgcacaagagaaacctggcggcagcgcaaaagatg

SEQ ID NO: 236381 - DNA, 103 bp, Artificial Sequence
  Synthetic Polynucleotide
taatacgactcactatagggagggtctctctcctgtgtggactctcttgtaacagaggagaacaagaatgtccacacagaacctggcggcagcgcaaaagatg

SEQ ID NO: 236382 - DNA, 103 bp, Artificial Sequence
  Synthetic Polynucleotide
taatacgactcactatagggccgcacgtgtagggtctctctcctgtgtggaacagaggagaccacacatgagagagaccaacctggcggcagcgcaaaagatg

SEQ ID NO: 236383 - DNA, 103 bp, Artificial Sequence
  Synthetic Polynucleotide
taatacgactcactatagggtccacactctccgcacgtgtagggtctctcaacagaggagagagagaatgtacacgtgcaacctggcggcagcgcaaaagatg

SEQ ID NO: 236384 - DNA, 103 bp, Artificial Sequence
  Synthetic Polynucleotide
taatacgactcactatagggcaaagcagtttccacactctccgcacgtgtaacagaggagaacacgtatggagagtgtgaacctggcggcagcgcaaaagatg

SEQ ID NO: 236385 - DNA, 103 bp, Artificial Sequence
  Synthetic Polynucleotide
taatacgactcactataggggactgccgcccaaagcagtttccacactctaacagaggagaagagtgatgaaactgcttaacctggcggcagcgcaaaagatg

SEQ ID NO: 236386 - DNA, 103 bp, Artificial Sequence
  Synthetic Polynucleotide
taatacgactcactatagggcttcagggttgactgccgcccaaagcagttaacagaggagaaactgcatggggcggcagaacctggcggcagcgcaaaagatg

SEQ ID NO: 236387 - DNA, 103 bp, Artificial Sequence
  Synthetic Polynucleotide
taatacgactcactataggggctcaggatctgggcagtttttttgcagagaacagaggagactctgcatgaaaactgccaacctggcggcagcgcaaaagatg

SEQ ID NO: 236388 - DNA, 103 bp, Artificial Sequence
  Synthetic Polynucleotide
taatacgactcactatagggtctggtgcagcttcagggttgactgccgccaacagaggagaggcggcatgcaaccctgaaacctggcggcagcgcaaaagatg

SEQ ID NO: 236389 - DNA, 103 bp, Artificial Sequence
  Synthetic Polynucleotide
taatacgactcactataggggtgtggatcctctggtgcagcttcagggttaacagaggagaaaccctatggctgcaccaaacctggcggcagcgcaaaagatg

SEQ ID NO: 236390 - DNA, 103 bp, Artificial Sequence
  Synthetic Polynucleotide
taatacgactcactatagggcttctctccagtgtggatcctctggtgcagaacagaggagactgcacatgaggatccacaacctggcggcagcgcaaaagatg

SEQ ID NO: 236391 - DNA, 103 bp, Artificial Sequence
  Synthetic Polynucleotide
taatacgactcactatagggactggtatggcttctctccagtgtggatccaacagaggagaggatccatgctggagagaaacctggcggcagcgcaaaagatg

SEQ ID NO: 236392 - DNA, 103 bp, Artificial Sequence
  Synthetic Polynucleotide
taatacgactcactatagggcactggccacactggtatggcttctctccaaacagaggagatggagaatggccataccaaacctggcggcagcgcaaaagatg

SEQ ID NO: 236393 - DNA, 103 bp, Artificial Sequence
  Synthetic Polynucleotide
taatacgactcactataggggcttttcccacactggccacactggtatggaacagaggagaccatacatgtgtggccagaacctggcggcagcgcaaaagatg

SEQ ID NO: 236394 - DNA, 103 bp, Artificial Sequence
  Synthetic Polynucleotide
taatacgactcactatagggtctggcgaaagcttttcccacactggccacaacagaggagagtggccatggtgggaaaaaacctggcggcagcgcaaaagatg

SEQ ID NO: 236395 - DNA, 103 bp, Artificial Sequence
  Synthetic Polynucleotide
taatacgactcactatagggaggtttgagctctggcgaaagcttttcccaaacagaggagatgggaaatgctttcgccaaacctggcggcagcgcaaaagatg

SEQ ID NO: 236396 - DNA, 103 bp, Artificial Sequence
  Synthetic Polynucleotide
taatacgactcactatagggatgctggtgaaggtttgagctctggcgaaaaacagaggagatttcgcatgagctcaaacaacctggcggcagcgcaaaagatg

SEQ ID NO: 236397 - DNA, 103 bp, Artificial Sequence
  Synthetic Polynucleotide
taatacgactcactataggggaagtcggtgatgctggtgaaggtttgagcaacagaggagagctcaaatgttcaccagcaacctggcggcagcgcaaaagatg

SEQ ID NO: 236398 - DNA, 103 bp, Artificial Sequence
  Synthetic Polynucleotide
taatacgactcactatagggtggcggcagagctcaggatctgggcagtttaacagaggagaaaactgatgagatcctgaaacctggcggcagcgcaaaagatg

SEQ ID NO: 236399 - DNA, 103 bp, Artificial Sequence
  Synthetic Polynucleotide
taatacgactcactatagggtccccatggtgaagtcggtgatgctggtgaaacagaggagatcaccaatgtcaccgactaacctggcggcagcgcaaaagatg

SEQ ID NO: 236400 - DNA, 103 bp, Artificial Sequence
  Synthetic Polynucleotide
taatacgactcactatagggtctgaagctctggcggcagagctcaggatcaacagaggagagatcctatgctctgccgcaacctggcggcagcgcaaaagatg

SEQ ID NO: 236401 - DNA, 103 bp, Artificial Sequence
  Synthetic Polynucleotide
taatacgactcactatagggaacaaaagcgtctgaagctctggcggcagaaacagaggagatctgccatgagagcttcaaacctggcggcagcgcaaaagatg

SEQ ID NO: 236402 - DNA, 103 bp, Artificial Sequence
  Synthetic Polynucleotide
taatacgactcactatagggacctcttgataacaaaagcgtctgaagctcaacagaggagagagcttatgacgcttttgaacctggcggcagcgcaaaagatg

SEQ ID NO: 236403 - DNA, 103 bp, Artificial Sequence
  Synthetic Polynucleotide
taatacgactcactataggggggtccagacacctcttgataacaaaagcgaacagaggagacgctttatgtatcaagagaacctggcggcagcgcaaaagatg

SEQ ID NO: 236404 - DNA, 103 bp, Artificial Sequence
  Synthetic Polynucleotide
taatacgactcactataggggagcctcttggggtccagacacctcttgataacagaggagaatcaagatgtgtctggacaacctggcggcagcgcaaaagatg

SEQ ID NO: 236405 - DNA, 103 bp, Artificial Sequence
  Synthetic Polynucleotide
taatacgactcactatagggagctgggagagagcctcttggggtccagacaacagaggagagtctggatgccaagaggcaacctggcggcagcgcaaaagatg

SEQ ID NO: 236406 - DNA, 103 bp, Artificial Sequence
  Synthetic Polynucleotide
taatacgactcactataggggagctgtcggagctgggagagagcctcttgaacagaggagacaagagatgctctcccagaacctggcggcagcgcaaaagatg

SEQ ID NO: 236407 - DNA, 103 bp, Artificial Sequence
  Synthetic Polynucleotide
taatacgactcactatagggcagtgttggagcttaaagttatctccatttaacagaggagaaaatggatgtaactttaaaacctggcggcagcgcaaaagatg

SEQ ID NO: 236408 - DNA, 103 bp, Artificial Sequence
  Synthetic Polynucleotide
taatacgactcactatagggactgacggcagagctgtcggagctgggagaaacagaggagatctcccatgtccgacagcaacctggcggcagcgcaaaagatg

SEQ ID NO: 236409 - DNA, 103 bp, Artificial Sequence
  Synthetic Polynucleotide
taatacgactcactatagggggttgcaaccactgacggcagagctgtcggaacagaggagaccgacaatgctgccgtcaaacctggcggcagcgcaaaagatg

SEQ ID NO: 236410 - DNA, 103 bp, Artificial Sequence
  Synthetic Polynucleotide
taatacgactcactataggggtgcagctcgggttgcaaccactgacggcaaacagaggagatgccgtatgtggttgcaaaacctggcggcagcgcaaaagatg

SEQ ID NO: 236411 - DNA, 103 bp, Artificial Sequence
  Synthetic Polynucleotide
taatacgactcactataggggctccttggtgtgcagctcgggttgcaaccaacagaggagaggttgcatgccgagctgcaacctggcggcagcgcaaaagatg

SEQ ID NO: 236412 - DNA, 103 bp, Artificial Sequence
  Synthetic Polynucleotide
taatacgactcactatagggtccaaaatctgctccttggtgtgcagctcgaacagaggagacgagctatgcaccaaggaaacctggcggcagcgcaaaagatg

SEQ ID NO: 236413 - DNA, 103 bp, Artificial Sequence
  Synthetic Polynucleotide
taatacgactcactatagggcaccagaagctccaaaatctgctccttggtaacagaggagaaccaagatgcagattttgaacctggcggcagcgcaaaagatg

SEQ ID NO: 236414 - DNA, 103 bp, Artificial Sequence
  Synthetic Polynucleotide
taatacgactcactatagggactgctccatcaccagaagctccaaaatctaacagaggagaagatttatgagcttctggaacctggcggcagcgcaaaagatg

SEQ ID NO: 236415 - DNA, 103 bp, Artificial Sequence
  Synthetic Polynucleotide
taatacgactcactatagggatggtcaggaactgctccatcaccagaagcaacagaggagagcttctatggatggagcaaacctggcggcagcgcaaaagatg

SEQ ID NO: 236416 - DNA, 103 bp, Artificial Sequence
  Synthetic Polynucleotide
taatacgactcactatagggcgggggcaggatggtcaggaactgctccataacagaggagaatggagatgttcctgaccaacctggcggcagcgcaaaagatg

SEQ ID NO: 236417 - DNA, 103 bp, Artificial Sequence
  Synthetic Polynucleotide
taatacgactcactatagggcctggatctccgggggcaggatggtcaggaaacagaggagatcctgaatgtcctgccccaacctggcggcagcgcaaaagatg

SEQ ID NO: 236418 - DNA, 103 bp, Artificial Sequence
  Synthetic Polynucleotide
taatacgactcactataggggaggaagcttcagtgttggagcttaaagttaacagaggagaaactttatgctccaacacaacctggcggcagcgcaaaagatg

SEQ ID NO: 236419 - DNA, 103 bp, Artificial Sequence
  Synthetic Polynucleotide
taatacgactcactatagggctgacccgagcctggatctccgggggcaggaacagaggagacctgccatgggagatccaaacctggcggcagcgcaaaagatg

SEQ ID NO: 236420 - DNA, 103 bp, Artificial Sequence
  Synthetic Polynucleotide
taatacgactcactatagggacatcgatgcctgacccgagcctggatctcaacagaggagagagatcatggctcgggtcaacctggcggcagcgcaaaagatg

SEQ ID NO: 236421 - DNA, 103 bp, Artificial Sequence
  Synthetic Polynucleotide
taatacgactcactatagggtgctcattggacatcgatgcctgacccgagaacagaggagactcgggatgggcatcgataacctggcggcagcgcaaaagatg

SEQ ID NO: 236422 - DNA, 103 bp, Artificial Sequence
  Synthetic Polynucleotide
taatacgactcactatagggatctccttgctgctcattggacatcgatgcaacagaggagagcatcgatgtccaatgagaacctggcggcagcgcaaaagatg

SEQ ID NO: 236423 - DNA, 103 bp, Artificial Sequence
  Synthetic Polynucleotide
taatacgactcactataggggagggtcacaatctccttgctgctcattggaacagaggagaccaatgatgagcaaggagaacctggcggcagcgcaaaagatg

SEQ ID NO: 236424 - DNA, 103 bp, Artificial Sequence
  Synthetic Polynucleotide
taatacgactcactatagggaatcttccacgagggtcacaatctccttgcaacagaggagagcaaggatgttgtgacccaacctggcggcagcgcaaaagatg

SEQ ID NO: 236425 - DNA, 103 bp, Artificial Sequence
  Synthetic Polynucleotide
taatacgactcactataggggctctgtgaaaatcttccacgagggtcacaaacagaggagatgtgacatgcgtggaagaaacctggcggcagcgcaaaagatg

SEQ ID NO: 236426 - DNA, 103 bp, Artificial Sequence
  Synthetic Polynucleotide
taatacgactcactatagggtttcttggatgctctgtgaaaatcttccacaacagaggagagtggaaatgtttcacagaaacctggcggcagcgcaaaagatg

SEQ ID NO: 236427 - DNA, 103 bp, Artificial Sequence
  Synthetic Polynucleotide
taatacgactcactatagggactgctttggtttcttggatgctctgtgaaaacagaggagattcacaatgcatccaagaaacctggcggcagcgcaaaagatg

SEQ ID NO: 236428 - DNA, 103 bp, Artificial Sequence
  Synthetic Polynucleotide
taatacgactcactatagggacggccacccactgctttggtttcttggataacagaggagaatccaaatgaccaaagcaaacctggcggcagcgcaaaagatg

SEQ ID NO: 236429 - DNA, 103 bp, Artificial Sequence
  Synthetic Polynucleotide
taatacgactcactatagggctcttgcttggaggaagcttcagtgttggaaacagaggagatccaacatggaagcttccaacctggcggcagcgcaaaagatg

SEQ ID NO: 236430 - DNA, 103 bp, Artificial Sequence
  Synthetic Polynucleotide
taatacgactcactatagggctgcatacaaacggccacccactgctttggaacagaggagaccaaagatgtgggtggccaacctggcggcagcgcaaaagatg

SEQ ID NO: 236431 - DNA, 103 bp, Artificial Sequence
  Synthetic Polynucleotide
taatacgactcactatagggccttttgcccctgcatacaaacggccacccaacagaggagagggtggatgtttgtatgcaacctggcggcagcgcaaaagatg

SEQ ID NO: 236432 - DNA, 103 bp, Artificial Sequence
  Synthetic Polynucleotide
taatacgactcactatagggtccaagagcaccttttgcccctgcatacaaaacagaggagattgtatatgggggcaaaaaacctggcggcagcgcaaaagatg

SEQ ID NO: 236433 - DNA, 103 bp, Artificial Sequence
  Synthetic Polynucleotide
taatacgactcactatagggtccagttttctccaagagcaccttttgcccaacagaggagagggcaaatggtgctcttgaacctggcggcagcgcaaaagatg

SEQ ID NO: 236434 - DNA, 103 bp, Artificial Sequence
  Synthetic Polynucleotide
taatacgactcactatagggcaagctgagatccagttttctccaagagcaaacagaggagatgctctatgagaaaactgaacctggcggcagcgcaaaagatg

SEQ ID NO: 236435 - DNA, 103 bp, Artificial Sequence
  Synthetic Polynucleotide
taatacgactcactatagggtcctgttctccaagctgagatccagttttcaacagaggagagaaaacatgatctcagctaacctggcggcagcgcaaaagatg

SEQ ID NO: 236436 - DNA, 103 bp, Artificial Sequence
  Synthetic Polynucleotide
taatacgactcactataggggtctggcagttcctgttctccaagctgagaaacagaggagatctcagatgggagaacagaacctggcggcagcgcaaaagatg

SEQ ID NO: 236437 - DNA, 103 bp, Artificial Sequence
  Synthetic Polynucleotide
taatacgactcactataggggcggttgaaagtctggcagttcctgttctcaacagaggagagagaacatgaactgccagaacctggcggcagcgcaaaagatg

SEQ ID NO: 236438 - DNA, 103 bp, Artificial Sequence
  Synthetic Polynucleotide
taatacgactcactatagggctaggagtctgcggttgaaagtctggcagtaacagaggagaactgccatgctttcaaccaacctggcggcagcgcaaaagatg

SEQ ID NO: 236439 - DNA, 103 bp, Artificial Sequence
  Synthetic Polynucleotide
taatacgactcactataggggagatctctcctaggagtctgcggttgaaaaacagaggagatttcaaatgcagactcctaacctggcggcagcgcaaaagatg

SEQ ID NO: 236440 - DNA, 103 bp, Artificial Sequence
  Synthetic Polynucleotide
taatacgactcactatagggttatgtgtctctcttgcttggaggaagcttaacagaggagaaagcttatgccaagcaagaacctggcggcagcgcaaaagatg

SEQ ID NO: 236441 - DNA, 103 bp, Artificial Sequence
  Synthetic Polynucleotide
taatacgactcactatagggagctctccctgagatctctcctaggagtctaacagaggagaagactcatgggagagatcaacctggcggcagcgcaaaagatg

SEQ ID NO: 236442 - DNA, 103 bp, Artificial Sequence
  Synthetic Polynucleotide
taatacgactcactatagggtctgctggagagctctccctgagatctctcaacagaggagagagagaatgcagggagagaacctggcggcagcgcaaaagatg

SEQ ID NO: 236443 - DNA, 103 bp, Artificial Sequence
  Synthetic Polynucleotide
taatacgactcactatagggctgggaaggctctgctggagagctctccctaacagaggagaagggagatgtctccagcaaacctggcggcagcgcaaaagatg

SEQ ID NO: 236444 - DNA, 103 bp, Artificial Sequence
  Synthetic Polynucleotide
taatacgactcactatagggaagctcctgcctgggaaggctctgctggagaacagaggagactccagatgagccttcccaacctggcggcagcgcaaaagatg

SEQ ID NO: 236445 - DNA, 103 bp, Artificial Sequence
  Synthetic Polynucleotide
taatacgactcactatagggagccggtcataagctcctgcctgggaaggcaacagaggagagccttcatgggcaggagcaacctggcggcagcgcaaaagatg

SEQ ID NO: 236446 - DNA, 103 bp, Artificial Sequence
  Synthetic Polynucleotide
taatacgactcactatagggatgggggctcagccggtcataagctcctgcaacagaggagagcaggaatgtatgaccggaacctggcggcagcgcaaaagatg

SEQ ID NO: 236447 - DNA, 103 bp, Artificial Sequence
  Synthetic Polynucleotide
taatacgactcactatagggtctcccaatgatgggggctcagccggtcataacagaggagaatgaccatgtgagcccccaacctggcggcagcgcaaaagatg

SEQ ID NO: 236448 - DNA, 103 bp, Artificial Sequence
  Synthetic Polynucleotide
taatacgactcactatagggagtggggatttctcccaatgatgggggctcaacagaggagagagcccatgtcattgggaaacctggcggcagcgcaaaagatg

SEQ ID NO: 236449 - DNA, 103 bp, Artificial Sequence
  Synthetic Polynucleotide
taatacgactcactatagggttcttggaggagtggggatttctcccaatgaacagaggagacattggatgaaatccccaaacctggcggcagcgcaaaagatg

SEQ ID NO: 236450 - DNA, 103 bp, Artificial Sequence
  Synthetic Polynucleotide
taatacgactcactatagggtgggggttggttcttggaggagtggggattaacagaggagaaatcccatgtcctccaagaacctggcggcagcgcaaaagatg

SEQ ID NO: 236451 - DNA, 103 bp, Artificial Sequence
  Synthetic Polynucleotide
taatacgactcactatagggagtttggctattatgtgtctctcttgcttgaacagaggagacaagcaatggagacacataacctggcggcagcgcaaaagatg

SEQ ID NO: 236452 - DNA, 103 bp, Artificial Sequence
  Synthetic Polynucleotide
taatacgactcactatagggccagccaatttgggggttggttcttggaggaacagaggagacctccaatgaccaaccccaacctggcggcagcgcaaaagatg

SEQ ID NO: 236453 - DNA, 103 bp, Artificial Sequence
  Synthetic Polynucleotide
taatacgactcactatagggggcctctgtcccagccaatttgggggttggaacagaggagaccaaccatgaaattggctaacctggcggcagcgcaaaagatg

SEQ ID NO: 236454 - DNA, 103 bp, Artificial Sequence
  Synthetic Polynucleotide
taatacgactcactatagggtcattctgggggcctctgtcccagccaattaacagaggagaaattggatgggacagaggaacctggcggcagcgcaaaagatg

SEQ ID NO: 236455 - DNA, 103 bp, Artificial Sequence
  Synthetic Polynucleotide
taatacgactcactatagggttgtcacttctcattctgggggcctctgtcaacagaggagagacagaatgccccagaataacctggcggcagcgcaaaagatg

SEQ ID NO: 236456 - DNA, 103 bp, Artificial Sequence
  Synthetic Polynucleotide
taatacgactcactatagggattttccttgttgtcacttctcattctgggaacagaggagacccagaatgagaagtgacaacctggcggcagcgcaaaagatg

SEQ ID NO: 236457 - DNA, 103 bp, Artificial Sequence
  Synthetic Polynucleotide
taatacgactcactatagggcctgttgtggattttccttgttgtcacttcaacagaggagagaagtgatgacaaggaaaaacctggcggcagcgcaaaagatg

SEQ ID NO: 236458 - DNA, 103 bp, Artificial Sequence
  Synthetic Polynucleotide
taatacgactcactatagggttagccccttcctgttgtggattttccttgaacagaggagacaaggaatgtccacaacaaacctggcggcagcgcaaaagatg

SEQ ID NO: 236459 - DNA, 103 bp, Artificial Sequence
  Synthetic Polynucleotide
taatacgactcactatagggctttgctcctttagccccttcctgttgtggaacagaggagaccacaaatggaaggggctaacctggcggcagcgcaaaagatg

SEQ ID NO: 236460 - DNA, 103 bp, Artificial Sequence
  Synthetic Polynucleotide
taatacgactcactatagggctgcacatggctttgctcctttagccccttaacagaggagaaaggggatgaaggagcaaaacctggcggcagcgcaaaagatg

SEQ ID NO: 236461 - DNA, 103 bp, Artificial Sequence
  Synthetic Polynucleotide
taatacgactcactatagggccagctgacactgcacatggctttgctcctaacagaggagaaggagcatggccatgtgcaacctggcggcagcgcaaaagatg

SEQ ID NO: 236462 - DNA, 103 bp, Artificial Sequence
  Synthetic Polynucleotide
taatacgactcactatagggtttctcttctagtttggctattatgtgtctaacagaggagaagacacatgatagccaaaaacctggcggcagcgcaaaagatg

SEQ ID NO: 236463 - DNA, 103 bp, Artificial Sequence
  Synthetic Polynucleotide
taatacgactcactatagggtttggatctgccagctgacactgcacatggaacagaggagaccatgtatggtgtcagctaacctggcggcagcgcaaaagatg

SEQ ID NO: 236464 - DNA, 103 bp, Artificial Sequence
  Synthetic Polynucleotide
taatacgactcactataggggaccattccctttggatctgccagctgacaaacagaggagatgtcagatggcagatccaaacctggcggcagcgcaaaagatg

SEQ ID NO: 236465 - DNA, 103 bp, Artificial Sequence
  Synthetic Polynucleotide
taatacgactcactatagggggattctgcagaccattccctttggatctgaacagaggagacagatcatgagggaatggaacctggcggcagcgcaaaagatg

SEQ ID NO: 236466 - DNA, 103 bp, Artificial Sequence
  Synthetic Polynucleotide
taatacgactcactatagggtcttggttcaggattctgcagaccattcccaacagaggagagggaatatgctgcagaataacctggcggcagcgcaaaagatg

SEQ ID NO: 236467 - DNA, 103 bp, Artificial Sequence
  Synthetic Polynucleotide
taatacgactcactatagggtatttgcccctcttggttcaggattctgcaaacagaggagatgcagaatgctgaaccaaaacctggcggcagcgcaaaagatg

SEQ ID NO: 236468 - DNA, 103 bp, Artificial Sequence
  Synthetic Polynucleotide
taatacgactcactatagggggttcactcatatttgcccctcttggttcaaacagaggagatgaaccatgaggggcaaaaacctggcggcagcgcaaaagatg

SEQ ID NO: 236469 - DNA, 103 bp, Artificial Sequence
  Synthetic Polynucleotide
taatacgactcactatagggtgacaaccgaggttcactcatatttgccccaacagaggagaggggcaatgatgagtgaaaacctggcggcagcgcaaaagatg

SEQ ID NO: 236470 - DNA, 103 bp, Artificial Sequence
  Synthetic Polynucleotide
taatacgactcactatagggcctgcctccgtgacaaccgaggttcactcaaacagaggagatgagtgatgctcggttgtaacctggcggcagcgcaaaagatg

SEQ ID NO: 236471 - DNA, 103 bp, Artificial Sequence
  Synthetic Polynucleotide
taatacgactcactatagggggggagctgacctgcctccgtgacaaccgaaacagaggagatcggttatgacggaggcaaacctggcggcagcgcaaaagatg

SEQ ID NO: 236472 - DNA, 103 bp, Artificial Sequence
  Synthetic Polynucleotide
taatacgactcactatagggttgagcatttggggagctgacctgcctccgaacagaggagacggaggatggtcagctccaacctggcggcagcgcaaaagatg

SEQ ID NO: 236473 - DNA, 103 bp, Artificial Sequence
  Synthetic Polynucleotide
taatacgactcactataggggagggccccgtttctcttctagtttggctaaacagaggagatagccaatgtagaagagaaacctggcggcagcgcaaaagatg

SEQ ID NO: 236474 - DNA, 103 bp, Artificial Sequence
  Synthetic Polynucleotide
taatacgactcactatagggcaaatggcttttgagcatttggggagctgaaacagaggagatcagctatgcaaatgctcaacctggcggcagcgcaaaagatg

SEQ ID NO: 236475 - DNA, 103 bp, Artificial Sequence
  Synthetic Polynucleotide
taatacgactcactatagggtggtagtgagcaaatggcttttgagcatttaacagaggagaaaatgcatgaaagccattaacctggcggcagcgcaaaagatg

SEQ ID NO: 236476 - DNA, 103 bp, Artificial Sequence
  Synthetic Polynucleotide
taatacgactcactataggggcaatgtctctggtagtgagcaaatggcttaacagaggagaaagccaatggctcactacaacctggcggcagcgcaaaagatg

SEQ ID NO: 236477 - DNA, 103 bp, Artificial Sequence
  Synthetic Polynucleotide
taatacgactcactatagggattccaccctgcaatgtctctggtagtgagaacagaggagactcactatgagagacattaacctggcggcagcgcaaaagatg

SEQ ID NO: 236478 - DNA, 103 bp, Artificial Sequence
  Synthetic Polynucleotide
taatacgactcactatagggctgctgatgtattccaccctgcaatgtctcaacagaggagagagacaatgcagggtggaaacctggcggcagcgcaaaagatg

SEQ ID NO: 236479 - DNA, 103 bp, Artificial Sequence
  Synthetic Polynucleotide
taatacgactcactatagggttttagggggctgctgatgtattccaccctaacagaggagaagggtgatgtacatcagcaacctggcggcagcgcaaaagatg

SEQ ID NO: 236480 - DNA, 103 bp, Artificial Sequence
  Synthetic Polynucleotide
taatacgactcactataggggtgggtggctttttagggggctgctgatgtaacagaggagaacatcaatggccccctaaaacctggcggcagcgcaaaagatg

SEQ ID NO: 236481 - DNA, 103 bp, Artificial Sequence
  Synthetic Polynucleotide
taatacgactcactatagggagctctctcagtgggtggctttttagggggaacagaggagaccccctatgaagccacccaacctggcggcagcgcaaaagatg

SEQ ID NO: 236482 - DNA, 103 bp, Artificial Sequence
  Synthetic Polynucleotide
taatacgactcactataggggcttttctttagctctctcagtgggtggctaacagaggagaagccacatgctgagagagaacctggcggcagcgcaaaagatg

SEQ ID NO: 236483 - DNA, 103 bp, Artificial Sequence
  Synthetic Polynucleotide
taatacgactcactatagggtacctcctttgcttttctttagctctctcaaacagaggagatgagagatgtaaagaaaaaacctggcggcagcgcaaaagatg

SEQ ID NO: 236484 - DNA, 103 bp, Artificial Sequence
  Synthetic Polynucleotide
taatacgactcactatagggttttgcagaggagggccccgtttctcttctaacagaggagaagaagaatgacggggcccaacctggcggcagcgcaaaagatg

SEQ ID NO: 236485 - DNA, 103 bp, Artificial Sequence
  Synthetic Polynucleotide
taatacgactcactatagggagactccgtttacctcctttgcttttctttaacagaggagaaaagaaatgcaaaggaggaacctggcggcagcgcaaaagatg

SEQ ID NO: 236486 - DNA, 103 bp, Artificial Sequence
  Synthetic Polynucleotide
taatacgactcactatagggacggttgctcagactccgtttacctcctttaacagaggagaaaaggaatgaaacggagtaacctggcggcagcgcaaaagatg

SEQ ID NO: 236487 - DNA, 103 bp, Artificial Sequence
  Synthetic Polynucleotide
taatacgactcactataggggatgttgcaaacggttgctcagactccgttaacagaggagaaacggaatgtgagcaaccaacctggcggcagcgcaaaagatg

SEQ ID NO: 236488 - DNA, 103 bp, Artificial Sequence
  Synthetic Polynucleotide
taatacgactcactatagggtggtgaccaagatgttgcaaacggttgctcaacagaggagagagcaaatgtttgcaacaaacctggcggcagcgcaaaagatg

SEQ ID NO: 236489 - DNA, 103 bp, Artificial Sequence
  Synthetic Polynucleotide
taatacgactcactataggggcgggtgggctggtgaccaagatgttgcaaaacagaggagattgcaaatgcttggtcacaacctggcggcagcgcaaaagatg

SEQ ID NO: 236490 - DNA, 103 bp, Artificial Sequence
  Synthetic Polynucleotide
taatacgactcactatagggtctttgctgagcgggtgggctggtgaccaaaacagaggagattggtcatgagcccacccaacctggcggcagcgcaaaagatg

SEQ ID NO: 236491 - DNA, 103 bp, Artificial Sequence
  Synthetic Polynucleotide
taatacgactcactatagggttgtagggtttctttgctgagcgggtgggcaacagaggagagcccacatgctcagcaaaaacctggcggcagcgcaaaagatg

SEQ ID NO: 236492 - DNA, 103 bp, Artificial Sequence
  Synthetic Polynucleotide
taatacgactcactataggggtcatcacatttgtagggtttctttgctgaaacagaggagatcagcaatgaaaccctacaacctggcggcagcgcaaaagatg

SEQ ID NO: 236493 - DNA, 103 bp, Artificial Sequence
  Synthetic Polynucleotide
taatacgactcactatagggttttcccacagtcatcacatttgtagggttaacagaggagaaaccctatgaatgtgatgaacctggcggcagcgcaaaagatg

SEQ ID NO: 236494 - DNA, 103 bp, Artificial Sequence
  Synthetic Polynucleotide
taatacgactcactatagggcacgtgaagcttttcccacagtcatcacataacagaggagaatgtgaatgctgtgggaaaacctggcggcagcgcaaaagatg

SEQ ID NO: 236495 - DNA, 103 bp, Artificial Sequence
  Synthetic Polynucleotide
taatacgactcactatagggcttctgggataaattcacatcagcaggcataacagaggagaatgcctatggatgtgaataacctggcggcagcgcaaaagatg

SEQ ID NO: 236496 - DNA, 103 bp, Artificial Sequence
  Synthetic Polynucleotide
taatacgactcactatagggctcctccctgctgaagtccacggtcacgtcaacagaggagagacgtgatggtggacttcaacctggcggcagcgcaaaagatg

SEQ ID NO: 236497 - DNA, 103 bp, Artificial Sequence
  Synthetic Polynucleotide
taatacgactcactatagggacattccttgcatatacagggtatatcaccaacagaggagaggtgatatgccctgtataaacctggcggcagcgcaaaagatg

SEQ ID NO: 236498 - DNA, 103 bp, Artificial Sequence
  Synthetic Polynucleotide
taatacgactcactatagggagaccttcccacattccttgcatatacaggaacagaggagacctgtaatggcaaggaataacctggcggcagcgcaaaagatg

SEQ ID NO: 236499 - DNA, 103 bp, Artificial Sequence
  Synthetic Polynucleotide
taatacgactcactatagggctctgaataaagaccttcccacattccttgaacagaggagacaaggaatgtgggaaggtaacctggcggcagcgcaaaagatg

SEQ ID NO: 236500 - DNA, 103 bp, Artificial Sequence
  Synthetic Polynucleotide
taatacgactcactatagggcaattctgatctctgaataaagaccttcccaacagaggagagggaagatgtttattcagaacctggcggcagcgcaaaagatg

SEQ ID NO: 236501 - DNA, 103 bp, Artificial Sequence
  Synthetic Polynucleotide
taatacgactcactatagggggtgcgtaagcaattctgatctctgaataaaacagaggagattattcatggatcagaataacctggcggcagcgcaaaagatg

SEQ ID NO: 236502 - DNA, 103 bp, Artificial Sequence
  Synthetic Polynucleotide
taatacgactcactatagggtgtgttttctggtgcgtaagcaattctgataacagaggagaatcagaatggcttacgcaaacctggcggcagcgcaaaagatg

SEQ ID NO: 236503 - DNA, 103 bp, Artificial Sequence
  Synthetic Polynucleotide
taatacgactcactatagggctttctagtgtgtgttttctggtgcgtaagaacagaggagacttacgatgcagaaaacaaacctggcggcagcgcaaaagatg

SEQ ID NO: 236504 - DNA, 103 bp, Artificial Sequence
  Synthetic Polynucleotide
taatacgactcactatagggtatagggcttctttctagtgtgtgttttctaacagaggagaagaaaaatgacactagaaaacctggcggcagcgcaaaagatg

SEQ ID NO: 236505 - DNA, 103 bp, Artificial Sequence
  Synthetic Polynucleotide
taatacgactcactatagggtcatggcatttatagggcttctttctagtgaacagaggagacactagatggaagccctaaacctggcggcagcgcaaaagatg

SEQ ID NO: 236506 - DNA, 103 bp, Artificial Sequence
  Synthetic Polynucleotide
taatacgactcactatagggttttccacagtcatggcatttatagggcttaacagaggagaaagcccatgaaatgccataacctggcggcagcgcaaaagatg

SEQ ID NO: 236507 - DNA, 103 bp, Artificial Sequence
  Synthetic Polynucleotide
taatacgactcactataggggttgctgccactcctccctgctgaagtccaaacagaggagatggactatggcagggaggaacctggcggcagcgcaaaagatg

SEQ ID NO: 236508 - DNA, 103 bp, Artificial Sequence
  Synthetic Polynucleotide
taatacgactcactatagggggaaaaaggcttttccacagtcatggcattaacagaggagaaatgccatgactgtggaaaacctggcggcagcgcaaaagatg

SEQ ID NO: 236509 - DNA, 103 bp, Artificial Sequence
  Synthetic Polynucleotide
taatacgactcactataggggataacatctggaaaaaggcttttccacagaacagaggagactgtggatgagcctttttaacctggcggcagcgcaaaagatg

SEQ ID NO: 236510 - DNA, 103 bp, Artificial Sequence
  Synthetic Polynucleotide
taatacgactcactatagggtctgaagagagataacatctggaaaaaggcaacagaggagagcctttatgcagatgttaaacctggcggcagcgcaaaagatg

SEQ ID NO: 236511 - DNA, 103 bp, Artificial Sequence
  Synthetic Polynucleotide
taatacgactcactatagggttctctgatgtctgaagagagataacatctaacagaggagaagatgtatgctctcttcaaacctggcggcagcgcaaaagatg

SEQ ID NO: 236512 - DNA, 103 bp, Artificial Sequence
  Synthetic Polynucleotide
taatacgactcactatagggctactgtgagttctctgatgtctgaagagaaacagaggagatctcttatgacatcagagaacctggcggcagcgcaaaagatg

SEQ ID NO: 236513 - DNA, 103 bp, Artificial Sequence
  Synthetic Polynucleotide
taatacgactcactataggggagtttttctctactgtgagttctctgatgaacagaggagacatcagatgactcacagtaacctggcggcagcgcaaaagatg

SEQ ID NO: 236514 - DNA, 103 bp, Artificial Sequence
  Synthetic Polynucleotide
taatacgactcactatagggtgcattcatagagtttttctctactgtgagaacagaggagactcacaatggagaaaaacaacctggcggcagcgcaaaagatg

SEQ ID NO: 236515 - DNA, 103 bp, Artificial Sequence
  Synthetic Polynucleotide
taatacgactcactatagggccacattcactgcattcatagagtttttctaacagaggagaagaaaaatgctatgaatgaacctggcggcagcgcaaaagatg

SEQ ID NO: 236516 - DNA, 103 bp, Artificial Sequence
  Synthetic Polynucleotide
taatacgactcactataggggaagcctttgccacattcactgcattcataaacagaggagatatgaaatgagtgaatgtaacctggcggcagcgcaaaagatg

SEQ ID NO: 236517 - DNA, 103 bp, Artificial Sequence
  Synthetic Polynucleotide
taatacgactcactatagggagttttgggagaagcctttgccacattcacaacagaggagagtgaatatggcaaaggctaacctggcggcagcgcaaaagatg

SEQ ID NO: 236518 - DNA, 103 bp, Artificial Sequence
  Synthetic Polynucleotide
taatacgactcactataggggcagggtccagttgctgccactcctccctgaacagaggagacagggaatggtggcagcaaacctggcggcagcgcaaaagatg

SEQ ID NO: 236519 - DNA, 103 bp, Artificial Sequence
  Synthetic Polynucleotide
taatacgactcactatagggatgagggttgagttttgggagaagcctttgaacagaggagacaaaggatgctcccaaaaaacctggcggcagcgcaaaagatg

SEQ ID NO: 236520 - DNA, 103 bp, Artificial Sequence
  Synthetic Polynucleotide
taatacgactcactatagggctgatgtataatgagggttgagttttgggaaacagaggagatcccaaatgtcaaccctcaacctggcggcagcgcaaaagatg

SEQ ID NO: 236521 - DNA, 103 bp, Artificial Sequence
  Synthetic Polynucleotide
taatacgactcactatagggtatgaattttctgatgtataatgagggttgaacagaggagacaacccatgttatacatcaacctggcggcagcgcaaaagatg

SEQ ID NO: 236522 - DNA, 103 bp, Artificial Sequence
  Synthetic Polynucleotide
taatacgactcactatagggctctcaccagtatgaattttctgatgtataaacagaggagatatacaatggaaaattcaaacctggcggcagcgcaaaagatg

SEQ ID NO: 236523 - DNA, 103 bp, Artificial Sequence
  Synthetic Polynucleotide
taatacgactcactatagggtgcatactgtctctcaccagtatgaattttaacagaggagaaaaattatgactggtgagaacctggcggcagcgcaaaagatg

SEQ ID NO: 236524 - DNA, 103 bp, Artificial Sequence
  Synthetic Polynucleotide
taatacgactcactatagggattcactgcatgcatactgtctctcaccagaacagaggagactggtgatggacagtatgaacctggcggcagcgcaaaagatg

SEQ ID NO: 236525 - DNA, 103 bp, Artificial Sequence
  Synthetic Polynucleotide
taatacgactcactataggggctttcccacattcactgcatgcatactgtaacagaggagaacagtaatgatgcagtgaaacctggcggcagcgcaaaagatg

SEQ ID NO: 236526 - DNA, 103 bp, Artificial Sequence
  Synthetic Polynucleotide
taatacgactcactatagggctgggtaaaggctttcccacattcactgcaaacagaggagatgcagtatgtgtgggaaaaacctggcggcagcgcaaaagatg

SEQ ID NO: 236527 - DNA, 103 bp, Artificial Sequence
  Synthetic Polynucleotide
taatacgactcactataggggtgttgacttctgggtaaaggctttcccacaacagaggagagtgggaatgcctttacccaacctggcggcagcgcaaaagatg

SEQ ID NO: 236528 - DNA, 103 bp, Artificial Sequence
  Synthetic Polynucleotide
taatacgactcactatagggtgcaagctgagtgttgacttctgggtaaagaacagaggagactttacatggaagtcaacaacctggcggcagcgcaaaagatg

SEQ ID NO: 236529 - DNA, 103 bp, Artificial Sequence
  Synthetic Polynucleotide
taatacgactcactataggggcatctctgggcagggtccagttgctgccaaacagaggagatggcagatgctggaccctaacctggcggcagcgcaaaagatg

SEQ ID NO: 236530 - DNA, 103 bp, Artificial Sequence
  Synthetic Polynucleotide
taatacgactcactataggggattctctggtgcaagctgagtgttgacttaacagaggagaaagtcaatgctcagcttgaacctggcggcagcgcaaaagatg

SEQ ID NO: 236531 - DNA, 103 bp, Artificial Sequence
  Synthetic Polynucleotide
taatacgactcactataggggccctgagtggattctctggtgcaagctgaaacagaggagatcagctatgaccagagaaaacctggcggcagcgcaaaagatg

SEQ ID NO: 236532 - DNA, 103 bp, Artificial Sequence
  Synthetic Polynucleotide
taatacgactcactatagggtaggacttctgccctgagtggattctctggaacagaggagaccagagatgccactcaggaacctggcggcagcgcaaaagatg

SEQ ID NO: 236533 - DNA, 103 bp, Artificial Sequence
  Synthetic Polynucleotide
taatacgactcactataggggatacacacataggacttctgccctgagtgaacagaggagacactcaatgcagaagtccaacctggcggcagcgcaaaagatg

SEQ ID NO: 236534 - DNA, 103 bp, Artificial Sequence
  Synthetic Polynucleotide
taatacgactcactataggggcccgcattcgatacacacataggacttctaacagaggagaagaagtatgatgtgtgtaaacctggcggcagcgcaaaagatg

SEQ ID NO: 236535 - DNA, 103 bp, Artificial Sequence
  Synthetic Polynucleotide
taatacgactcactatagggatgaaggcctgcccgcattcgatacacacaaacagaggagatgtgtgatgcgaatgcggaacctggcggcagcgcaaaagatg

SEQ ID NO: 236536 - DNA, 103 bp, Artificial Sequence
  Synthetic Polynucleotide
taatacgactcactatagggtgccttctggatgaaggcctgcccgcattcaacagaggagagaatgcatgcaggccttcaacctggcggcagcgcaaaagatg

SEQ ID NO: 236537 - DNA, 103 bp, Artificial Sequence
  Synthetic Polynucleotide
taatacgactcactatagggcaatcaggtgtgccttctggatgaaggcctaacagaggagaaggcctatgtccagaaggaacctggcggcagcgcaaaagatg

SEQ ID NO: 236538 - DNA, 103 bp, Artificial Sequence
  Synthetic Polynucleotide
taatacgactcactatagggctttgatggacaatcaggtgtgccttctggaacagaggagaccagaaatgacacctgataacctggcggcagcgcaaaagatg

SEQ ID NO: 236539 - DNA, 103 bp, Artificial Sequence
  Synthetic Polynucleotide
taatacgactcactatagggtgtgtggcttctttgatggacaatcaggtgaacagaggagacacctgatggtccatcaaaacctggcggcagcgcaaaagatg

SEQ ID NO: 236540 - DNA, 103 bp, Artificial Sequence
  Synthetic Polynucleotide
taatacgactcactatagggcccggtacaggcatctctgggcagggtccaaacagaggagatggaccatgcccagagataacctggcggcagcgcaaaagatg

SEQ ID NO: 236541 - DNA, 103 bp, Artificial Sequence
  Synthetic Polynucleotide
taatacgactcactataggggtttttctcctgtgtggcttctttgatggaaacagaggagatccatcatggaagccacaaacctggcggcagcgcaaaagatg

SEQ ID NO: 236542 - DNA, 103 bp, Artificial Sequence
  Synthetic Polynucleotide
taatacgactcactatagggcactgataaggtttttctcctgtgtggcttaacagaggagaaagccaatgaggagaaaaaacctggcggcagcgcaaaagatg

SEQ ID NO: 236543 - DNA, 103 bp, Artificial Sequence
  Synthetic Polynucleotide
taatacgactcactatagggacagttgtggcactgataaggtttttctccaacagaggagaggagaaatgccttatcagaacctggcggcagcgcaaaagatg

SEQ ID NO: 236544 - DNA, 103 bp, Artificial Sequence
  Synthetic Polynucleotide
taatacgactcactatagggaggatttcccacagttgtggcactgataagaacagaggagacttatcatggccacaactaacctggcggcagcgcaaaagatg

SEQ ID NO: 236545 - DNA, 103 bp, Artificial Sequence
  Synthetic Polynucleotide
taatacgactcactatagggttggaaatgaaggatttcccacagttgtggaacagaggagaccacaaatgtgggaaatcaacctggcggcagcgcaaaagatg

SEQ ID NO: 236546 - DNA, 103 bp, Artificial Sequence
  Synthetic Polynucleotide
taatacgactcactatagggaagctgtgacttggaaatgaaggatttcccaacagaggagagggaaaatgttcatttccaacctggcggcagcgcaaaagatg

SEQ ID NO: 236547 - DNA, 103 bp, Artificial Sequence
  Synthetic Polynucleotide
taatacgactcactataggggatgtatatcaagctgtgacttggaaatgaaacagaggagatcatttatgagtcacagcaacctggcggcagcgcaaaagatg

SEQ ID NO: 236548 - DNA, 103 bp, Artificial Sequence
  Synthetic Polynucleotide
taatacgactcactatagggtgaattcgatgatgtatatcaagctgtgacaacagaggagagtcacaatgtgatatacaaacctggcggcagcgcaaaagatg

SEQ ID NO: 236549 - DNA, 103 bp, Artificial Sequence
  Synthetic Polynucleotide
taatacgactcactatagggctcccctgtatgaattcgatgatgtatatcaacagaggagagatataatgcatcgaattaacctggcggcagcgcaaaagatg

SEQ ID NO: 236550 - DNA, 103 bp, Artificial Sequence
  Synthetic Polynucleotide
taatacgactcactatagggcataaggtttctcccctgtatgaattcgataacagaggagaatcgaaatgatacaggggaacctggcggcagcgcaaaagatg

SEQ ID NO: 236551 - DNA, 103 bp, Artificial Sequence
  Synthetic Polynucleotide
taatacgactcactatagggagcatcacatcccggtacaggcatctctggaacagaggagaccagagatgcctgtaccgaacctggcggcagcgcaaaagatg

SEQ ID NO: 236552 - DNA, 103 bp, Artificial Sequence
  Synthetic Polynucleotide
taatacgactcactatagggtcactgcattcataaggtttctcccctgtaaacagaggagatacaggatggaaaccttaaacctggcggcagcgcaaaagatg

SEQ ID NO: 236553 - DNA, 103 bp, Artificial Sequence
  Synthetic Polynucleotide
taatacgactcactatagggttttccacagtcactgcattcataaggtttaacagaggagaaaacctatggaatgcagtaacctggcggcagcgcaaaagatg

SEQ ID NO: 236554 - DNA, 103 bp, Artificial Sequence
  Synthetic Polynucleotide
taatacgactcactataggggggtgaaggtttttccacagtcactgcattaacagaggagaaatgcaatgactgtggaaaacctggcggcagcgcaaaagatg

SEQ ID NO: 236555 - DNA, 103 bp, Artificial Sequence
  Synthetic Polynucleotide
taatacgactcactatagggtgtgacttttgggtgaaggtttttccacagaacagaggagactgtggatgaaccttcacaacctggcggcagcgcaaaagatg

SEQ ID NO: 236556 - DNA, 103 bp, Artificial Sequence
  Synthetic Polynucleotide
taatacgactcactatagggtatattcaggtgtgacttttgggtgaaggtaacagaggagaaccttcatgcaaaagtcaaacctggcggcagcgcaaaagatg

SEQ ID NO: 236557 - DNA, 103 bp, Artificial Sequence
  Synthetic Polynucleotide
taatacgactcactatagggttttctggtgtatattcaggtgtgacttttaacagaggagaaaaagtatgacctgaataaacctggcggcagcgcaaaagatg

SEQ ID NO: 236558 - DNA, 103 bp, Artificial Sequence
  Synthetic Polynucleotide
taatacgactcactatagggccagtatgaattttctggtgtatattcaggaacagaggagacctgaaatgacaccagaaaacctggcggcagcgcaaaagatg

SEQ ID NO: 236559 - DNA, 103 bp, Artificial Sequence
  Synthetic Polynucleotide
taatacgactcactataggggtgtctttctccagtatgaattttctggtgaacagaggagacaccagatgattcatactaacctggcggcagcgcaaaagatg

SEQ ID NO: 236560 - DNA, 103 bp, Artificial Sequence
  Synthetic Polynucleotide
taatacgactcactatagggtgcatacatggtgtctttctccagtatgaaaacagaggagattcataatggagaaagacaacctggcggcagcgcaaaagatg

SEQ ID NO: 236561 - DNA, 103 bp, Artificial Sequence
  Synthetic Polynucleotide
taatacgactcactatagggccgcattcactgcatacatggtgtctttctaacagaggagaagaaagatgccatgtatgaacctggcggcagcgcaaaagatg

SEQ ID NO: 236562 - DNA, 103 bp, Artificial Sequence
  Synthetic Polynucleotide
taatacgactcactatagggatagagctccagcatcacatcccggtacagaacagaggagactgtacatggatgtgatgaacctggcggcagcgcaaaagatg

SEQ ID NO: 236563 - DNA, 103 bp, Artificial Sequence
  Synthetic Polynucleotide
taatacgactcactataggggaaggctttcccgcattcactgcatacatgaacagaggagacatgtaatgagtgaatgcaacctggcggcagcgcaaaagatg

SEQ ID NO: 236564 - DNA, 103 bp, Artificial Sequence
  Synthetic Polynucleotide
taatacgactcactatagggacttctggttgaaggctttcccgcattcacaacagaggagagtgaatatgggaaagcctaacctggcggcagcgcaaaagatg

SEQ ID NO: 236565 - DNA, 103 bp, Artificial Sequence
  Synthetic Polynucleotide
taatacgactcactatagggctgagtattgacttctggttgaaggctttcaacagaggagagaaagcatgcaaccagaaaacctggcggcagcgcaaaagatg

SEQ ID NO: 236566 - DNA, 103 bp, Artificial Sequence
  Synthetic Polynucleotide
taatacgactcactatagggctgatgcatgctgagtattgacttctggttaacagaggagaaaccagatgtcaatactcaacctggcggcagcgcaaaagatg

SEQ ID NO: 236567 - DNA, 103 bp, Artificial Sequence
  Synthetic Polynucleotide
taatacgactcactatagggtgtgaattctctgatgcatgctgagtattgaacagaggagacaatacatggcatgcatcaacctggcggcagcgcaaaagatg

SEQ ID NO: 236568 - DNA, 103 bp, Artificial Sequence
  Synthetic Polynucleotide
taatacgactcactatagggttctctccggtgtgaattctctgatgcatgaacagaggagacatgcaatggagaattcaaacctggcggcagcgcaaaagatg

SEQ ID NO: 236569 - DNA, 103 bp, Artificial Sequence
  Synthetic Polynucleotide
taatacgactcactatagggtttgtaaggcttctctccggtgtgaattctaacagaggagaagaattatgaccggagagaacctggcggcagcgcaaaagatg

SEQ ID NO: 236570 - DNA, 103 bp, Artificial Sequence
  Synthetic Polynucleotide
taatacgactcactatagggattcactgcatttgtaaggcttctctccggaacagaggagaccggagatgagccttacaaacctggcggcagcgcaaaagatg

SEQ ID NO: 236571 - DNA, 103 bp, Artificial Sequence
  Synthetic Polynucleotide
taatacgactcactataggggctttcccacattcactgcatttgtaaggcaacagaggagagccttaatgatgcagtgaaacctggcggcagcgcaaaagatg

SEQ ID NO: 236572 - DNA, 103 bp, Artificial Sequence
  Synthetic Polynucleotide
taatacgactcactatagggagaagtgaaggctttcccacattcactgcaaacagaggagatgcagtatgtgtgggaaaaacctggcggcagcgcaaaagatg

SEQ ID NO: 236573 - DNA, 103 bp, Artificial Sequence
  Synthetic Polynucleotide
taatacgactcactatagggagagatggctatagagctccagcatcacataacagaggagaatgtgaatgtggagctctaacctggcggcagcgcaaaagatg

SEQ ID NO: 236574 - DNA, 103 bp, Artificial Sequence
  Synthetic Polynucleotide
taatacgactcactatagggattgagacttagaagtgaaggctttcccacaacagaggagagtgggaatgccttcacttaacctggcggcagcgcaaaagatg

SEQ ID NO: 236575 - DNA, 103 bp, Artificial Sequence
  Synthetic Polynucleotide
taatacgactcactatagggtgctctttgaattgagacttagaagtgaagaacagaggagacttcacatgtaagtctcaaacctggcggcagcgcaaaagatg

SEQ ID NO: 236576 - DNA, 103 bp, Artificial Sequence
  Synthetic Polynucleotide
taatacgactcactatagggaattcgctgatgctctttgaattgagacttaacagaggagaaagtctatgttcaaagagaacctggcggcagcgcaaaagatg

SEQ ID NO: 236577 - DNA, 103 bp, Artificial Sequence
  Synthetic Polynucleotide
taatacgactcactatagggcacccgtgtgaattcgctgatgctctttgaaacagaggagatcaaagatgatcagcgaaaacctggcggcagcgcaaaagatg

SEQ ID NO: 236578 - DNA, 103 bp, Artificial Sequence
  Synthetic Polynucleotide
taatacgactcactatagggtagggtttctcacccgtgtgaattcgctgaaacagaggagatcagcgatgtcacacgggaacctggcggcagcgcaaaagatg

SEQ ID NO: 236579 - DNA, 103 bp, Artificial Sequence
  Synthetic Polynucleotide
taatacgactcactatagggagtgcacacatagggtttctcacccgtgtgaacagaggagacacacgatggagaaacccaacctggcggcagcgcaaaagatg

SEQ ID NO: 236580 - DNA, 103 bp, Artificial Sequence
  Synthetic Polynucleotide
taatacgactcactatagggtcccacattcagtgcacacatagggtttctaacagaggagaagaaacatgatgtgtgcaaacctggcggcagcgcaaaagatg

SEQ ID NO: 236581 - DNA, 103 bp, Artificial Sequence
  Synthetic Polynucleotide
taatacgactcactatagggttgaaggccttcccacattcagtgcacacaaacagaggagatgtgtgatgtgaatgtggaacctggcggcagcgcaaaagatg

SEQ ID NO: 236582 - DNA, 103 bp, Artificial Sequence
  Synthetic Polynucleotide
taatacgactcactatagggtgacctgccgttgaaggccttcccacattcaacagaggagagaatgtatgaaggccttcaacctggcggcagcgcaaaagatg

SEQ ID NO: 236583 - DNA, 103 bp, Artificial Sequence
  Synthetic Polynucleotide
taatacgactcactatagggtatggaaatttgacctgccgttgaaggcctaacagaggagaaggcctatgacggcaggtaacctggcggcagcgcaaaagatg

SEQ ID NO: 236584 - DNA, 103 bp, Artificial Sequence
  Synthetic Polynucleotide
taatacgactcactatagggcccactgcgaagagatggctatagagctccaacagaggagaggagctatgtagccatctaacctggcggcagcgcaaaagatg

SEQ ID NO: 236585 - DNA, 103 bp, Artificial Sequence
  Synthetic Polynucleotide
taatacgactcactatagggatttgatgtttatggaaatttgacctgccgaacagaggagacggcagatgaaatttccaaacctggcggcagcgcaaaagatg

SEQ ID NO: 236586 - DNA, 103 bp, Artificial Sequence
  Synthetic Polynucleotide
taatacgactcactatagggagtgtgagttatttgatgtttatggaaattaacagaggagaaatttcatgaaacatcaaaacctggcggcagcgcaaaagatg

SEQ ID NO: 236587 - DNA, 103 bp, Artificial Sequence
  Synthetic Polynucleotide
taatacgactcactataggggcctctctctagtgtgagttatttgatgttaacagaggagaaacatcatgtaactcacaaacctggcggcagcgcaaaagatg

SEQ ID NO: 236588 - DNA, 103 bp, Artificial Sequence
  Synthetic Polynucleotide
taatacgactcactatagggcagacaaaaggcctctctctagtgtgagttaacagaggagaaactcaatgtagagagagaacctggcggcagcgcaaaagatg

SEQ ID NO: 236589 - DNA, 103 bp, Artificial Sequence
  Synthetic Polynucleotide
taatacgactcactatagggacatttgtaacagacaaaaggcctctctctaacagaggagaagagagatgccttttgtcaacctggcggcagcgcaaaagatg

SEQ ID NO: 236590 - DNA, 103 bp, Artificial Sequence
  Synthetic Polynucleotide
taatacgactcactatagggaagccttcccacatttgtaacagacaaaagaacagaggagacttttgatggttacaaataacctggcggcagcgcaaaagatg

SEQ ID NO: 236591 - DNA, 103 bp, Artificial Sequence
  Synthetic Polynucleotide
taatacgactcactatagggttctggacaaaagccttcccacatttgtaaaacagaggagattacaaatgtgggaaggcaacctggcggcagcgcaaaagatg

SEQ ID NO: 236592 - DNA, 103 bp, Artificial Sequence
  Synthetic Polynucleotide
taatacgactcactatagggcaactctgatttctggacaaaagccttcccaacagaggagagggaagatgtttgtccagaacctggcggcagcgcaaaagatg

SEQ ID NO: 236593 - DNA, 103 bp, Artificial Sequence
  Synthetic Polynucleotide
taatacgactcactataggggatgggtaatcaactctgatttctggacaaaacagaggagattgtccatgaatcagagtaacctggcggcagcgcaaaagatg

SEQ ID NO: 236594 - DNA, 103 bp, Artificial Sequence
  Synthetic Polynucleotide
taatacgactcactatagggtgagttctttgatgggtaatcaactctgataacagaggagaatcagaatggattacccaaacctggcggcagcgcaaaagatg

SEQ ID NO: 236595 - DNA, 103 bp, Artificial Sequence
  Synthetic Polynucleotide
taatacgactcactatagggaatgtgataccccactgcgaagagatggctaacagaggagaagccatatgttcgcagtgaacctggcggcagcgcaaaagatg

SEQ ID NO: 236596 - DNA, 103 bp, Artificial Sequence
  Synthetic Polynucleotide
taatacgactcactatagggctctcccatgtgagttctttgatgggtaataacagaggagaattaccatgcaaagaactaacctggcggcagcgcaaaagatg

SEQ ID NO: 236597 - DNA, 103 bp, Artificial Sequence
  Synthetic Polynucleotide
taatacgactcactatagggcatagggtttctctcccatgtgagttctttaacagaggagaaaagaaatgacatgggagaacctggcggcagcgcaaaagatg

SEQ ID NO: 236598 - DNA, 103 bp, Artificial Sequence
  Synthetic Polynucleotide
taatacgactcactatagggtcaaggcattcatagggtttctctcccatgaacagaggagacatgggatggaaaccctaaacctggcggcagcgcaaaagatg

SEQ ID NO: 236599 - DNA, 103 bp, Artificial Sequence
  Synthetic Polynucleotide
taatacgactcactatagggtttcccacagtcaaggcattcatagggtttaacagaggagaaaacccatggaatgccttaacctggcggcagcgcaaaagatg

SEQ ID NO: 236600 - DNA, 103 bp, Artificial Sequence
  Synthetic Polynucleotide
taatacgactcactatagggtactgaacgatttcccacagtcaaggcattaacagaggagaaatgccatgactgtgggaaacctggcggcagcgcaaaagatg

SEQ ID NO: 236601 - DNA, 103 bp, Artificial Sequence
  Synthetic Polynucleotide
taatacgactcactatagggtgtggtttcttactgaacgatttcccacagaacagaggagactgtggatgatcgttcagaacctggcggcagcgcaaaagatg

SEQ ID NO: 236602 - DNA, 103 bp, Artificial Sequence
  Synthetic Polynucleotide
taatacgactcactatagggcaccttgagttgtggtttcttactgaacgaaacagaggagatcgttcatgaagaaaccaaacctggcggcagcgcaaaagatg

SEQ ID NO: 236603 - DNA, 103 bp, Artificial Sequence
  Synthetic Polynucleotide
taatacgactcactatagggttcgctgatgcaccttgagttgtggtttctaacagaggagaagaaacatgaactcaaggaacctggcggcagcgcaaaagatg

SEQ ID NO: 236604 - DNA, 103 bp, Artificial Sequence
  Synthetic Polynucleotide
taatacgactcactatagggcccgtgtgaattcgctgatgcaccttgagtaacagaggagaactcaaatggcatcagcgaacctggcggcagcgcaaaagatg

SEQ ID NO: 236605 - DNA, 103 bp, Artificial Sequence
  Synthetic Polynucleotide
taatacgactcactatagggaggtctttctcccgtgtgaattcgctgatgaacagaggagacatcagatgattcacacgaacctggcggcagcgcaaaagatg

SEQ ID NO: 236606 - DNA, 103 bp, Artificial Sequence
  Synthetic Polynucleotide
taatacgactcactatagggggacctgaggcttctgggataaattcacataacagaggagaatgtgaatgtatcccagaaacctggcggcagcgcaaaagatg

SEQ ID NO: 236607 - DNA, 103 bp, Artificial Sequence
  Synthetic Polynucleotide
taatacgactcactatagggctgggttgggaatgtgataccccactgcgaaacagaggagatcgcagatgggtatcacaaacctggcggcagcgcaaaagatg

SEQ ID NO: 236608 - DNA, 103 bp, Artificial Sequence
  Synthetic Polynucleotide
taatacgactcactatagggaacacacataaggtctttctcccgtgtgaaaacagaggagattcacaatggagaaagacaacctggcggcagcgcaaaagatg

SEQ ID NO: 236609 - DNA, 103 bp, Artificial Sequence
  Synthetic Polynucleotide
taatacgactcactatagggccacattcagaacacacataaggtctttctaacagaggagaagaaagatgttatgtgtgaacctggcggcagcgcaaaagatg

SEQ ID NO: 236610 - DNA, 103 bp, Artificial Sequence
  Synthetic Polynucleotide
taatacgactcactataggggaaggcctttccacattcagaacacacataaacagaggagatatgtgatgtctgaatgtaacctggcggcagcgcaaaagatg

SEQ ID NO: 236611 - DNA, 103 bp, Artificial Sequence
  Synthetic Polynucleotide
taatacgactcactatagggacctgttgttgaaggcctttccacattcagaacagaggagactgaatatggaaaggcctaacctggcggcagcgcaaaagatg

SEQ ID NO: 236612 - DNA, 103 bp, Artificial Sequence
  Synthetic Polynucleotide
taatacgactcactatagggttgaagtttgacctgttgttgaaggcctttaacagaggagaaaaggcatgcaacaacagaacctggcggcagcgcaaaagatg

SEQ ID NO: 236613 - DNA, 103 bp, Artificial Sequence
  Synthetic Polynucleotide
taatacgactcactatagggttggtgtttattgaagtttgacctgttgttaacagaggagaaacaacatgtcaaacttcaacctggcggcagcgcaaaagatg

SEQ ID NO: 236614 - DNA, 103 bp, Artificial Sequence
  Synthetic Polynucleotide
taatacgactcactatagggtatgagttgtttggtgtttattgaagtttgaacagaggagacaaactatgataaacaccaacctggcggcagcgcaaaagatg

SEQ ID NO: 236615 - DNA, 103 bp, Artificial Sequence
  Synthetic Polynucleotide
taatacgactcactatagggttgtctctggtatgagttgtttggtgtttaaacagaggagataaacaatgaacaactcaaacctggcggcagcgcaaaagatg

SEQ ID NO: 236616 - DNA, 103 bp, Artificial Sequence
  Synthetic Polynucleotide
taatacgactcactatagggtttgtaagatttgtctctggtatgagttgtaacagaggagaacaactatgaccagagacaacctggcggcagcgcaaaagatg

SEQ ID NO: 236617 - DNA, 103 bp, Artificial Sequence
  Synthetic Polynucleotide
taatacgactcactatagggaataactgcatttgtaagatttgtctctggaacagaggagaccagagatgaatcttacaaacctggcggcagcgcaaaagatg

SEQ ID NO: 236618 - DNA, 103 bp, Artificial Sequence
  Synthetic Polynucleotide
taatacgactcactatagggaagatgacctctgggttgggaatgtgatacaacagaggagagtatcaatgtcccaacccaacctggcggcagcgcaaaagatg

SEQ ID NO: 236619 - DNA, 103 bp, Artificial Sequence
  Synthetic Polynucleotide
taatacgactcactatagggcctttcacagaataactgcatttgtaagataacagaggagaatcttaatgatgcagttaaacctggcggcagcgcaaaagatg

SEQ ID NO: 236620 - DNA, 103 bp, Artificial Sequence
  Synthetic Polynucleotide
taatacgactcactatagggcttggtaaagcctttcacagaataactgcaaacagaggagatgcagtatgtctgtgaaaaacctggcggcagcgcaaaagatg

SEQ ID NO: 236621 - DNA, 103 bp, Artificial Sequence
  Synthetic Polynucleotide
taatacgactcactatagggtagcattctgaagatgacctctgggttgggaacagaggagacccaacatggaggtcatcaacctggcggcagcgcaaaagatg

SEQ ID NO: 236622 - DNA, 103 bp, Artificial Sequence
  Synthetic Polynucleotide
taatacgactcactatagggccttttcttttagcattctgaagatgacctaacagaggagaaggtcaatgtcagaatgcaacctggcggcagcgcaaaagatg

SEQ ID NO: 236623 - DNA, 103 bp, Artificial Sequence
  Synthetic Polynucleotide
taatacgactcactatagggacacgcggctccttttcttttagcattctgaacagaggagacagaatatgaaaagaaaaaacctggcggcagcgcaaaagatg

SEQ ID NO: 236624 - DNA, 103 bp, Artificial Sequence
  Synthetic Polynucleotide
taatacgactcactatagggagcctcctccacacgcggctccttttctttaacagaggagaaaagaaatggagccgcgtaacctggcggcagcgcaaaagatg

SEQ ID NO: 236625 - DNA, 103 bp, Artificial Sequence
  Synthetic Polynucleotide
taatacgactcactataggggtgagacttcagcctcctccacacgcggctaacagaggagaagccgcatgtggaggaggaacctggcggcagcgcaaaagatg

SEQ ID NO: 236626 - DNA, 103 bp, Artificial Sequence
  Synthetic Polynucleotide
taatacgactcactatagggcacctctgatgtgagacttcagcctcctccaacagaggagaggaggaatgtgaagtctcaacctggcggcagcgcaaaagatg

SEQ ID NO: 236627 - DNA, 103 bp, Artificial Sequence
  Synthetic Polynucleotide
taatacgactcactatagggcctttcttgacacctctgatgtgagacttcaacagaggagagaagtcatgcatcagaggaacctggcggcagcgcaaaagatg

SEQ ID NO: 236628 - DNA, 103 bp, Artificial Sequence
  Synthetic Polynucleotide
taatacgactcactataggggcccaaactccctttcttgacacctctgataacagaggagaatcagaatggtcaagaaaaacctggcggcagcgcaaaagatg

SEQ ID NO: 236629 - DNA, 103 bp, Artificial Sequence
  Synthetic Polynucleotide
taatacgactcactatagggtctggacccaggacctgaggcttctgggataacagaggagaatcccaatggcctcaggtaacctggcggcagcgcaaaagatg

SEQ ID NO: 236630 - DNA, 103 bp, Artificial Sequence
  Synthetic Polynucleotide
taatacgactcactataggggggatttcaagcccaaactccctttcttgaaacagaggagatcaagaatgggagtttggaacctggcggcagcgcaaaagatg

SEQ ID NO: 236631 - DNA, 103 bp, Artificial Sequence
  Synthetic Polynucleotide
taatacgactcactatagggctccttttgtgggatttcaagcccaaactcaacagaggagagagtttatgcttgaaatcaacctggcggcagcgcaaaagatg

SEQ ID NO: 236632 - DNA, 103 bp, Artificial Sequence
  Synthetic Polynucleotide
taatacgactcactatagggtcttagaaatctccttttgtgggatttcaaaacagaggagattgaaaatgcacaaaaggaacctggcggcagcgcaaaagatg

SEQ ID NO: 236633 - DNA, 103 bp, Artificial Sequence
  Synthetic Polynucleotide
taatacgactcactatagggaatgaagctttcttagaaatctccttttgtaacagaggagaacaaaaatggatttctaaaacctggcggcagcgcaaaagatg

SEQ ID NO: 236634 - DNA, 103 bp, Artificial Sequence
  Synthetic Polynucleotide
taatacgactcactatagggatccttttgaaatgaagctttcttagaaataacagaggagaatttctatgaaagcttcaaacctggcggcagcgcaaaagatg

SEQ ID NO: 236635 - DNA, 103 bp, Artificial Sequence
  Synthetic Polynucleotide
taatacgactcactatagggcacctaccatatccttttgaaatgaagcttaacagaggagaaagcttatgttcaaaaggaacctggcggcagcgcaaaagatg

SEQ ID NO: 236636 - DNA, 103 bp, Artificial Sequence
  Synthetic Polynucleotide
taatacgactcactatagggcttgtgaactcacctaccatatccttttgaaacagaggagatcaaaaatgtatggtaggaacctggcggcagcgcaaaagatg

SEQ ID NO: 236637 - DNA, 103 bp, Artificial Sequence
  Synthetic Polynucleotide
taatacgactcactatagggtgaaccatctcttgtgaactcacctaccataacagaggagaatggtaatggagttcacaaacctggcggcagcgcaaaagatg

SEQ ID NO: 236638 - DNA, 103 bp, Artificial Sequence
  Synthetic Polynucleotide
taatacgactcactatagggtggaacaccatgaaccatctcttgtgaactaacagaggagaagttcaatggagatggttaacctggcggcagcgcaaaagatg

SEQ ID NO: 236639 - DNA, 103 bp, Artificial Sequence
  Synthetic Polynucleotide
taatacgactcactatagggtcttctaaaatggaacaccatgaaccatctaacagaggagaagatggatgatggtgttcaacctggcggcagcgcaaaagatg

SEQ ID NO: 236640 - DNA, 103 bp, Artificial Sequence
  Synthetic Polynucleotide
taatacgactcactatagggatcctgcttctctggacccaggacctgaggaacagaggagacctcagatgctgggtccaaacctggcggcagcgcaaaagatg

SEQ ID NO: 236641 - DNA, 103 bp, Artificial Sequence
  Synthetic Polynucleotide
taatacgactcactatagggcagcctcagttcttctaaaatggaacaccaaacagaggagatggtgtatgattttagaaaacctggcggcagcgcaaaagatg

SEQ ID NO: 236642 - DNA, 103 bp, Artificial Sequence
  Synthetic Polynucleotide
taatacgactcactatagggggtcagcatccagcctcagttcttctaaaaaacagaggagattttagatgaactgaggcaacctggcggcagcgcaaaagatg

SEQ ID NO: 236643 - DNA, 103 bp, Artificial Sequence
  Synthetic Polynucleotide
taatacgactcactatagggttctttgtgcggtcagcatccagcctcagtaacagaggagaactgagatgggatgctgaaacctggcggcagcgcaaaagatg

SEQ ID NO: 236644 - DNA, 103 bp, Artificial Sequence
  Synthetic Polynucleotide
taatacgactcactatagggttgctcatctttctttgtgcggtcagcatcaacagaggagagatgctatgcgcacaaagaacctggcggcagcgcaaaagatg

SEQ ID NO: 236645 - DNA, 103 bp, Artificial Sequence
  Synthetic Polynucleotide
taatacgactcactataggggaatttgattttgctcatctttctttgtgcaacagaggagagcacaaatgaagatgagcaacctggcggcagcgcaaaagatg

SEQ ID NO: 236646 - DNA, 103 bp, Artificial Sequence
  Synthetic Polynucleotide
taatacgactcactatagggctcatgggttgaatttgattttgctcatctaacagaggagaagatgaatgaaatcaaataacctggcggcagcgcaaaagatg

SEQ ID NO: 236647 - DNA, 103 bp, Artificial Sequence
  Synthetic Polynucleotide
taatacgactcactatagggagcactgtgactcatgggttgaatttgattaacagaggagaaatcaaatgcaacccatgaacctggcggcagcgcaaaagatg

SEQ ID NO: 236648 - DNA, 103 bp, Artificial Sequence
  Synthetic Polynucleotide
taatacgactcactatagggtgttgaagaaagcactgtgactcatgggttaacagaggagaaacccaatggtcacagtgaacctggcggcagcgcaaaagatg

SEQ ID NO: 236649 - DNA, 103 bp, Artificial Sequence
  Synthetic Polynucleotide
taatacgactcactatagggaatgttttcttgttgaagaaagcactgtgaaacagaggagatcacagatgtttcttcaaaacctggcggcagcgcaaaagatg

SEQ ID NO: 236650 - DNA, 103 bp, Artificial Sequence
  Synthetic Polynucleotide
taatacgactcactatagggttctgtgttcaatgttttcttgttgaagaaaacagaggagattcttcatgaagaaaacaaacctggcggcagcgcaaaagatg

SEQ ID NO: 236651 - DNA, 103 bp, Artificial Sequence
  Synthetic Polynucleotide
taatacgactcactatagggcgcaagatccatcctgcttctctggacccaaacagaggagatgggtcatgagaagcaggaacctggcggcagcgcaaaagatg

SEQ ID NO: 236652 - DNA, 103 bp, Artificial Sequence
  Synthetic Polynucleotide
taatacgactcactatagggcacaattgctttctgtgttcaatgttttctaacagaggagaagaaaaatgtgaacacagaacctggcggcagcgcaaaagatg

SEQ ID NO: 236653 - DNA, 103 bp, Artificial Sequence
  Synthetic Polynucleotide
taatacgactcactatagggtccttatattcacaattgctttctgtgttcaacagaggagagaacacatgaagcaattgaacctggcggcagcgcaaaagatg

SEQ ID NO: 236654 - DNA, 103 bp, Artificial Sequence
  Synthetic Polynucleotide
taatacgactcactatagggtttcccagggtccttatattcacaattgctaacagaggagaagcaatatggaatataagaacctggcggcagcgcaaaagatg

SEQ ID NO: 236655 - DNA, 103 bp, Artificial Sequence
  Synthetic Polynucleotide
taatacgactcactatagggtgcgaatcattttcccagggtccttatattaacagaggagaaatataatgaccctgggaaacctggcggcagcgcaaaagatg

SEQ ID NO: 236656 - DNA, 103 bp, Artificial Sequence
  Synthetic Polynucleotide
taatacgactcactatagggtggggcctcgtgcgaatcattttcccagggaacagaggagaccctggatgaatgattcgaacctggcggcagcgcaaaagatg

SEQ ID NO: 236657 - DNA, 103 bp, Artificial Sequence
  Synthetic Polynucleotide
taatacgactcactatagggagaagcaaggtggggcctcgtgcgaatcataacagaggagaatgattatgacgaggcccaacctggcggcagcgcaaaagatg

SEQ ID NO: 236658 - DNA, 103 bp, Artificial Sequence
  Synthetic Polynucleotide
taatacgactcactataggggtttctgtgaagaagcaaggtggggcctcgaacagaggagacgaggcatgaccttgcttaacctggcggcagcgcaaaagatg

SEQ ID NO: 236659 - DNA, 103 bp, Artificial Sequence
  Synthetic Polynucleotide
taatacgactcactatagggttctgaggttgtttctgtgaagaagcaaggaacagaggagaccttgcatgttcacagaaaacctggcggcagcgcaaaagatg

SEQ ID NO: 236660 - DNA, 103 bp, Artificial Sequence
  Synthetic Polynucleotide
taatacgactcactatagggtaagcaacatttctgaggttgtttctgtgaaacagaggagatcacagatgcaacctcagaacctggcggcagcgcaaaagatg

SEQ ID NO: 236661 - DNA, 103 bp, Artificial Sequence
  Synthetic Polynucleotide
taatacgactcactatagggtttctgtaaataagcaacatttctgaggttaacagaggagaaacctcatgaatgttgctaacctggcggcagcgcaaaagatg

SEQ ID NO: 236662 - DNA, 103 bp, Artificial Sequence
  Synthetic Polynucleotide
taatacgactcactatagggactgatgcctcgcaagatccatcctgcttcaacagaggagagaagcaatgtggatcttgaacctggcggcagcgcaaaagatg

SEQ ID NO: 236663 - DNA, 103 bp, Artificial Sequence
  Synthetic Polynucleotide
taatacgactcactatagggagcttcaaactttctgtaaataagcaacataacagaggagaatgttgatgatttacagaaacctggcggcagcgcaaaagatg

SEQ ID NO: 236664 - DNA, 103 bp, Artificial Sequence
  Synthetic Polynucleotide
taatacgactcactatagggttctaggttcagcttcaaactttctgtaaaaacagaggagatttacaatgagtttgaagaacctggcggcagcgcaaaagatg

SEQ ID NO: 236665 - DNA, 103 bp, Artificial Sequence
  Synthetic Polynucleotide
taatacgactcactataggggaccgttcacttctaggttcagcttcaaacaacagaggagagtttgaatgtgaacctagaacctggcggcagcgcaaaagatg

SEQ ID NO: 236666 - DNA, 103 bp, Artificial Sequence
  Synthetic Polynucleotide
taatacgactcactatagggctttcattctgaccgttcacttctaggttcaacagaggagagaacctatgagtgaacggaacctggcggcagcgcaaaagatg

SEQ ID NO: 236667 - DNA, 103 bp, Artificial Sequence
  Synthetic Polynucleotide
taatacgactcactatagggtgtgtcattgctttcattctgaccgttcacaacagaggagagtgaacatgcagaatgaaaacctggcggcagcgcaaaagatg

SEQ ID NO: 236668 - DNA, 103 bp, Artificial Sequence
  Synthetic Polynucleotide
taatacgactcactatagggcaagctgttctgtgtcattgctttcattctaacagaggagaagaatgatggcaatgacaaacctggcggcagcgcaaaagatg

SEQ ID NO: 236669 - DNA, 103 bp, Artificial Sequence
  Synthetic Polynucleotide
taatacgactcactatagggacaacgtcatcaagctgttctgtgtcattgaacagaggagacaatgaatgagaacagctaacctggcggcagcgcaaaagatg

SEQ ID NO: 236670 - DNA, 103 bp, Artificial Sequence
  Synthetic Polynucleotide
taatacgactcactatagggaccagacccaacaacgtcatcaagctgttcaacagaggagagaacagatggatgacgttaacctggcggcagcgcaaaagatg

SEQ ID NO: 236671 - DNA, 103 bp, Artificial Sequence
  Synthetic Polynucleotide
taatacgactcactatagggtgaatagctgaccagacccaacaacgtcataacagaggagaatgacgatgttgggtctgaacctggcggcagcgcaaaagatg

SEQ ID NO: 236672 - DNA, 103 bp, Artificial Sequence
  Synthetic Polynucleotide
taatacgactcactataggggagctatggctgaatagctgaccagacccaaacagaggagatgggtcatgtcagctattaacctggcggcagcgcaaaagatg

SEQ ID NO: 236673 - DNA, 103 bp, Artificial Sequence
  Synthetic Polynucleotide
taatacgactcactatagggctcaaatgacactgatgcctcgcaagatccaacagaggagaggatctatggaggcatcaaacctggcggcagcgcaaaagatg

SEQ ID NO: 236674 - DNA, 103 bp, Artificial Sequence
  Synthetic Polynucleotide
taatacgactcactatagggggcatcagaagagctatggctgaatagctgaacagaggagacagctaatgagccatagcaacctggcggcagcgcaaaagatg

SEQ ID NO: 236675 - DNA, 103 bp, Artificial Sequence
  Synthetic Polynucleotide
taatacgactcactatagggtcttgctgcaggcatcagaagagctatggcaacagaggagagccataatgcttctgatgaacctggcggcagcgcaaaagatg

SEQ ID NO: 236676 - DNA, 103 bp, Artificial Sequence
  Synthetic Polynucleotide
taatacgactcactataggggtatgaatattcttgctgcaggcatcagaaaacagaggagattctgaatgctgcagcaaaacctggcggcagcgcaaaagatg

SEQ ID NO: 236677 - DNA, 103 bp, Artificial Sequence
  Synthetic Polynucleotide
taatacgactcactatagggtgtctctcctgtatgaatattcttgctgcaaacagaggagatgcagcatgaatattcataacctggcggcagcgcaaaagatg

SEQ ID NO: 236678 - DNA, 103 bp, Artificial Sequence
  Synthetic Polynucleotide
taatacgactcactatagggctttgcaaaatgtctctcctgtatgaatataacagaggagaatattcatgcaggagagaaacctggcggcagcgcaaaagatg

SEQ ID NO: 236679 - DNA, 103 bp, Artificial Sequence
  Synthetic Polynucleotide
taatacgactcactatagggcactggttacctttgcaaaatgtctctcctaacagaggagaaggagaatgattttgcaaaacctggcggcagcgcaaaagatg

SEQ ID NO: 236680 - DNA, 103 bp, Artificial Sequence
  Synthetic Polynucleotide
taatacgactcactataggggacttttctacactggttacctttgcaaaaaacagaggagattttgcatgggtaaccagaacctggcggcagcgcaaaagatg

SEQ ID NO: 236681 - DNA, 103 bp, Artificial Sequence
  Synthetic Polynucleotide
taatacgactcactatagggtatggccacagacttttctacactggttacaacagaggagagtaaccatggtagaaaagaacctggcggcagcgcaaaagatg

SEQ ID NO: 236682 - DNA, 103 bp, Artificial Sequence
  Synthetic Polynucleotide
taatacgactcactatagggagtgactgtttatggccacagacttttctaaacagaggagatagaaaatgctgtggccaaacctggcggcagcgcaaaagatg

SEQ ID NO: 236683 - DNA, 103 bp, Artificial Sequence
  Synthetic Polynucleotide
taatacgactcactatagggatgttgcttgagtgactgtttatggccacaaacagaggagatgtggcatgaaacagtcaaacctggcggcagcgcaaaagatg

SEQ ID NO: 236684 - DNA, 103 bp, Artificial Sequence
  Synthetic Polynucleotide
taatacgactcactatagggcggtcacgtcctcaaatgacactgatgcctaacagaggagaaggcatatgtgtcatttgaacctggcggcagcgcaaaagatg

SEQ ID NO: 236685 - DNA, 103 bp, Artificial Sequence
  Synthetic Polynucleotide
taatacgactcactatagggtatgaatttgatgttgcttgagtgactgttaacagaggagaaacagtatgtcaagcaacaacctggcggcagcgcaaaagatg

SEQ ID NO: 236686 - DNA, 103 bp, Artificial Sequence
  Synthetic Polynucleotide
taatacgactcactatagggttcttctgagtatgaatttgatgttgcttgaacagaggagacaagcaatgtcaaattcaaacctggcggcagcgcaaaagatg

SEQ ID NO: 236687 - DNA, 103 bp, Artificial Sequence
  Synthetic Polynucleotide
taatacgactcactatagggtccatctggtttcttctgagtatgaatttgaacagaggagacaaattatgactcagaagaacctggcggcagcgcaaaagatg

SEQ ID NO: 236688 - DNA, 103 bp, Artificial Sequence
  Synthetic Polynucleotide
taatacgactcactatagggattcagaacatccatctggtttcttctgagaacagaggagactcagaatgaaccagatgaacctggcggcagcgcaaaagatg

SEQ ID NO: 236689 - DNA, 103 bp, Artificial Sequence
  Synthetic Polynucleotide
taatacgactcactatagggctccccccacattcagaacatccatctggtaacagaggagaaccagaatgatgttctgaaacctggcggcagcgcaaaagatg

SEQ ID NO: 236690 - DNA, 103 bp, Artificial Sequence
  Synthetic Polynucleotide
taatacgactcactatagggctgggtgaagctccccccacattcagaacaaacagaggagatgttctatgtgtggggggaacctggcggcagcgcaaaagatg

SEQ ID NO: 236691 - DNA, 103 bp, Artificial Sequence
  Synthetic Polynucleotide
taatacgactcactatagggggtgtgacttctgggtgaagctccccccacaacagaggagagtggggatggcttcacccaacctggcggcagcgcaaaagatg

SEQ ID NO: 236692 - DNA, 103 bp, Artificial Sequence
  Synthetic Polynucleotide
taatacgactcactatagggtgggcaaagaggtgtgacttctgggtgaagaacagaggagacttcacatggaagtcacaaacctggcggcagcgcaaaagatg

SEQ ID NO: 236693 - DNA, 103 bp, Artificial Sequence
  Synthetic Polynucleotide
taatacgactcactatagggaattctctgttgggcaaagaggtgtgacttaacagaggagaaagtcaatgctctttgccaacctggcggcagcgcaaaagatg

SEQ ID NO: 236694 - DNA, 103 bp, Artificial Sequence
  Synthetic Polynucleotide
taatacgactcactatagggctacactatgaattctctgttgggcaaagaaacagaggagatctttgatgaacagagaaaacctggcggcagcgcaaaagatg

SEQ ID NO: 236695 - DNA, 103 bp, Artificial Sequence
  Synthetic Polynucleotide
taatacgactcactatagggctgaagtccacggtcacgtcctcaaatgacaacagaggagagtcattatgggacgtgacaacctggcggcagcgcaaaagatg

SEQ ID NO: 236696 - DNA, 103 bp, Artificial Sequence
  Synthetic Polynucleotide
taatacgactcactatagggtggaggtttcctacactatgaattctctgtaacagaggagaacagagatgtcatagtgtaacctggcggcagcgcaaaagatg

SEQ ID NO: 236697 - DNA, 103 bp, Artificial Sequence
  Synthetic Polynucleotide
taatacgactcactataggggccacattcatggaggtttcctacactatgaacagaggagacatagtatgggaaacctcaacctggcggcagcgcaaaagatg

SEQ ID NO: 236698 - DNA, 103 bp, Artificial Sequence
  Synthetic Polynucleotide
taatacgactcactatagggttccacatttgccacattcatggaggtttcaacagaggagagaaaccatgatgaatgtgaacctggcggcagcgcaaaagatg

SEQ ID NO: 236699 - DNA, 103 bp, Artificial Sequence
  Synthetic Polynucleotide
taatacgactcactatagggatgaaggcttttccacatttgccacattcaaacagaggagatgaatgatgcaaatgtggaacctggcggcagcgcaaaagatg

SEQ ID NO: 236700 - DNA, 103 bp, Artificial Sequence
  Synthetic Polynucleotide
taatacgactcactatagggtagttgtggcatgaaggcttttccacatttaacagaggagaaaatgtatgaaagccttcaacctggcggcagcgcaaaagatg

SEQ ID NO: 236701 - DNA, 103 bp, Artificial Sequence
  Synthetic Polynucleotide
taatacgactcactatagggcactgagttttagttgtggcatgaaggcttaacagaggagaaagcctatgtgccacaacaacctggcggcagcgcaaaagatg

SEQ ID NO: 236702 - DNA, 103 bp, Artificial Sequence
  Synthetic Polynucleotide
taatacgactcactataggggtcagatatacactgagttttagttgtggcaacagaggagagccacaatgaaaactcagaacctggcggcagcgcaaaagatg

SEQ ID NO: 236703 - DNA, 103 bp, Artificial Sequence
  Synthetic Polynucleotide
taatacgactcactatagggtgtatgatctgtcagatatacactgagtttaacagaggagaaaactcatggtatatctgaacctggcggcagcgcaaaagatg

SEQ ID NO: 236704 - DNA, 103 bp, Artificial Sequence
  Synthetic Polynucleotide
taatacgactcactataggggtatatcacctgtatgatctgtcagatataaacagaggagatatatcatgcagatcataaacctggcggcagcgcaaaagatg

SEQ ID NO: 236705 - DNA, 103 bp, Artificial Sequence
  Synthetic Polynucleotide
taatacgactcactatagggcatatacagggtatatcacctgtatgatctaacagaggagaagatcaatgaggtgatataacctggcggcagcgcaaaagatg

SEQ ID NO: 236706 - DNA, 103 bp, Artificial Sequence
  Synthetic Polynucleotide
taatacgactcactatagggctggtcctctggttccacggctgtagccataacagaggagaatggctatggccgtggaaaacctggcggcagcgcaaaagatg

SEQ ID NO: 236707 - DNA, 103 bp, Artificial Sequence
  Synthetic Polynucleotide
taatacgactcactatagggcgggtcatccctctgtaagacagactctggaacagaggagaccagagatggtcttacagaacctggcggcagcgcaaaagatg

SEQ ID NO: 236708 - DNA, 103 bp, Artificial Sequence
  Synthetic Polynucleotide
taatacgactcactatagggcctgtgtatatcctccaaactcagatcttcaacagaggagagaagatatgagtttggagaacctggcggcagcgcaaaagatg

SEQ ID NO: 236709 - DNA, 103 bp, Artificial Sequence
  Synthetic Polynucleotide
taatacgactcactatagggccaaaacaggcctgtgtatatcctccaaacaacagaggagagtttggatgatatacacaaacctggcggcagcgcaaaagatg

SEQ ID NO: 236710 - DNA, 103 bp, Artificial Sequence
  Synthetic Polynucleotide
taatacgactcactatagggtctggttctcccaaaacaggcctgtgtataaacagaggagatatacaatggcctgttttaacctggcggcagcgcaaaagatg

SEQ ID NO: 236711 - DNA, 103 bp, Artificial Sequence
  Synthetic Polynucleotide
taatacgactcactatagggctggtgaatttctggttctcccaaaacaggaacagaggagacctgttatgggagaaccaaacctggcggcagcgcaaaagatg

SEQ ID NO: 236712 - DNA, 103 bp, Artificial Sequence
  Synthetic Polynucleotide
taatacgactcactatagggaatctggagtctggtgaatttctggttctcaacagaggagagagaacatgaaattcaccaacctggcggcagcgcaaaagatg

SEQ ID NO: 236713 - DNA, 103 bp, Artificial Sequence
  Synthetic Polynucleotide
taatacgactcactatagggactatttcccaatctggagtctggtgaattaacagaggagaaattcaatggactccagaaacctggcggcagcgcaaaagatg

SEQ ID NO: 236714 - DNA, 103 bp, Artificial Sequence
  Synthetic Polynucleotide
taatacgactcactataggggtcctcaaagactatttcccaatctggagtaacagaggagaactccaatgtgggaaataaacctggcggcagcgcaaaagatg

SEQ ID NO: 236715 - DNA, 103 bp, Artificial Sequence
  Synthetic Polynucleotide
taatacgactcactatagggtacctggattgtcctcaaagactatttcccaacagaggagagggaaaatgtctttgaggaacctggcggcagcgcaaaagatg

SEQ ID NO: 236716 - DNA, 103 bp, Artificial Sequence
  Synthetic Polynucleotide
taatacgactcactatagggtcattaagtctacctggattgtcctcaaagaacagaggagactttgaatgcaatccaggaacctggcggcagcgcaaaagatg

SEQ ID NO: 236717 - DNA, 103 bp, Artificial Sequence
  Synthetic Polynucleotide
taatacgactcactatagggaaatcttctttcattaagtctacctggattaacagaggagaaatccaatgagacttaataacctggcggcagcgcaaaagatg

SEQ ID NO: 236718 - DNA, 103 bp, Artificial Sequence
  Synthetic Polynucleotide
taatacgactcactatagggtttccagcaccgggtcatccctctgtaagaaacagaggagatcttacatggggatgaccaacctggcggcagcgcaaaagatg

SEQ ID NO: 236719 - DNA, 103 bp, Artificial Sequence
  Synthetic Polynucleotide
taatacgactcactatagggtattagtaccaaatcttctttcattaagtcaacagaggagagacttaatgaaagaagataacctggcggcagcgcaaaagatg

SEQ ID NO: 236720 - DNA, 103 bp, Artificial Sequence
  Synthetic Polynucleotide
taatacgactcactatagggacttgagaaatattagtaccaaatcttcttaacagaggagaaagaagatgtggtactaaaacctggcggcagcgcaaaagatg

SEQ ID NO: 236721 - DNA, 103 bp, Artificial Sequence
  Synthetic Polynucleotide
taatacgactcactatagggaaaactattcacttgagaaatattagtaccaacagaggagaggtactatgatttctcaaaacctggcggcagcgcaaaagatg

SEQ ID NO: 236722 - DNA, 103 bp, Artificial Sequence
  Synthetic Polynucleotide
taatacgactcactataggggaaggttcacaaaactattcacttgagaaaaacagaggagatttctcatgtgaatagttaacctggcggcagcgcaaaagatg

SEQ ID NO: 236723 - DNA, 103 bp, Artificial Sequence
  Synthetic Polynucleotide
taatacgactcactataggggtagtttcccgaaggttcacaaaactattcaacagaggagagaatagatgtgtgaacctaacctggcggcagcgcaaaagatg

SEQ ID NO: 236724 - DNA, 103 bp, Artificial Sequence
  Synthetic Polynucleotide
taatacgactcactataggggtggacgggtgtagtttcccgaaggttcacaacagaggagagtgaacatgcgggaaactaacctggcggcagcgcaaaagatg

SEQ ID NO: 236725 - DNA, 103 bp, Artificial Sequence
  Synthetic Polynucleotide
taatacgactcactatagggctaacagggggtggacgggtgtagtttcccaacagaggagagggaaaatgcacccgtccaacctggcggcagcgcaaaagatg

SEQ ID NO: 236726 - DNA, 103 bp, Artificial Sequence
  Synthetic Polynucleotide
taatacgactcactatagggtgatgcctccctaacagggggtggacgggtaacagaggagaacccgtatgccccctgttaacctggcggcagcgcaaaagatg

SEQ ID NO: 236727 - DNA, 103 bp, Artificial Sequence
  Synthetic Polynucleotide
taatacgactcactatagggagaacagtcatgatgcctccctaacaggggaacagaggagacccctgatggggaggcataacctggcggcagcgcaaaagatg

SEQ ID NO: 236728 - DNA, 103 bp, Artificial Sequence
  Synthetic Polynucleotide
taatacgactcactatagggttccacacacagaacagtcatgatgcctccaacagaggagaggaggcatgatgactgttaacctggcggcagcgcaaaagatg

SEQ ID NO: 236729 - DNA, 103 bp, Artificial Sequence
  Synthetic Polynucleotide
taatacgactcactatagggtggtgggaggtttccagcaccgggtcatccaacagaggagaggatgaatgggtgctggaaacctggcggcagcgcaaaagatg

SEQ ID NO: 236730 - DNA, 103 bp, Artificial Sequence
  Synthetic Polynucleotide
taatacgactcactataggggtgaagctctttccacacacagaacagtcaaacagaggagatgactgatgtgtgtgtggaacctggcggcagcgcaaaagatg

SEQ ID NO: 236731 - DNA, 103 bp, Artificial Sequence
  Synthetic Polynucleotide
taatacgactcactatagggggagttacaagtgaagctctttccacacacaacagaggagagtgtgtatgaagagcttcaacctggcggcagcgcaaaagatg

SEQ ID NO: 236732 - DNA, 103 bp, Artificial Sequence
  Synthetic Polynucleotide
taatacgactcactatagggtaacaaggtgggagttacaagtgaagctctaacagaggagaagagctatgcttgtaactaacctggcggcagcgcaaaagatg

SEQ ID NO: 236733 - DNA, 103 bp, Artificial Sequence
  Synthetic Polynucleotide
taatacgactcactatagggctcaggtgtctaacaaggtgggagttacaaaacagaggagattgtaaatgccaccttgtaacctggcggcagcgcaaaagatg

SEQ ID NO: 236734 - DNA, 103 bp, Artificial Sequence
  Synthetic Polynucleotide
taatacgactcactatagggtgtgtgagtcctcaggtgtctaacaaggtgaacagaggagacaccttatgagacacctgaacctggcggcagcgcaaaagatg

SEQ ID NO: 236735 - DNA, 103 bp, Artificial Sequence
  Synthetic Polynucleotide
taatacgactcactataggggtttctctcctgtgtgagtcctcaggtgtcaacagaggagagacaccatgggactcacaaacctggcggcagcgcaaaagatg

SEQ ID NO: 236736 - DNA, 103 bp, Artificial Sequence
  Synthetic Polynucleotide
taatacgactcactatagggcatttatagggtttctctcctgtgtgagtcaacagaggagagactcaatgaggagagaaaacctggcggcagcgcaaaagatg

SEQ ID NO: 236737 - DNA, 103 bp, Artificial Sequence
  Synthetic Polynucleotide
taatacgactcactatagggacattccatacatttatagggtttctctccaacagaggagaggagagatgccctataaaaacctggcggcagcgcaaaagatg

SEQ ID NO: 236738 - DNA, 103 bp, Artificial Sequence
  Synthetic Polynucleotide
taatacgactcactatagggaactttttccacattccatacatttataggaacagaggagacctataatggtatggaataacctggcggcagcgcaaaagatg

SEQ ID NO: 236739 - DNA, 103 bp, Artificial Sequence
  Synthetic Polynucleotide
taatacgactcactatagggcttcgtgtgtaactttttccacattccataaacagaggagatatggaatgtggaaaaagaacctggcggcagcgcaaaagatg

SEQ ID NO: 236740 - DNA, 103 bp, Artificial Sequence
  Synthetic Polynucleotide
taatacgactcactatagggtcggaagttctggtgggaggtttccagcacaacagaggagagtgctgatgacctcccacaacctggcggcagcgcaaaagatg

SEQ ID NO: 236741 - DNA, 103 bp, Artificial Sequence
  Synthetic Polynucleotide
taatacgactcactatagggaagatgtgagcttcgtgtgtaactttttccaacagaggagaggaaaaatgtacacacgaaacctggcggcagcgcaaaagatg

SEQ ID NO: 236742 - DNA, 103 bp, Artificial Sequence
  Synthetic Polynucleotide
taatacgactcactatagggggtgcctggcaagatgtgagcttcgtgtgtaacagaggagaacacacatggctcacatcaacctggcggcagcgcaaaagatg

SEQ ID NO: 236743 - DNA, 103 bp, Artificial Sequence
  Synthetic Polynucleotide
taatacgactcactatagggtgaaccttttggtgcctggcaagatgtgagaacagaggagactcacaatgtgccaggcaaacctggcggcagcgcaaaagatg

SEQ ID NO: 236744 - DNA, 103 bp, Artificial Sequence
  Synthetic Polynucleotide
taatacgactcactataggggttcatcttgtgaaccttttggtgcctggcaacagaggagagccaggatgcaaaaggttaacctggcggcagcgcaaaagatg

SEQ ID NO: 236745 - DNA, 103 bp, Artificial Sequence
  Synthetic Polynucleotide
taatacgactcactatagggtgtaaggcgcgttcatcttgtgaaccttttaacagaggagaaaaaggatgacaagatgaaacctggcggcagcgcaaaagatg

SEQ ID NO: 236746 - DNA, 103 bp, Artificial Sequence
  Synthetic Polynucleotide
taatacgactcactatagggaggggatatttgtaaggcgcgttcatcttgaacagaggagacaagatatgcgcgccttaaacctggcggcagcgcaaaagatg

SEQ ID NO: 236747 - DNA, 103 bp, Artificial Sequence
  Synthetic Polynucleotide
taatacgactcactatagggcttccggtttaggggatatttgtaaggcgcaacagaggagagcgcctatgaaatatcccaacctggcggcagcgcaaaagatg

SEQ ID NO: 236748 - DNA, 103 bp, Artificial Sequence
  Synthetic Polynucleotide
taatacgactcactatagggcttccaaattcttccggtttaggggatattaacagaggagaaatatcatgtaaaccggaaacctggcggcagcgcaaaagatg

SEQ ID NO: 236749 - DNA, 103 bp, Artificial Sequence
  Synthetic Polynucleotide
taatacgactcactatagggggggaggtctcttccaaattcttccggtttaacagaggagaaaaccgatggaatttggaaacctggcggcagcgcaaaagatg

SEQ ID NO: 236750 - DNA, 103 bp, Artificial Sequence
  Synthetic Polynucleotide
taatacgactcactatagggctgtgtcacaggggaggtctcttccaaattaacagaggagaaatttgatggagacctccaacctggcggcagcgcaaaagatg

SEQ ID NO: 236751 - DNA, 103 bp, Artificial Sequence
  Synthetic Polynucleotide
taatacgactcactatagggagcggaagcgtcggaagttctggtgggaggaacagaggagacctcccatgagaacttccaacctggcggcagcgcaaaagatg

SEQ ID NO: 236752 - DNA, 103 bp, Artificial Sequence
  Synthetic Polynucleotide
taatacgactcactatagggttctctcagcctgtgtcacaggggaggtctaacagaggagaagacctatgctgtgacacaacctggcggcagcgcaaaagatg

SEQ ID NO: 236753 - DNA, 103 bp, Artificial Sequence
  Synthetic Polynucleotide
taatacgactcactatagggactgatggagttctctcagcctgtgtcacaaacagaggagatgtgacatgggctgagagaacctggcggcagcgcaaaagatg

SEQ ID NO: 236754 - DNA, 103 bp, Artificial Sequence
  Synthetic Polynucleotide
taatacgactcactataggggggtttctccactgatggagttctctcagcaacagaggagagctgagatgactccatcaaacctggcggcagcgcaaaagatg

SEQ ID NO: 236755 - DNA, 103 bp, Artificial Sequence
  Synthetic Polynucleotide
taatacgactcactatagggcacatctatagggtttctccactgatggagaacagaggagactccatatgtggagaaacaacctggcggcagcgcaaaagatg

SEQ ID NO: 236756 - DNA, 103 bp, Artificial Sequence
  Synthetic Polynucleotide
taatacgactcactatagggccgcaatcatcacatctatagggtttctccaacagaggagaggagaaatgctatagatgaacctggcggcagcgcaaaagatg

SEQ ID NO: 236757 - DNA, 103 bp, Artificial Sequence
  Synthetic Polynucleotide
taatacgactcactataggggaagtgctttccgcaatcatcacatctataaacagaggagatatagaatggatgattgcaacctggcggcagcgcaaaagatg

SEQ ID NO: 236758 - DNA, 103 bp, Artificial Sequence
  Synthetic Polynucleotide
taatacgactcactatagggaagtccagcggaagtgctttccgcaatcataacagaggagaatgattatggaaagcactaacctggcggcagcgcaaaagatg

SEQ ID NO: 236759 - DNA, 103 bp, Artificial Sequence
  Synthetic Polynucleotide
taatacgactcactatagggacaaggtctgaagtccagcggaagtgctttaacagaggagaaaagcaatgccgctggacaacctggcggcagcgcaaaagatg

SEQ ID NO: 236760 - DNA, 103 bp, Artificial Sequence
  Synthetic Polynucleotide
taatacgactcactatagggctgatgtctgacaaggtctgaagtccagcgaacagaggagacgctggatgtcagaccttaacctggcggcagcgcaaaagatg

SEQ ID NO: 236761 - DNA, 103 bp, Artificial Sequence
  Synthetic Polynucleotide
taatacgactcactatagggtatgtgtcctctgatgtctgacaaggtctgaacagaggagacagaccatgtcagacatcaacctggcggcagcgcaaaagatg

SEQ ID NO: 236762 - DNA, 103 bp, Artificial Sequence
  Synthetic Polynucleotide
taatacgactcactataggggcctcctggtagcggaagcgtcggaagttcaacagaggagagaacttatgacgcttccgaacctggcggcagcgcaaaagatg

SEQ ID NO: 236763 - DNA, 103 bp, Artificial Sequence
  Synthetic Polynucleotide
taatacgactcactatagggttttctccagtatgtgtcctctgatgtctgaacagaggagacagacaatggaggacacaaacctggcggcagcgcaaaagatg

SEQ ID NO: 236764 - DNA, 103 bp, Artificial Sequence
  Synthetic Polynucleotide
taatacgactcactatagggaaagaagggtttttctccagtatgtgtcctaacagaggagaaggacaatgactggagaaaacctggcggcagcgcaaaagatg

SEQ ID NO: 236765 - DNA, 103 bp, Artificial Sequence
  Synthetic Polynucleotide
taatacgactcactatagggaaatagtacaaaagaagggtttttctccagaacagaggagactggagatgaacccttctaacctggcggcagcgcaaaagatg

SEQ ID NO: 236766 - DNA, 103 bp, Artificial Sequence
  Synthetic Polynucleotide
taatacgactcactatagggcttttgccacaaatagtacaaaagaagggtaacagaggagaacccttatgttgtactataacctggcggcagcgcaaaagatg

SEQ ID NO: 236767 - DNA, 103 bp, Artificial Sequence
  Synthetic Polynucleotide
taatacgactcactatagggctggctgaagcttttgccacaaatagtacaaacagaggagatgtactatgtgtggcaaaaacctggcggcagcgcaaaagatg

SEQ ID NO: 236768 - DNA, 103 bp, Artificial Sequence
  Synthetic Polynucleotide
taatacgactcactatagggacacagatttctggctgaagcttttgccacaacagaggagagtggcaatggcttcagccaacctggcggcagcgcaaaagatg

SEQ ID NO: 236769 - DNA, 103 bp, Artificial Sequence
  Synthetic Polynucleotide
taatacgactcactatagggtgtgttgttaacacagatttctggctgaagaacagaggagacttcagatggaaatctgtaacctggcggcagcgcaaaagatg

SEQ ID NO: 236770 - DNA, 103 bp, Artificial Sequence
  Synthetic Polynucleotide
taatacgactcactataggggattctttggtgtgttgttaacacagatttaacagaggagaaaatctatgttaacaacaaacctggcggcagcgcaaaagatg

SEQ ID NO: 236771 - DNA, 103 bp, Artificial Sequence
  Synthetic Polynucleotide
taatacgactcactatagggctcccaggtggattctttggtgtgttgttaaacagaggagataacaaatgaccaaagaaaacctggcggcagcgcaaaagatg

SEQ ID NO: 236772 - DNA, 103 bp, Artificial Sequence
  Synthetic Polynucleotide
taatacgactcactatagggtagggtttgcctcccaggtggattctttggaacagaggagaccaaagatgccacctgggaacctggcggcagcgcaaaagatg

SEQ ID NO: 236773 - DNA, 103 bp, Artificial Sequence
  Synthetic Polynucleotide
taatacgactcactatagggagggcttgctgcctcctggtagcggaagcgaacagaggagacgcttcatgtaccaggagaacctggcggcagcgcaaaagatg

SEQ ID NO: 236774 - DNA, 103 bp, Artificial Sequence
  Synthetic Polynucleotide
taatacgactcactatagggtccacacaagtagggtttgcctcccaggtgaacagaggagacacctgatgggcaaacccaacctggcggcagcgcaaaagatg

SEQ ID NO: 236775 - DNA, 103 bp, Artificial Sequence
  Synthetic Polynucleotide
taatacgactcactatagggcaccacactctccacacaagtagggtttgcaacagaggagagcaaacatgacttgtgtgaacctggcggcagcgcaaaagatg

SEQ ID NO: 236776 - DNA, 103 bp, Artificial Sequence
  Synthetic Polynucleotide
taatacgactcactatagggctgaagtcctcaccacactctccacacaagaacagaggagacttgtgatgagagtgtggaacctggcggcagcgcaaaagatg

SEQ ID NO: 236777 - DNA, 103 bp, Artificial Sequence
  Synthetic Polynucleotide
taatacgactcactatagggcctgtgttcactgaagtcctcaccacactcaacagaggagagagtgtatggaggacttcaacctggcggcagcgcaaaagatg

SEQ ID NO: 236778 - DNA, 103 bp, Artificial Sequence
  Synthetic Polynucleotide
taatacgactcactatagggccaggtaccgcctgtgttcactgaagtcctaacagaggagaaggactatggtgaacacaaacctggcggcagcgcaaaagatg

SEQ ID NO: 236779 - DNA, 103 bp, Artificial Sequence
  Synthetic Polynucleotide
taatacgactcactatagggttccggtgcgccaggtaccgcctgtgttcaaacagaggagatgaacaatggcggtacctaacctggcggcagcgcaaaagatg

SEQ ID NO: 236780 - DNA, 103 bp, Artificial Sequence
  Synthetic Polynucleotide
taatacgactcactatagggagcgtgcgtcttccggtgcgccaggtaccgaacagaggagacggtacatggcgcaccggaacctggcggcagcgcaaaagatg

SEQ ID NO: 236781 - DNA, 103 bp, Artificial Sequence
  Synthetic Polynucleotide
taatacgactcactataggggttcctcagcagcgtgcgtcttccggtgcgaacagaggagacgcaccatgagacgcacgaacctggcggcagcgcaaaagatg

SEQ ID NO: 236782 - DNA, 103 bp, Artificial Sequence
  Synthetic Polynucleotide
taatacgactcactatagggcagaggtagagttcctcagcagcgtgcgtcaacagaggagagacgcaatgtgctgaggaaacctggcggcagcgcaaaagatg

SEQ ID NO: 236783 - DNA, 103 bp, Artificial Sequence
  Synthetic Polynucleotide
taatacgactcactataggggcactcgctgcagaggtagagttcctcagcaacagaggagagctgagatgctctacctcaacctggcggcagcgcaaaagatg

SEQ ID NO: 236784 - DNA, 103 bp, Artificial Sequence
  Synthetic Polynucleotide
taatacgactcactataggggagcttctctagggcttgctgcctcctggtaacagaggagaaccaggatgcagcaagccaacctggcggcagcgcaaaagatg

SEQ ID NO: 236785 - DNA, 103 bp, Artificial Sequence
  Synthetic Polynucleotide
taatacgactcactatagggagcagcgcccgcactcgctgcagaggtagaaacagaggagatctaccatggcagcgagtaacctggcggcagcgcaaaagatg

SEQ ID NO: 236786 - DNA, 103 bp, Artificial Sequence
  Synthetic Polynucleotide
taatacgactcactatagggctgtgggtgaagcagcgcccgcactcgctgaacagaggagacagcgaatgcgggcgctgaacctggcggcagcgcaaaagatg

SEQ ID NO: 236787 - DNA, 103 bp, Artificial Sequence
  Synthetic Polynucleotide
taatacgactcactataggggaacgctgcgctgtgggtgaagcagcgcccaacagaggagagggcgcatgttcacccacaacctggcggcagcgcaaaagatg

SEQ ID NO: 236788 - DNA, 103 bp, Artificial Sequence
  Synthetic Polynucleotide
taatacgactcactatagggagtgcttggcgaacgctgcgctgtgggtgaaacagaggagatcacccatggcgcagcgtaacctggcggcagcgcaaaagatg

SEQ ID NO: 236789 - DNA, 103 bp, Artificial Sequence
  Synthetic Polynucleotide
taatacgactcactatagggtgtcctctcaagtgcttggcgaacgctgcgaacagaggagacgcagcatgcgccaagcaaacctggcggcagcgcaaaagatg

SEQ ID NO: 236790 - DNA, 103 bp, Artificial Sequence
  Synthetic Polynucleotide
taatacgactcactatagggcactgaggcgtgtcctctcaagtgcttggcaacagaggagagccaagatgttgagaggaaacctggcggcagcgcaaaagatg

SEQ ID NO: 236791 - DNA, 103 bp, Artificial Sequence
  Synthetic Polynucleotide
taatacgactcactatagggggcagggcctcactgaggcgtgtcctctcaaacagaggagatgagagatgacgcctcagaacctggcggcagcgcaaaagatg

SEQ ID NO: 236792 - DNA, 103 bp, Artificial Sequence
  Synthetic Polynucleotide
taatacgactcactatagggtcgttgcatcggcagggcctcactgaggcgaacagaggagacgcctcatggaggccctgaacctggcggcagcgcaaaagatg

SEQ ID NO: 236793 - DNA, 103 bp, Artificial Sequence
  Synthetic Polynucleotide
taatacgactcactatagggcttcccacattcgttgcatcggcagggcctaacagaggagaaggcccatgcgatgcaacaacctggcggcagcgcaaaagatg

SEQ ID NO: 236794 - DNA, 103 bp, Artificial Sequence
  Synthetic Polynucleotide
taatacgactcactataggggactgaagctcttcccacattcgttgcatcaacagaggagagatgcaatgaatgtgggaaacctggcggcagcgcaaaagatg

SEQ ID NO: 236795 - DNA, 103 bp, Artificial Sequence
  Synthetic Polynucleotide
taatacgactcactatagggagtctgatgagagcttctctagggcttgctaacagaggagaagcaagatgtagagaagcaacctggcggcagcgcaaaagatg

SEQ ID NO: 236796 - DNA, 103 bp, Artificial Sequence
  Synthetic Polynucleotide
taatacgactcactatagggtggtccctgcgactgaagctcttcccacataacagaggagaatgtggatggagcttcagaacctggcggcagcgcaaaagatg

SEQ ID NO: 236797 - DNA, 103 bp, Artificial Sequence
  Synthetic Polynucleotide
taatacgactcactatagggcctgacgaggtggtccctgcgactgaagctaacagaggagaagcttcatgcgcagggacaacctggcggcagcgcaaaagatg

SEQ ID NO: 236798 - DNA, 103 bp, Artificial Sequence
  Synthetic Polynucleotide
taatacgactcactatagggttctctgatgcctgacgaggtggtccctgcaacagaggagagcagggatgacctcgtcaaacctggcggcagcgcaaaagatg

SEQ ID NO: 236799 - DNA, 103 bp, Artificial Sequence
  Synthetic Polynucleotide
taatacgactcactatagggccagtgtgtgttctctgatgcctgacgaggaacagaggagacctcgtatggcatcagagaacctggcggcagcgcaaaagatg

SEQ ID NO: 236800 - DNA, 103 bp, Artificial Sequence
  Synthetic Polynucleotide
taatacgactcactatagggtggtttctccccagtgtgtgttctctgatgaacagaggagacatcagatgacacacactaacctggcggcagcgcaaaagatg

SEQ ID NO: 236801 - DNA, 103 bp, Artificial Sequence
  Synthetic Polynucleotide
taatacgactcactatagggggcacgtgaatggtttctccccagtgtgtgaacagaggagacacacaatggggagaaacaacctggcggcagcgcaaaagatg

SEQ ID NO: 236802 - DNA, 103 bp, Artificial Sequence
  Synthetic Polynucleotide
taatacgactcactatagggccacaggtagggcacgtgaatggtttctccaacagaggagaggagaaatgattcacgtgaacctggcggcagcgcaaaagatg

SEQ ID NO: 236803 - DNA, 103 bp, Artificial Sequence
  Synthetic Polynucleotide
taatacgactcactataggggaagctttttccacaggtagggcacgtgaaaacagaggagattcacgatgcctacctgtaacctggcggcagcgcaaaagatg

SEQ ID NO: 236804 - DNA, 103 bp, Artificial Sequence
  Synthetic Polynucleotide
taatacgactcactatagggatcctctgctgaagctttttccacaggtagaacagaggagactacctatggaaaaagctaacctggcggcagcgcaaaagatg

SEQ ID NO: 236805 - DNA, 103 bp, Artificial Sequence
  Synthetic Polynucleotide
taatacgactcactatagggattaagtgatatcctctgctgaagctttttaacagaggagaaaaaagatgcagcagaggaacctggcggcagcgcaaaagatg

SEQ ID NO: 236806 - DNA, 103 bp, Artificial Sequence
  Synthetic Polynucleotide
taatacgactcactatagggaagttctcggagtctgatgagagcttctctaacagaggagaagagaaatgctcatcagaaacctggcggcagcgcaaaagatg

SEQ ID NO: 236807 - DNA, 103 bp, Artificial Sequence
  Synthetic Polynucleotide
taatacgactcactatagggctgatgcctaattaagtgatatcctctgctaacagaggagaagcagaatgtatcacttaaacctggcggcagcgcaaaagatg

SEQ ID NO: 236808 - DNA, 103 bp, Artificial Sequence
  Synthetic Polynucleotide
taatacgactcactatagggagtgggtcctctgatgcctaattaagtgataacagaggagaatcactatgttaggcatcaacctggcggcagcgcaaaagatg

SEQ ID NO: 236809 - DNA, 103 bp, Artificial Sequence
  Synthetic Polynucleotide
taatacgactcactataggggtcttttctgagtgggtcctctgatgcctaaacagaggagataggcaatggaggacccaaacctggcggcagcgcaaaagatg

SEQ ID NO: 236810 - DNA, 103 bp, Artificial Sequence
  Synthetic Polynucleotide
taatacgactcactatagggcccaaagatcctggtcctctggttccacggaacagaggagaccgtggatgcagaggaccaacctggcggcagcgcaaaagatg

SEQ ID NO: 236811 - DNA, 103 bp, Artificial Sequence
  Synthetic Polynucleotide
taatacgactcactatagggactggtgacaaagttctcggagtctgatgaaacagaggagatcatcaatgtccgagaacaacctggcggcagcgcaaaagatg

SEQ ID NO: 236812 - DNA, 103 bp, Artificial Sequence
  Synthetic Polynucleotide
taatacgactcactatagggggtctcagccactggtgacaaagttctcggaacagaggagaccgagaatgttgtcaccaaacctggcggcagcgcaaaagatg

SEQ ID NO: 236813 - DNA, 103 bp, Artificial Sequence
  Synthetic Polynucleotide
taatacgactcactatagggccgcctctctggtctcagccactggtgacaaacagaggagatgtcacatgtggctgagaaacctggcggcagcgcaaaagatg

SEQ ID NO: 236814 - DNA, 103 bp, Artificial Sequence
  Synthetic Polynucleotide
taatacgactcactataggggctcctttgtccgcctctctggtctcagccaacagaggagaggctgaatgcagagaggcaacctggcggcagcgcaaaagatg

SEQ ID NO: 236815 - DNA, 103 bp, Artificial Sequence
  Synthetic Polynucleotide
taatacgactcactatagggtctaggatctgctcctttgtccgcctctctaacagaggagaagagagatggacaaaggaaacctggcggcagcgcaaaagatg

SEQ ID NO: 236816 - DNA, 103 bp, Artificial Sequence
  Synthetic Polynucleotide
taatacgactcactatagggcacaagcagctctaggatctgctcctttgtaacagaggagaacaaagatgcagatcctaaacctggcggcagcgcaaaagatg

SEQ ID NO: 236817 - DNA, 103 bp, Artificial Sequence
  Synthetic Polynucleotide
taatacgactcactatagggattgttccagcacaagcagctctaggatctaacagaggagaagatccatgagctgcttgaacctggcggcagcgcaaaagatg

SEQ ID NO: 236818 - DNA, 103 bp, Artificial Sequence
  Synthetic Polynucleotide
taatacgactcactatagggacggtaagaaattgttccagcacaagcagcaacagaggagagctgctatggctggaacaaacctggcggcagcgcaaaagatg

SEQ ID NO: 236819 - DNA, 103 bp, Artificial Sequence
  Synthetic Polynucleotide
taatacgactcactatagggtccaggtaggacggtaagaaattgttccagaacagaggagactggaaatgtttcttaccaacctggcggcagcgcaaaagatg

SEQ ID NO: 236820 - DNA, 103 bp, Artificial Sequence
  Synthetic Polynucleotide
taatacgactcactatagggtctgtagttctccaggtaggacggtaagaaaacagaggagattcttaatgtcctacctgaacctggcggcagcgcaaaagatg

SEQ ID NO: 236821 - DNA, 103 bp, Artificial Sequence
  Synthetic Polynucleotide
taatacgactcactatagggccctcttcttcccaaagatcctggtcctctaacagaggagaagaggaatgggatctttgaacctggcggcagcgcaaaagatg

SEQ ID NO: 236822 - DNA, 103 bp, Artificial Sequence
  Synthetic Polynucleotide
taatacgactcactatagggcgcacccagctctgtagttctccaggtaggaacagaggagacctaccatgagaactacaaacctggcggcagcgcaaaagatg

SEQ ID NO: 236823 - DNA, 103 bp, Artificial Sequence
  Synthetic Polynucleotide
taatacgactcactatagggccgttggccccgcacccagctctgtagttcaacagaggagagaactaatgagctgggtgaacctggcggcagcgcaaaagatg

SEQ ID NO: 236824 - DNA, 103 bp, Artificial Sequence
  Synthetic Polynucleotide
taatacgactcactatagggcactttctggccgttggccccgcacccagcaacagaggagagctgggatgggggccaacaacctggcggcagcgcaaaagatg

SEQ ID NO: 236825 - DNA, 103 bp, Artificial Sequence
  Synthetic Polynucleotide
taatacgactcactataggggcctcctcgccactttctggccgttggcccaacagaggagagggccaatggccagaaagaacctggcggcagcgcaaaagatg

SEQ ID NO: 236826 - DNA, 103 bp, Artificial Sequence
  Synthetic Polynucleotide
taatacgactcactatagggcagcgtcactgcctcctcgccactttctggaacagaggagaccagaaatgggcgaggagaacctggcggcagcgcaaaagatg

SEQ ID NO: 236827 - DNA, 103 bp, Artificial Sequence
  Synthetic Polynucleotide
taatacgactcactatagggaaccctccaccagcgtcactgcctcctcgcaacagaggagagcgaggatgcagtgacgcaacctggcggcagcgcaaaagatg

SEQ ID NO: 236828 - DNA, 103 bp, Artificial Sequence
  Synthetic Polynucleotide
taatacgactcactatagggtgtttctgcaaaccctccaccagcgtcactaacagaggagaagtgacatgggtggagggaacctggcggcagcgcaaaagatg

SEQ ID NO: 236829 - DNA, 103 bp, Artificial Sequence
  Synthetic Polynucleotide
taatacgactcactatagggtctcctgggttgtttctgcaaaccctccacaacagaggagagtggagatgttgcagaaaaacctggcggcagcgcaaaagatg

SEQ ID NO: 236830 - DNA, 103 bp, Artificial Sequence
  Synthetic Polynucleotide
taatacgactcactatagggaccgccttggtctcctgggttgtttctgcaaacagaggagatgcagaatgaacccaggaaacctggcggcagcgcaaaagatg

SEQ ID NO: 236831 - DNA, 103 bp, Artificial Sequence
  Synthetic Polynucleotide
taatacgactcactatagggacagtcacccaccgccttggtctcctgggtaacagaggagaacccagatgaccaaggcgaacctggcggcagcgcaaaagatg

SEQ ID NO: 236832 - DNA, 103 bp, Artificial Sequence
  Synthetic Polynucleotide
taatacgactcactatagggcatcagaattccctcttcttcccaaagatcaacagaggagagatcttatggaagaagagaacctggcggcagcgcaaaagatg

SEQ ID NO: 236833 - DNA, 103 bp, Artificial Sequence
  Synthetic Polynucleotide
taatacgactcactataggggtgaacatggacagtcacccaccgccttggaacagaggagaccaaggatgtgggtgactaacctggcggcagcgcaaaagatg

SEQ ID NO: 236834 - DNA, 103 bp, Artificial Sequence
  Synthetic Polynucleotide
taatacgactcactatagggcttcctggccgtgaacatggacagtcacccaacagaggagagggtgaatgtccatgttcaacctggcggcagcgcaaaagatg

SEQ ID NO: 236835 - DNA, 103 bp, Artificial Sequence
  Synthetic Polynucleotide
taatacgactcactatagggtctgacaggacttcctggccgtgaacatggaacagaggagaccatgtatgcggccaggaaacctggcggcagcgcaaaagatg

SEQ ID NO: 236836 - DNA, 103 bp, Artificial Sequence
  Synthetic Polynucleotide
taatacgactcactatagggcaccgtctcctctgacaggacttcctggccaacagaggagaggccagatggtcctgtcaaacctggcggcagcgcaaaagatg

SEQ ID NO: 236837 - DNA, 103 bp, Artificial Sequence
  Synthetic Polynucleotide
taatacgactcactatagggctcctaaatgcaccgtctcctctgacaggaaacagaggagatcctgtatgaggagacggaacctggcggcagcgcaaaagatg

SEQ ID NO: 236838 - DNA, 103 bp, Artificial Sequence
  Synthetic Polynucleotide
taatacgactcactatagggtcaggctccactcctaaatgcaccgtctccaacagaggagaggagacatggcatttaggaacctggcggcagcgcaaaagatg

SEQ ID NO: 236839 - DNA, 103 bp, Artificial Sequence
  Synthetic Polynucleotide
taatacgactcactatagggattaggtgactcaggctccactcctaaatgaacagaggagacatttaatggtggagcctaacctggcggcagcgcaaaagatg

SEQ ID NO: 236840 - DNA, 103 bp, Artificial Sequence
  Synthetic Polynucleotide
taatacgactcactatagggcctgcagctcattaggtgactcaggctccaaacagaggagatggagcatgagtcacctaaacctggcggcagcgcaaaagatg

SEQ ID NO: 236841 - DNA, 103 bp, Artificial Sequence
  Synthetic Polynucleotide
taatacgactcactatagggtgcacaggatcctgcagctcattaggtgacaacagaggagagtcaccatgtgagctgcaaacctggcggcagcgcaaaagatg

SEQ ID NO: 236842 - DNA, 103 bp, Artificial Sequence
  Synthetic Polynucleotide
taatacgactcactatagggggtcgagctttgcacaggatcctgcagctcaacagaggagagagctgatggatcctgtgaacctggcggcagcgcaaaagatg

SEQ ID NO: 236843 - DNA, 103 bp, Artificial Sequence
  Synthetic Polynucleotide
taatacgactcactatagggccagtttcaccatcagaattccctcttcttaacagaggagaaagaagatggaattctgaaacctggcggcagcgcaaaagatg

SEQ ID NO: 236844 - DNA, 103 bp, Artificial Sequence
  Synthetic Polynucleotide
taatacgactcactatagggactgctcgggggtcgagctttgcacaggataacagaggagaatcctgatgaaagctcgaaacctggcggcagcgcaaaagatg

SEQ ID NO: 236845 - DNA, 103 bp, Artificial Sequence
  Synthetic Polynucleotide
taatacgactcactatagggtcctcaggagactgctcgggggtcgagcttaacagaggagaaagctcatgccccgagcaaacctggcggcagcgcaaaagatg

SEQ ID NO: 236846 - DNA, 103 bp, Artificial Sequence
  Synthetic Polynucleotide
taatacgactcactatagggctgtgtggtttcctcaggagactgctcgggaacagaggagacccgagatgtctcctgagaacctggcggcagcgcaaaagatg

SEQ ID NO: 236847 - DNA, 103 bp, Artificial Sequence
  Synthetic Polynucleotide
taatacgactcactataggggatctgggctctgtgtggtttcctcaggagaacagaggagactcctgatgaaaccacacaacctggcggcagcgcaaaagatg

SEQ ID NO: 236848 - DNA, 103 bp, Artificial Sequence
  Synthetic Polynucleotide
taatacgactcactatagggggtgcccccagatctgggctctgtgtggttaacagaggagaaaccacatggagcccagaaacctggcggcagcgcaaaagatg

SEQ ID NO: 236849 - DNA, 103 bp, Artificial Sequence
  Synthetic Polynucleotide
taatacgactcactatagggctgctctgccggtgcccccagatctgggctaacagaggagaagcccaatgctgggggcaaacctggcggcagcgcaaaagatg

SEQ ID NO: 236850 - DNA, 103 bp, Artificial Sequence
  Synthetic Polynucleotide
taatacgactcactatagggggtgtggacgctgctctgccggtgcccccaaacagaggagatgggggatgcggcagagcaacctggcggcagcgcaaaagatg

SEQ ID NO: 236851 - DNA, 103 bp, Artificial Sequence
  Synthetic Polynucleotide
taatacgactcactatagggtcctcttcctggtgtggacgctgctctgccaacagaggagaggcagaatggcgtccacaaacctggcggcagcgcaaaagatg

SEQ ID NO: 236852 - DNA, 103 bp, Artificial Sequence
  Synthetic Polynucleotide
taatacgactcactatagggggtctggagctcctcttcctggtgtggacgaacagaggagacgtccaatgcaggaagagaacctggcggcagcgcaaaagatg

SEQ ID NO: 236853 - DNA, 103 bp, Artificial Sequence
  Synthetic Polynucleotide
taatacgactcactatagggtctcctgcagggtctggagctcctcttcctaacagaggagaaggaagatgagctccagaaacctggcggcagcgcaaaagatg

SEQ ID NO: 236854 - DNA, 103 bp, Artificial Sequence
  Synthetic Polynucleotide
taatacgactcactatagggaaatcatcttccagtttcaccatcagaattaacagaggagaaattctatgggtgaaactaacctggcggcagcgcaaaagatg

SEQ ID NO: 236855 - DNA, 103 bp, Artificial Sequence
  Synthetic Polynucleotide
taatacgactcactataggggggacctcgctctcctgcagggtctggagcaacagaggagagctccaatgcctgcaggaaacctggcggcagcgcaaaagatg

SEQ ID NO: 236856 - DNA, 103 bp, Artificial Sequence
  Synthetic Polynucleotide
taatacgactcactatagggctcgggcactgggacctcgctctcctgcagaacagaggagactgcagatgagcgaggtcaacctggcggcagcgcaaaagatg

SEQ ID NO: 236857 - DNA, 103 bp, Artificial Sequence
  Synthetic Polynucleotide
taatacgactcactatagggggtctgggtcctcgggcactgggacctcgcaacagaggagagcgaggatgcagtgcccgaacctggcggcagcgcaaaagatg

SEQ ID NO: 236858 - DNA, 103 bp, Artificial Sequence
  Synthetic Polynucleotide
taatacgactcactatagggtctgcaggaaggtctgggtcctcgggcactaacagaggagaagtgccatgggacccagaaacctggcggcagcgcaaaagatg

SEQ ID NO: 236859 - DNA, 103 bp, Artificial Sequence
  Synthetic Polynucleotide
taatacgactcactatagggagagctcctctctgcaggaaggtctgggtcaacagaggagagacccaatgcttcctgcaaacctggcggcagcgcaaaagatg

SEQ ID NO: 236860 - DNA, 103 bp, Artificial Sequence
  Synthetic Polynucleotide
taatacgactcactatagggctgagtctccagagctcctctctgcaggaaaacagaggagattcctgatgagaggagctaacctggcggcagcgcaaaagatg

SEQ ID NO: 236861 - DNA, 103 bp, Artificial Sequence
  Synthetic Polynucleotide
taatacgactcactataggggcaaccatctctgagtctccagagctcctcaacagaggagagaggagatgtggagactcaacctggcggcagcgcaaaagatg

SEQ ID NO: 236862 - DNA, 103 bp, Artificial Sequence
  Synthetic Polynucleotide
taatacgactcactatagggagtaagaagagcaaccatctctgagtctccaacagaggagaggagacatggagatggttaacctggcggcagcgcaaaagatg

SEQ ID NO: 236863 - DNA, 103 bp, Artificial Sequence
  Synthetic Polynucleotide
taatacgactcactataggggtgacagagcagtaagaagagcaaccatctaacagaggagaagatggatgctcttcttaaacctggcggcagcgcaaaagatg

SEQ ID NO: 236864 - DNA, 103 bp, Artificial Sequence
  Synthetic Polynucleotide
taatacgactcactatagggaccagtccctgtgacagagcagtaagaagaaacagaggagatcttctatgtgctctgtcaacctggcggcagcgcaaaagatg

SEQ ID NO: 236865 - DNA, 103 bp, Artificial Sequence
  Synthetic Polynucleotide
taatacgactcactatagggccgacaggtgaaatcatcttccagtttcacaacagaggagagtgaaaatggaagatgataacctggcggcagcgcaaaagatg

SEQ ID NO: 236866 - DNA, 103 bp, Artificial Sequence
  Synthetic Polynucleotide
taatacgactcactatagggcttgaacgttaccagtccctgtgacagagcaacagaggagagctctgatgcagggactgaacctggcggcagcgcaaaagatg

SEQ ID NO: 236867 - DNA, 103 bp, Artificial Sequence
  Synthetic Polynucleotide
taatacgactcactatagggcggccacatccttgaacgttaccagtccctaacagaggagaagggacatgtaacgttcaaacctggcggcagcgcaaaagatg

SEQ ID NO: 236868 - DNA, 103 bp, Artificial Sequence
  Synthetic Polynucleotide
taatacgactcactataggggaaaagcatacggccacatccttgaacgttaacagaggagaaacgttatgggatgtggcaacctggcggcagcgcaaaagatg

SEQ ID NO: 236869 - DNA, 103 bp, Artificial Sequence
  Synthetic Polynucleotide
taatacgactcactatagggctggtcctgggaaaagcatacggccacatcaacagaggagagatgtgatggtatgctttaacctggcggcagcgcaaaagatg

SEQ ID NO: 236870 - DNA, 103 bp, Artificial Sequence
  Synthetic Polynucleotide
taatacgactcactataggggatcactccactggtcctgggaaaagcataaacagaggagatatgctatgcccaggaccaacctggcggcagcgcaaaagatg

SEQ ID NO: 236871 - DNA, 103 bp, Artificial Sequence
  Synthetic Polynucleotide
taatacgactcactataggggttgggtccagatcactccactggtcctggaacagaggagaccaggaatggtggagtgaaacctggcggcagcgcaaaagatg

SEQ ID NO: 236872 - DNA, 103 bp, Artificial Sequence
  Synthetic Polynucleotide
taatacgactcactatagggctctttctgtgttgggtccagatcactccaaacagaggagatggagtatgctggacccaaacctggcggcagcgcaaaagatg

SEQ ID NO: 236873 - DNA, 103 bp, Artificial Sequence
  Synthetic Polynucleotide
taatacgactcactatagggctccatagaactctttctgtgttgggtccaaacagaggagatggaccatgcacagaaagaacctggcggcagcgcaaaagatg

SEQ ID NO: 236874 - DNA, 103 bp, Artificial Sequence
  Synthetic Polynucleotide
taatacgactcactatagggaagacatattctccatagaactctttctgtaacagaggagaacagaaatggttctatggaacctggcggcagcgcaaaagatg

SEQ ID NO: 236875 - DNA, 103 bp, Artificial Sequence
  Synthetic Polynucleotide
taatacgactcactataggggtcttcttccaagacatattctccatagaaaacagaggagattctatatggaatatgtcaacctggcggcagcgcaaaagatg

SEQ ID NO: 236876 - DNA, 103 bp, Artificial Sequence
  Synthetic Polynucleotide
taatacgactcactatagggcagactctggccgacaggtgaaatcatcttaacagaggagaaagatgatgtcacctgtcaacctggcggcagcgcaaaagatg

SEQ ID NO: 236877 - DNA, 103 bp, Artificial Sequence
  Synthetic Polynucleotide
taatacgactcactatagggcaattccacagtcttcttccaagacatattaacagaggagaaatatgatgtggaagaagaacctggcggcagcgcaaaagatg

SEQ ID NO: 236878 - DNA, 103 bp, Artificial Sequence
  Synthetic Polynucleotide
taatacgactcactatagggagagagacaacaattccacagtcttcttccaacagaggagaggaagaatgctgtggaataacctggcggcagcgcaaaagatg

SEQ ID NO: 236879 - DNA, 103 bp, Artificial Sequence
  Synthetic Polynucleotide
taatacgactcactatagggtggaaatgacagagagacaacaattccacaaacagaggagatgtggaatggttgtctctaacctggcggcagcgcaaaagatg

SEQ ID NO: 236880 - DNA, 103 bp, Artificial Sequence
  Synthetic Polynucleotide
taatacgactcactataggggtctggggattggaaatgacagagagacaaaacagaggagattgtctatgtgtcatttcaacctggcggcagcgcaaaagatg

SEQ ID NO: 236881 - DNA, 103 bp, Artificial Sequence
  Synthetic Polynucleotide
taatacgactcactatagggatctcatcaggtctggggattggaaatgacaacagaggagagtcattatgaatccccagaacctggcggcagcgcaaaagatg

SEQ ID NO: 236882 - DNA, 103 bp, Artificial Sequence
  Synthetic Polynucleotide
taatacgactcactatagggaacctgggagatctcatcaggtctggggataacagaggagaatccccatgcctgatgagaacctggcggcagcgcaaaagatg

SEQ ID NO: 236883 - DNA, 103 bp, Artificial Sequence
  Synthetic Polynucleotide
taatacgactcactatagggcttcctctctaacctgggagatctcatcagaacagaggagactgatgatgtctcccaggaacctggcggcagcgcaaaagatg

SEQ ID NO: 236884 - DNA, 103 bp, Artificial Sequence
  Synthetic Polynucleotide
taatacgactcactatagggacccaaggctcttcctctctaacctgggagaacagaggagactcccaatgtagagaggaaacctggcggcagcgcaaaagatg

SEQ ID NO: 236885 - DNA, 103 bp, Artificial Sequence
  Synthetic Polynucleotide
taatacgactcactataggggatatctgggacccaaggctcttcctctctaacagaggagaagagagatggagccttggaacctggcggcagcgcaaaagatg

SEQ ID NO: 236886 - DNA, 103 bp, Artificial Sequence
  Synthetic Polynucleotide
taatacgactcactataggggaggctcttggatatctgggacccaaggctaacagaggagaagccttatgtcccagataaacctggcggcagcgcaaaagatg

SEQ ID NO: 236887 - DNA, 103 bp, Artificial Sequence
  Synthetic Polynucleotide
taatacgactcactatagggctctgtaagacagactctggccgacaggtgaacagaggagacacctgatggccagagtcaacctggcggcagcgcaaaagatg

SEQ ID NO: 236888 - DNA, 103 bp, Artificial Sequence
  Synthetic Polynucleotide
taatacgactcactatagggtgagtctcctgaggctcttggatatctgggaacagaggagacccagaatgccaagagccaacctggcggcagcgcaaaagatg

SEQ ID NO: 236889 - DNA, 103 bp, Artificial Sequence
  Synthetic Polynucleotide
taatacgactcactatagggttctggctcttgagtctcctgaggctcttgaacagaggagacaagagatgcaggagactaacctggcggcagcgcaaaagatg

SEQ ID NO: 236890 - DNA, 103 bp, Artificial Sequence
  Synthetic Polynucleotide
taatacgactcactatagggaactcaggatttctggctcttgagtctcctaacagaggagaaggagaatgaagagccagaacctggcggcagcgcaaaagatg

SEQ ID NO: 236891 - DNA, 103 bp, Artificial Sequence
  Synthetic Polynucleotide
taatacgactcactataggggtgtaggtaaaactcaggatttctggctctaacagaggagaagagccatgaatcctgagaacctggcggcagcgcaaaagatg

SEQ ID NO: 236892 - DNA, 103 bp, Artificial Sequence
  Synthetic Polynucleotide
taatacgactcactatagggcctatctcctgtgtaggtaaaactcaggataacagaggagaatcctgatgtttacctacaacctggcggcagcgcaaaagatg

SEQ ID NO: 236893 - DNA, 103 bp, Artificial Sequence
  Synthetic Polynucleotide
taatacgactcactatagggcatctttactcctatctcctgtgtaggtaaaacagaggagattacctatgcaggagataaacctggcggcagcgcaaaagatg

SEQ ID NO: 236894 - DNA, 103 bp, Artificial Sequence
  Synthetic Polynucleotide
taatacgactcactatagggcactcttcctcatctttactcctatctcctaacagaggagaaggagaatggagtaaagaaacctggcggcagcgcaaaagatg

SEQ ID NO: 236895 - DNA, 103 bp, Artificial Sequence
  Synthetic Polynucleotide
taatacgactcactatagggctgctccagacactcttcctcatctttactaacagaggagaagtaaaatggaggaagagaacctggcggcagcgcaaaagatg

SEQ ID NO: 236896 - DNA, 103 bp, Artificial Sequence
  Synthetic Polynucleotide
taatacgactcactatagggtcagatcttcctgctccagacactcttcctaacagaggagaaggaagatggtctggagcaacctggcggcagcgcaaaagatg

SEQ ID NO: 236897 - DNA, 103 bp, Artificial Sequence
  Synthetic Polynucleotide
taatacgactcactatagggtcctccaaactcagatcttcctgctccagaaacagaggagatctggaatgggaagatctaacctggcggcagcgcaaaagatg

SEQ ID NO: 236898 - DNA, 103 bp, Artificial Sequence
  Synthetic Polynucleotide
taatacgactcactataggggtcctggatgcctccgccgtctgcagacataacagaggagaatgtctatggacggcggaaacctggcggcagcgcaaaagatg

SEQ ID NO: 236899 - DNA, 103 bp, Artificial Sequence
  Synthetic Polynucleotide
taatacgactcactatagggtgaaggtaccgcctcccccagcttagaaggaacagaggagaccttctatgctgggggagaacctggcggcagcgcaaaagatg

SEQ ID NO: 236900 - DNA, 103 bp, Artificial Sequence
  Synthetic Polynucleotide
taatacgactcactataggggtcagtgcaggcgtagggcttctcgcccgtaacagaggagaacgggcatgaagccctacaacctggcggcagcgcaaaagatg

SEQ ID NO: 236901 - DNA, 103 bp, Artificial Sequence
  Synthetic Polynucleotide
taatacgactcactataggggcttcccgcagtcagtgcaggcgtagggctaacagaggagaagccctatgcctgcactgaacctggcggcagcgcaaaagatg

SEQ ID NO: 236902 - DNA, 103 bp, Artificial Sequence
  Synthetic Polynucleotide
taatacgactcactatagggcggccgaagcgcttcccgcagtcagtgcagaacagaggagactgcacatgctgcgggaaaacctggcggcagcgcaaaagatg

SEQ ID NO: 236903 - DNA, 103 bp, Artificial Sequence
  Synthetic Polynucleotide
taatacgactcactataggggtgcgagctgcggccgaagcgcttcccgcaaacagaggagatgcgggatgcgcttcggcaacctggcggcagcgcaaaagatg

SEQ ID NO: 236904 - DNA, 103 bp, Artificial Sequence
  Synthetic Polynucleotide
taatacgactcactataggggctggatgaggtgcgagctgcggccgaagcaacagaggagagcttcgatggcagctcgcaacctggcggcagcgcaaaagatg

SEQ ID NO: 236905 - DNA, 103 bp, Artificial Sequence
  Synthetic Polynucleotide
taatacgactcactatagggatgatctggtgctggatgaggtgcgagctgaacagaggagacagctcatgcctcatccaaacctggcggcagcgcaaaagatg

SEQ ID NO: 236906 - DNA, 103 bp, Artificial Sequence
  Synthetic Polynucleotide
taatacgactcactataggggcccgtgtggatgatctggtgctggatgagaacagaggagactcatcatgcaccagatcaacctggcggcagcgcaaaagatg

SEQ ID NO: 236907 - DNA, 103 bp, Artificial Sequence
  Synthetic Polynucleotide
taatacgactcactatagggagggcttctcgcccgtgtggatgatctggtaacagaggagaaccagaatgtccacacggaacctggcggcagcgcaaaagatg

SEQ ID NO: 236908 - DNA, 103 bp, Artificial Sequence
  Synthetic Polynucleotide
taatacgactcactataggggggcaggtgtagggcttctcgcccgtgtggaacagaggagaccacacatgcgagaagccaacctggcggcagcgcaaaagatg

SEQ ID NO: 236909 - DNA, 103 bp, Artificial Sequence
  Synthetic Polynucleotide
taatacgactcactatagggccggcaggcggggcaggtgtagggcttctcaacagaggagagagaagatgtacacctgcaacctggcggcagcgcaaaagatg

SEQ ID NO: 236910 - DNA, 103 bp, Artificial Sequence
  Synthetic Polynucleotide
taatacgactcactataggggagtgtcccctgaaggtaccgcctcccccaaacagaggagatgggggatgcggtaccttaacctggcggcagcgcaaaagatg

SEQ ID NO: 236911 - DNA, 103 bp, Artificial Sequence
  Synthetic Polynucleotide
taatacgactcactatagggtgaagctcttccggcaggcggggcaggtgtaacagaggagaacacctatgccgcctgccaacctggcggcagcgcaaaagatg

SEQ ID NO: 236912 - DNA, 103 bp, Artificial Sequence
  Synthetic Polynucleotide
taatacgactcactataggggagtggtggctgaagctcttccggcaggcgaacagaggagacgcctgatggaagagcttaacctggcggcagcgcaaaagatg

SEQ ID NO: 236913 - DNA, 103 bp, Artificial Sequence
  Synthetic Polynucleotide
taatacgactcactatagggaatcagcgtggagtggtggctgaagctcttaacagaggagaaagagcatgagccaccacaacctggcggcagcgcaaaagatg

SEQ ID NO: 236914 - DNA, 103 bp, Artificial Sequence
  Synthetic Polynucleotide
taatacgactcactataggggctggtgctgaatcagcgtggagtggtggcaacagaggagagccaccatgccacgctgaaacctggcggcagcgcaaaagatg

SEQ ID NO: 236915 - DNA, 103 bp, Artificial Sequence
  Synthetic Polynucleotide
taatacgactcactataggggtgtggatgcgctggtgctgaatcagcgtgaacagaggagacacgctatgtcagcaccaaacctggcggcagcgcaaaagatg

SEQ ID NO: 236916 - DNA, 103 bp, Artificial Sequence
  Synthetic Polynucleotide
taatacgactcactatagggcttctctccggtgtggatgcgctggtgctgaacagaggagacagcacatgcgcatccacaacctggcggcagcgcaaaagatg

SEQ ID NO: 236917 - DNA, 103 bp, Artificial Sequence
  Synthetic Polynucleotide
taatacgactcactatagggacacgtagggcttctctccggtgtggatgcaacagaggagagcatccatgccggagagaaacctggcggcagcgcaaaagatg

SEQ ID NO: 236918 - DNA, 103 bp, Artificial Sequence
  Synthetic Polynucleotide
taatacgactcactatagggcagcggtcgcacacgtagggcttctctccgaacagaggagacggagaatggccctacgtaacctggcggcagcgcaaaagatg

SEQ ID NO: 236919 - DNA, 103 bp, Artificial Sequence
  Synthetic Polynucleotide
taatacgactcactataggggcgcttggcgcagcggtcgcacacgtagggaacagaggagaccctacatgtgcgaccgcaacctggcggcagcgcaaaagatg

SEQ ID NO: 236920 - DNA, 103 bp, Artificial Sequence
  Synthetic Polynucleotide
taatacgactcactatagggggcgggtgaagcgcttggcgcagcggtcgcaacagaggagagcgaccatggcgccaagcaacctggcggcagcgcaaaagatg

SEQ ID NO: 236921 - DNA, 103 bp, Artificial Sequence
  Synthetic Polynucleotide
taatacgactcactatagggagtgactcctgagtgtcccctgaaggtaccaacagaggagaggtaccatgaggggacacaacctggcggcagcgcaaaagatg

SEQ ID NO: 236922 - DNA, 103 bp, Artificial Sequence
  Synthetic Polynucleotide
taatacgactcactatagggaagtccgagcggcgggtgaagcgcttggcgaacagaggagacgccaaatgcttcacccgaacctggcggcagcgcaaaagatg

SEQ ID NO: 236923 - DNA, 103 bp, Artificial Sequence
  Synthetic Polynucleotide
taatacgactcactataggggtgggtgaccaagtccgagcggcgggtgaaaacagaggagattcaccatgcgctcggacaacctggcggcagcgcaaaagatg

SEQ ID NO: 236924 - DNA, 103 bp, Artificial Sequence
  Synthetic Polynucleotide
taatacgactcactataggggggtgccctggtgggtgaccaagtccgagcaacagaggagagctcggatgtggtcacccaacctggcggcagcgcaaaagatg

SEQ ID NO: 236925 - DNA, 103 bp, Artificial Sequence
  Synthetic Polynucleotide
taatacgactcactataggggcgcccgtgtgggtgccctggtgggtgaccaacagaggagaggtcacatgccagggcacaacctggcggcagcgcaaaagatg

SEQ ID NO: 236926 - DNA, 103 bp, Artificial Sequence
  Synthetic Polynucleotide
taatacgactcactataggggtgcggcttggcgcccgtgtgggtgccctgaacagaggagacagggcatgcacacgggcaacctggcggcagcgcaaaagatg

SEQ ID NO: 236927 - DNA, 103 bp, Artificial Sequence
  Synthetic Polynucleotide
taatacgactcactatagggtggggcacttgtgcggcttggcgcccgtgtaacagaggagaacacggatgccaagccgcaacctggcggcagcgcaaaagatg

SEQ ID NO: 236928 - DNA, 103 bp, Artificial Sequence
  Synthetic Polynucleotide
taatacgactcactatagggttggcgcagatggggcacttgtgcggcttgaacagaggagacaagccatgcaagtgcccaacctggcggcagcgcaaaagatg

SEQ ID NO: 236929 - DNA, 103 bp, Artificial Sequence
  Synthetic Polynucleotide
taatacgactcactatagggcgtgaagcacttggcgcagatggggcacttaacagaggagaaagtgcatgatctgcgccaacctggcggcagcgcaaaagatg

SEQ ID NO: 236930 - DNA, 103 bp, Artificial Sequence
  Synthetic Polynucleotide
taatacgactcactatagggccgagctctgcgtgaagcacttggcgcagaaacagaggagatctgcgatgagtgcttcaaacctggcggcagcgcaaaagatg

SEQ ID NO: 236931 - DNA, 103 bp, Artificial Sequence
  Synthetic Polynucleotide
taatacgactcactataggggtgactagcgccgagctctgcgtgaagcacaacagaggagagtgcttatggcagagctcaacctggcggcagcgcaaaagatg

SEQ ID NO: 236932 - DNA, 103 bp, Artificial Sequence
  Synthetic Polynucleotide
taatacgactcactatagggcttaatgtgcagtgactcctgagtgtccccaacagaggagaggggacatgcaggagtcaaacctggcggcagcgcaaaagatg

SEQ ID NO: 236933 - DNA, 103 bp, Artificial Sequence
  Synthetic Polynucleotide
taatacgactcactataggggcgctggtgggtgactagcgccgagctctgaacagaggagacagagcatggcgctagtcaacctggcggcagcgcaaaagatg

SEQ ID NO: 236934 - DNA, 103 bp, Artificial Sequence
  Synthetic Polynucleotide
taatacgactcactatagggcagtgtgggtgcgctggtgggtgactagcgaacagaggagacgctagatgcccaccagcaacctggcggcagcgcaaaagatg

SEQ ID NO: 236935 - DNA, 103 bp, Artificial Sequence
  Synthetic Polynucleotide
taatacgactcactatagggggcttgaccccagtgtgggtgcgctggtggaacagaggagaccaccaatgcacccacacaacctggcggcagcgcaaaagatg

SEQ ID NO: 236936 - DNA, 103 bp, Artificial Sequence
  Synthetic Polynucleotide
taatacgactcactataggggcacggatagggcttgaccccagtgtgggtaacagaggagaacccacatgggggtcaagaacctggcggcagcgcaaaagatg

SEQ ID NO: 236937 - DNA, 103 bp, Artificial Sequence
  Synthetic Polynucleotide
taatacgactcactatagggcgcactcggggcacggatagggcttgacccaacagaggagagggtcaatgcctatccgtaacctggcggcagcgcaaaagatg

SEQ ID NO: 236938 - DNA, 103 bp, Artificial Sequence
  Synthetic Polynucleotide
taatacgactcactatagggaagcacttgccgcactcggggcacggatagaacagaggagactatccatgccccgagtgaacctggcggcagcgcaaaagatg

SEQ ID NO: 236939 - DNA, 103 bp, Artificial Sequence
  Synthetic Polynucleotide
taatacgactcactatagggacgctggctgaagcacttgccgcactcgggaacagaggagacccgagatgggcaagtgcaacctggcggcagcgcaaaagatg

SEQ ID NO: 236940 - DNA, 103 bp, Artificial Sequence
  Synthetic Polynucleotide
taatacgactcactatagggtgaggttggaacgctggctgaagcacttgcaacagaggagagcaagtatgtcagccagcaacctggcggcagcgcaaaagatg

SEQ ID NO: 236941 - DNA, 103 bp, Artificial Sequence
  Synthetic Polynucleotide
taatacgactcactatagggttgtgcgcgatgaggttggaacgctggctgaacagaggagacagccaatgttccaacctaacctggcggcagcgcaaaagatg

SEQ ID NO: 236942 - DNA, 103 bp, Artificial Sequence
  Synthetic Polynucleotide
taatacgactcactataggggtgtgtgcggttgtgcgcgatgaggttggaaacagaggagatccaacatgatcgcgcacaacctggcggcagcgcaaaagatg

SEQ ID NO: 236943 - DNA, 103 bp, Artificial Sequence
  Synthetic Polynucleotide
taatacgactcactatagggcgggctccatcttaatgtgcagtgactcctaacagaggagaaggagtatgtgcacattaaacctggcggcagcgcaaaagatg

SEQ ID NO: 236944 - DNA, 103 bp, Artificial Sequence
  Synthetic Polynucleotide
taatacgactcactatagggtctcgcctgtgtgtgtgcggttgtgcgcgaaacagaggagatcgcgcatgaccgcacacaacctggcggcagcgcaaaagatg

SEQ ID NO: 236945 - DNA, 103 bp, Artificial Sequence
  Synthetic Polynucleotide
taatacgactcactatagggtggtagggcttctcgcctgtgtgtgtgcggaacagaggagaccgcacatgcacaggcgaaacctggcggcagcgcaaaagatg

SEQ ID NO: 236946 - DNA, 103 bp, Artificial Sequence
  Synthetic Polynucleotide
taatacgactcactataggggtcgaggcagtggtagggcttctcgcctgtaacagaggagaacaggcatgaagccctacaacctggcggcagcgcaaaagatg

SEQ ID NO: 236947 - DNA, 103 bp, Artificial Sequence
  Synthetic Polynucleotide
taatacgactcactatagggtcttgccgcagtcgaggcagtggtagggctaacagaggagaagccctatgactgcctcgaacctggcggcagcgcaaaagatg

SEQ ID NO: 236948 - DNA, 103 bp, Artificial Sequence
  Synthetic Polynucleotide
taatacgactcactatagggtggctgaagctcttgccgcagtcgaggcagaacagaggagactgcctatgctgcggcaaaacctggcggcagcgcaaaagatg

SEQ ID NO: 236949 - DNA, 103 bp, Artificial Sequence
  Synthetic Polynucleotide
taatacgactcactataggggtgcgagctgtggctgaagctcttgccgcaaacagaggagatgcggcatgagcttcagcaacctggcggcagcgcaaaagatg

SEQ ID NO: 236950 - DNA, 103 bp, Artificial Sequence
  Synthetic Polynucleotide
taatacgactcactataggggcgcggtgaggtgcgagctgtggctgaagcaacagaggagagcttcaatgacagctcgcaacctggcggcagcgcaaaagatg

SEQ ID NO: 236951 - DNA, 103 bp, Artificial Sequence
  Synthetic Polynucleotide
taatacgactcactataggggtgcgctggtgcgcggtgaggtgcgagctgaacagaggagacagctcatgcctcaccgcaacctggcggcagcgcaaaagatg

SEQ ID NO: 236952 - DNA, 103 bp, Artificial Sequence
  Synthetic Polynucleotide
taatacgactcactataggggccacggtgggtgcgctggtgcgcggtgagaacagaggagactcaccatgcaccagcgcaacctggcggcagcgcaaaagatg

SEQ ID NO: 236953 - DNA, 103 bp, Artificial Sequence
  Synthetic Polynucleotide
taatacgactcactatagggagggccgcacgccacggtgggtgcgctggtaacagaggagaaccagcatgcccaccgtgaacctggcggcagcgcaaaagatg

SEQ ID NO: 236954 - DNA, 103 bp, Artificial Sequence
  Synthetic Polynucleotide
taatacgactcactatagggtgtggctcttcgggctccatcttaatgtgcaacagaggagagcacatatggatggagccaacctggcggcagcgcaaaagatg

SEQ ID NO: 236955 - DNA, 103 bp, Artificial Sequence
  Synthetic Polynucleotide
taatacgactcactataggggggcaggcgtagggccgcacgccacggtggaacagaggagaccaccgatgcgtgcggccaacctggcggcagcgcaaaagatg

SEQ ID NO: 236956 - DNA, 103 bp, Artificial Sequence
  Synthetic Polynucleotide
taatacgactcactataggggccgcacaacgggcaggcgtagggccgcacaacagaggagagtgcggatgtacgcctgcaacctggcggcagcgcaaaagatg

SEQ ID NO: 236957 - DNA, 103 bp, Artificial Sequence
  Synthetic Polynucleotide
taatacgactcactatagggtgaagctcttgccgcacaacgggcaggcgtaacagaggagaacgcctatgcgttgtgcgaacctggcggcagcgcaaaagatg

SEQ ID NO: 236958 - DNA, 103 bp, Artificial Sequence
  Synthetic Polynucleotide
taatacgactcactataggggagcgccggctgaagctcttgccgcacaacaacagaggagagttgtgatgcaagagcttaacctggcggcagcgcaaaagatg

SEQ ID NO: 236959 - DNA, 103 bp, Artificial Sequence
  Synthetic Polynucleotide
taatacgactcactataggggtgcaggttggagcgccggctgaagctcttaacagaggagaaagagcatgagccggcgcaacctggcggcagcgcaaaagatg

SEQ ID NO: 236960 - DNA, 103 bp, Artificial Sequence
  Synthetic Polynucleotide
taatacgactcactatagggtctcgtgccggtgcaggttggagcgccggcaacagaggagagccggcatgccaacctgcaacctggcggcagcgcaaaagatg

SEQ ID NO: 236961 - DNA, 103 bp, Artificial Sequence
  Synthetic Polynucleotide
taatacgactcactataggggtgtggatcttctcgtgccggtgcaggttgaacagaggagacaacctatgccggcacgaaacctggcggcagcgcaaaagatg

SEQ ID NO: 236962 - DNA, 103 bp, Artificial Sequence
  Synthetic Polynucleotide
taatacgactcactataggggggcccggtggtgtggatcttctcgtgccgaacagaggagacggcacatgaagatccacaacctggcggcagcgcaaaagatg

SEQ ID NO: 236963 - DNA, 103 bp, Artificial Sequence
  Synthetic Polynucleotide
taatacgactcactatagggccagggccttgggcccggtggtgtggatctaacagaggagaagatccatgccaccgggcaacctggcggcagcgcaaaagatg

SEQ ID NO: 236964 - DNA, 103 bp, Artificial Sequence
  Synthetic Polynucleotide
taatacgactcactatagggatcagcatggccagggccttgggcccggtgaacagaggagacaccggatgcaaggccctaacctggcggcagcgcaaaagatg

SEQ ID NO: 236965 - DNA, 103 bp, Artificial Sequence
  Synthetic Polynucleotide
taatacgactcactatagggcccctcggagtgtggctcttcgggctccataacagaggagaatggagatggaagagccaaacctggcggcagcgcaaaagatg

SEQ ID NO: 236966 - DNA, 103 bp, Artificial Sequence
  Synthetic Polynucleotide
taatacgactcactatagggcgcccccagcatcagcatggccagggccttaacagaggagaaaggccatggccatgctgaacctggcggcagcgcaaaagatg

SEQ ID NO: 236967 - DNA, 103 bp, Artificial Sequence
  Synthetic Polynucleotide
taatacgactcactatagggccgccgccgccgcccccagcatcagcatggaacagaggagaccatgcatgtgctgggggaacctggcggcagcgcaaaagatg

SEQ ID NO: 236968 - DNA, 103 bp, Artificial Sequence
  Synthetic Polynucleotide
taatacgactcactataggggccagagcccccgccgccgccgcccccagcaacagaggagagctgggatgggcggcggcaacctggcggcagcgcaaaagatg

SEQ ID NO: 236969 - DNA, 103 bp, Artificial Sequence
  Synthetic Polynucleotide
taatacgactcactatagggtgggggtgtggccagagcccccgccgccgcaacagaggagagcggcgatgggggctctgaacctggcggcagcgcaaaagatg

SEQ ID NO: 236970 - DNA, 103 bp, Artificial Sequence
  Synthetic Polynucleotide
taatacgactcactatagggtgggagcgggtgggggtgtggccagagcccaacagaggagagggctcatgccacaccccaacctggcggcagcgcaaaagatg

SEQ ID NO: 236971 - DNA, 103 bp, Artificial Sequence
  Synthetic Polynucleotide
taatacgactcactatagggcctgcgatgccccctcggagtgtggctcttaacagaggagaaagagcatgactccgaggaacctggcggcagcgcaaaagatg

SEQ ID NO: 236972 - DNA, 103 bp, Artificial Sequence
  Synthetic Polynucleotide
taatacgactcactataggggccccatcctcctgcgatgccccctcggagaacagaggagactccgaatgggcatcgcaaacctggcggcagcgcaaaagatg

SEQ ID NO: 236973 - DNA, 103 bp, Artificial Sequence
  Synthetic Polynucleotide
taatacgactcactatagggggcaccttgagccccatcctcctgcgatgcaacagaggagagcatcgatggaggatgggaacctggcggcagcgcaaaagatg

SEQ ID NO: 236974 - DNA, 103 bp, Artificial Sequence
  Synthetic Polynucleotide
taatacgactcactatagggtgtcctgggtgtcctggatgcctccgccgtaacagaggagaacggcgatggcatccaggaacctggcggcagcgcaaaagatg

SEQ ID NO: 236975 - DNA, 103 bp, Artificial Sequence
  Synthetic Polynucleotide
taatacgactcactatagggcccagccccaggcaccttgagccccatcctaacagaggagaaggatgatgctcaaggtgaacctggcggcagcgcaaaagatg

SEQ ID NO: 236976 - DNA, 103 bp, Artificial Sequence
  Synthetic Polynucleotide
taatacgactcactatagggcttaggggtgcccagccccaggcaccttgaaacagaggagatcaaggatgctggggctgaacctggcggcagcgcaaaagatg

SEQ ID NO: 236977 - DNA, 103 bp, Artificial Sequence
  Synthetic Polynucleotide
taatacgactcactatagggagagccgtgacttaggggtgcccagccccaaacagaggagatggggcatggcacccctaaacctggcggcagcgcaaaagatg

SEQ ID NO: 236978 - DNA, 103 bp, Artificial Sequence
  Synthetic Polynucleotide
taatacgactcactatagggctttctccttagagccgtgacttaggggtgaacagaggagacaccccatggtcacggctaacctggcggcagcgcaaaagatg

SEQ ID NO: 236979 - DNA, 103 bp, Artificial Sequence
  Synthetic Polynucleotide
taatacgactcactatagggaggaagagagctttctccttagagccgtgaaacagaggagatcacggatgtaaggagaaaacctggcggcagcgcaaaagatg

SEQ ID NO: 236980 - DNA, 103 bp, Artificial Sequence
  Synthetic Polynucleotide
taatacgactcactatagggtccgccaggcaggaagagagctttctccttaacagaggagaaaggagatggctctcttcaacctggcggcagcgcaaaagatg

SEQ ID NO: 236981 - DNA, 103 bp, Artificial Sequence
  Synthetic Polynucleotide
taatacgactcactatagggaggggagggctccgccaggcaggaagagagaacagaggagactctctatgtgcctggcgaacctggcggcagcgcaaaagatg

SEQ ID NO: 236982 - DNA, 103 bp, Artificial Sequence
  Synthetic Polynucleotide
taatacgactcactatagggatccggggggaggggagggctccgccaggcaacagaggagagcctggatgagccctcccaacctggcggcagcgcaaaagatg

SEQ ID NO: 236983 - DNA, 103 bp, Artificial Sequence
  Synthetic Polynucleotide
taatacgactcactatagggaagcacggggatccggggggaggggagggcaacagaggagagccctcatgtccccccggaacctggcggcagcgcaaaagatg

SEQ ID NO: 236984 - DNA, 103 bp, Artificial Sequence
  Synthetic Polynucleotide
taatacgactcactatagggcctctcgggaaagcacggggatccggggggaacagaggagaccccccatgtccccgtgcaacctggcggcagcgcaaaagatg

SEQ ID NO: 236985 - DNA, 103 bp, Artificial Sequence
  Synthetic Polynucleotide
taatacgactcactatagggggtgtctccttgtcctgggtgtcctggatgaacagaggagacatccaatgcacccaggaaacctggcggcagcgcaaaagatg

SEQ ID NO: 236986 - DNA, 103 bp, Artificial Sequence
  Synthetic Polynucleotide
taatacgactcactatagggctggtcctcccctctcgggaaagcacggggaacagaggagaccccgtatgttcccgagaaacctggcggcagcgcaaaagatg

SEQ ID NO: 236987 - DNA, 103 bp, Artificial Sequence
  Synthetic Polynucleotide
taatacgactcactatagggctgccggtctctggtcctcccctctcgggaaacagaggagatcccgaatggggaggaccaacctggcggcagcgcaaaagatg

SEQ ID NO: 236988 - DNA, 103 bp, Artificial Sequence
  Synthetic Polynucleotide
taatacgactcactatagggctgcagccatctgccggtctctggtcctccaacagaggagaggaggaatggagaccggcaacctggcggcagcgcaaaagatg

SEQ ID NO: 236989 - DNA, 103 bp, Artificial Sequence
  Synthetic Polynucleotide
taatacgactcactataggggtgaggagcgctgcagccatctgccggtctaacagaggagaagaccgatggatggctgcaacctggcggcagcgcaaaagatg

SEQ ID NO: 236990 - DNA, 103 bp, Artificial Sequence
  Synthetic Polynucleotide
taatacgactcactatagggggaccaggcagtgaggagcgctgcagccataacagaggagaatggctatggcgctcctcaacctggcggcagcgcaaaagatg

SEQ ID NO: 236991 - DNA, 103 bp, Artificial Sequence
  Synthetic Polynucleotide
taatacgactcactatagggctggcatctgggaccaggcagtgaggagcgaacagaggagacgctccatgctgcctggtaacctggcggcagcgcaaaagatg

SEQ ID NO: 236992 - DNA, 103 bp, Artificial Sequence
  Synthetic Polynucleotide
taatacgactcactatagggtcgaaagtcactggcatctgggaccaggcaaacagaggagatgcctgatgccagatgccaacctggcggcagcgcaaaagatg

SEQ ID NO: 236993 - DNA, 103 bp, Artificial Sequence
  Synthetic Polynucleotide
taatacgactcactatagggggccacatcctcgaaagtcactggcatctgaacagaggagacagatgatggtgactttcaacctggcggcagcgcaaaagatg

SEQ ID NO: 236994 - DNA, 103 bp, Artificial Sequence
  Synthetic Polynucleotide
taatacgactcactatagggagaggtacaaggccacatcctcgaaagtcaaacagaggagatgacttatgaggatgtggaacctggcggcagcgcaaaagatg

SEQ ID NO: 236995 - DNA, 103 bp, Artificial Sequence
  Synthetic Polynucleotide
taatacgactcactatagggtcctcccgggagaggtacaaggccacatccaacagaggagaggatgtatgcttgtacctaacctggcggcagcgcaaaagatg

SEQ ID NO: 236996 - DNA, 103 bp, Artificial Sequence
  Synthetic Polynucleotide
taatacgactcactatagggaacctccgggggtgtctccttgtcctgggtaacagaggagaacccagatgaaggagacaaacctggcggcagcgcaaaagatg

SEQ ID NO: 236997 - DNA, 103 bp, Artificial Sequence
  Synthetic Polynucleotide
taatacgactcactatagggccgtccccactcctcccgggagaggtacaaaacagaggagattgtacatgtcccgggagaacctggcggcagcgcaaaagatg

SEQ ID NO: 236998 - DNA, 103 bp, Artificial Sequence
  Synthetic Polynucleotide
taatacgactcactatagggtgtggtccagccgtccccactcctcccgggaacagaggagacccgggatgagtggggacaacctggcggcagcgcaaaagatg

SEQ ID NO: 236999 - DNA, 103 bp, Artificial Sequence
  Synthetic Polynucleotide
taatacgactcactatagggttctgctgcgtgtggtccagccgtccccacaacagaggagagtggggatggctggaccaaacctggcggcagcgcaaaagatg

SEQ ID NO: 237000 - DNA, 103 bp, Artificial Sequence
  Synthetic Polynucleotide
taatacgactcactatagggcctgtagaagttctgctgcgtgtggtccagaacagaggagactggacatgacgcagcagaacctggcggcagcgcaaaagatg

SEQ ID NO: 237001 - DNA, 103 bp, Artificial Sequence
  Synthetic Polynucleotide
taatacgactcactataggggcaggacatccctgtagaagttctgctgcgaacagaggagacgcagcatgacttctacaaacctggcggcagcgcaaaagatg

SEQ ID NO: 237002 - DNA, 103 bp, Artificial Sequence
  Synthetic Polynucleotide
taatacgactcactatagggtttttcttctgcaggacatccctgtagaagaacagaggagacttctaatgggatgtcctaacctggcggcagcgcaaaagatg

SEQ ID NO: 237003 - DNA, 103 bp, Artificial Sequence
  Synthetic Polynucleotide
taatacgactcactatagggtgacagcccatttttcttctgcaggacatcaacagaggagagatgtcatgcagaagaaaaacctggcggcagcgcaaaagatg

SEQ ID NO: 237004 - DNA, 103 bp, Artificial Sequence
  Synthetic Polynucleotide
taatacgactcactataggggaaagcccagtgacagcccatttttcttctaacagaggagaagaagaatgatgggctgtaacctggcggcagcgcaaaagatg

SEQ ID NO: 237005 - DNA, 103 bp, Artificial Sequence
  Synthetic Polynucleotide
taatacgactcactatagggctgctgaagggaaagcccagtgacagcccaaacagaggagatgggctatgactgggcttaacctggcggcagcgcaaaagatg

SEQ ID NO: 237006 - DNA, 103 bp, Artificial Sequence
  Synthetic Polynucleotide
taatacgactcactatagggccagaaaggcctgctgaagggaaagcccagaacagaggagactgggcatgcccttcagcaacctggcggcagcgcaaaagatg

SEQ ID NO: 237007 - DNA, 103 bp, Artificial Sequence
  Synthetic Polynucleotide
taatacgactcactatagggcacgatctggaacctccgggggtgtctcctaacagaggagaaggagaatgccccggaggaacctggcggcagcgcaaaagatg

SEQ ID NO: 237008 - DNA, 103 bp, Artificial Sequence
  Synthetic Polynucleotide
taatacgactcactatagggcttgaggggcccagaaaggcctgctgaaggaacagaggagaccttcaatgggcctttctaacctggcggcagcgcaaaagatg

SEQ ID NO: 237009 - DNA, 103 bp, Artificial Sequence
  Synthetic Polynucleotide
taatacgactcactatagggttgccgtgcgcttgaggggcccagaaaggcaacagaggagagcctttatgggcccctcaaacctggcggcagcgcaaaagatg

SEQ ID NO: 237010 - DNA, 103 bp, Artificial Sequence
  Synthetic Polynucleotide
taatacgactcactatagggggcctcacccttgccgtgcgcttgaggggcaacagaggagagcccctatggcgcacggcaacctggcggcagcgcaaaagatg

SEQ ID NO: 237011 - DNA, 103 bp, Artificial Sequence
  Synthetic Polynucleotide
taatacgactcactatagggtggagcccgaggcctcacccttgccgtgcgaacagaggagacgcacgatgagggtgaggaacctggcggcagcgcaaaagatg

SEQ ID NO: 237012 - DNA, 103 bp, Artificial Sequence
  Synthetic Polynucleotide
taatacgactcactataggggcctgccggctggagcccgaggcctcacccaacagaggagagggtgaatgctcgggctcaacctggcggcagcgcaaaagatg

SEQ ID NO: 237013 - DNA, 103 bp, Artificial Sequence
  Synthetic Polynucleotide
taatacgactcactatagggctcatctcctgcctgccggctggagcccgaaacagaggagatcgggcatgagccggcagaacctggcggcagcgcaaaagatg

SEQ ID NO: 237014 - DNA, 103 bp, Artificial Sequence
  Synthetic Polynucleotide
taatacgactcactatagggtccactccttctcatctcctgcctgccggcaacagaggagagccggcatgcaggagatgaacctggcggcagcgcaaaagatg

SEQ ID NO: 237015 - DNA, 103 bp, Artificial Sequence
  Synthetic Polynucleotide
taatacgactcactatagggcacgcgcctctccactccttctcatctcctaacagaggagaaggagaatggaaggagtgaacctggcggcagcgcaaaagatg

SEQ ID NO: 237016 - DNA, 103 bp, Artificial Sequence
  Synthetic Polynucleotide
taatacgactcactatagggggctcctgtgcacgcgcctctccactccttaacagaggagaaaggagatgagaggcgcgaacctggcggcagcgcaaaagatg

SEQ ID NO: 237017 - DNA, 103 bp, Artificial Sequence
  Synthetic Polynucleotide
taatacgactcactatagggccacctcgacggctcctgtgcacgcgcctcaacagaggagagaggcgatggcacaggagaacctggcggcagcgcaaaagatg

SEQ ID NO: 237018 - DNA, 103 bp, Artificial Sequence
  Synthetic Polynucleotide
taatacgactcactatagggtgaggatgtccacgatctggaacctccgggaacagaggagacccggaatgtccagatcgaacctggcggcagcgcaaaagatg

SEQ ID NO: 237019 - DNA, 103 bp, Artificial Sequence
  Synthetic Polynucleotide
taatacgactcactatagggaccctctgccccacctcgacggctcctgtgaacagaggagacacaggatgcgtcgaggtaacctggcggcagcgcaaaagatg

SEQ ID NO: 237020 - DNA, 103 bp, Artificial Sequence
  Synthetic Polynucleotide
taatacgactcactatagggtgaggtctgcaccctctgccccacctcgacaacagaggagagtcgagatggggcagaggaacctggcggcagcgcaaaagatg

SEQ ID NO: 237021 - DNA, 103 bp, Artificial Sequence
  Synthetic Polynucleotide
taatacgactcactatagggctgccacggatgaggtctgcaccctctgccaacagaggagaggcagaatgtgcagacctaacctggcggcagcgcaaaagatg

SEQ ID NO: 237022 - DNA, 103 bp, Artificial Sequence
  Synthetic Polynucleotide
taatacgactcactatagggttcccaagggctgccacggatgaggtctgcaacagaggagagcagacatgatccgtggcaacctggcggcagcgcaaaagatg

SEQ ID NO: 237023 - DNA, 103 bp, Artificial Sequence
  Synthetic Polynucleotide
taatacgactcactataggggggcttcacattcccaagggctgccacggaaacagaggagatccgtgatggcccttgggaacctggcggcagcgcaaaagatg

SEQ ID NO: 237024 - DNA, 103 bp, Artificial Sequence
  Synthetic Polynucleotide
taatacgactcactatagggtggttctgaagggcttcacattcccaagggaacagaggagacccttgatgatgtgaagcaacctggcggcagcgcaaaagatg

SEQ ID NO: 237025 - DNA, 103 bp, Artificial Sequence
  Synthetic Polynucleotide
taatacgactcactatagggctccctgccctggttctgaagggcttcacaaacagaggagatgtgaaatgcttcagaacaacctggcggcagcgcaaaagatg

SEQ ID NO: 237026 - DNA, 103 bp, Artificial Sequence
  Synthetic Polynucleotide
taatacgactcactatagggccactggactctccctgccctggttctgaaaacagaggagattcagaatgagggcagggaacctggcggcagcgcaaaagatg

SEQ ID NO: 237027 - DNA, 103 bp, Artificial Sequence
  Synthetic Polynucleotide
taatacgactcactataggggcgggacgccccactggactctccctgcccaacagaggagagggcagatggagtccagtaacctggcggcagcgcaaaagatg

SEQ ID NO: 237028 - DNA, 103 bp, Artificial Sequence
  Synthetic Polynucleotide
taatacgactcactatagggtgcgcgcactgcgggacgccccactggactaacagaggagaagtccaatggggcgtcccaacctggcggcagcgcaaaagatg

SEQ ID NO: 237029 - DNA, 103 bp, Artificial Sequence
  Synthetic Polynucleotide
taatacgactcactatagggcatttcctgatgaggatgtccacgatctggaacagaggagaccagatatgggacatcctaacctggcggcagcgcaaaagatg

SEQ ID NO: 237030 - DNA, 103 bp, Artificial Sequence
  Synthetic Polynucleotide
taatacgactcactatagggggctgcttcctgcgcgcactgcgggacgccaacagaggagaggcgtcatgcagtgcgcgaacctggcggcagcgcaaaagatg

SEQ ID NO: 237031 - DNA, 103 bp, Artificial Sequence
  Synthetic Polynucleotide
taatacgactcactatagggtccggccgcaggctgcttcctgcgcgcactaacagaggagaagtgcgatgaggaagcagaacctggcggcagcgcaaaagatg

SEQ ID NO: 237032 - DNA, 103 bp, Artificial Sequence
  Synthetic Polynucleotide
taatacgactcactatagggggccctgagctccggccgcaggctgcttccaacagaggagaggaagcatgctgcggccgaacctggcggcagcgcaaaagatg

SEQ ID NO: 237033 - DNA, 103 bp, Artificial Sequence
  Synthetic Polynucleotide
taatacgactcactataggggtctttggccggccctgagctccggccgcaaacagaggagatgcggcatgagctcagggaacctggcggcagcgcaaaagatg

SEQ ID NO: 237034 - DNA, 103 bp, Artificial Sequence
  Synthetic Polynucleotide
taatacgactcactataggggctgcccggagtctttggccggccctgagcaacagaggagagctcagatgcggccaaagaacctggcggcagcgcaaaagatg

SEQ ID NO: 237035 - DNA, 103 bp, Artificial Sequence
  Synthetic Polynucleotide
taatacgactcactatagggggctcagccggctgcccggagtctttggccaacagaggagaggccaaatgctccgggcaaacctggcggcagcgcaaaagatg

SEQ ID NO: 237036 - DNA, 103 bp, Artificial Sequence
  Synthetic Polynucleotide
taatacgactcactatagggggtgcgatctggctcagccggctgcccggaaacagaggagatccgggatgccggctgagaacctggcggcagcgcaaaagatg

SEQ ID NO: 237037 - DNA, 103 bp, Artificial Sequence
  Synthetic Polynucleotide
taatacgactcactatagggctgcatccggggtgcgatctggctcagccgaacagaggagacggctgatgcagatcgcaaacctggcggcagcgcaaaagatg

SEQ ID NO: 237038 - DNA, 103 bp, Artificial Sequence
  Synthetic Polynucleotide
taatacgactcactatagggtctggcggagctgcatccggggtgcgatctaacagaggagaagatcgatgcccggatgcaacctggcggcagcgcaaaagatg

SEQ ID NO: 237039 - DNA, 103 bp, Artificial Sequence
  Synthetic Polynucleotide
taatacgactcactataggggggactggggtctggcggagctgcatccggaacagaggagaccggatatggctccgccaaacctggcggcagcgcaaaagatg

SEQ ID NO: 237040 - DNA, 103 bp, Artificial Sequence
  Synthetic Polynucleotide
taatacgactcactataggggcttagaaggcatttcctgatgaggatgtcaacagaggagagacatcatgatcaggaaaaacctggcggcagcgcaaaagatg

SEQ ID NO: 237041 - DNA, 103 bp, Artificial Sequence
  Synthetic Polynucleotide
taatacgactcactatagggggggctccgtgggactggggtctggcggagaacagaggagactccgcatgaccccagtcaacctggcggcagcgcaaaagatg

SEQ ID NO: 237042 - DNA, 103 bp, Artificial Sequence
  Synthetic Polynucleotide
taatacgactcactatagggcggtactcctggggctccgtgggactggggaacagaggagaccccagatgcacggagccaacctggcggcagcgcaaaagatg

SEQ ID NO: 237043 - DNA, 103 bp, Artificial Sequence
  Synthetic Polynucleotide
taatacgactcactatagggctccgggacgcggtactcctggggctccgtaacagaggagaacggagatgcaggagtacaacctggcggcagcgcaaaagatg

SEQ ID NO: 237044 - DNA, 103 bp, Artificial Sequence
  Synthetic Polynucleotide
taatacgactcactatagggcgttgggcttctccgggacgcggtactcctaacagaggagaaggagtatggcgtcccggaacctggcggcagcgcaaaagatg

SEQ ID NO: 237045 - DNA, 103 bp, Artificial Sequence
  Synthetic Polynucleotide
taatacgactcactatagggttctcctcctcgttgggcttctccgggacgaacagaggagacgtcccatggaagcccaaaacctggcggcagcgcaaaagatg

SEQ ID NO: 237046 - DNA, 103 bp, Artificial Sequence
  Synthetic Polynucleotide
taatacgactcactatagggcggggcgcccttctcctcctcgttgggcttaacagaggagaaagcccatggaggaggagaacctggcggcagcgcaaaagatg

SEQ ID NO: 237047 - DNA, 103 bp, Artificial Sequence
  Synthetic Polynucleotide
taatacgactcactatagggcgccactctccggggcgcccttctcctcctaacagaggagaaggaggatgagggcgcccaacctggcggcagcgcaaaagatg

SEQ ID NO: 237048 - DNA, 103 bp, Artificial Sequence
  Synthetic Polynucleotide
taatacgactcactatagggaggccctcctcgccactctccggggcgcccaacagaggagagggcgcatgggagagtggaacctggcggcagcgcaaaagatg

SEQ ID NO: 237049 - DNA, 103 bp, Artificial Sequence
  Synthetic Polynucleotide
taatacgactcactataggggtcaggggccaggccctcctcgccactctcaacagaggagagagagtatggaggagggcaacctggcggcagcgcaaaagatg

SEQ ID NO: 237050 - DNA, 103 bp, Artificial Sequence
  Synthetic Polynucleotide
taatacgactcactatagggccacctcactgtcaggggccaggccctcctaacagaggagaaggaggatgtggcccctgaacctggcggcagcgcaaaagatg

SEQ ID NO: 237051 - DNA, 103 bp, Artificial Sequence
  Synthetic Polynucleotide
taatacgactcactataggggcctcccccagcttagaaggcatttcctgaaacagaggagatcaggaatggccttctaaaacctggcggcagcgcaaaagatg

SEQ ID NO: 237052 - DNA, 103 bp, Artificial Sequence
  Synthetic Polynucleotide
taatacgactcactatagggctcttcctgcccacctcactgtcaggggccaacagaggagaggccccatgcagtgaggtaacctggcggcagcgcaaaagatg

SEQ ID NO: 237053 - DNA, 103 bp, Artificial Sequence
  Synthetic Polynucleotide
taatacgactcactataggggcaccggtagctcttcctgcccacctcactaacagaggagaagtgagatgggcaggaagaacctggcggcagcgcaaaagatg

SEQ ID NO: 237054 - DNA, 103 bp, Artificial Sequence
  Synthetic Polynucleotide
taatacgactcactatagggcgcactgctcgcaccggtagctcttcctgcaacagaggagagcaggaatggctaccggtaacctggcggcagcgcaaaagatg

SEQ ID NO: 237055 - DNA, 103 bp, Artificial Sequence
  Synthetic Polynucleotide
taatacgactcactatagggaagcccttgccgcactgctcgcaccggtagaacagaggagactaccgatgcgagcagtgaacctggcggcagcgcaaaagatg

SEQ ID NO: 237056 - DNA, 103 bp, Artificial Sequence
  Synthetic Polynucleotide
taatacgactcactataggggtgccagctgaagcccttgccgcactgctcaacagaggagagagcagatgggcaagggcaacctggcggcagcgcaaaagatg

SEQ ID NO: 237057 - DNA, 103 bp, Artificial Sequence
  Synthetic Polynucleotide
taatacgactcactatagggccaggtgcgagtgccagctgaagcccttgcaacagaggagagcaaggatgtcagctggcaacctggcggcagcgcaaaagatg

SEQ ID NO: 237058 - DNA, 103 bp, Artificial Sequence
  Synthetic Polynucleotide
taatacgactcactatagggcggtgcgtcaccaggtgcgagtgccagctgaacagaggagacagctgatgctcgcacctaacctggcggcagcgcaaaagatg

SEQ ID NO: 237059 - DNA, 103 bp, Artificial Sequence
  Synthetic Polynucleotide
taatacgactcactataggggtgcgtgcgccggtgcgtcaccaggtgcgaaacagaggagatcgcacatggtgacgcacaacctggcggcagcgcaaaagatg

SEQ ID NO: 237060 - DNA, 103 bp, Artificial Sequence
  Synthetic Polynucleotide
taatacgactcactatagggtctcgcccgtgtgcgtgcgccggtgcgtcaaacagaggagatgacgcatgggcgcacgcaacctggcggcagcgcaaaagatg

SEQ ID NO: 237061 - DNA, 103 bp, Artificial Sequence
  Synthetic Polynucleotide
taatacgactcactataggggcgtagggcttctcgcccgtgtgcgtgcgcaacagaggagagcgcacatgcacgggcgaaacctggcggcagcgcaaaagatg

SEQ ID NO: 237062 - DNA, 103 bp, Artificial Sequence
  Synthetic Polynucleotide
taatacgactcactatagggtggcatgtttcctgtcactttcgattgcataacagaggagaatgcaaatgaaagtgacaaacctggcggcagcgcaaaagatg

SEQ ID NO: 237063 - DNA, 103 bp, Artificial Sequence
  Synthetic Polynucleotide
taatacgactcactatagggcattgacaaggcatcctccatctccatcggaacagaggagaccgatgatgatggaggataacctggcggcagcgcaaaagatg

SEQ ID NO: 237064 - DNA, 103 bp, Artificial Sequence
  Synthetic Polynucleotide
taatacgactcactatagggactgcccttatttgtttctccaagctccttaacagaggagaaaggagatgggagaaacaaacctggcggcagcgcaaaagatg

SEQ ID NO: 237065 - DNA, 103 bp, Artificial Sequence
  Synthetic Polynucleotide
taatacgactcactatagggggcctgcacaactgcccttatttgtttctcaacagaggagagagaaaatgataagggcaaacctggcggcagcgcaaaagatg

SEQ ID NO: 237066 - DNA, 103 bp, Artificial Sequence
  Synthetic Polynucleotide
taatacgactcactatagggtcttgcgagaggcctgcacaactgcccttaaacagaggagataagggatgttgtgcaggaacctggcggcagcgcaaaagatg

SEQ ID NO: 237067 - DNA, 103 bp, Artificial Sequence
  Synthetic Polynucleotide
taatacgactcactatagggcttctctttctcttgcgagaggcctgcacaaacagaggagatgtgcaatgctctcgcaaaacctggcggcagcgcaaaagatg

SEQ ID NO: 237068 - DNA, 103 bp, Artificial Sequence
  Synthetic Polynucleotide
taatacgactcactatagggagtgtttgcacttctctttctcttgcgagaaacagaggagatctcgcatgagaaagagaaacctggcggcagcgcaaaagatg

SEQ ID NO: 237069 - DNA, 103 bp, Artificial Sequence
  Synthetic Polynucleotide
taatacgactcactatagggtcgccgtgggagtgtttgcacttctctttcaacagaggagagaaagaatggtgcaaacaaacctggcggcagcgcaaaagatg

SEQ ID NO: 237070 - DNA, 103 bp, Artificial Sequence
  Synthetic Polynucleotide
taatacgactcactatagggggagggcgcttcgccgtgggagtgtttgcaaacagaggagatgcaaaatgtcccacggcaacctggcggcagcgcaaaagatg

SEQ ID NO: 237071 - DNA, 103 bp, Artificial Sequence
  Synthetic Polynucleotide
taatacgactcactatagggccgcgtccacggagggcgcttcgccgtgggaacagaggagacccacgatgaagcgccctaacctggcggcagcgcaaaagatg

SEQ ID NO: 237072 - DNA, 103 bp, Artificial Sequence
  Synthetic Polynucleotide
taatacgactcactatagggaacttgggatccgcgtccacggagggcgctaacagaggagaagcgccatgcgtggacgcaacctggcggcagcgcaaaagatg

SEQ ID NO: 237073 - DNA, 103 bp, Artificial Sequence
  Synthetic Polynucleotide
taatacgactcactataggggctactgggtaacttgggatccgcgtccacaacagaggagagtggacatggatcccaagaacctggcggcagcgcaaaagatg

SEQ ID NO: 237074 - DNA, 103 bp, Artificial Sequence
  Synthetic Polynucleotide
taatacgactcactatagggcggtccctttcattgacaaggcatcctccaaacagaggagatggaggatgccttgtcaaaacctggcggcagcgcaaaagatg

SEQ ID NO: 237075 - DNA, 103 bp, Artificial Sequence
  Synthetic Polynucleotide
taatacgactcactataggggcttctccttgctactgggtaacttgggataacagaggagaatcccaatgtacccagtaaacctggcggcagcgcaaaagatg

SEQ ID NO: 237076 - DNA, 103 bp, Artificial Sequence
  Synthetic Polynucleotide
taatacgactcactatagggcagtgagtgggcttctccttgctactgggtaacagaggagaacccagatgcaaggagaaaacctggcggcagcgcaaaagatg

SEQ ID NO: 237077 - DNA, 103 bp, Artificial Sequence
  Synthetic Polynucleotide
taatacgactcactataggggcactcggagcagtgagtgggcttctccttaacagaggagaaaggagatgcccactcacaacctggcggcagcgcaaaagatg

SEQ ID NO: 237078 - DNA, 103 bp, Artificial Sequence
  Synthetic Polynucleotide
taatacgactcactatagggaagctttgccgcactcggagcagtgagtggaacagaggagaccactcatggctccgagtaacctggcggcagcgcaaaagatg

SEQ ID NO: 237079 - DNA, 103 bp, Artificial Sequence
  Synthetic Polynucleotide
taatacgactcactatagggtaggttctgaaagctttgccgcactcggagaacagaggagactccgaatgcggcaaagcaacctggcggcagcgcaaaagatg

SEQ ID NO: 237080 - DNA, 103 bp, Artificial Sequence
  Synthetic Polynucleotide
taatacgactcactatagggcagctggtggtaggttctgaaagctttgccaacagaggagaggcaaaatgttcagaaccaacctggcggcagcgcaaaagatg

SEQ ID NO: 237081 - DNA, 103 bp, Artificial Sequence
  Synthetic Polynucleotide
taatacgactcactatagggagtgcaagaccagctggtggtaggttctgaaacagaggagatcagaaatgaccaccagcaacctggcggcagcgcaaaagatg

SEQ ID NO: 237082 - DNA, 103 bp, Artificial Sequence
  Synthetic Polynucleotide
taatacgactcactatagggtggaccctggagtgcaagaccagctggtggaacagaggagaccaccaatgggtcttgcaaacctggcggcagcgcaaaagatg

SEQ ID NO: 237083 - DNA, 103 bp, Artificial Sequence
  Synthetic Polynucleotide
taatacgactcactataggggtccttcttgtggaccctggagtgcaagacaacagaggagagtcttgatgtccagggtcaacctggcggcagcgcaaaagatg

SEQ ID NO: 237084 - DNA, 103 bp, Artificial Sequence
  Synthetic Polynucleotide
taatacgactcactatagggcggccctccggtccttcttgtggaccctggaacagaggagaccagggatgacaagaaggaacctggcggcagcgcaaaagatg

SEQ ID NO: 237085 - DNA, 103 bp, Artificial Sequence
  Synthetic Polynucleotide
taatacgactcactatagggggaacaacagcggtccctttcattgacaagaacagaggagacttgtcatggaaagggacaacctggcggcagcgcaaaagatg

SEQ ID NO: 237086 - DNA, 103 bp, Artificial Sequence
  Synthetic Polynucleotide
taatacgactcactataggggactccgcgccggccctccggtccttcttgaacagaggagacaagaaatgccggagggcaacctggcggcagcgcaaaagatg

SEQ ID NO: 237087 - DNA, 103 bp, Artificial Sequence
  Synthetic Polynucleotide
taatacgactcactatagggcatggtgggcgactccgcgccggccctccgaacagaggagacggaggatgggcgcggagaacctggcggcagcgcaaaagatg

SEQ ID NO: 237088 - DNA, 103 bp, Artificial Sequence
  Synthetic Polynucleotide
taatacgactcactatagggcgtccacagacatggtgggcgactccgcgcaacagaggagagcgcggatgcgcccaccaaacctggcggcagcgcaaaagatg

SEQ ID NO: 237089 - DNA, 103 bp, Artificial Sequence
  Synthetic Polynucleotide
taatacgactcactatagggggctgcctcccgtccacagacatggtgggcaacagaggagagcccacatggtctgtggaaacctggcggcagcgcaaaagatg

SEQ ID NO: 237090 - DNA, 103 bp, Artificial Sequence
  Synthetic Polynucleotide
taatacgactcactatagggacacgtccccggctgcctcccgtccacagaaacagaggagatctgtgatggggaggcagaacctggcggcagcgcaaaagatg

SEQ ID NO: 237091 - DNA, 103 bp, Artificial Sequence
  Synthetic Polynucleotide
taatacgactcactatagggggtcaggagaacacgtccccggctgcctccaacagaggagaggaggcatgcggggacgtaacctggcggcagcgcaaaagatg

SEQ ID NO: 237092 - DNA, 103 bp, Artificial Sequence
  Synthetic Polynucleotide
taatacgactcactatagggggggcggcgaggtcaggagaacacgtccccaacagaggagaggggacatgttctcctgaaacctggcggcagcgcaaaagatg

SEQ ID NO: 237093 - DNA, 103 bp, Artificial Sequence
  Synthetic Polynucleotide
taatacgactcactatagggttcatccagaggggcggcgaggtcaggagaaacagaggagatctcctatgctcgccgccaacctggcggcagcgcaaaagatg

SEQ ID NO: 237094 - DNA, 103 bp, Artificial Sequence
  Synthetic Polynucleotide
taatacgactcactatagggcggctccattttcatccagaggggcggcgaaacagaggagatcgccgatgctctggatgaacctggcggcagcgcaaaagatg

SEQ ID NO: 237095 - DNA, 103 bp, Artificial Sequence
  Synthetic Polynucleotide
taatacgactcactatagggcctcgatccacggctccattttcatccagaaacagaggagatctggaatgaaatggagcaacctggcggcagcgcaaaagatg

SEQ ID NO: 237096 - DNA, 103 bp, Artificial Sequence
  Synthetic Polynucleotide
taatacgactcactatagggagctcggaatggaacaacagcggtccctttaacagaggagaaaagggatggctgttgttaacctggcggcagcgcaaaagatg

SEQ ID NO: 237097 - DNA, 103 bp, Artificial Sequence
  Synthetic Polynucleotide
taatacgactcactatagggaccaccttcccctcgatccacggctccattaacagaggagaaatggaatggtggatcgaaacctggcggcagcgcaaaagatg

SEQ ID NO: 237098 - DNA, 103 bp, Artificial Sequence
  Synthetic Polynucleotide
taatacgactcactatagggcgtcttcagaaccaccttcccctcgatccaaacagaggagatggatcatggggaaggtgaacctggcggcagcgcaaaagatg

SEQ ID NO: 237099 - DNA, 103 bp, Artificial Sequence
  Synthetic Polynucleotide
taatacgactcactatagggtcctcagatccgtcttcagaaccaccttccaacagaggagaggaaggatgttctgaagaaacctggcggcagcgcaaaagatg

SEQ ID NO: 237100 - DNA, 103 bp, Artificial Sequence
  Synthetic Polynucleotide
taatacgactcactataggggggaagcccatcctcagatccgtcttcagaaacagaggagatctgaaatgggatctgagaacctggcggcagcgcaaaagatg

SEQ ID NO: 237101 - DNA, 103 bp, Artificial Sequence
  Synthetic Polynucleotide
taatacgactcactatagggggattccttcgggaagcccatcctcagatcaacagaggagagatctgatgatgggcttcaacctggcggcagcgcaaaagatg

SEQ ID NO: 237102 - DNA, 103 bp, Artificial Sequence
  Synthetic Polynucleotide
taatacgactcactatagggttatccagatggattccttcgggaagcccaaacagaggagatgggctatgcgaaggaataacctggcggcagcgcaaaagatg

SEQ ID NO: 237103 - DNA, 103 bp, Artificial Sequence
  Synthetic Polynucleotide
taatacgactcactatagggatcatcatttttatccagatggattccttcaacagaggagagaaggaatgcatctggataacctggcggcagcgcaaaagatg

SEQ ID NO: 237104 - DNA, 103 bp, Artificial Sequence
  Synthetic Polynucleotide
taatacgactcactatagggtttttcctccatcatcatttttatccagataacagaggagaatctggatgaaaatgatgaacctggcggcagcgcaaaagatg

SEQ ID NO: 237105 - DNA, 103 bp, Artificial Sequence
  Synthetic Polynucleotide
taatacgactcactatagggagatgttttatttttcctccatcatcatttaacagaggagaaaatgaatgtggaggaaaaacctggcggcagcgcaaaagatg

SEQ ID NO: 237106 - DNA, 103 bp, Artificial Sequence
  Synthetic Polynucleotide
taatacgactcactatagggtgaagatgtaagatgttttatttttcctccaacagaggagaggaggaatgataaaacataacctggcggcagcgcaaaagatg

SEQ ID NO: 237107 - DNA, 103 bp, Artificial Sequence
  Synthetic Polynucleotide
taatacgactcactatagggtttcttgtgtagctcggaatggaacaacagaacagaggagactgttgatgcattccgagaacctggcggcagcgcaaaagatg

SEQ ID NO: 237108 - DNA, 103 bp, Artificial Sequence
  Synthetic Polynucleotide
taatacgactcactatagggtacactctcttgaagatgtaagatgttttaaacagaggagataaaacatgttacatcttaacctggcggcagcgcaaaagatg

SEQ ID NO: 237109 - DNA, 103 bp, Artificial Sequence
  Synthetic Polynucleotide
taatacgactcactatagggccacaataactacactctcttgaagatgtaaacagaggagatacatcatgaagagagtgaacctggcggcagcgcaaaagatg

SEQ ID NO: 237110 - DNA, 103 bp, Artificial Sequence
  Synthetic Polynucleotide
taatacgactcactataggggaaaaactttccacaataactacactctctaacagaggagaagagagatgagttattgtaacctggcggcagcgcaaaagatg

SEQ ID NO: 237111 - DNA, 103 bp, Artificial Sequence
  Synthetic Polynucleotide
taatacgactcactatagggaatttgaacggaaaaactttccacaataacaacagaggagagttattatggaaagttttaacctggcggcagcgcaaaagatg

SEQ ID NO: 237112 - DNA, 103 bp, Artificial Sequence
  Synthetic Polynucleotide
taatacgactcactatagggttgaggtaataatttgaacggaaaaactttaacagaggagaaaagttatgccgttcaaaaacctggcggcagcgcaaaagatg

SEQ ID NO: 237113 - DNA, 103 bp, Artificial Sequence
  Synthetic Polynucleotide
taatacgactcactataggggagatgaatattgaggtaataatttgaacgaacagaggagacgttcaatgtattacctcaacctggcggcagcgcaaaagatg

SEQ ID NO: 237114 - DNA, 103 bp, Artificial Sequence
  Synthetic Polynucleotide
taatacgactcactatagggtatgcgttctgagatgaatattgaggtaataacagaggagaattaccatgatattcatcaacctggcggcagcgcaaaagatg

SEQ ID NO: 237115 - DNA, 103 bp, Artificial Sequence
  Synthetic Polynucleotide
taatacgactcactatagggttttcacctgtatgcgttctgagatgaataaacagaggagatattcaatgcagaacgcaaacctggcggcagcgcaaaagatg

SEQ ID NO: 237116 - DNA, 103 bp, Artificial Sequence
  Synthetic Polynucleotide
taatacgactcactatagggtttgtatggtttttcacctgtatgcgttctaacagaggagaagaacgatgacaggtgaaaacctggcggcagcgcaaaagatg

SEQ ID NO: 237117 - DNA, 103 bp, Artificial Sequence
  Synthetic Polynucleotide
taatacgactcactatagggaaaattcacatttgtatggtttttcacctgaacagaggagacaggtgatgaaccatacaaacctggcggcagcgcaaaagatg

SEQ ID NO: 237118 - DNA, 103 bp, Artificial Sequence
  Synthetic Polynucleotide
taatacgactcactatagggatgacatttttttcttgtgtagctcggaataacagaggagaattccgatgtacacaagaaacctggcggcagcgcaaaagatg

SEQ ID NO: 237119 - DNA, 103 bp, Artificial Sequence
  Synthetic Polynucleotide
taatacgactcactataggggcatattcacaaaattcacatttgtatggtaacagaggagaaccataatgatgtgaattaacctggcggcagcgcaaaagatg

SEQ ID NO: 237120 - DNA, 103 bp, Artificial Sequence
  Synthetic Polynucleotide
taatacgactcactatagggctgggctgcagcatattcacaaaattcacaaacagaggagatgtgaaatgtgtgaatataacctggcggcagcgcaaaagatg

SEQ ID NO: 237121 - DNA, 103 bp, Artificial Sequence
  Synthetic Polynucleotide
taatacgactcactataggggagatgtcttctgggctgcagcatattcacaacagaggagagtgaatatgctgcagcccaacctggcggcagcgcaaaagatg

SEQ ID NO: 237122 - DNA, 103 bp, Artificial Sequence
  Synthetic Polynucleotide
taatacgactcactatagggtgatacctcagagatgtcttctgggctgcaaacagaggagatgcagcatggaagacatcaacctggcggcagcgcaaaagatg

SEQ ID NO: 237123 - DNA, 103 bp, Artificial Sequence
  Synthetic Polynucleotide
taatacgactcactatagggtctctccaagtgatacctcagagatgtcttaacagaggagaaagacaatgctgaggtataacctggcggcagcgcaaaagatg

SEQ ID NO: 237124 - DNA, 103 bp, Artificial Sequence
  Synthetic Polynucleotide
taatacgactcactatagggccttgtgatgtctctccaagtgatacctcaaacagaggagatgaggtatgacttggagaaacctggcggcagcgcaaaagatg

SEQ ID NO: 237125 - DNA, 103 bp, Artificial Sequence
  Synthetic Polynucleotide
taatacgactcactataggggtttgtttttccttgtgatgtctctccaagaacagaggagacttggaatgacatcacaaaacctggcggcagcgcaaaagatg

SEQ ID NO: 237126 - DNA, 103 bp, Artificial Sequence
  Synthetic Polynucleotide
taatacgactcactatagggagcaacatcggtttgtttttccttgtgatgaacagaggagacatcacatggaaaaacaaaacctggcggcagcgcaaaagatg

SEQ ID NO: 237127 - DNA, 103 bp, Artificial Sequence
  Synthetic Polynucleotide
taatacgactcactatagggtgacttcagcagcaacatcggtttgtttttaacagaggagaaaaaacatgccgatgttgaacctggcggcagcgcaaaagatg

SEQ ID NO: 237128 - DNA, 103 bp, Artificial Sequence
  Synthetic Polynucleotide
taatacgactcactatagggccatcgttcttgacttcagcagcaacatcgaacagaggagacgatgtatgtgctgaagtaacctggcggcagcgcaaaagatg

SEQ ID NO: 237129 - DNA, 103 bp, Artificial Sequence
  Synthetic Polynucleotide
taatacgactcactatagggctcgatttggatgacatttttttcttgtgtaacagaggagaacacaaatgaaaaatgtcaacctggcggcagcgcaaaagatg

SEQ ID NO: 237130 - DNA, 103 bp, Artificial Sequence
  Synthetic Polynucleotide
taatacgactcactatagggctgatttttaccatcgttcttgacttcagcaacagaggagagctgaaatgaagaacgataacctggcggcagcgcaaaagatg

SEQ ID NO: 237131 - DNA, 103 bp, Artificial Sequence
  Synthetic Polynucleotide
taatacgactcactatagggcttcagtgtcctgatttttaccatcgttctaacagaggagaagaacgatggtaaaaatcaacctggcggcagcgcaaaagatg

SEQ ID NO: 237132 - DNA, 103 bp, Artificial Sequence
  Synthetic Polynucleotide
taatacgactcactatagggaatagtgcatcttcagtgtcctgatttttaaacagaggagataaaaaatgggacactgaaacctggcggcagcgcaaaagatg

SEQ ID NO: 237133 - DNA, 103 bp, Artificial Sequence
  Synthetic Polynucleotide
taatacgactcactataggggtcagcggttaatagtgcatcttcagtgtcaacagaggagagacactatggatgcactaaacctggcggcagcgcaaaagatg

SEQ ID NO: 237134 - DNA, 103 bp, Artificial Sequence
  Synthetic Polynucleotide
taatacgactcactatagggtttgcgcactgtcagcggttaatagtgcataacagaggagaatgcacatgtaaccgctgaacctggcggcagcgcaaaagatg

SEQ ID NO: 237135 - DNA, 103 bp, Artificial Sequence
  Synthetic Polynucleotide
taatacgactcactatagggaaatttttggtttgcgcactgtcagcggttaacagaggagaaaccgcatgcagtgcgcaaacctggcggcagcgcaaaagatg

SEQ ID NO: 237136 - DNA, 103 bp, Artificial Sequence
  Synthetic Polynucleotide
taatacgactcactatagggaaatcttttcaaatttttggtttgcgcactaacagaggagaagtgcgatgaccaaaaataacctggcggcagcgcaaaagatg

SEQ ID NO: 237137 - DNA, 103 bp, Artificial Sequence
  Synthetic Polynucleotide
taatacgactcactatagggcaccatcaaaaaatcttttcaaatttttggaacagaggagaccaaaaatgtgaaaagataacctggcggcagcgcaaaagatg

SEQ ID NO: 237138 - DNA, 103 bp, Artificial Sequence
  Synthetic Polynucleotide
taatacgactcactatagggacatctttggcaccatcaaaaaatcttttcaacagaggagagaaaagatgttttgatggaacctggcggcagcgcaaaagatg

SEQ ID NO: 237139 - DNA, 103 bp, Artificial Sequence
  Synthetic Polynucleotide
taatacgactcactatagggactgcctgtaacatctttggcaccatcaaaaacagaggagatttgatatggccaaagataacctggcggcagcgcaaaagatg

SEQ ID NO: 237140 - DNA, 103 bp, Artificial Sequence
  Synthetic Polynucleotide
taatacgactcactataggggcatatacccctcgatttggatgacattttaacagaggagaaaaatgatgtccaaatcgaacctggcggcagcgcaaaagatg

SEQ ID NO: 237141 - DNA, 103 bp, Artificial Sequence
  Synthetic Polynucleotide
taatacgactcactatagggttgcaggtggactgcctgtaacatctttggaacagaggagaccaaagatgttacaggcaaacctggcggcagcgcaaaagatg

SEQ ID NO: 237142 - DNA, 103 bp, Artificial Sequence
  Synthetic Polynucleotide
taatacgactcactatagggttaagctgctttgcaggtggactgcctgtaaacagaggagatacaggatgtccacctgcaacctggcggcagcgcaaaagatg

SEQ ID NO: 237143 - DNA, 103 bp, Artificial Sequence
  Synthetic Polynucleotide
taatacgactcactatagggaggcatctccttaagctgctttgcaggtggaacagaggagaccacctatgaagcagcttaacctggcggcagcgcaaaagatg

SEQ ID NO: 237144 - DNA, 103 bp, Artificial Sequence
  Synthetic Polynucleotide
taatacgactcactataggggaaaaacagaaggcatctccttaagctgctaacagaggagaagcagcatgaggagatgcaacctggcggcagcgcaaaagatg

SEQ ID NO: 237145 - DNA, 103 bp, Artificial Sequence
  Synthetic Polynucleotide
taatacgactcactatagggagaacattctgaaaaacagaaggcatctccaacagaggagaggagatatgttctgttttaacctggcggcagcgcaaaagatg

SEQ ID NO: 237146 - DNA, 103 bp, Artificial Sequence
  Synthetic Polynucleotide
taatacgactcactatagggagcgctgcccagaacattctgaaaaacagaaacagaggagatctgttatgcagaatgttaacctggcggcagcgcaaaagatg

SEQ ID NO: 237147 - DNA, 103 bp, Artificial Sequence
  Synthetic Polynucleotide
taatacgactcactataggggtgagaggacagcgctgcccagaacattctaacagaggagaagaatgatgtgggcagcgaacctggcggcagcgcaaaagatg

SEQ ID NO: 237148 - DNA, 103 bp, Artificial Sequence
  Synthetic Polynucleotide
taatacgactcactatagggttgtgtgctggtgagaggacagcgctgcccaacagaggagagggcagatgtgtcctctcaacctggcggcagcgcaaaagatg

SEQ ID NO: 237149 - DNA, 103 bp, Artificial Sequence
  Synthetic Polynucleotide
taatacgactcactatagggctgagtatctttgtgtgctggtgagaggacaacagaggagagtcctcatgccagcacacaacctggcggcagcgcaaaagatg

SEQ ID NO: 237150 - DNA, 103 bp, Artificial Sequence
  Synthetic Polynucleotide
taatacgactcactatagggtatggaaatcctgagtatctttgtgtgctgaacagaggagacagcacatgaagatactcaacctggcggcagcgcaaaagatg

SEQ ID NO: 237151 - DNA, 103 bp, Artificial Sequence
  Synthetic Polynucleotide
taatacgactcactatagggcaatccaagggcatatacccctcgatttggaacagaggagaccaaatatgggggtatataacctggcggcagcgcaaaagatg

SEQ ID NO: 237152 - DNA, 103 bp, Artificial Sequence
  Synthetic Polynucleotide
taatacgactcactataggggctgcatttttatggaaatcctgagtatctaacagaggagaagatacatgggatttccaaacctggcggcagcgcaaaagatg

SEQ ID NO: 237153 - DNA, 103 bp, Artificial Sequence
  Synthetic Polynucleotide
taatacgactcactatagggactgtcatcagctgcatttttatggaaatcaacagaggagagatttcatgaaaaatgcaaacctggcggcagcgcaaaagatg

SEQ ID NO: 237154 - DNA, 103 bp, Artificial Sequence
  Synthetic Polynucleotide
taatacgactcactatagggctttatcagcactgtcatcagctgcattttaacagaggagaaaaatgatgctgatgacaaacctggcggcagcgcaaaagatg

SEQ ID NO: 237155 - DNA, 103 bp, Artificial Sequence
  Synthetic Polynucleotide
taatacgactcactatagggtttttattcactttatcagcactgtcatcaaacagaggagatgatgaatgtgctgataaaacctggcggcagcgcaaaagatg

SEQ ID NO: 237156 - DNA, 103 bp, Artificial Sequence
  Synthetic Polynucleotide
taatacgactcactatagggaggggtagggtttttattcactttatcagcaacagaggagagctgatatggtgaataaaaacctggcggcagcgcaaaagatg

SEQ ID NO: 237157 - DNA, 103 bp, Artificial Sequence
  Synthetic Polynucleotide
taatacgactcactatagggccaggtaagcaggggtagggtttttattcaaacagaggagatgaataatgaccctacccaacctggcggcagcgcaaaagatg

SEQ ID NO: 237158 - DNA, 103 bp, Artificial Sequence
  Synthetic Polynucleotide
taatacgactcactatagggtttaacaggtccaggtaagcaggggtagggaacagaggagaccctacatgtgcttacctaacctggcggcagcgcaaaagatg

SEQ ID NO: 237159 - DNA, 103 bp, Artificial Sequence
  Synthetic Polynucleotide
taatacgactcactatagggtgatctcttttttaacaggtccaggtaagcaacagaggagagcttacatggacctgttaaacctggcggcagcgcaaaagatg

SEQ ID NO: 237160 - DNA, 103 bp, Artificial Sequence
  Synthetic Polynucleotide
taatacgactcactatagggtttcaactgctgatctcttttttaacaggtaacagaggagaacctgtatgaaaagagataacctggcggcagcgcaaaagatg

SEQ ID NO: 237161 - DNA, 103 bp, Artificial Sequence
  Synthetic Polynucleotide
taatacgactcactatagggtttgcctgagtttcaactgctgatctctttaacagaggagaaaagagatgagcagttgaaacctggcggcagcgcaaaagatg

SEQ ID NO: 237162 - DNA, 103 bp, Artificial Sequence
  Synthetic Polynucleotide
taatacgactcactataggggcagaacatgcaatccaagggcatatacccaacagaggagagggtatatgcccttggataacctggcggcagcgcaaaagatg

SEQ ID NO: 237163 - DNA, 103 bp, Artificial Sequence
  Synthetic Polynucleotide
taatacgactcactataggggatgaggttatttgcctgagtttcaactgcaacagaggagagcagttatgactcaggcaaacctggcggcagcgcaaaagatg

SEQ ID NO: 237164 - DNA, 103 bp, Artificial Sequence
  Synthetic Polynucleotide
taatacgactcactatagggtggttctacagatgaggttatttgcctgagaacagaggagactcaggatgataacctcaaacctggcggcagcgcaaaagatg

SEQ ID NO: 237165 - DNA, 103 bp, Artificial Sequence
  Synthetic Polynucleotide
taatacgactcactatagggacatccgccttggttctacagatgaggttaaacagaggagataacctatgctgtagaacaacctggcggcagcgcaaaagatg

SEQ ID NO: 237166 - DNA, 103 bp, Artificial Sequence
  Synthetic Polynucleotide
taatacgactcactatagggaggaggagtaacatccgccttggttctacaaacagaggagatgtagaatgaaggcggataacctggcggcagcgcaaaagatg

SEQ ID NO: 237167 - DNA, 103 bp, Artificial Sequence
  Synthetic Polynucleotide
taatacgactcactatagggtgccatccggaggaggagtaacatccgcctaacagaggagaaggcggatgttactcctcaacctggcggcagcgcaaaagatg

SEQ ID NO: 237168 - DNA, 103 bp, Artificial Sequence
  Synthetic Polynucleotide
taatacgactcactatagggtgggtggtactgccatccggaggaggagtaaacagaggagatactccatgtccggatggaacctggcggcagcgcaaaagatg

SEQ ID NO: 237169 - DNA, 103 bp, Artificial Sequence
  Synthetic Polynucleotide
taatacgactcactatagggttcaaggttatgggtggtactgccatccggaacagaggagaccggatatgagtaccaccaacctggcggcagcgcaaaagatg

SEQ ID NO: 237170 - DNA, 103 bp, Artificial Sequence
  Synthetic Polynucleotide
taatacgactcactatagggtggggctaacttcaaggttatgggtggtacaacagaggagagtaccaatgataaccttgaacctggcggcagcgcaaaagatg

SEQ ID NO: 237171 - DNA, 103 bp, Artificial Sequence
  Synthetic Polynucleotide
taatacgactcactatagggtgcttctctttggggctaacttcaaggttaaacagaggagataacctatgagttagcccaacctggcggcagcgcaaaagatg

SEQ ID NO: 237172 - DNA, 103 bp, Artificial Sequence
  Synthetic Polynucleotide
taatacgactcactatagggggtctccgtttgcttctctttggggctaacaacagaggagagttagcatgaaagagaagaacctggcggcagcgcaaaagatg

SEQ ID NO: 237173 - DNA, 103 bp, Artificial Sequence
  Synthetic Polynucleotide
taatacgactcactataggggggattgagttggcatgtttcctgtcacttaacagaggagaaagtgaatggaaacatgcaacctggcggcagcgcaaaagatg

SEQ ID NO: 237174 - DNA, 103 bp, Artificial Sequence
  Synthetic Polynucleotide
taatacgactcactatagggaggtctggctgcagaacatgcaatccaaggaacagaggagaccttggatggcatgttctaacctggcggcagcgcaaaagatg

SEQ ID NO: 237175 - DNA, 103 bp, Artificial Sequence
  Synthetic Polynucleotide
taatacgactcactatagggagtcagctgcggtctccgtttgcttctcttaacagaggagaaagagaatgaaacggagaaacctggcggcagcgcaaaagatg

SEQ ID NO: 237176 - DNA, 103 bp, Artificial Sequence
  Synthetic Polynucleotide
taatacgactcactatagggctgtatctgcagtcagctgcggtctccgttaacagaggagaaacggaatgcgcagctgaaacctggcggcagcgcaaaagatg

SEQ ID NO: 237177 - DNA, 103 bp, Artificial Sequence
  Synthetic Polynucleotide
taatacgactcactatagggcacacttggcctgtatctgcagtcagctgcaacagaggagagcagctatgtgcagatacaacctggcggcagcgcaaaagatg

SEQ ID NO: 237178 - DNA, 103 bp, Artificial Sequence
  Synthetic Polynucleotide
taatacgactcactatagggcgtgacaatccacacttggcctgtatctgcaacagaggagagcagatatgggccaagtgaacctggcggcagcgcaaaagatg

SEQ ID NO: 237179 - DNA, 103 bp, Artificial Sequence
  Synthetic Polynucleotide
taatacgactcactatagggaaaggtttttcgtgacaatccacacttggcaacagaggagagccaagatgggattgtcaaacctggcggcagcgcaaaagatg

SEQ ID NO: 237180 - DNA, 103 bp, Artificial Sequence
  Synthetic Polynucleotide
taatacgactcactatagggggataaatttaaaggtttttcgtgacaatcaacagaggagagattgtatggaaaaacctaacctggcggcagcgcaaaagatg

SEQ ID NO: 237181 - DNA, 103 bp, Artificial Sequence
  Synthetic Polynucleotide
taatacgactcactataggggagcccccacggataaatttaaaggtttttaacagaggagaaaaaacatgtaaatttataacctggcggcagcgcaaaagatg

SEQ ID NO: 237182 - DNA, 103 bp, Artificial Sequence
  Synthetic Polynucleotide
taatacgactcactatagggcaattgtgaagagcccccacggataaatttaacagaggagaaaatttatgcgtgggggcaacctggcggcagcgcaaaagatg

SEQ ID NO: 237183 - DNA, 103 bp, Artificial Sequence
  Synthetic Polynucleotide
taatacgactcactatagggaattgccgggcaattgtgaagagcccccacaacagaggagagtggggatgcttcacaataacctggcggcagcgcaaaagatg

SEQ ID NO: 237184 - DNA, 103 bp, Artificial Sequence
  Synthetic Polynucleotide
taatacgactcactatagggtactcaaagaaattgccgggcaattgtgaaaacagaggagattcacaatggcccggcaaaacctggcggcagcgcaaaagatg

SEQ ID NO: 237185 - DNA, 103 bp, Artificial Sequence
  Synthetic Polynucleotide
taatacgactcactataggggaatgtgtgaaggtctggctgcagaacatgaacagaggagacatgttatgcagccagacaacctggcggcagcgcaaaagatg

SEQ ID NO: 237186 - DNA, 103 bp, Artificial Sequence
  Synthetic Polynucleotide
taatacgactcactatagggatcaaacttttactcaaagaaattgccgggaacagaggagacccggcatgttctttgagaacctggcggcagcgcaaaagatg

SEQ ID NO: 237187 - DNA, 103 bp, Artificial Sequence
  Synthetic Polynucleotide
taatacgactcactataggggatacttggaatcaaacttttactcaaagaaacagaggagatctttgatgaaaagtttgaacctggcggcagcgcaaaagatg

SEQ ID NO: 237188 - DNA, 103 bp, Artificial Sequence
  Synthetic Polynucleotide
taatacgactcactatagggatggacaggtgatacttggaatcaaactttaacagaggagaaaagttatgttccaagtaaacctggcggcagcgcaaaagatg

SEQ ID NO: 237189 - DNA, 103 bp, Artificial Sequence
  Synthetic Polynucleotide
taatacgactcactatagggaaggtacaaaatggacaggtgatacttggaaacagaggagatccaagatgcacctgtccaacctggcggcagcgcaaaagatg

SEQ ID NO: 237190 - DNA, 103 bp, Artificial Sequence
  Synthetic Polynucleotide
taatacgactcactatagggaaatgtcttgaaggtacaaaatggacaggtaacagaggagaacctgtatgttttgtaccaacctggcggcagcgcaaaagatg

SEQ ID NO: 237191 - DNA, 103 bp, Artificial Sequence
  Synthetic Polynucleotide
taatacgactcactatagggcttctggataaaatgtcttgaaggtacaaaaacagaggagatttgtaatgtcaagacataacctggcggcagcgcaaaagatg

SEQ ID NO: 237192 - DNA, 103 bp, Artificial Sequence
  Synthetic Polynucleotide
taatacgactcactatagggatcattaaaacttctggataaaatgtcttgaacagaggagacaagacatgttatccagaaacctggcggcagcgcaaaagatg

SEQ ID NO: 237193 - DNA, 103 bp, Artificial Sequence
  Synthetic Polynucleotide
taatacgactcactatagggtctctggtgcatcattaaaacttctggataaacagaggagatatccaatggttttaatgaacctggcggcagcgcaaaagatg

SEQ ID NO: 237194 - DNA, 103 bp, Artificial Sequence
  Synthetic Polynucleotide
taatacgactcactatagggtatgctccagtctctggtgcatcattaaaaaacagaggagattttaaatgtgcaccagaaacctggcggcagcgcaaaagatg

SEQ ID NO: 237195 - DNA, 103 bp, Artificial Sequence
  Synthetic Polynucleotide
taatacgactcactatagggggattgtatttatgctccagtctctggtgcaacagaggagagcaccaatgactggagcaaacctggcggcagcgcaaaagatg

SEQ ID NO: 237196 - DNA, 103 bp, Artificial Sequence
  Synthetic Polynucleotide
taatacgactcactatagggaaggtcttctgaatgtgtgaaggtctggctaacagaggagaagccagatgttcacacataacctggcggcagcgcaaaagatg

SEQ ID NO: 237197 - DNA, 103 bp, Artificial Sequence
  Synthetic Polynucleotide
taatacgactcactatagggatgaacgtcaggattgtatttatgctccagaacagaggagactggagatgaaatacaataacctggcggcagcgcaaaagatg

SEQ ID NO: 237198 - DNA, 103 bp, Artificial Sequence
  Synthetic Polynucleotide
taatacgactcactataggggacagtttttatgaacgtcaggattgtattaacagaggagaaatacaatgctgacgttcaacctggcggcagcgcaaaagatg

SEQ ID NO: 237199 - DNA, 103 bp, Artificial Sequence
  Synthetic Polynucleotide
taatacgactcactataggggacttgtttcgacagtttttatgaacgtcaaacagaggagatgacgtatgtaaaaactgaacctggcggcagcgcaaaagatg

SEQ ID NO: 237200 - DNA, 103 bp, Artificial Sequence
  Synthetic Polynucleotide
taatacgactcactatagggtctaagcaaggacttgtttcgacagtttttaacagaggagaaaaaacatgcgaaacaagaacctggcggcagcgcaaaagatg

SEQ ID NO: 237201 - DNA, 103 bp, Artificial Sequence
  Synthetic Polynucleotide
taatacgactcactatagggtacgtcgacttctaagcaaggacttgtttcaacagaggagagaaacaatgccttgcttaaacctggcggcagcgcaaaagatg

SEQ ID NO: 237202 - DNA, 103 bp, Artificial Sequence
  Synthetic Polynucleotide
taatacgactcactataggggggcatccggtacgtcgacttctaagcaagaacagaggagacttgctatgaagtcgacgaacctggcggcagcgcaaaagatg

SEQ ID NO: 237203 - DNA, 103 bp, Artificial Sequence
  Synthetic Polynucleotide
taatacgactcactatagggcaacgctggcgggcatccggtacgtcgactaacagaggagaagtcgaatgaccggatgcaacctggcggcagcgcaaaagatg

SEQ ID NO: 237204 - DNA, 103 bp, Artificial Sequence
  Synthetic Polynucleotide
taatacgactcactatagggcttttcccagcaacgctggcgggcatccggaacagaggagaccggatatgcgccagcgtaacctggcggcagcgcaaaagatg

SEQ ID NO: 237205 - DNA, 103 bp, Artificial Sequence
  Synthetic Polynucleotide
taatacgactcactatagggggaggcacatcttttcccagcaacgctggcaacagaggagagccagcatggctgggaaaaacctggcggcagcgcaaaagatg

SEQ ID NO: 237206 - DNA, 103 bp, Artificial Sequence
  Synthetic Polynucleotide
taatacgactcactatagggactagagaggggaggcacatcttttcccagaacagaggagactgggaatggatgtgcctaacctggcggcagcgcaaaagatg

SEQ ID NO: 237207 - DNA, 103 bp, Artificial Sequence
  Synthetic Polynucleotide
taatacgactcactatagggcatgtttattaaggtcttctgaatgtgtgaaacagaggagatcacacatgcagaagaccaacctggcggcagcgcaaaagatg

SEQ ID NO: 237208 - DNA, 103 bp, Artificial Sequence
  Synthetic Polynucleotide
taatacgactcactataggggtttacagaaactagagaggggaggcacataacagaggagaatgtgcatgccctctctaaacctggcggcagcgcaaaagatg

SEQ ID NO: 237209 - DNA, 103 bp, Artificial Sequence
  Synthetic Polynucleotide
taatacgactcactatagggttgggcttgggtttacagaaactagagaggaacagaggagacctctcatgtttctgtaaaacctggcggcagcgcaaaagatg

SEQ ID NO: 237210 - DNA, 103 bp, Artificial Sequence
  Synthetic Polynucleotide
taatacgactcactataggggaaagcagacttgggcttgggtttacagaaaacagaggagattctgtatgcccaagcccaacctggcggcagcgcaaaagatg

SEQ ID NO: 237211 - DNA, 103 bp, Artificial Sequence
  Synthetic Polynucleotide
taatacgactcactatagggactgcgccgggaaagcagacttgggcttggaacagaggagaccaagcatgagtctgcttaacctggcggcagcgcaaaagatg

SEQ ID NO: 237212 - DNA, 103 bp, Artificial Sequence
  Synthetic Polynucleotide
taatacgactcactatagggagggatttggactgcgccgggaaagcagacaacagaggagagtctgcatgcccggcgcaaacctggcggcagcgcaaaagatg

SEQ ID NO: 237213 - DNA, 103 bp, Artificial Sequence
  Synthetic Polynucleotide
taatacgactcactatagggcgcagatggcagggatttggactgcgccggaacagaggagaccggcgatgtccaaatccaacctggcggcagcgcaaaagatg

SEQ ID NO: 237214 - DNA, 103 bp, Artificial Sequence
  Synthetic Polynucleotide
taatacgactcactataggggcttccccttcgcagatggcagggatttggaacagaggagaccaaatatgtgccatctgaacctggcggcagcgcaaaagatg

SEQ ID NO: 237215 - DNA, 103 bp, Artificial Sequence
  Synthetic Polynucleotide
taatacgactcactatagggggagggctctgcttccccttcgcagatggcaacagaggagagccatcatggaaggggaaaacctggcggcagcgcaaaagatg

SEQ ID NO: 237216 - DNA, 103 bp, Artificial Sequence
  Synthetic Polynucleotide
taatacgactcactataggggcctggcccaggagggctctgcttccccttaacagaggagaaaggggatgcagagccctaacctggcggcagcgcaaaagatg

SEQ ID NO: 237217 - DNA, 103 bp, Artificial Sequence
  Synthetic Polynucleotide
taatacgactcactataggggaggggccttgcctggcccaggagggctctaacagaggagaagagccatgctgggccagaacctggcggcagcgcaaaagatg

SEQ ID NO: 237218 - DNA, 103 bp, Artificial Sequence
  Synthetic Polynucleotide
taatacgactcactatagggtgcattaagacatgtttattaaggtcttctaacagaggagaagaagaatgtaataaacaaacctggcggcagcgcaaaagatg

SEQ ID NO: 237219 - DNA, 103 bp, Artificial Sequence
  Synthetic Polynucleotide
taatacgactcactatagggcctgaagtcagaggggccttgcctggcccaaacagaggagatgggccatgcaaggccccaacctggcggcagcgcaaaagatg

SEQ ID NO: 237220 - DNA, 103 bp, Artificial Sequence
  Synthetic Polynucleotide
taatacgactcactatagggagagtctatccctgaagtcagaggggccttaacagaggagaaaggccatgctgacttcaaacctggcggcagcgcaaaagatg

SEQ ID NO: 237221 - DNA, 103 bp, Artificial Sequence
  Synthetic Polynucleotide
taatacgactcactatagggctaaagtgctagagtctatccctgaagtcaaacagaggagatgacttatgggatagactaacctggcggcagcgcaaaagatg

SEQ ID NO: 237222 - DNA, 103 bp, Artificial Sequence
  Synthetic Polynucleotide
taatacgactcactatagggttacttggggctaaagtgctagagtctatcaacagaggagagatagaatgtagcactttaacctggcggcagcgcaaaagatg

SEQ ID NO: 237223 - DNA, 103 bp, Artificial Sequence
  Synthetic Polynucleotide
taatacgactcactatagggggacttcaggttacttggggctaaagtgctaacagaggagaagcactatggccccaagtaacctggcggcagcgcaaaagatg

SEQ ID NO: 237224 - DNA, 103 bp, Artificial Sequence
  Synthetic Polynucleotide
taatacgactcactataggggtggtctgtgggacttcaggttacttggggaacagaggagaccccaaatgacctgaagtaacctggcggcagcgcaaaagatg

SEQ ID NO: 237225 - DNA, 103 bp, Artificial Sequence
  Synthetic Polynucleotide
taatacgactcactatagggacattctgctgtggtctgtgggacttcaggaacagaggagacctgaaatgccacagaccaacctggcggcagcgcaaaagatg

SEQ ID NO: 237226 - DNA, 103 bp, Artificial Sequence
  Synthetic Polynucleotide
taatacgactcactatagggttggacccccacattctgctgtggtctgtgaacagaggagacacagaatgcagcagaataacctggcggcagcgcaaaagatg

SEQ ID NO: 237227 - DNA, 103 bp, Artificial Sequence
  Synthetic Polynucleotide
taatacgactcactatagggtggcggccccttggacccccacattctgctaacagaggagaagcagaatgtgggggtccaacctggcggcagcgcaaaagatg

SEQ ID NO: 237228 - DNA, 103 bp, Artificial Sequence
  Synthetic Polynucleotide
taatacgactcactatagggtgttgcctggtggcggccccttggacccccaacagaggagagggggtatgaggggccgcaacctggcggcagcgcaaaagatg

SEQ ID NO: 237229 - DNA, 103 bp, Artificial Sequence
  Synthetic Polynucleotide
taatacgactcactatagggaggccggtgttgcattaagacatgtttattaacagaggagaaataaaatggtcttaatgaacctggcggcagcgcaaaagatg

SEQ ID NO: 237230 - DNA, 103 bp, Artificial Sequence
  Synthetic Polynucleotide
taatacgactcactatagggctcagattgctgttgcctggtggcggccccaacagaggagaggggccatgaccaggcaaaacctggcggcagcgcaaaagatg

SEQ ID NO: 237231 - DNA, 103 bp, Artificial Sequence
  Synthetic Polynucleotide
taatacgactcactatagggtaggaaacatctcagattgctgttgcctggaacagaggagaccaggcatgagcaatctgaacctggcggcagcgcaaaagatg

SEQ ID NO: 237232 - DNA, 103 bp, Artificial Sequence
  Synthetic Polynucleotide
taatacgactcactatagggacactggttttaggaaacatctcagattgcaacagaggagagcaatcatggatgtttccaacctggcggcagcgcaaaagatg

SEQ ID NO: 237233 - DNA, 103 bp, Artificial Sequence
  Synthetic Polynucleotide
taatacgactcactatagggtgcaggggaaacactggttttaggaaacataacagaggagaatgtttatgaaaaccagtaacctggcggcagcgcaaaagatg

SEQ ID NO: 237234 - DNA, 103 bp, Artificial Sequence
  Synthetic Polynucleotide
taatacgactcactatagggtcttatccggtgcaggggaaacactggtttaacagaggagaaaaccaatgtttcccctgaacctggcggcagcgcaaaagatg

SEQ ID NO: 237235 - DNA, 103 bp, Artificial Sequence
  Synthetic Polynucleotide
taatacgactcactatagggggtctttttgtcttatccggtgcaggggaaaacagaggagattccccatgaccggataaaacctggcggcagcgcaaaagatg

SEQ ID NO: 237236 - DNA, 103 bp, Artificial Sequence
  Synthetic Polynucleotide
taatacgactcactatagggttttgtctcgggtctttttgtcttatccggaacagaggagaccggatatgacaaaaagaaacctggcggcagcgcaaaagatg

SEQ ID NO: 237237 - DNA, 103 bp, Artificial Sequence
  Synthetic Polynucleotide
taatacgactcactataggggaggtttcaattttgtctcgggtctttttgaacagaggagacaaaaaatgccgagacaaaacctggcggcagcgcaaaagatg

SEQ ID NO: 237238 - DNA, 103 bp, Artificial Sequence
  Synthetic Polynucleotide
taatacgactcactataggggctactggaagaggtttcaattttgtctcgaacagaggagacgagacatgattgaaaccaacctggcggcagcgcaaaagatg

SEQ ID NO: 237239 - DNA, 103 bp, Artificial Sequence
  Synthetic Polynucleotide
taatacgactcactatagggctgagaaggagctactggaagaggtttcaaaacagaggagattgaaaatgcttccagtaaacctggcggcagcgcaaaagatg

SEQ ID NO: 237240 - DNA, 103 bp, Artificial Sequence
  Synthetic Polynucleotide
taatacgactcactatagggcacagagggtaggccggtgttgcattaagaaacagaggagatcttaaatgaacaccggcaacctggcggcagcgcaaaagatg

SEQ ID NO: 237241 - DNA, 103 bp, Artificial Sequence
  Synthetic Polynucleotide
taatacgactcactatagggcgagggtgggctgagaaggagctactggaaaacagaggagattccagatgctccttctcaacctggcggcagcgcaaaagatg

SEQ ID NO: 237242 - DNA, 103 bp, Artificial Sequence
  Synthetic Polynucleotide
taatacgactcactatagggttactgctgccgagggtgggctgagaaggaaacagaggagatccttcatggcccaccctaacctggcggcagcgcaaaagatg

SEQ ID NO: 237243 - DNA, 103 bp, Artificial Sequence
  Synthetic Polynucleotide
taatacgactcactatagggaccattgatgttactgctgccgagggtgggaacagaggagacccaccatgggcagcagtaacctggcggcagcgcaaaagatg

SEQ ID NO: 237244 - DNA, 103 bp, Artificial Sequence
  Synthetic Polynucleotide
taatacgactcactatagggagtcgatggaaccattgatgttactgctgcaacagaggagagcagcaatgacatcaatgaacctggcggcagcgcaaaagatg

SEQ ID NO: 237245 - DNA, 103 bp, Artificial Sequence
  Synthetic Polynucleotide
taatacgactcactatagggttggcggggtagtcgatggaaccattgatgaacagaggagacatcaaatgttccatcgaaacctggcggcagcgcaaaagatg

SEQ ID NO: 237246 - DNA, 103 bp, Artificial Sequence
  Synthetic Polynucleotide
taatacgactcactataggggctgtcgttcttggcggggtagtcgatggaaacagaggagatccatcatgtaccccgccaacctggcggcagcgcaaaagatg

SEQ ID NO: 237247 - DNA, 103 bp, Artificial Sequence
  Synthetic Polynucleotide
taatacgactcactataggggtgcccacgggctgtcgttcttggcggggtaacagaggagaaccccgatgagaacgacaaacctggcggcagcgcaaaagatg

SEQ ID NO: 237248 - DNA, 103 bp, Artificial Sequence
  Synthetic Polynucleotide
taatacgactcactatagggcttcccggaggtgcccacgggctgtcgttcaacagaggagagaacgaatgcccgtgggcaacctggcggcagcgcaaaagatg

SEQ ID NO: 237249 - DNA, 103 bp, Artificial Sequence
  Synthetic Polynucleotide
taatacgactcactataggggaaatagtctcttcccggaggtgcccacggaacagaggagaccgtggatgcctccgggaaacctggcggcagcgcaaaagatg

SEQ ID NO: 237250 - DNA, 103 bp, Artificial Sequence
  Synthetic Polynucleotide
taatacgactcactatagggtccgattacagaaatagtctcttcccggagaacagaggagactccggatggagactattaacctggcggcagcgcaaaagatg

SEQ ID NO: 237251 - DNA, 103 bp, Artificial Sequence
  Synthetic Polynucleotide
taatacgactcactatagggactgctggttcacagagggtaggccggtgtaacagaggagaacaccgatgtaccctctgaacctggcggcagcgcaaaagatg

SEQ ID NO: 237252 - DNA, 103 bp, Artificial Sequence
  Synthetic Polynucleotide
taatacgactcactatagggttgctggcactccgattacagaaatagtctaacagaggagaagactaatgctgtaatcgaacctggcggcagcgcaaaagatg

SEQ ID NO: 237253 - DNA, 103 bp, Artificial Sequence
  Synthetic Polynucleotide
taatacgactcactatagggtgctgcagtattgctggcactccgattacaaacagaggagatgtaatatgagtgccagcaacctggcggcagcgcaaaagatg

SEQ ID NO: 237254 - DNA, 103 bp, Artificial Sequence
  Synthetic Polynucleotide
taatacgactcactatagggcaccaaattctgctgcagtattgctggcacaacagaggagagtgccaatgatactgcagaacctggcggcagcgcaaaagatg

SEQ ID NO: 237255 - DNA, 103 bp, Artificial Sequence
  Synthetic Polynucleotide
taatacgactcactatagggggaaggggctcaccaaattctgctgcagtaaacagaggagatactgcatgagaatttggaacctggcggcagcgcaaaagatg

SEQ ID NO: 237256 - DNA, 103 bp, Artificial Sequence
  Synthetic Polynucleotide
taatacgactcactatagggcagtctttttggaaggggctcaccaaattcaacagaggagagaatttatggagccccttaacctggcggcagcgcaaaagatg

SEQ ID NO: 237257 - DNA, 103 bp, Artificial Sequence
  Synthetic Polynucleotide
taatacgactcactatagggcgctggacttcagtctttttggaaggggctaacagaggagaagccccatgcaaaaagacaacctggcggcagcgcaaaagatg

SEQ ID NO: 237258 - DNA, 103 bp, Artificial Sequence
  Synthetic Polynucleotide
taatacgactcactatagggagggcaaccacgctggacttcagtctttttaacagaggagaaaaaagatggaagtccagaacctggcggcagcgcaaaagatg

SEQ ID NO: 237259 - DNA, 103 bp, Artificial Sequence
  Synthetic Polynucleotide
taatacgactcactataggggtcaacgtcaagggcaaccacgctggacttaacagaggagaaagtccatggtggttgccaacctggcggcagcgcaaaagatg

SEQ ID NO: 237260 - DNA, 103 bp, Artificial Sequence
  Synthetic Polynucleotide
taatacgactcactatagggccccgggctggtcaacgtcaagggcaaccaaacagaggagatggttgatgttgacgttgaacctggcggcagcgcaaaagatg

SEQ ID NO: 237261 - DNA, 103 bp, Artificial Sequence
  Synthetic Polynucleotide
taatacgactcactatagggctgtaattggccccgggctggtcaacgtcaaacagaggagatgacgtatgccagcccggaacctggcggcagcgcaaaagatg

SEQ ID NO: 237262 - DNA, 103 bp, Artificial Sequence
  Synthetic Polynucleotide
taatacgactcactatagggaacccgaagaactgctggttcacagagggtaacagaggagaaccctcatggaaccagcaaacctggcggcagcgcaaaagatg

SEQ ID NO: 237263 - DNA, 103 bp, Artificial Sequence
  Synthetic Polynucleotide
taatacgactcactatagggatagcctcttctgtaattggccccgggctgaacagaggagacagcccatggccaattacaacctggcggcagcgcaaaagatg

SEQ ID NO: 237264 - DNA, 103 bp, Artificial Sequence
  Synthetic Polynucleotide
taatacgactcactatagggtgggaaggtcatagcctcttctgtaattggaacagaggagaccaattatggaagaggctaacctggcggcagcgcaaaagatg

SEQ ID NO: 237265 - DNA, 103 bp, Artificial Sequence
  Synthetic Polynucleotide
taatacgactcactatagggatatggtacttgggaaggtcatagcctcttaacagaggagaaagaggatgtgaccttccaacctggcggcagcgcaaaagatg

SEQ ID NO: 237266 - DNA, 103 bp, Artificial Sequence
  Synthetic Polynucleotide
taatacgactcactataggggcctctgaccatatggtacttgggaaggtcaacagaggagagaccttatgaagtaccataacctggcggcagcgcaaaagatg

SEQ ID NO: 237267 - DNA, 103 bp, Artificial Sequence
  Synthetic Polynucleotide
taatacgactcactataggggtgatgtgatgcctctgaccatatggtactaacagaggagaagtaccatgtggtcagagaacctggcggcagcgcaaaagatg

SEQ ID NO: 237268 - DNA, 103 bp, Artificial Sequence
  Synthetic Polynucleotide
taatacgactcactatagggtgcggtaacagtgatgtgatgcctctgaccaacagaggagaggtcagatgcatcacatcaacctggcggcagcgcaaaagatg

SEQ ID NO: 237269 - DNA, 103 bp, Artificial Sequence
  Synthetic Polynucleotide
taatacgactcactatagggcacacagtcctgcggtaacagtgatgtgataacagaggagaatcacaatgctgttaccgaacctggcggcagcgcaaaagatg

SEQ ID NO: 237270 - DNA, 103 bp, Artificial Sequence
  Synthetic Polynucleotide
taatacgactcactataggggcgacggatacacacagtcctgcggtaacaaacagaggagatgttacatgaggactgtgaacctggcggcagcgcaaaagatg

SEQ ID NO: 237271 - DNA, 103 bp, Artificial Sequence
  Synthetic Polynucleotide
taatacgactcactatagggggcagcgcctgcgacggatacacacagtccaacagaggagaggactgatggtatccgtcaacctggcggcagcgcaaaagatg

SEQ ID NO: 237272 - DNA, 103 bp, Artificial Sequence
  Synthetic Polynucleotide
taatacgactcactatagggtggtttgggaggcagcgcctgcgacggataaacagaggagatatccgatgcaggcgctgaacctggcggcagcgcaaaagatg

SEQ ID NO: 237273 - DNA, 103 bp, Artificial Sequence
  Synthetic Polynucleotide
taatacgactcactatagggactctgcttcaacccgaagaactgctggttaacagaggagaaaccagatgttcttcgggaacctggcggcagcgcaaaagatg

SEQ ID NO: 237274 - DNA, 103 bp, Artificial Sequence
  Synthetic Polynucleotide
taatacgactcactatagggtcaggaaccttggtttgggaggcagcgcctaacagaggagaaggcgcatgctcccaaacaacctggcggcagcgcaaaagatg

SEQ ID NO: 237275 - DNA, 103 bp, Artificial Sequence
  Synthetic Polynucleotide
taatacgactcactatagggtcgctggagctcaggaaccttggtttgggaaacagaggagatcccaaatgaaggttcctaacctggcggcagcgcaaaagatg

SEQ ID NO: 237276 - DNA, 103 bp, Artificial Sequence
  Synthetic Polynucleotide
taatacgactcactatagggagaatcgacctcgctggagctcaggaacctaacagaggagaaggttcatgagctccagcaacctggcggcagcgcaaaagatg

SEQ ID NO: 237277 - DNA, 103 bp, Artificial Sequence
  Synthetic Polynucleotide
taatacgactcactataggggcacatttggagaatcgacctcgctggagcaacagaggagagctccaatgaggtcgattaacctggcggcagcgcaaaagatg

SEQ ID NO: 237278 - DNA, 103 bp, Artificial Sequence
  Synthetic Polynucleotide
taatacgactcactatagggtgaacagtcagcacatttggagaatcgaccaacagaggagaggtcgaatgtccaaatgtaacctggcggcagcgcaaaagatg

SEQ ID NO: 237279 - DNA, 103 bp, Artificial Sequence
  Synthetic Polynucleotide
taatacgactcactatagggatagggcttctgaacagtcagcacatttggaacagaggagaccaaatatgctgactgttaacctggcggcagcgcaaaagatg

SEQ ID NO: 237280 - DNA, 103 bp, Artificial Sequence
  Synthetic Polynucleotide
taatacgactcactatagggcggagccaccatagggcttctgaacagtcaaacagaggagatgactgatgagaagccctaacctggcggcagcgcaaaagatg

SEQ ID NO: 237281 - DNA, 103 bp, Artificial Sequence
  Synthetic Polynucleotide
taatacgactcactatagggtaaagtggcccggagccaccatagggcttcaacagaggagagaagccatgtggtggctcaacctggcggcagcgcaaaagatg

SEQ ID NO: 237282 - DNA, 103 bp, Artificial Sequence
  Synthetic Polynucleotide
taatacgactcactatagggcacacaagtgtaaagtggcccggagccaccaacagaggagaggtggcatggggccacttaacctggcggcagcgcaaaagatg

SEQ ID NO: 237283 - DNA, 103 bp, Artificial Sequence
  Synthetic Polynucleotide
taatacgactcactatagggtaccagcaggcacacaagtgtaaagtggccaacagaggagaggccacatgacacttgtgaacctggcggcagcgcaaaagatg

SEQ ID NO: 237284 - DNA, 103 bp, Artificial Sequence
  Synthetic Polynucleotide
taatacgactcactatagggtacattaagagggattgagttggcatgtttaacagaggagaaaacatatgaactcaatcaacctggcggcagcgcaaaagatg

SEQ ID NO: 237285 - DNA, 103 bp, Artificial Sequence
  Synthetic Polynucleotide
taatacgactcactatagggggactgagatactctgcttcaacccgaagaaacagaggagatcttcgatgtgaagcagaaacctggcggcagcgcaaaagatg

SEQ ID NO: 237286 - DNA, 103 bp, Artificial Sequence
  Synthetic Polynucleotide
taatacgactcactataggggatgctggactaccagcaggcacacaagtgaacagaggagacacttgatggcctgctggaacctggcggcagcgcaaaagatg

SEQ ID NO: 237287 - DNA, 103 bp, Artificial Sequence
  Synthetic Polynucleotide
taatacgactcactatagggcgtcgagctggatgctggactaccagcaggaacagaggagacctgctatgagtccagcaaacctggcggcagcgcaaaagatg

SEQ ID NO: 237288 - DNA, 103 bp, Artificial Sequence
  Synthetic Polynucleotide
taatacgactcactatagggttccttctaacgtcgagctggatgctggacaacagaggagagtccagatgccagctcgaaacctggcggcagcgcaaaagatg

SEQ ID NO: 237289 - DNA, 103 bp, Artificial Sequence
  Synthetic Polynucleotide
taatacgactcactatagggacaggcctttttccttctaacgtcgagctgaacagaggagacagctcatggttagaaggaacctggcggcagcgcaaaagatg

SEQ ID NO: 237290 - DNA, 103 bp, Artificial Sequence
  Synthetic Polynucleotide
taatacgactcactatagggttgatatgacacaggcctttttccttctaaaacagaggagattagaaatgaaaaggcctaacctggcggcagcgcaaaagatg

SEQ ID NO: 237291 - DNA, 103 bp, Artificial Sequence
  Synthetic Polynucleotide
taatacgactcactatagggtagataagtgttgatatgacacaggcctttaacagaggagaaaaggcatgtgtcatatcaacctggcggcagcgcaaaagatg

SEQ ID NO: 237292 - DNA, 103 bp, Artificial Sequence
  Synthetic Polynucleotide
taatacgactcactataggggccatgctgttagataagtgttgatatgacaacagaggagagtcataatgacacttatcaacctggcggcagcgcaaaagatg

SEQ ID NO: 237293 - DNA, 103 bp, Artificial Sequence
  Synthetic Polynucleotide
taatacgactcactatagggtctcttttgtgccatgctgttagataagtgaacagaggagacacttaatgaacagcatgaacctggcggcagcgcaaaagatg

SEQ ID NO: 237294 - DNA, 103 bp, Artificial Sequence
  Synthetic Polynucleotide
taatacgactcactatagggtctcatagtttctcttttgtgccatgctgtaacagaggagaacagcaatgcacaaaagaaacctggcggcagcgcaaaagatg

SEQ ID NO: 237295 - DNA, 103 bp, Artificial Sequence
  Synthetic Polynucleotide
taatacgactcactatagggccaataaaattctcatagtttctcttttgtaacagaggagaacaaaaatgaaactatgaaacctggcggcagcgcaaaagatg

SEQ ID NO: 237296 - DNA, 103 bp, Artificial Sequence
  Synthetic Polynucleotide
taatacgactcactatagggtttatcaagcggactgagatactctgcttcaacagaggagagaagcaatgtatctcagtaacctggcggcagcgcaaaagatg

SEQ ID NO: 237297 - DNA, 103 bp, Artificial Sequence
  Synthetic Polynucleotide
taatacgactcactatagggatgtgcattcccaataaaattctcatagttaacagaggagaaactatatgaattttattaacctggcggcagcgcaaaagatg

SEQ ID NO: 237298 - DNA, 103 bp, Artificial Sequence
  Synthetic Polynucleotide
taatacgactcactatagggttggtcgataatgtgcattcccaataaaataacagaggagaattttaatgggaatgcacaacctggcggcagcgcaaaagatg

SEQ ID NO: 237299 - DNA, 103 bp, Artificial Sequence
  Synthetic Polynucleotide
taatacgactcactatagggtttttgtcatttggtcgataatgtgcattcaacagaggagagaatgcatgttatcgaccaacctggcggcagcgcaaaagatg

SEQ ID NO: 237300 - DNA, 103 bp, Artificial Sequence
  Synthetic Polynucleotide
taatacgactcactataggggcacttgacttttatcaagcggactgagataacagaggagaatctcaatgcgcttgataaacctggcggcagcgcaaaagatg

SEQ ID NO: 237301 - DNA, 103 bp, Artificial Sequence
  Synthetic Polynucleotide
taatacgactcactatagggggttctgttcgcacttgacttttatcaagcaacagaggagagcttgaatgaagtcaagtaacctggcggcagcgcaaaagatg

SEQ ID NO: 237302 - DNA, 103 bp, Artificial Sequence
  Synthetic Polynucleotide
taatacgactcactatagggttccttgggaggttctgttcgcacttgactaacagaggagaagtcaaatgcgaacagaaaacctggcggcagcgcaaaagatg

SEQ ID NO: 237303 - DNA, 103 bp, Artificial Sequence
  Synthetic Polynucleotide
taatacgactcactatagggtgcaattcttttccttgggaggttctgttcaacagaggagagaacagatgctcccaaggaacctggcggcagcgcaaaagatg

SEQ ID NO: 237304 - DNA, 103 bp, Artificial Sequence
  Synthetic Polynucleotide
taatacgactcactatagggtcattttccttgcaattcttttccttgggaaacagaggagatcccaaatgaaagaattgaacctggcggcagcgcaaaagatg

SEQ ID NO: 237305 - DNA, 103 bp, Artificial Sequence
  Synthetic Polynucleotide
taatacgactcactatagggacagctaaattcattttccttgcaattcttaacagaggagaaagaatatgaaggaaaataacctggcggcagcgcaaaagatg

SEQ ID NO: 237306 - DNA, 103 bp, Artificial Sequence
  Synthetic Polynucleotide
taatacgactcactatagggcacatacctcacagctaaattcattttcctaacagaggagaaggaaaatgaatttagctaacctggcggcagcgcaaaagatg

SEQ ID NO: 237307 - DNA, 103 bp, Artificial Sequence
  Synthetic Polynucleotide
taatacgactcactatagggaatgtctgcccacatacctcacagctaaataacagaggagaatttagatgtgaggtatgaacctggcggcagcgcaaaagatg

SEQ ID NO: 237308 - DNA, 103 bp, Artificial Sequence
  Synthetic Polynucleotide
taatacgactcactatagggcccatccatgtacattaagagggattgagtaacagaggagaactcaaatgctcttaatgaacctggcggcagcgcaaaagatg

SEQ ID NO: 237309 - DNA, 103 bp, Artificial Sequence
  Synthetic Polynucleotide
taatacgactcactatagggagcgactctaaatgtctgcccacatacctcaacagaggagagaggtaatggggcagacaaacctggcggcagcgcaaaagatg

SEQ ID NO: 237310 - DNA, 103 bp, Artificial Sequence
  Synthetic Polynucleotide
taatacgactcactatagggcaacatcaaaagcgactctaaatgtctgccaacagaggagaggcagaatgttagagtcgaacctggcggcagcgcaaaagatg

SEQ ID NO: 237311 - DNA, 103 bp, Artificial Sequence
  Synthetic Polynucleotide
taatacgactcactatagggatgtggatctcaacatcaaaagcgactctaaacagaggagatagagtatgttttgatgtaacctggcggcagcgcaaaagatg

SEQ ID NO: 237312 - DNA, 103 bp, Artificial Sequence
  Synthetic Polynucleotide
taatacgactcactataggggtgtgttctcatgtggatctcaacatcaaaaacagaggagatttgatatggagatccacaacctggcggcagcgcaaaagatg

SEQ ID NO: 237313 - DNA, 103 bp, Artificial Sequence
  Synthetic Polynucleotide
taatacgactcactatagggaagaatctttgtgtgttctcatgtggatctaacagaggagaagatccatgtgagaacacaacctggcggcagcgcaaaagatg

SEQ ID NO: 237314 - DNA, 103 bp, Artificial Sequence
  Synthetic Polynucleotide
taatacgactcactatagggccgtaagtgaaagaatctttgtgtgttctcaacagaggagagagaacatgcaaagattcaacctggcggcagcgcaaaagatg

SEQ ID NO: 237315 - DNA, 103 bp, Artificial Sequence
  Synthetic Polynucleotide
taatacgactcactatagggcatgttacacccgtaagtgaaagaatctttaacagaggagaaaagatatgttcacttacaacctggcggcagcgcaaaagatg

SEQ ID NO: 237316 - DNA, 103 bp, Artificial Sequence
  Synthetic Polynucleotide
taatacgactcactatagggttcttccgcacatgttacacccgtaagtgaaacagaggagatcacttatgggtgtaacaaacctggcggcagcgcaaaagatg

SEQ ID NO: 237317 - DNA, 103 bp, Artificial Sequence
  Synthetic Polynucleotide
taatacgactcactatagggtccttgaatcttcttccgcacatgttacacaacagaggagagtgtaaatggtgcggaagaacctggcggcagcgcaaaagatg

SEQ ID NO: 237318 - DNA, 103 bp, Artificial Sequence
  Synthetic Polynucleotide
taatacgactcactatagggaaaccaaggctccttgaatcttcttccgcaaacagaggagatgcggaatgagattcaagaacctggcggcagcgcaaaagatg

SEQ ID NO: 237319 - DNA, 103 bp, Artificial Sequence
  Synthetic Polynucleotide
taatacgactcactatagggtcacttctggcccatccatgtacattaagaaacagaggagatcttaaatgacatggatgaacctggcggcagcgcaaaagatg

SEQ ID NO: 237320 - DNA, 103 bp, Artificial Sequence
  Synthetic Polynucleotide
taatacgactcactataggggatttttaagaaaccaaggctccttgaatcaacagaggagagattcaatgagccttggtaacctggcggcagcgcaaaagatg

SEQ ID NO: 237321 - DNA, 103 bp, Artificial Sequence
  Synthetic Polynucleotide
taatacgactcactataggggtccgcatgtgatttttaagaaaccaaggcaacagaggagagccttgatgtcttaaaaaaacctggcggcagcgcaaaagatg

SEQ ID NO: 237322 - DNA, 103 bp, Artificial Sequence
  Synthetic Polynucleotide
taatacgactcactataggggccattatgtgtccgcatgtgatttttaagaacagaggagacttaaaatgcacatgcggaacctggcggcagcgcaaaagatg

SEQ ID NO: 237323 - DNA, 103 bp, Artificial Sequence
  Synthetic Polynucleotide
taatacgactcactatagggcccccgatttgccattatgtgtccgcatgtaacagaggagaacatgcatgcacataatgaacctggcggcagcgcaaaagatg

SEQ ID NO: 237324 - DNA, 103 bp, Artificial Sequence
  Synthetic Polynucleotide
taatacgactcactatagggttgcttctggcccccgatttgccattatgtaacagaggagaacataaatgcaaatcgggaacctggcggcagcgcaaaagatg

SEQ ID NO: 237325 - DNA, 103 bp, Artificial Sequence
  Synthetic Polynucleotide
taatacgactcactatagggttgctgcagtttgcttctggcccccgatttaacagaggagaaaatcgatggccagaagcaacctggcggcagcgcaaaagatg

SEQ ID NO: 237326 - DNA, 103 bp, Artificial Sequence
  Synthetic Polynucleotide
taatacgactcactatagggtctccaagccttgctgcagtttgcttctggaacagaggagaccagaaatgaactgcagcaacctggcggcagcgcaaaagatg

SEQ ID NO: 237327 - DNA, 103 bp, Artificial Sequence
  Synthetic Polynucleotide
taatacgactcactataggggctggactactctccaagccttgctgcagtaacagaggagaactgcaatgaggcttggaaacctggcggcagcgcaaaagatg

SEQ ID NO: 237328 - DNA, 103 bp, Artificial Sequence
  Synthetic Polynucleotide
taatacgactcactataggggttgatcgttgctggactactctccaagccaacagaggagaggcttgatgagtagtccaaacctggcggcagcgcaaaagatg

SEQ ID NO: 237329 - DNA, 103 bp, Artificial Sequence
  Synthetic Polynucleotide
taatacgactcactatagggggacgacctcgttgatcgttgctggactacaacagaggagagtagtcatgcaacgatcaaacctggcggcagcgcaaaagatg

SEQ ID NO: 237330 - DNA, 103 bp, Artificial Sequence
  Synthetic Polynucleotide
taatacgactcactataggggagctgccaatcacttctggcccatccatgaacagaggagacatggaatggccagaagtaacctggcggcagcgcaaaagatg

SEQ ID NO: 237331 - DNA, 103 bp, Artificial Sequence
  Synthetic Polynucleotide
taatacgactcactataggggcgtgcacctggacgacctcgttgatcgttaacagaggagaaacgatatgcgaggtcgtaacctggcggcagcgcaaaagatg

SEQ ID NO: 237332 - DNA, 103 bp, Artificial Sequence
  Synthetic Polynucleotide
taatacgactcactataggggctctcggccgcgtgcacctggacgacctcaacagaggagagaggtcatgcaggtgcacaacctggcggcagcgcaaaagatg

SEQ ID NO: 237333 - DNA, 103 bp, Artificial Sequence
  Synthetic Polynucleotide
taatacgactcactataggggagaggagatgctctcggccgcgtgcacctaacagaggagaaggtgcatgcggccgagaaacctggcggcagcgcaaaagatg

SEQ ID NO: 237334 - DNA, 103 bp, Artificial Sequence
  Synthetic Polynucleotide
taatacgactcactatagggattttgtaaggagaggagatgctctcggccaacagaggagaggccgaatgcatctcctcaacctggcggcagcgcaaaagatg

SEQ ID NO: 237335 - DNA, 103 bp, Artificial Sequence
  Synthetic Polynucleotide
taatacgactcactatagggaaccatgcagattttgtaaggagaggagataacagaggagaatctccatgccttacaaaaacctggcggcagcgcaaaagatg

SEQ ID NO: 237336 - DNA, 103 bp, Artificial Sequence
  Synthetic Polynucleotide
taatacgactcactatagggggaagccacaaaccatgcagattttgtaagaacagaggagacttacaatgtctgcatggaacctggcggcagcgcaaaagatg

SEQ ID NO: 237337 - DNA, 103 bp, Artificial Sequence
  Synthetic Polynucleotide
taatacgactcactatagggtttggaaataggaagccacaaaccatgcagaacagaggagactgcatatgttgtggcttaacctggcggcagcgcaaaagatg

SEQ ID NO: 237338 - DNA, 103 bp, Artificial Sequence
  Synthetic Polynucleotide
taatacgactcactatagggactttctttatttggaaataggaagccacaaacagaggagatgtggcatgctatttccaaacctggcggcagcgcaaaagatg

SEQ ID NO: 237339 - DNA, 103 bp, Artificial Sequence
  Synthetic Polynucleotide
taatacgactcactataggggctcaattagactttctttatttggaaataaacagaggagatatttcatgataaagaaaaacctggcggcagcgcaaaagatg

SEQ ID NO: 237340 - DNA, 103 bp, Artificial Sequence
  Synthetic Polynucleotide
taatacgactcactatagggaccttgcggtgctcaattagactttctttaaacagaggagataaagaatgtctaattgaaacctggcggcagcgcaaaagatg

SEQ ID NO: 237341 - DNA, 103 bp, Artificial Sequence
  Synthetic Polynucleotide
taatacgactcactatagggactgccaagagagctgccaatcacttctggaacagaggagaccagaaatgattggcagcaacctggcggcagcgcaaaagatg

SEQ ID NO: 237342 - DNA, 103 bp, Artificial Sequence
  Synthetic Polynucleotide
taatacgactcactatagggtttggtgtgcaccttgcggtgctcaattagaacagaggagactaattatgcaccgcaagaacctggcggcagcgcaaaagatg

SEQ ID NO: 237343 - DNA, 103 bp, Artificial Sequence
  Synthetic Polynucleotide
taatacgactcactatagggaagcagtttttttggtgtgcaccttgcggtaacagaggagaaccgcaatgtgcacaccaaacctggcggcagcgcaaaagatg

SEQ ID NO: 237344 - DNA, 103 bp, Artificial Sequence
  Synthetic Polynucleotide
taatacgactcactatagggctggtaccgaaagcagtttttttggtgtgcaacagaggagagcacacatgaaaaactgcaacctggcggcagcgcaaaagatg

SEQ ID NO: 237345 - DNA, 103 bp, Artificial Sequence
  Synthetic Polynucleotide
taatacgactcactatagggctgcgcgctgctggtaccgaaagcagttttaacagaggagaaaaactatgttcggtaccaacctggcggcagcgcaaaagatg

SEQ ID NO: 237346 - DNA, 103 bp, Artificial Sequence
  Synthetic Polynucleotide
taatacgactcactataggggagagtctgtctgcgcgctgctggtaccgaaacagaggagatcggtaatggcagcgcgcaacctggcggcagcgcaaaagatg

SEQ ID NO: 237347 - DNA, 103 bp, Artificial Sequence
  Synthetic Polynucleotide
taatacgactcactatagggcctccttgtggagagtctgtctgcgcgctgaacagaggagacagcgcatggacagactcaacctggcggcagcgcaaaagatg

SEQ ID NO: 237348 - DNA, 103 bp, Artificial Sequence
  Synthetic Polynucleotide
taatacgactcactatagggggacggcattcctccttgtggagagtctgtaacagaggagaacagacatgccacaaggaaacctggcggcagcgcaaaagatg

SEQ ID NO: 237349 - DNA, 103 bp, Artificial Sequence
  Synthetic Polynucleotide
taatacgactcactatagggcctccctcgaggacggcattcctccttgtgaacagaggagacacaagatggaatgccgtaacctggcggcagcgcaaaagatg

SEQ ID NO: 237350 - DNA, 103 bp, Artificial Sequence
  Synthetic Polynucleotide
taatacgactcactatagggtgcaggaagtcctccctcgaggacggcattaacagaggagaaatgccatgctcgagggaaacctggcggcagcgcaaaagatg

SEQ ID NO: 237351 - DNA, 103 bp, Artificial Sequence
  Synthetic Polynucleotide
taatacgactcactataggggttgaacaactgcaggaagtcctccctcgaaacagaggagatcgaggatggacttcctgaacctggcggcagcgcaaaagatg

SEQ ID NO: 237352 - DNA, 103 bp, Artificial Sequence
  Synthetic Polynucleotide
taatacgactcactatagggtctccatcggactgccaagagagctgccaaaacagaggagattggcaatgctcttggcaaacctggcggcagcgcaaaagatg

SEQ ID NO: 237353 - DNA, 103 bp, Artificial Sequence
  Synthetic Polynucleotide
taatacgactcactatagggttggtctcaagttgaacaactgcaggaagtaacagaggagaacttccatgagttgttcaaacctggcggcagcgcaaaagatg

SEQ ID NO: 237354 - DNA, 103 bp, Artificial Sequence
  Synthetic Polynucleotide
taatacgactcactataggggggtgagattttggtctcaagttgaacaacaacagaggagagttgttatgcttgagaccaacctggcggcagcgcaaaagatg

SEQ ID NO: 237355 - DNA, 103 bp, Artificial Sequence
  Synthetic Polynucleotide
taatacgactcactatagggccccgtttcagggtgagattttggtctcaaaacagaggagattgagaatgaaatctcacaacctggcggcagcgcaaaagatg

SEQ ID NO: 237356 - DNA, 103 bp, Artificial Sequence
  Synthetic Polynucleotide
taatacgactcactatagggcaggcttcttccccgtttcagggtgagattaacagaggagaaatctcatgctgaaacggaacctggcggcagcgcaaaagatg

SEQ ID NO: 237357 - DNA, 103 bp, Artificial Sequence
  Synthetic Polynucleotide
taatacgactcactatagggatgcatctgacaggcttcttccccgtttcaaacagaggagatgaaacatggaagaagccaacctggcggcagcgcaaaagatg

SEQ ID NO: 237358 - DNA, 103 bp, Artificial Sequence
  Synthetic Polynucleotide
taatacgactcactataggggagctgagggatgcatctgacaggcttcttaacagaggagaaagaagatggtcagatgcaacctggcggcagcgcaaaagatg

SEQ ID NO: 237359 - DNA, 103 bp, Artificial Sequence
  Synthetic Polynucleotide
taatacgactcactatagggtgaacggatcgagctgagggatgcatctgaaacagaggagatcagatatgtccctcagcaacctggcggcagcgcaaaagatg

SEQ ID NO: 237360 - DNA, 103 bp, Artificial Sequence
  Synthetic Polynucleotide
taatacgactcactatagggtggaaggtggtgaacggatcgagctgagggaacagaggagaccctcaatgcgatccgttaacctggcggcagcgcaaaagatg

SEQ ID NO: 237361 - DNA, 103 bp, Artificial Sequence
  Synthetic Polynucleotide
taatacgactcactatagggctgccaagcctggaaggtggtgaacggatcaacagaggagagatccgatgaccaccttcaacctggcggcagcgcaaaagatg

SEQ ID NO: 237362 - DNA, 103 bp, Artificial Sequence
  Synthetic Polynucleotide
taatacgactcactatagggtggtagccagctgccaagcctggaaggtggaacagaggagaccacctatgaggcttggcaacctggcggcagcgcaaaagatg

SEQ ID NO: 237363 - DNA, 103 bp, Artificial Sequence
  Synthetic Polynucleotide
taatacgactcactataggggcatcctccatctccatcggactgccaagaaacagaggagatcttggatgtccgatggaaacctggcggcagcgcaaaagatg

SEQ ID NO: 237364 - DNA, 103 bp, Artificial Sequence
  Synthetic Polynucleotide
taatacgactcactatagggacttttcctttggtagccagctgccaagccaacagaggagaggcttgatggctggctacaacctggcggcagcgcaaaagatg

SEQ ID NO: 237365 - DNA, 103 bp, Artificial Sequence
  Synthetic Polynucleotide
taatacgactcactataggggcaaatggcaacttttcctttggtagccagaacagaggagactggctatgaaaggaaaaaacctggcggcagcgcaaaagatg

SEQ ID NO: 237366 - DNA, 103 bp, Artificial Sequence
  Synthetic Polynucleotide
taatacgactcactatagggtcacttcttggcaaatggcaacttttccttaacagaggagaaaggaaatgttgccatttaacctggcggcagcgcaaaagatg

SEQ ID NO: 237367 - DNA, 103 bp, Artificial Sequence
  Synthetic Polynucleotide
taatacgactcactatagggcccgattccttcacttcttggcaaatggcaaacagaggagatgccatatgccaagaagtaacctggcggcagcgcaaaagatg

SEQ ID NO: 237368 - DNA, 103 bp, Artificial Sequence
  Synthetic Polynucleotide
taatacgactcactatagggcccttcttgccccgattccttcacttcttgaacagaggagacaagaaatgaaggaatcgaacctggcggcagcgcaaaagatg

SEQ ID NO: 237369 - DNA, 103 bp, Artificial Sequence
  Synthetic Polynucleotide
taatacgactcactatagggtgtcggtgctcccttcttgccccgattcctaacagaggagaaggaatatgggcaagaagaacctggcggcagcgcaaaagatg

SEQ ID NO: 237370 - DNA, 103 bp, Artificial Sequence
  Synthetic Polynucleotide
taatacgactcactataggggaatcgtcgttgtcggtgctcccttcttgcaacagaggagagcaagaatggagcaccgaaacctggcggcagcgcaaaagatg

SEQ ID NO: 237371 - DNA, 103 bp, Artificial Sequence
  Synthetic Polynucleotide
taatacgactcactatagggctcggaactcgaatcgtcgttgtcggtgctaacagaggagaagcaccatgaacgacgataacctggcggcagcgcaaaagatg

SEQ ID NO: 237372 - DNA, 103 bp, Artificial Sequence
  Synthetic Polynucleotide
taatacgactcactatagggcaagctccttctcggaactcgaatcgtcgtaacagaggagaacgacgatgcgagttccgaacctggcggcagcgcaaaagatg

SEQ ID NO: 237373 - DNA, 103 bp, Artificial Sequence
  Synthetic Polynucleotide
taatacgactcactatagggtttgtttctccaagctccttctcggaactcaacagaggagagagttcatggaaggagctaacctggcggcagcgcaaaagatg

SEQ ID NO: 237374 - DNA, 103 bp, Artificial Sequence
  Synthetic Polynucleotide
taatacgactcactataggggctcggggcgcggggacgtgagccctccataacagaggagaatggagatgtcacgtcccaacctggcggcagcgcaaaagatg

SEQ ID NO: 237375 - DNA, 103 bp, Artificial Sequence
  Synthetic Polynucleotide
taatacgactcactataggggagcgaccctgcgctcacggctggcccgttaacagaggagaaacgggatggccgtgagcaacctggcggcagcgcaaaagatg

SEQ ID NO: 237376 - DNA, 103 bp, Artificial Sequence
  Synthetic Polynucleotide
taatacgactcactatagggaggcccggaggcaggccccggggcacgcagaacagaggagactgcgtatgccggggcctaacctggcggcagcgcaaaagatg

SEQ ID NO: 237377 - DNA, 103 bp, Artificial Sequence
  Synthetic Polynucleotide
taatacgactcactataggggggcgcgggcaggcccggaggcaggccccgaacagaggagacggggcatgcctccgggcaacctggcggcagcgcaaaagatg

SEQ ID NO: 237378 - DNA, 103 bp, Artificial Sequence
  Synthetic Polynucleotide
taatacgactcactatagggggaggctggggggcgcgggcaggcccggagaacagaggagactccggatgtgcccgcgcaacctggcggcagcgcaaaagatg

SEQ ID NO: 237379 - DNA, 103 bp, Artificial Sequence
  Synthetic Polynucleotide
taatacgactcactataggggccgaggtcaggaggctggggggcgcgggcaacagaggagagcccgcatgccccagcctaacctggcggcagcgcaaaagatg

SEQ ID NO: 237380 - DNA, 103 bp, Artificial Sequence
  Synthetic Polynucleotide
taatacgactcactatagggaggccagcaggccgaggtcaggaggctgggaacagaggagacccagcatgctgacctcgaacctggcggcagcgcaaaagatg

SEQ ID NO: 237381 - DNA, 103 bp, Artificial Sequence
  Synthetic Polynucleotide
taatacgactcactatagggaacggctcataggccagcaggccgaggtcaaacagaggagatgacctatgcctgctggcaacctggcggcagcgcaaaagatg

SEQ ID NO: 237382 - DNA, 103 bp, Artificial Sequence
  Synthetic Polynucleotide
taatacgactcactatagggcgctgggcccaacggctcataggccagcagaacagaggagactgctgatgtatgagccgaacctggcggcagcgcaaaagatg

SEQ ID NO: 237383 - DNA, 103 bp, Artificial Sequence
  Synthetic Polynucleotide
taatacgactcactatagggccaagaggagcgctgggcccaacggctcataacagaggagaatgagcatgtgggcccagaacctggcggcagcgcaaaagatg

SEQ ID NO: 237384 - DNA, 103 bp, Artificial Sequence
  Synthetic Polynucleotide
taatacgactcactatagggggagccggggccaagaggagcgctgggcccaacagaggagagggcccatggctcctcttaacctggcggcagcgcaaaagatg

SEQ ID NO: 237385 - DNA, 103 bp, Artificial Sequence
  Synthetic Polynucleotide
taatacgactcactatagggggccggggtgggagccggggccaagaggagaacagaggagactcctcatggccccggctaacctggcggcagcgcaaaagatg

SEQ ID NO: 237386 - DNA, 103 bp, Artificial Sequence
  Synthetic Polynucleotide
taatacgactcactatagggctcccatcccgagcgaccctgcgctcacggaacagaggagaccgtgaatgcagggtcgcaacctggcggcagcgcaaaagatg

SEQ ID NO: 237387 - DNA, 103 bp, Artificial Sequence
  Synthetic Polynucleotide
taatacgactcactatagggcacggcgctcggccggggtgggagccggggaacagaggagaccccggatgccaccccggaacctggcggcagcgcaaaagatg

SEQ ID NO: 237388 - DNA, 103 bp, Artificial Sequence
  Synthetic Polynucleotide
taatacgactcactatagggctcgggggctcacggcgctcggccggggtgaacagaggagacaccccatgcgagcgccgaacctggcggcagcgcaaaagatg

SEQ ID NO: 237389 - DNA, 103 bp, Artificial Sequence
  Synthetic Polynucleotide
taatacgactcactataggggcccaagaggctcgggggctcacggcgctcaacagaggagagagcgcatggagcccccgaacctggcggcagcgcaaaagatg

SEQ ID NO: 237390 - DNA, 103 bp, Artificial Sequence
  Synthetic Polynucleotide
taatacgactcactatagggggctcaggtagcccaagaggctcgggggctaacagaggagaagccccatggcctcttggaacctggcggcagcgcaaaagatg

SEQ ID NO: 237391 - DNA, 103 bp, Artificial Sequence
  Synthetic Polynucleotide
taatacgactcactatagggccagctcgcaggctcaggtagcccaagaggaacagaggagacctcttatgctacctgagaacctggcggcagcgcaaaagatg

SEQ ID NO: 237392 - DNA, 103 bp, Artificial Sequence
  Synthetic Polynucleotide
taatacgactcactatagggccggccctcgccagctcgcaggctcaggtaaacagaggagatacctgatgctgcgagctaacctggcggcagcgcaaaagatg

SEQ ID NO: 237393 - DNA, 103 bp, Artificial Sequence
  Synthetic Polynucleotide
taatacgactcactatagggcgccgttgggccggccctcgccagctcgcaaacagaggagatgcgagatggcgagggccaacctggcggcagcgcaaaagatg

SEQ ID NO: 237394 - DNA, 103 bp, Artificial Sequence
  Synthetic Polynucleotide
taatacgactcactatagggtcagcaccctcgccgttgggccggccctcgaacagaggagacgagggatggcccaacggaacctggcggcagcgcaaaagatg

SEQ ID NO: 237395 - DNA, 103 bp, Artificial Sequence
  Synthetic Polynucleotide
taatacgactcactataggggggaccgggctcagcaccctcgccgttgggaacagaggagacccaacatggagggtgctaacctggcggcagcgcaaaagatg

SEQ ID NO: 237396 - DNA, 103 bp, Artificial Sequence
  Synthetic Polynucleotide
taatacgactcactatagggagctgcggccgggaccgggctcagcaccctaacagaggagaagggtgatgagcccggtcaacctggcggcagcgcaaaagatg

SEQ ID NO: 237397 - DNA, 103 bp, Artificial Sequence
  Synthetic Polynucleotide
taatacgactcactatagggcagctcaccgctcccatcccgagcgaccctaacagaggagaagggtcatgcgggatgggaacctggcggcagcgcaaaagatg

SEQ ID NO: 237398 - DNA, 103 bp, Artificial Sequence
  Synthetic Polynucleotide
taatacgactcactatagggaagcctccgaagctgcggccgggaccgggcaacagaggagagcccggatgcggccgcagaacctggcggcagcgcaaaagatg

SEQ ID NO: 237399 - DNA, 103 bp, Artificial Sequence
  Synthetic Polynucleotide
taatacgactcactatagggcagcgggcggaagcctccgaagctgcggccaacagaggagaggccgcatgttcggaggcaacctggcggcagcgcaaaagatg

SEQ ID NO: 237400 - DNA, 103 bp, Artificial Sequence
  Synthetic Polynucleotide
taatacgactcactataggggagcagaggacagcgggcggaagcctccgaaacagaggagatcggagatgtccgcccgcaacctggcggcagcgcaaaagatg

SEQ ID NO: 237401 - DNA, 103 bp, Artificial Sequence
  Synthetic Polynucleotide
taatacgactcactatagggcgggccgggagagcagaggacagcgggcggaacagaggagaccgcccatggtcctctgcaacctggcggcagcgcaaaagatg

SEQ ID NO: 237402 - DNA, 103 bp, Artificial Sequence
  Synthetic Polynucleotide
taatacgactcactatagggccggcgagcccgggccgggagagcagaggaaacagaggagatcctctatgctcccggccaacctggcggcagcgcaaaagatg

SEQ ID NO: 237403 - DNA, 103 bp, Artificial Sequence
  Synthetic Polynucleotide
taatacgactcactatagggccgcacggtgccggcgagcccgggccgggaaacagaggagatcccggatggggctcgccaacctggcggcagcgcaaaagatg

SEQ ID NO: 237404 - DNA, 103 bp, Artificial Sequence
  Synthetic Polynucleotide
taatacgactcactatagggtcaggctcctccgcacggtgccggcgagccaacagaggagaggctcgatggcaccgtgcaacctggcggcagcgcaaaagatg

SEQ ID NO: 237405 - DNA, 103 bp, Artificial Sequence
  Synthetic Polynucleotide
taatacgactcactatagggctcttcttcctcaggctcctccgcacggtgaacagaggagacaccgtatggaggagcctaacctggcggcagcgcaaaagatg

SEQ ID NO: 237406 - DNA, 103 bp, Artificial Sequence
  Synthetic Polynucleotide
taatacgactcactatagggccaccacctcctcttcttcctcaggctcctaacagaggagaaggagcatgaggaagaagaacctggcggcagcgcaaaagatg

SEQ ID NO: 237407 - DNA, 103 bp, Artificial Sequence
  Synthetic Polynucleotide
taatacgactcactatagggtcctcggcctccaccacctcctcttcttccaacagaggagaggaagaatgggaggtggtaacctggcggcagcgcaaaagatg

SEQ ID NO: 237408 - DNA, 103 bp, Artificial Sequence
  Synthetic Polynucleotide
taatacgactcactatagggactctcagaccagctcaccgctcccatcccaacagaggagagggatgatggcggtgagcaacctggcggcagcgcaaaagatg

SEQ ID NO: 237409 - DNA, 103 bp, Artificial Sequence
  Synthetic Polynucleotide
taatacgactcactatagggccaggtttcctcctcggcctccaccacctcaacagaggagagaggtgatggaggccgagaacctggcggcagcgcaaaagatg

SEQ ID NO: 237410 - DNA, 103 bp, Artificial Sequence
  Synthetic Polynucleotide
taatacgactcactatagggtgccccgggcccaggtttcctcctcggcctaacagaggagaaggccgatgaggaaacctaacctggcggcagcgcaaaagatg

SEQ ID NO: 237411 - DNA, 103 bp, Artificial Sequence
  Synthetic Polynucleotide
taatacgactcactatagggcccagcgacctgccccgggcccaggtttccaacagaggagaggaaacatgggcccggggaacctggcggcagcgcaaaagatg

SEQ ID NO: 237412 - DNA, 103 bp, Artificial Sequence
  Synthetic Polynucleotide
taatacgactcactatagggagccagagagcccagcgacctgccccgggcaacagaggagagcccggatgaggtcgctgaacctggcggcagcgcaaaagatg

SEQ ID NO: 237413 - DNA, 103 bp, Artificial Sequence
  Synthetic Polynucleotide
taatacgactcactatagggggtgcagggaagccagagagcccagcgaccaacagaggagaggtcgcatggctctctggaacctggcggcagcgcaaaagatg

SEQ ID NO: 237414 - DNA, 103 bp, Artificial Sequence
  Synthetic Polynucleotide
taatacgactcactatagggcccgggcgcgggtgcagggaagccagagagaacagaggagactctctatgttccctgcaaacctggcggcagcgcaaaagatg

SEQ ID NO: 237415 - DNA, 103 bp, Artificial Sequence
  Synthetic Polynucleotide
taatacgactcactatagggcggtccctcacccgggcgcgggtgcagggaaacagaggagatccctgatgccgcgcccgaacctggcggcagcgcaaaagatg

SEQ ID NO: 237416 - DNA, 103 bp, Artificial Sequence
  Synthetic Polynucleotide
taatacgactcactatagggcagagtgccccggtccctcacccgggcgcgaacagaggagacgcgccatggtgagggacaacctggcggcagcgcaaaagatg

SEQ ID NO: 237417 - DNA, 103 bp, Artificial Sequence
  Synthetic Polynucleotide
taatacgactcactataggggcagcagaggcagagtgccccggtccctcaaacagaggagatgagggatgggggcactcaacctggcggcagcgcaaaagatg

SEQ ID NO: 237418 - DNA, 103 bp, Artificial Sequence
  Synthetic Polynucleotide
taatacgactcactatagggctgggccccagcagcagaggcagagtgcccaacagaggagagggcacatggcctctgctaacctggcggcagcgcaaaagatg

SEQ ID NO: 237419 - DNA, 103 bp, Artificial Sequence
  Synthetic Polynucleotide
taatacgactcactatagggcgcctgcacgactctcagaccagctcaccgaacagaggagacggtgaatgggtctgagaaacctggcggcagcgcaaaagatg

SEQ ID NO: 237420 - DNA, 103 bp, Artificial Sequence
  Synthetic Polynucleotide
taatacgactcactatagggtcgatcttgcctgggccccagcagcagaggaacagaggagacctctgatgctggggcccaacctggcggcagcgcaaaagatg

SEQ ID NO: 237421 - DNA, 103 bp, Artificial Sequence
  Synthetic Polynucleotide
taatacgactcactatagggtgcgtggcggtcgatcttgcctgggccccaaacagaggagatggggcatgggcaagatcaacctggcggcagcgcaaaagatg

SEQ ID NO: 237422 - DNA, 103 bp, Artificial Sequence
  Synthetic Polynucleotide
taatacgactcactatagggattctcttcctgcgtggcggtcgatcttgcaacagaggagagcaagaatgaccgccacgaacctggcggcagcgcaaaagatg

SEQ ID NO: 237423 - DNA, 103 bp, Artificial Sequence
  Synthetic Polynucleotide
taatacgactcactatagggccaacagcccattctcttcctgcgtggcggaacagaggagaccgccaatgaggaagagaaacctggcggcagcgcaaaagatg

SEQ ID NO: 237424 - DNA, 103 bp, Artificial Sequence
  Synthetic Polynucleotide
taatacgactcactataggggtccctccaaccaacagcccattctcttccaacagaggagaggaagaatgtgggctgttaacctggcggcagcgcaaaagatg

SEQ ID NO: 237425 - DNA, 103 bp, Artificial Sequence
  Synthetic Polynucleotide
taatacgactcactatagggttcaggccgggtccctccaaccaacagcccaacagaggagagggctgatggttggagggaacctggcggcagcgcaaaagatg

SEQ ID NO: 237426 - DNA, 103 bp, Artificial Sequence
  Synthetic Polynucleotide
taatacgactcactatagggcccggcccccttcaggccgggtccctccaaaacagaggagattggagatgcccggcctgaacctggcggcagcgcaaaagatg

SEQ ID NO: 237427 - DNA, 103 bp, Artificial Sequence
  Synthetic Polynucleotide
taatacgactcactatagggccggtggcgccccggcccccttcaggccggaacagaggagaccggccatgagggggccgaacctggcggcagcgcaaaagatg

SEQ ID NO: 237428 - DNA, 103 bp, Artificial Sequence
  Synthetic Polynucleotide
taatacgactcactatagggacaatccttgccggtggcgccccggcccccaacagaggagagggggcatgggcgccaccaacctggcggcagcgcaaaagatg

SEQ ID NO: 237429 - DNA, 103 bp, Artificial Sequence
  Synthetic Polynucleotide
taatacgactcactatagggcgcagaaaggacaatccttgccggtggcgcaacagaggagagcgccaatggcaaggattaacctggcggcagcgcaaaagatg

SEQ ID NO: 237430 - DNA, 103 bp, Artificial Sequence
  Synthetic Polynucleotide
taatacgactcactatagggaagcgccgttcgcctgcacgactctcagacaacagaggagagtctgaatgtcgtgcaggaacctggcggcagcgcaaaagatg

SEQ ID NO: 237431 - DNA, 103 bp, Artificial Sequence
  Synthetic Polynucleotide
taatacgactcactatagggaaagattttccgcagaaaggacaatccttgaacagaggagacaaggaatgtcctttctgaacctggcggcagcgcaaaagatg

SEQ ID NO: 237432 - DNA, 103 bp, Artificial Sequence
  Synthetic Polynucleotide
taatacgactcactatagggtgctgagcggaaagattttccgcagaaaggaacagaggagacctttcatgggaaaatctaacctggcggcagcgcaaaagatg

SEQ ID NO: 237433 - DNA, 103 bp, Artificial Sequence
  Synthetic Polynucleotide
taatacgactcactatagggtgaggtgatgtgctgagcggaaagattttcaacagaggagagaaaatatgtccgctcagaacctggcggcagcgcaaaagatg

SEQ ID NO: 237434 - DNA, 103 bp, Artificial Sequence
  Synthetic Polynucleotide
taatacgactcactatagggagatgcactttgaggtgatgtgctgagcggaacagaggagaccgctcatgacatcacctaacctggcggcagcgcaaaagatg

SEQ ID NO: 237435 - DNA, 103 bp, Artificial Sequence
  Synthetic Polynucleotide
taatacgactcactataggggtgcactcgcagatgcactttgaggtgatgaacagaggagacatcacatgaaagtgcataacctggcggcagcgcaaaagatg

SEQ ID NO: 237436 - DNA, 103 bp, Artificial Sequence
  Synthetic Polynucleotide
taatacgactcactataggggctcgcctgtgtgcactcgcagatgcacttaacagaggagaaagtgcatgtgcgagtgcaacctggcggcagcgcaaaagatg

SEQ ID NO: 237437 - DNA, 103 bp, Artificial Sequence
  Synthetic Polynucleotide
taatacgactcactatagggttgtagggccgctcgcctgtgtgcactcgcaacagaggagagcgagtatgcacaggcgaaacctggcggcagcgcaaaagatg

SEQ ID NO: 237438 - DNA, 103 bp, Artificial Sequence
  Synthetic Polynucleotide
taatacgactcactataggggtgcggacacttgtagggccgctcgcctgtaacagaggagaacaggcatgcggccctacaacctggcggcagcgcaaaagatg

SEQ ID NO: 237439 - DNA, 103 bp, Artificial Sequence
  Synthetic Polynucleotide
taatacgactcactatagggcgtagtcgcagtgcggacacttgtagggccaacagaggagaggccctatgagtgtccgcaacctggcggcagcgcaaaagatg

SEQ ID NO: 237440 - DNA, 103 bp, Artificial Sequence
  Synthetic Polynucleotide
taatacgactcactatagggtgggtgcccgcgtagtcgcagtgcggacacaacagaggagagtgtccatgctgcgactaaacctggcggcagcgcaaaagatg

SEQ ID NO: 237441 - DNA, 103 bp, Artificial Sequence
  Synthetic Polynucleotide
taatacgactcactatagggagggcaggggaagcgccgttcgcctgcacgaacagaggagacgtgcaatggaacggcgcaacctggcggcagcgcaaaagatg

SEQ ID NO: 237442 - DNA, 103 bp, Artificial Sequence
  Synthetic Polynucleotide
taatacgactcactatagggcgagccggactgggtgcccgcgtagtcgcaaacagaggagatgcgacatggcgggcaccaacctggcggcagcgcaaaagatg

SEQ ID NO: 237443 - DNA, 103 bp, Artificial Sequence
  Synthetic Polynucleotide
taatacgactcactataggggatacttgagcgagccggactgggtgcccgaacagaggagacgggcaatgagtccggctaacctggcggcagcgcaaaagatg

SEQ ID NO: 237444 - DNA, 103 bp, Artificial Sequence
  Synthetic Polynucleotide
taatacgactcactatagggcgctgtaggtgatacttgagcgagccggacaacagaggagagtccggatggctcaagtaaacctggcggcagcgcaaaagatg

SEQ ID NO: 237445 - DNA, 103 bp, Artificial Sequence
  Synthetic Polynucleotide
taatacgactcactatagggccggtggtggcgctgtaggtgatacttgagaacagaggagactcaagatgcacctacagaacctggcggcagcgcaaaagatg

SEQ ID NO: 237446 - DNA, 103 bp, Artificial Sequence
  Synthetic Polynucleotide
taatacgactcactatagggtcctctgctcccggtggtggcgctgtaggtaacagaggagaacctacatggccaccaccaacctggcggcagcgcaaaagatg

SEQ ID NO: 237447 - DNA, 103 bp, Artificial Sequence
  Synthetic Polynucleotide
taatacgactcactatagggccggccccgctcctctgctcccggtggtggaacagaggagaccaccaatgggagcagagaacctggcggcagcgcaaaagatg

SEQ ID NO: 237448 - DNA, 103 bp, Artificial Sequence
  Synthetic Polynucleotide
taatacgactcactatagggtggcccggggccggccccgctcctctgctcaacagaggagagagcagatgagcggggccaacctggcggcagcgcaaaagatg

SEQ ID NO: 237449 - DNA, 103 bp, Artificial Sequence
  Synthetic Polynucleotide
taatacgactcactataggggctccgggggtggcccggggccggccccgcaacagaggagagcggggatggccccgggcaacctggcggcagcgcaaaagatg

SEQ ID NO: 237450 - DNA, 103 bp, Artificial Sequence
  Synthetic Polynucleotide
taatacgactcactatagggggaggcggtggctccgggggtggcccggggaacagaggagaccccggatgacccccggaaacctggcggcagcgcaaaagatg

SEQ ID NO: 237451 - DNA, 103 bp, Artificial Sequence
  Synthetic Polynucleotide
taatacgactcactatagggccgctgggaaggaggcggtggctccgggggaacagaggagacccccgatgccaccgcctaacctggcggcagcgcaaaagatg

SEQ ID NO: 237452 - DNA, 103 bp, Artificial Sequence
  Synthetic Polynucleotide
taatacgactcactatagggtcccgcatacagggcaggggaagcgccgttaacagaggagaaacggcatgtcccctgccaacctggcggcagcgcaaaagatg

SEQ ID NO: 237453 - DNA, 103 bp, Artificial Sequence
  Synthetic Polynucleotide
taatacgactcactataggggggccgaaccccgctgggaaggaggcggtgaacagaggagacaccgcatgcttcccagcaacctggcggcagcgcaaaagatg

SEQ ID NO: 237454 - DNA, 103 bp, Artificial Sequence
  Synthetic Polynucleotide
taatacgactcactatagggccagattgcggggccgaaccccgctgggaaaacagaggagattcccaatggggttcggcaacctggcggcagcgcaaaagatg

SEQ ID NO: 237455 - DNA, 103 bp, Artificial Sequence
  Synthetic Polynucleotide
taatacgactcactatagggcggcttggctccagattgcggggccgaaccaacagaggagaggttcgatgccgcaatctaacctggcggcagcgcaaaagatg

SEQ ID NO: 237456 - DNA, 103 bp, Artificial Sequence
  Synthetic Polynucleotide
taatacgactcactataggggctgcggagacggcttggctccagattgcgaacagaggagacgcaatatggagccaagcaacctggcggcagcgcaaaagatg

SEQ ID NO: 237457 - DNA, 103 bp, Artificial Sequence
  Synthetic Polynucleotide
taatacgactcactatagggcaggtcgcaggctgcggagacggcttggctaacagaggagaagccaaatggtctccgcaaacctggcggcagcgcaaaagatg

SEQ ID NO: 237458 - DNA, 103 bp, Artificial Sequence
  Synthetic Polynucleotide
taatacgactcactataggggccctccacccaggtcgcaggctgcggagaaacagaggagatctccgatgcctgcgaccaacctggcggcagcgcaaaagatg

SEQ ID NO: 237459 - DNA, 103 bp, Artificial Sequence
  Synthetic Polynucleotide
taatacgactcactataggggacttgaggcgccctccacccaggtcgcagaacagaggagactgcgaatggggtggaggaacctggcggcagcgcaaaagatg

SEQ ID NO: 237460 - DNA, 103 bp, Artificial Sequence
  Synthetic Polynucleotide
taatacgactcactatagggggaggccggggacttgaggcgccctccaccaacagaggagaggtggaatgcgcctcaagaacctggcggcagcgcaaaagatg

SEQ ID NO: 237461 - DNA, 103 bp, Artificial Sequence
  Synthetic Polynucleotide
taatacgactcactatagggaccgctagaaggaggccggggacttgaggcaacagaggagagcctcaatgccccggcctaacctggcggcagcgcaaaagatg

SEQ ID NO: 237462 - DNA, 103 bp, Artificial Sequence
  Synthetic Polynucleotide
taatacgactcactatagggccggcccagcaccgctagaaggaggccgggaacagaggagacccggcatgcttctagcgaacctggcggcagcgcaaaagatg

SEQ ID NO: 237463 - DNA, 103 bp, Artificial Sequence
  Synthetic Polynucleotide
taatacgactcactatagggcggaagcgcttcccgcatacagggcaggggaacagaggagacccctgatgtgtatgcggaacctggcggcagcgcaaaagatg

SEQ ID NO: 237464 - DNA, 103 bp, Artificial Sequence
  Synthetic Polynucleotide
taatacgactcactatagggcgacgggaccccggcccagcaccgctagaaaacagaggagattctagatgtgctgggccaacctggcggcagcgcaaaagatg

SEQ ID NO: 237465 - DNA, 103 bp, Artificial Sequence
  Synthetic Polynucleotide
taatacgactcactatagggggcgggcttccgacgggaccccggcccagcaacagaggagagctgggatggggtcccgtaacctggcggcagcgcaaaagatg

SEQ ID NO: 237466 - DNA, 103 bp, Artificial Sequence
  Synthetic Polynucleotide
taatacgactcactatagggtcccagggctggcgggcttccgacgggaccaacagaggagaggtcccatgggaagcccgaacctggcggcagcgcaaaagatg

SEQ ID NO: 237467 - DNA, 103 bp, Artificial Sequence
  Synthetic Polynucleotide
taatacgactcactatagggcgcagggtcctcccagggctggcgggcttcaacagaggagagaagccatgcagccctggaacctggcggcagcgcaaaagatg

SEQ ID NO: 237468 - DNA, 103 bp, Artificial Sequence
  Synthetic Polynucleotide
taatacgactcactatagggtcgcccgttgcgcagggtcctcccagggctaacagaggagaagccctatgaggaccctgaacctggcggcagcgcaaaagatg

SEQ ID NO: 237469 - DNA, 103 bp, Artificial Sequence
  Synthetic Polynucleotide
taatacgactcactatagggcctcaccgcctcgcccgttgcgcagggtccaacagaggagaggacccatggcaacgggcaacctggcggcagcgcaaaagatg

SEQ ID NO: 237470 - DNA, 103 bp, Artificial Sequence
  Synthetic Polynucleotide
taatacgactcactatagggaggggttcggcctcaccgcctcgcccgttgaacagaggagacaacggatgaggcggtgaaacctggcggcagcgcaaaagatg

SEQ ID NO: 237471 - DNA, 103 bp, Artificial Sequence
  Synthetic Polynucleotide
taatacgactcactatagggggacaggtccaggggttcggcctcaccgccaacagaggagaggcggtatggccgaacccaacctggcggcagcgcaaaagatg

SEQ ID NO: 237472 - DNA, 103 bp, Artificial Sequence
  Synthetic Polynucleotide
taatacgactcactatagggctgcccgcaaggacaggtccaggggttcggaacagaggagaccgaacatgtggacctgtaacctggcggcagcgcaaaagatg

SEQ ID NO: 237473 - DNA, 103 bp, Artificial Sequence
  Synthetic Polynucleotide
taatacgactcactatagggcctcccggccctgcccgcaaggacaggtccaacagaggagaggacctatgcttgcgggcaacctggcggcagcgcaaaagatg

SEQ ID NO: 237474 - DNA, 103 bp, Artificial Sequence
  Synthetic Polynucleotide
taatacgactcactatagggagagttgaagcggaagcgcttcccgcatacaacagaggagagtatgcatgaagcgcttcaacctggcggcagcgcaaaagatg

SEQ ID NO: 237475 - DNA, 103 bp, Artificial Sequence
  Synthetic Polynucleotide
taatacgactcactatagggcccggcctcgcctcccggccctgcccgcaaaacagaggagattgcggatggggccgggaaacctggcggcagcgcaaaagatg

SEQ ID NO: 237476 - DNA, 103 bp, Artificial Sequence
  Synthetic Polynucleotide
taatacgactcactatagggcacccccaggcccggcctcgcctcccggccaacagaggagaggccggatggcgaggccgaacctggcggcagcgcaaaagatg

SEQ ID NO: 237477 - DNA, 103 bp, Artificial Sequence
  Synthetic Polynucleotide
taatacgactcactatagggcggtggagggcacccccaggcccggcctcgaacagaggagacgaggcatggcctgggggaacctggcggcagcgcaaaagatg

SEQ ID NO: 237478 - DNA, 103 bp, Artificial Sequence
  Synthetic Polynucleotide
taatacgactcactataggggaagaggcagcggtggagggcacccccaggaacagaggagacctgggatggccctccacaacctggcggcagcgcaaaagatg

SEQ ID NO: 237479 - DNA, 103 bp, Artificial Sequence
  Synthetic Polynucleotide
taatacgactcactatagggcgaacgggcagaagaggcagcggtggagggaacagaggagaccctccatggctgcctctaacctggcggcagcgcaaaagatg

SEQ ID NO: 237480 - DNA, 103 bp, Artificial Sequence
  Synthetic Polynucleotide
taatacgactcactataggggctccagtggcgaacgggcagaagaggcagaacagaggagactgcctatgctgcccgttaacctggcggcagcgcaaaagatg

SEQ ID NO: 237481 - DNA, 103 bp, Artificial Sequence
  Synthetic Polynucleotide
taatacgactcactataggggagctctggggctccagtggcgaacgggcaaacagaggagatgcccgatggccactggaaacctggcggcagcgcaaaagatg

SEQ ID NO: 237482 - DNA, 103 bp, Artificial Sequence
  Synthetic Polynucleotide
taatacgactcactataggggcaaggccatgagctctggggctccagtggaacagaggagaccactgatgccccagagcaacctggcggcagcgcaaaagatg

SEQ ID NO: 237483 - DNA, 103 bp, Artificial Sequence
  Synthetic Polynucleotide
taatacgactcactatagggacttgaaggtgcaaggccatgagctctgggaacagaggagacccagaatgcatggccttaacctggcggcagcgcaaaagatg

SEQ ID NO: 237484 - DNA, 103 bp, Artificial Sequence
  Synthetic Polynucleotide
taatacgactcactataggggctgtggtgcacttgaaggtgcaaggccataacagaggagaatggccatgcaccttcaaaacctggcggcagcgcaaaagatg

SEQ ID NO: 237485 - DNA, 103 bp, Artificial Sequence
  Synthetic Polynucleotide
taatacgactcactatagggctaagtggccgctcggggcgcggggacgtgaacagaggagacacgtcatggcgccccgaaacctggcggcagcgcaaaagatg

SEQ ID NO: 237486 - DNA, 103 bp, Artificial Sequence
  Synthetic Polynucleotide
taatacgactcactatagggaagcaaggatagagttgaagcggaagcgctaacagaggagaagcgctatggcttcaactaacctggcggcagcgcaaaagatg

SEQ ID NO: 237487 - DNA, 103 bp, Artificial Sequence
  Synthetic Polynucleotide
taatacgactcactatagggtagcccggcggctgtggtgcacttgaaggtaacagaggagaaccttcatgtgcaccacaaacctggcggcagcgcaaaagatg

SEQ ID NO: 237488 - DNA, 103 bp, Artificial Sequence
  Synthetic Polynucleotide
taatacgactcactatagggcggcggcccctagcccggcggctgtggtgcaacagaggagagcaccaatgccgccgggcaacctggcggcagcgcaaaagatg

SEQ ID NO: 237489 - DNA, 103 bp, Artificial Sequence
  Synthetic Polynucleotide
taatacgactcactatagggctggggtggccggcggcccctagcccggcgaacagaggagacgccggatgaggggccgcaacctggcggcagcgcaaaagatg

SEQ ID NO: 237490 - DNA, 103 bp, Artificial Sequence
  Synthetic Polynucleotide
taatacgactcactatagggacgcgtcagcctggggtggccggcggccccaacagaggagaggggccatgggccaccccaacctggcggcagcgcaaaagatg

SEQ ID NO: 237491 - DNA, 103 bp, Artificial Sequence
  Synthetic Polynucleotide
taatacgactcactatagggtagggcggggacgcgtcagcctggggtggcaacagaggagagccaccatgggctgacgcaacctggcggcagcgcaaaagatg

SEQ ID NO: 237492 - DNA, 103 bp, Artificial Sequence
  Synthetic Polynucleotide
taatacgactcactatagggtactcgggcatagggcggggacgcgtcagcaacagaggagagctgacatgtccccgcccaacctggcggcagcgcaaaagatg

SEQ ID NO: 237493 - DNA, 103 bp, Artificial Sequence
  Synthetic Polynucleotide
taatacgactcactatagggctcctgatggtactcgggcatagggcggggaacagaggagaccccgcatgatgcccgagaacctggcggcagcgcaaaagatg

SEQ ID NO: 237494 - DNA, 103 bp, Artificial Sequence
  Synthetic Polynucleotide
taatacgactcactatagggggaggggtctctcctgatggtactcgggcaaacagaggagatgcccgatgaccatcaggaacctggcggcagcgcaaaagatg

SEQ ID NO: 237495 - DNA, 103 bp, Artificial Sequence
  Synthetic Polynucleotide
taatacgactcactatagggcgaaggactgggaggggtctctcctgatggaacagaggagaccatcaatggagacccctaacctggcggcagcgcaaaagatg

SEQ ID NO: 237496 - DNA, 103 bp, Artificial Sequence
  Synthetic Polynucleotide
taatacgactcactatagggccccttcctgcgaaggactgggaggggtctaacagaggagaagacccatgccagtccttaacctggcggcagcgcaaaagatg

SEQ ID NO: 237497 - DNA, 103 bp, Artificial Sequence
  Synthetic Polynucleotide
taatacgactcactatagggcgcaggtgcaaagcaaggatagagttgaagaacagaggagacttcaaatgtatccttgcaacctggcggcagcgcaaaagatg

SEQ ID NO: 237498 - DNA, 103 bp, Artificial Sequence
  Synthetic Polynucleotide
taatacgactcactataggggagccctcctccccttcctgcgaaggactgaacagaggagacagtccatggcaggaaggaacctggcggcagcgcaaaagatg

SEQ ID NO: 237499 - DNA, 103 bp, Artificial Sequence
  Synthetic Polynucleotide
taatacgactcactatagggggacagcccggagccctcctccccttcctgaacagaggagacaggaaatggaggagggcaacctggcggcagcgcaaaagatg

SEQ ID NO: 237500 - DNA, 103 bp, Artificial Sequence
  Synthetic Polynucleotide
taatacgactcactatagggctccgggtctggacagcccggagccctcctaacagaggagaaggaggatgccgggctgtaacctggcggcagcgcaaaagatg

SEQ ID NO: 237501 - DNA, 103 bp, Artificial Sequence
  Synthetic Polynucleotide
taatacgactcactatagggagccctgcctctccgggtctggacagcccgaacagaggagacgggctatgcagacccggaacctggcggcagcgcaaaagatg

SEQ ID NO: 237502 - DNA, 103 bp, Artificial Sequence
  Synthetic Polynucleotide
taatacgactcactatagggttgcccccccagccctgcctctccgggtctaacagaggagaagacccatggaggcagggaacctggcggcagcgcaaaagatg

SEQ ID NO: 237503 - DNA, 103 bp, Artificial Sequence
  Synthetic Polynucleotide
taatacgactcactatagggtgggtgcgcccgcaggtgcaaagcaaggataacagaggagaatccttatgttgcacctgaacctggcggcagcgcaaaagatg

SEQ ID NO: 237504 - DNA, 103 bp, Artificial Sequence
  Synthetic Polynucleotide
taatacgactcactatagggcctgggctcctgggtgcgcccgcaggtgcaaacagaggagatgcaccatggggcgcaccaacctggcggcagcgcaaaagatg

SEQ ID NO: 237505 - DNA, 103 bp, Artificial Sequence
  Synthetic Polynucleotide
taatacgactcactatagggcactggaaggcctgggctcctgggtgcgccaacagaggagaggcgcaatgaggagcccaaacctggcggcagcgcaaaagatg

SEQ ID NO: 237506 - DNA, 103 bp, Artificial Sequence
  Synthetic Polynucleotide
taatacgactcactataggggcagtgagggcactggaaggcctgggctccaacagaggagaggagccatggccttccagaacctggcggcagcgcaaaagatg

SEQ ID NO: 237507 - DNA, 103 bp, Artificial Sequence
  Synthetic Polynucleotide
taatacgactcactatagggcgcggtggccgcagtgagggcactggaaggaacagaggagaccttccatggccctcactaacctggcggcagcgcaaaagatg

SEQ ID NO: 237508 - DNA, 103 bp, Artificial Sequence
  Synthetic Polynucleotide
taatacgactcactatagggcgctgcgccgcgcggtggccgcagtgagggaacagaggagaccctcaatgcggccaccgaacctggcggcagcgcaaaagatg

SEQ ID NO: 237509 - DNA, 103 bp, Artificial Sequence
  Synthetic Polynucleotide
taatacgactcactatagggcagcagagcccgctgcgccgcgcggtggccaacagaggagaggccacatggcggcgcagaacctggcggcagcgcaaaagatg

SEQ ID NO: 237510 - DNA, 103 bp, Artificial Sequence
  Synthetic Polynucleotide
taatacgactcactatagggggtgcgagcgcagcagagcccgctgcgccgaacagaggagacggcgcatggggctctgcaacctggcggcagcgcaaaagatg

SEQ ID NO: 237511 - DNA, 103 bp, Artificial Sequence
  Synthetic Polynucleotide
taatacgactcactatagggggcgacggcgctaagtggccgctcggggcgaacagaggagacgccccatgcggccacttaacctggcggcagcgcaaaagatg

SEQ ID NO: 237512 - DNA, 103 bp, Artificial Sequence
  Synthetic Polynucleotide
taatacgactcactatagggtgtgtgcgcaggtgcgagcgcagcagagccaacagaggagaggctctatggcgctcgcaaacctggcggcagcgcaaaagatg

SEQ ID NO: 237513 - DNA, 103 bp, Artificial Sequence
  Synthetic Polynucleotide
taatacgactcactatagggctcgggctggtgtgtgcgcaggtgcgagcgaacagaggagacgctcgatgctgcgcacaaacctggcggcagcgcaaaagatg

SEQ ID NO: 237514 - DNA, 103 bp, Artificial Sequence
  Synthetic Polynucleotide
taatacgactcactatagggtacgtgggcgctcgggctggtgtgtgcgcaaacagaggagatgcgcaatgaccagcccgaacctggcggcagcgcaaaagatg

SEQ ID NO: 237515 - DNA, 103 bp, Artificial Sequence
  Synthetic Polynucleotide
taatacgactcactataggggcagcaggactacgtgggcgctcgggctggaacagaggagaccagccatggcgcccacgaacctggcggcagcgcaaaagatg

SEQ ID NO: 237516 - DNA, 103 bp, Artificial Sequence
  Synthetic Polynucleotide
taatacgactcactatagggcaacaggcgtgcagcaggactacgtgggcgaacagaggagacgcccaatgagtcctgctaacctggcggcagcgcaaaagatg

SEQ ID NO: 237517 - DNA, 103 bp, Artificial Sequence
  Synthetic Polynucleotide
taatacgactcactatagggccaactccagcaacaggcgtgcagcaggacaacagaggagagtcctgatgcacgcctgtaacctggcggcagcgcaaaagatg

SEQ ID NO: 237518 - DNA, 103 bp, Artificial Sequence
  Synthetic Polynucleotide
taatacgactcactataggggcgcgctcttccaactccagcaacaggcgtaacagaggagaacgcctatggctggagttaacctggcggcagcgcaaaagatg

SEQ ID NO: 237519 - DNA, 103 bp, Artificial Sequence
  Synthetic Polynucleotide
taatacgactcactataggggcgtagtagcgcgcgctcttccaactccagaacagaggagactggagatggaagagcgcaacctggcggcagcgcaaaagatg

SEQ ID NO: 237520 - DNA, 103 bp, Artificial Sequence
  Synthetic Polynucleotide
taatacgactcactataggggtcgggcctcgcgtagtagcgcgcgctcttaacagaggagaaagagcatgcgctactacaacctggcggcagcgcaaaagatg

SEQ ID NO: 237521 - DNA, 103 bp, Artificial Sequence
  Synthetic Polynucleotide
taatacgactcactataggggctctccccagtcgggcctcgcgtagtagcaacagaggagagctactatgcgaggcccgaacctggcggcagcgcaaaagatg

SEQ ID NO: 237522 - DNA, 103 bp, Artificial Sequence
  Synthetic Polynucleotide
taatacgactcactataggggaaagccggcggcgacggcgctaagtggccaacagaggagaggccacatggcgccgtcgaacctggcggcagcgcaaaagatg

SEQ ID NO: 237523 - DNA, 103 bp, Artificial Sequence
  Synthetic Polynucleotide
taatacgactcactatagggtgagcttcgggctctccccagtcgggcctcaacagaggagagaggccatgctggggagaaacctggcggcagcgcaaaagatg

SEQ ID NO: 237524 - DNA, 103 bp, Artificial Sequence
  Synthetic Polynucleotide
taatacgactcactataggggcatgccccctgagcttcgggctctccccaaacagaggagatggggaatgcccgaagctaacctggcggcagcgcaaaagatg

SEQ ID NO: 237525 - DNA, 103 bp, Artificial Sequence
  Synthetic Polynucleotide
taatacgactcactatagggggggtggcctgcatgccccctgagcttcggaacagaggagaccgaagatgagggggcataacctggcggcagcgcaaaagatg

SEQ ID NO: 237526 - DNA, 103 bp, Artificial Sequence
  Synthetic Polynucleotide
taatacgactcactatagggctcagtggcaggggtggcctgcatgcccccaacagaggagagggggcatgcaggccaccaacctggcggcagcgcaaaagatg

SEQ ID NO: 237527 - DNA, 103 bp, Artificial Sequence
  Synthetic Polynucleotide
taatacgactcactataggggcgccagaccctcagtggcaggggtggcctaacagaggagaaggccaatgctgccactgaacctggcggcagcgcaaaagatg

SEQ ID NO: 237528 - DNA, 103 bp, Artificial Sequence
  Synthetic Polynucleotide
taatacgactcactataggggcctggggccgcgccagaccctcagtggcaaacagaggagatgccacatggggtctggcaacctggcggcagcgcaaaagatg

SEQ ID NO: 237529 - DNA, 103 bp, Artificial Sequence
  Synthetic Polynucleotide
taatacgactcactatagggcgatgaaggagcctggggccgcgccagaccaacagaggagaggtctgatgcggccccagaacctggcggcagcgcaaaagatg

SEQ ID NO: 237530 - DNA, 103 bp, Artificial Sequence
  Synthetic Polynucleotide
taatacgactcactatagggggaaggcggacgatgaaggagcctggggccaacagaggagaggccccatgctccttcataacctggcggcagcgcaaaagatg

SEQ ID NO: 237531 - DNA, 103 bp, Artificial Sequence
  Synthetic Polynucleotide
taatacgactcactatagggtaggggcaacggaaggcggacgatgaaggaaacagaggagatccttcatggtccgccttaacctggcggcagcgcaaaagatg

SEQ ID NO: 237532 - DNA, 103 bp, Artificial Sequence
  Synthetic Polynucleotide
taatacgactcactataggggcctttgcagtaggggcaacggaaggcggaaacagaggagatccgccatgcgttgccccaacctggcggcagcgcaaaagatg

SEQ ID NO: 237533 - DNA, 103 bp, Artificial Sequence
  Synthetic Polynucleotide
taatacgactcactataggggctcgccgtcgaaagccggcggcgacggcgaacagaggagacgccgtatgcgccggcttaacctggcggcagcgcaaaagatg

SEQ ID NO: 237534 - DNA, 103 bp, Artificial Sequence
  Synthetic Polynucleotide
taatacgactcactatagggtgcgaaacttgcctttgcagtaggggcaacaacagaggagagttgccatgactgcaaagaacctggcggcagcgcaaaagatg

SEQ ID NO: 237535 - DNA, 103 bp, Artificial Sequence
  Synthetic Polynucleotide
taatacgactcactatagggtccgccgaggtgcgaaacttgcctttgcagaacagaggagactgcaaatgcaagtttcgaacctggcggcagcgcaaaagatg

SEQ ID NO: 237536 - DNA, 103 bp, Artificial Sequence
  Synthetic Polynucleotide
taatacgactcactataggggcgttcgcgctccgccgaggtgcgaaacttaacagaggagaaagtttatgacctcggcgaacctggcggcagcgcaaaagatg

SEQ ID NO: 237537 - DNA, 103 bp, Artificial Sequence
  Synthetic Polynucleotide
taatacgactcactatagggtgtgcaggtggcgttcgcgctccgccgaggaacagaggagacctcggatgagcgcgaacaacctggcggcagcgcaaaagatg

SEQ ID NO: 237538 - DNA, 103 bp, Artificial Sequence
  Synthetic Polynucleotide
taatacgactcactatagggctatgcaggatgtgcaggtggcgttcgcgcaacagaggagagcgcgaatgccacctgcaaacctggcggcagcgcaaaagatg

SEQ ID NO: 237539 - DNA, 103 bp, Artificial Sequence
  Synthetic Polynucleotide
taatacgactcactatagggcttccagggcctatgcaggatgtgcaggtgaacagaggagacacctgatgatcctgcataacctggcggcagcgcaaaagatg

SEQ ID NO: 237540 - DNA, 103 bp, Artificial Sequence
  Synthetic Polynucleotide
taatacgactcactatagggacaggccgcacttccagggcctatgcaggaaacagaggagatcctgcatgggccctggaaacctggcggcagcgcaaaagatg

SEQ ID NO: 237541 - DNA, 103 bp, Artificial Sequence
  Synthetic Polynucleotide
taatacgactcactatagggccgaaactgcacaggccgcacttccagggcaacagaggagagccctgatggtgcggcctaacctggcggcagcgcaaaagatg

SEQ ID NO: 237542 - DNA, 103 bp, Artificial Sequence
  Synthetic Polynucleotide
taatacgactcactatagggctggctggagccgaaactgcacaggccgcaaacagaggagatgcggcatgtgcagtttcaacctggcggcagcgcaaaagatg

SEQ ID NO: 237543 - DNA, 103 bp, Artificial Sequence
  Synthetic Polynucleotide
taatacgactcactataggggctcctcctcctggctggagccgaaactgcaacagaggagagcagttatggctccagccaacctggcggcagcgcaaaagatg

SEQ ID NO: 237544 - DNA, 103 bp, Artificial Sequence
  Synthetic Polynucleotide
taatacgactcactatagggtgcagatccagctcgccgtcgaaagccggcaacagaggagagccggcatgcgacggcgaaacctggcggcagcgcaaaagatg

SEQ ID NO: 237545 - DNA, 103 bp, Artificial Sequence
  Synthetic Polynucleotide
taatacgactcactatagggtggtgcagcagctcctcctcctggctggagaacagaggagactccagatgggaggaggaaacctggcggcagcgcaaaagatg

SEQ ID NO: 237546 - DNA, 103 bp, Artificial Sequence
  Synthetic Polynucleotide
taatacgactcactatagggcgtcaggctgtggtgcagcagctcctcctcaacagaggagagaggagatgctgctgcacaacctggcggcagcgcaaaagatg

SEQ ID NO: 237547 - DNA, 103 bp, Artificial Sequence
  Synthetic Polynucleotide
taatacgactcactatagggccccgtgggccgtcaggctgtggtgcagcaaacagaggagatgctgcatgacagcctgaaacctggcggcagcgcaaaagatg

SEQ ID NO: 237548 - DNA, 103 bp, Artificial Sequence
  Synthetic Polynucleotide
taatacgactcactatagggcgctcgggagccccgtgggccgtcaggctgaacagaggagacagcctatgggcccacggaacctggcggcagcgcaaaagatg

SEQ ID NO: 237549 - DNA, 103 bp, Artificial Sequence
  Synthetic Polynucleotide
taatacgactcactatagggcgccaggggacgctcgggagccccgtgggcaacagaggagagcccacatggctcccgagaacctggcggcagcgcaaaagatg

SEQ ID NO: 237550 - DNA, 103 bp, Artificial Sequence
  Synthetic Polynucleotide
taatacgactcactatagggcggaggtggccgccaggggacgctcgggagaacagaggagactcccgatggtcccctggaacctggcggcagcgcaaaagatg

SEQ ID NO: 237551 - DNA, 103 bp, Artificial Sequence
  Synthetic Polynucleotide
taatacgactcactatagggggaggcgcagcggaggtggccgccaggggaaacagaggagatcccctatgggccacctcaacctggcggcagcgcaaaagatg

SEQ ID NO: 237552 - DNA, 103 bp, Artificial Sequence
  Synthetic Polynucleotide
taatacgactcactatagggaggctgaggcggaggcgcagcggaggtggcaacagaggagagccaccatggctgcgcctaacctggcggcagcgcaaaagatg

SEQ ID NO: 237553 - DNA, 103 bp, Artificial Sequence
  Synthetic Polynucleotide
taatacgactcactataggggctgaggctgaggctgaggcggaggcgcagaacagaggagactgcgcatgcgcctcagcaacctggcggcagcgcaaaagatg

SEQ ID NO: 237554 - DNA, 103 bp, Artificial Sequence
  Synthetic Polynucleotide
taatacgactcactatagggtggggtggaggctgaggctgaggctgaggcaacagaggagagcctcaatgtcagcctcaaacctggcggcagcgcaaaagatg

SEQ ID NO: 237555 - DNA, 103 bp, Artificial Sequence
  Synthetic Polynucleotide
taatacgactcactatagggggagtatcgctgcagatccagctcgccgtcaacagaggagagacggcatgctggatctgaacctggcggcagcgcaaaagatg

SEQ ID NO: 237556 - DNA, 103 bp, Artificial Sequence
  Synthetic Polynucleotide
taatacgactcactataggggggttcgggctggggtggaggctgaggctgaacagaggagacagcctatgcctccacccaacctggcggcagcgcaaaagatg

SEQ ID NO: 237557 - DNA, 103 bp, Artificial Sequence
  Synthetic Polynucleotide
taatacgactcactatagggggactgatctgggttcgggctggggtggagaacagaggagactccacatgagcccgaacaacctggcggcagcgcaaaagatg

SEQ ID NO: 237558 - DNA, 103 bp, Artificial Sequence
  Synthetic Polynucleotide
taatacgactcactatagggtccggctgggggactgatctgggttcgggcaacagaggagagcccgaatgcagatcagtaacctggcggcagcgcaaaagatg

SEQ ID NO: 237559 - DNA, 103 bp, Artificial Sequence
  Synthetic Polynucleotide
taatacgactcactatagggcggctccggctccggctgggggactgatctaacagaggagaagatcaatgccccagccgaacctggcggcagcgcaaaagatg

SEQ ID NO: 237560 - DNA, 103 bp, Artificial Sequence
  Synthetic Polynucleotide
taatacgactcactataggggttcgggctccggctccggctccggctgggaacagaggagacccagcatgagccggagcaacctggcggcagcgcaaaagatg

SEQ ID NO: 237561 - DNA, 103 bp, Artificial Sequence
  Synthetic Polynucleotide
taatacgactcactataggggttgcctcacgttcgggctccggctccggcaacagaggagagccggaatgggagcccgaaacctggcggcagcgcaaaagatg

SEQ ID NO: 237562 - DNA, 103 bp, Artificial Sequence
  Synthetic Polynucleotide
taatacgactcactatagggtggggtcggggttgcctcacgttcgggctcaacagaggagagagcccatgcgtgaggcaaacctggcggcagcgcaaaagatg

SEQ ID NO: 237563 - DNA, 103 bp, Artificial Sequence
  Synthetic Polynucleotide
taatacgactcactatagggcggcaggagctggggtcggggttgcctcacaacagaggagagtgaggatgccccgacccaacctggcggcagcgcaaaagatg

SEQ ID NO: 237564 - DNA, 103 bp, Artificial Sequence
  Synthetic Polynucleotide
taatacgactcactatagggtcctcgggagcggcaggagctggggtcgggaacagaggagacccgacatgagctcctgcaacctggcggcagcgcaaaagatg

SEQ ID NO: 237565 - DNA, 103 bp, Artificial Sequence
  Synthetic Polynucleotide
taatacgactcactatagggcgctgggggctcctcgggagcggcaggagcaacagaggagagctcctatggctcccgagaacctggcggcagcgcaaaagatg

SEQ ID NO: 237566 - DNA, 103 bp, Artificial Sequence
  Synthetic Polynucleotide
taatacgactcactatagggctggcccgttggagtatcgctgcagatccaaacagaggagatggatcatgagcgatactaacctggcggcagcgcaaaagatg

SEQ ID NO: 237567 - DNA, 103 bp, Artificial Sequence
  Synthetic Polynucleotide
taatacgactcactatagggactccggaggcgctgggggctcctcgggagaacagaggagactcccgatgagcccccagaacctggcggcagcgcaaaagatg

SEQ ID NO: 237568 - DNA, 103 bp, Artificial Sequence
  Synthetic Polynucleotide
taatacgactcactatagggtggcagcggaactccggaggcgctgggggcaacagaggagagcccccatggcctccggaaacctggcggcagcgcaaaagatg

SEQ ID NO: 237569 - DNA, 103 bp, Artificial Sequence
  Synthetic Polynucleotide
taatacgactcactataggggccgcacacttggcagcggaactccggaggaacagaggagacctccgatgttccgctgcaacctggcggcagcgcaaaagatg

SEQ ID NO: 237570 - DNA, 103 bp, Artificial Sequence
  Synthetic Polynucleotide
taatacgactcactatagggtaaagctctggccgcacacttggcagcggaaacagaggagatccgctatgaagtgtgcgaacctggcggcagcgcaaaagatg

SEQ ID NO: 237571 - DNA, 103 bp, Artificial Sequence
  Synthetic Polynucleotide
taatacgactcactatagggcaagactgtgtaaagctctggccgcacactaacagaggagaagtgtgatgccagagcttaacctggcggcagcgcaaaagatg

SEQ ID NO: 237572 - DNA, 103 bp, Artificial Sequence
  Synthetic Polynucleotide
taatacgactcactatagggcttgagaaaccaagactgtgtaaagctctgaacagaggagacagagcatgacacagtctaacctggcggcagcgcaaaagatg

SEQ ID NO: 237573 - DNA, 103 bp, Artificial Sequence
  Synthetic Polynucleotide
taatacgactcactataggggcatgtggcccttgagaaaccaagactgtgaacagaggagacacagtatgggtttctcaaacctggcggcagcgcaaaagatg

SEQ ID NO: 237574 - DNA, 103 bp, Artificial Sequence
  Synthetic Polynucleotide
taatacgactcactatagggttgtgcttacgcatgtggcccttgagaaacaacagaggagagtttctatggggccacataacctggcggcagcgcaaaagatg

SEQ ID NO: 237575 - DNA, 103 bp, Artificial Sequence
  Synthetic Polynucleotide
taatacgactcactataggggaaggaggccttgtgcttacgcatgtggccaacagaggagaggccacatgcgtaagcacaacctggcggcagcgcaaaagatg

SEQ ID NO: 237576 - DNA, 103 bp, Artificial Sequence
  Synthetic Polynucleotide
taatacgactcactatagggacgcatgatcgaaggaggccttgtgcttacaacagaggagagtaagcatgaggcctcctaacctggcggcagcgcaaaagatg

SEQ ID NO: 237577 - DNA, 103 bp, Artificial Sequence
  Synthetic Polynucleotide
taatacgactcactataggggcgctcacggctggcccgttggagtatcgcaacagaggagagcgataatgcaacgggccaacctggcggcagcgcaaaagatg

SEQ ID NO: 237578 - DNA, 103 bp, Artificial Sequence
  Synthetic Polynucleotide
taatacgactcactatagggcacaccggacacgcatgatcgaaggaggccaacagaggagaggcctcatgcgatcatgcaacctggcggcagcgcaaaagatg

SEQ ID NO: 237579 - DNA, 103 bp, Artificial Sequence
  Synthetic Polynucleotide
taatacgactcactataggggcagcggccgcacaccggacacgcatgatcaacagaggagagatcatatgtgtccggtgaacctggcggcagcgcaaaagatg

SEQ ID NO: 237580 - DNA, 103 bp, Artificial Sequence
  Synthetic Polynucleotide
taatacgactcactataggggctccttgaagcagcggccgcacaccggacaacagaggagagtccggatggcggccgctaacctggcggcagcgcaaaagatg

SEQ ID NO: 237581 - DNA, 103 bp, Artificial Sequence
  Synthetic Polynucleotide
taatacgactcactatagggaggaaccagggctccttgaagcagcggccgaacagaggagacggccgatgcttcaaggaaacctggcggcagcgcaaaagatg

SEQ ID NO: 237582 - DNA, 103 bp, Artificial Sequence
  Synthetic Polynucleotide
taatacgactcactataggggtggttcttaaggaaccagggctccttgaaaacagaggagattcaagatgccctggttcaacctggcggcagcgcaaaagatg

SEQ ID NO: 237583 - DNA, 103 bp, Artificial Sequence
  Synthetic Polynucleotide
taatacgactcactataggggcaccttcatgtggttcttaaggaaccaggaacagaggagacctggtatgttaagaaccaacctggcggcagcgcaaaagatg

SEQ ID NO: 237584 - DNA, 103 bp, Artificial Sequence
  Synthetic Polynucleotide
taatacgactcactatagggttgctggcgtgcaccttcatgtggttcttaaacagaggagataagaaatgcatgaaggtaacctggcggcagcgcaaaagatg

SEQ ID NO: 237585 - DNA, 103 bp, Artificial Sequence
  Synthetic Polynucleotide
taatacgactcactatagggtgggcccagcttgctggcgtgcaccttcataacagaggagaatgaagatgcacgccagcaacctggcggcagcgcaaaagatg

SEQ ID NO: 237586 - DNA, 103 bp, Artificial Sequence
  Synthetic Polynucleotide
taatacgactcactataggggggcacgcagtgggcccagcttgctggcgtaacagaggagaacgccaatgagctgggccaacctggcggcagcgcaaaagatg

SEQ ID NO: 237587 - DNA, 103 bp, Artificial Sequence
  Synthetic Polynucleotide
taatacgactcactataggggcaggccccggggcacgcagtgggcccagcaacagaggagagctgggatgactgcgtgcaacctggcggcagcgcaaaagatg

SEQ ID NO: 237588 - DNA, 103 bp, Artificial Sequence
  Synthetic Polynucleotide
taatacgactcactatagggatcctgacttccagtaattgtactggccataacagaggagaatggccatgacaattactaacctggcggcagcgcaaaagatg

SEQ ID NO: 237589 - DNA, 103 bp, Artificial Sequence
  Synthetic Polynucleotide
taatacgactcactatagggaataggagaagatgcttctccccactgttgaacagaggagacaacagatgggagaagcaaacctggcggcagcgcaaaagatg

SEQ ID NO: 237590 - DNA, 103 bp, Artificial Sequence
  Synthetic Polynucleotide
taatacgactcactatagggtactcgctggtggatgtgcaggtttgagcgaacagaggagacgctcaatgctgcacatcaacctggcggcagcgcaaaagatg

SEQ ID NO: 237591 - DNA, 103 bp, Artificial Sequence
  Synthetic Polynucleotide
taatacgactcactatagggctcctgtgtgtactcgctggtggatgtgcaaacagaggagatgcacaatgaccagcgagaacctggcggcagcgcaaaagatg

SEQ ID NO: 237592 - DNA, 103 bp, Artificial Sequence
  Synthetic Polynucleotide
taatacgactcactatagggtagggcctctctcctgtgtgtactcgctggaacagaggagaccagcgatgacacacaggaacctggcggcagcgcaaaagatg

SEQ ID NO: 237593 - DNA, 103 bp, Artificial Sequence
  Synthetic Polynucleotide
taatacgactcactatagggaccacacttgtagggcctctctcctgtgtgaacagaggagacacacaatggagaggcccaacctggcggcagcgcaaaagatg

SEQ ID NO: 237594 - DNA, 103 bp, Artificial Sequence
  Synthetic Polynucleotide
taatacgactcactatagggtcccacactcaccacacttgtagggcctctaacagaggagaagaggcatgacaagtgtgaacctggcggcagcgcaaaagatg

SEQ ID NO: 237595 - DNA, 103 bp, Artificial Sequence
  Synthetic Polynucleotide
taatacgactcactatagggctgaagcccttcccacactcaccacacttgaacagaggagacaagtgatgtgagtgtggaacctggcggcagcgcaaaagatg

SEQ ID NO: 237596 - DNA, 103 bp, Artificial Sequence
  Synthetic Polynucleotide
taatacgactcactatagggcgagctctgactgaagcccttcccacactcaacagaggagagagtgtatgaagggcttcaacctggcggcagcgcaaaagatg

SEQ ID NO: 237597 - DNA, 103 bp, Artificial Sequence
  Synthetic Polynucleotide
taatacgactcactatagggtgtgaaggttcgagctctgactgaagccctaacagaggagaagggctatggtcagagctaacctggcggcagcgcaaaagatg

SEQ ID NO: 237598 - DNA, 103 bp, Artificial Sequence
  Synthetic Polynucleotide
taatacgactcactatagggcaccggtgaatgtgaaggttcgagctctgaaacagaggagatcagagatggaaccttcaaacctggcggcagcgcaaaagatg

SEQ ID NO: 237599 - DNA, 103 bp, Artificial Sequence
  Synthetic Polynucleotide
taatacgactcactatagggtgtgtggatgcaccggtgaatgtgaaggttaacagaggagaaaccttatgattcaccggaacctggcggcagcgcaaaagatg

SEQ ID NO: 237600 - DNA, 103 bp, Artificial Sequence
  Synthetic Polynucleotide
taatacgactcactatagggtgtttctggaaataggagaagatgcttctcaacagaggagagagaagatgcttctcctaaacctggcggcagcgcaaaagatg

SEQ ID NO: 237601 - DNA, 103 bp, Artificial Sequence
  Synthetic Polynucleotide
taatacgactcactataggggcttctctcctgtgtggatgcaccggtgaaaacagaggagattcaccatggcatccacaaacctggcggcagcgcaaaagatg

SEQ ID NO: 237602 - DNA, 103 bp, Artificial Sequence
  Synthetic Polynucleotide
taatacgactcactatagggcattggtaaggcttctctcctgtgtggatgaacagaggagacatccaatgaggagagaaaacctggcggcagcgcaaaagatg

SEQ ID NO: 237603 - DNA, 103 bp, Artificial Sequence
  Synthetic Polynucleotide
taatacgactcactatagggacactcatagcattggtaaggcttctctccaacagaggagaggagagatgccttaccaaaacctggcggcagcgcaaaagatg

SEQ ID NO: 237604 - DNA, 103 bp, Artificial Sequence
  Synthetic Polynucleotide
taatacgactcactatagggaacccttcccacactcatagcattggtaagaacagaggagacttaccatggctatgagtaacctggcggcagcgcaaaagatg

SEQ ID NO: 237605 - DNA, 103 bp, Artificial Sequence
  Synthetic Polynucleotide
taatacgactcactatagggctctggctgaaacccttcccacactcatagaacagaggagactatgaatgtgggaagggaacctggcggcagcgcaaaagatg

SEQ ID NO: 237606 - DNA, 103 bp, Artificial Sequence
  Synthetic Polynucleotide
taatacgactcactatagggaagatccgagctctggctgaaacccttcccaacagaggagagggaagatgttcagccagaacctggcggcagcgcaaaagatg

SEQ ID NO: 237607 - DNA, 103 bp, Artificial Sequence
  Synthetic Polynucleotide
taatacgactcactataggggatggatgcgaagatccgagctctggctgaaacagaggagatcagccatggctcggatcaacctggcggcagcgcaaaagatg

SEQ ID NO: 237608 - DNA, 103 bp, Artificial Sequence
  Synthetic Polynucleotide
taatacgactcactatagggtggactctgagatggatgcgaagatccgagaacagaggagactcggaatgtcgcatccaaacctggcggcagcgcaaaagatg

SEQ ID NO: 237609 - DNA, 103 bp, Artificial Sequence
  Synthetic Polynucleotide
taatacgactcactatagggctctccagtgtggactctgagatggatgcgaacagaggagacgcatcatgctcagagtcaacctggcggcagcgcaaaagatg

SEQ ID NO: 237610 - DNA, 103 bp, Artificial Sequence
  Synthetic Polynucleotide
taatacgactcactataggggatagggcttctctccagtgtggactctgaaacagaggagatcagagatgacactggagaacctggcggcagcgcaaaagatg

SEQ ID NO: 237611 - DNA, 103 bp, Artificial Sequence
  Synthetic Polynucleotide
taatacgactcactatagggacactgtccctgtttctggaaataggagaaaacagaggagattctccatgttccagaaaaacctggcggcagcgcaaaagatg

SEQ ID NO: 237612 - DNA, 103 bp, Artificial Sequence
  Synthetic Polynucleotide
taatacgactcactatagggttgccacagtgatagggcttctctccagtgaacagaggagacactggatggaagccctaaacctggcggcagcgcaaaagatg

SEQ ID NO: 237613 - DNA, 103 bp, Artificial Sequence
  Synthetic Polynucleotide
taatacgactcactatagggcttcccacacttgccacagtgatagggcttaacagaggagaaagcccatgcactgtggcaacctggcggcagcgcaaaagatg

SEQ ID NO: 237614 - DNA, 103 bp, Artificial Sequence
  Synthetic Polynucleotide
taatacgactcactatagggggctaaatcccttcccacacttgccacagtaacagaggagaactgtgatgagtgtgggaaacctggcggcagcgcaaaagatg

SEQ ID NO: 237615 - DNA, 103 bp, Artificial Sequence
  Synthetic Polynucleotide
taatacgactcactatagggttggaactctggctaaatcccttcccacacaacagaggagagtgtggatggggatttagaacctggcggcagcgcaaaagatg

SEQ ID NO: 237616 - DNA, 103 bp, Artificial Sequence
  Synthetic Polynucleotide
taatacgactcactataggggatgaggagtttggaactctggctaaatccaacagaggagaggatttatgcagagttccaacctggcggcagcgcaaaagatg

SEQ ID NO: 237617 - DNA, 103 bp, Artificial Sequence
  Synthetic Polynucleotide
taatacgactcactatagggctctctggtggatgaggagtttggaactctaacagaggagaagagttatgaactcctcaaacctggcggcagcgcaaaagatg

SEQ ID NO: 237618 - DNA, 103 bp, Artificial Sequence
  Synthetic Polynucleotide
taatacgactcactatagggccagtatgtactctctggtggatgaggagtaacagaggagaactcctatgccaccagagaacctggcggcagcgcaaaagatg

SEQ ID NO: 237619 - DNA, 103 bp, Artificial Sequence
  Synthetic Polynucleotide
taatacgactcactataggggggcttctctccagtatgtactctctggtgaacagaggagacaccagatggtacatactaacctggcggcagcgcaaaagatg

SEQ ID NO: 237620 - DNA, 103 bp, Artificial Sequence
  Synthetic Polynucleotide
taatacgactcactatagggtgcactcatagggcttctctccagtatgtaaacagaggagatacataatggagagaagcaacctggcggcagcgcaaaagatg

SEQ ID NO: 237621 - DNA, 103 bp, Artificial Sequence
  Synthetic Polynucleotide
taatacgactcactatagggccacacttgctgcactcatagggcttctctaacagaggagaagagaaatgctatgagtgaacctggcggcagcgcaaaagatg

SEQ ID NO: 237622 - DNA, 103 bp, Artificial Sequence
  Synthetic Polynucleotide
taatacgactcactatagggaagagtcatcacactgtccctgtttctggaaacagaggagatccagaatgagggacagtaacctggcggcagcgcaaaagatg

SEQ ID NO: 237623 - DNA, 103 bp, Artificial Sequence
  Synthetic Polynucleotide
taatacgactcactataggggaagcccttcccacacttgctgcactcataaacagaggagatatgagatgagcaagtgtaacctggcggcagcgcaaaagatg

SEQ ID NO: 237624 - DNA, 103 bp, Artificial Sequence
  Synthetic Polynucleotide
taatacgactcactatagggagctctggctgaagcccttcccacacttgcaacagaggagagcaagtatgggaagggctaacctggcggcagcgcaaaagatg

SEQ ID NO: 237625 - DNA, 103 bp, Artificial Sequence
  Synthetic Polynucleotide
taatacgactcactatagggtgaaggttggagctctggctgaagcccttcaacagaggagagaagggatgcagccagagaacctggcggcagcgcaaaagatg

SEQ ID NO: 237626 - DNA, 103 bp, Artificial Sequence
  Synthetic Polynucleotide
taatacgactcactatagggctggtggatgtgaaggttggagctctggctaacagaggagaagccagatgtccaaccttaacctggcggcagcgcaaaagatg

SEQ ID NO: 237627 - DNA, 103 bp, Artificial Sequence
  Synthetic Polynucleotide
taatacgactcactatagggtgtgaacccgctggtggatgtgaaggttggaacagaggagaccaaccatgacatccaccaacctggcggcagcgcaaaagatg

SEQ ID NO: 237628 - DNA, 103 bp, Artificial Sequence
  Synthetic Polynucleotide
taatacgactcactatagggggatctttcttgtgaacccgctggtggatgaacagaggagacatccaatggcgggttcaaacctggcggcagcgcaaaagatg

SEQ ID NO: 237629 - DNA, 103 bp, Artificial Sequence
  Synthetic Polynucleotide
taatacgactcactatagggaaccactttgaagagtcatcacactgtcccaacagaggagagggacaatgtgatgactcaacctggcggcagcgcaaaagatg

SEQ ID NO: 237630 - DNA, 103 bp, Artificial Sequence
  Synthetic Polynucleotide
taatacgactcactatagggttttcgaaacaaccactttgaagagtcatcaacagaggagagatgacatgtcaaagtggaacctggcggcagcgcaaaagatg

SEQ ID NO: 237631 - DNA, 103 bp, Artificial Sequence
  Synthetic Polynucleotide
taatacgactcactatagggactttcaatgttttcgaaacaaccactttgaacagaggagacaaagtatgtgtttcgaaaacctggcggcagcgcaaaagatg

SEQ ID NO: 237632 - DNA, 103 bp, Artificial Sequence
  Synthetic Polynucleotide
taatacgactcactatagggaatatgtttcactttcaatgttttcgaaacaacagaggagagtttcgatgacattgaaaaacctggcggcagcgcaaaagatg

SEQ ID NO: 237633 - DNA, 103 bp, Artificial Sequence
  Synthetic Polynucleotide
taatacgactcactatagggttcaaaggcaaatatgtttcactttcaatgaacagaggagacattgaatgtgaaacataaacctggcggcagcgcaaaagatg

SEQ ID NO: 237634 - DNA, 103 bp, Artificial Sequence
  Synthetic Polynucleotide
taatacgactcactataggggcttgagactttcaaaggcaaatatgtttcaacagaggagagaaacaatgttgcctttgaacctggcggcagcgcaaaagatg

SEQ ID NO: 237635 - DNA, 103 bp, Artificial Sequence
  Synthetic Polynucleotide
taatacgactcactatagggtcacaatacaatcctgacttccagtaattgaacagaggagacaattaatggaagtcaggaacctggcggcagcgcaaaagatg

SEQ ID NO: 237636 - DNA, 103 bp, Artificial Sequence
  Synthetic Polynucleotide
taatacgactcactatagggtgtctatttggcttgagactttcaaaggcaaacagaggagatgccttatgaagtctcaaaacctggcggcagcgcaaaagatg

SEQ ID NO: 237637 - DNA, 103 bp, Artificial Sequence
  Synthetic Polynucleotide
taatacgactcactataggggagtcttgtgtgtctatttggcttgagactaacagaggagaagtctcatgccaaatagaaacctggcggcagcgcaaaagatg

SEQ ID NO: 237638 - DNA, 103 bp, Artificial Sequence
  Synthetic Polynucleotide
taatacgactcactatagggcttcactgaagagtcttgtgtgtctatttgaacagaggagacaaataatgacacaagacaacctggcggcagcgcaaaagatg

SEQ ID NO: 237639 - DNA, 103 bp, Artificial Sequence
  Synthetic Polynucleotide
taatacgactcactatagggtcttacagaacttcactgaagagtcttgtgaacagaggagacacaagatgcttcagtgaaacctggcggcagcgcaaaagatg

SEQ ID NO: 237640 - DNA, 103 bp, Artificial Sequence
  Synthetic Polynucleotide
taatacgactcactatagggtgaggctcattcttacagaacttcactgaaaacagaggagattcagtatggttctgtaaaacctggcggcagcgcaaaagatg

SEQ ID NO: 237641 - DNA, 103 bp, Artificial Sequence
  Synthetic Polynucleotide
taatacgactcactatagggctgatgatcctgaggctcattcttacagaaaacagaggagattctgtatgaatgagcctaacctggcggcagcgcaaaagatg

SEQ ID NO: 237642 - DNA, 103 bp, Artificial Sequence
  Synthetic Polynucleotide
taatacgactcactataggggtctgctttcctgatgatcctgaggctcataacagaggagaatgagcatgaggatcatcaacctggcggcagcgcaaaagatg

SEQ ID NO: 237643 - DNA, 103 bp, Artificial Sequence
  Synthetic Polynucleotide
taatacgactcactatagggacaaagagacgtctgctttcctgatgatccaacagaggagaggatcaatgggaaagcagaacctggcggcagcgcaaaagatg

SEQ ID NO: 237644 - DNA, 103 bp, Artificial Sequence
  Synthetic Polynucleotide
taatacgactcactatagggttcttccattacaaagagacgtctgctttcaacagaggagagaaagcatgcgtctctttaacctggcggcagcgcaaaagatg

SEQ ID NO: 237645 - DNA, 103 bp, Artificial Sequence
  Synthetic Polynucleotide
taatacgactcactatagggtctcagtgctttcttccattacaaagagacaacagaggagagtctctatgtaatggaagaacctggcggcagcgcaaaagatg

SEQ ID NO: 237646 - DNA, 103 bp, Artificial Sequence
  Synthetic Polynucleotide
taatacgactcactatagggcctcgatgattcacaatacaatcctgacttaacagaggagaaagtcaatgttgtattgtaacctggcggcagcgcaaaagatg

SEQ ID NO: 237647 - DNA, 103 bp, Artificial Sequence
  Synthetic Polynucleotide
taatacgactcactatagggatcacttttctctcagtgctttcttccattaacagaggagaaatggaatgaagcactgaaacctggcggcagcgcaaaagatg

SEQ ID NO: 237648 - DNA, 103 bp, Artificial Sequence
  Synthetic Polynucleotide
taatacgactcactatagggttccccctttatcacttttctctcagtgctaacagaggagaagcactatgagaaaagtgaacctggcggcagcgcaaaagatg

SEQ ID NO: 237649 - DNA, 103 bp, Artificial Sequence
  Synthetic Polynucleotide
taatacgactcactatagggctgaacaactttccccctttatcacttttcaacagaggagagaaaagatgtaaagggggaacctggcggcagcgcaaaagatg

SEQ ID NO: 237650 - DNA, 103 bp, Artificial Sequence
  Synthetic Polynucleotide
taatacgactcactatagggtgaaggttctctgaacaactttccccctttaacagaggagaaaagggatgaagttgttcaacctggcggcagcgcaaaagatg

SEQ ID NO: 237651 - DNA, 103 bp, Artificial Sequence
  Synthetic Polynucleotide
taatacgactcactatagggcagtttaacttgaaggttctctgaacaactaacagaggagaagttgtatggagaaccttaacctggcggcagcgcaaaagatg

SEQ ID NO: 237652 - DNA, 103 bp, Artificial Sequence
  Synthetic Polynucleotide
taatacgactcactatagggcatcagacaccagtttaacttgaaggttctaacagaggagaagaaccatgaagttaaacaacctggcggcagcgcaaaagatg

SEQ ID NO: 237653 - DNA, 103 bp, Artificial Sequence
  Synthetic Polynucleotide
taatacgactcactatagggagttcttgtccatcagacaccagtttaactaacagaggagaagttaaatgggtgtctgaaacctggcggcagcgcaaaagatg

SEQ ID NO: 237654 - DNA, 103 bp, Artificial Sequence
  Synthetic Polynucleotide
taatacgactcactatagggtggcgaggccagttcttgtccatcagacacaacagaggagagtgtctatgggacaagaaaacctggcggcagcgcaaaagatg

SEQ ID NO: 237655 - DNA, 103 bp, Artificial Sequence
  Synthetic Polynucleotide
taatacgactcactatagggcatttaacaatggcgaggccagttcttgtcaacagaggagagacaagatgtggcctcgcaacctggcggcagcgcaaaagatg

SEQ ID NO: 237656 - DNA, 103 bp, Artificial Sequence
  Synthetic Polynucleotide
taatacgactcactataggggttgcctcaccatttaacaatggcgaggccaacagaggagaggcctcatgattgttaaaaacctggcggcagcgcaaaagatg

SEQ ID NO: 237657 - DNA, 103 bp, Artificial Sequence
  Synthetic Polynucleotide
taatacgactcactatagggatccacttcccctcgatgattcacaatacaaacagaggagatgtattatgaatcatcgaaacctggcggcagcgcaaaagatg

SEQ ID NO: 237658 - DNA, 103 bp, Artificial Sequence
  Synthetic Polynucleotide
taatacgactcactatagggattctggcaagttgcctcaccatttaacaaaacagaggagattgttaatgggtgaggcaaacctggcggcagcgcaaaagatg

SEQ ID NO: 237659 - DNA, 103 bp, Artificial Sequence
  Synthetic Polynucleotide
taatacgactcactatagggttaactggccattctggcaagttgcctcacaacagaggagagtgaggatgcttgccagaaacctggcggcagcgcaaaagatg

SEQ ID NO: 237660 - DNA, 103 bp, Artificial Sequence
  Synthetic Polynucleotide
taatacgactcactatagggaaagattcttttaactggccattctggcaaaacagaggagattgccaatgtggccagttaacctggcggcagcgcaaaagatg

SEQ ID NO: 237661 - DNA, 103 bp, Artificial Sequence
  Synthetic Polynucleotide
taatacgactcactatagggaatgggatccaaagattcttttaactggccaacagaggagaggccagatgaaagaatctaacctggcggcagcgcaaaagatg

SEQ ID NO: 237662 - DNA, 103 bp, Artificial Sequence
  Synthetic Polynucleotide
taatacgactcactatagggagttacagtcaatgggatccaaagattcttaacagaggagaaagaatatgtggatcccaaacctggcggcagcgcaaaagatg

SEQ ID NO: 237663 - DNA, 103 bp, Artificial Sequence
  Synthetic Polynucleotide
taatacgactcactatagggatgtctttgcagttacagtcaatgggatccaacagaggagaggatccatgtgactgtaaaacctggcggcagcgcaaaagatg

SEQ ID NO: 237664 - DNA, 103 bp, Artificial Sequence
  Synthetic Polynucleotide
taatacgactcactatagggccatccatgaatgtctttgcagttacagtcaacagaggagagactgtatgtgcaaagacaacctggcggcagcgcaaaagatg

SEQ ID NO: 237665 - DNA, 103 bp, Artificial Sequence
  Synthetic Polynucleotide
taatacgactcactatagggcctgtgatttccatccatgaatgtctttgcaacagaggagagcaaagatgttcatggataacctggcggcagcgcaaaagatg

SEQ ID NO: 237666 - DNA, 103 bp, Artificial Sequence
  Synthetic Polynucleotide
taatacgactcactatagggcaactgaccacctgtgatttccatccatgaaacagaggagatcatggatggaaatcacaaacctggcggcagcgcaaaagatg

SEQ ID NO: 237667 - DNA, 103 bp, Artificial Sequence
  Synthetic Polynucleotide
taatacgactcactatagggctgctgactacaactgaccacctgtgatttaacagaggagaaaatcaatggtggtcagtaacctggcggcagcgcaaaagatg

SEQ ID NO: 237668 - DNA, 103 bp, Artificial Sequence
  Synthetic Polynucleotide
taatacgactcactatagggcaggctccccatccacttcccctcgatgataacagaggagaatcatcatggggaagtggaacctggcggcagcgcaaaagatg

SEQ ID NO: 237669 - DNA, 103 bp, Artificial Sequence
  Synthetic Polynucleotide
taatacgactcactatagggtatgagctctctgctgactacaactgaccaaacagaggagatggtcaatggtagtcagcaacctggcggcagcgcaaaagatg

SEQ ID NO: 237670 - DNA, 103 bp, Artificial Sequence
  Synthetic Polynucleotide
taatacgactcactatagggttctcctctgtatgagctctctgctgactaaacagaggagatagtcaatggagagctcaaacctggcggcagcgcaaaagatg

SEQ ID NO: 237671 - DNA, 103 bp, Artificial Sequence
  Synthetic Polynucleotide
taatacgactcactataggggtcacagggtttctcctctgtatgagctctaacagaggagaagagctatgacagaggagaacctggcggcagcgcaaaagatg

SEQ ID NO: 237672 - DNA, 103 bp, Artificial Sequence
  Synthetic Polynucleotide
taatacgactcactatagggagttattatggtcacagggtttctcctctgaacagaggagacagaggatgaaccctgtgaacctggcggcagcgcaaaagatg

SEQ ID NO: 237673 - DNA, 103 bp, Artificial Sequence
  Synthetic Polynucleotide
taatacgactcactatagggattttcccacagttattatggtcacagggtaacagaggagaaccctgatgccataataaaacctggcggcagcgcaaaagatg

SEQ ID NO: 237674 - DNA, 103 bp, Artificial Sequence
  Synthetic Polynucleotide
taatacgactcactatagggggtgttaagtattttcccacagttattatgaacagaggagacataatatgtgtgggaaaaacctggcggcagcgcaaaagatg

SEQ ID NO: 237675 - DNA, 103 bp, Artificial Sequence
  Synthetic Polynucleotide
taatacgactcactatagggcatctgggctggtgttaagtattttcccacaacagaggagagtgggaatgtacttaacaaacctggcggcagcgcaaaagatg

SEQ ID NO: 237676 - DNA, 103 bp, Artificial Sequence
  Synthetic Polynucleotide
taatacgactcactatagggtatggatgaccatctgggctggtgttaagtaacagaggagaacttaaatgcagcccagaaacctggcggcagcgcaaaagatg

SEQ ID NO: 237677 - DNA, 103 bp, Artificial Sequence
  Synthetic Polynucleotide
taatacgactcactataggggattttctcatatggatgaccatctgggctaacagaggagaagcccaatgggtcatccaaacctggcggcagcgcaaaagatg

SEQ ID NO: 237678 - DNA, 103 bp, Artificial Sequence
  Synthetic Polynucleotide
taatacgactcactatagggctgcagtgtggattttctcatatggatgacaacagaggagagtcatcatgatgagaaaaaacctggcggcagcgcaaaagatg

SEQ ID NO: 237679 - DNA, 103 bp, Artificial Sequence
  Synthetic Polynucleotide
taatacgactcactatagggatatctagttcaggctccccatccacttccaacagaggagaggaagtatgtggggagccaacctggcggcagcgcaaaagatg

SEQ ID NO: 237680 - DNA, 103 bp, Artificial Sequence
  Synthetic Polynucleotide
taatacgactcactatagggtattgtttctctgcagtgtggattttctcaaacagaggagatgagaaatgccacactgcaacctggcggcagcgcaaaagatg

SEQ ID NO: 237681 - DNA, 103 bp, Artificial Sequence
  Synthetic Polynucleotide
taatacgactcactatagggactacattcgtattgtttctctgcagtgtgaacagaggagacacactatggagaaacaaaacctggcggcagcgcaaaagatg

SEQ ID NO: 237682 - DNA, 103 bp, Artificial Sequence
  Synthetic Polynucleotide
taatacgactcactatagggtaccacactgactacattcgtattgtttctaacagaggagaagaaacatgacgaatgtaaacctggcggcagcgcaaaagatg

SEQ ID NO: 237683 - DNA, 103 bp, Artificial Sequence
  Synthetic Polynucleotide
taatacgactcactatagggctgaagttcttaccacactgactacattcgaacagaggagacgaatgatgtcagtgtggaacctggcggcagcgcaaaagatg

SEQ ID NO: 237684 - DNA, 103 bp, Artificial Sequence
  Synthetic Polynucleotide
taatacgactcactatagggtgagctttgactgaagttcttaccacactgaacagaggagacagtgtatgaagaacttcaacctggcggcagcgcaaaagatg

SEQ ID NO: 237685 - DNA, 103 bp, Artificial Sequence
  Synthetic Polynucleotide
taatacgactcactataggggtagtagctctgagctttgactgaagttctaacagaggagaagaactatggtcaaagctaacctggcggcagcgcaaaagatg

SEQ ID NO: 237686 - DNA, 103 bp, Artificial Sequence
  Synthetic Polynucleotide
taatacgactcactatagggctctgatgaagtagtagctctgagctttgaaacagaggagatcaaagatgagagctactaacctggcggcagcgcaaaagatg

SEQ ID NO: 237687 - DNA, 103 bp, Artificial Sequence
  Synthetic Polynucleotide
taatacgactcactatagggtgtgtggtctctctgatgaagtagtagctcaacagaggagagagctaatgcttcatcagaacctggcggcagcgcaaaagatg

SEQ ID NO: 237688 - DNA, 103 bp, Artificial Sequence
  Synthetic Polynucleotide
taatacgactcactataggggtttttcttctgtgtggtctctctgatgaaaacagaggagattcatcatggagaccacaaacctggcggcagcgcaaaagatg

SEQ ID NO: 237689 - DNA, 103 bp, Artificial Sequence
  Synthetic Polynucleotide
taatacgactcactatagggcatttgtagggtttttcttctgtgtggtctaacagaggagaagaccaatgagaagaaaaaacctggcggcagcgcaaaagatg

SEQ ID NO: 237690 - DNA, 103 bp, Artificial Sequence
  Synthetic Polynucleotide
taatacgactcactatagggacaaggggaaatatctagttcaggctccccaacagaggagaggggagatggaactagataacctggcggcagcgcaaaagatg

SEQ ID NO: 237691 - DNA, 103 bp, Artificial Sequence
  Synthetic Polynucleotide
taatacgactcactatagggacattgctcacatttgtagggtttttcttcaacagaggagagaagaaatgccctacaaaaacctggcggcagcgcaaaagatg

SEQ ID NO: 237692 - DNA, 103 bp, Artificial Sequence
  Synthetic Polynucleotide
taatacgactcactatagggagcccttcccacattgctcacatttgtaggaacagaggagacctacaatggtgagcaataacctggcggcagcgcaaaagatg

SEQ ID NO: 237693 - DNA, 103 bp, Artificial Sequence
  Synthetic Polynucleotide
taatacgactcactatagggctccttgtgaagcccttcccacattgctcaaacagaggagatgagcaatgtgggaagggaacctggcggcagcgcaaaagatg

SEQ ID NO: 237694 - DNA, 103 bp, Artificial Sequence
  Synthetic Polynucleotide
taatacgactcactatagggcagactcgagctccttgtgaagcccttcccaacagaggagagggaagatgttcacaaggaacctggcggcagcgcaaaagatg

SEQ ID NO: 237695 - DNA, 103 bp, Artificial Sequence
  Synthetic Polynucleotide
taatacgactcactataggggatggataagcagactcgagctccttgtgaaacagaggagatcacaaatggctcgagtcaacctggcggcagcgcaaaagatg

SEQ ID NO: 237696 - DNA, 103 bp, Artificial Sequence
  Synthetic Polynucleotide
taatacgactcactatagggtggactgcctgatggataagcagactcgagaacagaggagactcgagatggcttatccaaacctggcggcagcgcaaaagatg

SEQ ID NO: 237697 - DNA, 103 bp, Artificial Sequence
  Synthetic Polynucleotide
taatacgactcactatagggctcatctgtgtggactgcctgatggataagaacagaggagacttatcatgcaggcagtcaacctggcggcagcgcaaaagatg

SEQ ID NO: 237698 - DNA, 103 bp, Artificial Sequence
  Synthetic Polynucleotide
taatacgactcactatagggtataaggcttctcatctgtgtggactgcctaacagaggagaaggcagatgacacagatgaacctggcggcagcgcaaaagatg

SEQ ID NO: 237699 - DNA, 103 bp, Artificial Sequence
  Synthetic Polynucleotide
taatacgactcactatagggttgtcacacttataaggcttctcatctgtgaacagaggagacacagaatggaagccttaaacctggcggcagcgcaaaagatg

SEQ ID NO: 237700 - DNA, 103 bp, Artificial Sequence
  Synthetic Polynucleotide
taatacgactcactatagggcttcccacacttgtcacacttataaggcttaacagaggagaaagcctatgaagtgtgacaacctggcggcagcgcaaaagatg

SEQ ID NO: 237701 - DNA, 103 bp, Artificial Sequence
  Synthetic Polynucleotide
taatacgactcactatagggcccactgttgacaaggggaaatatctagttaacagaggagaaactagatgtttccccttaacctggcggcagcgcaaaagatg

SEQ ID NO: 237702 - DNA, 103 bp, Artificial Sequence
  Synthetic Polynucleotide
taatacgactcactatagggtggtgaagcccttcccacacttgtcacactaacagaggagaagtgtgatgagtgtgggaaacctggcggcagcgcaaaagatg

SEQ ID NO: 237703 - DNA, 103 bp, Artificial Sequence
  Synthetic Polynucleotide
taatacgactcactatagggcttgagctcctggtgaagcccttcccacacaacagaggagagtgtggatggggcttcacaacctggcggcagcgcaaaagatg

SEQ ID NO: 237704 - DNA, 103 bp, Artificial Sequence
  Synthetic Polynucleotide
taatacgactcactataggggatgagcagacttgagctcctggtgaagccaacagaggagaggcttcatgaggagctcaaacctggcggcagcgcaaaagatg

SEQ ID NO: 237705 - DNA, 103 bp, Artificial Sequence
  Synthetic Polynucleotide
taatacgactcactatagggcggcatgatggatgagcagacttgagctccaacagaggagaggagctatggtctgctcaaacctggcggcagcgcaaaagatg

SEQ ID NO: 237706 - DNA, 103 bp, Artificial Sequence
  Synthetic Polynucleotide
taatacgactcactatagggcctgtatggacggcatgatggatgagcagaaacagaggagatctgctatgccatcatgcaacctggcggcagcgcaaaagatg

SEQ ID NO: 237707 - DNA, 103 bp, Artificial Sequence
  Synthetic Polynucleotide
taatacgactcactatagggaggtttttcgcctgtatggacggcatgatgaacagaggagacatcatatggtccatacaaacctggcggcagcgcaaaagatg

SEQ ID NO: 237708 - DNA, 103 bp, Artificial Sequence
  Synthetic Polynucleotide
taatacgactcactatagggcacatttataaggtttttcgcctgtatggaaacagaggagatccataatggcgaaaaacaacctggcggcagcgcaaaagatg

SEQ ID NO: 237709 - DNA, 103 bp, Artificial Sequence
  Synthetic Polynucleotide
taatacgactcactatagggccacacttgtcacatttataaggtttttcgaacagaggagacgaaaaatgttataaatgaacctggcggcagcgcaaaagatg

SEQ ID NO: 237710 - DNA, 103 bp, Artificial Sequence
  Synthetic Polynucleotide
taatacgactcactatagggaaagcccttcccacacttgtcacatttataaacagaggagatataaaatggacaagtgtaacctggcggcagcgcaaaagatg

SEQ ID NO: 237711 - DNA, 103 bp, Artificial Sequence
  Synthetic Polynucleotide
taatacgactcactatagggagctctgactaaagcccttcccacacttgtaacagaggagaacaagtatgggaagggctaacctggcggcagcgcaaaagatg

SEQ ID NO: 237712 - DNA, 103 bp, Artificial Sequence
  Synthetic Polynucleotide
taatacgactcactataggggatgcttctccccactgttgacaaggggaaaacagaggagattccccatgtcaacagtgaacctggcggcagcgcaaaagatg

SEQ ID NO: 237713 - DNA, 103 bp, Artificial Sequence
  Synthetic Polynucleotide
taatacgactcactatagggtgcagtttggagctctgactaaagcccttcaacagaggagagaagggatgtagtcagagaacctggcggcagcgcaaaagatg

SEQ ID NO: 237714 - DNA, 103 bp, Artificial Sequence
  Synthetic Polynucleotide
taatacgactcactatagggctggtggatgtgcagtttggagctctgactaacagaggagaagtcagatgtccaaactgaacctggcggcagcgcaaaagatg

SEQ ID NO: 237715 - DNA, 103 bp, Artificial Sequence
  Synthetic Polynucleotide
taatacgactcactatagggtgtggactcgctggtggatgtgcagtttggaacagaggagaccaaacatgacatccaccaacctggcggcagcgcaaaagatg

SEQ ID NO: 237716 - DNA, 103 bp, Artificial Sequence
  Synthetic Polynucleotide
taatacgactcactatagggttctctccagtgtggactcgctggtggatgaacagaggagacatccaatggcgagtccaaacctggcggcagcgcaaaagatg

SEQ ID NO: 237717 - DNA, 103 bp, Artificial Sequence
  Synthetic Polynucleotide
taatacgactcactatagggctcatagggcttctctccagtgtggactcgaacagaggagacgagtcatgactggagagaacctggcggcagcgcaaaagatg

SEQ ID NO: 237718 - DNA, 103 bp, Artificial Sequence
  Synthetic Polynucleotide
taatacgactcactatagggactcctcacactcatagggcttctctccagaacagaggagactggagatgagccctatgaacctggcggcagcgcaaaagatg

SEQ ID NO: 237719 - DNA, 103 bp, Artificial Sequence
  Synthetic Polynucleotide
taatacgactcactatagggctcataccacactcctcacactcatagggcaacagaggagagccctaatggtgtgaggaaacctggcggcagcgcaaaagatg

SEQ ID NO: 237720 - DNA, 103 bp, Artificial Sequence
  Synthetic Polynucleotide
taatacgactcactatagggctgactgaagctcataccacactcctcacaaacagaggagatgtgagatgtgtggtatgaacctggcggcagcgcaaaagatg

SEQ ID NO: 237721 - DNA, 103 bp, Artificial Sequence
  Synthetic Polynucleotide
taatacgactcactatagggggtttgagcgctgactgaagctcataccacaacagaggagagtggtaatggcttcagtcaacctggcggcagcgcaaaagatg

SEQ ID NO: 237722 - DNA, 103 bp, Artificial Sequence
  Synthetic Polynucleotide
taatacgactcactatagggtggatgtgcaggtttgagcgctgactgaagaacagaggagacttcagatggcgctcaaaaacctggcggcagcgcaaaagatg

SEQ ID NO: 237723 - DNA, 103 bp, Artificial Sequence
  Synthetic Polynucleotide
taatacgactcactataggggacagccccctgggtcttggaagcagccataacagaggagaatggctatgtccaagaccaacctggcggcagcgcaaaagatg

SEQ ID NO: 237724 - DNA, 103 bp, Artificial Sequence
  Synthetic Polynucleotide
taatacgactcactatagggaagcggctccaggatacaatccttactgtcaacagaggagagacagtatggattgtatcaacctggcggcagcgcaaaagatg

SEQ ID NO: 237725 - DNA, 103 bp, Artificial Sequence
  Synthetic Polynucleotide
taatacgactcactataggggaaatttaatccaagttctgactttattttaacagaggagaaaaataatgtcagaacttaacctggcggcagcgcaaaagatg

SEQ ID NO: 237726 - DNA, 103 bp, Artificial Sequence
  Synthetic Polynucleotide
taatacgactcactatagggcttgctgatagaaatttaatccaagttctgaacagaggagacagaacatggattaaattaacctggcggcagcgcaaaagatg

SEQ ID NO: 237727 - DNA, 103 bp, Artificial Sequence
  Synthetic Polynucleotide
taatacgactcactatagggaccagtttcacttgctgatagaaatttaataacagaggagaattaaaatgctatcagcaaacctggcggcagcgcaaaagatg

SEQ ID NO: 237728 - DNA, 103 bp, Artificial Sequence
  Synthetic Polynucleotide
taatacgactcactatagggaataaaattgaccagtttcacttgctgataaacagaggagatatcagatggtgaaactgaacctggcggcagcgcaaaagatg

SEQ ID NO: 237729 - DNA, 103 bp, Artificial Sequence
  Synthetic Polynucleotide
taatacgactcactatagggcttgcctccgaataaaattgaccagtttcaaacagaggagatgaaacatgtcaattttaaacctggcggcagcgcaaaagatg

SEQ ID NO: 237730 - DNA, 103 bp, Artificial Sequence
  Synthetic Polynucleotide
taatacgactcactatagggcattggtgaacttgcctccgaataaaattgaacagaggagacaatttatgtcggaggcaaacctggcggcagcgcaaaagatg

SEQ ID NO: 237731 - DNA, 103 bp, Artificial Sequence
  Synthetic Polynucleotide
taatacgactcactatagggataacatctgcattggtgaacttgcctccgaacagaggagacggaggatggttcaccaaaacctggcggcagcgcaaaagatg

SEQ ID NO: 237732 - DNA, 103 bp, Artificial Sequence
  Synthetic Polynucleotide
taatacgactcactatagggcatggcagccataacatctgcattggtgaaaacagaggagattcaccatggcagatgttaacctggcggcagcgcaaaagatg

SEQ ID NO: 237733 - DNA, 103 bp, Artificial Sequence
  Synthetic Polynucleotide
taatacgactcactatagggttgaacttcacatggcagccataacatctgaacagaggagacagatgatgtggctgccaaacctggcggcagcgcaaaagatg

SEQ ID NO: 237734 - DNA, 103 bp, Artificial Sequence
  Synthetic Polynucleotide
taatacgactcactatagggtgctttggatttgaacttcacatggcagccaacagaggagaggctgcatggtgaagttcaacctggcggcagcgcaaaagatg

SEQ ID NO: 237735 - DNA, 103 bp, Artificial Sequence
  Synthetic Polynucleotide
taatacgactcactatagggctggcagggaaagcggctccaggatacaataacagaggagaattgtaatgtggagccgcaacctggcggcagcgcaaaagatg

SEQ ID NO: 237736 - DNA, 103 bp, Artificial Sequence
  Synthetic Polynucleotide
taatacgactcactatagggttcttaagtctgctttggatttgaacttcaaacagaggagatgaagtatgaatccaaagaacctggcggcagcgcaaaagatg

SEQ ID NO: 237737 - DNA, 103 bp, Artificial Sequence
  Synthetic Polynucleotide
taatacgactcactatagggtccatgtgagttcttaagtctgctttggataacagaggagaatccaaatgagacttaagaacctggcggcagcgcaaaagatg

SEQ ID NO: 237738 - DNA, 103 bp, Artificial Sequence
  Synthetic Polynucleotide
taatacgactcactatagggtttagtttcttccatgtgagttcttaagtcaacagaggagagacttaatgactcacatgaacctggcggcagcgcaaaagatg

SEQ ID NO: 237739 - DNA, 103 bp, Artificial Sequence
  Synthetic Polynucleotide
taatacgactcactataggggcgaagtgtgtttagtttcttccatgtgagaacagaggagactcacaatgaagaaactaaacctggcggcagcgcaaaagatg

SEQ ID NO: 237740 - DNA, 103 bp, Artificial Sequence
  Synthetic Polynucleotide
taatacgactcactatagggtcggggagcagcgaagtgtgtttagtttctaacagaggagaagaaacatgacacacttcaacctggcggcagcgcaaaagatg

SEQ ID NO: 237741 - DNA, 103 bp, Artificial Sequence
  Synthetic Polynucleotide
taatacgactcactatagggcgtctttctatcggggagcagcgaagtgtgaacagaggagacacactatgctgctccccaacctggcggcagcgcaaaagatg

SEQ ID NO: 237742 - DNA, 103 bp, Artificial Sequence
  Synthetic Polynucleotide
taatacgactcactataggggttgatcccacgtctttctatcggggagcaaacagaggagatgctccatgatagaaagaaacctggcggcagcgcaaaagatg

SEQ ID NO: 237743 - DNA, 103 bp, Artificial Sequence
  Synthetic Polynucleotide
taatacgactcactatagggtaatactccagttgatcccacgtctttctaaacagaggagatagaaaatggtgggatcaaacctggcggcagcgcaaaagatg

SEQ ID NO: 237744 - DNA, 103 bp, Artificial Sequence
  Synthetic Polynucleotide
taatacgactcactatagggggttggaaaataatactccagttgatcccaaacagaggagatgggatatgctggagtataacctggcggcagcgcaaaagatg

SEQ ID NO: 237745 - DNA, 103 bp, Artificial Sequence
  Synthetic Polynucleotide
taatacgactcactatagggcattttcataggttggaaaataatactccaaacagaggagatggagtatgattttccaaaacctggcggcagcgcaaaagatg

SEQ ID NO: 237746 - DNA, 103 bp, Artificial Sequence
  Synthetic Polynucleotide
taatacgactcactatagggcctggactttctggcagggaaagcggctccaacagaggagaggagccatgttccctgccaacctggcggcagcgcaaaagatg

SEQ ID NO: 237747 - DNA, 103 bp, Artificial Sequence
  Synthetic Polynucleotide
taatacgactcactatagggaggagagtgtcattttcataggttggaaaaaacagaggagattttccatgctatgaaaaaacctggcggcagcgcaaaagatg

SEQ ID NO: 237748 - DNA, 103 bp, Artificial Sequence
  Synthetic Polynucleotide
taatacgactcactatagggtagtgtacacaggagagtgtcattttcataaacagaggagatatgaaatggacactctcaacctggcggcagcgcaaaagatg

SEQ ID NO: 237749 - DNA, 103 bp, Artificial Sequence
  Synthetic Polynucleotide
taatacgactcactatagggcactgtcagatagtgtacacaggagagtgtaacagaggagaacactcatgtgtgtacacaacctggcggcagcgcaaaagatg

SEQ ID NO: 237750 - DNA, 103 bp, Artificial Sequence
  Synthetic Polynucleotide
taatacgactcactatagggaggtcactttcactgtcagatagtgtacacaacagaggagagtgtacatgatctgacagaacctggcggcagcgcaaaagatg

SEQ ID NO: 237751 - DNA, 103 bp, Artificial Sequence
  Synthetic Polynucleotide
taatacgactcactatagggctgagctgtcaggtcactttcactgtcagaaacagaggagatctgacatggaaagtgacaacctggcggcagcgcaaaagatg

SEQ ID NO: 237752 - DNA, 103 bp, Artificial Sequence
  Synthetic Polynucleotide
taatacgactcactatagggcattttgttcctgagctgtcaggtcactttaacagaggagaaaagtgatgtgacagctcaacctggcggcagcgcaaaagatg

SEQ ID NO: 237753 - DNA, 103 bp, Artificial Sequence
  Synthetic Polynucleotide
taatacgactcactatagggggaacattttcattttgttcctgagctgtcaacagaggagagacagcatgggaacaaaaaacctggcggcagcgcaaaagatg

SEQ ID NO: 237754 - DNA, 103 bp, Artificial Sequence
  Synthetic Polynucleotide
taatacgactcactatagggactgatgatgggaacattttcattttgttcaacagaggagagaacaaatggaaaatgttaacctggcggcagcgcaaaagatg

SEQ ID NO: 237755 - DNA, 103 bp, Artificial Sequence
  Synthetic Polynucleotide
taatacgactcactatagggatgtatcttcactgatgatgggaacattttaacagaggagaaaaatgatgccatcatcaaacctggcggcagcgcaaaagatg

SEQ ID NO: 237756 - DNA, 103 bp, Artificial Sequence
  Synthetic Polynucleotide
taatacgactcactatagggtacagtttagatgtatcttcactgatgatgaacagaggagacatcatatgtgaagatacaacctggcggcagcgcaaaagatg

SEQ ID NO: 237757 - DNA, 103 bp, Artificial Sequence
  Synthetic Polynucleotide
taatacgactcactatagggggtggtgccacctggactttctggcagggaaacagaggagatccctgatggaaagtccaaacctggcggcagcgcaaaagatg

SEQ ID NO: 237758 - DNA, 103 bp, Artificial Sequence
  Synthetic Polynucleotide
taatacgactcactatagggtttcaaagcatacagtttagatgtatcttcaacagaggagagaagatatgtctaaactgaacctggcggcagcgcaaaagatg

SEQ ID NO: 237759 - DNA, 103 bp, Artificial Sequence
  Synthetic Polynucleotide
taatacgactcactatagggtactgctttgtttcaaagcatacagtttagaacagaggagactaaacatgatgctttgaaacctggcggcagcgcaaaagatg

SEQ ID NO: 237760 - DNA, 103 bp, Artificial Sequence
  Synthetic Polynucleotide
taatacgactcactatagggtggttcaaaatactgctttgtttcaaagcaaacagaggagatgctttatgacaaagcagaacctggcggcagcgcaaaagatg

SEQ ID NO: 237761 - DNA, 103 bp, Artificial Sequence
  Synthetic Polynucleotide
taatacgactcactatagggtagtagcaactggttcaaaatactgctttgaacagaggagacaaagcatgattttgaacaacctggcggcagcgcaaaagatg

SEQ ID NO: 237762 - DNA, 103 bp, Artificial Sequence
  Synthetic Polynucleotide
taatacgactcactatagggcttctaaagtggtggtgccacctggactttaacagaggagaaaagtcatggtggcaccaaacctggcggcagcgcaaaagatg

SEQ ID NO: 237763 - DNA, 103 bp, Artificial Sequence
  Synthetic Polynucleotide
taatacgactcactataggggatggagaaccttctaaagtggtggtgccaaacagaggagatggcacatgcactttagaaacctggcggcagcgcaaaagatg

SEQ ID NO: 237764 - DNA, 103 bp, Artificial Sequence
  Synthetic Polynucleotide
taatacgactcactatagggacaaggcacagatggagaaccttctaaagtaacagaggagaactttaatgggttctccaaacctggcggcagcgcaaaagatg

SEQ ID NO: 237765 - DNA, 103 bp, Artificial Sequence
  Synthetic Polynucleotide
taatacgactcactatagggcacagaaaatacaaggcacagatggagaacaacagaggagagttctcatgctgtgccttaacctggcggcagcgcaaaagatg

SEQ ID NO: 237766 - DNA, 103 bp, Artificial Sequence
  Synthetic Polynucleotide
taatacgactcactatagggaaatgttcttcacagaaaatacaaggcacaaacagaggagatgtgccatgtattttctgaacctggcggcagcgcaaaagatg

SEQ ID NO: 237767 - DNA, 103 bp, Artificial Sequence
  Synthetic Polynucleotide
taatacgactcactatagggagccacaggaaaatgttcttcacagaaaataacagaggagaattttcatggaagaacataacctggcggcagcgcaaaagatg

SEQ ID NO: 237768 - DNA, 103 bp, Artificial Sequence
  Synthetic Polynucleotide
taatacgactcactataggggcattcgggcgacagccccctgggtcttggaacagaggagaccaagaatgagggggctgaacctggcggcagcgcaaaagatg

SEQ ID NO: 237769 - DNA, 103 bp, Artificial Sequence
  Synthetic Polynucleotide
taatacgactcactatagggtgtcttgttcagccacaggaaaatgttcttaacagaggagaaagaacatgttcctgtggaacctggcggcagcgcaaaagatg

SEQ ID NO: 237770 - DNA, 103 bp, Artificial Sequence
  Synthetic Polynucleotide
taatacgactcactatagggttcagaagtttgtcttgttcagccacaggaaacagaggagatcctgtatgtgaacaagaaacctggcggcagcgcaaaagatg

SEQ ID NO: 237771 - DNA, 103 bp, Artificial Sequence
  Synthetic Polynucleotide
taatacgactcactatagggaatcatgtgcttcagaagtttgtcttgttcaacagaggagagaacaaatgaaacttctgaacctggcggcagcgcaaaagatg

SEQ ID NO: 237772 - DNA, 103 bp, Artificial Sequence
  Synthetic Polynucleotide
taatacgactcactatagggtatgctcaataatcatgtgcttcagaagttaacagaggagaaacttcatgagcacatgaaacctggcggcagcgcaaaagatg

SEQ ID NO: 237773 - DNA, 103 bp, Artificial Sequence
  Synthetic Polynucleotide
taatacgactcactatagggatgacaatcttatgctcaataatcatgtgcaacagaggagagcacatatgtattgagcaaacctggcggcagcgcaaaagatg

SEQ ID NO: 237774 - DNA, 103 bp, Artificial Sequence
  Synthetic Polynucleotide
taatacgactcactataggggacatcagctatgacaatcttatgctcaataacagaggagaattgagatgaagattgtcaacctggcggcagcgcaaaagatg

SEQ ID NO: 237775 - DNA, 103 bp, Artificial Sequence
  Synthetic Polynucleotide
taatacgactcactatagggcaaccaacttgacatcagctatgacaatctaacagaggagaagattgatgtagctgatgaacctggcggcagcgcaaaagatg

SEQ ID NO: 237776 - DNA, 103 bp, Artificial Sequence
  Synthetic Polynucleotide
taatacgactcactatagggtggaaatcagcaaccaacttgacatcagctaacagaggagaagctgaatgcaagttggtaacctggcggcagcgcaaaagatg

SEQ ID NO: 237777 - DNA, 103 bp, Artificial Sequence
  Synthetic Polynucleotide
taatacgactcactatagggaatgtacctttggaaatcagcaaccaacttaacagaggagaaagttgatggctgatttcaacctggcggcagcgcaaaagatg

SEQ ID NO: 237778 - DNA, 103 bp, Artificial Sequence
  Synthetic Polynucleotide
taatacgactcactatagggtccaatataaaatgtacctttggaaatcagaacagaggagactgattatgaaaggtacaaacctggcggcagcgcaaaagatg

SEQ ID NO: 237779 - DNA, 103 bp, Artificial Sequence
  Synthetic Polynucleotide
taatacgactcactatagggcggtcttcctgcattcgggcgacagcccccaacagaggagagggggcatgcgcccgaataacctggcggcagcgcaaaagatg

SEQ ID NO: 237780 - DNA, 103 bp, Artificial Sequence
  Synthetic Polynucleotide
taatacgactcactatagggaaccttttcctccaatataaaatgtaccttaacagaggagaaaggtaatgtttatattgaacctggcggcagcgcaaaagatg

SEQ ID NO: 237781 - DNA, 103 bp, Artificial Sequence
  Synthetic Polynucleotide
taatacgactcactatagggctgttcagtgaaccttttcctccaatataaaacagaggagattatatatgaggaaaaggaacctggcggcagcgcaaaagatg

SEQ ID NO: 237782 - DNA, 103 bp, Artificial Sequence
  Synthetic Polynucleotide
taatacgactcactatagggctgtgatgggctgttcagtgaaccttttccaacagaggagaggaaaaatgtcactgaacaacctggcggcagcgcaaaagatg

SEQ ID NO: 237783 - DNA, 103 bp, Artificial Sequence
  Synthetic Polynucleotide
taatacgactcactatagggctacaaaaatctgtgatgggctgttcagtgaacagaggagacactgaatggcccatcacaacctggcggcagcgcaaaagatg

SEQ ID NO: 237784 - DNA, 103 bp, Artificial Sequence
  Synthetic Polynucleotide
taatacgactcactatagggtcttattacactacaaaaatctgtgatgggaacagaggagacccatcatggatttttgtaacctggcggcagcgcaaaagatg

SEQ ID NO: 237785 - DNA, 103 bp, Artificial Sequence
  Synthetic Polynucleotide
taatacgactcactatagggtggaattaattcttattacactacaaaaataacagaggagaatttttatggtgtaataaaacctggcggcagcgcaaaagatg

SEQ ID NO: 237786 - DNA, 103 bp, Artificial Sequence
  Synthetic Polynucleotide
taatacgactcactatagggaatggagcagtggaattaattcttattacaaacagaggagatgtaatatgaattaattcaacctggcggcagcgcaaaagatg

SEQ ID NO: 237787 - DNA, 103 bp, Artificial Sequence
  Synthetic Polynucleotide
taatacgactcactatagggttgttcttcaaatggagcagtggaattaataacagaggagaattaatatgactgctccaaacctggcggcagcgcaaaagatg

SEQ ID NO: 237788 - DNA, 103 bp, Artificial Sequence
  Synthetic Polynucleotide
taatacgactcactatagggaataattctcttgttcttcaaatggagcagaacagaggagactgctcatgttgaagaacaacctggcggcagcgcaaaagatg

SEQ ID NO: 237789 - DNA, 103 bp, Artificial Sequence
  Synthetic Polynucleotide
taatacgactcactatagggcataacaaaaaataattctcttgttcttcaaacagaggagatgaagaatgagagaattaaacctggcggcagcgcaaaagatg

SEQ ID NO: 237790 - DNA, 103 bp, Artificial Sequence
  Synthetic Polynucleotide
taatacgactcactataggggctcccatcacggtcttcctgcattcgggcaacagaggagagcccgaatgcaggaagacaacctggcggcagcgcaaaagatg

SEQ ID NO: 237791 - DNA, 103 bp, Artificial Sequence
  Synthetic Polynucleotide
taatacgactcactatagggtaaaacgtcacataacaaaaaataattctcaacagaggagagagaatatgtttttgttaaacctggcggcagcgcaaaagatg

SEQ ID NO: 237792 - DNA, 103 bp, Artificial Sequence
  Synthetic Polynucleotide
taatacgactcactatagggtatcttctggtaaaacgtcacataacaaaaaacagaggagattttgtatggtgacgtttaacctggcggcagcgcaaaagatg

SEQ ID NO: 237793 - DNA, 103 bp, Artificial Sequence
  Synthetic Polynucleotide
taatacgactcactatagggctaagaattctatcttctggtaaaacgtcaaacagaggagatgacgtatgaccagaagaaacctggcggcagcgcaaaagatg

SEQ ID NO: 237794 - DNA, 103 bp, Artificial Sequence
  Synthetic Polynucleotide
taatacgactcactatagggaagctcttctctaagaattctatcttctggaacagaggagaccagaaatgagaattcttaacctggcggcagcgcaaaagatg

SEQ ID NO: 237795 - DNA, 103 bp, Artificial Sequence
  Synthetic Polynucleotide
taatacgactcactatagggtctgtttctgaagctcttctctaagaattcaacagaggagagaattcatggagaagagcaacctggcggcagcgcaaaagatg

SEQ ID NO: 237796 - DNA, 103 bp, Artificial Sequence
  Synthetic Polynucleotide
taatacgactcactatagggtctctcagtctctgtttctgaagctcttctaacagaggagaagaagaatgtcagaaacaaacctggcggcagcgcaaaagatg

SEQ ID NO: 237797 - DNA, 103 bp, Artificial Sequence
  Synthetic Polynucleotide
taatacgactcactatagggttccagaatttctctcagtctctgtttctgaacagaggagacagaaaatgagactgagaaacctggcggcagcgcaaaagatg

SEQ ID NO: 237798 - DNA, 103 bp, Artificial Sequence
  Synthetic Polynucleotide
taatacgactcactataggggctgctgttgttccagaatttctctcagtcaacagaggagagactgaatgaaattctggaacctggcggcagcgcaaaagatg

SEQ ID NO: 237799 - DNA, 103 bp, Artificial Sequence
  Synthetic Polynucleotide
taatacgactcactatagggtttcgttcttgctgctgttgttccagaattaacagaggagaaattctatgacaacagcaaacctggcggcagcgcaaaagatg

SEQ ID NO: 237800 - DNA, 103 bp, Artificial Sequence
  Synthetic Polynucleotide
taatacgactcactatagggattggtatcatttcgttcttgctgctgttgaacagaggagacaacagatgcaagaacgaaacctggcggcagcgcaaaagatg

SEQ ID NO: 237801 - DNA, 103 bp, Artificial Sequence
  Synthetic Polynucleotide
taatacgactcactatagggctgtgctgcagctcccatcacggtcttcctaacagaggagaaggaagatggtgatgggaaacctggcggcagcgcaaaagatg

SEQ ID NO: 237802 - DNA, 103 bp, Artificial Sequence
  Synthetic Polynucleotide
taatacgactcactatagggcgccatgaaaattggtatcatttcgttcttaacagaggagaaagaacatgatgataccaaacctggcggcagcgcaaaagatg

SEQ ID NO: 237803 - DNA, 103 bp, Artificial Sequence
  Synthetic Polynucleotide
taatacgactcactatagggaacatacaaacgccatgaaaattggtatcaaacagaggagatgatacatgttttcatggaacctggcggcagcgcaaaagatg

SEQ ID NO: 237804 - DNA, 103 bp, Artificial Sequence
  Synthetic Polynucleotide
taatacgactcactatagggttcattgcaaaacatacaaacgccatgaaaaacagaggagatttcatatggtttgtatgaacctggcggcagcgcaaaagatg

SEQ ID NO: 237805 - DNA, 103 bp, Artificial Sequence
  Synthetic Polynucleotide
taatacgactcactatagggcaaggaattcttcattgcaaaacatacaaaaacagaggagatttgtaatgtttgcaatgaacctggcggcagcgcaaaagatg

SEQ ID NO: 237806 - DNA, 103 bp, Artificial Sequence
  Synthetic Polynucleotide
taatacgactcactataggggatctgtttccaaggaattcttcattgcaaaacagaggagattgcaaatgagaattcctaacctggcggcagcgcaaaagatg

SEQ ID NO: 237807 - DNA, 103 bp, Artificial Sequence
  Synthetic Polynucleotide
taatacgactcactatagggcaaaataacagatctgtttccaaggaattcaacagaggagagaattcatgggaaacagaaacctggcggcagcgcaaaagatg

SEQ ID NO: 237808 - DNA, 103 bp, Artificial Sequence
  Synthetic Polynucleotide
taatacgactcactatagggccatgtggttcaaaataacagatctgtttcaacagaggagagaaacaatgctgttatttaacctggcggcagcgcaaaagatg

SEQ ID NO: 237809 - DNA, 103 bp, Artificial Sequence
  Synthetic Polynucleotide
taatacgactcactatagggtgttctctggccatgtggttcaaaataacaaacagaggagatgttatatggaaccacataacctggcggcagcgcaaaagatg

SEQ ID NO: 237810 - DNA, 103 bp, Artificial Sequence
  Synthetic Polynucleotide
taatacgactcactataggggttgaaagcatgttctctggccatgtggttaacagaggagaaaccacatggccagagaaaacctggcggcagcgcaaaagatg

SEQ ID NO: 237811 - DNA, 103 bp, Artificial Sequence
  Synthetic Polynucleotide
taatacgactcactataggggcaatccaatgttgaaagcatgttctctggaacagaggagaccagagatgatgctttcaaacctggcggcagcgcaaaagatg

SEQ ID NO: 237812 - DNA, 103 bp, Artificial Sequence
  Synthetic Polynucleotide
taatacgactcactatagggacacccccgactgtgctgcagctcccatcaaacagaggagatgatggatgctgcagcacaacctggcggcagcgcaaaagatg

SEQ ID NO: 237813 - DNA, 103 bp, Artificial Sequence
  Synthetic Polynucleotide
taatacgactcactatagggatgttgtctggcaatccaatgttgaaagcaaacagaggagatgctttatgcattggattaacctggcggcagcgcaaaagatg

SEQ ID NO: 237814 - DNA, 103 bp, Artificial Sequence
  Synthetic Polynucleotide
taatacgactcactataggggcagtttacaatgttgtctggcaatccaataacagaggagaattggaatgccagacaacaacctggcggcagcgcaaaagatg

SEQ ID NO: 237815 - DNA, 103 bp, Artificial Sequence
  Synthetic Polynucleotide
taatacgactcactatagggaaaattcattgcagtttacaatgttgtctgaacagaggagacagacaatgttgtaaactaacctggcggcagcgcaaaagatg

SEQ ID NO: 237816 - DNA, 103 bp, Artificial Sequence
  Synthetic Polynucleotide
taatacgactcactatagggaatgtacacaaaaattcattgcagtttacaaacagaggagatgtaaaatgcaatgaattaacctggcggcagcgcaaaagatg

SEQ ID NO: 237817 - DNA, 103 bp, Artificial Sequence
  Synthetic Polynucleotide
taatacgactcactatagggctttttctgtaatgtacacaaaaattcattaacagaggagaaatgaaatgttgtgtacaaacctggcggcagcgcaaaagatg

SEQ ID NO: 237818 - DNA, 103 bp, Artificial Sequence
  Synthetic Polynucleotide
taatacgactcactatagggaattgtcaagctttttctgtaatgtacacaaacagaggagatgtgtaatgtacagaaaaaacctggcggcagcgcaaaagatg

SEQ ID NO: 237819 - DNA, 103 bp, Artificial Sequence
  Synthetic Polynucleotide
taatacgactcactatagggaagcactgcaaattgtcaagctttttctgtaacagaggagaacagaaatggcttgacaaaacctggcggcagcgcaaaagatg

SEQ ID NO: 237820 - DNA, 103 bp, Artificial Sequence
  Synthetic Polynucleotide
taatacgactcactatagggctcacagtacaagcactgcaaattgtcaagaacagaggagacttgacatgttgcagtgcaacctggcggcagcgcaaaagatg

SEQ ID NO: 237821 - DNA, 103 bp, Artificial Sequence
  Synthetic Polynucleotide
taatacgactcactatagggtgaaggtcttctcacagtacaagcactgcaaacagaggagatgcagtatgtgtactgtgaacctggcggcagcgcaaaagatg

SEQ ID NO: 237822 - DNA, 103 bp, Artificial Sequence
  Synthetic Polynucleotide
taatacgactcactatagggtttttgtccctgaaggtcttctcacagtacaacagaggagagtactgatggaagaccttaacctggcggcagcgcaaaagatg

SEQ ID NO: 237823 - DNA, 103 bp, Artificial Sequence
  Synthetic Polynucleotide
taatacgactcactatagggcccataacctacacccccgactgtgctgcaaacagaggagatgcagcatggtcgggggtaacctggcggcagcgcaaaagatg

SEQ ID NO: 237824 - DNA, 103 bp, Artificial Sequence
  Synthetic Polynucleotide
taatacgactcactatagggtttaagtgtatttttgtccctgaaggtcttaacagaggagaaagaccatgagggacaaaaacctggcggcagcgcaaaagatg

SEQ ID NO: 237825 - DNA, 103 bp, Artificial Sequence
  Synthetic Polynucleotide
taatacgactcactatagggtcatgtgatctttaagtgtatttttgtcccaacagaggagagggacaatgatacacttaaacctggcggcagcgcaaaagatg

SEQ ID NO: 237826 - DNA, 103 bp, Artificial Sequence
  Synthetic Polynucleotide
taatacgactcactatagggtgttttttcctcatgtgatctttaagtgtaaacagaggagatacactatgagatcacataacctggcggcagcgcaaaagatg

SEQ ID NO: 237827 - DNA, 103 bp, Artificial Sequence
  Synthetic Polynucleotide
taatacgactcactatagggcttacgatgctgttttttcctcatgtgatcaacagaggagagatcacatgaggaaaaaaaacctggcggcagcgcaaaagatg

SEQ ID NO: 237828 - DNA, 103 bp, Artificial Sequence
  Synthetic Polynucleotide
taatacgactcactatagggtaggattaatcttacgatgctgttttttccaacagaggagaggaaaaatgagcatcgtaaacctggcggcagcgcaaaagatg

SEQ ID NO: 237829 - DNA, 103 bp, Artificial Sequence
  Synthetic Polynucleotide
taatacgactcactatagggtctctgttcttaggattaatcttacgatgcaacagaggagagcatcgatggattaatccaacctggcggcagcgcaaaagatg

SEQ ID NO: 237830 - DNA, 103 bp, Artificial Sequence
  Synthetic Polynucleotide
taatacgactcactatagggtctgtcatattctctgttcttaggattaataacagaggagaattaatatgaagaacagaaacctggcggcagcgcaaaagatg

SEQ ID NO: 237831 - DNA, 103 bp, Artificial Sequence
  Synthetic Polynucleotide
taatacgactcactatagggtgacataaaatctgtcatattctctgttctaacagaggagaagaacaatgaatatgacaaacctggcggcagcgcaaaagatg

SEQ ID NO: 237832 - DNA, 103 bp, Artificial Sequence
  Synthetic Polynucleotide
taatacgactcactatagggaaataattgatgacataaaatctgtcatataacagaggagaatatgaatgattttatgtaacctggcggcagcgcaaaagatg

SEQ ID NO: 237833 - DNA, 103 bp, Artificial Sequence
  Synthetic Polynucleotide
taatacgactcactatagggtccaagttccaaataattgatgacataaaaaacagaggagattttatatgatcaattataacctggcggcagcgcaaaagatg

SEQ ID NO: 237834 - DNA, 103 bp, Artificial Sequence
  Synthetic Polynucleotide
taatacgactcactatagggccttactgtccccataacctacacccccgaaacagaggagatcggggatgtaggttatgaacctggcggcagcgcaaaagatg

SEQ ID NO: 237835 - DNA, 103 bp, Artificial Sequence
  Synthetic Polynucleotide
taatacgactcactatagggcccacgattttccaagttccaaataattgaaacagaggagatcaattatgtggaacttgaacctggcggcagcgcaaaagatg

SEQ ID NO: 237836 - DNA, 103 bp, Artificial Sequence
  Synthetic Polynucleotide
taatacgactcactatagggtgaacttcttcccacgattttccaagttccaacagaggagaggaactatgaaaatcgtgaacctggcggcagcgcaaaagatg

SEQ ID NO: 237837 - DNA, 103 bp, Artificial Sequence
  Synthetic Polynucleotide
taatacgactcactatagggatcttccaactgaacttcttcccacgatttaacagaggagaaaatcgatggaagaagttaacctggcggcagcgcaaaagatg

SEQ ID NO: 237838 - DNA, 103 bp, Artificial Sequence
  Synthetic Polynucleotide
taatacgactcactatagggactcccgatcatcttccaactgaacttcttaacagaggagaaagaagatgagttggaagaacctggcggcagcgcaaaagatg

SEQ ID NO: 237839 - DNA, 103 bp, Artificial Sequence
  Synthetic Polynucleotide
taatacgactcactatagggtggtccagcaactcccgatcatcttccaacaacagaggagagttggaatgtgatcgggaaacctggcggcagcgcaaaagatg

SEQ ID NO: 237840 - DNA, 103 bp, Artificial Sequence
  Synthetic Polynucleotide
taatacgactcactatagggatcttcctgatggtccagcaactcccgatcaacagaggagagatcggatgttgctggacaacctggcggcagcgcaaaagatg

SEQ ID NO: 237841 - DNA, 103 bp, Artificial Sequence
  Synthetic Polynucleotide
taatacgactcactatagggcagaccagtcatcttcctgatggtccagcaaacagaggagatgctggatgatcaggaagaacctggcggcagcgcaaaagatg

SEQ ID NO: 237842 - DNA, 103 bp, Artificial Sequence
  Synthetic Polynucleotide
taatacgactcactatagggtcttcccaatcagaccagtcatcttcctgaaacagaggagatcaggaatgtgactggtcaacctggcggcagcgcaaaagatg

SEQ ID NO: 237843 - DNA, 103 bp, Artificial Sequence
  Synthetic Polynucleotide
taatacgactcactatagggggcagggtgttcttcccaatcagaccagtcaacagaggagagactggatggattgggaaaacctggcggcagcgcaaaagatg

SEQ ID NO: 237844 - DNA, 103 bp, Artificial Sequence
  Synthetic Polynucleotide
taatacgactcactatagggagactgcagaggcagggtgttcttcccaataacagaggagaattgggatgaacaccctgaacctggcggcagcgcaaaagatg

SEQ ID NO: 237845 - DNA, 103 bp, Artificial Sequence
  Synthetic Polynucleotide
taatacgactcactatagggaggatacaatccttactgtccccataacctaacagaggagaaggttaatgggacagtaaaacctggcggcagcgcaaaagatg

SEQ ID NO: 237846 - DNA, 103 bp, Artificial Sequence
  Synthetic Polynucleotide
taatacgactcactatagggcaaaataagcagactgcagaggcagggtgtaacagaggagaacacccatgctctgcagtaacctggcggcagcgcaaaagatg

SEQ ID NO: 237847 - DNA, 103 bp, Artificial Sequence
  Synthetic Polynucleotide
taatacgactcactatagggttgcttttcacaaaataagcagactgcagaaacagaggagatctgcaatgtgcttatttaacctggcggcagcgcaaaagatg

SEQ ID NO: 237848 - DNA, 103 bp, Artificial Sequence
  Synthetic Polynucleotide
taatacgactcactatagggttgtttctgcttgcttttcacaaaataagcaacagaggagagcttatatggtgaaaagcaacctggcggcagcgcaaaagatg

SEQ ID NO: 237849 - DNA, 103 bp, Artificial Sequence
  Synthetic Polynucleotide
taatacgactcactatagggaacttctcaattgtttctgcttgcttttcaaacagaggagatgaaaaatgagcagaaacaacctggcggcagcgcaaaagatg

SEQ ID NO: 237850 - DNA, 103 bp, Artificial Sequence
  Synthetic Polynucleotide
taatacgactcactataggggtggacatacaacttctcaattgtttctgcaacagaggagagcagaaatgattgagaagaacctggcggcagcgcaaaagatg

SEQ ID NO: 237851 - DNA, 103 bp, Artificial Sequence
  Synthetic Polynucleotide
taatacgactcactatagggcatcctccatgtggacatacaacttctcaaaacagaggagattgagaatgtgtatgtccaacctggcggcagcgcaaaagatg

SEQ ID NO: 237852 - DNA, 103 bp, Artificial Sequence
  Synthetic Polynucleotide
taatacgactcactatagggaattcgtgtgcatcctccatgtggacatacaacagaggagagtatgtatgcatggaggaaacctggcggcagcgcaaaagatg

SEQ ID NO: 237853 - DNA, 103 bp, Artificial Sequence
  Synthetic Polynucleotide
taatacgactcactataggggagaagatcaaattcgtgtgcatcctccataacagaggagaatggagatggcacacgaaaacctggcggcagcgcaaaagatg

SEQ ID NO: 237854 - DNA, 103 bp, Artificial Sequence
  Synthetic Polynucleotide
taatacgactcactatagggactttattttgagaagatcaaattcgtgtgaacagaggagacacacgatgttgatcttcaacctggcggcagcgcaaaagatg

SEQ ID NO: 237855 - DNA, 103 bp, Artificial Sequence
  Synthetic Polynucleotide
taatacgactcactatagggccaagttctgactttattttgagaagatcaaacagaggagatgatctatgcaaaataaaaacctggcggcagcgcaaaagatg

SEQ ID NO: 237856 - DNA, 103 bp, Artificial Sequence
  Synthetic Polynucleotide
taatacgactcactataggggccactcaggaacccactgccgattttcataacagaggagaatgaaaatgggcagtgggaacctggcggcagcgcaaaagatg

SEQ ID NO: 237857 - DNA, 103 bp, Artificial Sequence
  Synthetic Polynucleotide
taatacgactcactatagggtgccctcctgccgctgctgccgccgccgccaacagaggagaggcggcatgggcagcagcaacctggcggcagcgcaaaagatg

SEQ ID NO: 237858 - DNA, 103 bp, Artificial Sequence
  Synthetic Polynucleotide
taatacgactcactatagggactatgtgtcctcttgtgtctctccatatgaacagaggagacatatgatgagacacaagaacctggcggcagcgcaaaagatg

SEQ ID NO: 237859 - DNA, 103 bp, Artificial Sequence
  Synthetic Polynucleotide
taatacgactcactataggggcttttctccactatgtgtcctcttgtgtcaacagaggagagacacaatgggacacataaacctggcggcagcgcaaaagatg

SEQ ID NO: 237860 - DNA, 103 bp, Artificial Sequence
  Synthetic Polynucleotide
taatacgactcactatagggcacttatatggcttttctccactatgtgtcaacagaggagagacacaatgtggagaaaaaacctggcggcagcgcaaaagatg

SEQ ID NO: 237861 - DNA, 103 bp, Artificial Sequence
  Synthetic Polynucleotide
taatacgactcactataggggcaagtgtcacacttatatggcttttctccaacagaggagaggagaaatgccatataagaacctggcggcagcgcaaaagatg

SEQ ID NO: 237862 - DNA, 103 bp, Artificial Sequence
  Synthetic Polynucleotide
taatacgactcactatagggaatactgttggcaagtgtcacacttatatgaacagaggagacatataatggtgacacttaacctggcggcagcgcaaaagatg

SEQ ID NO: 237863 - DNA, 103 bp, Artificial Sequence
  Synthetic Polynucleotide
taatacgactcactataggggtccttgaaaaatactgttggcaagtgtcaaacagaggagatgacacatgccaacagtaaacctggcggcagcgcaaaagatg

SEQ ID NO: 237864 - DNA, 103 bp, Artificial Sequence
  Synthetic Polynucleotide
taatacgactcactatagggcaatctatcagtccttgaaaaatactgttgaacagaggagacaacagatgttttcaaggaacctggcggcagcgcaaaagatg

SEQ ID NO: 237865 - DNA, 103 bp, Artificial Sequence
  Synthetic Polynucleotide
taatacgactcactatagggtgtgcttcaacaatctatcagtccttgaaaaacagaggagatttcaaatgctgatagataacctggcggcagcgcaaaagatg

SEQ ID NO: 237866 - DNA, 103 bp, Artificial Sequence
  Synthetic Polynucleotide
taatacgactcactatagggcatgtgcgcctgtgcttcaacaatctatcaaacagaggagatgatagatggttgaagcaaacctggcggcagcgcaaaagatg

SEQ ID NO: 237867 - DNA, 103 bp, Artificial Sequence
  Synthetic Polynucleotide
taatacgactcactataggggacttcaccacatgtgcgcctgtgcttcaaaacagaggagattgaagatgaggcgcacaaacctggcggcagcgcaaaagatg

SEQ ID NO: 237868 - DNA, 103 bp, Artificial Sequence
  Synthetic Polynucleotide
taatacgactcactataggggttccatctctgccctcctgccgctgctgcaacagaggagagcagcaatggcaggagggaacctggcggcagcgcaaaagatg

SEQ ID NO: 237869 - DNA, 103 bp, Artificial Sequence
  Synthetic Polynucleotide
taatacgactcactatagggctttaactatgacttcaccacatgtgcgccaacagaggagaggcgcaatggtggtgaagaacctggcggcagcgcaaaagatg

SEQ ID NO: 237870 - DNA, 103 bp, Artificial Sequence
  Synthetic Polynucleotide
taatacgactcactatagggctagtggctcctttaactatgacttcaccaaacagaggagatggtgaatgcatagttaaaacctggcggcagcgcaaaagatg

SEQ ID NO: 237871 - DNA, 103 bp, Artificial Sequence
  Synthetic Polynucleotide
taatacgactcactatagggaggttctgcactagtggctcctttaactataacagaggagaatagttatgggagccactaacctggcggcagcgcaaaagatg

SEQ ID NO: 237872 - DNA, 103 bp, Artificial Sequence
  Synthetic Polynucleotide
taatacgactcactatagggttgatgacccaggttctgcactagtggctcaacagaggagagagccaatggtgcagaacaacctggcggcagcgcaaaagatg

SEQ ID NO: 237873 - DNA, 103 bp, Artificial Sequence
  Synthetic Polynucleotide
taatacgactcactatagggttggtatggtttgatgacccaggttctgcaaacagaggagatgcagaatgtgggtcatcaacctggcggcagcgcaaaagatg

SEQ ID NO: 237874 - DNA, 103 bp, Artificial Sequence
  Synthetic Polynucleotide
taatacgactcactatagggattacccatattggtatggtttgatgacccaacagaggagagggtcaatgaaccataccaacctggcggcagcgcaaaagatg

SEQ ID NO: 237875 - DNA, 103 bp, Artificial Sequence
  Synthetic Polynucleotide
taatacgactcactatagggacacagccagattacccatattggtatggtaacagaggagaaccataatgatatgggtaaacctggcggcagcgcaaaagatg

SEQ ID NO: 237876 - DNA, 103 bp, Artificial Sequence
  Synthetic Polynucleotide
taatacgactcactatagggccctgagacaacacagccagattacccataaacagaggagatatgggatgtctggctgtaacctggcggcagcgcaaaagatg

SEQ ID NO: 237877 - DNA, 103 bp, Artificial Sequence
  Synthetic Polynucleotide
taatacgactcactatagggacttgtatttccctgagacaacacagccagaacagaggagactggctatgttgtctcagaacctggcggcagcgcaaaagatg

SEQ ID NO: 237878 - DNA, 103 bp, Artificial Sequence
  Synthetic Polynucleotide
taatacgactcactatagggtccttgaagaacttgtatttccctgagacaaacagaggagatgtctcatggaaatacaaaacctggcggcagcgcaaaagatg

SEQ ID NO: 237879 - DNA, 103 bp, Artificial Sequence
  Synthetic Polynucleotide
taatacgactcactatagggggaaaggtgggttccatctctgccctcctgaacagaggagacaggagatgagagatggaaacctggcggcagcgcaaaagatg

SEQ ID NO: 237880 - DNA, 103 bp, Artificial Sequence
  Synthetic Polynucleotide
taatacgactcactatagggtttgtttttctccttgaagaacttgtatttaacagaggagaaaatacatgttcttcaagaacctggcggcagcgcaaaagatg

SEQ ID NO: 237881 - DNA, 103 bp, Artificial Sequence
  Synthetic Polynucleotide
taatacgactcactataggggctttttgactttgtttttctccttgaagaaacagaggagatcttcaatgagaaaaacaaacctggcggcagcgcaaaagatg

SEQ ID NO: 237882 - DNA, 103 bp, Artificial Sequence
  Synthetic Polynucleotide
taatacgactcactatagggcaatagctatgctttttgactttgtttttcaacagaggagagaaaaaatgagtcaaaaaaacctggcggcagcgcaaaagatg

SEQ ID NO: 237883 - DNA, 103 bp, Artificial Sequence
  Synthetic Polynucleotide
taatacgactcactatagggtccttattttcaatagctatgctttttgacaacagaggagagtcaaaatgcatagctataacctggcggcagcgcaaaagatg

SEQ ID NO: 237884 - DNA, 103 bp, Artificial Sequence
  Synthetic Polynucleotide
taatacgactcactatagggggtcttctgttccttattttcaatagctataacagaggagaatagctatggaaaataagaacctggcggcagcgcaaaagatg

SEQ ID NO: 237885 - DNA, 103 bp, Artificial Sequence
  Synthetic Polynucleotide
taatacgactcactatagggttgttttaccggtcttctgttccttattttaacagaggagaaaaataatgaacagaagaaacctggcggcagcgcaaaagatg

SEQ ID NO: 237886 - DNA, 103 bp, Artificial Sequence
  Synthetic Polynucleotide
taatacgactcactatagggtgcgattcatttgttttaccggtcttctgtaacagaggagaacagaaatgcggtaaaacaacctggcggcagcgcaaaagatg

SEQ ID NO: 237887 - DNA, 103 bp, Artificial Sequence
  Synthetic Polynucleotide
taatacgactcactatagggatttgaaatttgcgattcatttgttttaccaacagaggagaggtaaaatgaatgaatcgaacctggcggcagcgcaaaagatg

SEQ ID NO: 237888 - DNA, 103 bp, Artificial Sequence
  Synthetic Polynucleotide
taatacgactcactatagggtgtttatattatttgaaatttgcgattcataacagaggagaatgaatatgaaatttcaaaacctggcggcagcgcaaaagatg

SEQ ID NO: 237889 - DNA, 103 bp, Artificial Sequence
  Synthetic Polynucleotide
taatacgactcactatagggtaactctgcatgtttatattatttgaaattaacagaggagaaatttcatgtaatataaaaacctggcggcagcgcaaaagatg

SEQ ID NO: 237890 - DNA, 103 bp, Artificial Sequence
  Synthetic Polynucleotide
taatacgactcactatagggcataccctggggaaaggtgggttccatctcaacagaggagagagatgatgcccacctttaacctggcggcagcgcaaaagatg

SEQ ID NO: 237891 - DNA, 103 bp, Artificial Sequence
  Synthetic Polynucleotide
taatacgactcactatagggttctactgagtaactctgcatgtttatattaacagaggagaaatataatgatgcagagtaacctggcggcagcgcaaaagatg

SEQ ID NO: 237892 - DNA, 103 bp, Artificial Sequence
  Synthetic Polynucleotide
taatacgactcactatagggcggtaggcatttctactgagtaactctgcaaacagaggagatgcagaatgactcagtagaacctggcggcagcgcaaaagatg

SEQ ID NO: 237893 - DNA, 103 bp, Artificial Sequence
  Synthetic Polynucleotide
taatacgactcactatagggctggaagacacggtaggcatttctactgagaacagaggagactcagtatgaatgcctacaacctggcggcagcgcaaaagatg

SEQ ID NO: 237894 - DNA, 103 bp, Artificial Sequence
  Synthetic Polynucleotide
taatacgactcactatagggtatgcctccactggaagacacggtaggcataacagaggagaatgcctatggtgtcttccaacctggcggcagcgcaaaagatg

SEQ ID NO: 237895 - DNA, 103 bp, Artificial Sequence
  Synthetic Polynucleotide
taatacgactcactatagggcagtgccaattatgcctccactggaagacaaacagaggagatgtcttatggtggaggcaaacctggcggcagcgcaaaagatg

SEQ ID NO: 237896 - DNA, 103 bp, Artificial Sequence
  Synthetic Polynucleotide
taatacgactcactatagggtcatctattccagtgccaattatgcctccaaacagaggagatggaggatgaattggcacaacctggcggcagcgcaaaagatg

SEQ ID NO: 237897 - DNA, 103 bp, Artificial Sequence
  Synthetic Polynucleotide
taatacgactcactatagggcttctgcagttcatctattccagtgccaataacagaggagaattggcatgggaatagataacctggcggcagcgcaaaagatg

SEQ ID NO: 237898 - DNA, 103 bp, Artificial Sequence
  Synthetic Polynucleotide
taatacgactcactatagggttggcaccctcttctgcagttcatctattcaacagaggagagaatagatgaactgcagaaacctggcggcagcgcaaaagatg

SEQ ID NO: 237899 - DNA, 103 bp, Artificial Sequence
  Synthetic Polynucleotide
taatacgactcactatagggaagatcaattttggcaccctcttctgcagtaacagaggagaactgcaatggagggtgccaacctggcggcagcgcaaaagatg

SEQ ID NO: 237900 - DNA, 103 bp, Artificial Sequence
  Synthetic Polynucleotide
taatacgactcactatagggtcctttcttaaagatcaattttggcaccctaacagaggagaagggtgatgaaattgatcaacctggcggcagcgcaaaagatg

SEQ ID NO: 237901 - DNA, 103 bp, Artificial Sequence
  Synthetic Polynucleotide
taatacgactcactatagggtgaacataaccataccctggggaaaggtggaacagaggagaccacctatgcccagggtaaacctggcggcagcgcaaaagatg

SEQ ID NO: 237902 - DNA, 103 bp, Artificial Sequence
  Synthetic Polynucleotide
taatacgactcactatagggtctttctgcttcctttcttaaagatcaattaacagaggagaaattgaatgttaagaaagaacctggcggcagcgcaaaagatg

SEQ ID NO: 237903 - DNA, 103 bp, Artificial Sequence
  Synthetic Polynucleotide
taatacgactcactatagggttatctgtattctttctgcttcctttcttaaacagaggagataagaaatgaagcagaaaaacctggcggcagcgcaaaagatg

SEQ ID NO: 237904 - DNA, 103 bp, Artificial Sequence
  Synthetic Polynucleotide
taatacgactcactatagggaaggtagtttttatctgtattctttctgctaacagaggagaagcagaatgaatacagataacctggcggcagcgcaaaagatg

SEQ ID NO: 237905 - DNA, 103 bp, Artificial Sequence
  Synthetic Polynucleotide
taatacgactcactatagggacacaaagttaaggtagtttttatctgtataacagaggagaatacagatgaaaactaccaacctggcggcagcgcaaaagatg

SEQ ID NO: 237906 - DNA, 103 bp, Artificial Sequence
  Synthetic Polynucleotide
taatacgactcactatagggggtaatggtgacacaaagttaaggtagtttaacagaggagaaaactaatgtaactttgtaacctggcggcagcgcaaaagatg

SEQ ID NO: 237907 - DNA, 103 bp, Artificial Sequence
  Synthetic Polynucleotide
taatacgactcactatagggtactatgtctggtaatggtgacacaaagttaacagaggagaaactttatgtcaccattaaacctggcggcagcgcaaaagatg

SEQ ID NO: 237908 - DNA, 103 bp, Artificial Sequence
  Synthetic Polynucleotide
taatacgactcactatagggatttctgtcctactatgtctggtaatggtgaacagaggagacaccatatgcagacatagaacctggcggcagcgcaaaagatg

SEQ ID NO: 237909 - DNA, 103 bp, Artificial Sequence
  Synthetic Polynucleotide
taatacgactcactatagggccagacaaggatttctgtcctactatgtctaacagaggagaagacatatgaggacagaaaacctggcggcagcgcaaaagatg

SEQ ID NO: 237910 - DNA, 103 bp, Artificial Sequence
  Synthetic Polynucleotide
taatacgactcactatagggacttggttttccagacaaggatttctgtccaacagaggagaggacagatgtccttgtctaacctggcggcagcgcaaaagatg

SEQ ID NO: 237911 - DNA, 103 bp, Artificial Sequence
  Synthetic Polynucleotide
taatacgactcactatagggcaagtgagccacttggttttccagacaaggaacagaggagaccttgtatggaaaaccaaaacctggcggcagcgcaaaagatg

SEQ ID NO: 237912 - DNA, 103 bp, Artificial Sequence
  Synthetic Polynucleotide
taatacgactcactatagggagacggtggttgaacataaccataccctggaacagaggagaccagggatgggttatgttaacctggcggcagcgcaaaagatg

SEQ ID NO: 237913 - DNA, 103 bp, Artificial Sequence
  Synthetic Polynucleotide
taatacgactcactataggggatactatgccaagtgagccacttggttttaacagaggagaaaaaccatgtggctcactaacctggcggcagcgcaaaagatg

SEQ ID NO: 237914 - DNA, 103 bp, Artificial Sequence
  Synthetic Polynucleotide
taatacgactcactatagggactattatttgatactatgccaagtgagccaacagaggagaggctcaatgggcatagtaaacctggcggcagcgcaaaagatg

SEQ ID NO: 237915 - DNA, 103 bp, Artificial Sequence
  Synthetic Polynucleotide
taatacgactcactatagggtggtctccacactattatttgatactatgcaacagaggagagcatagatgcaaataataaacctggcggcagcgcaaaagatg

SEQ ID NO: 237916 - DNA, 103 bp, Artificial Sequence
  Synthetic Polynucleotide
taatacgactcactatagggagaagaccaatggtctccacactattatttaacagaggagaaaataaatgtgtggagacaacctggcggcagcgcaaaagatg

SEQ ID NO: 237917 - DNA, 103 bp, Artificial Sequence
  Synthetic Polynucleotide
taatacgactcactatagggtgtactttggagaagaccaatggtctccacaacagaggagagtggagatgattggtcttaacctggcggcagcgcaaaagatg

SEQ ID NO: 237918 - DNA, 103 bp, Artificial Sequence
  Synthetic Polynucleotide
taatacgactcactataggggtttgccacttgtactttggagaagaccaaaacagaggagattggtcatgtccaaagtaaacctggcggcagcgcaaaagatg

SEQ ID NO: 237919 - DNA, 103 bp, Artificial Sequence
  Synthetic Polynucleotide
taatacgactcactatagggatctgaccttgtttgccacttgtactttggaacagaggagaccaaagatgaagtggcaaaacctggcggcagcgcaaaagatg

SEQ ID NO: 237920 - DNA, 103 bp, Artificial Sequence
  Synthetic Polynucleotide
taatacgactcactatagggattactacttatctgaccttgtttgccactaacagaggagaagtggcatgcaaggtcagaacctggcggcagcgcaaaagatg

SEQ ID NO: 237921 - DNA, 103 bp, Artificial Sequence
  Synthetic Polynucleotide
taatacgactcactatagggcatcatcataattactacttatctgaccttaacagaggagaaaggtcatgtaagtagtaaacctggcggcagcgcaaaagatg

SEQ ID NO: 237922 - DNA, 103 bp, Artificial Sequence
  Synthetic Polynucleotide
taatacgactcactatagggaactgcatggcatcatcataattactacttaacagaggagaaagtagatgttatgatgaaacctggcggcagcgcaaaagatg

SEQ ID NO: 237923 - DNA, 103 bp, Artificial Sequence
  Synthetic Polynucleotide
taatacgactcactataggggaccgggggaagacggtggttgaacataacaacagaggagagttatgatgaaccaccgtaacctggcggcagcgcaaaagatg

SEQ ID NO: 237924 - DNA, 103 bp, Artificial Sequence
  Synthetic Polynucleotide
taatacgactcactatagggtttctttgaaaactgcatggcatcatcataaacagaggagatatgatatggccatgcagaacctggcggcagcgcaaaagatg

SEQ ID NO: 237925 - DNA, 103 bp, Artificial Sequence
  Synthetic Polynucleotide
taatacgactcactatagggaatatcttcttttctttgaaaactgcatggaacagaggagaccatgcatgtttcaaagaaacctggcggcagcgcaaaagatg

SEQ ID NO: 237926 - DNA, 103 bp, Artificial Sequence
  Synthetic Polynucleotide
taatacgactcactataggggcagttggtaaatatcttcttttctttgaaaacagaggagattcaaaatgaagaagataaacctggcggcagcgcaaaagatg

SEQ ID NO: 237927 - DNA, 103 bp, Artificial Sequence
  Synthetic Polynucleotide
taatacgactcactataggggttgctgctggcagttggtaaatatcttctaacagaggagaagaagaatgttaccaactaacctggcggcagcgcaaaagatg

SEQ ID NO: 237928 - DNA, 103 bp, Artificial Sequence
  Synthetic Polynucleotide
taatacgactcactatagggaaaaggcactgttgctgctggcagttggtaaacagaggagataccaaatgccagcagcaaacctggcggcagcgcaaaagatg

SEQ ID NO: 237929 - DNA, 103 bp, Artificial Sequence
  Synthetic Polynucleotide
taatacgactcactatagggacgtttatagaaaaggcactgttgctgctgaacagaggagacagcagatgcagtgccttaacctggcggcagcgcaaaagatg

SEQ ID NO: 237930 - DNA, 103 bp, Artificial Sequence
  Synthetic Polynucleotide
taatacgactcactatagggcatgtgtcctacgtttatagaaaaggcactaacagaggagaagtgccatgtctataaacaacctggcggcagcgcaaaagatg

SEQ ID NO: 237931 - DNA, 103 bp, Artificial Sequence
  Synthetic Polynucleotide
taatacgactcactataggggttgggagaccatgtgtcctacgtttatagaacagaggagactataaatgtaggacacaaacctggcggcagcgcaaaagatg

SEQ ID NO: 237932 - DNA, 103 bp, Artificial Sequence
  Synthetic Polynucleotide
taatacgactcactatagggatgacagactgttgggagaccatgtgtcctaacagaggagaaggacaatgggtctcccaaacctggcggcagcgcaaaagatg

SEQ ID NO: 237933 - DNA, 103 bp, Artificial Sequence
  Synthetic Polynucleotide
taatacgactcactatagggtgcagactgaatgacagactgttgggagacaacagaggagagtctccatgcagtctgtcaacctggcggcagcgcaaaagatg

SEQ ID NO: 237934 - DNA, 103 bp, Artificial Sequence
  Synthetic Polynucleotide
taatacgactcactatagggtgaagctggtgaccgggggaagacggtggtaacagaggagaaccaccatgttcccccggaacctggcggcagcgcaaaagatg

SEQ ID NO: 237935 - DNA, 103 bp, Artificial Sequence
  Synthetic Polynucleotide
taatacgactcactatagggcactgacacctgcagactgaatgacagactaacagaggagaagtctgatgttcagtctgaacctggcggcagcgcaaaagatg

SEQ ID NO: 237936 - DNA, 103 bp, Artificial Sequence
  Synthetic Polynucleotide
taatacgactcactatagggttgtccaaaacactgacacctgcagactgaaacagaggagatcagtcatgaggtgtcagaacctggcggcagcgcaaaagatg

SEQ ID NO: 237937 - DNA, 103 bp, Artificial Sequence
  Synthetic Polynucleotide
taatacgactcactatagggtggtgcctcattgtccaaaacactgacaccaacagaggagaggtgtcatggttttggacaacctggcggcagcgcaaaagatg

SEQ ID NO: 237938 - DNA, 103 bp, Artificial Sequence
  Synthetic Polynucleotide
taatacgactcactatagggtaagtgacaatggtgcctcattgtccaaaaaacagaggagattttggatgatgaggcacaacctggcggcagcgcaaaagatg

SEQ ID NO: 237939 - DNA, 103 bp, Artificial Sequence
  Synthetic Polynucleotide
taatacgactcactataggggaggagtcaataagtgacaatggtgcctcaaacagaggagatgaggcatgattgtcactaacctggcggcagcgcaaaagatg

SEQ ID NO: 237940 - DNA, 103 bp, Artificial Sequence
  Synthetic Polynucleotide
taatacgactcactatagggatttagagctgaggagtcaataagtgacaaaacagaggagattgtcaatgattgactccaacctggcggcagcgcaaaagatg

SEQ ID NO: 237941 - DNA, 103 bp, Artificial Sequence
  Synthetic Polynucleotide
taatacgactcactatagggtaatttcagcatttagagctgaggagtcaaaacagaggagattgactatgcagctctaaaacctggcggcagcgcaaaagatg

SEQ ID NO: 237942 - DNA, 103 bp, Artificial Sequence
  Synthetic Polynucleotide
taatacgactcactatagggtgacaagatttaatttcagcatttagagctaacagaggagaagctctatgtgctgaaataacctggcggcagcgcaaaagatg

SEQ ID NO: 237943 - DNA, 103 bp, Artificial Sequence
  Synthetic Polynucleotide
taatacgactcactatagggagacttgtcatgacaagatttaatttcagcaacagaggagagctgaaatgaaatcttgtaacctggcggcagcgcaaaagatg

SEQ ID NO: 237944 - DNA, 103 bp, Artificial Sequence
  Synthetic Polynucleotide
taatacgactcactatagggcaggaattccagacttgtcatgacaagattaacagaggagaaatcttatgatgacaagtaacctggcggcagcgcaaaagatg

SEQ ID NO: 237945 - DNA, 103 bp, Artificial Sequence
  Synthetic Polynucleotide
taatacgactcactataggggccggccgggtgaagctggtgaccgggggaaacagaggagatcccccatgcaccagcttaacctggcggcagcgcaaaagatg

SEQ ID NO: 237946 - DNA, 103 bp, Artificial Sequence
  Synthetic Polynucleotide
taatacgactcactatagggaaaacctcatcaggaattccagacttgtcaaacagaggagatgacaaatgtggaattccaacctggcggcagcgcaaaagatg

SEQ ID NO: 237947 - DNA, 103 bp, Artificial Sequence
  Synthetic Polynucleotide
taatacgactcactatagggaatactttgtaaaacctcatcaggaattccaacagaggagaggaattatggatgaggttaacctggcggcagcgcaaaagatg

SEQ ID NO: 237948 - DNA, 103 bp, Artificial Sequence
  Synthetic Polynucleotide
taatacgactcactatagggattgatccaaaatactttgtaaaacctcataacagaggagaatgaggatgtacaaagtaaacctggcggcagcgcaaaagatg

SEQ ID NO: 237949 - DNA, 103 bp, Artificial Sequence
  Synthetic Polynucleotide
taatacgactcactatagggttgttggagtattgatccaaaatactttgtaacagaggagaacaaagatgtttggatcaaacctggcggcagcgcaaaagatg

SEQ ID NO: 237950 - DNA, 103 bp, Artificial Sequence
  Synthetic Polynucleotide
taatacgactcactataggggctttctgatttgttggagtattgatccaaaacagaggagattggatatgtactccaacaacctggcggcagcgcaaaagatg

SEQ ID NO: 237951 - DNA, 103 bp, Artificial Sequence
  Synthetic Polynucleotide
taatacgactcactatagggcctctttctggctttctgatttgttggagtaacagaggagaactccaatgaatcagaaaaacctggcggcagcgcaaaagatg

SEQ ID NO: 237952 - DNA, 103 bp, Artificial Sequence
  Synthetic Polynucleotide
taatacgactcactatagggttgaaaggatcctctttctggctttctgataacagaggagaatcagaatgccagaaagaaacctggcggcagcgcaaaagatg

SEQ ID NO: 237953 - DNA, 103 bp, Artificial Sequence
  Synthetic Polynucleotide
taatacgactcactatagggttctgcaatattgaaaggatcctctttctgaacagaggagacagaaaatggatcctttcaacctggcggcagcgcaaaagatg

SEQ ID NO: 237954 - DNA, 103 bp, Artificial Sequence
  Synthetic Polynucleotide
taatacgactcactatagggccactcgtggttctgcaatattgaaaggataacagaggagaatccttatgatattgcagaacctggcggcagcgcaaaagatg

SEQ ID NO: 237955 - DNA, 103 bp, Artificial Sequence
  Synthetic Polynucleotide
taatacgactcactataggggtgtgtaaatccactcgtggttctgcaataaacagaggagatattgcatgaccacgagtaacctggcggcagcgcaaaagatg

SEQ ID NO: 237956 - DNA, 103 bp, Artificial Sequence
  Synthetic Polynucleotide
taatacgactcactatagggggccgaccccgccggccgggtgaagctggtaacagaggagaaccagcatgacccggccgaacctggcggcagcgcaaaagatg

SEQ ID NO: 237957 - DNA, 103 bp, Artificial Sequence
  Synthetic Polynucleotide
taatacgactcactatagggttctcctgaggtgtgtaaatccactcgtggaacagaggagaccacgaatggatttacacaacctggcggcagcgcaaaagatg

SEQ ID NO: 237958 - DNA, 103 bp, Artificial Sequence
  Synthetic Polynucleotide
taatacgactcactatagggattctgagtgttctcctgaggtgtgtaaataacagaggagaatttacatgcctcaggagaacctggcggcagcgcaaaagatg

SEQ ID NO: 237959 - DNA, 103 bp, Artificial Sequence
  Synthetic Polynucleotide
taatacgactcactatagggtcttgaaccaattctgagtgttctcctgagaacagaggagactcaggatgacactcagaaacctggcggcagcgcaaaagatg

SEQ ID NO: 237960 - DNA, 103 bp, Artificial Sequence
  Synthetic Polynucleotide
taatacgactcactatagggcaaattttcttcttgaaccaattctgagtgaacagaggagacactcaatgttggttcaaaacctggcggcagcgcaaaagatg

SEQ ID NO: 237961 - DNA, 103 bp, Artificial Sequence
  Synthetic Polynucleotide
taatacgactcactatagggtgcctgggctcaaattttcttcttgaaccaaacagaggagatggttcatgaagaaaattaacctggcggcagcgcaaaagatg

SEQ ID NO: 237962 - DNA, 103 bp, Artificial Sequence
  Synthetic Polynucleotide
taatacgactcactatagggggtgtttgggtgcctgggctcaaattttctaacagaggagaagaaaaatggagcccaggaacctggcggcagcgcaaaagatg

SEQ ID NO: 237963 - DNA, 103 bp, Artificial Sequence
  Synthetic Polynucleotide
taatacgactcactatagggatcatttgaaggtgtttgggtgcctgggctaacagaggagaagcccaatgacccaaacaaacctggcggcagcgcaaaagatg

SEQ ID NO: 237964 - DNA, 103 bp, Artificial Sequence
  Synthetic Polynucleotide
taatacgactcactatagggtacttgctttatcatttgaaggtgtttgggaacagaggagacccaaaatgcttcaaatgaacctggcggcagcgcaaaagatg

SEQ ID NO: 237965 - DNA, 103 bp, Artificial Sequence
  Synthetic Polynucleotide
taatacgactcactatagggtcttgcaacatacttgctttatcatttgaaaacagaggagattcaaaatgtaaagcaagaacctggcggcagcgcaaaagatg

SEQ ID NO: 237966 - DNA, 103 bp, Artificial Sequence
  Synthetic Polynucleotide
taatacgactcactatagggtttggagtattcttgcaacatacttgctttaacagaggagaaaagcaatgatgttgcaaaacctggcggcagcgcaaaagatg

SEQ ID NO: 237967 - DNA, 103 bp, Artificial Sequence
  Synthetic Polynucleotide
taatacgactcactatagggtacctccgccgccactcaggaacccactgcaacagaggagagcagtgatgtcctgagtgaacctggcggcagcgcaaaagatg

SEQ ID NO: 237968 - DNA, 103 bp, Artificial Sequence
  Synthetic Polynucleotide
taatacgactcactatagggggggaggggcggccgaccccgccggccgggaacagaggagacccggcatgcggggtcggaacctggcggcagcgcaaaagatg

SEQ ID NO: 237969 - DNA, 103 bp, Artificial Sequence
  Synthetic Polynucleotide
taatacgactcactataggggttggaggtatttggagtattcttgcaacaaacagaggagatgttgcatgaatactccaaacctggcggcagcgcaaaagatg

SEQ ID NO: 237970 - DNA, 103 bp, Artificial Sequence
  Synthetic Polynucleotide
taatacgactcactatagggtcaaaagcctgttggaggtatttggagtataacagaggagaatactcatgatacctccaaacctggcggcagcgcaaaagatg

SEQ ID NO: 237971 - DNA, 103 bp, Artificial Sequence
  Synthetic Polynucleotide
taatacgactcactatagggagtggatttttcaaaagcctgttggaggtaaacagaggagatacctcatgcaggcttttaacctggcggcagcgcaaaagatg

SEQ ID NO: 237972 - DNA, 103 bp, Artificial Sequence
  Synthetic Polynucleotide
taatacgactcactatagggaacttgcattagtggatttttcaaaagcctaacagaggagaaggcttatgaaaaatccaaacctggcggcagcgcaaaagatg

SEQ ID NO: 237973 - DNA, 103 bp, Artificial Sequence
  Synthetic Polynucleotide
taatacgactcactatagggccaagagtaaaacttgcattagtggattttaacagaggagaaaaatcatgtaatgcaagaacctggcggcagcgcaaaagatg

SEQ ID NO: 237974 - DNA, 103 bp, Artificial Sequence
  Synthetic Polynucleotide
taatacgactcactataggggaaaccgtgtccaagagtaaaacttgcattaacagaggagaaatgcaatgtttactcttaacctggcggcagcgcaaaagatg

SEQ ID NO: 237975 - DNA, 103 bp, Artificial Sequence
  Synthetic Polynucleotide
taatacgactcactatagggtgacaaattggaaaccgtgtccaagagtaaaacagaggagattactcatggacacggttaacctggcggcagcgcaaaagatg

SEQ ID NO: 237976 - DNA, 103 bp, Artificial Sequence
  Synthetic Polynucleotide
taatacgactcactataggggaagacaaactgacaaattggaaaccgtgtaacagaggagaacacggatgccaatttgtaacctggcggcagcgcaaaagatg

SEQ ID NO: 237977 - DNA, 103 bp, Artificial Sequence
  Synthetic Polynucleotide
taatacgactcactataggggtggagaggtgaagacaaactgacaaattgaacagaggagacaatttatgagtttgtctaacctggcggcagcgcaaaagatg

SEQ ID NO: 237978 - DNA, 103 bp, Artificial Sequence
  Synthetic Polynucleotide
taatacgactcactatagggaagtgtggttgtggagaggtgaagacaaacaacagaggagagtttgtatgcacctctccaacctggcggcagcgcaaaagatg

SEQ ID NO: 237979 - DNA, 103 bp, Artificial Sequence
  Synthetic Polynucleotide
taatacgactcactatagggacgcattgcgggggaggggcggccgaccccaacagaggagaggggtcatgcgcccctccaacctggcggcagcgcaaaagatg

SEQ ID NO: 237980 - DNA, 103 bp, Artificial Sequence
  Synthetic Polynucleotide
taatacgactcactatagggtctggaaacaaagtgtggttgtggagaggtaacagaggagaacctctatgcaaccacacaacctggcggcagcgcaaaagatg

SEQ ID NO: 237981 - DNA, 103 bp, Artificial Sequence
  Synthetic Polynucleotide
taatacgactcactatagggtatttgtttttctggaaacaaagtgtggttaacagaggagaaaccacatgttgtttccaaacctggcggcagcgcaaaagatg

SEQ ID NO: 237982 - DNA, 103 bp, Artificial Sequence
  Synthetic Polynucleotide
taatacgactcactatagggacgtagtgtatatttgtttttctggaaacaaacagaggagatgtttcatgaaaaacaaaaacctggcggcagcgcaaaagatg

SEQ ID NO: 237983 - DNA, 103 bp, Artificial Sequence
  Synthetic Polynucleotide
taatacgactcactatagggtccaaaggagacgtagtgtatatttgttttaacagaggagaaaaacaatgatacactacaacctggcggcagcgcaaaagatg

SEQ ID NO: 237984 - DNA, 103 bp, Artificial Sequence
  Synthetic Polynucleotide
taatacgactcactataggggaaaccacactccaaaggagacgtagtgtaaacagaggagatacactatgtctcctttgaacctggcggcagcgcaaaagatg

SEQ ID NO: 237985 - DNA, 103 bp, Artificial Sequence
  Synthetic Polynucleotide
taatacgactcactatagggcagattggccgaaaccacactccaaaggagaacagaggagactccttatgagtgtggttaacctggcggcagcgcaaaagatg

SEQ ID NO: 237986 - DNA, 103 bp, Artificial Sequence
  Synthetic Polynucleotide
taatacgactcactatagggactgaggtaacagattggccgaaaccacacaacagaggagagtgtggatgcggccaatcaacctggcggcagcgcaaaagatg

SEQ ID NO: 237987 - DNA, 103 bp, Artificial Sequence
  Synthetic Polynucleotide
taatacgactcactatagggagatggcaacactgaggtaacagattggccaacagaggagaggccaaatggttacctcaaacctggcggcagcgcaaaagatg

SEQ ID NO: 237988 - DNA, 103 bp, Artificial Sequence
  Synthetic Polynucleotide
taatacgactcactatagggttggcaatgaagatggcaacactgaggtaaaacagaggagattacctatgtgttgccataacctggcggcagcgcaaaagatg

SEQ ID NO: 237989 - DNA, 103 bp, Artificial Sequence
  Synthetic Polynucleotide
taatacgactcactatagggaaaggaggctttggcaatgaagatggcaacaacagaggagagttgccatgttcattgccaacctggcggcagcgcaaaagatg

SEQ ID NO: 237990 - DNA, 103 bp, Artificial Sequence
  Synthetic Polynucleotide
taatacgactcactatagggggaggataacacgcattgcgggggaggggcaacagaggagagcccctatgccgcaatgcaacctggcggcagcgcaaaagatg

SEQ ID NO: 237991 - DNA, 103 bp, Artificial Sequence
  Synthetic Polynucleotide
taatacgactcactatagggcaacatcccaaaaggaggctttggcaatgaaacagaggagatcattgatgaagcctcctaacctggcggcagcgcaaaagatg

SEQ ID NO: 237992 - DNA, 103 bp, Artificial Sequence
  Synthetic Polynucleotide
taatacgactcactataggggagatccaaacaacatcccaaaaggaggctaacagaggagaagcctcatgttgggatgtaacctggcggcagcgcaaaagatg

SEQ ID NO: 237993 - DNA, 103 bp, Artificial Sequence
  Synthetic Polynucleotide
taatacgactcactatagggagacctggctgagatccaaacaacatcccaaacagaggagatgggatatggtttggatcaacctggcggcagcgcaaaagatg

SEQ ID NO: 237994 - DNA, 103 bp, Artificial Sequence
  Synthetic Polynucleotide
taatacgactcactatagggagacaaataaagacctggctgagatccaaaaacagaggagatttggaatgcagccaggtaacctggcggcagcgcaaaagatg

SEQ ID NO: 237995 - DNA, 103 bp, Artificial Sequence
  Synthetic Polynucleotide
taatacgactcactatagggcatccaaagcagacaaataaagacctggctaacagaggagaagccagatgtttatttgtaacctggcggcagcgcaaaagatg

SEQ ID NO: 237996 - DNA, 103 bp, Artificial Sequence
  Synthetic Polynucleotide
taatacgactcactatagggtgatgtgtagcatccaaagcagacaaataaaacagaggagattatttatgtgctttggaaacctggcggcagcgcaaaagatg

SEQ ID NO: 237997 - DNA, 103 bp, Artificial Sequence
  Synthetic Polynucleotide
taatacgactcactatagggtgtcaactgctgatgtgtagcatccaaagcaacagaggagagctttgatggctacacataacctggcggcagcgcaaaagatg

SEQ ID NO: 237998 - DNA, 103 bp, Artificial Sequence
  Synthetic Polynucleotide
taatacgactcactatagggcctgggaaggtgtcaactgctgatgtgtagaacagaggagactacacatgagcagttgaaacctggcggcagcgcaaaagatg

SEQ ID NO: 237999 - DNA, 103 bp, Artificial Sequence
  Synthetic Polynucleotide
taatacgactcactatagggtcatccagctcctgggaaggtgtcaactgcaacagaggagagcagttatgaccttcccaaacctggcggcagcgcaaaagatg

SEQ ID NO: 238000 - DNA, 103 bp, Artificial Sequence
  Synthetic Polynucleotide
taatacgactcactatagggatctatcagatcatccagctcctgggaaggaacagaggagaccttccatggagctggataacctggcggcagcgcaaaagatg

SEQ ID NO: 238001 - DNA, 103 bp, Artificial Sequence
  Synthetic Polynucleotide
taatacgactcactatagggcggaggtagaggaggataacacgcattgcgaacagaggagacgcaatatgtgttatcctaacctggcggcagcgcaaaagatg

SEQ ID NO: 238002 - DNA, 103 bp, Artificial Sequence
  Synthetic Polynucleotide
taatacgactcactatagggtcttctgagaatctatcagatcatccagctaacagaggagaagctggatgatctgatagaacctggcggcagcgcaaaagatg

SEQ ID NO: 238003 - DNA, 103 bp, Artificial Sequence
  Synthetic Polynucleotide
taatacgactcactataggggtctctaagttcttctgagaatctatcagaaacagaggagatctgatatgttctcagaaaacctggcggcagcgcaaaagatg

SEQ ID NO: 238004 - DNA, 103 bp, Artificial Sequence
  Synthetic Polynucleotide
taatacgactcactatagggggctgatgaagtctctaagttcttctgagaaacagaggagatctcagatgaacttagagaacctggcggcagcgcaaaagatg

SEQ ID NO: 238005 - DNA, 103 bp, Artificial Sequence
  Synthetic Polynucleotide
taatacgactcactatagggaggactggaaggctgatgaagtctctaagtaacagaggagaacttagatgcttcatcagaacctggcggcagcgcaaaagatg

SEQ ID NO: 238006 - DNA, 103 bp, Artificial Sequence
  Synthetic Polynucleotide
taatacgactcactatagggttctgagatgaggactggaaggctgatgaaaacagaggagattcatcatgcttccagtcaacctggcggcagcgcaaaagatg

SEQ ID NO: 238007 - DNA, 103 bp, Artificial Sequence
  Synthetic Polynucleotide
taatacgactcactataggggctagtcaatttctgagatgaggactggaaaacagaggagattccagatgtcatctcagaacctggcggcagcgcaaaagatg

SEQ ID NO: 238008 - DNA, 103 bp, Artificial Sequence
  Synthetic Polynucleotide
taatacgactcactataggggttccttctggctagtcaatttctgagatgaacagaggagacatctcatgaattgactaaacctggcggcagcgcaaaagatg

SEQ ID NO: 238009 - DNA, 103 bp, Artificial Sequence
  Synthetic Polynucleotide
taatacgactcactatagggaagtttttctgttccttctggctagtcaataacagaggagaattgacatgccagaaggaaacctggcggcagcgcaaaagatg

SEQ ID NO: 238010 - DNA, 103 bp, Artificial Sequence
  Synthetic Polynucleotide
taatacgactcactatagggtgaagactctaagtttttctgttccttctgaacagaggagacagaagatgcagaaaaacaacctggcggcagcgcaaaagatg

SEQ ID NO: 238011 - DNA, 103 bp, Artificial Sequence
  Synthetic Polynucleotide
taatacgactcactataggggaaagcctgttgaagactctaagtttttctaacagaggagaagaaaaatgtagagtcttaacctggcggcagcgcaaaagatg

SEQ ID NO: 238012 - DNA, 103 bp, Artificial Sequence
  Synthetic Polynucleotide
taatacgactcactataggggccggggctgcggaggtagaggaggataacaacagaggagagttatcatgctctacctcaacctggcggcagcgcaaaagatg

SEQ ID NO: 238013 - DNA, 103 bp, Artificial Sequence
  Synthetic Polynucleotide
taatacgactcactataggggatggaatctgaaagcctgttgaagactctaacagaggagaagagtcatgaacaggcttaacctggcggcagcgcaaaagatg

SEQ ID NO: 238014 - DNA, 103 bp, Artificial Sequence
  Synthetic Polynucleotide
taatacgactcactatagggtaactcctgagatggaatctgaaagcctgtaacagaggagaacaggcatgcagattccaaacctggcggcagcgcaaaagatg

SEQ ID NO: 238015 - DNA, 103 bp, Artificial Sequence
  Synthetic Polynucleotide
taatacgactcactatagggtctggctagctaactcctgagatggaatctaacagaggagaagattcatgctcaggagtaacctggcggcagcgcaaaagatg

SEQ ID NO: 238016 - DNA, 103 bp, Artificial Sequence
  Synthetic Polynucleotide
taatacgactcactatagggtgaggatctatctggctagctaactcctgaaacagaggagatcaggaatgagctagccaaacctggcggcagcgcaaaagatg

SEQ ID NO: 238017 - DNA, 103 bp, Artificial Sequence
  Synthetic Polynucleotide
taatacgactcactatagggtatgtctttctgaggatctatctggctagcaacagaggagagctagcatgatagatcctaacctggcggcagcgcaaaagatg

SEQ ID NO: 238018 - DNA, 103 bp, Artificial Sequence
  Synthetic Polynucleotide
taatacgactcactatagggttctaggctctatgtctttctgaggatctaaacagaggagatagatcatgagaaagacaaacctggcggcagcgcaaaagatg

SEQ ID NO: 238019 - DNA, 103 bp, Artificial Sequence
  Synthetic Polynucleotide
taatacgactcactatagggtgatacgttgttctaggctctatgtctttcaacagaggagagaaagaatgagagcctagaacctggcggcagcgcaaaagatg

SEQ ID NO: 238020 - DNA, 103 bp, Artificial Sequence
  Synthetic Polynucleotide
taatacgactcactataggggttctcaatctgatacgttgttctaggctcaacagaggagagagcctatgacaacgtataacctggcggcagcgcaaaagatg

SEQ ID NO: 238021 - DNA, 103 bp, Artificial Sequence
  Synthetic Polynucleotide
taatacgactcactatagggcttgtgcaaagttctcaatctgatacgttgaacagaggagacaacgtatgagattgagaaacctggcggcagcgcaaaagatg

SEQ ID NO: 238022 - DNA, 103 bp, Artificial Sequence
  Synthetic Polynucleotide
taatacgactcactataggggaaccaaacgcttgtgcaaagttctcaatcaacagaggagagattgaatgctttgcacaaacctggcggcagcgcaaaagatg

SEQ ID NO: 238023 - DNA, 103 bp, Artificial Sequence
  Synthetic Polynucleotide
taatacgactcactataggggggctcagcggccggggctgcggaggtagaaacagaggagatctaccatggcagccccgaacctggcggcagcgcaaaagatg

SEQ ID NO: 238024 - DNA, 103 bp, Artificial Sequence
  Synthetic Polynucleotide
taatacgactcactatagggcttaaactgagaaccaaacgcttgtgcaaaaacagaggagatttgcaatggcgtttggtaacctggcggcagcgcaaaagatg

SEQ ID NO: 238025 - DNA, 103 bp, Artificial Sequence
  Synthetic Polynucleotide
taatacgactcactatagggtgctgcccgacttaaactgagaaccaaacgaacagaggagacgtttgatgctcagtttaaacctggcggcagcgcaaaagatg

SEQ ID NO: 238026 - DNA, 103 bp, Artificial Sequence
  Synthetic Polynucleotide
taatacgactcactatagggattggcaccctgctgcccgacttaaactgaaacagaggagatcagttatggtcgggcagaacctggcggcagcgcaaaagatg

SEQ ID NO: 238027 - DNA, 103 bp, Artificial Sequence
  Synthetic Polynucleotide
taatacgactcactataggggataaaggtcattggcaccctgctgcccgaaacagaggagatcgggcatgagggtgccaaacctggcggcagcgcaaaagatg

SEQ ID NO: 238028 - DNA, 103 bp, Artificial Sequence
  Synthetic Polynucleotide
taatacgactcactatagggtagagttagtgataaaggtcattggcacccaacagaggagagggtgcatgtgacctttaaacctggcggcagcgcaaaagatg

SEQ ID NO: 238029 - DNA, 103 bp, Artificial Sequence
  Synthetic Polynucleotide
taatacgactcactatagggacttctccattagagttagtgataaaggtcaacagaggagagaccttatgcactaactcaacctggcggcagcgcaaaagatg

SEQ ID NO: 238030 - DNA, 103 bp, Artificial Sequence
  Synthetic Polynucleotide
taatacgactcactatagggtctatggtccacttctccattagagttagtaacagaggagaactaacatgaatggagaaaacctggcggcagcgcaaaagatg

SEQ ID NO: 238031 - DNA, 103 bp, Artificial Sequence
  Synthetic Polynucleotide
taatacgactcactatagggaagtccttactctatggtccacttctccataacagaggagaatggagatgtggaccataaacctggcggcagcgcaaaagatg

SEQ ID NO: 238032 - DNA, 103 bp, Artificial Sequence
  Synthetic Polynucleotide
taatacgactcactatagggtctgacactgaagtccttactctatggtccaacagaggagaggaccaatgagtaaggacaacctggcggcagcgcaaaagatg

SEQ ID NO: 238033 - DNA, 103 bp, Artificial Sequence
  Synthetic Polynucleotide
taatacgactcactatagggccctgagaaatctgacactgaagtccttacaacagaggagagtaaggatgtcagtgtcaaacctggcggcagcgcaaaagatg

SEQ ID NO: 238034 - DNA, 103 bp, Artificial Sequence
  Synthetic Polynucleotide
taatacgactcactataggggcggaggggggggctcagcggccggggctgaacagaggagacagcccatgccgctgagcaacctggcggcagcgcaaaagatg

SEQ ID NO: 238035 - DNA, 103 bp, Artificial Sequence
  Synthetic Polynucleotide
taatacgactcactatagggtatttgtataccctgagaaatctgacactgaacagaggagacagtgtatgatttctcagaacctggcggcagcgcaaaagatg

SEQ ID NO: 238036 - DNA, 103 bp, Artificial Sequence
  Synthetic Polynucleotide
taatacgactcactatagggtcagacatcatatttgtataccctgagaaaaacagaggagatttctcatggtatacaaaaacctggcggcagcgcaaaagatg

SEQ ID NO: 238037 - DNA, 103 bp, Artificial Sequence
  Synthetic Polynucleotide
taatacgactcactatagggctcacttacatcagacatcatatttgtataaacagaggagatatacaatgatgatgtctaacctggcggcagcgcaaaagatg

SEQ ID NO: 238038 - DNA, 103 bp, Artificial Sequence
  Synthetic Polynucleotide
taatacgactcactatagggtactacatggctcacttacatcagacatcaaacagaggagatgatgtatgatgtaagtgaacctggcggcagcgcaaaagatg

SEQ ID NO: 238039 - DNA, 103 bp, Artificial Sequence
  Synthetic Polynucleotide
taatacgactcactatagggtttactcttgtactacatggctcacttacaaacagaggagatgtaagatggccatgtagaacctggcggcagcgcaaaagatg

SEQ ID NO: 238040 - DNA, 103 bp, Artificial Sequence
  Synthetic Polynucleotide
taatacgactcactatagggggtgggtgtctttactcttgtactacatggaacagaggagaccatgtatgacaagagtaaacctggcggcagcgcaaaagatg

SEQ ID NO: 238041 - DNA, 103 bp, Artificial Sequence
  Synthetic Polynucleotide
taatacgactcactatagggaactctggctggtgggtgtctttactcttgaacagaggagacaagagatgagacacccaaacctggcggcagcgcaaaagatg

SEQ ID NO: 238042 - DNA, 103 bp, Artificial Sequence
  Synthetic Polynucleotide
taatacgactcactatagggtccggggctggcggaggggggggctcagcgaacagaggagacgctgaatgcccccctccaacctggcggcagcgcaaaagatg

SEQ ID NO: 238043 - DNA, 103 bp, Artificial Sequence
  Synthetic Polynucleotide
taatacgactcactataggggaaagtcatgtccggggctggcggagggggaacagaggagaccccctatgccagccccgaacctggcggcagcgcaaaagatg

SEQ ID NO: 238044 - DNA, 103 bp, Artificial Sequence
  Synthetic Polynucleotide
taatacgactcactataggggctccttcttgaaagtcatgtccggggctgaacagaggagacagcccatgacatgacttaacctggcggcagcgcaaaagatg

SEQ ID NO: 238045 - DNA, 103 bp, Artificial Sequence
  Synthetic Polynucleotide
taatacgactcactatagggctactgccggtacctccgccgccactcaggaacagaggagacctgagatgcggcggaggaacctggcggcagcgcaaaagatg

SEQ ID NO: 238046 - DNA, 103 bp, Artificial Sequence
  Synthetic Polynucleotide
taatacgactcactataggggacgccgccggctccttcttgaaagtcatgaacagaggagacatgacatgcaagaaggaaacctggcggcagcgcaaaagatg

SEQ ID NO: 238047 - DNA, 103 bp, Artificial Sequence
  Synthetic Polynucleotide
taatacgactcactatagggggccgcggctgacgccgccggctccttcttaacagaggagaaagaagatgccggcggcgaacctggcggcagcgcaaaagatg

SEQ ID NO: 238048 - DNA, 103 bp, Artificial Sequence
  Synthetic Polynucleotide
taatacgactcactataggggcgaggggaaggccgcggctgacgccgccgaacagaggagacggcggatgcagccgcggaacctggcggcagcgcaaaagatg

SEQ ID NO: 238049 - DNA, 103 bp, Artificial Sequence
  Synthetic Polynucleotide
taatacgactcactataggggaggtcctctgcgaggggaaggccgcggctaacagaggagaagccgcatgcttcccctcaacctggcggcagcgcaaaagatg

SEQ ID NO: 238050 - DNA, 103 bp, Artificial Sequence
  Synthetic Polynucleotide
taatacgactcactataggggaacccccaggaggtcctctgcgaggggaaaacagaggagattccccatgcagaggaccaacctggcggcagcgcaaaagatg

SEQ ID NO: 238051 - DNA, 103 bp, Artificial Sequence
  Synthetic Polynucleotide
taatacgactcactatagggaagactgcaagaacccccaggaggtcctctaacagaggagaagaggaatgcctgggggtaacctggcggcagcgcaaaagatg

SEQ ID NO: 238052 - DNA, 103 bp, Artificial Sequence
  Synthetic Polynucleotide
taatacgactcactatagggatgctaaccaaagactgcaagaacccccagaacagaggagactggggatgcttgcagtcaacctggcggcagcgcaaaagatg

SEQ ID NO: 238053 - DNA, 103 bp, Artificial Sequence
  Synthetic Polynucleotide
taatacgactcactatagggctcctgtttgatgctaaccaaagactgcaaaacagaggagattgcagatgttggttagcaacctggcggcagcgcaaaagatg

SEQ ID NO: 238054 - DNA, 103 bp, Artificial Sequence
  Synthetic Polynucleotide
taatacgactcactatagggccgcgggtttctcctgtttgatgctaaccaaacagaggagatggttaatgtcaaacaggaacctggcggcagcgcaaaagatg

SEQ ID NO: 238055 - DNA, 103 bp, Artificial Sequence
  Synthetic Polynucleotide
taatacgactcactatagggtcctcaggatccgcgggtttctcctgtttgaacagaggagacaaacaatggaaacccgcaacctggcggcagcgcaaaagatg

SEQ ID NO: 238056 - DNA, 103 bp, Artificial Sequence
  Synthetic Polynucleotide
taatacgactcactataggggctaccaccgctactgccggtacctccgccaacagaggagaggcggaatgaccggcagtaacctggcggcagcgcaaaagatg

SEQ ID NO: 238057 - DNA, 103 bp, Artificial Sequence
  Synthetic Polynucleotide
taatacgactcactatagggggactgctgctcctcaggatccgcgggtttaacagaggagaaaacccatggatcctgagaacctggcggcagcgcaaaagatg

SEQ ID NO: 238058 - DNA, 103 bp, Artificial Sequence
  Synthetic Polynucleotide
taatacgactcactatagggggtggtggtgggactgctgctcctcaggataacagaggagaatcctgatgagcagcagtaacctggcggcagcgcaaaagatg

SEQ ID NO: 238059 - DNA, 103 bp, Artificial Sequence
  Synthetic Polynucleotide
taatacgactcactatagggtggtggtgatggtggtggtgggactgctgcaacagaggagagcagcaatgccaccaccaaacctggcggcagcgcaaaagatg

SEQ ID NO: 238060 - DNA, 103 bp, Artificial Sequence
  Synthetic Polynucleotide
taatacgactcactatagggcccatagtggtggtggtgatggtggtggtgaacagaggagacaccacatgcatcaccacaacctggcggcagcgcaaaagatg

SEQ ID NO: 238061 - DNA, 103 bp, Artificial Sequence
  Synthetic Polynucleotide
taatacgactcactatagggcgaacagccccccatagtggtggtggtgataacagaggagaatcaccatgaccactatgaacctggcggcagcgcaaaagatg

SEQ ID NO: 238062 - DNA, 103 bp, Artificial Sequence
  Synthetic Polynucleotide
taatacgactcactatagggtcagctccagcgaacagccccccatagtggaacagaggagaccactaatgggggctgttaacctggcggcagcgcaaaagatg

SEQ ID NO: 238063 - DNA, 103 bp, Artificial Sequence
  Synthetic Polynucleotide
taatacgactcactatagggagacctctcttcagctccagcgaacagcccaacagaggagagggctgatggctggagctaacctggcggcagcgcaaaagatg

SEQ ID NO: 238064 - DNA, 103 bp, Artificial Sequence
  Synthetic Polynucleotide
taatacgactcactatagggctaggcctggagacctctcttcagctccagaacagaggagactggagatgaagagaggtaacctggcggcagcgcaaaagatg

SEQ ID NO: 238065 - DNA, 103 bp, Artificial Sequence
  Synthetic Polynucleotide
taatacgactcactatagggtcaccgcctcctaggcctggagacctctctaacagaggagaagagagatgtccaggcctaacctggcggcagcgcaaaagatg

SEQ ID NO: 238066 - DNA, 103 bp, Artificial Sequence
  Synthetic Polynucleotide
taatacgactcactatagggactccccccttcaccgcctcctaggcctggaacagaggagaccaggcatgggaggcggtaacctggcggcagcgcaaaagatg

SEQ ID NO: 238067 - DNA, 103 bp, Artificial Sequence
  Synthetic Polynucleotide
taatacgactcactatagggcgccggagccgctaccaccgctactgccggaacagaggagaccggcaatggcggtggtaaacctggcggcagcgcaaaagatg

SEQ ID NO: 238068 - DNA, 103 bp, Artificial Sequence
  Synthetic Polynucleotide
taatacgactcactatagggtgacgccgtgactccccccttcaccgcctcaacagaggagagaggcgatgaaggggggaaacctggcggcagcgcaaaagatg

SEQ ID NO: 238069 - DNA, 103 bp, Artificial Sequence
  Synthetic Polynucleotide
taatacgactcactatagggaggtcctggatgacgccgtgactcccccctaacagaggagaagggggatgtcacggcgtaacctggcggcagcgcaaaagatg

SEQ ID NO: 238070 - DNA, 103 bp, Artificial Sequence
  Synthetic Polynucleotide
taatacgactcactataggggagaatactgaggtcctggatgacgccgtgaacagaggagacacggcatgatccaggacaacctggcggcagcgcaaaagatg

SEQ ID NO: 238071 - DNA, 103 bp, Artificial Sequence
  Synthetic Polynucleotide
taatacgactcactatagggcatgctggtggagaatactgaggtcctggaaacagaggagatccaggatgtcagtattcaacctggcggcagcgcaaaagatg

SEQ ID NO: 238072 - DNA, 103 bp, Artificial Sequence
  Synthetic Polynucleotide
taatacgactcactatagggtgctgctggacatgctggtggagaatactgaacagaggagacagtatatgccaccagcaaacctggcggcagcgcaaaagatg

SEQ ID NO: 238073 - DNA, 103 bp, Artificial Sequence
  Synthetic Polynucleotide
taatacgactcactatagggctgggctggttgctgctggacatgctggtgaacagaggagacaccagatggtccagcagaacctggcggcagcgcaaaagatg

SEQ ID NO: 238074 - DNA, 103 bp, Artificial Sequence
  Synthetic Polynucleotide
taatacgactcactatagggcacggtggtgctgggctggttgctgctggaaacagaggagatccagcatgaaccagcccaacctggcggcagcgcaaaagatg

SEQ ID NO: 238075 - DNA, 103 bp, Artificial Sequence
  Synthetic Polynucleotide
taatacgactcactatagggagtaatacgtcacggtggtgctgggctggtaacagaggagaaccagcatggcaccaccgaacctggcggcagcgcaaaagatg

SEQ ID NO: 238076 - DNA, 103 bp, Artificial Sequence
  Synthetic Polynucleotide
taatacgactcactatagggactgctgctgagtaatacgtcacggtggtgaacagaggagacaccacatggacgtattaaacctggcggcagcgcaaaagatg

SEQ ID NO: 238077 - DNA, 103 bp, Artificial Sequence
  Synthetic Polynucleotide
taatacgactcactatagggcagtcctgctactgctgctgagtaatacgtaacagaggagaacgtatatgtcagcagcaaacctggcggcagcgcaaaagatg

SEQ ID NO: 238078 - DNA, 103 bp, Artificial Sequence
  Synthetic Polynucleotide
taatacgactcactatagggctaccaccgccgccggagccgctaccaccgaacagaggagacggtggatgcggctccggaacctggcggcagcgcaaaagatg

SEQ ID NO: 238079 - DNA, 103 bp, Artificial Sequence
  Synthetic Polynucleotide
taatacgactcactatagggtggtggtcatcagtcctgctactgctgctgaacagaggagacagcagatgtagcaggacaacctggcggcagcgcaaaagatg

SEQ ID NO: 238080 - DNA, 103 bp, Artificial Sequence
  Synthetic Polynucleotide
taatacgactcactatagggctcagtgccatggtggtcatcagtcctgctaacagaggagaagcaggatggatgaccacaacctggcggcagcgcaaaagatg

SEQ ID NO: 238081 - DNA, 103 bp, Artificial Sequence
  Synthetic Polynucleotide
taatacgactcactataggggctttggctcctcagtgccatggtggtcataacagaggagaatgaccatgatggcactgaacctggcggcagcgcaaaagatg

SEQ ID NO: 238082 - DNA, 103 bp, Artificial Sequence
  Synthetic Polynucleotide
taatacgactcactatagggttagtgtcctgctttggctcctcagtgccaaacagaggagatggcacatgggagccaaaaacctggcggcagcgcaaaagatg

SEQ ID NO: 238083 - DNA, 103 bp, Artificial Sequence
  Synthetic Polynucleotide
taatacgactcactatagggctttttgacattagtgtcctgctttggctcaacagaggagagagccaatgcaggacactaacctggcggcagcgcaaaagatg

SEQ ID NO: 238084 - DNA, 103 bp, Artificial Sequence
  Synthetic Polynucleotide
taatacgactcactataggggcctttttgcctttttgacattagtgtcctaacagaggagaaggacaatgatgtcaaaaaacctggcggcagcgcaaaagatg

SEQ ID NO: 238085 - DNA, 103 bp, Artificial Sequence
  Synthetic Polynucleotide
taatacgactcactatagggtctggctttggcctttttgcctttttgacaaacagaggagatgtcaaatgggcaaaaagaacctggcggcagcgcaaaagatg

SEQ ID NO: 238086 - DNA, 103 bp, Artificial Sequence
  Synthetic Polynucleotide
taatacgactcactatagggtccctgagattctggctttggcctttttgcaacagaggagagcaaaaatgccaaagccaaacctggcggcagcgcaaaagatg

SEQ ID NO: 238087 - DNA, 103 bp, Artificial Sequence
  Synthetic Polynucleotide
taatacgactcactatagggtggctttgattccctgagattctggctttgaacagaggagacaaagcatgaatctcaggaacctggcggcagcgcaaaagatg

SEQ ID NO: 238088 - DNA, 103 bp, Artificial Sequence
  Synthetic Polynucleotide
taatacgactcactatagggggcttcctcttggctttgattccctgagataacagaggagaatctcaatgaatcaaagcaacctggcggcagcgcaaaagatg

SEQ ID NO: 238089 - DNA, 103 bp, Artificial Sequence
  Synthetic Polynucleotide
taatacgactcactataggggccgccgccactaccaccgccgccggagccaacagaggagaggctccatgggcggtggtaacctggcggcagcgcaaaagatg

SEQ ID NO: 238090 - DNA, 103 bp, Artificial Sequence
  Synthetic Polynucleotide
taatacgactcactatagggagatgcacttggcttcctcttggctttgataacagaggagaatcaaaatgaagaggaagaacctggcggcagcgcaaaagatg

SEQ ID NO: 238091 - DNA, 103 bp, Artificial Sequence
  Synthetic Polynucleotide
taatacgactcactatagggaaggtttggaagatgcacttggcttcctctaacagaggagaagaggaatgcaagtgcataacctggcggcagcgcaaaagatg

SEQ ID NO: 238092 - DNA, 103 bp, Artificial Sequence
  Synthetic Polynucleotide
taatacgactcactatagggccaaccaaagaaggtttggaagatgcacttaacagaggagaaagtgcatgttccaaaccaacctggcggcagcgcaaaagatg

SEQ ID NO: 238093 - DNA, 103 bp, Artificial Sequence
  Synthetic Polynucleotide
taatacgactcactatagggttctccatctccaaccaaagaaggtttggaaacagaggagatccaaaatgtctttggttaacctggcggcagcgcaaaagatg

SEQ ID NO: 238094 - DNA, 103 bp, Artificial Sequence
  Synthetic Polynucleotide
taatacgactcactatagggggatggcaccttctccatctccaaccaaagaacagaggagactttggatggagatggagaacctggcggcagcgcaaaagatg

SEQ ID NO: 238095 - DNA, 103 bp, Artificial Sequence
  Synthetic Polynucleotide
taatacgactcactatagggcttggggagaggatggcaccttctccatctaacagaggagaagatggatgaggtgccataacctggcggcagcgcaaaagatg

SEQ ID NO: 238096 - DNA, 103 bp, Artificial Sequence
  Synthetic Polynucleotide
taatacgactcactatagggaggtttctgacttggggagaggatggcaccaacagaggagaggtgccatgctctccccaaacctggcggcagcgcaaaagatg

SEQ ID NO: 238097 - DNA, 103 bp, Artificial Sequence
  Synthetic Polynucleotide
taatacgactcactatagggcacagatatgaggtttctgacttggggagaaacagaggagatctcccatggtcagaaacaacctggcggcagcgcaaaagatg

SEQ ID NO: 238098 - DNA, 103 bp, Artificial Sequence
  Synthetic Polynucleotide
taatacgactcactatagggctacagtgatcacagatatgaggtttctgaaacagaggagatcagaaatgtcatatctgaacctggcggcagcgcaaaagatg

SEQ ID NO: 238099 - DNA, 103 bp, Artificial Sequence
  Synthetic Polynucleotide
taatacgactcactataggggaaagcagcactacagtgatcacagatatgaacagaggagacatatcatggatcactgtaacctggcggcagcgcaaaagatg

SEQ ID NO: 238100 - DNA, 103 bp, Artificial Sequence
  Synthetic Polynucleotide
taatacgactcactatagggcgccgccgccgccgccgccactaccaccgcaacagaggagagcggtgatggtggcggcgaacctggcggcagcgcaaaagatg

SEQ ID NO: 238101 - DNA, 103 bp, Artificial Sequence
  Synthetic Polynucleotide
taatacgactcactatagggaggagcttcggaaagcagcactacagtgataacagaggagaatcactatggtgctgcttaacctggcggcagcgcaaaagatg

SEQ ID NO: 238102 - DNA, 103 bp, Artificial Sequence
  Synthetic Polynucleotide
taatacgactcactatagggcgcaggtgataggagcttcggaaagcagcaaacagaggagatgctgcatgccgaagctcaacctggcggcagcgcaaaagatg

SEQ ID NO: 238103 - DNA, 103 bp, Artificial Sequence
  Synthetic Polynucleotide
taatacgactcactataggggacatgtctccgcaggtgataggagcttcgaacagaggagacgaagcatgtatcacctgaacctggcggcagcgcaaaagatg

SEQ ID NO: 238104 - DNA, 103 bp, Artificial Sequence
  Synthetic Polynucleotide
taatacgactcactatagggtatgaatgaggacatgtctccgcaggtgataacagaggagaatcaccatgggagacatgaacctggcggcagcgcaaaagatg

SEQ ID NO: 238105 - DNA, 103 bp, Artificial Sequence
  Synthetic Polynucleotide
taatacgactcactatagggctttctcctgtatgaatgaggacatgtctcaacagaggagagagacaatgcctcattcaaacctggcggcagcgcaaaagatg

SEQ ID NO: 238106 - DNA, 103 bp, Artificial Sequence
  Synthetic Polynucleotide
taatacgactcactatagggctggaaaggtctttctcctgtatgaatgagaacagaggagactcattatgacaggagaaaacctggcggcagcgcaaaagatg

SEQ ID NO: 238107 - DNA, 103 bp, Artificial Sequence
  Synthetic Polynucleotide
taatacgactcactatagggactggctgcactggaaaggtctttctcctgaacagaggagacaggagatggacctttccaacctggcggcagcgcaaaagatg

SEQ ID NO: 238108 - DNA, 103 bp, Artificial Sequence
  Synthetic Polynucleotide
taatacgactcactatagggcccatactacactggctgcactggaaaggtaacagaggagaacctttatggtgcagccaaacctggcggcagcgcaaaagatg

SEQ ID NO: 238109 - DNA, 103 bp, Artificial Sequence
  Synthetic Polynucleotide
taatacgactcactatagggctgaatgaaacccatactacactggctgcaaacagaggagatgcagcatgtgtagtatgaacctggcggcagcgcaaaagatg

SEQ ID NO: 238110 - DNA, 103 bp, Artificial Sequence
  Synthetic Polynucleotide
taatacgactcactataggggtaggtatttctgaatgaaacccatactacaacagaggagagtagtaatggtttcattcaacctggcggcagcgcaaaagatg

SEQ ID NO: 238111 - DNA, 103 bp, Artificial Sequence
  Synthetic Polynucleotide
taatacgactcactatagggccgctgctgccgccgccgccgccgccgccaaacagaggagatggcggatgcggcggcggaacctggcggcagcgcaaaagatg

SEQ ID NO: 238112 - DNA, 103 bp, Artificial Sequence
  Synthetic Polynucleotide
taatacgactcactatagggtgtctctgtagtaggtatttctgaatgaaaaacagaggagatttcatatggaaatacctaacctggcggcagcgcaaaagatg

SEQ ID NO: 238113 - DNA, 103 bp, Artificial Sequence
  Synthetic Polynucleotide
taatacgactcactatagggaattttctcatgtctctgtagtaggtatttaacagaggagaaaatacatgctacagagaaacctggcggcagcgcaaaagatg

SEQ ID NO: 238114 - DNA, 103 bp, Artificial Sequence
  Synthetic Polynucleotide
taatacgactcactatagggctctactatgaattttctcatgtctctgtaaacagaggagatacagaatgatgagaaaaaacctggcggcagcgcaaaagatg

SEQ ID NO: 238115 - DNA, 103 bp, Artificial Sequence
  Synthetic Polynucleotide
taatacgactcactatagggaatggcttctctctactatgaattttctcaaacagaggagatgagaaatgtcatagtagaacctggcggcagcgcaaaagatg

SEQ ID NO: 238116 - DNA, 103 bp, Artificial Sequence
  Synthetic Polynucleotide
taatacgactcactatagggatcacatccaaatggcttctctctactatgaacagaggagacatagtatggagaagccaaacctggcggcagcgcaaaagatg

SEQ ID NO: 238117 - DNA, 103 bp, Artificial Sequence
  Synthetic Polynucleotide
taatacgactcactatagggtgctgcactgatcacatccaaatggcttctaacagaggagaagaagcatgttggatgtgaacctggcggcagcgcaaaagatg

SEQ ID NO: 238118 - DNA, 103 bp, Artificial Sequence
  Synthetic Polynucleotide
taatacgactcactatagggataaacttcatgctgcactgatcacatccaaacagaggagatggatgatgtcagtgcagaacctggcggcagcgcaaaagatg

SEQ ID NO: 238119 - DNA, 103 bp, Artificial Sequence
  Synthetic Polynucleotide
taatacgactcactataggggtacttctgaataaacttcatgctgcactgaacagaggagacagtgcatgatgaagtttaacctggcggcagcgcaaaagatg

SEQ ID NO: 238120 - DNA, 103 bp, Artificial Sequence
  Synthetic Polynucleotide
taatacgactcactatagggtctccatatggtacttctgaataaacttcaaacagaggagatgaagtatgttcagaagtaacctggcggcagcgcaaaagatg

SEQ ID NO: 238121 - DNA, 103 bp, Artificial Sequence
  Synthetic Polynucleotide
taatacgactcactatagggctcttgtgtctctccatatggtacttctgaaacagaggagatcagaaatgccatatggaaacctggcggcagcgcaaaagatg

SEQ ID NO: 238122 - DNA, 103 bp, Artificial Sequence
  Synthetic Polynucleotide
taatacgactcactatagggctgattacatttctcttctgaagtgtacataacagaggagaatgtacatgtcagaagagaacctggcggcagcgcaaaagatg

SEQ ID NO: 238123 - DNA, 103 bp, Artificial Sequence
  Synthetic Polynucleotide
taatacgactcactatagggaccatctatctgaataatctcatgcatatgaacagaggagacatatgatggagattattaacctggcggcagcgcaaaagatg

SEQ ID NO: 238124 - DNA, 103 bp, Artificial Sequence
  Synthetic Polynucleotide
taatacgactcactatagggctgttgggcaacaaagtccattcctaggagaacagaggagactcctaatgatggactttaacctggcggcagcgcaaaagatg

SEQ ID NO: 238125 - DNA, 103 bp, Artificial Sequence
  Synthetic Polynucleotide
taatacgactcactatagggttctcattttctgttgggcaacaaagtccaaacagaggagatggactatgttgcccaacaacctggcggcagcgcaaaagatg

SEQ ID NO: 238126 - DNA, 103 bp, Artificial Sequence
  Synthetic Polynucleotide
taatacgactcactatagggtctgtttgagttctcattttctgttgggcaaacagaggagatgcccaatggaaaatgagaacctggcggcagcgcaaaagatg

SEQ ID NO: 238127 - DNA, 103 bp, Artificial Sequence
  Synthetic Polynucleotide
taatacgactcactataggggtgtagctcctctgtttgagttctcattttaacagaggagaaaaatgatgactcaaacaaacctggcggcagcgcaaaagatg

SEQ ID NO: 238128 - DNA, 103 bp, Artificial Sequence
  Synthetic Polynucleotide
taatacgactcactatagggtgtatttatagtgtagctcctctgtttgagaacagaggagactcaaaatgaggagctacaacctggcggcagcgcaaaagatg

SEQ ID NO: 238129 - DNA, 103 bp, Artificial Sequence
  Synthetic Polynucleotide
taatacgactcactatagggtcacatacagtgtatttatagtgtagctccaacagaggagaggagctatgctataaataaacctggcggcagcgcaaaagatg

SEQ ID NO: 238130 - DNA, 103 bp, Artificial Sequence
  Synthetic Polynucleotide
taatacgactcactataggggaagcttttatcacatacagtgtatttataaacagaggagatataaaatgactgtatgtaacctggcggcagcgcaaaagatg

SEQ ID NO: 238131 - DNA, 103 bp, Artificial Sequence
  Synthetic Polynucleotide
taatacgactcactatagggaactctggtggaagcttttatcacatacagaacagaggagactgtatatgataaaagctaacctggcggcagcgcaaaagatg

SEQ ID NO: 238132 - DNA, 103 bp, Artificial Sequence
  Synthetic Polynucleotide
taatacgactcactatagggagaagggctgaactctggtggaagcttttaaacagaggagataaaagatgccaccagagaacctggcggcagcgcaaaagatg

SEQ ID NO: 238133 - DNA, 103 bp, Artificial Sequence
  Synthetic Polynucleotide
taatacgactcactatagggctgatgttgaagaagggctgaactctggtgaacagaggagacaccagatgtcagcccttaacctggcggcagcgcaaaagatg

SEQ ID NO: 238134 - DNA, 103 bp, Artificial Sequence
  Synthetic Polynucleotide
taatacgactcactatagggggtatatatgaccatctatctgaataatctaacagaggagaagattaatgagatagatgaacctggcggcagcgcaaaagatg

SEQ ID NO: 238135 - DNA, 103 bp, Artificial Sequence
  Synthetic Polynucleotide
taatacgactcactatagggtgtgtactgtctgatgttgaagaagggctgaacagaggagacagcccatgttcaacatcaacctggcggcagcgcaaaagatg

SEQ ID NO: 238136 - DNA, 103 bp, Artificial Sequence
  Synthetic Polynucleotide
taatacgactcactatagggttttcaccaatgtgtactgtctgatgttgaaacagaggagatcaacaatggacagtacaaacctggcggcagcgcaaaagatg

SEQ ID NO: 238137 - DNA, 103 bp, Artificial Sequence
  Synthetic Polynucleotide
taatacgactcactataggggacaaacggtttttcaccaatgtgtactgtaacagaggagaacagtaatgattggtgaaaacctggcggcagcgcaaaagatg

SEQ ID NO: 238138 - DNA, 103 bp, Artificial Sequence
  Synthetic Polynucleotide
taatacgactcactatagggtcacattacagacaaacggtttttcaccaaaacagaggagattggtgatgaaccgtttgaacctggcggcagcgcaaaagatg

SEQ ID NO: 238139 - DNA, 103 bp, Artificial Sequence
  Synthetic Polynucleotide
taatacgactcactatagggcctttttcactcacattacagacaaacggtaacagaggagaaccgttatgctgtaatgtaacctggcggcagcgcaaaagatg

SEQ ID NO: 238140 - DNA, 103 bp, Artificial Sequence
  Synthetic Polynucleotide
taatacgactcactatagggaagctcaagacctttttcactcacattacaaacagaggagatgtaatatgagtgaaaaaaacctggcggcagcgcaaaagatg

SEQ ID NO: 238141 - DNA, 103 bp, Artificial Sequence
  Synthetic Polynucleotide
taatacgactcactatagggggggagggctaagctcaagacctttttcacaacagaggagagtgaaaatggtcttgagcaacctggcggcagcgcaaaagatg

SEQ ID NO: 238142 - DNA, 103 bp, Artificial Sequence
  Synthetic Polynucleotide
taatacgactcactatagggtctgacgcatggggagggctaagctcaagaaacagaggagatcttgaatgtagccctccaacctggcggcagcgcaaaagatg

SEQ ID NO: 238143 - DNA, 103 bp, Artificial Sequence
  Synthetic Polynucleotide
taatacgactcactatagggctgtgaggcttctgacgcatggggagggctaacagaggagaagccctatgcatgcgtcaaacctggcggcagcgcaaaagatg

SEQ ID NO: 238144 - DNA, 103 bp, Artificial Sequence
  Synthetic Polynucleotide
taatacgactcactatagggtcaaggcactggtatatatgaccatctatcaacagaggagagatagaatgtcatatataaacctggcggcagcgcaaaagatg

SEQ ID NO: 238145 - DNA, 103 bp, Artificial Sequence
  Synthetic Polynucleotide
taatacgactcactatagggttgcttgcattcaaggcactggtatatatgaacagaggagacatataatgcagtgccttaacctggcggcagcgcaaaagatg

SEQ ID NO: 238146 - DNA, 103 bp, Artificial Sequence
  Synthetic Polynucleotide
taatacgactcactatagggcacagaagttttgcttgcattcaaggcactaacagaggagaagtgccatgaatgcaagcaacctggcggcagcgcaaaagatg

SEQ ID NO: 238147 - DNA, 103 bp, Artificial Sequence
  Synthetic Polynucleotide
taatacgactcactataggggctaagttttcacagaagttttgcttgcataacagaggagaatgcaaatgaaacttctgaacctggcggcagcgcaaaagatg

SEQ ID NO: 238148 - DNA, 103 bp, Artificial Sequence
  Synthetic Polynucleotide
taatacgactcactatagggcataataagagctaagttttcacagaagttaacagaggagaaacttcatggaaaacttaaacctggcggcagcgcaaaagatg

SEQ ID NO: 238149 - DNA, 103 bp, Artificial Sequence
  Synthetic Polynucleotide
taatacgactcactatagggttctctcacacataataagagctaagttttaacagaggagaaaaactatgctcttattaaacctggcggcagcgcaaaagatg

SEQ ID NO: 238150 - DNA, 103 bp, Artificial Sequence
  Synthetic Polynucleotide
taatacgactcactatagggccagtatgggttctctcacacataataagaaacagaggagatcttatatggtgtgagagaacctggcggcagcgcaaaagatg

SEQ ID NO: 238151 - DNA, 103 bp, Artificial Sequence
  Synthetic Polynucleotide
taatacgactcactatagggaggtttctccccagtatgggttctctcacaaacagaggagatgtgagatgacccatactaacctggcggcagcgcaaaagatg

SEQ ID NO: 238152 - DNA, 103 bp, Artificial Sequence
  Synthetic Polynucleotide
taatacgactcactatagggtttgagttctctgattacatttctcttctgaacagaggagacagaagatgaatgtaatcaacctggcggcagcgcaaaagatg

SEQ ID NO: 238153 - DNA, 103 bp, Artificial Sequence
  Synthetic Polynucleotide
taatacgactcactatagggcacatttataaggtttctccccagtatgggaacagaggagacccataatggggagaaacaacctggcggcagcgcaaaagatg

SEQ ID NO: 238154 - DNA, 103 bp, Artificial Sequence
  Synthetic Polynucleotide
taatacgactcactatagggtcacacatatcacatttataaggtttctccaacagaggagaggagaaatgttataaatgaacctggcggcagcgcaaaagatg

SEQ ID NO: 238155 - DNA, 103 bp, Artificial Sequence
  Synthetic Polynucleotide
taatacgactcactatagggaaaggttttctcacacatatcacatttataaacagaggagatataaaatggatatgtgtaacctggcggcagcgcaaaagatg

SEQ ID NO: 238156 - DNA, 103 bp, Artificial Sequence
  Synthetic Polynucleotide
taatacgactcactatagggagctttggacaaaggttttctcacacatataacagaggagaatatgtatgagaaaacctaacctggcggcagcgcaaaagatg

SEQ ID NO: 238157 - DNA, 103 bp, Artificial Sequence
  Synthetic Polynucleotide
taatacgactcactataggggtaagatctgagctttggacaaaggttttcaacagaggagagaaaacatgtgtccaaagaacctggcggcagcgcaaaagatg

SEQ ID NO: 238158 - DNA, 103 bp, Artificial Sequence
  Synthetic Polynucleotide
taatacgactcactatagggctggtgtgaagtaagatctgagctttggacaacagaggagagtccaaatgtcagatcttaacctggcggcagcgcaaaagatg

SEQ ID NO: 238159 - DNA, 103 bp, Artificial Sequence
  Synthetic Polynucleotide
taatacgactcactatagggtgtggatcctctggtgtgaagtaagatctgaacagaggagacagatcatgcttcacaccaacctggcggcagcgcaaaagatg

SEQ ID NO: 238160 - DNA, 103 bp, Artificial Sequence
  Synthetic Polynucleotide
taatacgactcactatagggttctcgtaattgtggatcctctggtgtgaaaacagaggagattcacaatggaggatccaaacctggcggcagcgcaaaagatg

SEQ ID NO: 238161 - DNA, 103 bp, Artificial Sequence
  Synthetic Polynucleotide
taatacgactcactatagggtttataaggtttctcgtaattgtggatcctaacagaggagaaggatcatgaattacgagaacctggcggcagcgcaaaagatg

SEQ ID NO: 238162 - DNA, 103 bp, Artificial Sequence
  Synthetic Polynucleotide
taatacgactcactatagggatttgctacatttataaggtttctcgtaataacagaggagaattacgatgaaccttataaacctggcggcagcgcaaaagatg

SEQ ID NO: 238163 - DNA, 103 bp, Artificial Sequence
  Synthetic Polynucleotide
taatacgactcactatagggattttccttttttgagttctctgattacataacagaggagaatgtaaatggagaactcaaacctggcggcagcgcaaaagatg

SEQ ID NO: 238164 - DNA, 103 bp, Artificial Sequence
  Synthetic Polynucleotide
taatacgactcactatagggctcttctcacatttgctacatttataaggtaacagaggagaaccttaatgatgtagcaaaacctggcggcagcgcaaaagatg

SEQ ID NO: 238165 - DNA, 103 bp, Artificial Sequence
  Synthetic Polynucleotide
taatacgactcactatagggatgccaaaagctcttctcacatttgctacaaacagaggagatgtagcatgtgtgagaagaacctggcggcagcgcaaaagatg

SEQ ID NO: 238166 - DNA, 103 bp, Artificial Sequence
  Synthetic Polynucleotide
taatacgactcactataggggcgctaagtgatgccaaaagctcttctcacaacagaggagagtgagaatggcttttggcaacctggcggcagcgcaaaagatg

SEQ ID NO: 238167 - DNA, 103 bp, Artificial Sequence
  Synthetic Polynucleotide
taatacgactcactatagggtgtcctgaaagcgctaagtgatgccaaaagaacagaggagacttttgatgtcacttagcaacctggcggcagcgcaaaagatg

SEQ ID NO: 238168 - DNA, 103 bp, Artificial Sequence
  Synthetic Polynucleotide
taatacgactcactatagggtgttctctgatgtcctgaaagcgctaagtgaacagaggagacacttaatgctttcaggaaacctggcggcagcgcaaaagatg

SEQ ID NO: 238169 - DNA, 103 bp, Artificial Sequence
  Synthetic Polynucleotide
taatacgactcactatagggtacctgcatgtgttctctgatgtcctgaaaaacagaggagatttcagatgatcagagaaaacctggcggcagcgcaaaagatg

SEQ ID NO: 238170 - DNA, 103 bp, Artificial Sequence
  Synthetic Polynucleotide
taatacgactcactatagggtagaattttttacctgcatgtgttctctgaaacagaggagatcagagatgacatgcaggaacctggcggcagcgcaaaagatg

SEQ ID NO: 238171 - DNA, 103 bp, Artificial Sequence
  Synthetic Polynucleotide
taatacgactcactataggggtcacatgtatagaattttttacctgcatgaacagaggagacatgcaatgaaaaaattcaacctggcggcagcgcaaaagatg

SEQ ID NO: 238172 - DNA, 103 bp, Artificial Sequence
  Synthetic Polynucleotide
taatacgactcactatagggtgccacaaatgtcacatgtatagaatttttaacagaggagaaaaaatatgatacatgtgaacctggcggcagcgcaaaagatg

SEQ ID NO: 238173 - DNA, 103 bp, Artificial Sequence
  Synthetic Polynucleotide
taatacgactcactatagggccaaaattcttgccacaaatgtcacatgtaaacagaggagatacatgatgcatttgtggaacctggcggcagcgcaaaagatg

SEQ ID NO: 238174 - DNA, 103 bp, Artificial Sequence
  Synthetic Polynucleotide
taatacgactcactatagggtacattatatattttccttttttgagttctaacagaggagaagaactatgaaaaggaaaaacctggcggcagcgcaaaagatg

SEQ ID NO: 238175 - DNA, 103 bp, Artificial Sequence
  Synthetic Polynucleotide
taatacgactcactatagggagaactctgaccaaaattcttgccacaaataacagaggagaatttgtatgaagaattttaacctggcggcagcgcaaaagatg

SEQ ID NO: 238176 - DNA, 103 bp, Artificial Sequence
  Synthetic Polynucleotide
taatacgactcactatagggcaagcagatcagaactctgaccaaaattctaacagaggagaagaattatggtcagagttaacctggcggcagcgcaaaagatg

SEQ ID NO: 238177 - DNA, 103 bp, Artificial Sequence
  Synthetic Polynucleotide
taatacgactcactatagggcgctggtggacaagcagatcagaactctgaaacagaggagatcagagatgtgatctgctaacctggcggcagcgcaaaagatg

SEQ ID NO: 238178 - DNA, 103 bp, Artificial Sequence
  Synthetic Polynucleotide
taatacgactcactatagggagtatggcttcgctggtggacaagcagatcaacagaggagagatctgatggtccaccagaacctggcggcagcgcaaaagatg

SEQ ID NO: 238179 - DNA, 103 bp, Artificial Sequence
  Synthetic Polynucleotide
taatacgactcactataggggtttctcgccagtatggcttcgctggtggaaacagaggagatccaccatggaagccataaacctggcggcagcgcaaaagatg

SEQ ID NO: 238180 - DNA, 103 bp, Artificial Sequence
  Synthetic Polynucleotide
taatacgactcactatagggcatagatatggtttctcgccagtatggcttaacagaggagaaagccaatgtggcgagaaaacctggcggcagcgcaaaagatg

SEQ ID NO: 238181 - DNA, 103 bp, Artificial Sequence
  Synthetic Polynucleotide
taatacgactcactatagggacactcactacatagatatggtttctcgccaacagaggagaggcgagatgccatatctaaacctggcggcagcgcaaaagatg

SEQ ID NO: 238182 - DNA, 103 bp, Artificial Sequence
  Synthetic Polynucleotide
taatacgactcactatagggagcatttgtcacactcactacatagatatgaacagaggagacatatcatggtagtgagtaacctggcggcagcgcaaaagatg

SEQ ID NO: 238183 - DNA, 103 bp, Artificial Sequence
  Synthetic Polynucleotide
taatacgactcactatagggcttctactgaagcatttgtcacactcactaaacagaggagatagtgaatgtgacaaatgaacctggcggcagcgcaaaagatg

SEQ ID NO: 238184 - DNA, 103 bp, Artificial Sequence
  Synthetic Polynucleotide
taatacgactcactataggggaggtttgtacttctactgaagcatttgtcaacagaggagagacaaaatgttcagtagaaacctggcggcagcgcaaaagatg

SEQ ID NO: 238185 - DNA, 103 bp, Artificial Sequence
  Synthetic Polynucleotide
taatacgactcactatagggtccgagggcatacattatatattttcctttaacagaggagaaaaggaatgtatataatgaacctggcggcagcgcaaaagatg

SEQ ID NO: 238186 - DNA, 103 bp, Artificial Sequence
  Synthetic Polynucleotide
taatacgactcactataggggatgccttatgaggtttgtacttctactgaaacagaggagatcagtaatggtacaaaccaacctggcggcagcgcaaaagatg

SEQ ID NO: 238187 - DNA, 103 bp, Artificial Sequence
  Synthetic Polynucleotide
taatacgactcactatagggtgagttcttcgatgccttatgaggtttgtaaacagaggagatacaaaatgcataaggcaaacctggcggcagcgcaaaagatg

SEQ ID NO: 238188 - DNA, 103 bp, Artificial Sequence
  Synthetic Polynucleotide
taatacgactcactatagggctcacctgtgtgagttcttcgatgccttataacagaggagaataaggatgcgaagaactaacctggcggcagcgcaaaagatg

SEQ ID NO: 238189 - DNA, 103 bp, Artificial Sequence
  Synthetic Polynucleotide
taatacgactcactatagggtaaatggtttctcacctgtgtgagttcttcaacagaggagagaagaaatgacacaggtgaacctggcggcagcgcaaaagatg

SEQ ID NO: 238190 - DNA, 103 bp, Artificial Sequence
  Synthetic Polynucleotide
taatacgactcactatagggtcgagacacttaaatggtttctcacctgtgaacagaggagacacaggatggaaaccattaacctggcggcagcgcaaaagatg

SEQ ID NO: 238191 - DNA, 103 bp, Artificial Sequence
  Synthetic Polynucleotide
taatacgactcactatagggtttttcacactcgagacacttaaatggtttaacagaggagaaaaccaatgaagtgtctcaacctggcggcagcgcaaaagatg

SEQ ID NO: 238192 - DNA, 103 bp, Artificial Sequence
  Synthetic Polynucleotide
taatacgactcactatagggcactaaaagctttttcacactcgagacactaacagaggagaagtgtcatgagtgtgaaaaacctggcggcagcgcaaaagatg

SEQ ID NO: 238193 - DNA, 103 bp, Artificial Sequence
  Synthetic Polynucleotide
taatacgactcactatagggtctgatttcccactaaaagctttttcacacaacagaggagagtgtgaatgagcttttagaacctggcggcagcgcaaaagatg

SEQ ID NO: 238194 - DNA, 103 bp, Artificial Sequence
  Synthetic Polynucleotide
taatacgactcactataggggctaataagatctgatttcccactaaaagcaacagaggagagcttttatggggaaatcaaacctggcggcagcgcaaaagatg

SEQ ID NO: 238195 - DNA, 103 bp, Artificial Sequence
  Synthetic Polynucleotide
taatacgactcactatagggttctctggtggctaataagatctgatttccaacagaggagaggaaatatgatcttattaaacctggcggcagcgcaaaagatg

SEQ ID NO: 238196 - DNA, 103 bp, Artificial Sequence
  Synthetic Polynucleotide
taatacgactcactatagggtttttacccttccgagggcatacattatataacagaggagaatataaatgatgccctcgaacctggcggcagcgcaaaagatg

SEQ ID NO: 238197 - DNA, 103 bp, Artificial Sequence
  Synthetic Polynucleotide
taatacgactcactatagggccagtgtgagttctctggtggctaataagaaacagaggagatcttatatgccaccagagaacctggcggcagcgcaaaagatg

SEQ ID NO: 238198 - DNA, 103 bp, Artificial Sequence
  Synthetic Polynucleotide
taatacgactcactataggggggcctttccccagtgtgagttctctggtgaacagaggagacaccagatgactcacactaacctggcggcagcgcaaaagatg

SEQ ID NO: 238199 - DNA, 103 bp, Artificial Sequence
  Synthetic Polynucleotide
taatacgactcactatagggtacatttgtagggcctttccccagtgtgagaacagaggagactcacaatggggaaaggcaacctggcggcagcgcaaaagatg

SEQ ID NO: 238200 - DNA, 103 bp, Artificial Sequence
  Synthetic Polynucleotide
taatacgactcactatagggtcacacttattacatttgtagggcctttccaacagaggagaggaaagatgctacaaatgaacctggcggcagcgcaaaagatg

SEQ ID NO: 238201 - DNA, 103 bp, Artificial Sequence
  Synthetic Polynucleotide
taatacgactcactataggggtaacttttctcacacttattacatttgtaaacagaggagatacaaaatgaataagtgtaacctggcggcagcgcaaaagatg

SEQ ID NO: 238202 - DNA, 103 bp, Artificial Sequence
  Synthetic Polynucleotide
taatacgactcactatagggaacggtgtcggtaacttttctcacacttataacagaggagaataagtatgagaaaagttaacctggcggcagcgcaaaagatg

SEQ ID NO: 238203 - DNA, 103 bp, Artificial Sequence
  Synthetic Polynucleotide
taatacgactcactatagggatgaaggctgaacggtgtcggtaacttttcaacagaggagagaaaagatgccgacaccgaacctggcggcagcgcaaaagatg

SEQ ID NO: 238204 - DNA, 103 bp, Artificial Sequence
  Synthetic Polynucleotide
taatacgactcactatagggtttatgtacaatgaaggctgaacggtgtcgaacagaggagacgacacatgtcagccttcaacctggcggcagcgcaaaagatg

SEQ ID NO: 238205 - DNA, 103 bp, Artificial Sequence
  Synthetic Polynucleotide
taatacgactcactatagggtatgaactcttttatgtacaatgaaggctgaacagaggagacagcctatgttgtacataaacctggcggcagcgcaaaagatg

SEQ ID NO: 238206 - DNA, 103 bp, Artificial Sequence
  Synthetic Polynucleotide
taatacgactcactatagggttctccccagtatgaactcttttatgtacaaacagaggagatgtacaatgaagagttcaaacctggcggcagcgcaaaagatg

SEQ ID NO: 238207 - DNA, 103 bp, Artificial Sequence
  Synthetic Polynucleotide
taatacgactcactatagggaataaaaatctttttacccttccgagggcaaacagaggagatgccctatgaagggtaaaaacctggcggcagcgcaaaagatg

SEQ ID NO: 238208 - DNA, 103 bp, Artificial Sequence
  Synthetic Polynucleotide
taatacgactcactatagggcttatagggcttctccccagtatgaactctaacagaggagaagagttatgactggggagaacctggcggcagcgcaaaagatg

SEQ ID NO: 238209 - DNA, 103 bp, Artificial Sequence
  Synthetic Polynucleotide
taatacgactcactatagggaggcaccacacttatagggcttctccccagaacagaggagactggggatgagccctataaacctggcggcagcgcaaaagatg

SEQ ID NO: 238210 - DNA, 103 bp, Artificial Sequence
  Synthetic Polynucleotide
taatacgactcactatagggcatttttcacaggcaccacacttatagggcaacagaggagagccctaatggtgtggtgcaacctggcggcagcgcaaaagatg

SEQ ID NO: 238211 - DNA, 103 bp, Artificial Sequence
  Synthetic Polynucleotide
taatacgactcactatagggctggccaaagcatttttcacaggcaccacaaacagaggagatgtggtatgtgtgaaaaaaacctggcggcagcgcaaaagatg

SEQ ID NO: 238212 - DNA, 103 bp, Artificial Sequence
  Synthetic Polynucleotide
taatacgactcactatagggggtctgatttctggccaaagcatttttcacaacagaggagagtgaaaatggctttggccaacctggcggcagcgcaaaagatg

SEQ ID NO: 238213 - DNA, 103 bp, Artificial Sequence
  Synthetic Polynucleotide
taatacgactcactatagggtgcacgataaggtctgatttctggccaaagaacagaggagactttggatggaaatcagaaacctggcggcagcgcaaaagatg

SEQ ID NO: 238214 - DNA, 103 bp, Artificial Sequence
  Synthetic Polynucleotide
taatacgactcactataggggactctctggtgcacgataaggtctgatttaacagaggagaaaatcaatgcttatcgtgaacctggcggcagcgcaaaagatg

SEQ ID NO: 238215 - DNA, 103 bp, Artificial Sequence
  Synthetic Polynucleotide
taatacgactcactatagggcacctgtgtggactctctggtgcacgataaaacagaggagattatcgatgaccagagagaacctggcggcagcgcaaaagatg

SEQ ID NO: 238216 - DNA, 103 bp, Artificial Sequence
  Synthetic Polynucleotide
taatacgactcactatagggtacggcttctcacctgtgtggactctctggaacagaggagaccagagatgccacacaggaacctggcggcagcgcaaaagatg

SEQ ID NO: 238217 - DNA, 103 bp, Artificial Sequence
  Synthetic Polynucleotide
taatacgactcactatagggcaggcatttatacggcttctcacctgtgtgaacagaggagacacacaatggagaagccgaacctggcggcagcgcaaaagatg

SEQ ID NO: 238218 - DNA, 103 bp, Artificial Sequence
  Synthetic Polynucleotide
taatacgactcactatagggcatgcatatgaataaaaatctttttaccctaacagaggagaagggtaatgagatttttaaacctggcggcagcgcaaaagatg

SEQ ID NO: 238219 - DNA, 103 bp, Artificial Sequence
  Synthetic Polynucleotide
taatacgactcactatagggtcatacattccaggcatttatacggcttctaacagaggagaagaagcatgataaatgccaacctggcggcagcgcaaaagatg

SEQ ID NO: 238220 - DNA, 103 bp, Artificial Sequence
  Synthetic Polynucleotide
taatacgactcactataggggtaaaacttctcatacattccaggcatttaaacagaggagataaatgatgggaatgtataacctggcggcagcgcaaaagatg

SEQ ID NO: 238221 - DNA, 103 bp, Artificial Sequence
  Synthetic Polynucleotide
taatacgactcactatagggggcactccgagtaaaacttctcatacattcaacagaggagagaatgtatgagaagttttaacctggcggcagcgcaaaagatg

SEQ ID NO: 238222 - DNA, 103 bp, Artificial Sequence
  Synthetic Polynucleotide
taatacgactcactatagggtaattaggttggcactccgagtaaaacttcaacagaggagagaagttatgctcggagtgaacctggcggcagcgcaaaagatg

SEQ ID NO: 238223 - DNA, 103 bp, Artificial Sequence
  Synthetic Polynucleotide
taatacgactcactataggggcctggtgcctaattaggttggcactccgaaacagaggagatcggagatgcaacctaataacctggcggcagcgcaaaagatg

SEQ ID NO: 238224 - DNA, 103 bp, Artificial Sequence
  Synthetic Polynucleotide
taatacgactcactatagggagtgtgagttgcctggtgcctaattaggttaacagaggagaaacctaatgaggcaccagaacctggcggcagcgcaaaagatg

SEQ ID NO: 238225 - DNA, 103 bp, Artificial Sequence
  Synthetic Polynucleotide
taatacgactcactatagggtaaaagtgtgagtgtgagttgcctggtgccaacagaggagaggcaccatgcaactcacaaacctggcggcagcgcaaaagatg

SEQ ID NO: 238226 - DNA, 103 bp, Artificial Sequence
  Synthetic Polynucleotide
taatacgactcactatagggtcaaggcatttaaaagtgtgagtgtgagttaacagaggagaaactcaatgtcacactttaacctggcggcagcgcaaaagatg

SEQ ID NO: 238227 - DNA, 103 bp, Artificial Sequence
  Synthetic Polynucleotide
taatacgactcactatagggtttttcatattcaaggcatttaaaagtgtgaacagaggagacacactatgaaatgccttaacctggcggcagcgcaaaagatg

SEQ ID NO: 238228 - DNA, 103 bp, Artificial Sequence
  Synthetic Polynucleotide
taatacgactcactatagggagttaaagcttttttcatattcaaggcattaacagaggagaaatgccatgaatatgaaaaacctggcggcagcgcaaaagatg

SEQ ID NO: 238229 - DNA, 103 bp, Artificial Sequence
  Synthetic Polynucleotide
taatacgactcactatagggtgaataatctcatgcatatgaataaaaatcaacagaggagagattttatgtcatatgcaaacctggcggcagcgcaaaagatg

SEQ ID NO: 238230 - DNA, 103 bp, Artificial Sequence
  Synthetic Polynucleotide
taatacgactcactatagggtctgagctacagttaaagcttttttcatataacagaggagaatatgaatgaagctttaaaacctggcggcagcgcaaaagatg

SEQ ID NO: 238231 - DNA, 103 bp, Artificial Sequence
  Synthetic Polynucleotide
taatacgactcactatagggtacaataagatctgagctacagttaaagctaacagaggagaagctttatgtgtagctcaaacctggcggcagcgcaaaagatg

SEQ ID NO: 238232 - DNA, 103 bp, Artificial Sequence
  Synthetic Polynucleotide
taatacgactcactatagggttctctgatgtacaataagatctgagctacaacagaggagagtagctatgatcttattgaacctggcggcagcgcaaaagatg

SEQ ID NO: 238233 - DNA, 103 bp, Artificial Sequence
  Synthetic Polynucleotide
taatacgactcactatagggtccatgtgaattctctgatgtacaataagaaacagaggagatcttatatgacatcagagaacctggcggcagcgcaaaagatg

SEQ ID NO: 238234 - DNA, 103 bp, Artificial Sequence
  Synthetic Polynucleotide
taatacgactcactatagggtggtttctcttccatgtgaattctctgatgaacagaggagacatcagatgattcacatgaacctggcggcagcgcaaaagatg

SEQ ID NO: 238235 - DNA, 103 bp, Artificial Sequence
  Synthetic Polynucleotide
taatacgactcactatagggaccactgatgtggtttctcttccatgtgaaaacagaggagattcacaatgaagagaaacaacctggcggcagcgcaaaagatg

SEQ ID NO: 238236 - DNA, 103 bp, Artificial Sequence
  Synthetic Polynucleotide
taatacgactcactatagggtcacacgcagaccactgatgtggtttctctaacagaggagaagagaaatgacatcagtgaacctggcggcagcgcaaaagatg

SEQ ID NO: 238237 - DNA, 103 bp, Artificial Sequence
  Synthetic Polynucleotide
taatacgactcactataggggaagccactctcacacgcagaccactgatgaacagaggagacatcagatgtctgcgtgtaacctggcggcagcgcaaaagatg

SEQ ID NO: 238238 - DNA, 103 bp, Artificial Sequence
  Synthetic Polynucleotide
taatacgactcactatagggttcctaggaggaagccactctcacacgcagaacagaggagactgcgtatgagagtggctaacctggcggcagcgcaaaagatg

SEQ ID NO: 238239 - DNA, 103 bp, Artificial Sequence
  Synthetic Polynucleotide
taatacgactcactatagggacaaagtccattcctaggaggaagccactcaacagaggagagagtggatgcctcctaggaacctggcggcagcgcaaaagatg

SEQ ID NO: 238240 - DNA, 103 bp, Artificial Sequence
  Synthetic Polynucleotide
taatacgactcactataggggctgctgctctccacctcgttctcctccataacagaggagaatggagatgaacgaggtgaacctggcggcagcgcaaaagatg

SEQ ID NO: 238241 - DNA, 103 bp, Artificial Sequence
  Synthetic Polynucleotide
taatacgactcactataggggctgctgtcggcggacacggcttctgaggtaacagaggagaacctcaatggccgtgtccaacctggcggcagcgcaaaagatg

SEQ ID NO: 238242 - DNA, 103 bp, Artificial Sequence
  Synthetic Polynucleotide
taatacgactcactatagggggggcgctggagccgaagctgccggcctcgaacagaggagacgaggcatgcagcttcggaacctggcggcagcgcaaaagatg

SEQ ID NO: 238243 - DNA, 103 bp, Artificial Sequence
  Synthetic Polynucleotide
taatacgactcactatagggtactgggggtggggcgctggagccgaagctaacagaggagaagcttcatgtccagcgccaacctggcggcagcgcaaaagatg

SEQ ID NO: 238244 - DNA, 103 bp, Artificial Sequence
  Synthetic Polynucleotide
taatacgactcactatagggggccttggggtactgggggtggggcgctggaacagaggagaccagcgatgcacccccagaacctggcggcagcgcaaaagatg

SEQ ID NO: 238245 - DNA, 103 bp, Artificial Sequence
  Synthetic Polynucleotide
taatacgactcactatagggtctccttcggggccttggggtactgggggtaacagaggagaacccccatgaccccaaggaacctggcggcagcgcaaaagatg

SEQ ID NO: 238246 - DNA, 103 bp, Artificial Sequence
  Synthetic Polynucleotide
taatacgactcactataggggccggccaggtctccttcggggccttggggaacagaggagaccccaaatgcccgaaggaaacctggcggcagcgcaaaagatg

SEQ ID NO: 238247 - DNA, 103 bp, Artificial Sequence
  Synthetic Polynucleotide
taatacgactcactatagggagcttccggggccggccaggtctccttcggaacagaggagaccgaagatgacctggccgaacctggcggcagcgcaaaagatg

SEQ ID NO: 238248 - DNA, 103 bp, Artificial Sequence
  Synthetic Polynucleotide
taatacgactcactatagggcaggcggggcagcttccggggccggccaggaacagaggagacctggcatgccccggaagaacctggcggcagcgcaaaagatg

SEQ ID NO: 238249 - DNA, 103 bp, Artificial Sequence
  Synthetic Polynucleotide
taatacgactcactatagggctgagatctccaggcggggcagcttccgggaacagaggagacccggaatgtgccccgccaacctggcggcagcgcaaaagatg

SEQ ID NO: 238250 - DNA, 103 bp, Artificial Sequence
  Synthetic Polynucleotide
taatacgactcactatagggtctgggaggtctgagatctccaggcggggcaacagaggagagccccgatgggagatctcaacctggcggcagcgcaaaagatg

SEQ ID NO: 238251 - DNA, 103 bp, Artificial Sequence
  Synthetic Polynucleotide
taatacgactcactatagggttccacaccatctgggaggtctgagatctcaacagaggagagagatcatggacctcccaaacctggcggcagcgcaaaagatg

SEQ ID NO: 238252 - DNA, 103 bp, Artificial Sequence
  Synthetic Polynucleotide
taatacgactcactatagggccgcggcgtcgctgctgtcggcggacacggaacagaggagaccgtgtatgccgacagcaaacctggcggcagcgcaaaagatg

SEQ ID NO: 238253 - DNA, 103 bp, Artificial Sequence
  Synthetic Polynucleotide
taatacgactcactataggggaggctctccttccacaccatctgggaggtaacagaggagaacctccatgatggtgtggaacctggcggcagcgcaaaagatg

SEQ ID NO: 238254 - DNA, 103 bp, Artificial Sequence
  Synthetic Polynucleotide
taatacgactcactataggggaactcactagaggctctccttccacaccaaacagaggagatggtgtatgaggagagccaacctggcggcagcgcaaaagatg

SEQ ID NO: 238255 - DNA, 103 bp, Artificial Sequence
  Synthetic Polynucleotide
taatacgactcactatagggtccactctgggaactcactagaggctctccaacagaggagaggagagatgctagtgagtaacctggcggcagcgcaaaagatg

SEQ ID NO: 238256 - DNA, 103 bp, Artificial Sequence
  Synthetic Polynucleotide
taatacgactcactataggggagggctctgtccactctgggaactcactaaacagaggagatagtgaatgcccagagtgaacctggcggcagcgcaaaagatg

SEQ ID NO: 238257 - DNA, 103 bp, Artificial Sequence
  Synthetic Polynucleotide
taatacgactcactatagggtgtggctctggagggctctgtccactctggaacagaggagaccagagatgacagagcccaacctggcggcagcgcaaaagatg

SEQ ID NO: 238258 - DNA, 103 bp, Artificial Sequence
  Synthetic Polynucleotide
taatacgactcactatagggctcgggatcctgtggctctggagggctctgaacagaggagacagagcatgccagagccaaacctggcggcagcgcaaaagatg

SEQ ID NO: 238259 - DNA, 103 bp, Artificial Sequence
  Synthetic Polynucleotide
taatacgactcactatagggagctgggagcctcgggatcctgtggctctgaacagaggagacagagcatgaggatcccgaacctggcggcagcgcaaaagatg

SEQ ID NO: 238260 - DNA, 103 bp, Artificial Sequence
  Synthetic Polynucleotide
taatacgactcactataggggggcctgaggagctgggagcctcgggatccaacagaggagaggatccatgggctcccagaacctggcggcagcgcaaaagatg

SEQ ID NO: 238261 - DNA, 103 bp, Artificial Sequence
  Synthetic Polynucleotide
taatacgactcactatagggcaggtgtcctgggcctgaggagctgggagcaacagaggagagctcccatgtcctcaggcaacctggcggcagcgcaaaagatg

SEQ ID NO: 238262 - DNA, 103 bp, Artificial Sequence
  Synthetic Polynucleotide
taatacgactcactatagggccatggccaccaggtgtcctgggcctgaggaacagaggagacctcagatgcaggacaccaacctggcggcagcgcaaaagatg

SEQ ID NO: 238263 - DNA, 103 bp, Artificial Sequence
  Synthetic Polynucleotide
taatacgactcactatagggcccggggcggccgcggcgtcgctgctgtcgaacagaggagacgacagatgcgacgccgcaacctggcggcagcgcaaaagatg

SEQ ID NO: 238264 - DNA, 103 bp, Artificial Sequence
  Synthetic Polynucleotide
taatacgactcactatagggctcaccttgcccatggccaccaggtgtcctaacagaggagaaggacaatgggtggccataacctggcggcagcgcaaaagatg

SEQ ID NO: 238265 - DNA, 103 bp, Artificial Sequence
  Synthetic Polynucleotide
taatacgactcactatagggaggggtcctgctcaccttgcccatggccacaacagaggagagtggccatgggcaaggtgaacctggcggcagcgcaaaagatg

SEQ ID NO: 238266 - DNA, 103 bp, Artificial Sequence
  Synthetic Polynucleotide
taatacgactcactatagggcagcttccacaggggtcctgctcaccttgcaacagaggagagcaaggatggcaggacccaacctggcggcagcgcaaaagatg

SEQ ID NO: 238267 - DNA, 103 bp, Artificial Sequence
  Synthetic Polynucleotide
taatacgactcactatagggtggctcacaccagcttccacaggggtcctgaacagaggagacaggacatgtgtggaagcaacctggcggcagcgcaaaagatg

SEQ ID NO: 238268 - DNA, 103 bp, Artificial Sequence
  Synthetic Polynucleotide
taatacgactcactatagggtgcatctgactggctcacaccagcttccacaacagaggagagtggaaatgggtgtgagcaacctggcggcagcgcaaaagatg

SEQ ID NO: 238269 - DNA, 103 bp, Artificial Sequence
  Synthetic Polynucleotide
taatacgactcactatagggctgcgttctctgcatctgactggctcacacaacagaggagagtgtgaatgagtcagatgaacctggcggcagcgcaaaagatg

SEQ ID NO: 238270 - DNA, 103 bp, Artificial Sequence
  Synthetic Polynucleotide
taatacgactcactatagggcaggagggggctgcgttctctgcatctgacaacagaggagagtcagaatgagagaacgcaacctggcggcagcgcaaaagatg

SEQ ID NO: 238271 - DNA, 103 bp, Artificial Sequence
  Synthetic Polynucleotide
taatacgactcactatagggctcatccgggcaggagggggctgcgttctcaacagaggagagagaacatggccccctccaacctggcggcagcgcaaaagatg

SEQ ID NO: 238272 - DNA, 103 bp, Artificial Sequence
  Synthetic Polynucleotide
taatacgactcactataggggagtgtcatgctcatccgggcaggagggggaacagaggagaccccctatggcccggatgaacctggcggcagcgcaaaagatg

SEQ ID NO: 238273 - DNA, 103 bp, Artificial Sequence
  Synthetic Polynucleotide
taatacgactcactatagggcgccggggcagagtgtcatgctcatccgggaacagaggagacccggaatggcatgacacaacctggcggcagcgcaaaagatg

SEQ ID NO: 238274 - DNA, 103 bp, Artificial Sequence
  Synthetic Polynucleotide
taatacgactcactatagggctctgcctgccccggggcggccgcggcgtcaacagaggagagacgccatggccgccccgaacctggcggcagcgcaaaagatg

SEQ ID NO: 238275 - DNA, 103 bp, Artificial Sequence
  Synthetic Polynucleotide
taatacgactcactatagggtcgacctcggcgccggggcagagtgtcatgaacagaggagacatgacatgctgccccggaacctggcggcagcgcaaaagatg

SEQ ID NO: 238276 - DNA, 103 bp, Artificial Sequence
  Synthetic Polynucleotide
taatacgactcactataggggcctggaaggtcgacctcggcgccggggcaaacagaggagatgccccatggccgaggtcaacctggcggcagcgcaaaagatg

SEQ ID NO: 238277 - DNA, 103 bp, Artificial Sequence
  Synthetic Polynucleotide
taatacgactcactatagggcctaggaagcgcctggaaggtcgacctcggaacagaggagaccgaggatgaccttccagaacctggcggcagcgcaaaagatg

SEQ ID NO: 238278 - DNA, 103 bp, Artificial Sequence
  Synthetic Polynucleotide
taatacgactcactataggggtatttcttgcctaggaagcgcctggaaggaacagaggagaccttccatgcgcttcctaaacctggcggcagcgcaaaagatg

SEQ ID NO: 238279 - DNA, 103 bp, Artificial Sequence
  Synthetic Polynucleotide
taatacgactcactatagggagtacttgcggtatttcttgcctaggaagcaacagaggagagcttccatggcaagaaataacctggcggcagcgcaaaagatg

SEQ ID NO: 238280 - DNA, 103 bp, Artificial Sequence
  Synthetic Polynucleotide
taatacgactcactataggggacttgtaatagtacttgcggtatttcttgaacagaggagacaagaaatgccgcaagtaaacctggcggcagcgcaaaagatg

SEQ ID NO: 238281 - DNA, 103 bp, Artificial Sequence
  Synthetic Polynucleotide
taatacgactcactatagggtggtttgggcgacttgtaatagtacttgcgaacagaggagacgcaagatgtattacaagaacctggcggcagcgcaaaagatg

SEQ ID NO: 238282 - DNA, 103 bp, Artificial Sequence
  Synthetic Polynucleotide
taatacgactcactataggggcctcaaaagtggtttgggcgacttgtaataacagaggagaattacaatgcgcccaaacaacctggcggcagcgcaaaagatg

SEQ ID NO: 238283 - DNA, 103 bp, Artificial Sequence
  Synthetic Polynucleotide
taatacgactcactatagggcacaggaagggcctcaaaagtggtttgggcaacagaggagagcccaaatgacttttgagaacctggcggcagcgcaaaagatg

SEQ ID NO: 238284 - DNA, 103 bp, Artificial Sequence
  Synthetic Polynucleotide
taatacgactcactatagggacagatgcggcacaggaagggcctcaaaagaacagaggagacttttgatgcccttcctgaacctggcggcagcgcaaaagatg

SEQ ID NO: 238285 - DNA, 103 bp, Artificial Sequence
  Synthetic Polynucleotide
taatacgactcactatagggagtcatcggcctctgcctgccccggggcggaacagaggagaccgcccatgggcaggcagaacctggcggcagcgcaaaagatg

SEQ ID NO: 238286 - DNA, 103 bp, Artificial Sequence
  Synthetic Polynucleotide
taatacgactcactatagggagcgagaaccacagatgcggcacaggaaggaacagaggagaccttccatggccgcatctaacctggcggcagcgcaaaagatg

SEQ ID NO: 238287 - DNA, 103 bp, Artificial Sequence
  Synthetic Polynucleotide
taatacgactcactatagggtgggacagaaagcgagaaccacagatgcggaacagaggagaccgcatatgtggttctcgaacctggcggcagcgcaaaagatg

SEQ ID NO: 238288 - DNA, 103 bp, Artificial Sequence
  Synthetic Polynucleotide
taatacgactcactatagggcaggtcctcgtgggacagaaagcgagaaccaacagaggagaggttctatgtttctgtccaacctggcggcagcgcaaaagatg

SEQ ID NO: 238289 - DNA, 103 bp, Artificial Sequence
  Synthetic Polynucleotide
taatacgactcactatagggcgtggaagcgcaggtcctcgtgggacagaaaacagaggagattctgtatgacgaggaccaacctggcggcagcgcaaaagatg

SEQ ID NO: 238290 - DNA, 103 bp, Artificial Sequence
  Synthetic Polynucleotide
taatacgactcactatagggtgggagttgacgtggaagcgcaggtcctcgaacagaggagacgaggaatggcgcttccaaacctggcggcagcgcaaaagatg

SEQ ID NO: 238291 - DNA, 103 bp, Artificial Sequence
  Synthetic Polynucleotide
taatacgactcactataggggccagcctcatgggagttgacgtggaagcgaacagaggagacgcttcatggtcaactccaacctggcggcagcgcaaaagatg

SEQ ID NO: 238292 - DNA, 103 bp, Artificial Sequence
  Synthetic Polynucleotide
taatacgactcactataggggctggggatcgccagcctcatgggagttgaaacagaggagatcaactatgatgaggctgaacctggcggcagcgcaaaagatg

SEQ ID NO: 238293 - DNA, 103 bp, Artificial Sequence
  Synthetic Polynucleotide
taatacgactcactatagggcacttgaagagctggggatcgccagcctcaaacagaggagatgaggcatgcgatccccaaacctggcggcagcgcaaaagatg

SEQ ID NO: 238294 - DNA, 103 bp, Artificial Sequence
  Synthetic Polynucleotide
taatacgactcactataggggcactgcaggcacttgaagagctggggatcaacagaggagagatcccatgctcttcaagaacctggcggcagcgcaaaagatg

SEQ ID NO: 238295 - DNA, 103 bp, Artificial Sequence
  Synthetic Polynucleotide
taatacgactcactatagggaacgatagctgcactgcaggcacttgaagaaacagaggagatcttcaatggcctgcagtaacctggcggcagcgcaaaagatg

SEQ ID NO: 238296 - DNA, 103 bp, Artificial Sequence
  Synthetic Polynucleotide
taatacgactcactatagggcccacgccagagtcatcggcctctgcctgcaacagaggagagcaggcatgggccgatgaaacctggcggcagcgcaaaagatg

SEQ ID NO: 238297 - DNA, 103 bp, Artificial Sequence
  Synthetic Polynucleotide
taatacgactcactatagggcagcggcgggaacgatagctgcactgcaggaacagaggagacctgcaatgcagctatcgaacctggcggcagcgcaaaagatg

SEQ ID NO: 238298 - DNA, 103 bp, Artificial Sequence
  Synthetic Polynucleotide
taatacgactcactataggggagcgaggaccagcggcgggaacgatagctaacagaggagaagctatatgtcccgccgcaacctggcggcagcgcaaaagatg

SEQ ID NO: 238299 - DNA, 103 bp, Artificial Sequence
  Synthetic Polynucleotide
taatacgactcactatagggtgtgctccttgagcgaggaccagcggcgggaacagaggagacccgccatgggtcctcgcaacctggcggcagcgcaaaagatg

SEQ ID NO: 238300 - DNA, 103 bp, Artificial Sequence
  Synthetic Polynucleotide
taatacgactcactatagggtggttgaacatgtgctccttgagcgaggacaacagaggagagtcctcatgcaaggagcaaacctggcggcagcgcaaaagatg

SEQ ID NO: 238301 - DNA, 103 bp, Artificial Sequence
  Synthetic Polynucleotide
taatacgactcactataggggctgcccacgtggttgaacatgtgctccttaacagaggagaaaggagatgatgttcaacaacctggcggcagcgcaaaagatg

SEQ ID NO: 238302 - DNA, 103 bp, Artificial Sequence
  Synthetic Polynucleotide
taatacgactcactatagggtgtagggcttgctgcccacgtggttgaacaaacagaggagatgttcaatgacgtgggcaaacctggcggcagcgcaaaagatg

SEQ ID NO: 238303 - DNA, 103 bp, Artificial Sequence
  Synthetic Polynucleotide
taatacgactcactatagggtcgtcacacttgtagggcttgctgcccacgaacagaggagacgtgggatgcaagccctaaacctggcggcagcgcaaaagatg

SEQ ID NO: 238304 - DNA, 103 bp, Artificial Sequence
  Synthetic Polynucleotide
taatacgactcactataggggtagctgcactcgtcacacttgtagggcttaacagaggagaaagcccatgaagtgtgacaacctggcggcagcgcaaaagatg

SEQ ID NO: 238305 - DNA, 103 bp, Artificial Sequence
  Synthetic Polynucleotide
taatacgactcactatagggagacactggtgtagctgcactcgtcacactaacagaggagaagtgtgatgagtgcagctaacctggcggcagcgcaaaagatg

SEQ ID NO: 238306 - DNA, 103 bp, Artificial Sequence
  Synthetic Polynucleotide
taatacgactcactatagggtccttccggtagacactggtgtagctgcacaacagaggagagtgcagatgcaccagtgtaacctggcggcagcgcaaaagatg

SEQ ID NO: 238307 - DNA, 103 bp, Artificial Sequence
  Synthetic Polynucleotide
taatacgactcactatagggcgagctttgccccacgccagagtcatcggcaacagaggagagccgatatgtctggcgtgaacctggcggcagcgcaaaagatg

SEQ ID NO: 238308 - DNA, 103 bp, Artificial Sequence
  Synthetic Polynucleotide
taatacgactcactatagggccgaatgacgtccttccggtagacactggtaacagaggagaaccagtatgtaccggaagaacctggcggcagcgcaaaagatg

SEQ ID NO: 238309 - DNA, 103 bp, Artificial Sequence
  Synthetic Polynucleotide
taatacgactcactatagggcagcggcgtgccgaatgacgtccttccggtaacagaggagaaccggaatgacgtcattcaacctggcggcagcgcaaaagatg

SEQ ID NO: 238310 - DNA, 103 bp, Artificial Sequence
  Synthetic Polynucleotide
taatacgactcactatagggcggctgtgcacagcggcgtgccgaatgacgaacagaggagacgtcatatggcacgccgcaacctggcggcagcgcaaaagatg

SEQ ID NO: 238311 - DNA, 103 bp, Artificial Sequence
  Synthetic Polynucleotide
taatacgactcactatagggcttccggtcccggctgtgcacagcggcgtgaacagaggagacacgccatggtgcacagcaacctggcggcagcgcaaaagatg

SEQ ID NO: 238312 - DNA, 103 bp, Artificial Sequence
  Synthetic Polynucleotide
taatacgactcactatagggctggcctcttcttccggtcccggctgtgcaaacagaggagatgcacaatggggaccggaaacctggcggcagcgcaaaagatg

SEQ ID NO: 238313 - DNA, 103 bp, Artificial Sequence
  Synthetic Polynucleotide
taatacgactcactatagggggagtcggatctggcctcttcttccggtccaacagaggagaggaccgatggaagaggccaacctggcggcagcgcaaaagatg

SEQ ID NO: 238314 - DNA, 103 bp, Artificial Sequence
  Synthetic Polynucleotide
taatacgactcactataggggctcagctttggagtcggatctggcctcttaacagaggagaaagaggatggatccgactaacctggcggcagcgcaaaagatg

SEQ ID NO: 238315 - DNA, 103 bp, Artificial Sequence
  Synthetic Polynucleotide
taatacgactcactatagggaggggaaagagctcagctttggagtcggataacagaggagaatccgaatgcaaagctgaaacctggcggcagcgcaaaagatg

SEQ ID NO: 238316 - DNA, 103 bp, Artificial Sequence
  Synthetic Polynucleotide
taatacgactcactatagggcacacagggcaggggaaagagctcagctttaacagaggagaaaagctatgctctttcccaacctggcggcagcgcaaaagatg

SEQ ID NO: 238317 - DNA, 103 bp, Artificial Sequence
  Synthetic Polynucleotide
taatacgactcactatagggcacacggccacacacagggcaggggaaagaaacagaggagatctttcatgtgccctgtgaacctggcggcagcgcaaaagatg

SEQ ID NO: 238318 - DNA, 103 bp, Artificial Sequence
  Synthetic Polynucleotide
taatacgactcactatagggtgccgcggtccgagctttgccccacgccagaacagaggagactggcgatgggcaaagctaacctggcggcagcgcaaaagatg

SEQ ID NO: 238319 - DNA, 103 bp, Artificial Sequence
  Synthetic Polynucleotide
taatacgactcactataggggcatggggtacacacggccacacacagggcaacagaggagagccctgatggtggccgtgaacctggcggcagcgcaaaagatg

SEQ ID NO: 238320 - DNA, 103 bp, Artificial Sequence
  Synthetic Polynucleotide
taatacgactcactatagggagtcttttctgcatggggtacacacggccaaacagaggagatggccgatggtaccccataacctggcggcagcgcaaaagatg

SEQ ID NO: 238321 - DNA, 103 bp, Artificial Sequence
  Synthetic Polynucleotide
taatacgactcactataggggtgctgcgtgagtcttttctgcatggggtaaacagaggagataccccatgcagaaaagaaacctggcggcagcgcaaaagatg

SEQ ID NO: 238322 - DNA, 103 bp, Artificial Sequence
  Synthetic Polynucleotide
taatacgactcactataggggcgtcttcatgtgctgcgtgagtcttttctaacagaggagaagaaaaatgtcacgcagcaacctggcggcagcgcaaaagatg

SEQ ID NO: 238323 - DNA, 103 bp, Artificial Sequence
  Synthetic Polynucleotide
taatacgactcactatagggtcagtgctgtgcgtcttcatgtgctgcgtgaacagaggagacacgcaatgcatgaagacaacctggcggcagcgcaaaagatg

SEQ ID NO: 238324 - DNA, 103 bp, Artificial Sequence
  Synthetic Polynucleotide
taatacgactcactataggggtggggcttctcagtgctgtgcgtcttcataacagaggagaatgaagatgcacagcactaacctggcggcagcgcaaaagatg

SEQ ID NO: 238325 - DNA, 103 bp, Artificial Sequence
  Synthetic Polynucleotide
taatacgactcactatagggtgtcacacatgtggggcttctcagtgctgtaacagaggagaacagcaatgagaagccccaacctggcggcagcgcaaaagatg

SEQ ID NO: 238326 - DNA, 103 bp, Artificial Sequence
  Synthetic Polynucleotide
taatacgactcactatagggtttccacacttgtcacacatgtggggcttcaacagaggagagaagccatgcatgtgtgaaacctggcggcagcgcaaaagatg

SEQ ID NO: 238327 - DNA, 103 bp, Artificial Sequence
  Synthetic Polynucleotide
taatacgactcactatagggcttaaaggactttccacacttgtcacacataacagaggagaatgtgtatgaagtgtggaaacctggcggcagcgcaaaagatg

SEQ ID NO: 238328 - DNA, 103 bp, Artificial Sequence
  Synthetic Polynucleotide
taatacgactcactatagggtgtagcgcttcttaaaggactttccacactaacagaggagaagtgtgatgagtcctttaaacctggcggcagcgcaaaagatg

SEQ ID NO: 238329 - DNA, 103 bp, Artificial Sequence
  Synthetic Polynucleotide
taatacgactcactatagggtgagaacggctgccgcggtccgagctttgcaacagaggagagcaaagatgggaccgcggaacctggcggcagcgcaaaagatg

SEQ ID NO: 238330 - DNA, 103 bp, Artificial Sequence
  Synthetic Polynucleotide
taatacgactcactatagggattttgaaggtgtagcgcttcttaaaggacaacagaggagagtccttatggaagcgctaaacctggcggcagcgcaaaagatg

SEQ ID NO: 238331 - DNA, 103 bp, Artificial Sequence
  Synthetic Polynucleotide
taatacgactcactataggggagcaggtgcattttgaaggtgtagcgcttaacagaggagaaagcgcatgaccttcaaaaacctggcggcagcgcaaaagatg

SEQ ID NO: 238332 - DNA, 103 bp, Artificial Sequence
  Synthetic Polynucleotide
taatacgactcactatagggggatgtgcgtgagcaggtgcattttgaaggaacagaggagaccttcaatgtgcacctgcaacctggcggcagcgcaaaagatg

SEQ ID NO: 238333 - DNA, 103 bp, Artificial Sequence
  Synthetic Polynucleotide
taatacgactcactataggggcaacagcctggatgtgcgtgagcaggtgcaacagaggagagcacctatgcacgcacataacctggcggcagcgcaaaagatg

SEQ ID NO: 238334 - DNA, 103 bp, Artificial Sequence
  Synthetic Polynucleotide
taatacgactcactatagggcctgcggttggcaacagcctggatgtgcgtaacagaggagaacgcacatgcaggctgttaacctggcggcagcgcaaaagatg

SEQ ID NO: 238335 - DNA, 103 bp, Artificial Sequence
  Synthetic Polynucleotide
taatacgactcactatagggcacacttgaacctgcggttggcaacagcctaacagaggagaaggctgatgccaaccgcaaacctggcggcagcgcaaaagatg

SEQ ID NO: 238336 - DNA, 103 bp, Artificial Sequence
  Synthetic Polynucleotide
taatacgactcactatagggtcacagaactcacacttgaacctgcggttgaacagaggagacaaccgatggttcaagtgaacctggcggcagcgcaaaagatg

SEQ ID NO: 238337 - DNA, 103 bp, Artificial Sequence
  Synthetic Polynucleotide
taatacgactcactatagggacaaacaaactcacagaactcacacttgaaaacagaggagattcaagatggagttctgtaacctggcggcagcgcaaaagatg

SEQ ID NO: 238338 - DNA, 103 bp, Artificial Sequence
  Synthetic Polynucleotide
taatacgactcactatagggtcttgtcttcacaaacaaactcacagaactaacagaggagaagttctatgagtttgtttaacctggcggcagcgcaaaagatg

SEQ ID NO: 238339 - DNA, 103 bp, Artificial Sequence
  Synthetic Polynucleotide
taatacgactcactatagggagcagtgccttcttgtcttcacaaacaaacaacagaggagagtttgtatgtgaagacaaaacctggcggcagcgcaaaagatg

SEQ ID NO: 238340 - DNA, 103 bp, Artificial Sequence
  Synthetic Polynucleotide
taatacgactcactatagggtacctcctcctgagaacggctgccgcggtcaacagaggagagaccgcatgagccgttctaacctggcggcagcgcaaaagatg

SEQ ID NO: 238341 - DNA, 103 bp, Artificial Sequence
  Synthetic Polynucleotide
taatacgactcactatagggctggtggttcagcagtgccttcttgtcttcaacagaggagagaagacatgaaggcactgaacctggcggcagcgcaaaagatg

SEQ ID NO: 238342 - DNA, 103 bp, Artificial Sequence
  Synthetic Polynucleotide
taatacgactcactatagggcgtgggacaactggtggttcagcagtgcctaacagaggagaaggcacatgtgaaccaccaacctggcggcagcgcaaaagatg

SEQ ID NO: 238343 - DNA, 103 bp, Artificial Sequence
  Synthetic Polynucleotide
taatacgactcactatagggttgtcactgacgtgggacaactggtggttcaacagaggagagaaccaatggttgtcccaaacctggcggcagcgcaaaagatg

SEQ ID NO: 238344 - DNA, 103 bp, Artificial Sequence
  Synthetic Polynucleotide
taatacgactcactatagggtttgaagggcttgtcactgacgtgggacaaaacagaggagattgtccatggtcagtgacaacctggcggcagcgcaaaagatg

SEQ ID NO: 238345 - DNA, 103 bp, Artificial Sequence
  Synthetic Polynucleotide
taatacgactcactatagggaaaagctgcatttgaagggcttgtcactgaaacagaggagatcagtgatgagcccttcaaacctggcggcagcgcaaaagatg

SEQ ID NO: 238346 - DNA, 103 bp, Artificial Sequence
  Synthetic Polynucleotide
taatacgactcactatagggcggtagggacaaaagctgcatttgaagggcaacagaggagagcccttatgatgcagcttaacctggcggcagcgcaaaagatg

SEQ ID NO: 238347 - DNA, 103 bp, Artificial Sequence
  Synthetic Polynucleotide
taatacgactcactatagggtcggaaggtgcggtagggacaaaagctgcaaacagaggagatgcagcatgtgtccctacaacctggcggcagcgcaaaagatg

SEQ ID NO: 238348 - DNA, 103 bp, Artificial Sequence
  Synthetic Polynucleotide
taatacgactcactatagggagaagtcctctcggaaggtgcggtagggacaacagaggagagtccctatggcaccttccaacctggcggcagcgcaaaagatg

SEQ ID NO: 238349 - DNA, 103 bp, Artificial Sequence
  Synthetic Polynucleotide
taatacgactcactatagggtgggacagcaagaagtcctctcggaaggtgaacagaggagacaccttatgagaggacttaacctggcggcagcgcaaaagatg

SEQ ID NO: 238350 - DNA, 103 bp, Artificial Sequence
  Synthetic Polynucleotide
taatacgactcactataggggacagccacatgggacagcaagaagtcctcaacagaggagagaggacatgttgctgtccaacctggcggcagcgcaaaagatg

SEQ ID NO: 238351 - DNA, 103 bp, Artificial Sequence
  Synthetic Polynucleotide
taatacgactcactataggggggccgcgtcgctgctgctctccacctcgtaacagaggagaacgaggatgagagcagcaaacctggcggcagcgcaaaagatg

SEQ ID NO: 238352 - DNA, 103 bp, Artificial Sequence
  Synthetic Polynucleotide
taatacgactcactatagggtgctctcagatacctcctcctgagaacggcaacagaggagagccgttatgaggaggaggaacctggcggcagcgcaaaagatg

SEQ ID NO: 238353 - DNA, 103 bp, Artificial Sequence
  Synthetic Polynucleotide
taatacgactcactatagggctgtgtgcttgacagccacatgggacagcaaacagaggagatgctgtatgatgtggctgaacctggcggcagcgcaaaagatg

SEQ ID NO: 238354 - DNA, 103 bp, Artificial Sequence
  Synthetic Polynucleotide
taatacgactcactatagggggcttggcccctgtgtgcttgacagccacaaacagaggagatgtggcatgcaagcacacaacctggcggcagcgcaaaagatg

SEQ ID NO: 238355 - DNA, 103 bp, Artificial Sequence
  Synthetic Polynucleotide
taatacgactcactatagggacaggcgaagggcttggcccctgtgtgcttaacagaggagaaagcacatgggggccaagaacctggcggcagcgcaaaagatg

SEQ ID NO: 238356 - DNA, 103 bp, Artificial Sequence
  Synthetic Polynucleotide
taatacgactcactatagggggcagtactcacaggcgaagggcttggcccaacagaggagagggccaatgccttcgcctaacctggcggcagcgcaaaagatg

SEQ ID NO: 238357 - DNA, 103 bp, Artificial Sequence
  Synthetic Polynucleotide
taatacgactcactataggggtgctgaagtggcagtactcacaggcgaagaacagaggagacttcgcatgtgagtactgaacctggcggcagcgcaaaagatg

SEQ ID NO: 238358 - DNA, 103 bp, Artificial Sequence
  Synthetic Polynucleotide
taatacgactcactatagggcttgtgccgtgtgctgaagtggcagtactcaacagaggagagagtacatgcacttcagcaacctggcggcagcgcaaaagatg

SEQ ID NO: 238359 - DNA, 103 bp, Artificial Sequence
  Synthetic Polynucleotide
taatacgactcactataggggcaggttcttcttgtgccgtgtgctgaagtaacagaggagaacttcaatgcacggcacaaacctggcggcagcgcaaaagatg

SEQ ID NO: 238360 - DNA, 103 bp, Artificial Sequence
  Synthetic Polynucleotide
taatacgactcactatagggacgtgcaggcgcaggttcttcttgtgccgtaacagaggagaacggcaatggaagaacctaacctggcggcagcgcaaaagatg

SEQ ID NO: 238361 - DNA, 103 bp, Artificial Sequence
  Synthetic Polynucleotide
taatacgactcactatagggtcggcaccgtacgtgcaggcgcaggttcttaacagaggagaaagaacatgcgcctgcacaacctggcggcagcgcaaaagatg

SEQ ID NO: 238362 - DNA, 103 bp, Artificial Sequence
  Synthetic Polynucleotide
taatacgactcactatagggtgcttgcgtgtcggcaccgtacgtgcaggcaacagaggagagcctgcatgtacggtgccaacctggcggcagcgcaaaagatg

SEQ ID NO: 238363 - DNA, 103 bp, Artificial Sequence
  Synthetic Polynucleotide
taatacgactcactataggggcgctcgagctgctctcagatacctcctccaacagaggagaggaggaatgatctgagagaacctggcggcagcgcaaaagatg

SEQ ID NO: 238364 - DNA, 103 bp, Artificial Sequence
  Synthetic Polynucleotide
taatacgactcactatagggtcctcgaagctgcttgcgtgtcggcaccgtaacagaggagaacggtgatgacacgcaagaacctggcggcagcgcaaaagatg

SEQ ID NO: 238365 - DNA, 103 bp, Artificial Sequence
  Synthetic Polynucleotide
taatacgactcactatagggcctcccccattcctcgaagctgcttgcgtgaacagaggagacacgcaatgagcttcgagaacctggcggcagcgcaaaagatg

SEQ ID NO: 238366 - DNA, 103 bp, Artificial Sequence
  Synthetic Polynucleotide
taatacgactcactatagggcagggtggcgcctcccccattcctcgaagcaacagaggagagcttcgatgaatgggggaaacctggcggcagcgcaaaagatg

SEQ ID NO: 238367 - DNA, 103 bp, Artificial Sequence
  Synthetic Polynucleotide
taatacgactcactataggggggggctcctcagggtggcgcctcccccataacagaggagaatggggatggcgccacccaacctggcggcagcgcaaaagatg

SEQ ID NO: 238368 - DNA, 103 bp, Artificial Sequence
  Synthetic Polynucleotide
taatacgactcactatagggacggcgggaggggggctcctcagggtggcgaacagaggagacgccacatggaggagcccaacctggcggcagcgcaaaagatg

SEQ ID NO: 238369 - DNA, 103 bp, Artificial Sequence
  Synthetic Polynucleotide
taatacgactcactatagggagaaggggcgacggcgggaggggggctcctaacagaggagaaggagcatgcctcccgccaacctggcggcagcgcaaaagatg

SEQ ID NO: 238370 - DNA, 103 bp, Artificial Sequence
  Synthetic Polynucleotide
taatacgactcactatagggtgcagagagaagaaggggcgacggcgggagaacagaggagactcccgatgtcgccccttaacctggcggcagcgcaaaagatg

SEQ ID NO: 238371 - DNA, 103 bp, Artificial Sequence
  Synthetic Polynucleotide
taatacgactcactatagggctcaatctgctgcagagagaagaaggggcgaacagaggagacgccccatgttctctctgaacctggcggcagcgcaaaagatg

SEQ ID NO: 238372 - DNA, 103 bp, Artificial Sequence
  Synthetic Polynucleotide
taatacgactcactataggggcttcagctcctcaatctgctgcagagagaaacagaggagatctctcatgagcagattgaacctggcggcagcgcaaaagatg

SEQ ID NO: 238373 - DNA, 103 bp, Artificial Sequence
  Synthetic Polynucleotide
taatacgactcactatagggctgtgctgctgcttcagctcctcaatctgcaacagaggagagcagatatgggagctgaaaacctggcggcagcgcaaaagatg

SEQ ID NO: 238374 - DNA, 103 bp, Artificial Sequence
  Synthetic Polynucleotide
taatacgactcactatagggcagggggtctgcgctcgagctgctctcagaaacagaggagatctgagatgagctcgagcaacctggcggcagcgcaaaagatg

SEQ ID NO: 238375 - DNA, 103 bp, Artificial Sequence
  Synthetic Polynucleotide
taatacgactcactatagggaggggccgcactgtgctgctgcttcagctcaacagaggagagagctgatgcagcagcacaacctggcggcagcgcaaaagatg

SEQ ID NO: 238376 - DNA, 103 bp, Artificial Sequence
  Synthetic Polynucleotide
taatacgactcactataggggaggtggtccaggggccgcactgtgctgctaacagaggagaagcagcatggtgcggcccaacctggcggcagcgcaaaagatg

SEQ ID NO: 238377 - DNA, 103 bp, Artificial Sequence
  Synthetic Polynucleotide
taatacgactcactatagggggggaactgggaggtggtccaggggccgcaaacagaggagatgcggcatgtggaccaccaacctggcggcagcgcaaaagatg

SEQ ID NO: 238378 - DNA, 103 bp, Artificial Sequence
  Synthetic Polynucleotide
taatacgactcactatagggaggaggtcctggggaactgggaggtggtccaacagaggagaggaccaatgcccagttccaacctggcggcagcgcaaaagatg

SEQ ID NO: 238379 - DNA, 103 bp, Artificial Sequence
  Synthetic Polynucleotide
taatacgactcactatagggggggtatctcaggaggtcctggggaactggaacagaggagaccagttatgcaggacctcaacctggcggcagcgcaaaagatg

SEQ ID NO: 238380 - DNA, 103 bp, Artificial Sequence
  Synthetic Polynucleotide
taatacgactcactataggggtcgcctctgggggtatctcaggaggtcctaacagaggagaaggaccatgtgagataccaacctggcggcagcgcaaaagatg

SEQ ID NO: 238381 - DNA, 103 bp, Artificial Sequence
  Synthetic Polynucleotide
taatacgactcactatagggctggaaagttgtcgcctctgggggtatctcaacagaggagagagataatgccagaggcgaacctggcggcagcgcaaaagatg

SEQ ID NO: 238382 - DNA, 103 bp, Artificial Sequence
  Synthetic Polynucleotide
taatacgactcactatagggcctcagatgactggaaagttgtcgcctctgaacagaggagacagaggatgcaactttccaacctggcggcagcgcaaaagatg

SEQ ID NO: 238383 - DNA, 103 bp, Artificial Sequence
  Synthetic Polynucleotide
taatacgactcactatagggaatgagggagcctcagatgactggaaagttaacagaggagaaactttatggtcatctgaaacctggcggcagcgcaaaagatg

SEQ ID NO: 238384 - DNA, 103 bp, Artificial Sequence
  Synthetic Polynucleotide
taatacgactcactatagggagaacagagcaatgagggagcctcagatgaaacagaggagatcatctatggctccctcaaacctggcggcagcgcaaaagatg

SEQ ID NO: 238385 - DNA, 103 bp, Artificial Sequence
  Synthetic Polynucleotide
taatacgactcactatagggagctattaggcagggggtctgcgctcgagcaacagaggagagctcgaatgcagacccccaacctggcggcagcgcaaaagatg

SEQ ID NO: 238386 - DNA, 103 bp, Artificial Sequence
  Synthetic Polynucleotide
taatacgactcactatagggccagggtgtcagaacagagcaatgagggagaacagaggagactccctatgtgctctgttaacctggcggcagcgcaaaagatg

SEQ ID NO: 238387 - DNA, 103 bp, Artificial Sequence
  Synthetic Polynucleotide
taatacgactcactataggggtggcgccgcccagggtgtcagaacagagcaacagaggagagctctgatgtgacaccctaacctggcggcagcgcaaaagatg

SEQ ID NO: 238388 - DNA, 103 bp, Artificial Sequence
  Synthetic Polynucleotide
taatacgactcactataggggtagatgatggtggcgccgcccagggtgtcaacagaggagagacaccatgggcggcgccaacctggcggcagcgcaaaagatg

SEQ ID NO: 238389 - DNA, 103 bp, Artificial Sequence
  Synthetic Polynucleotide
taatacgactcactatagggctccttgctggtagatgatggtggcgccgcaacagaggagagcggcgatgccatcatctaacctggcggcagcgcaaaagatg

SEQ ID NO: 238390 - DNA, 103 bp, Artificial Sequence
  Synthetic Polynucleotide
taatacgactcactataggggactcctcagctccttgctggtagatgatgaacagaggagacatcatatgccagcaaggaacctggcggcagcgcaaaagatg

SEQ ID NO: 238391 - DNA, 103 bp, Artificial Sequence
  Synthetic Polynucleotide
taatacgactcactatagggcatcgctgtcgactcctcagctccttgctgaacagaggagacagcaaatggctgaggagaacctggcggcagcgcaaaagatg

SEQ ID NO: 238392 - DNA, 103 bp, Artificial Sequence
  Synthetic Polynucleotide
taatacgactcactatagggtctgcgtggccatcgctgtcgactcctcagaacagaggagactgaggatgcgacagcgaaacctggcggcagcgcaaaagatg

SEQ ID NO: 238393 - DNA, 103 bp, Artificial Sequence
  Synthetic Polynucleotide
taatacgactcactatagggtccaaggctgtctgcgtggccatcgctgtcaacagaggagagacagcatgggccacgcaaacctggcggcagcgcaaaagatg

SEQ ID NO: 238394 - DNA, 103 bp, Artificial Sequence
  Synthetic Polynucleotide
taatacgactcactatagggcagcagaagatccaaggctgtctgcgtggcaacagaggagagccacgatgacagccttgaacctggcggcagcgcaaaagatg

SEQ ID NO: 238395 - DNA, 103 bp, Artificial Sequence
  Synthetic Polynucleotide
taatacgactcactatagggcactcatgttcagcagaagatccaaggctgaacagaggagacagcctatgatcttctgcaacctggcggcagcgcaaaagatg

SEQ ID NO: 238396 - DNA, 103 bp, Artificial Sequence
  Synthetic Polynucleotide
taatacgactcactatagggtcagggaggtagctattaggcagggggtctaacagaggagaagacccatggcctaatagaacctggcggcagcgcaaaagatg

SEQ ID NO: 238397 - DNA, 103 bp, Artificial Sequence
  Synthetic Polynucleotide
taatacgactcactatagggtcccgctgagcactcatgttcagcagaagaaacagaggagatcttctatggaacatgagaacctggcggcagcgcaaaagatg

SEQ ID NO: 238398 - DNA, 103 bp, Artificial Sequence
  Synthetic Polynucleotide
taatacgactcactataggggccccccagttcccgctgagcactcatgttaacagaggagaaacatgatggctcagcggaacctggcggcagcgcaaaagatg

SEQ ID NO: 238399 - DNA, 103 bp, Artificial Sequence
  Synthetic Polynucleotide
taatacgactcactataggggcagggctgtgccccccagttcccgctgagaacagaggagactcagcatgaactgggggaacctggcggcagcgcaaaagatg

SEQ ID NO: 238400 - DNA, 103 bp, Artificial Sequence
  Synthetic Polynucleotide
taatacgactcactatagggacagccacctgcagggctgtgccccccagtaacagaggagaactgggatgcacagccctaacctggcggcagcgcaaaagatg

SEQ ID NO: 238401 - DNA, 103 bp, Artificial Sequence
  Synthetic Polynucleotide
taatacgactcactatagggcgacttcaccacagccacctgcagggctgtaacagaggagaacagccatgcaggtggctaacctggcggcagcgcaaaagatg

SEQ ID NO: 238402 - DNA, 103 bp, Artificial Sequence
  Synthetic Polynucleotide
taatacgactcactatagggccacatcttccgacttcaccacagccacctaacagaggagaaggtggatgtggtgaagtaacctggcggcagcgcaaaagatg

SEQ ID NO: 238403 - DNA, 103 bp, Artificial Sequence
  Synthetic Polynucleotide
taatacgactcactatagggaaccctgcttccacatcttccgacttcaccaacagaggagaggtgaaatgggaagatgtaacctggcggcagcgcaaaagatg

SEQ ID NO: 238404 - DNA, 103 bp, Artificial Sequence
  Synthetic Polynucleotide
taatacgactcactatagggaggggatgctaaccctgcttccacatcttcaacagaggagagaagatatggaagcagggaacctggcggcagcgcaaaagatg

SEQ ID NO: 238405 - DNA, 103 bp, Artificial Sequence
  Synthetic Polynucleotide
taatacgactcactataggggctgcccaccaggggatgctaaccctgcttaacagaggagaaagcagatgtagcatcccaacctggcggcagcgcaaaagatg

SEQ ID NO: 238406 - DNA, 103 bp, Artificial Sequence
  Synthetic Polynucleotide
taatacgactcactatagggtcaggggagggctgcccaccaggggatgctaacagaggagaagcatcatgtggtgggcaaacctggcggcagcgcaaaagatg

SEQ ID NO: 238407 - DNA, 103 bp, Artificial Sequence
  Synthetic Polynucleotide
taatacgactcactatagggagacgatgaatcagggaggtagctattaggaacagaggagacctaatatgtacctccctaacctggcggcagcgcaaaagatg

SEQ ID NO: 238408 - DNA, 103 bp, Artificial Sequence
  Synthetic Polynucleotide
taatacgactcactatagggagtggcaccttcaggggagggctgcccaccaacagaggagaggtgggatgccctcccctaacctggcggcagcgcaaaagatg

SEQ ID NO: 238409 - DNA, 103 bp, Artificial Sequence
  Synthetic Polynucleotide
taatacgactcactatagggccacctgtggagtggcaccttcaggggaggaacagaggagacctcccatgaaggtgccaaacctggcggcagcgcaaaagatg

SEQ ID NO: 238410 - DNA, 103 bp, Artificial Sequence
  Synthetic Polynucleotide
taatacgactcactatagggtggagggtgaccacctgtggagtggcacctaacagaggagaaggtgcatgtccacaggtaacctggcggcagcgcaaaagatg

SEQ ID NO: 238411 - DNA, 103 bp, Artificial Sequence
  Synthetic Polynucleotide
taatacgactcactatagggctctgccacgtggagggtgaccacctgtggaacagaggagaccacagatggtcaccctcaacctggcggcagcgcaaaagatg

SEQ ID NO: 238412 - DNA, 103 bp, Artificial Sequence
  Synthetic Polynucleotide
taatacgactcactatagggcgccccctggctctgccacgtggagggtgaaacagaggagatcacccatgacgtggcagaacctggcggcagcgcaaaagatg

SEQ ID NO: 238413 - DNA, 103 bp, Artificial Sequence
  Synthetic Polynucleotide
taatacgactcactataggggctgctgcaccgccccctggctctgccacgaacagaggagacgtggcatggccagggggaacctggcggcagcgcaaaagatg

SEQ ID NO: 238414 - DNA, 103 bp, Artificial Sequence
  Synthetic Polynucleotide
taatacgactcactatagggctggctctcggctgctgcaccgccccctggaacagaggagaccagggatgggtgcagcaaacctggcggcagcgcaaaagatg

SEQ ID NO: 238415 - DNA, 103 bp, Artificial Sequence
  Synthetic Polynucleotide
taatacgactcactataggggagggcctagctggctctcggctgctgcacaacagaggagagtgcagatgccgagagccaacctggcggcagcgcaaaagatg

SEQ ID NO: 238416 - DNA, 103 bp, Artificial Sequence
  Synthetic Polynucleotide
taatacgactcactatagggggtaggtcaggagggcctagctggctctcgaacagaggagacgagagatggctaggcccaacctggcggcagcgcaaaagatg

SEQ ID NO: 238417 - DNA, 103 bp, Artificial Sequence
  Synthetic Polynucleotide
taatacgactcactatagggggtgatctgcggtaggtcaggagggcctagaacagaggagactaggcatgcctgacctaaacctggcggcagcgcaaaagatg

SEQ ID NO: 238418 - DNA, 103 bp, Artificial Sequence
  Synthetic Polynucleotide
taatacgactcactatagggcatgagacacagacgatgaatcagggaggtaacagaggagaacctccatgattcatcgtaacctggcggcagcgcaaaagatg

SEQ ID NO: 238419 - DNA, 103 bp, Artificial Sequence
  Synthetic Polynucleotide
taatacgactcactatagggcaggtgccagggtgatctgcggtaggtcagaacagaggagactgaccatgcgcagatcaaacctggcggcagcgcaaaagatg

SEQ ID NO: 238420 - DNA, 103 bp, Artificial Sequence
  Synthetic Polynucleotide
taatacgactcactatagggccaaatggaccaggtgccagggtgatctgcaacagaggagagcagatatgcctggcaccaacctggcggcagcgcaaaagatg

SEQ ID NO: 238421 - DNA, 103 bp, Artificial Sequence
  Synthetic Polynucleotide
taatacgactcactataggggccagtcccaccaaatggaccaggtgccagaacagaggagactggcaatgggtccatttaacctggcggcagcgcaaaagatg

SEQ ID NO: 238422 - DNA, 103 bp, Artificial Sequence
  Synthetic Polynucleotide
taatacgactcactatagggtgacactgtagccagtcccaccaaatggacaacagaggagagtccatatggtgggactgaacctggcggcagcgcaaaagatg

SEQ ID NO: 238423 - DNA, 103 bp, Artificial Sequence
  Synthetic Polynucleotide
taatacgactcactatagggggtgctgtgatgacactgtagccagtcccaaacagaggagatgggacatgctacagtgtaacctggcggcagcgcaaaagatg

SEQ ID NO: 238424 - DNA, 103 bp, Artificial Sequence
  Synthetic Polynucleotide
taatacgactcactatagggctccatagggggtgctgtgatgacactgtaaacagaggagatacagtatgatcacagcaaacctggcggcagcgcaaaagatg

SEQ ID NO: 238425 - DNA, 103 bp, Artificial Sequence
  Synthetic Polynucleotide
taatacgactcactatagggatgttccctcctccatagggggtgctgtgaaacagaggagatcacagatgcccctatggaacctggcggcagcgcaaaagatg

SEQ ID NO: 238426 - DNA, 103 bp, Artificial Sequence
  Synthetic Polynucleotide
taatacgactcactatagggccaggagctgatgttccctcctccatagggaacagaggagaccctatatgggagggaacaacctggcggcagcgcaaaagatg

SEQ ID NO: 238427 - DNA, 103 bp, Artificial Sequence
  Synthetic Polynucleotide
taatacgactcactataggggtaaggtgtgccaggagctgatgttccctcaacagaggagagagggaatgtcagctcctaacctggcggcagcgcaaaagatg

SEQ ID NO: 238428 - DNA, 103 bp, Artificial Sequence
  Synthetic Polynucleotide
taatacgactcactataggggctcctcgctgtaaggtgtgccaggagctgaacagaggagacagctcatggcacaccttaacctggcggcagcgcaaaagatg

SEQ ID NO: 238429 - DNA, 103 bp, Artificial Sequence
  Synthetic Polynucleotide
taatacgactcactataggggccactggcccatgagacacagacgatgaaaacagaggagattcatcatgtgtgtctcaaacctggcggcagcgcaaaagatg

SEQ ID NO: 238430 - DNA, 103 bp, Artificial Sequence
  Synthetic Polynucleotide
taatacgactcactatagggtctcctgcgggctcctcgctgtaaggtgtgaacagaggagacacaccatgcagcgaggaaacctggcggcagcgcaaaagatg

SEQ ID NO: 238431 - DNA, 103 bp, Artificial Sequence
  Synthetic Polynucleotide
taatacgactcactatagggctgggctgcctctcctgcgggctcctcgctaacagaggagaagcgagatgcccgcaggaaacctggcggcagcgcaaaagatg

SEQ ID NO: 238432 - DNA, 103 bp, Artificial Sequence
  Synthetic Polynucleotide
taatacgactcactatagggcaaccacagcctgggctgcctctcctgcggaacagaggagaccgcagatgaggcagcccaacctggcggcagcgcaaaagatg

SEQ ID NO: 238433 - DNA, 103 bp, Artificial Sequence
  Synthetic Polynucleotide
taatacgactcactataggggtgtcactcacaaccacagcctgggctgccaacagaggagaggcagcatgggctgtggtaacctggcggcagcgcaaaagatg

SEQ ID NO: 238434 - DNA, 103 bp, Artificial Sequence
  Synthetic Polynucleotide
taatacgactcactatagggttcttttagggtgtcactcacaaccacagcaacagaggagagctgtgatggtgagtgacaacctggcggcagcgcaaaagatg

SEQ ID NO: 238435 - DNA, 103 bp, Artificial Sequence
  Synthetic Polynucleotide
taatacgactcactataggggggtgccagcttcttttagggtgtcactcaaacagaggagatgagtgatgccctaaaagaacctggcggcagcgcaaaagatg

SEQ ID NO: 238436 - DNA, 103 bp, Artificial Sequence
  Synthetic Polynucleotide
taatacgactcactatagggatgatgtagtgggtgccagcttcttttaggaacagaggagacctaaaatgagctggcacaacctggcggcagcgcaaaagatg

SEQ ID NO: 238437 - DNA, 103 bp, Artificial Sequence
  Synthetic Polynucleotide
taatacgactcactatagggatcagtagccatgatgtagtgggtgccagcaacagaggagagctggcatgcactacatcaacctggcggcagcgcaaaagatg

SEQ ID NO: 238438 - DNA, 103 bp, Artificial Sequence
  Synthetic Polynucleotide
taatacgactcactatagggactgggtaccatcagtagccatgatgtagtaacagaggagaactacaatgtggctactgaacctggcggcagcgcaaaagatg

SEQ ID NO: 238439 - DNA, 103 bp, Artificial Sequence
  Synthetic Polynucleotide
taatacgactcactatagggatgtggtgcaactgggtaccatcagtagccaacagaggagaggctacatgtggtacccaaacctggcggcagcgcaaaagatg

SEQ ID NO: 238440 - DNA, 103 bp, Artificial Sequence
  Synthetic Polynucleotide
taatacgactcactatagggtgtcacccctgccactggcccatgagacacaacagaggagagtgtctatggggccagtgaacctggcggcagcgcaaaagatg

SEQ ID NO: 238441 - DNA, 103 bp, Artificial Sequence
  Synthetic Polynucleotide
taatacgactcactatagggggtgagctcaatgtggtgcaactgggtaccaacagaggagaggtaccatgttgcaccacaacctggcggcagcgcaaaagatg

SEQ ID NO: 238442 - DNA, 103 bp, Artificial Sequence
  Synthetic Polynucleotide
taatacgactcactatagggagccatctgcggtgagctcaatgtggtgcaaacagaggagatgcaccatgttgagctcaaacctggcggcagcgcaaaagatg

SEQ ID NO: 238443 - DNA, 103 bp, Artificial Sequence
  Synthetic Polynucleotide
taatacgactcactatagggaaggagatggagccatctgcggtgagctcaaacagaggagatgagctatgcgcagatggaacctggcggcagcgcaaaagatg

SEQ ID NO: 238444 - DNA, 103 bp, Artificial Sequence
  Synthetic Polynucleotide
taatacgactcactatagggtggacttgggaaggagatggagccatctgcaacagaggagagcagatatgtccatctccaacctggcggcagcgcaaaagatg

SEQ ID NO: 238445 - DNA, 103 bp, Artificial Sequence
  Synthetic Polynucleotide
taatacgactcactatagggccagagcatctggacttgggaaggagatggaacagaggagaccatctatgtcccaagtcaacctggcggcagcgcaaaagatg

SEQ ID NO: 238446 - DNA, 103 bp, Artificial Sequence
  Synthetic Polynucleotide
taatacgactcactataggggcaccagaggccagagcatctggacttgggaacagaggagacccaagatgagatgctctaacctggcggcagcgcaaaagatg

SEQ ID NO: 238447 - DNA, 103 bp, Artificial Sequence
  Synthetic Polynucleotide
taatacgactcactataggggggccatttggcaccagaggccagagcatcaacagaggagagatgctatggcctctggtaacctggcggcagcgcaaaagatg

SEQ ID NO: 238448 - DNA, 103 bp, Artificial Sequence
  Synthetic Polynucleotide
taatacgactcactatagggactgcagcaggggccatttggcaccagaggaacagaggagacctctgatgccaaatggcaacctggcggcagcgcaaaagatg

SEQ ID NO: 238449 - DNA, 103 bp, Artificial Sequence
  Synthetic Polynucleotide
taatacgactcactatagggagtcccccacactgcagcaggggccatttgaacagaggagacaaatgatgcctgctgcaaacctggcggcagcgcaaaagatg

SEQ ID NO: 238450 - DNA, 103 bp, Artificial Sequence
  Synthetic Polynucleotide
taatacgactcactataggggtctctgggcagtcccccacactgcagcagaacagaggagactgctgatgtgtgggggaaacctggcggcagcgcaaaagatg

SEQ ID NO: 238451 - DNA, 103 bp, Artificial Sequence
  Synthetic Polynucleotide
taatacgactcactatagggggggaccgcctgtcacccctgccactggccaacagaggagaggccagatgcaggggtgaaacctggcggcagcgcaaaagatg

SEQ ID NO: 238452 - DNA, 103 bp, Artificial Sequence
  Synthetic Polynucleotide
taatacgactcactataggggctcagggccgtctctgggcagtcccccacaacagaggagagtggggatgtgcccagagaacctggcggcagcgcaaaagatg

SEQ ID NO: 238453 - DNA, 103 bp, Artificial Sequence
  Synthetic Polynucleotide
taatacgactcactatagggggagatgggggctcagggccgtctctgggcaacagaggagagcccagatgcggccctgaaacctggcggcagcgcaaaagatg

SEQ ID NO: 238454 - DNA, 103 bp, Artificial Sequence
  Synthetic Polynucleotide
taatacgactcactatagggggtcttggctggagatgggggctcagggccaacagaggagaggccctatgcccccatctaacctggcggcagcgcaaaagatg

SEQ ID NO: 238455 - DNA, 103 bp, Artificial Sequence
  Synthetic Polynucleotide
taatacgactcactatagggctacgcagtgggtcttggctggagatggggaacagaggagaccccatatgcagccaagaaacctggcggcagcgcaaaagatg

SEQ ID NO: 238456 - DNA, 103 bp, Artificial Sequence
  Synthetic Polynucleotide
taatacgactcactatagggtgggagtcccctacgcagtgggtcttggctaacagaggagaagccaaatgccactgcgtaacctggcggcagcgcaaaagatg

SEQ ID NO: 238457 - DNA, 103 bp, Artificial Sequence
  Synthetic Polynucleotide
taatacgactcactatagggggcagagctctgggagtcccctacgcagtgaacagaggagacactgcatgggggactccaacctggcggcagcgcaaaagatg

SEQ ID NO: 238458 - DNA, 103 bp, Artificial Sequence
  Synthetic Polynucleotide
taatacgactcactataggggaggtgaggaggcagagctctgggagtcccaacagaggagagggactatgagagctctgaacctggcggcagcgcaaaagatg

SEQ ID NO: 238459 - DNA, 103 bp, Artificial Sequence
  Synthetic Polynucleotide
taatacgactcactatagggctggttgcaggaggtgaggaggcagagctcaacagaggagagagctcatgctcctcaccaacctggcggcagcgcaaaagatg

SEQ ID NO: 238460 - DNA, 103 bp, Artificial Sequence
  Synthetic Polynucleotide
taatacgactcactatagggcagggctttgctggttgcaggaggtgaggaaacagaggagatcctcaatgcctgcaaccaacctggcggcagcgcaaaagatg

SEQ ID NO: 238461 - DNA, 103 bp, Artificial Sequence
  Synthetic Polynucleotide
taatacgactcactatagggctgccaggcccagggctttgctggttgcagaacagaggagactgcaaatggcaaagcccaacctggcggcagcgcaaaagatg

SEQ ID NO: 238462 - DNA, 103 bp, Artificial Sequence
  Synthetic Polynucleotide
taatacgactcactatagggccaggcccaggggccgcgtcgctgctgctcaacagaggagagagcagatgcgacgcggcaacctggcggcagcgcaaaagatg

SEQ ID NO: 238463 - DNA, 103 bp, Artificial Sequence
  Synthetic Polynucleotide
taatacgactcactatagggacaagtgctgggggaccgcctgtcacccctaacagaggagaaggggtatgaggcggtccaacctggcggcagcgcaaaagatg

SEQ ID NO: 238464 - DNA, 103 bp, Artificial Sequence
  Synthetic Polynucleotide
taatacgactcactataggggacgggggcactgccaggcccagggctttgaacagaggagacaaagcatggggcctggcaacctggcggcagcgcaaaagatg

SEQ ID NO: 238465 - DNA, 103 bp, Artificial Sequence
  Synthetic Polynucleotide
taatacgactcactatagggagatggcggtgacgggggcactgccaggccaacagaggagaggcctgatggtgcccccgaacctggcggcagcgcaaaagatg

SEQ ID NO: 238466 - DNA, 103 bp, Artificial Sequence
  Synthetic Polynucleotide
taatacgactcactatagggcagtggctgcagatggcggtgacgggggcaaacagaggagatgccccatgcaccgccataacctggcggcagcgcaaaagatg

SEQ ID NO: 238467 - DNA, 103 bp, Artificial Sequence
  Synthetic Polynucleotide
taatacgactcactatagggtttgatgcagcagtggctgcagatggcggtaacagaggagaaccgccatgtgcagccacaacctggcggcagcgcaaaagatg

SEQ ID NO: 238468 - DNA, 103 bp, Artificial Sequence
  Synthetic Polynucleotide
taatacgactcactatagggggaaaacttctttgatgcagcagtggctgcaacagaggagagcagccatggctgcatcaaacctggcggcagcgcaaaagatg

SEQ ID NO: 238469 - DNA, 103 bp, Artificial Sequence
  Synthetic Polynucleotide
taatacgactcactatagggagatcttgcaggaaaacttctttgatgcagaacagaggagactgcatatgagaagttttaacctggcggcagcgcaaaagatg

SEQ ID NO: 238470 - DNA, 103 bp, Artificial Sequence
  Synthetic Polynucleotide
taatacgactcactataggggcctcggcacagatcttgcaggaaaacttcaacagaggagagaagttatgctgcaagataacctggcggcagcgcaaaagatg

SEQ ID NO: 238471 - DNA, 103 bp, Artificial Sequence
  Synthetic Polynucleotide
taatacgactcactataggggccagggaaggcctcggcacagatcttgcaaacagaggagatgcaagatgtgtgccgagaacctggcggcagcgcaaaagatg

SEQ ID NO: 238472 - DNA, 103 bp, Artificial Sequence
  Synthetic Polynucleotide
taatacgactcactatagggtctcagctcggccagggaaggcctcggcacaacagaggagagtgccgatgccttccctgaacctggcggcagcgcaaaagatg

SEQ ID NO: 238473 - DNA, 103 bp, Artificial Sequence
  Synthetic Polynucleotide
taatacgactcactatagggtgactctccatctcagctcggccagggaagaacagaggagacttcccatgccgagctgaaacctggcggcagcgcaaaagatg

SEQ ID NO: 238474 - DNA, 103 bp, Artificial Sequence
  Synthetic Polynucleotide
taatacgactcactatagggactagagtgcacaagtgctgggggaccgccaacagaggagaggcggtatgccagcacttaacctggcggcagcgcaaaagatg

SEQ ID NO: 238475 - DNA, 103 bp, Artificial Sequence
  Synthetic Polynucleotide
taatacgactcactatagggggcccgcttgtgactctccatctcagctcgaacagaggagacgagctatgatggagagtaacctggcggcagcgcaaaagatg

SEQ ID NO: 238476 - DNA, 103 bp, Artificial Sequence
  Synthetic Polynucleotide
taatacgactcactataggggcccagcgtgggcccgcttgtgactctccaaacagaggagatggagaatgacaagcgggaacctggcggcagcgcaaaagatg

SEQ ID NO: 238477 - DNA, 103 bp, Artificial Sequence
  Synthetic Polynucleotide
taatacgactcactatagggaaggcaccaggcccagcgtgggcccgcttgaacagaggagacaagcgatgccacgctggaacctggcggcagcgcaaaagatg

SEQ ID NO: 238478 - DNA, 103 bp, Artificial Sequence
  Synthetic Polynucleotide
taatacgactcactatagggggggcacttgaaggcaccaggcccagcgtgaacagaggagacacgctatgcctggtgccaacctggcggcagcgcaaaagatg

SEQ ID NO: 238479 - DNA, 103 bp, Artificial Sequence
  Synthetic Polynucleotide
taatacgactcactatagggaggggcagtcggggcacttgaaggcaccagaacagaggagactggtgatgtcaagtgccaacctggcggcagcgcaaaagatg

SEQ ID NO: 238480 - DNA, 103 bp, Artificial Sequence
  Synthetic Polynucleotide
taatacgactcactatagggcgggcactgaaggggcagtcggggcacttgaacagaggagacaagtgatgcgactgcccaacctggcggcagcgcaaaagatg

SEQ ID NO: 238481 - DNA, 103 bp, Artificial Sequence
  Synthetic Polynucleotide
taatacgactcactataggggggccactggcgggcactgaaggggcagtcaacagaggagagactgcatgttcagtgccaacctggcggcagcgcaaaagatg

SEQ ID NO: 238482 - DNA, 103 bp, Artificial Sequence
  Synthetic Polynucleotide
taatacgactcactatagggcccggacctcgggccactggcgggcactgaaacagaggagatcagtgatggccagtggcaacctggcggcagcgcaaaagatg

SEQ ID NO: 238483 - DNA, 103 bp, Artificial Sequence
  Synthetic Polynucleotide
taatacgactcactataggggccatgtgcgcccggacctcgggccactggaacagaggagaccagtgatgcgaggtccgaacctggcggcagcgcaaaagatg

SEQ ID NO: 238484 - DNA, 103 bp, Artificial Sequence
  Synthetic Polynucleotide
taatacgactcactatagggtgagtgctgtgccatgtgcgcccggacctcaacagaggagagaggtcatggcgcacatgaacctggcggcagcgcaaaagatg

SEQ ID NO: 238485 - DNA, 103 bp, Artificial Sequence
  Synthetic Polynucleotide
taatacgactcactatagggctgggagtgcactagagtgcacaagtgctgaacagaggagacagcacatgtgcactctaaacctggcggcagcgcaaaagatg

SEQ ID NO: 238486 - DNA, 103 bp, Artificial Sequence
  Synthetic Polynucleotide
taatacgactcactataggggccgtaggcttgagtgctgtgccatgtgcgaacagaggagacgcacaatgcacagcactaacctggcggcagcgcaaaagatg

SEQ ID NO: 238487 - DNA, 103 bp, Artificial Sequence
  Synthetic Polynucleotide
taatacgactcactatagggcactggtggggccgtaggcttgagtgctgtaacagaggagaacagcaatgaagcctacgaacctggcggcagcgcaaaagatg

SEQ ID NO: 238488 - DNA, 103 bp, Artificial Sequence
  Synthetic Polynucleotide
taatacgactcactataggggcactggctacactggtggggccgtaggctaacagaggagaagcctaatgccccaccagaacctggcggcagcgcaaaagatg

SEQ ID NO: 238489 - DNA, 103 bp, Artificial Sequence
  Synthetic Polynucleotide
taatacgactcactatagggaggcaaagctgcactggctacactggtgggaacagaggagacccaccatggtagccagtaacctggcggcagcgcaaaagatg

SEQ ID NO: 238490 - DNA, 103 bp, Artificial Sequence
  Synthetic Polynucleotide
taatacgactcactatagggttgttcttggaggcaaagctgcactggctaaacagaggagatagccaatgcagctttgcaacctggcggcagcgcaaaagatg

SEQ ID NO: 238491 - DNA, 103 bp, Artificial Sequence
  Synthetic Polynucleotide
taatacgactcactatagggcaggtccttcttgttcttggaggcaaagctaacagaggagaagctttatgtccaagaacaacctggcggcagcgcaaaagatg

SEQ ID NO: 238492 - DNA, 103 bp, Artificial Sequence
  Synthetic Polynucleotide
taatacgactcactatagggtgtgccgacgcaggtccttcttgttcttggaacagaggagaccaagaatgagaaggaccaacctggcggcagcgcaaaagatg

SEQ ID NO: 238493 - DNA, 103 bp, Artificial Sequence
  Synthetic Polynucleotide
taatacgactcactatagggtgagtcagcatgtgccgacgcaggtccttcaacagaggagagaaggaatggcgtcggcaaacctggcggcagcgcaaaagatg

SEQ ID NO: 238494 - DNA, 103 bp, Artificial Sequence
  Synthetic Polynucleotide
taatacgactcactatagggctcctttgtgtgagtcagcatgtgccgacgaacagaggagacgtcggatgatgctgactaacctggcggcagcgcaaaagatg

SEQ ID NO: 238495 - DNA, 103 bp, Artificial Sequence
  Synthetic Polynucleotide
taatacgactcactatagggcaaaaggcttctcctttgtgtgagtcagcaaacagaggagatgctgaatgacacaaaggaacctggcggcagcgcaaaagatg

SEQ ID NO: 238496 - DNA, 103 bp, Artificial Sequence
  Synthetic Polynucleotide
taatacgactcactatagggatgttggggtctgggagtgcactagagtgcaacagaggagagcactcatgtgcactcccaacctggcggcagcgcaaaagatg

SEQ ID NO: 238497 - DNA, 103 bp, Artificial Sequence
  Synthetic Polynucleotide
taatacgactcactatagggaggtggcatgcaaaaggcttctcctttgtgaacagaggagacacaaaatggaagcctttaacctggcggcagcgcaaaagatg

SEQ ID NO: 238498 - DNA, 103 bp, Artificial Sequence
  Synthetic Polynucleotide
taatacgactcactatagggctgcccgcagaggtggcatgcaaaaggcttaacagaggagaaagcctatggcatgccacaacctggcggcagcgcaaaagatg

SEQ ID NO: 238499 - DNA, 103 bp, Artificial Sequence
  Synthetic Polynucleotide
taatacgactcactatagggggttgaaacgctgcccgcagaggtggcatgaacagaggagacatgccatgtctgcgggcaacctggcggcagcgcaaaagatg

SEQ ID NO: 238500 - DNA, 103 bp, Artificial Sequence
  Synthetic Polynucleotide
taatacgactcactatagggtgcccgttacggttgaaacgctgcccgcagaacagaggagactgcggatggcgtttcaaaacctggcggcagcgcaaaagatg

SEQ ID NO: 238501 - DNA, 103 bp, Artificial Sequence
  Synthetic Polynucleotide
taatacgactcactataggggaacttgaggtgcccgttacggttgaaacgaacagaggagacgtttcatgcgtaacgggaacctggcggcagcgcaaaagatg

SEQ ID NO: 238502 - DNA, 103 bp, Artificial Sequence
  Synthetic Polynucleotide
taatacgactcactataggggctggatgtggaacttgaggtgcccgttacaacagaggagagtaacgatgacctcaagtaacctggcggcagcgcaaaagatg

SEQ ID NO: 238503 - DNA, 103 bp, Artificial Sequence
  Synthetic Polynucleotide
taatacgactcactatagggctgtgcagccgctggatgtggaacttgaggaacagaggagacctcaaatgccacatccaaacctggcggcagcgcaaaagatg

SEQ ID NO: 238504 - DNA, 103 bp, Artificial Sequence
  Synthetic Polynucleotide
taatacgactcactatagggcccatcaggactgtgcagccgctggatgtgaacagaggagacacatcatgcggctgcacaacctggcggcagcgcaaaagatg

SEQ ID NO: 238505 - DNA, 103 bp, Artificial Sequence
  Synthetic Polynucleotide
taatacgactcactatagggctgacttcctcccatcaggactgtgcagccaacagaggagaggctgcatggtcctgatgaacctggcggcagcgcaaaagatg

SEQ ID NO: 238506 - DNA, 103 bp, Artificial Sequence
  Synthetic Polynucleotide
taatacgactcactataggggtaggggttcctgacttcctcccatcaggaaacagaggagatcctgaatggaggaagtcaacctggcggcagcgcaaaagatg

SEQ ID NO: 238507 - DNA, 103 bp, Artificial Sequence
  Synthetic Polynucleotide
taatacgactcactatagggggacaccagcatgttggggtctgggagtgcaacagaggagagcactcatggaccccaacaacctggcggcagcgcaaaagatg

SEQ ID NO: 238508 - DNA, 103 bp, Artificial Sequence
  Synthetic Polynucleotide
taatacgactcactatagggggcccgggctgtaggggttcctgacttcctaacagaggagaaggaagatgggaacccctaacctggcggcagcgcaaaagatg

SEQ ID NO: 238509 - DNA, 103 bp, Artificial Sequence
  Synthetic Polynucleotide
taatacgactcactatagggtctgggtaggggcccgggctgtaggggttcaacagaggagagaacccatgcagcccgggaacctggcggcagcgcaaaagatg

SEQ ID NO: 238510 - DNA, 103 bp, Artificial Sequence
  Synthetic Polynucleotide
taatacgactcactatagggtgggttggggtctgggtaggggcccgggctaacagaggagaagcccgatgccctacccaaacctggcggcagcgcaaaagatg

SEQ ID NO: 238511 - DNA, 103 bp, Artificial Sequence
  Synthetic Polynucleotide
taatacgactcactataggggatgatggtctgggttggggtctgggtaggaacagaggagacctaccatgaccccaaccaacctggcggcagcgcaaaagatg

SEQ ID NO: 238512 - DNA, 103 bp, Artificial Sequence
  Synthetic Polynucleotide
taatacgactcactatagggcactgttcaggatgatggtctgggttggggaacagaggagaccccaaatgagaccatcaaacctggcggcagcgcaaaagatg

SEQ ID NO: 238513 - DNA, 103 bp, Artificial Sequence
  Synthetic Polynucleotide
taatacgactcactataggggtttcgtcatcactgttcaggatgatggtcaacagaggagagaccatatgcctgaacagaacctggcggcagcgcaaaagatg

SEQ ID NO: 238514 - DNA, 103 bp, Artificial Sequence
  Synthetic Polynucleotide
taatacgactcactatagggggtggccagtgtttcgtcatcactgttcagaacagaggagactgaacatggatgacgaaaacctggcggcagcgcaaaagatg

SEQ ID NO: 238515 - DNA, 103 bp, Artificial Sequence
  Synthetic Polynucleotide
taatacgactcactatagggcagtgtgcagggtggccagtgtttcgtcataacagaggagaatgacgatgcactggccaaacctggcggcagcgcaaaagatg

SEQ ID NO: 238516 - DNA, 103 bp, Artificial Sequence
  Synthetic Polynucleotide
taatacgactcactataggggactggagtgcagtgtgcagggtggccagtaacagaggagaactggcatgcctgcacacaacctggcggcagcgcaaaagatg

SEQ ID NO: 238517 - DNA, 103 bp, Artificial Sequence
  Synthetic Polynucleotide
taatacgactcactatagggcccgtgactggactggagtgcagtgtgcagaacagaggagactgcacatggcactccagaacctggcggcagcgcaaaagatg

SEQ ID NO: 238518 - DNA, 103 bp, Artificial Sequence
  Synthetic Polynucleotide
taatacgactcactatagggctgtgcagtcggacaccagcatgttggggtaacagaggagaaccccaatgtgctggtgtaacctggcggcagcgcaaaagatg

SEQ ID NO: 238519 - DNA, 103 bp, Artificial Sequence
  Synthetic Polynucleotide
taatacgactcactatagggggcccaggaccccgtgactggactggagtgaacagaggagacactccatgccagtcacgaacctggcggcagcgcaaaagatg

SEQ ID NO: 238520 - DNA, 103 bp, Artificial Sequence
  Synthetic Polynucleotide
taatacgactcactatagggagccgctctgggcccaggaccccgtgactgaacagaggagacagtcaatgggtcctgggaacctggcggcagcgcaaaagatg

SEQ ID NO: 238521 - DNA, 103 bp, Artificial Sequence
  Synthetic Polynucleotide
taatacgactcactatagggtgcctgctgtagccgctctgggcccaggacaacagaggagagtcctgatgccagagcggaacctggcggcagcgcaaaagatg

SEQ ID NO: 238522 - DNA, 103 bp, Artificial Sequence
  Synthetic Polynucleotide
taatacgactcactatagggcctggctcagtgcctgctgtagccgctctgaacagaggagacagagcatgtacagcaggaacctggcggcagcgcaaaagatg

SEQ ID NO: 238523 - DNA, 103 bp, Artificial Sequence
  Synthetic Polynucleotide
taatacgactcactatagggatgatgtgttcctggctcagtgcctgctgtaacagaggagaacagcaatgactgagccaaacctggcggcagcgcaaaagatg

SEQ ID NO: 238524 - DNA, 103 bp, Artificial Sequence
  Synthetic Polynucleotide
taatacgactcactatagggctgggcaacgatgatgtgttcctggctcagaacagaggagactgagcatggaacacatcaacctggcggcagcgcaaaagatg

SEQ ID NO: 238525 - DNA, 103 bp, Artificial Sequence
  Synthetic Polynucleotide
taatacgactcactatagggctgtctgttcctgggcaacgatgatgtgttaacagaggagaaacacaatgtcgttgcccaacctggcggcagcgcaaaagatg

SEQ ID NO: 238526 - DNA, 103 bp, Artificial Sequence
  Synthetic Polynucleotide
taatacgactcactatagggtgattggtcactgtctgttcctgggcaacgaacagaggagacgttgcatgggaacagacaacctggcggcagcgcaaaagatg

SEQ ID NO: 238527 - DNA, 103 bp, Artificial Sequence
  Synthetic Polynucleotide
taatacgactcactatagggggcttcctcctgattggtcactgtctgttcaacagaggagagaacagatggtgaccaataacctggcggcagcgcaaaagatg

SEQ ID NO: 238528 - DNA, 103 bp, Artificial Sequence
  Synthetic Polynucleotide
taatacgactcactatagggggatgtaggcggcttcctcctgattggtcaaacagaggagatgaccaatgaggaggaagaacctggcggcagcgcaaaagatg

SEQ ID NO: 238529 - DNA, 103 bp, Artificial Sequence
  Synthetic Polynucleotide
taatacgactcactataggggaggaggaagctgtgcagtcggacaccagcaacagaggagagctggtatgcgactgcacaacctggcggcagcgcaaaagatg

SEQ ID NO: 238530 - DNA, 103 bp, Artificial Sequence
  Synthetic Polynucleotide
taatacgactcactataggggtgatctcttggatgtaggcggcttcctccaacagaggagaggaggaatgcgcctacataacctggcggcagcgcaaaagatg

SEQ ID NO: 238531 - DNA, 103 bp, Artificial Sequence
  Synthetic Polynucleotide
taatacgactcactatagggatctgccgtggtgatctcttggatgtaggcaacagaggagagcctacatgcaagagatcaacctggcggcagcgcaaaagatg

SEQ ID NO: 238532 - DNA, 103 bp, Artificial Sequence
  Synthetic Polynucleotide
taatacgactcactatagggcggtctggccatctgccgtggtgatctcttaacagaggagaaagagaatgccacggcagaacctggcggcagcgcaaaagatg

SEQ ID NO: 238533 - DNA, 103 bp, Artificial Sequence
  Synthetic Polynucleotide
taatacgactcactatagggaggtgctgtacggtctggccatctgccgtgaacagaggagacacggcatgtggccagacaacctggcggcagcgcaaaagatg

SEQ ID NO: 238534 - DNA, 103 bp, Artificial Sequence
  Synthetic Polynucleotide
taatacgactcactatagggggaggtcaccaggtgctgtacggtctggccaacagaggagaggccagatggtacagcacaacctggcggcagcgcaaaagatg

SEQ ID NO: 238535 - DNA, 103 bp, Artificial Sequence
  Synthetic Polynucleotide
taatacgactcactatagggcctggttgtcggaggtcaccaggtgctgtaaacagaggagatacagcatgtggtgacctaacctggcggcagcgcaaaagatg

SEQ ID NO: 238536 - DNA, 103 bp, Artificial Sequence
  Synthetic Polynucleotide
taatacgactcactatagggatatactgcacctggttgtcggaggtcaccaacagaggagaggtgacatgcgacaaccaaacctggcggcagcgcaaaagatg

SEQ ID NO: 238537 - DNA, 103 bp, Artificial Sequence
  Synthetic Polynucleotide
taatacgactcactatagggctgggagatgatatactgcacctggttgtcaacagaggagagacaacatggtgcagtataacctggcggcagcgcaaaagatg

SEQ ID NO: 238538 - DNA, 103 bp, Artificial Sequence
  Synthetic Polynucleotide
taatacgactcactatagggggacaccatcctgggagatgatatactgcaaacagaggagatgcagtatgtcatctcccaacctggcggcagcgcaaaagatg

SEQ ID NO: 238539 - DNA, 103 bp, Artificial Sequence
  Synthetic Polynucleotide
taatacgactcactatagggagcaggtgctggacaccatcctgggagatgaacagaggagacatctcatgggatggtgtaacctggcggcagcgcaaaagatg

SEQ ID NO: 238540 - DNA, 103 bp, Artificial Sequence
  Synthetic Polynucleotide
taatacgactcactataggggcccaggtccgaggaggaagctgtgcagtcaacagaggagagactgcatggcttcctccaacctggcggcagcgcaaaagatg

SEQ ID NO: 238541 - DNA, 103 bp, Artificial Sequence
  Synthetic Polynucleotide
taatacgactcactatagggttcctgggggagcaggtgctggacaccatcaacagaggagagatggtatgcagcacctgaacctggcggcagcgcaaaagatg

SEQ ID NO: 238542 - DNA, 103 bp, Artificial Sequence
  Synthetic Polynucleotide
taatacgactcactatagggccacaacatattcctgggggagcaggtgctaacagaggagaagcaccatgtcccccaggaacctggcggcagcgcaaaagatg

SEQ ID NO: 238543 - DNA, 103 bp, Artificial Sequence
  Synthetic Polynucleotide
taatacgactcactatagggccttcagggaccacaacatattcctgggggaacagaggagacccccaatgatatgttgtaacctggcggcagcgcaaaagatg

SEQ ID NO: 238544 - DNA, 103 bp, Artificial Sequence
  Synthetic Polynucleotide
taatacgactcactataggggatgtgatggccttcagggaccacaacataaacagaggagatatgttatggtccctgaaaacctggcggcagcgcaaaagatg

SEQ ID NO: 238545 - DNA, 103 bp, Artificial Sequence
  Synthetic Polynucleotide
taatacgactcactatagggcctgtacctggatgtgatggccttcagggaaacagaggagatccctgatggccatcacaaacctggcggcagcgcaaaagatg

SEQ ID NO: 238546 - DNA, 103 bp, Artificial Sequence
  Synthetic Polynucleotide
taatacgactcactatagggatctggccctcctgtacctggatgtgatggaacagaggagaccatcaatgccaggtacaaacctggcggcagcgcaaaagatg

SEQ ID NO: 238547 - DNA, 103 bp, Artificial Sequence
  Synthetic Polynucleotide
taatacgactcactataggggatgtgtgtgatctggccctcctgtacctgaacagaggagacaggtaatggagggccagaacctggcggcagcgcaaaagatg

SEQ ID NO: 238548 - DNA, 103 bp, Artificial Sequence
  Synthetic Polynucleotide
taatacgactcactataggggttcatactggatgtgtgtgatctggccctaacagaggagaagggccatgtcacacacaaacctggcggcagcgcaaaagatg

SEQ ID NO: 238549 - DNA, 103 bp, Artificial Sequence
  Synthetic Polynucleotide
taatacgactcactatagggggggctccttgttcatactggatgtgtgtgaacagaggagacacacaatgccagtatgaaacctggcggcagcgcaaaagatg

SEQ ID NO: 238550 - DNA, 103 bp, Artificial Sequence
  Synthetic Polynucleotide
taatacgactcactatagggctgaaggaacggggctccttgttcatactgaacagaggagacagtatatgcaaggagccaacctggcggcagcgcaaaagatg

SEQ ID NO: 238551 - DNA, 103 bp, Artificial Sequence
  Synthetic Polynucleotide
taatacgactcactatagggcgatggccgagcccaggtccgaggaggaagaacagaggagacttcctatgcggacctggaacctggcggcagcgcaaaagatg

SEQ ID NO: 238552 - DNA, 103 bp, Artificial Sequence
  Synthetic Polynucleotide
taatacgactcactatagggtctgggactcctgaaggaacggggctccttaacagaggagaaaggagatgcgttccttcaacctggcggcagcgcaaaagatg

SEQ ID NO: 238553 - DNA, 103 bp, Artificial Sequence
  Synthetic Polynucleotide
taatacgactcactatagggacatactggatctgggactcctgaaggaacaacagaggagagttcctatgggagtcccaaacctggcggcagcgcaaaagatg

SEQ ID NO: 238554 - DNA, 103 bp, Artificial Sequence
  Synthetic Polynucleotide
taatacgactcactatagggggacacaggcacatactggatctgggactcaacagaggagagagtccatgatccagtataacctggcggcagcgcaaaagatg

SEQ ID NO: 238555 - DNA, 103 bp, Artificial Sequence
  Synthetic Polynucleotide
taatacgactcactataggggctggcctggggacacaggcacatactggaaacagaggagatccagtatgtgcctgtgtaacctggcggcagcgcaaaagatg

SEQ ID NO: 238556 - DNA, 103 bp, Artificial Sequence
  Synthetic Polynucleotide
taatacgactcactataggggtgacaagctgctggcctggggacacaggcaacagaggagagcctgtatgcccaggccaaacctggcggcagcgcaaaagatg

SEQ ID NO: 238557 - DNA, 103 bp, Artificial Sequence
  Synthetic Polynucleotide
taatacgactcactatagggttgagcctgtgtgacaagctgctggcctggaacagaggagaccaggcatgcagcttgtcaacctggcggcagcgcaaaagatg

SEQ ID NO: 238558 - DNA, 103 bp, Artificial Sequence
  Synthetic Polynucleotide
taatacgactcactatagggcagcctcaagttgagcctgtgtgacaagctaacagaggagaagcttgatgcacaggctcaacctggcggcagcgcaaaagatg

SEQ ID NO: 238559 - DNA, 103 bp, Artificial Sequence
  Synthetic Polynucleotide
taatacgactcactataggggagtgtgctgcagcctcaagttgagcctgtaacagaggagaacaggcatgacttgaggcaacctggcggcagcgcaaaagatg

SEQ ID NO: 238560 - DNA, 103 bp, Artificial Sequence
  Synthetic Polynucleotide
taatacgactcactatagggtgtgacagctgagtgtgctgcagcctcaagaacagaggagacttgagatggcagcacacaacctggcggcagcgcaaaagatg

SEQ ID NO: 238561 - DNA, 103 bp, Artificial Sequence
  Synthetic Polynucleotide
taatacgactcactatagggcagccactgctgtgacagctgagtgtgctgaacagaggagacagcacatgcagctgtcaaacctggcggcagcgcaaaagatg

SEQ ID NO: 238562 - DNA, 103 bp, Artificial Sequence
  Synthetic Polynucleotide
taatacgactcactatagggatgatcttgtcgatggccgagcccaggtccaacagaggagaggacctatgctcggccataacctggcggcagcgcaaaagatg

SEQ ID NO: 238563 - DNA, 103 bp, Artificial Sequence
  Synthetic Polynucleotide
taatacgactcactatagggatggcagcatcagccactgctgtgacagctaacagaggagaagctgtatgagcagtggcaacctggcggcagcgcaaaagatg

SEQ ID NO: 238564 - DNA, 103 bp, Artificial Sequence
  Synthetic Polynucleotide
taatacgactcactatagggggcttgggccatggcagcatcagccactgcaacagaggagagcagtgatggatgctgccaacctggcggcagcgcaaaagatg

SEQ ID NO: 238565 - DNA, 103 bp, Artificial Sequence
  Synthetic Polynucleotide
taatacgactcactatagggacaggccctgggcttgggccatggcagcataacagaggagaatgctgatgtggcccaagaacctggcggcagcgcaaaagatg

SEQ ID NO: 238566 - DNA, 103 bp, Artificial Sequence
  Synthetic Polynucleotide
taatacgactcactatagggtctgtaccaaacaggccctgggcttgggccaacagaggagaggcccaatgccagggcctaacctggcggcagcgcaaaagatg

SEQ ID NO: 238567 - DNA, 103 bp, Artificial Sequence
  Synthetic Polynucleotide
taatacgactcactatagggcactgtctcgtctgtaccaaacaggccctgaacagaggagacagggcatgtttggtacaaacctggcggcagcgcaaaagatg

SEQ ID NO: 238568 - DNA, 103 bp, Artificial Sequence
  Synthetic Polynucleotide
taatacgactcactatagggtgtgttcgggcactgtctcgtctgtaccaaaacagaggagattggtaatgacgagacagaacctggcggcagcgcaaaagatg

SEQ ID NO: 238569 - DNA, 103 bp, Artificial Sequence
  Synthetic Polynucleotide
taatacgactcactatagggagctgttgaatgtgttcgggcactgtctcgaacagaggagacgagacatggcccgaacaaacctggcggcagcgcaaaagatg

SEQ ID NO: 238570 - DNA, 103 bp, Artificial Sequence
  Synthetic Polynucleotide
taatacgactcactatagggctggtgctgcagctgttgaatgtgttcgggaacagaggagacccgaaatgattcaacagaacctggcggcagcgcaaaagatg

SEQ ID NO: 238571 - DNA, 103 bp, Artificial Sequence
  Synthetic Polynucleotide
taatacgactcactatagggactcgatgccctggtgctgcagctgttgaaaacagaggagattcaacatgtgcagcaccaacctggcggcagcgcaaaagatg

SEQ ID NO: 238572 - DNA, 103 bp, Artificial Sequence
  Synthetic Polynucleotide
taatacgactcactatagggatgacgtcgtactcgatgccctggtgctgcaacagaggagagcagcaatggggcatcgaaacctggcggcagcgcaaaagatg

SEQ ID NO: 238573 - DNA, 103 bp, Artificial Sequence
  Synthetic Polynucleotide
taatacgactcactatagggctcgggccggccaggcccaggggccgcgtcaacagaggagagacgcgatgcctgggcctaacctggcggcagcgcaaaagatg

SEQ ID NO: 238574 - DNA, 103 bp, Artificial Sequence
  Synthetic Polynucleotide
taatacgactcactatagggggtggactcgatgatcttgtcgatggccgaaacagaggagatcggccatggacaagatcaacctggcggcagcgcaaaagatg

SEQ ID NO: 238575 - DNA, 103 bp, Artificial Sequence
  Synthetic Polynucleotide
taatacgactcactatagggggccagggtgatgacgtcgtactcgatgccaacagaggagaggcatcatgtacgacgtcaacctggcggcagcgcaaaagatg

SEQ ID NO: 238576 - DNA, 103 bp, Artificial Sequence
  Synthetic Polynucleotide
taatacgactcactatagggcgggcccgatggtggactcgatgatcttgtaacagaggagaacaagaatgtcgagtccaaacctggcggcagcgcaaaagatg

SEQ ID NO: 238577 - DNA, 103 bp, Artificial Sequence
  Synthetic Polynucleotide
taatacgactcactatagggtggatgaggtcgggcccgatggtggactcgaacagaggagacgagtcatgcatcgggccaacctggcggcagcgcaaaagatg

SEQ ID NO: 238578 - DNA, 103 bp, Artificial Sequence
  Synthetic Polynucleotide
taatacgactcactataggggatgcagttctggatgaggtcgggcccgataacagaggagaatcgggatggacctcatcaacctggcggcagcgcaaaagatg

SEQ ID NO: 238579 - DNA, 103 bp, Artificial Sequence
  Synthetic Polynucleotide
taatacgactcactatagggtggtcacagtgatgcagttctggatgaggtaacagaggagaacctcaatgagaactgcaaacctggcggcagcgcaaaagatg

SEQ ID NO: 238580 - DNA, 103 bp, Artificial Sequence
  Synthetic Polynucleotide
taatacgactcactatagggtcctcagcactggtcacagtgatgcagttcaacagaggagagaactgatgcactgtgacaacctggcggcagcgcaaaagatg

SEQ ID NO: 238581 - DNA, 103 bp, Artificial Sequence
  Synthetic Polynucleotide
taatacgactcactatagggggccccgccatcctcagcactggtcacagtaacagaggagaactgtgatgagtgctgagaacctggcggcagcgcaaaagatg

SEQ ID NO: 238582 - DNA, 103 bp, Artificial Sequence
  Synthetic Polynucleotide
taatacgactcactataggggtgtggtctcggccccgccatcctcagcacaacagaggagagtgctgatgatggcggggaacctggcggcagcgcaaaagatg

SEQ ID NO: 238583 - DNA, 103 bp, Artificial Sequence
  Synthetic Polynucleotide
taatacgactcactatagggatcaggtaccgtgtggtctcggccccgccaaacagaggagatggcggatgcgagaccacaacctggcggcagcgcaaaagatg

SEQ ID NO: 238584 - DNA, 103 bp, Artificial Sequence
  Synthetic Polynucleotide
taatacgactcactataggggccctgtaggatcaggtaccgtgtggtctcaacagaggagagagaccatgcggtacctgaacctggcggcagcgcaaaagatg

SEQ ID NO: 238585 - DNA, 103 bp, Artificial Sequence
  Synthetic Polynucleotide
taatacgactcactatagggcagagggctcctcgggccggccaggcccagaacagaggagactgggcatggccggcccgaacctggcggcagcgcaaaagatg

SEQ ID NO: 238586 - DNA, 103 bp, Artificial Sequence
  Synthetic Polynucleotide
taatacgactcactatagggcatcatctgggccctgtaggatcaggtaccaacagaggagaggtaccatgtcctacaggaacctggcggcagcgcaaaagatg

SEQ ID NO: 238587 - DNA, 103 bp, Artificial Sequence
  Synthetic Polynucleotide
taatacgactcactatagggatgggggctccatcatctgggccctgtaggaacagaggagacctacaatgcccagatgaaacctggcggcagcgcaaaagatg

SEQ ID NO: 238588 - DNA, 103 bp, Artificial Sequence
  Synthetic Polynucleotide
taatacgactcactatagggtggtgatgtcatgggggctccatcatctggaacagaggagaccagatatgggagcccccaacctggcggcagcgcaaaagatg

SEQ ID NO: 238589 - DNA, 103 bp, Artificial Sequence
  Synthetic Polynucleotide
taatacgactcactatagggaactggacattggtgatgtcatgggggctcaacagaggagagagcccatgtgacatcacaacctggcggcagcgcaaaagatg

SEQ ID NO: 238590 - DNA, 103 bp, Artificial Sequence
  Synthetic Polynucleotide
taatacgactcactataggggccaaggtggaactggacattggtgatgtcaacagaggagagacatcatgaatgtccagaacctggcggcagcgcaaaagatg

SEQ ID NO: 238591 - DNA, 103 bp, Artificial Sequence
  Synthetic Polynucleotide
taatacgactcactatagggtaggctgtgggccaaggtggaactggacataacagaggagaatgtccatgtccaccttgaacctggcggcagcgcaaaagatg

SEQ ID NO: 238592 - DNA, 103 bp, Artificial Sequence
  Synthetic Polynucleotide
taatacgactcactatagggcaatggctgctaggctgtgggccaaggtggaacagaggagaccacctatgcccacagccaacctggcggcagcgcaaaagatg

SEQ ID NO: 238593 - DNA, 103 bp, Artificial Sequence
  Synthetic Polynucleotide
taatacgactcactataggggccagggcctcaatggctgctaggctgtggaacagaggagaccacagatgagcagccataacctggcggcagcgcaaaagatg

SEQ ID NO: 238594 - DNA, 103 bp, Artificial Sequence
  Synthetic Polynucleotide
taatacgactcactatagggggggccatctgccagggcctcaatggctgcaacagaggagagcagccatggaggccctgaacctggcggcagcgcaaaagatg

SEQ ID NO: 238595 - DNA, 103 bp, Artificial Sequence
  Synthetic Polynucleotide
taatacgactcactatagggatgtggatgtggggccatctgccagggcctaacagaggagaaggcccatgcagatggccaacctggcggcagcgcaaaagatg

SEQ ID NO: 238596 - DNA, 103 bp, Artificial Sequence
  Synthetic Polynucleotide
taatacgactcactatagggaggccgctctcagagggctcctcgggccggaacagaggagaccggccatgggagccctcaacctggcggcagcgcaaaagatg

SEQ ID NO: 238597 - DNA, 103 bp, Artificial Sequence
  Synthetic Polynucleotide
taatacgactcactatagggaggcatgtggatgtggatgtggggccatctaacagaggagaagatggatgcacatccacaacctggcggcagcgcaaaagatg

SEQ ID NO: 238598 - DNA, 103 bp, Artificial Sequence
  Synthetic Polynucleotide
taatacgactcactatagggctgtgcctccaggcatgtggatgtggatgtaacagaggagaacatccatgtccacatgcaacctggcggcagcgcaaaagatg

SEQ ID NO: 238599 - DNA, 103 bp, Artificial Sequence
  Synthetic Polynucleotide
taatacgactcactatagggtgggcccaccctgtgcctccaggcatgtggaacagaggagaccacatatgtggaggcacaacctggcggcagcgcaaaagatg

SEQ ID NO: 238600 - DNA, 103 bp, Artificial Sequence
  Synthetic Polynucleotide
taatacgactcactatagggaccggggagctgggcccaccctgtgcctccaacagaggagaggaggcatggggtgggccaacctggcggcagcgcaaaagatg

SEQ ID NO: 238601 - DNA, 103 bp, Artificial Sequence
  Synthetic Polynucleotide
taatacgactcactataggggggcagctgcaccggggagctgggcccaccaacagaggagaggtgggatgagctccccgaacctggcggcagcgcaaaagatg

SEQ ID NO: 238602 - DNA, 103 bp, Artificial Sequence
  Synthetic Polynucleotide
taatacgactcactatagggcggaggctgggggcagctgcaccggggagcaacagaggagagctcccatgtgcagctgcaacctggcggcagcgcaaaagatg

SEQ ID NO: 238603 - DNA, 103 bp, Artificial Sequence
  Synthetic Polynucleotide
taatacgactcactatagggtcttcggcaccggaggctgggggcagctgcaacagaggagagcagctatgcccagcctcaacctggcggcagcgcaaaagatg

SEQ ID NO: 238604 - DNA, 103 bp, Artificial Sequence
  Synthetic Polynucleotide
taatacgactcactatagggcaggtccggctcttcggcaccggaggctggaacagaggagaccagccatgggtgccgaaaacctggcggcagcgcaaaagatg

SEQ ID NO: 238605 - DNA, 103 bp, Artificial Sequence
  Synthetic Polynucleotide
taatacgactcactatagggccaggctctgcaggtccggctcttcggcacaacagaggagagtgccgatgagccggaccaacctggcggcagcgcaaaagatg

SEQ ID NO: 238606 - DNA, 103 bp, Artificial Sequence
  Synthetic Polynucleotide
taatacgactcactatagggatcatggcctccaggctctgcaggtccggcaacagaggagagccggaatggcagagcctaacctggcggcagcgcaaaagatg

SEQ ID NO: 238607 - DNA, 103 bp, Artificial Sequence
  Synthetic Polynucleotide
taatacgactcactataggggcccacacccaggccgctctcagagggctcaacagaggagagagcccatggagagcggcaacctggcggcagcgcaaaagatg

SEQ ID NO: 238608 - DNA, 103 bp, Artificial Sequence
  Synthetic Polynucleotide
taatacgactcactatagggcaccacctccatcatggcctccaggctctgaacagaggagacagagcatggaggccatgaacctggcggcagcgcaaaagatg

SEQ ID NO: 238609 - DNA, 103 bp, Artificial Sequence
  Synthetic Polynucleotide
taatacgactcactataggggctgcaccaccaccacctccatcatggcctaacagaggagaaggccaatgtggaggtggaacctggcggcagcgcaaaagatg

SEQ ID NO: 238610 - DNA, 103 bp, Artificial Sequence
  Synthetic Polynucleotide
taatacgactcactatagggcatttgaactgctgcaccaccaccacctccaacagaggagaggaggtatgggtggtgcaaacctggcggcagcgcaaaagatg

SEQ ID NO: 238611 - DNA, 103 bp, Artificial Sequence
  Synthetic Polynucleotide
taatacgactcactataggggcacatcttgcatttgaactgctgcaccacaacagaggagagtggtgatgcagttcaaaaacctggcggcagcgcaaaagatg

SEQ ID NO: 238612 - DNA, 103 bp, Artificial Sequence
  Synthetic Polynucleotide
taatacgactcactatagggtccggtactggcacatcttgcatttgaactaacagaggagaagttcaatggcaagatgtaacctggcggcagcgcaaaagatg

SEQ ID NO: 238613 - DNA, 103 bp, Artificial Sequence
  Synthetic Polynucleotide
taatacgactcactatagggttggtgctgctccggtactggcacatcttgaacagaggagacaagatatgccagtaccgaacctggcggcagcgcaaaagatg

SEQ ID NO: 238614 - DNA, 103 bp, Artificial Sequence
  Synthetic Polynucleotide
taatacgactcactatagggcagtgtggccttggtgctgctccggtactgaacagaggagacagtacatgagcagcaccaacctggcggcagcgcaaaagatg

SEQ ID NO: 238615 - DNA, 103 bp, Artificial Sequence
  Synthetic Polynucleotide
taatacgactcactatagggtgtggcgcagcagtgtggccttggtgctgcaacagaggagagcagcaatgaggccacacaacctggcggcagcgcaaaagatg

SEQ ID NO: 238616 - DNA, 103 bp, Artificial Sequence
  Synthetic Polynucleotide
taatacgactcactatagggcgttcccgcatgtggcgcagcagtgtggccaacagaggagaggccacatggctgcgccaaacctggcggcagcgcaaaagatg

SEQ ID NO: 238617 - DNA, 103 bp, Artificial Sequence
  Synthetic Polynucleotide
taatacgactcactatagggacggaagtggcgttcccgcatgtggcgcagaacagaggagactgcgcatgatgcgggaaaacctggcggcagcgcaaaagatg

SEQ ID NO: 238618 - DNA, 103 bp, Artificial Sequence
  Synthetic Polynucleotide
taatacgactcactatagggcttctgaggtgcccacacccaggccgctctaacagaggagaagagcgatgtgggtgtggaacctggcggcagcgcaaaagatg

SEQ ID NO: 238619 - DNA, 103 bp, Artificial Sequence
  Synthetic Polynucleotide
taatacgactcactatagggctgctactggacggaagtggcgttcccgcaaacagaggagatgcgggatggccacttccaacctggcggcagcgcaaaagatg

SEQ ID NO: 238620 - DNA, 103 bp, Artificial Sequence
  Synthetic Polynucleotide
taatacgactcactataggggctgcggctgctgctactggacggaagtggaacagaggagaccacttatgtccagtagcaacctggcggcagcgcaaaagatg

SEQ ID NO: 238621 - DNA, 103 bp, Artificial Sequence
  Synthetic Polynucleotide
taatacgactcactatagggaccagctgctgctgcggctgctgctactggaacagaggagaccagtaatggcagccgcaaacctggcggcagcgcaaaagatg

SEQ ID NO: 238622 - DNA, 103 bp, Artificial Sequence
  Synthetic Polynucleotide
taatacgactcactataggggtccttttttaccagctgctgctgcggctgaacagaggagacagccgatgcagcagctgaacctggcggcagcgcaaaagatg

SEQ ID NO: 238623 - DNA, 103 bp, Artificial Sequence
  Synthetic Polynucleotide
taatacgactcactatagggttccgtagacgtccttttttaccagctgctaacagaggagaagcagcatgtaaaaaaggaacctggcggcagcgcaaaagatg

SEQ ID NO: 238624 - DNA, 103 bp, Artificial Sequence
  Synthetic Polynucleotide
taatacgactcactatagggggtgctccacttccgtagacgtccttttttaacagaggagaaaaaaaatgcgtctacggaacctggcggcagcgcaaaagatg

SEQ ID NO: 238625 - DNA, 103 bp, Artificial Sequence
  Synthetic Polynucleotide
taatacgactcactatagggtcttggtggaggtgctccacttccgtagacaacagaggagagtctacatgagtggagcaaacctggcggcagcgcaaaagatg

SEQ ID NO: 238626 - DNA, 103 bp, Artificial Sequence
  Synthetic Polynucleotide
taatacgactcactatagggtcctcttggctcttggtggaggtgctccacaacagaggagagtggagatgctccaccaaaacctggcggcagcgcaaaagatg

SEQ ID NO: 238627 - DNA, 103 bp, Artificial Sequence
  Synthetic Polynucleotide
taatacgactcactatagggtggtccctcttcctcttggctcttggtggaaacagaggagatccaccatgagccaagagaacctggcggcagcgcaaaagatg

SEQ ID NO: 238628 - DNA, 103 bp, Artificial Sequence
  Synthetic Polynucleotide
taatacgactcactatagggcctcctcctctggtccctcttcctcttggcaacagaggagagccaagatgaagagggacaacctggcggcagcgcaaaagatg

SEQ ID NO: 238629 - DNA, 103 bp, Artificial Sequence
  Synthetic Polynucleotide
taatacgactcactataggggcggacacggcttctgaggtgcccacacccaacagaggagagggtgtatgcacctcagaaacctggcggcagcgcaaaagatg

SEQ ID NO: 238630 - DNA, 103 bp, Artificial Sequence
  Synthetic Polynucleotide
taatacgactcactatagggtcatcatcgtcctcctcctctggtccctctaacagaggagaagagggatgagaggaggaaacctggcggcagcgcaaaagatg

SEQ ID NO: 238631 - DNA, 103 bp, Artificial Sequence
  Synthetic Polynucleotide
taatacgactcactataggggtctacaatgtcatcatcgtcctcctcctcaacagaggagagaggagatggacgatgataacctggcggcagcgcaaaagatg

SEQ ID NO: 238632 - DNA, 103 bp, Artificial Sequence
  Synthetic Polynucleotide
taatacgactcactatagggtggctccagcgtctacaatgtcatcatcgtaacagaggagaacgatgatgacattgtagaacctggcggcagcgcaaaagatg

SEQ ID NO: 238633 - DNA, 103 bp, Artificial Sequence
  Synthetic Polynucleotide
taatacgactcactatagggaggtcatcaatggctccagcgtctacaatgaacagaggagacattgtatgcgctggagcaacctggcggcagcgcaaaagatg

SEQ ID NO: 238634 - DNA, 103 bp, Artificial Sequence
  Synthetic Polynucleotide
taatacgactcactatagggatcctcctccaggtcatcaatggctccagcaacagaggagagctggaatgattgatgacaacctggcggcagcgcaaaagatg

SEQ ID NO: 238635 - DNA, 103 bp, Artificial Sequence
  Synthetic Polynucleotide
taatacgactcactatagggtatagtcgctatcctcctccaggtcatcaaaacagaggagattgatgatgtggaggaggaacctggcggcagcgcaaaagatg

SEQ ID NO: 238636 - DNA, 103 bp, Artificial Sequence
  Synthetic Polynucleotide
taatacgactcactatagggtcagctggattatagtcgctatcctcctccaacagaggagaggaggaatgtagcgactaaacctggcggcagcgcaaaagatg

SEQ ID NO: 238637 - DNA, 103 bp, Artificial Sequence
  Synthetic Polynucleotide
taatacgactcactataggggggctcatcctcagctggattatagtcgctaacagaggagaagcgacatgaatccagctaacctggcggcagcgcaaaagatg

SEQ ID NO: 238638 - DNA, 103 bp, Artificial Sequence
  Synthetic Polynucleotide
taatacgactcactataggggccggcctcggggctcatcctcagctggataacagaggagaatccagatgaggatgagcaacctggcggcagcgcaaaagatg

SEQ ID NO: 238639 - DNA, 103 bp, Artificial Sequence
  Synthetic Polynucleotide
taatacgactcactatagggagccgaagctgccggcctcggggctcatccaacagaggagaggatgaatgccgaggccgaacctggcggcagcgcaaaagatg

SEQ ID NO: 238640 - DNA, 103 bp, Artificial Sequence
  Synthetic Polynucleotide
taatacgactcactatagggcagtgttatggattcctgggcctggatcataacagaggagaatgatcatggcccaggaaaacctggcggcagcgcaaaagatg

SEQ ID NO: 238641 - DNA, 103 bp, Artificial Sequence
  Synthetic Polynucleotide
taatacgactcactataggggttctccaacatcacatcccggtacaggtcaacagaggagagacctgatgcgggatgtgaacctggcggcagcgcaaaagatg

SEQ ID NO: 238642 - DNA, 103 bp, Artificial Sequence
  Synthetic Polynucleotide
taatacgactcactataggggtgaaatctctgatgtgctatgagacacgtaacagaggagaacgtgtatgatagcacataacctggcggcagcgcaaaagatg

SEQ ID NO: 238643 - DNA, 103 bp, Artificial Sequence
  Synthetic Polynucleotide
taatacgactcactatagggtctttcctgtgtgaaatctctgatgtgctaaacagaggagatagcacatgagagatttcaacctggcggcagcgcaaaagatg

SEQ ID NO: 238644 - DNA, 103 bp, Artificial Sequence
  Synthetic Polynucleotide
taatacgactcactatagggacaaagggcgtctttcctgtgtgaaatctcaacagaggagagagattatgcacaggaaaaacctggcggcagcgcaaaagatg

SEQ ID NO: 238645 - DNA, 103 bp, Artificial Sequence
  Synthetic Polynucleotide
taatacgactcactatagggttcactgcacacaaagggcgtctttcctgtaacagaggagaacaggaatgacgccctttaacctggcggcagcgcaaaagatg

SEQ ID NO: 238646 - DNA, 103 bp, Artificial Sequence
  Synthetic Polynucleotide
taatacgactcactatagggattttccacattcactgcacacaaagggcgaacagaggagacgccctatgtgtgcagtgaacctggcggcagcgcaaaagatg

SEQ ID NO: 238647 - DNA, 103 bp, Artificial Sequence
  Synthetic Polynucleotide
taatacgactcactatagggtgagaacaggattttccacattcactgcacaacagaggagagtgcagatgatgtggaaaaacctggcggcagcgcaaaagatg

SEQ ID NO: 238648 - DNA, 103 bp, Artificial Sequence
  Synthetic Polynucleotide
taatacgactcactatagggacctgatttctgagaacaggattttccacaaacagaggagatgtggaatgtcctgttctaacctggcggcagcgcaaaagatg

SEQ ID NO: 238649 - DNA, 103 bp, Artificial Sequence
  Synthetic Polynucleotide
taatacgactcactataggggtttaatgagacctgatttctgagaacaggaacagaggagacctgttatgagaaatcagaacctggcggcagcgcaaaagatg

SEQ ID NO: 238650 - DNA, 103 bp, Artificial Sequence
  Synthetic Polynucleotide
taatacgactcactatagggattctttgatgtttaatgagacctgatttcaacagaggagagaaatcatgtctcattaaaacctggcggcagcgcaaaagatg

SEQ ID NO: 238651 - DNA, 103 bp, Artificial Sequence
  Synthetic Polynucleotide
taatacgactcactatagggtcctgtgtgaattctttgatgtttaatgagaacagaggagactcattatgcatcaaagaaacctggcggcagcgcaaaagatg

SEQ ID NO: 238652 - DNA, 103 bp, Artificial Sequence
  Synthetic Polynucleotide
taatacgactcactatagggggttgctgtagttctccaacatcacatcccaacagaggagagggatgatgtgttggagaaacctggcggcagcgcaaaagatg

SEQ ID NO: 238653 - DNA, 103 bp, Artificial Sequence
  Synthetic Polynucleotide
taatacgactcactatagggagggtttctctcctgtgtgaattctttgataacagaggagaatcaaaatgttcacacagaacctggcggcagcgcaaaagatg

SEQ ID NO: 238654 - DNA, 103 bp, Artificial Sequence
  Synthetic Polynucleotide
taatacgactcactatagggctacattcaaagggtttctctcctgtgtgaaacagaggagatcacacatgagagaaaccaacctggcggcagcgcaaaagatg

SEQ ID NO: 238655 - DNA, 103 bp, Artificial Sequence
  Synthetic Polynucleotide
taatacgactcactatagggcccacattcactacattcaaagggtttctcaacagaggagagagaaaatgtttgaatgtaacctggcggcagcgcaaaagatg

SEQ ID NO: 238656 - DNA, 103 bp, Artificial Sequence
  Synthetic Polynucleotide
taatacgactcactatagggtaaaggctttcccacattcactacattcaaaacagaggagattgaatatggtgaatgtgaacctggcggcagcgcaaaagatg

SEQ ID NO: 238657 - DNA, 103 bp, Artificial Sequence
  Synthetic Polynucleotide
taatacgactcactatagggtgctttgtgctaaaggctttcccacattcaaacagaggagatgaatgatggaaagccttaacctggcggcagcgcaaaagatg

SEQ ID NO: 238658 - DNA, 103 bp, Artificial Sequence
  Synthetic Polynucleotide
taatacgactcactatagggaatgagcttttgctttgtgctaaaggctttaacagaggagaaaagccatgagcacaaagaacctggcggcagcgcaaaagatg

SEQ ID NO: 238659 - DNA, 103 bp, Artificial Sequence
  Synthetic Polynucleotide
taatacgactcactatagggtttgatggacaatgagcttttgctttgtgcaacagaggagagcacaaatgaaaagctcaaacctggcggcagcgcaaaagatg

SEQ ID NO: 238660 - DNA, 103 bp, Artificial Sequence
  Synthetic Polynucleotide
taatacgactcactataggggtatgagtcctttgatggacaatgagctttaacagaggagaaaagctatgtgtccatcaaacctggcggcagcgcaaaagatg

SEQ ID NO: 238661 - DNA, 103 bp, Artificial Sequence
  Synthetic Polynucleotide
taatacgactcactatagggtctctctcctgtatgagtcctttgatggacaacagaggagagtccatatgaggactcataacctggcggcagcgcaaaagatg

SEQ ID NO: 238662 - DNA, 103 bp, Artificial Sequence
  Synthetic Polynucleotide
taatacgactcactatagggagccatagggtctctctcctgtatgagtccaacagaggagaggactcatgcaggagagaaacctggcggcagcgcaaaagatg

SEQ ID NO: 238663 - DNA, 103 bp, Artificial Sequence
  Synthetic Polynucleotide
taatacgactcactatagggactgccaccaggttgctgtagttctccaacaacagaggagagttggaatgctacagcaaaacctggcggcagcgcaaaagatg

SEQ ID NO: 238664 - DNA, 103 bp, Artificial Sequence
  Synthetic Polynucleotide
taatacgactcactatagggcactcgttacagccatagggtctctctcctaacagaggagaaggagaatgaccctatggaacctggcggcagcgcaaaagatg

SEQ ID NO: 238665 - DNA, 103 bp, Artificial Sequence
  Synthetic Polynucleotide
taatacgactcactatagggcgctttcccacactcgttacagccatagggaacagaggagaccctatatgtgtaacgagaacctggcggcagcgcaaaagatg

SEQ ID NO: 238666 - DNA, 103 bp, Artificial Sequence
  Synthetic Polynucleotide
taatacgactcactatagggtatacgcaaacgctttcccacactcgttacaacagaggagagtaacgatggtgggaaagaacctggcggcagcgcaaaagatg

SEQ ID NO: 238667 - DNA, 103 bp, Artificial Sequence
  Synthetic Polynucleotide
taatacgactcactatagggagacacgacatatacgcaaacgctttcccaaacagaggagatgggaaatggtttgcgtaaacctggcggcagcgcaaaagatg

SEQ ID NO: 238668 - DNA, 103 bp, Artificial Sequence
  Synthetic Polynucleotide
taatacgactcactatagggatgcttaaccagacacgacatatacgcaaaaacagaggagatttgcgatgatgtcgtgtaacctggcggcagcgcaaaagatg

SEQ ID NO: 238669 - DNA, 103 bp, Artificial Sequence
  Synthetic Polynucleotide
taatacgactcactataggggtattctcttatgcttaaccagacacgacaaacagaggagatgtcgtatgtggttaagcaacctggcggcagcgcaaaagatg

SEQ ID NO: 238670 - DNA, 103 bp, Artificial Sequence
  Synthetic Polynucleotide
taatacgactcactatagggtcccttgtgtgtattctcttatgcttaaccaacagaggagaggttaaatgtaagagaataacctggcggcagcgcaaaagatg

SEQ ID NO: 238671 - DNA, 103 bp, Artificial Sequence
  Synthetic Polynucleotide
taatacgactcactatagggctcttgtttctcccttgtgtgtattctcttaacagaggagaaagagaatgcacacaaggaacctggcggcagcgcaaaagatg

SEQ ID NO: 238672 - DNA, 103 bp, Artificial Sequence
  Synthetic Polynucleotide
taatacgactcactatagggccttggctgcctcttgtttctcccttgtgtaacagaggagaacacaaatgagaaacaagaacctggcggcagcgcaaaagatg

SEQ ID NO: 238673 - DNA, 103 bp, Artificial Sequence
  Synthetic Polynucleotide
taatacgactcactatagggggattttccaccttggctgcctcttgtttcaacagaggagagaaacaatgggcagccaaaacctggcggcagcgcaaaagatg

SEQ ID NO: 238674 - DNA, 103 bp, Artificial Sequence
  Synthetic Polynucleotide
taatacgactcactatagggttgataccccactgccaccaggttgctgtaaacagaggagatacagcatgctggtggcaaacctggcggcagcgcaaaagatg

SEQ ID NO: 238675 - DNA, 103 bp, Artificial Sequence
  Synthetic Polynucleotide
taatacgactcactatagggctctgcaggaggattttccaccttggctgcaacagaggagagcagccatggtggaaaataacctggcggcagcgcaaaagatg

SEQ ID NO: 238676 - DNA, 103 bp, Artificial Sequence
  Synthetic Polynucleotide
taatacgactcactatagggagctgtgcctctctgcaggaggattttccaaacagaggagatggaaaatgctcctgcagaacctggcggcagcgcaaaagatg

SEQ ID NO: 238677 - DNA, 103 bp, Artificial Sequence
  Synthetic Polynucleotide
taatacgactcactataggggtgtgtaatgagctgtgcctctctgcaggaaacagaggagatcctgcatggaggcacagaacctggcggcagcgcaaaagatg

SEQ ID NO: 238678 - DNA, 103 bp, Artificial Sequence
  Synthetic Polynucleotide
taatacgactcactataggggacatcactggtgtgtaatgagctgtgcctaacagaggagaaggcacatgtcattacacaacctggcggcagcgcaaaagatg

SEQ ID NO: 238679 - DNA, 103 bp, Artificial Sequence
  Synthetic Polynucleotide
taatacgactcactatagggtctcctgcatgacatcactggtgtgtaatgaacagaggagacattacatgccagtgatgaacctggcggcagcgcaaaagatg

SEQ ID NO: 238680 - DNA, 103 bp, Artificial Sequence
  Synthetic Polynucleotide
taatacgactcactataggggcagagtttttctcctgcatgacatcactgaacagaggagacagtgaatgcatgcaggaaacctggcggcagcgcaaaagatg

SEQ ID NO: 238681 - DNA, 103 bp, Artificial Sequence
  Synthetic Polynucleotide
taatacgactcactatagggcgccccgttagcagagtttttctcctgcataacagaggagaatgcagatgaaaaactctaacctggcggcagcgcaaaagatg

SEQ ID NO: 238682 - DNA, 103 bp, Artificial Sequence
  Synthetic Polynucleotide
taatacgactcactatagggcttgtgtagtcgccccgttagcagagttttaacagaggagaaaaactatgctaacggggaacctggcggcagcgcaaaagatg

SEQ ID NO: 238683 - DNA, 103 bp, Artificial Sequence
  Synthetic Polynucleotide
taatacgactcactatagggacagaaggcacttgtgtagtcgccccgttaaacagaggagataacggatggactacacaaacctggcggcagcgcaaaagatg

SEQ ID NO: 238684 - DNA, 103 bp, Artificial Sequence
  Synthetic Polynucleotide
taatacgactcactatagggctgaggggccacagaaggcacttgtgtagtaacagaggagaactacaatggtgccttctaacctggcggcagcgcaaaagatg

SEQ ID NO: 238685 - DNA, 103 bp, Artificial Sequence
  Synthetic Polynucleotide
taatacgactcactataggggtttgctggcttgataccccactgccaccaaacagaggagatggtggatgtggggtatcaacctggcggcagcgcaaaagatg

SEQ ID NO: 238686 - DNA, 103 bp, Artificial Sequence
  Synthetic Polynucleotide
taatacgactcactatagggttaatgatgtctgaggggccacagaaggcaaacagaggagatgccttatgtggcccctcaacctggcggcagcgcaaaagatg

SEQ ID NO: 238687 - DNA, 103 bp, Artificial Sequence
  Synthetic Polynucleotide
taatacgactcactatagggccgctgatgtttaatgatgtctgaggggccaacagaggagaggccccatggacatcattaacctggcggcagcgcaaaagatg

SEQ ID NO: 238688 - DNA, 103 bp, Artificial Sequence
  Synthetic Polynucleotide
taatacgactcactatagggtgcgaggaggccgctgatgtttaatgatgtaacagaggagaacatcaatgaacatcagcaacctggcggcagcgcaaaagatg

SEQ ID NO: 238689 - DNA, 103 bp, Artificial Sequence
  Synthetic Polynucleotide
taatacgactcactatagggcgttcctgtttgcgaggaggccgctgatgtaacagaggagaacatcaatggcctcctcgaacctggcggcagcgcaaaagatg

SEQ ID NO: 238690 - DNA, 103 bp, Artificial Sequence
  Synthetic Polynucleotide
taatacgactcactatagggacaaggactacgttcctgtttgcgaggaggaacagaggagacctcctatgaaacaggaaaacctggcggcagcgcaaaagatg

SEQ ID NO: 238691 - DNA, 103 bp, Artificial Sequence
  Synthetic Polynucleotide
taatacgactcactatagggtggctgtcccacaaggactacgttcctgttaacagaggagaaacaggatggtagtccttaacctggcggcagcgcaaaagatg

SEQ ID NO: 238692 - DNA, 103 bp, Artificial Sequence
  Synthetic Polynucleotide
taatacgactcactatagggatctgaccactggctgtcccacaaggactaaacagaggagatagtccatgtgggacagcaacctggcggcagcgcaaaagatg

SEQ ID NO: 238693 - DNA, 103 bp, Artificial Sequence
  Synthetic Polynucleotide
taatacgactcactataggggaggctgcacatctgaccactggctgtcccaacagaggagagggacaatgagtggtcagaacctggcggcagcgcaaaagatg

SEQ ID NO: 238694 - DNA, 103 bp, Artificial Sequence
  Synthetic Polynucleotide
taatacgactcactataggggttatctcctgaggctgcacatctgaccacaacagaggagagtggtcatgtgtgcagccaacctggcggcagcgcaaaagatg

SEQ ID NO: 238695 - DNA, 103 bp, Artificial Sequence
  Synthetic Polynucleotide
taatacgactcactatagggcaaatcctctgttatctcctgaggctgcacaacagaggagagtgcagatgcaggagataaacctggcggcagcgcaaaagatg

SEQ ID NO: 238696 - DNA, 103 bp, Artificial Sequence
  Synthetic Polynucleotide
taatacgactcactatagggagtgcatccggtttgctggcttgataccccaacagaggagaggggtaatgagccagcaaaacctggcggcagcgcaaaagatg

SEQ ID NO: 238697 - DNA, 103 bp, Artificial Sequence
  Synthetic Polynucleotide
taatacgactcactatagggctgtcctgtgcaaatcctctgttatctcctaacagaggagaaggagaatgcagaggattaacctggcggcagcgcaaaagatg

SEQ ID NO: 238698 - DNA, 103 bp, Artificial Sequence
  Synthetic Polynucleotide
taatacgactcactatagggcacaaggtttctgtcctgtgcaaatcctctaacagaggagaagaggaatggcacaggacaacctggcggcagcgcaaaagatg

SEQ ID NO: 238699 - DNA, 103 bp, Artificial Sequence
  Synthetic Polynucleotide
taatacgactcactatagggtcactgcattcacaaggtttctgtcctgtgaacagaggagacacaggatggaaaccttgaacctggcggcagcgcaaaagatg

SEQ ID NO: 238700 - DNA, 103 bp, Artificial Sequence
  Synthetic Polynucleotide
taatacgactcactatagggacaaccacattcactgcattcacaaggtttaacagaggagaaaacctatggaatgcagtaacctggcggcagcgcaaaagatg

SEQ ID NO: 238701 - DNA, 103 bp, Artificial Sequence
  Synthetic Polynucleotide
taatacgactcactatagggcacggaaggcacaaccacattcactgcattaacagaggagaaatgcaatgaatgtggttaacctggcggcagcgcaaaagatg

SEQ ID NO: 238702 - DNA, 103 bp, Artificial Sequence
  Synthetic Polynucleotide
taatacgactcactatagggcataattgatcacggaaggcacaaccacataacagaggagaatgtggatgtgccttccgaacctggcggcagcgcaaaagatg

SEQ ID NO: 238703 - DNA, 103 bp, Artificial Sequence
  Synthetic Polynucleotide
taatacgactcactatagggtaaaataagacataattgatcacggaaggcaacagaggagagccttcatggatcaattaaacctggcggcagcgcaaaagatg

SEQ ID NO: 238704 - DNA, 103 bp, Artificial Sequence
  Synthetic Polynucleotide
taatacgactcactatagggttctgtaacataaaataagacataattgataacagaggagaatcaatatggtcttatttaacctggcggcagcgcaaaagatg

SEQ ID NO: 238705 - DNA, 103 bp, Artificial Sequence
  Synthetic Polynucleotide
taatacgactcactatagggcaacttgaagagtgcatccggtttgctggcaacagaggagagccagcatgccggatgcaaacctggcggcagcgcaaaagatg

SEQ ID NO: 238706 - DNA, 103 bp, Artificial Sequence
  Synthetic Polynucleotide
taatacgactcactatagggctccttgttccaacttgaagagtgcatccgaacagaggagacggatgatgtcttcaagtaacctggcggcagcgcaaaagatg

SEQ ID NO: 238707 - DNA, 103 bp, Artificial Sequence
  Synthetic Polynucleotide
taatacgactcactatagggcacagttgttctccttgttccaacttgaagaacagaggagacttcaaatgggaacaaggaacctggcggcagcgcaaaagatg

SEQ ID NO: 238708 - DNA, 103 bp, Artificial Sequence
  Synthetic Polynucleotide
taatacgactcactatagggttcaattgtccacagttgttctccttgttcaacagaggagagaacaaatggaacaactgaacctggcggcagcgcaaaagatg

SEQ ID NO: 238709 - DNA, 103 bp, Artificial Sequence
  Synthetic Polynucleotide
taatacgactcactatagggccacatcctccagtgttatggattcctgggaacagaggagacccaggatgccataacacaacctggcggcagcgcaaaagatg

SEQ ID NO: 238710 - DNA, 103 bp, Artificial Sequence
  Synthetic Polynucleotide
taatacgactcactatagggggattccatcttcaattgtccacagttgttaacagaggagaaacaacatgggacaattgaacctggcggcagcgcaaaagatg

SEQ ID NO: 238711 - DNA, 103 bp, Artificial Sequence
  Synthetic Polynucleotide
taatacgactcactataggggctccactgtggattccatcttcaattgtcaacagaggagagacaatatgagatggaataacctggcggcagcgcaaaagatg

SEQ ID NO: 238712 - DNA, 103 bp, Artificial Sequence
  Synthetic Polynucleotide
taatacgactcactataggggtctgaacaggctccactgtggattccatcaacagaggagagatggaatgcacagtggaaacctggcggcagcgcaaaagatg

SEQ ID NO: 238713 - DNA, 103 bp, Artificial Sequence
  Synthetic Polynucleotide
taatacgactcactatagggctttccatatgtctgaacaggctccactgtaacagaggagaacagtgatgcctgttcagaacctggcggcagcgcaaaagatg

SEQ ID NO: 238714 - DNA, 103 bp, Artificial Sequence
  Synthetic Polynucleotide
taatacgactcactatagggacatgatcaactttccatatgtctgaacagaacagaggagactgttcatgcatatggaaaacctggcggcagcgcaaaagatg

SEQ ID NO: 238715 - DNA, 103 bp, Artificial Sequence
  Synthetic Polynucleotide
taatacgactcactataggggcgctccagcacatgatcaactttccatataacagaggagaatatggatggttgatcataacctggcggcagcgcaaaagatg

SEQ ID NO: 238716 - DNA, 103 bp, Artificial Sequence
  Synthetic Polynucleotide
taatacgactcactatagggcactctgcaagcgctccagcacatgatcaaaacagaggagattgatcatgtgctggagcaacctggcggcagcgcaaaagatg

SEQ ID NO: 238717 - DNA, 103 bp, Artificial Sequence
  Synthetic Polynucleotide
taatacgactcactatagggaccaggctttcactctgcaagcgctccagcaacagaggagagctggaatgcttgcagagaacctggcggcagcgcaaaagatg

SEQ ID NO: 238718 - DNA, 103 bp, Artificial Sequence
  Synthetic Polynucleotide
taatacgactcactatagggccttctgttcaccaggctttcactctgcaaaacagaggagattgcagatggaaagcctgaacctggcggcagcgcaaaagatg

SEQ ID NO: 238719 - DNA, 103 bp, Artificial Sequence
  Synthetic Polynucleotide
taatacgactcactataggggacatggtttccttctgttcaccaggctttaacagaggagaaaagccatgtgaacagaaaacctggcggcagcgcaaaagatg

SEQ ID NO: 238720 - DNA, 103 bp, Artificial Sequence
  Synthetic Polynucleotide
taatacgactcactatagggaagtccacagccacatcctccagtgttatgaacagaggagacataacatgggaggatgtaacctggcggcagcgcaaaagatg

SEQ ID NO: 238721 - DNA, 103 bp, Artificial Sequence
  Synthetic Polynucleotide
taatacgactcactatagggtcatgttcatgacatggtttccttctgttcaacagaggagagaacagatggaaaccatgaacctggcggcagcgcaaaagatg

SEQ ID NO: 238722 - DNA, 103 bp, Artificial Sequence
  Synthetic Polynucleotide
taatacgactcactatagggttcaaatgcatcatgttcatgacatggtttaacagaggagaaaaccaatgcatgaacataacctggcggcagcgcaaaagatg

SEQ ID NO: 238723 - DNA, 103 bp, Artificial Sequence
  Synthetic Polynucleotide
taatacgactcactataggggaacaatattttcaaatgcatcatgttcataacagaggagaatgaacatgatgcatttgaacctggcggcagcgcaaaagatg

SEQ ID NO: 238724 - DNA, 103 bp, Artificial Sequence
  Synthetic Polynucleotide
taatacgactcactatagggttgctgcaatgaacaatattttcaaatgcaaacagaggagatgcattatgaaatattgtaacctggcggcagcgcaaaagatg

SEQ ID NO: 238725 - DNA, 103 bp, Artificial Sequence
  Synthetic Polynucleotide
taatacgactcactatagggaaactgacttttgctgcaatgaacaatattaacagaggagaaatattatgcattgcagcaacctggcggcagcgcaaaagatg

SEQ ID NO: 238726 - DNA, 103 bp, Artificial Sequence
  Synthetic Polynucleotide
taatacgactcactataggggccctaacagaaactgacttttgctgcaataacagaggagaattgcaatgaaagtcagtaacctggcggcagcgcaaaagatg

SEQ ID NO: 238727 - DNA, 103 bp, Artificial Sequence
  Synthetic Polynucleotide
taatacgactcactatagggtcatgattttgccctaacagaaactgacttaacagaggagaaagtcaatgtctgttaggaacctggcggcagcgcaaaagatg

SEQ ID NO: 238728 - DNA, 103 bp, Artificial Sequence
  Synthetic Polynucleotide
taatacgactcactataggggtcaaatatatcatgattttgccctaacagaacagaggagactgttaatgcaaaatcataacctggcggcagcgcaaaagatg

SEQ ID NO: 238729 - DNA, 103 bp, Artificial Sequence
  Synthetic Polynucleotide
taatacgactcactatagggttccacgtaagtcaaatatatcatgattttaacagaggagaaaaatcatgatatatttgaacctggcggcagcgcaaaagatg

SEQ ID NO: 238730 - DNA, 103 bp, Artificial Sequence
  Synthetic Polynucleotide
taatacgactcactatagggttcaaactttttccacgtaagtcaaatataaacagaggagatatattatgcttacgtggaacctggcggcagcgcaaaagatg

SEQ ID NO: 238731 - DNA, 103 bp, Artificial Sequence
  Synthetic Polynucleotide
taatacgactcactatagggctcccaagtgaagtccacagccacatcctcaacagaggagagaggatatggctgtggacaacctggcggcagcgcaaaagatg

SEQ ID NO: 238732 - DNA, 103 bp, Artificial Sequence
  Synthetic Polynucleotide
taatacgactcactatagggtaaattggatttcaaactttttccacgtaaaacagaggagattacgtatgaaaagtttgaacctggcggcagcgcaaaagatg

SEQ ID NO: 238733 - DNA, 103 bp, Artificial Sequence
  Synthetic Polynucleotide
taatacgactcactatagggtaactaaagttaaattggatttcaaactttaacagaggagaaaagttatgaatccaattaacctggcggcagcgcaaaagatg

SEQ ID NO: 238734 - DNA, 103 bp, Artificial Sequence
  Synthetic Polynucleotide
taatacgactcactatagggttgctctggttaactaaagttaaattggataacagaggagaatccaaatgaactttagtaacctggcggcagcgcaaaagatg

SEQ ID NO: 238735 - DNA, 103 bp, Artificial Sequence
  Synthetic Polynucleotide
taatacgactcactatagggttcatagcctttgctctggttaactaaagtaacagaggagaactttaatgaaccagagcaacctggcggcagcgcaaaagatg

SEQ ID NO: 238736 - DNA, 103 bp, Artificial Sequence
  Synthetic Polynucleotide
taatacgactcactatagggagttctttatttcatagcctttgctctggtaacagaggagaaccagaatgaaggctatgaacctggcggcagcgcaaaagatg

SEQ ID NO: 238737 - DNA, 103 bp, Artificial Sequence
  Synthetic Polynucleotide
taatacgactcactatagggaactcaacagagttctttatttcatagcctaacagaggagaaggctaatgaataaagaaaacctggcggcagcgcaaaagatg

SEQ ID NO: 238738 - DNA, 103 bp, Artificial Sequence
  Synthetic Polynucleotide
taatacgactcactatagggatttccagtaaactcaacagagttctttataacagaggagaataaagatgtctgttgagaacctggcggcagcgcaaaagatg

SEQ ID NO: 238739 - DNA, 103 bp, Artificial Sequence
  Synthetic Polynucleotide
taatacgactcactatagggaggagtccccatttccagtaaactcaacagaacagaggagactgttgatgttactggaaaacctggcggcagcgcaaaagatg

SEQ ID NO: 238740 - DNA, 103 bp, Artificial Sequence
  Synthetic Polynucleotide
taatacgactcactataggggcatgaagaaaggagtccccatttccagtaaacagaggagatactggatgtggggactcaacctggcggcagcgcaaaagatg

SEQ ID NO: 238741 - DNA, 103 bp, Artificial Sequence
  Synthetic Polynucleotide
taatacgactcactatagggttcatggttagcatgaagaaaggagtccccaacagaggagaggggacatgtttcttcataacctggcggcagcgcaaaagatg

SEQ ID NO: 238742 - DNA, 103 bp, Artificial Sequence
  Synthetic Polynucleotide
taatacgactcactataggggttgccactcctcccaagtgaagtccacagaacagaggagactgtggatgtcacttgggaacctggcggcagcgcaaaagatg

SEQ ID NO: 238743 - DNA, 103 bp, Artificial Sequence
  Synthetic Polynucleotide
taatacgactcactatagggtatgaagtcgttcatggttagcatgaagaaaacagaggagattcttcatgctaaccatgaacctggcggcagcgcaaaagatg

SEQ ID NO: 238744 - DNA, 103 bp, Artificial Sequence
  Synthetic Polynucleotide
taatacgactcactatagggttaattgcagtatgaagtcgttcatggttaaacagaggagataaccaatgacgacttcaaacctggcggcagcgcaaaagatg

SEQ ID NO: 238745 - DNA, 103 bp, Artificial Sequence
  Synthetic Polynucleotide
taatacgactcactatagggtgcagggaatttaattgcagtatgaagtcgaacagaggagacgacttatgactgcaattaacctggcggcagcgcaaaagatg

SEQ ID NO: 238746 - DNA, 103 bp, Artificial Sequence
  Synthetic Polynucleotide
taatacgactcactataggggtttttgacttgcagggaatttaattgcagaacagaggagactgcaaatgaattccctgaacctggcggcagcgcaaaagatg

SEQ ID NO: 238747 - DNA, 103 bp, Artificial Sequence
  Synthetic Polynucleotide
taatacgactcactataggggtgctgatgagtttttgacttgcagggaataacagaggagaattcccatgaagtcaaaaaacctggcggcagcgcaaaagatg

SEQ ID NO: 238748 - DNA, 103 bp, Artificial Sequence
  Synthetic Polynucleotide
taatacgactcactatagggttgggacttagtgctgatgagtttttgactaacagaggagaagtcaaatgctcatcagcaacctggcggcagcgcaaaagatg

SEQ ID NO: 238749 - DNA, 103 bp, Artificial Sequence
  Synthetic Polynucleotide
taatacgactcactataggggactgatgaattgggacttagtgctgatgaaacagaggagatcatcaatgctaagtcccaacctggcggcagcgcaaaagatg

SEQ ID NO: 238750 - DNA, 103 bp, Artificial Sequence
  Synthetic Polynucleotide
taatacgactcactatagggtgatgcttgggactgatgaattgggacttaaacagaggagataagtcatgattcatcagaacctggcggcagcgcaaaagatg

SEQ ID NO: 238751 - DNA, 103 bp, Artificial Sequence
  Synthetic Polynucleotide
taatacgactcactatagggtcgtgttttctgatgcttgggactgatgaaaacagaggagattcatcatgcccaagcataacctggcggcagcgcaaaagatg

SEQ ID NO: 238752 - DNA, 103 bp, Artificial Sequence
  Synthetic Polynucleotide
taatacgactcactatagggtctctaattttcgtgttttctgatgcttggaacagaggagaccaagcatgagaaaacacaacctggcggcagcgcaaaagatg

SEQ ID NO: 238753 - DNA, 103 bp, Artificial Sequence
  Synthetic Polynucleotide
taatacgactcactataggggcgcccaggagttgccactcctcccaagtgaacagaggagacacttgatgggagtggcaaacctggcggcagcgcaaaagatg

SEQ ID NO: 238754 - DNA, 103 bp, Artificial Sequence
  Synthetic Polynucleotide
taatacgactcactatagggacatgatgcttctctaattttcgtgttttcaacagaggagagaaaacatgaaaattagaaacctggcggcagcgcaaaagatg

SEQ ID NO: 238755 - DNA, 103 bp, Artificial Sequence
  Synthetic Polynucleotide
taatacgactcactatagggttcactgcacacatgatgcttctctaatttaacagaggagaaaattaatgaagcatcataacctggcggcagcgcaaaagatg

SEQ ID NO: 238756 - DNA, 103 bp, Artificial Sequence
  Synthetic Polynucleotide
taatacgactcactatagggctttcccacattcactgcacacatgatgctaacagaggagaagcatcatgtgtgcagtgaacctggcggcagcgcaaaagatg

SEQ ID NO: 238757 - DNA, 103 bp, Artificial Sequence
  Synthetic Polynucleotide
taatacgactcactatagggttgatgaaggctttcccacattcactgcacaacagaggagagtgcagatgatgtgggaaaacctggcggcagcgcaaaagatg

SEQ ID NO: 238758 - DNA, 103 bp, Artificial Sequence
  Synthetic Polynucleotide
taatacgactcactatagggccaagacttcttgatgaaggctttcccacaaacagaggagatgtgggatggccttcatcaacctggcggcagcgcaaaagatg

SEQ ID NO: 238759 - DNA, 103 bp, Artificial Sequence
  Synthetic Polynucleotide
taatacgactcactataggggatcagttagccaagacttcttgatgaaggaacagaggagaccttcaatgagaagtcttaacctggcggcagcgcaaaagatg

SEQ ID NO: 238760 - DNA, 103 bp, Artificial Sequence
  Synthetic Polynucleotide
taatacgactcactatagggattacctggtgatcagttagccaagacttcaacagaggagagaagtcatggctaactgaaacctggcggcagcgcaaaagatg

SEQ ID NO: 238761 - DNA, 103 bp, Artificial Sequence
  Synthetic Polynucleotide
taatacgactcactatagggtcctgtatgcattacctggtgatcagttagaacagaggagactaactatgcaccaggtaaacctggcggcagcgcaaaagatg

SEQ ID NO: 238762 - DNA, 103 bp, Artificial Sequence
  Synthetic Polynucleotide
taatacgactcactatagggggggtttctctcctgtatgcattacctggtaacagaggagaaccaggatgtgcatacagaacctggcggcagcgcaaaagatg

SEQ ID NO: 238763 - DNA, 103 bp, Artificial Sequence
  Synthetic Polynucleotide
taatacgactcactatagggctacatctgtggggtttctctcctgtatgcaacagaggagagcatacatgagagaaaccaacctggcggcagcgcaaaagatg

SEQ ID NO: 238764 - DNA, 103 bp, Artificial Sequence
  Synthetic Polynucleotide
taatacgactcactatagggcttctgagcagcgcccaggagttgccactcaacagaggagagagtggatgctcctgggcaacctggcggcagcgcaaaagatg

SEQ ID NO: 238765 - DNA, 103 bp, Artificial Sequence
  Synthetic Polynucleotide
taatacgactcactatagggctcacatagactacatctgtggggtttctcaacagaggagagagaaaatgcacagatgtaacctggcggcagcgcaaaagatg

SEQ ID NO: 238766 - DNA, 103 bp, Artificial Sequence
  Synthetic Polynucleotide
taatacgactcactatagggagaaggctttctcacatagactacatctgtaacagaggagaacagatatggtctatgtgaacctggcggcagcgcaaaagatg

SEQ ID NO: 238767 - DNA, 103 bp, Artificial Sequence
  Synthetic Polynucleotide
taatacgactcactatagggaactttctggagaaggctttctcacatagaaacagaggagatctatgatggaaagccttaacctggcggcagcgcaaaagatg

SEQ ID NO: 238768 - DNA, 103 bp, Artificial Sequence
  Synthetic Polynucleotide
taatacgactcactatagggagtaagcatgaactttctggagaaggctttaacagaggagaaaagccatgtccagaaagaacctggcggcagcgcaaaagatg

SEQ ID NO: 238769 - DNA, 103 bp, Artificial Sequence
  Synthetic Polynucleotide
taatacgactcactataggggctgatgttcagtaagcatgaactttctggaacagaggagaccagaaatgtcatgcttaaacctggcggcagcgcaaaagatg

SEQ ID NO: 238770 - DNA, 103 bp, Artificial Sequence
  Synthetic Polynucleotide
taatacgactcactataggggtatgagttcgctgatgttcagtaagcatgaacagaggagacatgctatgtgaacatcaaacctggcggcagcgcaaaagatg

SEQ ID NO: 238771 - DNA, 103 bp, Artificial Sequence
  Synthetic Polynucleotide
taatacgactcactatagggtttttctcctgtatgagttcgctgatgttcaacagaggagagaacatatgcgaactcataacctggcggcagcgcaaaagatg

SEQ ID NO: 238772 - DNA, 103 bp, Artificial Sequence
  Synthetic Polynucleotide
taatacgactcactatagggattcataaggtttttctcctgtatgagttcaacagaggagagaactcatgcaggagaaaaacctggcggcagcgcaaaagatg

SEQ ID NO: 238773 - DNA, 103 bp, Artificial Sequence
  Synthetic Polynucleotide
taatacgactcactatagggcattcagggcattcataaggtttttctcctaacagaggagaaggagaatgaccttatgaaacctggcggcagcgcaaaagatg

SEQ ID NO: 238774 - DNA, 103 bp, Artificial Sequence
  Synthetic Polynucleotide
taatacgactcactatagggggctttgccacattcagggcattcataaggaacagaggagaccttatatgtgccctgaaaacctggcggcagcgcaaaagatg

SEQ ID NO: 238775 - DNA, 103 bp, Artificial Sequence
  Synthetic Polynucleotide
taatacgactcactatagggggtacaggtccttctgagcagcgcccaggaaacagaggagatcctggatgctgctcagaaacctggcggcagcgcaaaagatg

SEQ ID NO: 238776 - DNA, 103 bp, Artificial Sequence
  Synthetic Polynucleotide
taatacgactcactatagggtcttgagaaaggctttgccacattcagggcaacagaggagagccctgatggtggcaaagaacctggcggcagcgcaaaagatg

SEQ ID NO: 238777 - DNA, 103 bp, Artificial Sequence
  Synthetic Polynucleotide
taatacgactcactatagggagccgtgatttcttgagaaaggctttgccaaacagaggagatggcaaatgctttctcaaaacctggcggcagcgcaaaagatg

SEQ ID NO: 238778 - DNA, 103 bp, Artificial Sequence
  Synthetic Polynucleotide
taatacgactcactatagggatgtatgttgagccgtgatttcttgagaaaaacagaggagatttctcatgaaatcacggaacctggcggcagcgcaaaagatg

SEQ ID NO: 238779 - DNA, 103 bp, Artificial Sequence
  Synthetic Polynucleotide
taatacgactcactataggggtgttttctgatgtatgttgagccgtgattaacagaggagaaatcacatgtcaacatacaacctggcggcagcgcaaaagatg

SEQ ID NO: 238780 - DNA, 103 bp, Artificial Sequence
  Synthetic Polynucleotide
taatacgactcactatagggtctccggtatgtgttttctgatgtatgttgaacagaggagacaacatatgtcagaaaacaacctggcggcagcgcaaaagatg

SEQ ID NO: 238781 - DNA, 103 bp, Artificial Sequence
  Synthetic Polynucleotide
taatacgactcactatagggatagggtttctctccggtatgtgttttctgaacagaggagacagaaaatgcataccggaaacctggcggcagcgcaaaagatg

SEQ ID NO: 238782 - DNA, 103 bp, Artificial Sequence
  Synthetic Polynucleotide
taatacgactcactatagggcactgcatatatagggtttctctccggtataacagaggagaataccgatgagaaaccctaacctggcggcagcgcaaaagatg

SEQ ID NO: 238783 - DNA, 103 bp, Artificial Sequence
  Synthetic Polynucleotide
taatacgactcactatagggtttccacattcactgcatatatagggtttcaacagaggagagaaaccatgtatatgcagaacctggcggcagcgcaaaagatg

SEQ ID NO: 238784 - DNA, 103 bp, Artificial Sequence
  Synthetic Polynucleotide
taatacgactcactataggggatgaagccttttccacattcactgcatataacagaggagaatatgcatggaatgtggaaacctggcggcagcgcaaaagatg

SEQ ID NO: 238785 - DNA, 103 bp, Artificial Sequence
  Synthetic Polynucleotide
taatacgactcactatagggttcctttctggatgaagccttttccacattaacagaggagaaatgtgatgaaggcttcaaacctggcggcagcgcaaaagatg

SEQ ID NO: 238786 - DNA, 103 bp, Artificial Sequence
  Synthetic Polynucleotide
taatacgactcactatagggatcacatcccggtacaggtccttctgagcaaacagaggagatgctcaatgggacctgtaaacctggcggcagcgcaaaagatg

SEQ ID NO: 238787 - DNA, 103 bp, Artificial Sequence
  Synthetic Polynucleotide
taatacgactcactatagggacaatgagatttcctttctggatgaagcctaacagaggagaaggcttatgccagaaaggaacctggcggcagcgcaaaagatg

SEQ ID NO: 238788 - DNA, 103 bp, Artificial Sequence
  Synthetic Polynucleotide
taatacgactcactatagggtcgctggtgtacaatgagatttcctttctgaacagaggagacagaaaatgaatctcattaacctggcggcagcgcaaaagatg

SEQ ID NO: 238789 - DNA, 103 bp, Artificial Sequence
  Synthetic Polynucleotide
taatacgactcactatagggctgtatgaattcgctggtgtacaatgagataacagaggagaatctcaatgtacaccagcaacctggcggcagcgcaaaagatg

SEQ ID NO: 238790 - DNA, 103 bp, Artificial Sequence
  Synthetic Polynucleotide
taatacgactcactatagggggtttctcacctgtatgaattcgctggtgtaacagaggagaacaccaatgaattcatacaacctggcggcagcgcaaaagatg

SEQ ID NO: 238791 - DNA, 103 bp, Artificial Sequence
  Synthetic Polynucleotide
taatacgactcactataggggcatatataaggtttctcacctgtatgaataacagaggagaattcatatgggtgagaaaaacctggcggcagcgcaaaagatg

SEQ ID NO: 238792 - DNA, 103 bp, Artificial Sequence
  Synthetic Polynucleotide
taatacgactcactatagggcacattcattgcatatataaggtttctcacaacagaggagagtgagaatgcttatatataacctggcggcagcgcaaaagatg

SEQ ID NO: 238793 - DNA, 103 bp, Artificial Sequence
  Synthetic Polynucleotide
taatacgactcactatagggaagccttttccacattcattgcatatataaaacagaggagattatatatgcaatgaatgaacctggcggcagcgcaaaagatg

SEQ ID NO: 238794 - DNA, 103 bp, Artificial Sequence
  Synthetic Polynucleotide
taatacgactcactatagggcttctgaatgaagccttttccacattcattaacagaggagaaatgaaatgggaaaaggcaacctggcggcagcgcaaaagatg

SEQ ID NO: 238795 - DNA, 103 bp, Artificial Sequence
  Synthetic Polynucleotide
taatacgactcactatagggtgagacacgtcttctgaatgaagccttttcaacagaggagagaaaagatgtcattcagaaacctggcggcagcgcaaaagatg

SEQ ID NO: 238796 - DNA, 103 bp, Artificial Sequence
  Synthetic Polynucleotide
taatacgactcactatagggtgatgtgctatgagacacgtcttctgaatgaacagaggagacattcaatggacgtgtctaacctggcggcagcgcaaaagatg

SEQ ID NO: 238797 - DNA, 103 bp, Artificial Sequence
  Synthetic Polynucleotide
taatacgactcactatagggtccaaggcgtcgggacaggacactcgccataacagaggagaatggcgatggtcctgtccaacctggcggcagcgcaaaagatg

SEQ ID NO: 238798 - DNA, 103 bp, Artificial Sequence
  Synthetic Polynucleotide
taatacgactcactatagggcccttctagcagtggctccgagggtggggcaacagaggagagccccaatgtcggagccaaacctggcggcagcgcaaaagatg

SEQ ID NO: 238799 - DNA, 103 bp, Artificial Sequence
  Synthetic Polynucleotide
taatacgactcactatagggggcagcagcagcagcagcagcagcagattcaacagaggagagaatctatggctgctgctaacctggcggcagcgcaaaagatg

SEQ ID NO: 238800 - DNA, 103 bp, Artificial Sequence
  Synthetic Polynucleotide
taatacgactcactataggggggtgcctgcggcagcagcagcagcagcagaacagaggagactgctgatgctgctgctgaacctggcggcagcgcaaaagatg

SEQ ID NO: 238801 - DNA, 103 bp, Artificial Sequence
  Synthetic Polynucleotide
taatacgactcactatagggccagggactggggtgcctgcggcagcagcaaacagaggagatgctgcatgcgcaggcacaacctggcggcagcgcaaaagatg

SEQ ID NO: 238802 - DNA, 103 bp, Artificial Sequence
  Synthetic Polynucleotide
taatacgactcactatagggggtgggagtcccagggactggggtgcctgcaacagaggagagcaggcatgccagtccctaacctggcggcagcgcaaaagatg

SEQ ID NO: 238803 - DNA, 103 bp, Artificial Sequence
  Synthetic Polynucleotide
taatacgactcactatagggctggctcggaggtgggagtcccagggactgaacagaggagacagtccatgggactcccaaacctggcggcagcgcaaaagatg

SEQ ID NO: 238804 - DNA, 103 bp, Artificial Sequence
  Synthetic Polynucleotide
taatacgactcactatagggggggtgggagctggctcggaggtgggagtcaacagaggagagactccatgctccgagccaacctggcggcagcgcaaaagatg

SEQ ID NO: 238805 - DNA, 103 bp, Artificial Sequence
  Synthetic Polynucleotide
taatacgactcactatagggagtcatgctgggggtgggagctggctcggaaacagaggagatccgagatggctcccaccaacctggcggcagcgcaaaagatg

SEQ ID NO: 238806 - DNA, 103 bp, Artificial Sequence
  Synthetic Polynucleotide
taatacgactcactataggggaggcaggccagtcatgctgggggtgggagaacagaggagactcccaatgccagcatgaaacctggcggcagcgcaaaagatg

SEQ ID NO: 238807 - DNA, 103 bp, Artificial Sequence
  Synthetic Polynucleotide
taatacgactcactatagggagagcagacagaggcaggccagtcatgctgaacagaggagacagcatatgtggcctgccaacctggcggcagcgcaaaagatg

SEQ ID NO: 238808 - DNA, 103 bp, Artificial Sequence
  Synthetic Polynucleotide
taatacgactcactatagggaggtggtggaagagcagacagaggcaggccaacagaggagaggcctgatgctgtctgctaacctggcggcagcgcaaaagatg

SEQ ID NO: 238809 - DNA, 103 bp, Artificial Sequence
  Synthetic Polynucleotide
taatacgactcactatagggggggagcggccccttctagcagtggctccgaacagaggagacggagcatgtgctagaagaacctggcggcagcgcaaaagatg

SEQ ID NO: 238810 - DNA, 103 bp, Artificial Sequence
  Synthetic Polynucleotide
taatacgactcactatagggctttgtgcagaggtggtggaagagcagacaaacagaggagatgtctgatgttccaccacaacctggcggcagcgcaaaagatg

SEQ ID NO: 238811 - DNA, 103 bp, Artificial Sequence
  Synthetic Polynucleotide
taatacgactcactataggggaggactgggctttgtgcagaggtggtggaaacagaggagatccaccatgtctgcacaaaacctggcggcagcgcaaaagatg

SEQ ID NO: 238812 - DNA, 103 bp, Artificial Sequence
  Synthetic Polynucleotide
taatacgactcactatagggttctgggccggaggactgggctttgtgcagaacagaggagactgcacatggcccagtccaacctggcggcagcgcaaaagatg

SEQ ID NO: 238813 - DNA, 103 bp, Artificial Sequence
  Synthetic Polynucleotide
taatacgactcactatagggggccaggatgttctgggccggaggactgggaacagaggagacccagtatgccggcccagaacctggcggcagcgcaaaagatg

SEQ ID NO: 238814 - DNA, 103 bp, Artificial Sequence
  Synthetic Polynucleotide
taatacgactcactataggggaggactccgggccaggatgttctgggccgaacagaggagacggcccatgacatcctggaacctggcggcagcgcaaaagatg

SEQ ID NO: 238815 - DNA, 103 bp, Artificial Sequence
  Synthetic Polynucleotide
taatacgactcactatagggtgagggcagggaggactccgggccaggatgaacagaggagacatcctatgccggagtccaacctggcggcagcgcaaaagatg

SEQ ID NO: 238816 - DNA, 103 bp, Artificial Sequence
  Synthetic Polynucleotide
taatacgactcactatagggtgagagcccctgagggcagggaggactccgaacagaggagacggagtatgccctgccctaacctggcggcagcgcaaaagatg

SEQ ID NO: 238817 - DNA, 103 bp, Artificial Sequence
  Synthetic Polynucleotide
taatacgactcactataggggctgacttgctgagagcccctgagggcaggaacagaggagacctgccatgaggggctctaacctggcggcagcgcaaaagatg

SEQ ID NO: 238818 - DNA, 103 bp, Artificial Sequence
  Synthetic Polynucleotide
taatacgactcactatagggggacccaggagctgacttgctgagagccccaacagaggagaggggctatgagcaagtcaaacctggcggcagcgcaaaagatg

SEQ ID NO: 238819 - DNA, 103 bp, Artificial Sequence
  Synthetic Polynucleotide
taatacgactcactatagggtgtgccagaaggacccaggagctgacttgcaacagaggagagcaagtatgctcctgggtaacctggcggcagcgcaaaagatg

SEQ ID NO: 238820 - DNA, 103 bp, Artificial Sequence
  Synthetic Polynucleotide
taatacgactcactataggggtgaaaggctggggagcggccccttctagcaacagaggagagctagaatgggccgctccaacctggcggcagcgcaaaagatg

SEQ ID NO: 238821 - DNA, 103 bp, Artificial Sequence
  Synthetic Polynucleotide
taatacgactcactatagggtctgcctgaatgtgccagaaggacccaggaaacagaggagatcctggatgcttctggcaaacctggcggcagcgcaaaagatg

SEQ ID NO: 238822 - DNA, 103 bp, Artificial Sequence
  Synthetic Polynucleotide
taatacgactcactataggggtatgcatgatctgcctgaatgtgccagaaaacagaggagattctggatgattcaggcaaacctggcggcagcgcaaaagatg

SEQ ID NO: 238823 - DNA, 103 bp, Artificial Sequence
  Synthetic Polynucleotide
taatacgactcactataggggcagagcctggtatgcatgatctgcctgaaaacagaggagattcaggatgatcatgcataacctggcggcagcgcaaaagatg

SEQ ID NO: 238824 - DNA, 103 bp, Artificial Sequence
  Synthetic Polynucleotide
taatacgactcactatagggtggaaggatggcagagcctggtatgcatgaaacagaggagatcatgcatgccaggctctaacctggcggcagcgcaaaagatg

SEQ ID NO: 238825 - DNA, 103 bp, Artificial Sequence
  Synthetic Polynucleotide
taatacgactcactataggggactgggatctggaaggatggcagagcctgaacagaggagacaggctatgccatccttcaacctggcggcagcgcaaaagatg

SEQ ID NO: 238826 - DNA, 103 bp, Artificial Sequence
  Synthetic Polynucleotide
taatacgactcactatagggtgtgtggtgagactgggatctggaaggatgaacagaggagacatcctatgagatcccagaacctggcggcagcgcaaaagatg

SEQ ID NO: 238827 - DNA, 103 bp, Artificial Sequence
  Synthetic Polynucleotide
taatacgactcactatagggctggtgtagatgtgtggtgagactgggatcaacagaggagagatcccatgctcaccacaaacctggcggcagcgcaaaagatg

SEQ ID NO: 238828 - DNA, 103 bp, Artificial Sequence
  Synthetic Polynucleotide
taatacgactcactatagggccagctgacactggtgtagatgtgtggtgaaacagaggagatcaccaatgatctacaccaacctggcggcagcgcaaaagatg

SEQ ID NO: 238829 - DNA, 103 bp, Artificial Sequence
  Synthetic Polynucleotide
taatacgactcactataggggggcagcagcccagctgacactggtgtagaaacagaggagatctacaatggtgtcagctaacctggcggcagcgcaaaagatg

SEQ ID NO: 238830 - DNA, 103 bp, Artificial Sequence
  Synthetic Polynucleotide
taatacgactcactataggggcggcggagggggcagcagcccagctgacaaacagaggagatgtcagatgggctgctgcaacctggcggcagcgcaaaagatg

SEQ ID NO: 238831 - DNA, 103 bp, Artificial Sequence
  Synthetic Polynucleotide
taatacgactcactatagggatcagaggtggtgaaaggctggggagcggcaacagaggagagccgctatgcagcctttcaacctggcggcagcgcaaaagatg

SEQ ID NO: 238832 - DNA, 103 bp, Artificial Sequence
  Synthetic Polynucleotide
taatacgactcactataggggagagagcaggcggcggagggggcagcagcaacagaggagagctgctatgccctccgccaacctggcggcagcgcaaaagatg

SEQ ID NO: 238833 - DNA, 103 bp, Artificial Sequence
  Synthetic Polynucleotide
taatacgactcactatagggggaccggagagagagagcaggcggcggaggaacagaggagacctccgatgcctgctctcaacctggcggcagcgcaaaagatg

SEQ ID NO: 238834 - DNA, 103 bp, Artificial Sequence
  Synthetic Polynucleotide
taatacgactcactataggggaccggctccggaccggagagagagagcagaacagaggagactgctcatgctctccggtaacctggcggcagcgcaaaagatg

SEQ ID NO: 238835 - DNA, 103 bp, Artificial Sequence
  Synthetic Polynucleotide
taatacgactcactataggggaagcttagcgaccggctccggaccggagaaacagaggagatctccgatgcggagccggaacctggcggcagcgcaaaagatg

SEQ ID NO: 238836 - DNA, 103 bp, Artificial Sequence
  Synthetic Polynucleotide
taatacgactcactatagggggggctcgctgaagcttagcgaccggctccaacagaggagaggagccatgcgctaagctaacctggcggcagcgcaaaagatg

SEQ ID NO: 238837 - DNA, 103 bp, Artificial Sequence
  Synthetic Polynucleotide
taatacgactcactataggggctggctgctggggctcgctgaagcttagcaacagaggagagctaagatgcagcgagccaacctggcggcagcgcaaaagatg

SEQ ID NO: 238838 - DNA, 103 bp, Artificial Sequence
  Synthetic Polynucleotide
taatacgactcactatagggcatcgcaggtgctggctgctggggctcgctaacagaggagaagcgagatgcagcagccaaacctggcggcagcgcaaaagatg

SEQ ID NO: 238839 - DNA, 103 bp, Artificial Sequence
  Synthetic Polynucleotide
taatacgactcactataggggatgagatttcatcgcaggtgctggctgctaacagaggagaagcagcatgcacctgcgaaacctggcggcagcgcaaaagatg

SEQ ID NO: 238840 - DNA, 103 bp, Artificial Sequence
  Synthetic Polynucleotide
taatacgactcactataggggtgacgatcagatgagatttcatcgcaggtaacagaggagaacctgcatggaaatctcaaacctggcggcagcgcaaaagatg

SEQ ID NO: 238841 - DNA, 103 bp, Artificial Sequence
  Synthetic Polynucleotide
taatacgactcactataggggggtggagaagtgacgatcagatgagatttaacagaggagaaaatctatgctgatcgtcaacctggcggcagcgcaaaagatg

SEQ ID NO: 238842 - DNA, 103 bp, Artificial Sequence
  Synthetic Polynucleotide
taatacgactcactatagggagggggtgtcatcagaggtggtgaaaggctaacagaggagaagccttatgccacctctgaacctggcggcagcgcaaaagatg

SEQ ID NO: 238843 - DNA, 103 bp, Artificial Sequence
  Synthetic Polynucleotide
taatacgactcactatagggtctgggcccggggtggagaagtgacgatcaaacagaggagatgatcgatgcttctccacaacctggcggcagcgcaaaagatg

SEQ ID NO: 238844 - DNA, 103 bp, Artificial Sequence
  Synthetic Polynucleotide
taatacgactcactatagggctggcaccactctgggcccggggtggagaaaacagaggagattctccatgccgggcccaaacctggcggcagcgcaaaagatg

SEQ ID NO: 238845 - DNA, 103 bp, Artificial Sequence
  Synthetic Polynucleotide
taatacgactcactatagggtcgggctttcctggcaccactctgggcccgaacagaggagacgggccatgagtggtgccaacctggcggcagcgcaaaagatg

SEQ ID NO: 238846 - DNA, 103 bp, Artificial Sequence
  Synthetic Polynucleotide
taatacgactcactatagggtagcctcccctcgggctttcctggcaccacaacagaggagagtggtgatgggaaagcccaacctggcggcagcgcaaaagatg

SEQ ID NO: 238847 - DNA, 103 bp, Artificial Sequence
  Synthetic Polynucleotide
taatacgactcactatagggcggcacttcttagcctcccctcgggctttcaacagaggagagaaagcatgaggggaggcaacctggcggcagcgcaaaagatg

SEQ ID NO: 238848 - DNA, 103 bp, Artificial Sequence
  Synthetic Polynucleotide
taatacgactcactatagggatacaccttgcggcacttcttagcctccccaacagaggagaggggagatgaagaagtgcaacctggcggcagcgcaaaagatg

SEQ ID NO: 238849 - DNA, 103 bp, Artificial Sequence
  Synthetic Polynucleotide
taatacgactcactataggggctcgatgccatacaccttgcggcacttctaacagaggagaagaagtatggcaaggtgtaacctggcggcagcgcaaaagatg

SEQ ID NO: 238850 - DNA, 103 bp, Artificial Sequence
  Synthetic Polynucleotide
taatacgactcactatagggtggtcccggtgctcgatgccatacaccttgaacagaggagacaaggtatgtggcatcgaaacctggcggcagcgcaaaagatg

SEQ ID NO: 238851 - DNA, 103 bp, Artificial Sequence
  Synthetic Polynucleotide
taatacgactcactatagggcgtgcaccactggtcccggtgctcgatgccaacagaggagaggcatcatgcaccgggacaacctggcggcagcgcaaaagatg

SEQ ID NO: 238852 - DNA, 103 bp, Artificial Sequence
  Synthetic Polynucleotide
taatacgactcactatagggaccggcaggccgtgcaccactggtcccggtaacagaggagaaccgggatgagtggtgcaaacctggcggcagcgcaaaagatg

SEQ ID NO: 238853 - DNA, 103 bp, Artificial Sequence
  Synthetic Polynucleotide
taatacgactcactatagggtgctcctggcagggggtgtcatcagaggtgaacagaggagacacctcatgtgacaccccaacctggcggcagcgcaaaagatg

SEQ ID NO: 238854 - DNA, 103 bp, Artificial Sequence
  Synthetic Polynucleotide
taatacgactcactataggggccttcttccaccggcaggccgtgcaccacaacagaggagagtggtgatgggcctgccgaacctggcggcagcgcaaaagatg

SEQ ID NO: 238855 - DNA, 103 bp, Artificial Sequence
  Synthetic Polynucleotide
taatacgactcactataggggcgctggcaggccttcttccaccggcaggcaacagaggagagcctgcatgtggaagaagaacctggcggcagcgcaaaagatg

SEQ ID NO: 238856 - DNA, 103 bp, Artificial Sequence
  Synthetic Polynucleotide
taatacgactcactatagggagtccagaaagcgctggcaggccttcttccaacagaggagaggaagaatgcctgccagcaacctggcggcagcgcaaaagatg

SEQ ID NO: 238857 - DNA, 103 bp, Artificial Sequence
  Synthetic Polynucleotide
taatacgactcactatagggttccttgggctgctcctggcagggggtgtcaacagaggagagacaccatgtgccaggagaacctggcggcagcgcaaaagatg

SEQ ID NO: 238858 - DNA, 103 bp, Artificial Sequence
  Synthetic Polynucleotide
taatacgactcactatagggccttaaggacttccttgggctgctcctggcaacagaggagagccaggatgagcccaaggaacctggcggcagcgcaaaagatg

SEQ ID NO: 238859 - DNA, 103 bp, Artificial Sequence
  Synthetic Polynucleotide
taatacgactcactataggggtgctgggagccttaaggacttccttgggcaacagaggagagcccaaatgagtccttaaaacctggcggcagcgcaaaagatg

SEQ ID NO: 238860 - DNA, 103 bp, Artificial Sequence
  Synthetic Polynucleotide
taatacgactcactatagggaaggcccgaggtgctgggagccttaaggacaacagaggagagtccttatggctcccagcaacctggcggcagcgcaaaagatg

SEQ ID NO: 238861 - DNA, 103 bp, Artificial Sequence
  Synthetic Polynucleotide
taatacgactcactataggggggaccgctttccaaggcgtcgggacaggaaacagaggagatcctgtatggacgccttgaacctggcggcagcgcaaaagatg

SEQ ID NO: 238862 - DNA, 103 bp, Artificial Sequence
  Synthetic Polynucleotide
taatacgactcactatagggccacctgctgaaggcccgaggtgctgggagaacagaggagactcccaatgcctcgggccaacctggcggcagcgcaaaagatg

SEQ ID NO: 238863 - DNA, 103 bp, Artificial Sequence
  Synthetic Polynucleotide
taatacgactcactatagggggctgaaaggccacctgctgaaggcccgagaacagaggagactcgggatgtcagcaggtaacctggcggcagcgcaaaagatg

SEQ ID NO: 238864 - DNA, 103 bp, Artificial Sequence
  Synthetic Polynucleotide
taatacgactcactatagggcttctgcccaggctgaaaggccacctgctgaacagaggagacagcagatggcctttcagaacctggcggcagcgcaaaagatg

SEQ ID NO: 238865 - DNA, 103 bp, Artificial Sequence
  Synthetic Polynucleotide
taatacgactcactatagggacacataaaccttctgcccaggctgaaaggaacagaggagacctttcatgctgggcagaaacctggcggcagcgcaaaagatg

SEQ ID NO: 238866 - DNA, 103 bp, Artificial Sequence
  Synthetic Polynucleotide
taatacgactcactatagggcccccgtaccacacataaaccttctgcccaaacagaggagatgggcaatgggtttatgtaacctggcggcagcgcaaaagatg

SEQ ID NO: 238867 - DNA, 103 bp, Artificial Sequence
  Synthetic Polynucleotide
taatacgactcactataggggcactcttgacccccgtaccacacataaacaacagaggagagtttatatgtggtacgggaacctggcggcagcgcaaaagatg

SEQ ID NO: 238868 - DNA, 103 bp, Artificial Sequence
  Synthetic Polynucleotide
taatacgactcactatagggccagtcctgtgcactcttgacccccgtaccaacagaggagaggtacgatggtcaagagtaacctggcggcagcgcaaaagatg

SEQ ID NO: 238869 - DNA, 103 bp, Artificial Sequence
  Synthetic Polynucleotide
taatacgactcactatagggtgctgctccaccagtcctgtgcactcttgaaacagaggagatcaagaatgcacaggactaacctggcggcagcgcaaaagatg

SEQ ID NO: 238870 - DNA, 103 bp, Artificial Sequence
  Synthetic Polynucleotide
taatacgactcactatagggcatccagctgtgctgctccaccagtcctgtaacagaggagaacaggaatggtggagcagaacctggcggcagcgcaaaagatg

SEQ ID NO: 238871 - DNA, 103 bp, Artificial Sequence
  Synthetic Polynucleotide
taatacgactcactatagggcctgaccctccatccagctgtgctgctccaaacagaggagatggagcatgacagctggaaacctggcggcagcgcaaaagatg

SEQ ID NO: 238872 - DNA, 103 bp, Artificial Sequence
  Synthetic Polynucleotide
taatacgactcactataggggctcccaggagggaccgctttccaaggcgtaacagaggagaacgcctatgaaagcggtcaacctggcggcagcgcaaaagatg

SEQ ID NO: 238873 - DNA, 103 bp, Artificial Sequence
  Synthetic Polynucleotide
taatacgactcactatagggcagacggtcacctgaccctccatccagctgaacagaggagacagctgatgggagggtcaaacctggcggcagcgcaaaagatg

SEQ ID NO: 238874 - DNA, 103 bp, Artificial Sequence
  Synthetic Polynucleotide
taatacgactcactatagggctccagcagccagacggtcacctgaccctcaacagaggagagagggtatggtgaccgtcaacctggcggcagcgcaaaagatg

SEQ ID NO: 238875 - DNA, 103 bp, Artificial Sequence
  Synthetic Polynucleotide
taatacgactcactataggggcagcttctgctccagcagccagacggtcaaacagaggagatgaccgatgggctgctggaacctggcggcagcgcaaaagatg

SEQ ID NO: 238876 - DNA, 103 bp, Artificial Sequence
  Synthetic Polynucleotide
taatacgactcactatagggcagcagacctgcagcttctgctccagcagcaacagaggagagctgctatggcagaagctaacctggcggcagcgcaaaagatg

SEQ ID NO: 238877 - DNA, 103 bp, Artificial Sequence
  Synthetic Polynucleotide
taatacgactcactatagggctccaccctgcagcagacctgcagcttctgaacagaggagacagaagatgcaggtctgcaacctggcggcagcgcaaaagatg

SEQ ID NO: 238878 - DNA, 103 bp, Artificial Sequence
  Synthetic Polynucleotide
taatacgactcactataggggccacacctcctccaccctgcagcagacctaacagaggagaaggtctatggcagggtggaacctggcggcagcgcaaaagatg

SEQ ID NO: 238879 - DNA, 103 bp, Artificial Sequence
  Synthetic Polynucleotide
taatacgactcactatagggagctctgccagccacacctcctccaccctgaacagaggagacagggtatgggaggtgtgaacctggcggcagcgcaaaagatg

SEQ ID NO: 238880 - DNA, 103 bp, Artificial Sequence
  Synthetic Polynucleotide
taatacgactcactatagggggggccctgcagctctgccagccacacctcaacagaggagagaggtgatgctggcagagaacctggcggcagcgcaaaagatg

SEQ ID NO: 238881 - DNA, 103 bp, Artificial Sequence
  Synthetic Polynucleotide
taatacgactcactatagggcctggggacaggggccctgcagctctgccaaacagaggagatggcagatgtgcagggccaacctggcggcagcgcaaaagatg

SEQ ID NO: 238882 - DNA, 103 bp, Artificial Sequence
  Synthetic Polynucleotide
taatacgactcactatagggaggggtggtgcctggggacaggggccctgcaacagaggagagcagggatgctgtccccaaacctggcggcagcgcaaaagatg

SEQ ID NO: 238883 - DNA, 103 bp, Artificial Sequence
  Synthetic Polynucleotide
taatacgactcactatagggcaacacccgggctcccaggagggaccgcttaacagaggagaaagcggatgctcctgggaaacctggcggcagcgcaaaagatg

SEQ ID NO: 238884 - DNA, 103 bp, Artificial Sequence
  Synthetic Polynucleotide
taatacgactcactatagggtccgggctccaggggtggtgcctggggacaaacagaggagatgtcccatggcaccacccaacctggcggcagcgcaaaagatg

SEQ ID NO: 238885 - DNA, 103 bp, Artificial Sequence
  Synthetic Polynucleotide
taatacgactcactataggggggcctgggctccgggctccaggggtggtgaacagaggagacaccacatgtggagcccgaacctggcggcagcgcaaaagatg

SEQ ID NO: 238886 - DNA, 103 bp, Artificial Sequence
  Synthetic Polynucleotide
taatacgactcactatagggctgtaggccagggcctgggctccgggctccaacagaggagaggagccatgagcccaggcaacctggcggcagcgcaaaagatg

SEQ ID NO: 238887 - DNA, 103 bp, Artificial Sequence
  Synthetic Polynucleotide
taatacgactcactatagggggagacgggcctgtaggccagggcctgggcaacagaggagagcccagatgctggcctacaacctggcggcagcgcaaaagatg

SEQ ID NO: 238888 - DNA, 103 bp, Artificial Sequence
  Synthetic Polynucleotide
taatacgactcactatagggcgatgttcctggagacgggcctgtaggccaaacagaggagatggcctatgggcccgtctaacctggcggcagcgcaaaagatg

SEQ ID NO: 238889 - DNA, 103 bp, Artificial Sequence
  Synthetic Polynucleotide
taatacgactcactatagggtttgggacatcgatgttcctggagacgggcaacagaggagagcccgtatgcaggaacataacctggcggcagcgcaaaagatg

SEQ ID NO: 238890 - DNA, 103 bp, Artificial Sequence
  Synthetic Polynucleotide
taatacgactcactatagggcgacttcctctttgggacatcgatgttcctaacagaggagaaggaacatggatgtcccaaacctggcggcagcgcaaaagatg

SEQ ID NO: 238891 - DNA, 103 bp, Artificial Sequence
  Synthetic Polynucleotide
taatacgactcactatagggccactgcgtccgacttcctctttgggacataacagaggagaatgtccatgagaggaagtaacctggcggcagcgcaaaagatg

SEQ ID NO: 238892 - DNA, 103 bp, Artificial Sequence
  Synthetic Polynucleotide
taatacgactcactatagggtcatccatttccactgcgtccgacttcctcaacagaggagagaggaaatgggacgcagtaacctggcggcagcgcaaaagatg

SEQ ID NO: 238893 - DNA, 103 bp, Artificial Sequence
  Synthetic Polynucleotide
taatacgactcactatagggcgccatcatctcatccatttccactgcgtcaacagaggagagacgcaatggaaatggataacctggcggcagcgcaaaagatg

SEQ ID NO: 238894 - DNA, 103 bp, Artificial Sequence
  Synthetic Polynucleotide
taatacgactcactatagggcactgggtcccaacacccgggctcccaggaaacagaggagatcctggatgcccgggtgtaacctggcggcagcgcaaaagatg

SEQ ID NO: 238895 - DNA, 103 bp, Artificial Sequence
  Synthetic Polynucleotide
taatacgactcactataggggcaccatggccgccatcatctcatccatttaacagaggagaaaatggatgagatgatggaacctggcggcagcgcaaaagatg

SEQ ID NO: 238896 - DNA, 103 bp, Artificial Sequence
  Synthetic Polynucleotide
taatacgactcactatagggagggacgtcagcaccatggccgccatcatcaacagaggagagatgatatgggccatggtaacctggcggcagcgcaaaagatg

SEQ ID NO: 238897 - DNA, 103 bp, Artificial Sequence
  Synthetic Polynucleotide
taatacgactcactataggggctgcaggacagggacgtcagcaccatggcaacagaggagagccatgatgctgacgtccaacctggcggcagcgcaaaagatg

SEQ ID NO: 238898 - DNA, 103 bp, Artificial Sequence
  Synthetic Polynucleotide
taatacgactcactataggggtacaacagggctgcaggacagggacgtcaaacagaggagatgacgtatgtgtcctgcaaacctggcggcagcgcaaaagatg

SEQ ID NO: 238899 - DNA, 103 bp, Artificial Sequence
  Synthetic Polynucleotide
taatacgactcactatagggggaggactctgtacaacagggctgcaggacaacagaggagagtcctgatgccctgttgtaacctggcggcagcgcaaaagatg

SEQ ID NO: 238900 - DNA, 103 bp, Artificial Sequence
  Synthetic Polynucleotide
taatacgactcactatagggctcggtcccgggaggactctgtacaacaggaacagaggagacctgttatgcagagtcctaacctggcggcagcgcaaaagatg

SEQ ID NO: 238901 - DNA, 103 bp, Artificial Sequence
  Synthetic Polynucleotide
taatacgactcactatagggagaagttggcctcggtcccgggaggactctaacagaggagaagagtcatgccgggaccgaacctggcggcagcgcaaaagatg

SEQ ID NO: 238902 - DNA, 103 bp, Artificial Sequence
  Synthetic Polynucleotide
taatacgactcactatagggcgggaagcagagaagttggcctcggtcccgaacagaggagacgggacatgggccaacttaacctggcggcagcgcaaaagatg

SEQ ID NO: 238903 - DNA, 103 bp, Artificial Sequence
  Synthetic Polynucleotide
taatacgactcactataggggcaggccgcacgggaagcagagaagttggcaacagaggagagccaacatgtctgcttccaacctggcggcagcgcaaaagatg

SEQ ID NO: 238904 - DNA, 103 bp, Artificial Sequence
  Synthetic Polynucleotide
taatacgactcactatagggtccatgggtcgcaggccgcacgggaagcagaacagaggagactgcttatggtgcggcctaacctggcggcagcgcaaaagatg

SEQ ID NO: 238905 - DNA, 103 bp, Artificial Sequence
  Synthetic Polynucleotide
taatacgactcactatagggccctccgaggcactgggtcccaacacccggaacagaggagaccgggtatggggacccagaacctggcggcagcgcaaaagatg

SEQ ID NO: 238906 - DNA, 103 bp, Artificial Sequence
  Synthetic Polynucleotide
taatacgactcactatagggccactctccttccatgggtcgcaggccgcaaacagaggagatgcggcatgcgacccatgaacctggcggcagcgcaaaagatg

SEQ ID NO: 238907 - DNA, 103 bp, Artificial Sequence
  Synthetic Polynucleotide
taatacgactcactatagggcgagatgtcaccactctccttccatgggtcaacagaggagagacccaatgaaggagagtaacctggcggcagcgcaaaagatg

SEQ ID NO: 238908 - DNA, 103 bp, Artificial Sequence
  Synthetic Polynucleotide
taatacgactcactatagggtgccgctgtccgagatgtcaccactctcctaacagaggagaaggagaatggtgacatctaacctggcggcagcgcaaaagatg

SEQ ID NO: 238909 - DNA, 103 bp, Artificial Sequence
  Synthetic Polynucleotide
taatacgactcactataggggtagtgctgctgccgctgtccgagatgtcaaacagaggagatgacatatgggacagcggaacctggcggcagcgcaaaagatg

SEQ ID NO: 238910 - DNA, 103 bp, Artificial Sequence
  Synthetic Polynucleotide
taatacgactcactataggggtgaccgctggtagtgctgctgccgctgtcaacagaggagagacagcatgagcagcactaacctggcggcagcgcaaaagatg

SEQ ID NO: 238911 - DNA, 103 bp, Artificial Sequence
  Synthetic Polynucleotide
taatacgactcactatagggtcccactccagtgaccgctggtagtgctgcaacagaggagagcagcaatgccagcggtcaacctggcggcagcgcaaaagatg

SEQ ID NO: 238912 - DNA, 103 bp, Artificial Sequence
  Synthetic Polynucleotide
taatacgactcactatagggacaccactgctcccactccagtgaccgctgaacagaggagacagcggatgctggagtggaacctggcggcagcgcaaaagatg

SEQ ID NO: 238913 - DNA, 103 bp, Artificial Sequence
  Synthetic Polynucleotide
taatacgactcactataggggggggtggagacaccactgctcccactccaaacagaggagatggagtatgagcagtggtaacctggcggcagcgcaaaagatg

SEQ ID NO: 238914 - DNA, 103 bp, Artificial Sequence
  Synthetic Polynucleotide
taatacgactcactataggggggggggcgagggggtggagacaccactgcaacagaggagagcagtgatgtctccacccaacctggcggcagcgcaaaagatg

SEQ ID NO: 238915 - DNA, 103 bp, Artificial Sequence
  Synthetic Polynucleotide
taatacgactcactataggggcctgggggtgggggggcgagggggtggagaacagaggagactccacatgctcgcccccaacctggcggcagcgcaaaagatg

SEQ ID NO: 238916 - DNA, 103 bp, Artificial Sequence
  Synthetic Polynucleotide
taatacgactcactatagggagccgagggcccctccgaggcactgggtccaacagaggagaggacccatggcctcggagaacctggcggcagcgcaaaagatg

SEQ ID NO: 238917 - DNA, 103 bp, Artificial Sequence
  Synthetic Polynucleotide
taatacgactcactatagggcttggggctggcctgggggtgggggggcgaaacagaggagatcgcccatgcacccccagaacctggcggcagcgcaaaagatg

SEQ ID NO: 238918 - DNA, 103 bp, Artificial Sequence
  Synthetic Polynucleotide
taatacgactcactatagggcccccaaatacttggggctggcctgggggtaacagaggagaacccccatgccagccccaaacctggcggcagcgcaaaagatg

SEQ ID NO: 238919 - DNA, 103 bp, Artificial Sequence
  Synthetic Polynucleotide
taatacgactcactatagggccaaaagcatcccccaaatacttggggctgaacagaggagacagcccatggtatttgggaacctggcggcagcgcaaaagatg

SEQ ID NO: 238920 - DNA, 103 bp, Artificial Sequence
  Synthetic Polynucleotide
taatacgactcactatagggttggggagaaccaaaagcatcccccaaataaacagaggagatatttgatggatgcttttaacctggcggcagcgcaaaagatg

SEQ ID NO: 238921 - DNA, 103 bp, Artificial Sequence
  Synthetic Polynucleotide
taatacgactcactatagggcatgatcagtttggggagaaccaaaagcataacagaggagaatgcttatggttctccccaacctggcggcagcgcaaaagatg

SEQ ID NO: 238922 - DNA, 103 bp, Artificial Sequence
  Synthetic Polynucleotide
taatacgactcactataggggtctcaaagccatgatcagtttggggagaaaacagaggagattctccatgaactgatcaaacctggcggcagcgcaaaagatg

SEQ ID NO: 238923 - DNA, 103 bp, Artificial Sequence
  Synthetic Polynucleotide
taatacgactcactataggggtcaggatcggtctcaaagccatgatcagtaacagaggagaactgatatgggctttgagaacctggcggcagcgcaaaagatg

SEQ ID NO: 238924 - DNA, 103 bp, Artificial Sequence
  Synthetic Polynucleotide
taatacgactcactataggggcaggaaagggtcaggatcggtctcaaagcaacagaggagagctttgatgccgatcctgaacctggcggcagcgcaaaagatg

SEQ ID NO: 238925 - DNA, 103 bp, Artificial Sequence
  Synthetic Polynucleotide
taatacgactcactatagggggttcgtccagcaggaaagggtcaggatcgaacagaggagacgatccatgccctttcctaacctggcggcagcgcaaaagatg

SEQ ID NO: 238926 - DNA, 103 bp, Artificial Sequence
  Synthetic Polynucleotide
taatacgactcactatagggtcgtggagctggttcgtccagcaggaaaggaacagaggagacctttcatgctggacgaaaacctggcggcagcgcaaaagatg

SEQ ID NO: 238927 - DNA, 103 bp, Artificial Sequence
  Synthetic Polynucleotide
taatacgactcactatagggagggtggggcagccgagggcccctccgaggaacagaggagacctcggatgggccctcggaacctggcggcagcgcaaaagatg

SEQ ID NO: 238928 - DNA, 103 bp, Artificial Sequence
  Synthetic Polynucleotide
taatacgactcactatagggtctttctttttcgtggagctggttcgtccaaacagaggagatggacgatgcagctccacaacctggcggcagcgcaaaagatg

SEQ ID NO: 238929 - DNA, 103 bp, Artificial Sequence
  Synthetic Polynucleotide
taatacgactcactatagggttcacagagttctttctttttcgtggagctaacagaggagaagctccatgaaaaagaaaaacctggcggcagcgcaaaagatg

SEQ ID NO: 238930 - DNA, 103 bp, Artificial Sequence
  Synthetic Polynucleotide
taatacgactcactataggggtacatcaccttcacagagttctttcttttaacagaggagaaaaagaatgaactctgtgaacctggcggcagcgcaaaagatg

SEQ ID NO: 238931 - DNA, 103 bp, Artificial Sequence
  Synthetic Polynucleotide
taatacgactcactatagggacaggcacttgtacatcaccttcacagagtaacagaggagaactctgatgaggtgatgtaacctggcggcagcgcaaaagatg

SEQ ID NO: 238932 - DNA, 103 bp, Artificial Sequence
  Synthetic Polynucleotide
taatacgactcactatagggcagtttggccacaggcacttgtacatcaccaacagaggagaggtgatatgcaagtgcctaacctggcggcagcgcaaaagatg

SEQ ID NO: 238933 - DNA, 103 bp, Artificial Sequence
  Synthetic Polynucleotide
taatacgactcactatagggaactttgccacagtttggccacaggcacttaacagaggagaaagtgcatgtggccaaacaacctggcggcagcgcaaaagatg

SEQ ID NO: 238934 - DNA, 103 bp, Artificial Sequence
  Synthetic Polynucleotide
taatacgactcactatagggtggagcgcagaactttgccacagtttggccaacagaggagaggccaaatggtggcaaagaacctggcggcagcgcaaaagatg

SEQ ID NO: 238935 - DNA, 103 bp, Artificial Sequence
  Synthetic Polynucleotide
taatacgactcactatagggatgcccacaatggagcgcagaactttgccaaacagaggagatggcaaatgtctgcgctcaacctggcggcagcgcaaaagatg

SEQ ID NO: 238936 - DNA, 103 bp, Artificial Sequence
  Synthetic Polynucleotide
taatacgactcactataggggtgtcgtttgatgcccacaatggagcgcagaacagaggagactgcgcatgattgtgggcaacctggcggcagcgcaaaagatg

SEQ ID NO: 238937 - DNA, 103 bp, Artificial Sequence
  Synthetic Polynucleotide
taatacgactcactataggggggctttgacgtgtcgtttgatgcccacaaaacagaggagattgtggatgtcaaacgacaacctggcggcagcgcaaaagatg

SEQ ID NO: 238938 - DNA, 103 bp, Artificial Sequence
  Synthetic Polynucleotide
taatacgactcactatagggagtggctccgagggtggggcagccgagggcaacagaggagagccctcatgtgccccaccaacctggcggcagcgcaaaagatg

SEQ ID NO: 238939 - DNA, 103 bp, Artificial Sequence
  Synthetic Polynucleotide
taatacgactcactatagggcccagatggagggctttgacgtgtcgtttgaacagaggagacaaacgatgcgtcaaagcaacctggcggcagcgcaaaagatg

SEQ ID NO: 238940 - DNA, 103 bp, Artificial Sequence
  Synthetic Polynucleotide
taatacgactcactatagggcactgtgtcccccagatggagggctttgacaacagaggagagtcaaaatgctccatctgaacctggcggcagcgcaaaagatg

SEQ ID NO: 238941 - DNA, 103 bp, Artificial Sequence
  Synthetic Polynucleotide
taatacgactcactataggggatcagagtccactgtgtcccccagatggaaacagaggagatccatcatggggacacagaacctggcggcagcgcaaaagatg

SEQ ID NO: 238942 - DNA, 103 bp, Artificial Sequence
  Synthetic Polynucleotide
taatacgactcactatagggcgcttgaactgatcagagtccactgtgtccaacagaggagaggacacatgggactctgaaacctggcggcagcgcaaaagatg

SEQ ID NO: 238943 - DNA, 103 bp, Artificial Sequence
  Synthetic Polynucleotide
taatacgactcactatagggatcctcctcccgcttgaactgatcagagtcaacagaggagagactctatgcagttcaagaacctggcggcagcgcaaaagatg

SEQ ID NO: 238944 - DNA, 103 bp, Artificial Sequence
  Synthetic Polynucleotide
taatacgactcactatagggtgtagtagaaatcctcctcccgcttgaactaacagaggagaagttcaatggggaggaggaacctggcggcagcgcaaaagatg

SEQ ID NO: 238945 - DNA, 103 bp, Artificial Sequence
  Synthetic Polynucleotide
taatacgactcactatagggtgcacctctgtgtagtagaaatcctcctccaacagaggagaggaggaatgtttctactaaacctggcggcagcgcaaaagatg

SEQ ID NO: 238946 - DNA, 103 bp, Artificial Sequence
  Synthetic Polynucleotide
taatacgactcactatagggctccttcagctgcacctctgtgtagtagaaaacagaggagattctacatgacagaggtgaacctggcggcagcgcaaaagatg

SEQ ID NO: 238947 - DNA, 103 bp, Artificial Sequence
  Synthetic Polynucleotide
taatacgactcactatagggcagcagattcctccttcagctgcacctctgaacagaggagacagaggatgagctgaaggaacctggcggcagcgcaaaagatg

SEQ ID NO: 238948 - DNA, 103 bp, Artificial Sequence
  Synthetic Polynucleotide
taatacgactcactataggggcagcagcagcagcagattcctccttcagcaacagaggagagctgaaatgggaatctgcaacctggcggcagcgcaaaagatg

SEQ ID NO: 238949 - DNA, 103 bp, Artificial Sequence
  Synthetic Polynucleotide
taatacgactcactatagggaggatacactccatatttcaagtcgtccataacagaggagaatggacatgttgaaatataacctggcggcagcgcaaaagatg

SEQ ID NO: 238950 - DNA, 103 bp, Artificial Sequence
  Synthetic Polynucleotide
taatacgactcactatagggcacatccctaaatgtcaatgtctccttttcaacagaggagagaaaagatgacattgacaaacctggcggcagcgcaaaagatg

SEQ ID NO: 238951 - DNA, 103 bp, Artificial Sequence
  Synthetic Polynucleotide
taatacgactcactatagggtccagcatgaatgaacttatgtgtactaagaacagaggagacttagtatgcataagttcaacctggcggcagcgcaaaagatg

SEQ ID NO: 238952 - DNA, 103 bp, Artificial Sequence
  Synthetic Polynucleotide
taatacgactcactatagggagggtttctctccagcatgaatgaacttataacagaggagaataagtatgttcatgctgaacctggcggcagcgcaaaagatg

SEQ ID NO: 238953 - DNA, 103 bp, Artificial Sequence
  Synthetic Polynucleotide
taatacgactcactatagggtcacatttgtagggtttctctccagcatgaaacagaggagatcatgcatgagagaaaccaacctggcggcagcgcaaaagatg

SEQ ID NO: 238954 - DNA, 103 bp, Artificial Sequence
  Synthetic Polynucleotide
taatacgactcactataggggtcacattcctcacatttgtagggtttctcaacagaggagagagaaaatgtacaaatgtaacctggcggcagcgcaaaagatg

SEQ ID NO: 238955 - DNA, 103 bp, Artificial Sequence
  Synthetic Polynucleotide
taatacgactcactatagggtaaaagctttgtcacattcctcacatttgtaacagaggagaacaaatatgaggaatgtgaacctggcggcagcgcaaaagatg

SEQ ID NO: 238956 - DNA, 103 bp, Artificial Sequence
  Synthetic Polynucleotide
taatacgactcactataggggagaatcgattaaaagctttgtcacattccaacagaggagaggaatgatgcaaagctttaacctggcggcagcgcaaaagatg

SEQ ID NO: 238957 - DNA, 103 bp, Artificial Sequence
  Synthetic Polynucleotide
taatacgactcactatagggagtaaggtatgagaatcgattaaaagctttaacagaggagaaaagctatgaatcgattcaacctggcggcagcgcaaaagatg

SEQ ID NO: 238958 - DNA, 103 bp, Artificial Sequence
  Synthetic Polynucleotide
taatacgactcactatagggtcttatgtttagtaaggtatgagaatcgataacagaggagaatcgatatgcataccttaaacctggcggcagcgcaaaagatg

SEQ ID NO: 238959 - DNA, 103 bp, Artificial Sequence
  Synthetic Polynucleotide
taatacgactcactataggggtatgaattatcttatgtttagtaaggtataacagaggagaatacctatgtaaacataaaacctggcggcagcgcaaaagatg

SEQ ID NO: 238960 - DNA, 103 bp, Artificial Sequence
  Synthetic Polynucleotide
taatacgactcactatagggtttttctccagtatgaattatcttatgtttaacagaggagaaaacatatgataattcataacctggcggcagcgcaaaagatg

SEQ ID NO: 238961 - DNA, 103 bp, Artificial Sequence
  Synthetic Polynucleotide
taatacgactcactatagggattctatggccacatccctaaatgtcaatgaacagaggagacattgaatgttagggatgaacctggcggcagcgcaaaagatg

SEQ ID NO: 238962 - DNA, 103 bp, Artificial Sequence
  Synthetic Polynucleotide
taatacgactcactatagggatttgtaagatttttctccagtatgaattaaacagaggagataattcatgctggagaaaaacctggcggcagcgcaaaagatg

SEQ ID NO: 238963 - DNA, 103 bp, Artificial Sequence
  Synthetic Polynucleotide
taatacgactcactatagggcattcttcacatttgtaagatttttctccaaacagaggagatggagaatgatcttacaaaacctggcggcagcgcaaaagatg

SEQ ID NO: 238964 - DNA, 103 bp, Artificial Sequence
  Synthetic Polynucleotide
taatacgactcactataggggcctttgccacattcttcacatttgtaagaaacagaggagatcttacatgtgtgaagaaaacctggcggcagcgcaaaagatg

SEQ ID NO: 238965 - DNA, 103 bp, Artificial Sequence
  Synthetic Polynucleotide
taatacgactcactatagggaccaattaaagcctttgccacattcttcacaacagaggagagtgaagatggtggcaaagaacctggcggcagcgcaaaagatg

SEQ ID NO: 238966 - DNA, 103 bp, Artificial Sequence
  Synthetic Polynucleotide
taatacgactcactatagggagggttgaggaccaattaaagcctttgccaaacagaggagatggcaaatgctttaattgaacctggcggcagcgcaaaagatg

SEQ ID NO: 238967 - DNA, 103 bp, Artificial Sequence
  Synthetic Polynucleotide
taatacgactcactatagggatgtttagtaagggttgaggaccaattaaaaacagaggagatttaatatgtcctcaaccaacctggcggcagcgcaaaagatg

SEQ ID NO: 238968 - DNA, 103 bp, Artificial Sequence
  Synthetic Polynucleotide
taatacgactcactataggggaattcttttatgtttagtaagggttgaggaacagaggagacctcaaatgttactaaacaacctggcggcagcgcaaaagatg

SEQ ID NO: 238969 - DNA, 103 bp, Artificial Sequence
  Synthetic Polynucleotide
taatacgactcactatagggtctccagtatgaattcttttatgtttagtaaacagaggagatactaaatgtaaaagaataacctggcggcagcgcaaaagatg

SEQ ID NO: 238970 - DNA, 103 bp, Artificial Sequence
  Synthetic Polynucleotide
taatacgactcactataggggtagggtttctctccagtatgaattcttttaacagaggagaaaaagaatgcatactggaaacctggcggcagcgcaaaagatg

SEQ ID NO: 238971 - DNA, 103 bp, Artificial Sequence
  Synthetic Polynucleotide
taatacgactcactatagggcttcacatttgtagggtttctctccagtataacagaggagaatactgatgagaaaccctaacctggcggcagcgcaaaagatg

SEQ ID NO: 238972 - DNA, 103 bp, Artificial Sequence
  Synthetic Polynucleotide
taatacgactcactatagggtccagagagaattctatggccacatccctaaacagaggagatagggaatgggccatagaaacctggcggcagcgcaaaagatg

SEQ ID NO: 238973 - DNA, 103 bp, Artificial Sequence
  Synthetic Polynucleotide
taatacgactcactatagggttgccacacacttcacatttgtagggtttcaacagaggagagaaaccatgcaaatgtgaaacctggcggcagcgcaaaagatg

SEQ ID NO: 238974 - DNA, 103 bp, Artificial Sequence
  Synthetic Polynucleotide
taatacgactcactatagggattaaaggctttgccacacacttcacatttaacagaggagaaaatgtatggtgtgtggcaacctggcggcagcgcaaaagatg

SEQ ID NO: 238975 - DNA, 103 bp, Artificial Sequence
  Synthetic Polynucleotide
taatacgactcactatagggttgaggactcattaaaggctttgccacacaaacagaggagatgtgtgatgaagcctttaaacctggcggcagcgcaaaagatg

SEQ ID NO: 238976 - DNA, 103 bp, Artificial Sequence
  Synthetic Polynucleotide
taatacgactcactataggggtagtaaggtttgaggactcattaaaggctaacagaggagaagccttatgtgagtcctcaacctggcggcagcgcaaaagatg

SEQ ID NO: 238977 - DNA, 103 bp, Artificial Sequence
  Synthetic Polynucleotide
taatacgactcactatagggcatcttatgtgtagtaaggtttgaggactcaacagaggagagagtccatgaaccttactaacctggcggcagcgcaaaagatg

SEQ ID NO: 238978 - DNA, 103 bp, Artificial Sequence
  Synthetic Polynucleotide
taatacgactcactatagggcagtatgaatcatcttatgtgtagtaaggtaacagaggagaaccttaatgcacataagaaacctggcggcagcgcaaaagatg

SEQ ID NO: 238979 - DNA, 103 bp, Artificial Sequence
  Synthetic Polynucleotide
taatacgactcactatagggggtttctctccagtatgaatcatcttatgtaacagaggagaacataaatggattcatacaacctggcggcagcgcaaaagatg

SEQ ID NO: 238980 - DNA, 103 bp, Artificial Sequence
  Synthetic Polynucleotide
taatacgactcactatagggacatttgtagggtttctctccagtatgaataacagaggagaattcatatgggagagaaaaacctggcggcagcgcaaaagatg

SEQ ID NO: 238981 - DNA, 103 bp, Artificial Sequence
  Synthetic Polynucleotide
taatacgactcactatagggcacattcttcacatttgtagggtttctctcaacagaggagagagagaatgcctacaaataacctggcggcagcgcaaaagatg

SEQ ID NO: 238982 - DNA, 103 bp, Artificial Sequence
  Synthetic Polynucleotide
taatacgactcactatagggaaagctttgccacattcttcacatttgtagaacagaggagactacaaatgtgaagaatgaacctggcggcagcgcaaaagatg

SEQ ID NO: 238983 - DNA, 103 bp, Artificial Sequence
  Synthetic Polynucleotide
taatacgactcactatagggttcccactcctccagagagaattctatggcaacagaggagagccataatgttctctctgaacctggcggcagcgcaaaagatg

SEQ ID NO: 238984 - DNA, 103 bp, Artificial Sequence
  Synthetic Polynucleotide
taatacgactcactatagggggaccggttaaaagctttgccacattcttcaacagaggagagaagaaatgggcaaagctaacctggcggcagcgcaaaagatg

SEQ ID NO: 238985 - DNA, 103 bp, Artificial Sequence
  Synthetic Polynucleotide
taatacgactcactatagggtaagttgtggggaccggttaaaagctttgcaacagaggagagcaaagatgttaaccggtaacctggcggcagcgcaaaagatg

SEQ ID NO: 238986 - DNA, 103 bp, Artificial Sequence
  Synthetic Polynucleotide
taatacgactcactatagggttatgtgcagtaagttgtggggaccggttaaacagaggagataaccgatgcccacaactaacctggcggcagcgcaaaagatg

SEQ ID NO: 238987 - DNA, 103 bp, Artificial Sequence
  Synthetic Polynucleotide
taatacgactcactatagggatgaattatcttatgtgcagtaagttgtggaacagaggagaccacaaatgactgcacataacctggcggcagcgcaaaagatg

SEQ ID NO: 238988 - DNA, 103 bp, Artificial Sequence
  Synthetic Polynucleotide
taatacgactcactatagggtctctccagtatgaattatcttatgtgcagaacagaggagactgcacatgagataattcaacctggcggcagcgcaaaagatg

SEQ ID NO: 238989 - DNA, 103 bp, Artificial Sequence
  Synthetic Polynucleotide
taatacgactcactatagggttgtaaggtttctctccagtatgaattatcaacagaggagagataatatgtactggagaaacctggcggcagcgcaaaagatg

SEQ ID NO: 238990 - DNA, 103 bp, Artificial Sequence
  Synthetic Polynucleotide
taatacgactcactatagggttcttcacatttgtaaggtttctctccagtaacagaggagaactggaatgaaaccttacaacctggcggcagcgcaaaagatg

SEQ ID NO: 238991 - DNA, 103 bp, Artificial Sequence
  Synthetic Polynucleotide
taatacgactcactatagggctttgccacattcttcacatttgtaaggttaacagaggagaaaccttatgaatgtgaagaacctggcggcagcgcaaaagatg

SEQ ID NO: 238992 - DNA, 103 bp, Artificial Sequence
  Synthetic Polynucleotide
taatacgactcactatagggtggctaaaagctttgccacattcttcacataacagaggagaatgtgaatgatgtggcaaaacctggcggcagcgcaaaagatg

SEQ ID NO: 238993 - DNA, 103 bp, Artificial Sequence
  Synthetic Polynucleotide
taatacgactcactataggggattgatgactggctaaaagctttgccacaaacagaggagatgtggcatggcttttagcaacctggcggcagcgcaaaagatg

SEQ ID NO: 238994 - DNA, 103 bp, Artificial Sequence
  Synthetic Polynucleotide
taatacgactcactatagggggttcaggcattcccactcctccagagagaaacagaggagatctctcatgaggagtgggaacctggcggcagcgcaaaagatg

SEQ ID NO: 238995 - DNA, 103 bp, Artificial Sequence
  Synthetic Polynucleotide
taatacgactcactataggggtgtagtaaggattgatgactggctaaaagaacagaggagacttttaatgagtcatcaaaacctggcggcagcgcaaaagatg

SEQ ID NO: 238996 - DNA, 103 bp, Artificial Sequence
  Synthetic Polynucleotide
taatacgactcactatagggattctcttatgtgtagtaaggattgatgacaacagaggagagtcatcatgccttactacaacctggcggcagcgcaaaagatg

SEQ ID NO: 238997 - DNA, 103 bp, Artificial Sequence
  Synthetic Polynucleotide
taatacgactcactatagggtccagtgtgaattctcttatgtgtagtaagaacagaggagacttactatgcataagagaaacctggcggcagcgcaaaagatg

SEQ ID NO: 238998 - DNA, 103 bp, Artificial Sequence
  Synthetic Polynucleotide
taatacgactcactatagggagggtttctctccagtgtgaattctcttataacagaggagaataagaatgttcacactgaacctggcggcagcgcaaaagatg

SEQ ID NO: 238999 - DNA, 103 bp, Artificial Sequence
  Synthetic Polynucleotide
taatacgactcactatagggtcacatttgtagggtttctctccagtgtgaaacagaggagatcacacatgagagaaaccaacctggcggcagcgcaaaagatg

SEQ ID NO: 239000 - DNA, 103 bp, Artificial Sequence
  Synthetic Polynucleotide
taatacgactcactataggggccacattcttcacatttgtagggtttctcaacagaggagagagaaaatgtacaaatgtaacctggcggcagcgcaaaagatg

SEQ ID NO: 239001 - DNA, 103 bp, Artificial Sequence
  Synthetic Polynucleotide
taatacgactcactatagggtaaaagctttgccacattcttcacatttgtaacagaggagaacaaatatgaagaatgtgaacctggcggcagcgcaaaagatg

SEQ ID NO: 239002 - DNA, 103 bp, Artificial Sequence
  Synthetic Polynucleotide
taatacgactcactataggggaggatcggttaaaagctttgccacattctaacagaggagaagaatgatgcaaagctttaacctggcggcagcgcaaaagatg

SEQ ID NO: 239003 - DNA, 103 bp, Artificial Sequence
  Synthetic Polynucleotide
taatacgactcactatagggagtaagatttgaggatcggttaaaagctttaacagaggagaaaagctatgaaccgatccaacctggcggcagcgcaaaagatg

SEQ ID NO: 239004 - DNA, 103 bp, Artificial Sequence
  Synthetic Polynucleotide
taatacgactcactatagggtcttatgtttagtaagatttgaggatcggtaacagaggagaaccgatatgcaaatcttaaacctggcggcagcgcaaaagatg

SEQ ID NO: 239005 - DNA, 103 bp, Artificial Sequence
  Synthetic Polynucleotide
taatacgactcactatagggtgctgagcagggttcaggcattcccactccaacagaggagaggagtgatgatgcctgaaaacctggcggcagcgcaaaagatg

SEQ ID NO: 239006 - DNA, 103 bp, Artificial Sequence
  Synthetic Polynucleotide
taatacgactcactataggggtatgaattatcttatgtttagtaagatttaacagaggagaaaatctatgtaaacataaaacctggcggcagcgcaaaagatg

SEQ ID NO: 239007 - DNA, 103 bp, Artificial Sequence
  Synthetic Polynucleotide
taatacgactcactatagggtttctctcctgtatgaattatcttatgtttaacagaggagaaaacatatgataattcataacctggcggcagcgcaaaagatg

SEQ ID NO: 239008 - DNA, 103 bp, Artificial Sequence
  Synthetic Polynucleotide
taatacgactcactatagggatttgtaagatttctctcctgtatgaattaaacagaggagataattcatgcaggagagaaacctggcggcagcgcaaaagatg

SEQ ID NO: 239009 - DNA, 103 bp, Artificial Sequence
  Synthetic Polynucleotide
taatacgactcactatagggcattcttcacatttgtaagatttctctcctaacagaggagaaggagaatgatcttacaaaacctggcggcagcgcaaaagatg

SEQ ID NO: 239010 - DNA, 103 bp, Artificial Sequence
  Synthetic Polynucleotide
taatacgactcactatagggggctttaccacattcttcacatttgtaagaaacagaggagatcttacatgtgtgaagaaaacctggcggcagcgcaaaagatg

SEQ ID NO: 239011 - DNA, 103 bp, Artificial Sequence
  Synthetic Polynucleotide
taatacgactcactatagggattggttaaaggctttaccacattcttcacaacagaggagagtgaagatggtggtaaagaacctggcggcagcgcaaaagatg

SEQ ID NO: 239012 - DNA, 103 bp, Artificial Sequence
  Synthetic Polynucleotide
taatacgactcactatagggagagttgaggattggttaaaggctttaccaaacagaggagatggtaaatgctttaaccaaacctggcggcagcgcaaaagatg

SEQ ID NO: 239013 - DNA, 103 bp, Artificial Sequence
  Synthetic Polynucleotide
taatacgactcactatagggatgtttagtaagagttgaggattggttaaaaacagaggagatttaacatgtcctcaactaacctggcggcagcgcaaaagatg

SEQ ID NO: 239014 - DNA, 103 bp, Artificial Sequence
  Synthetic Polynucleotide
taatacgactcactataggggaattttcctatgtttagtaagagttgaggaacagaggagacctcaaatgttactaaacaacctggcggcagcgcaaaagatg

SEQ ID NO: 239015 - DNA, 103 bp, Artificial Sequence
  Synthetic Polynucleotide
taatacgactcactatagggtgtctagtatgaattttcctatgtttagtaaacagaggagatactaaatgtaggaaaataacctggcggcagcgcaaaagatg

SEQ ID NO: 239016 - DNA, 103 bp, Artificial Sequence
  Synthetic Polynucleotide
taatacgactcactatagggatataaattctgctgagcagggttcaggcaaacagaggagatgcctgatgcctgctcagaacctggcggcagcgcaaaagatg

SEQ ID NO: 239017 - DNA, 103 bp, Artificial Sequence
  Synthetic Polynucleotide
taatacgactcactataggggtagggtttctgtctagtatgaattttcctaacagaggagaaggaaaatgcatactagaaacctggcggcagcgcaaaagatg

SEQ ID NO: 239018 - DNA, 103 bp, Artificial Sequence
  Synthetic Polynucleotide
taatacgactcactatagggcttcacagttgtagggtttctgtctagtataacagaggagaatactaatgagaaaccctaacctggcggcagcgcaaaagatg

SEQ ID NO: 239019 - DNA, 103 bp, Artificial Sequence
  Synthetic Polynucleotide
taatacgactcactatagggttgtcacattcttcacagttgtagggtttcaacagaggagagaaaccatgcaactgtgaaacctggcggcagcgcaaaagatg

SEQ ID NO: 239020 - DNA, 103 bp, Artificial Sequence
  Synthetic Polynucleotide
taatacgactcactataggggttaaatgtattgtcacattcttcacagttaacagaggagaaactgtatggaatgtgacaacctggcggcagcgcaaaagatg

SEQ ID NO: 239021 - DNA, 103 bp, Artificial Sequence
  Synthetic Polynucleotide
taatacgactcactatagggttgaggactggttaaatgtattgtcacattaacagaggagaaatgtgatgatacatttaaacctggcggcagcgcaaaagatg

SEQ ID NO: 239022 - DNA, 103 bp, Artificial Sequence
  Synthetic Polynucleotide
taatacgactcactatagggttaataaggtttgaggactggttaaatgtaaacagaggagatacattatgccagtcctcaacctggcggcagcgcaaaagatg

SEQ ID NO: 239023 - DNA, 103 bp, Artificial Sequence
  Synthetic Polynucleotide
taatacgactcactatagggattattttgtttaataaggtttgaggactgaacagaggagacagtccatgaaccttattaacctggcggcagcgcaaaagatg

SEQ ID NO: 239024 - DNA, 103 bp, Artificial Sequence
  Synthetic Polynucleotide
taatacgactcactatagggtccagtatgaattattttgtttaataaggtaacagaggagaaccttaatgaacaaaataaacctggcggcagcgcaaaagatg

SEQ ID NO: 239025 - DNA, 103 bp, Artificial Sequence
  Synthetic Polynucleotide
taatacgactcactatagggagagtttctctccagtatgaattattttgtaacagaggagaacaaaaatgttcatactgaacctggcggcagcgcaaaagatg

SEQ ID NO: 239026 - DNA, 103 bp, Artificial Sequence
  Synthetic Polynucleotide
taatacgactcactatagggtgacatttgtagagtttctctccagtatgaaacagaggagatcatacatgagagaaactaacctggcggcagcgcaaaagatg

SEQ ID NO: 239027 - DNA, 103 bp, Artificial Sequence
  Synthetic Polynucleotide
taatacgactcactatagggtcacattcatatataaattctgctgagcagaacagaggagactgctcatgagaatttataacctggcggcagcgcaaaagatg

SEQ ID NO: 239028 - DNA, 103 bp, Artificial Sequence
  Synthetic Polynucleotide
taatacgactcactatagggcccacattcttgacatttgtagagtttctcaacagaggagagagaaaatgtacaaatgtaacctggcggcagcgcaaaagatg

SEQ ID NO: 239029 - DNA, 103 bp, Artificial Sequence
  Synthetic Polynucleotide
taatacgactcactatagggtaaaggctttcccacattcttgacatttgtaacagaggagaacaaatatgaagaatgtgaacctggcggcagcgcaaaagatg

SEQ ID NO: 239030 - DNA, 103 bp, Artificial Sequence
  Synthetic Polynucleotide
taatacgactcactatagggttttctaacatcacattcatatataaattcaacagaggagagaatttatgtatgaatgtaacctggcggcagcgcaaaagatg

SEQ ID NO: 239031 - DNA, 103 bp, Artificial Sequence
  Synthetic Polynucleotide
taatacgactcactataggggtttttgtagttttctaacatcacattcataacagaggagaatgaatatgatgttagaaaacctggcggcagcgcaaaagatg

SEQ ID NO: 239032 - DNA, 103 bp, Artificial Sequence
  Synthetic Polynucleotide
taatacgactcactatagggcttccttgagaggatacactccatatttcaaacagaggagatgaaatatggagtgtatcaacctggcggcagcgcaaaagatg

SEQ ID NO: 239033 - DNA, 103 bp, Artificial Sequence
  Synthetic Polynucleotide
taatacgactcactatagggagaagaccaggtttttgtagttttctaacaaacagaggagatgttagatgactacaaaaaacctggcggcagcgcaaaagatg

SEQ ID NO: 239034 - DNA, 103 bp, Artificial Sequence
  Synthetic Polynucleotide
taatacgactcactataggggcaacacccaagaagaccaggtttttgtagaacagaggagactacaaatgcctggtcttaacctggcggcagcgcaaaagatg

SEQ ID NO: 239035 - DNA, 103 bp, Artificial Sequence
  Synthetic Polynucleotide
taatacgactcactatagggcttagagacagcaacacccaagaagaccagaacagaggagactggtcatgttgggtgttaacctggcggcagcgcaaaagatg

SEQ ID NO: 239036 - DNA, 103 bp, Artificial Sequence
  Synthetic Polynucleotide
taatacgactcactatagggctgggtcttgcttagagacagcaacacccaaacagaggagatgggtgatgctgtctctaaacctggcggcagcgcaaaagatg

SEQ ID NO: 239037 - DNA, 103 bp, Artificial Sequence
  Synthetic Polynucleotide
taatacgactcactatagggagacaggtgactgggtcttgcttagagacaaacagaggagatgtctcatggcaagacccaacctggcggcagcgcaaaagatg

SEQ ID NO: 239038 - DNA, 103 bp, Artificial Sequence
  Synthetic Polynucleotide
taatacgactcactatagggttcttgctccagacaggtgactgggtcttgaacagaggagacaagacatggtcacctgtaacctggcggcagcgcaaaagatg

SEQ ID NO: 239039 - DNA, 103 bp, Artificial Sequence
  Synthetic Polynucleotide
taatacgactcactatagggagggctctttttcttgctccagacaggtgaaacagaggagatcacctatgtggagcaagaacctggcggcagcgcaaaagatg

SEQ ID NO: 239040 - DNA, 103 bp, Artificial Sequence
  Synthetic Polynucleotide
taatacgactcactatagggttcatattccagggctctttttcttgctccaacagaggagaggagcaatgaaaagagccaacctggcggcagcgcaaaagatg

SEQ ID NO: 239041 - DNA, 103 bp, Artificial Sequence
  Synthetic Polynucleotide
taatacgactcactatagggctcatgtctcttcatattccagggctctttaacagaggagaaaagagatgtggaatatgaacctggcggcagcgcaaaagatg

SEQ ID NO: 239042 - DNA, 103 bp, Artificial Sequence
  Synthetic Polynucleotide
taatacgactcactatagggcatccaccatctcatgtctcttcatattccaacagaggagaggaataatgagagacatgaacctggcggcagcgcaaaagatg

SEQ ID NO: 239043 - DNA, 103 bp, Artificial Sequence
  Synthetic Polynucleotide
taatacgactcactatagggcatccacttgcttccttgagaggatacactaacagaggagaagtgtaatgtctcaaggaaacctggcggcagcgcaaaagatg

SEQ ID NO: 239044 - DNA, 103 bp, Artificial Sequence
  Synthetic Polynucleotide
taatacgactcactataggggctgggggttcatccaccatctcatgtctcaacagaggagagagacaatggatggtggaaacctggcggcagcgcaaaagatg

SEQ ID NO: 239045 - DNA, 103 bp, Artificial Sequence
  Synthetic Polynucleotide
taatacgactcactatagggagaacacatagctgggggttcatccaccataacagaggagaatggtgatggaacccccaaacctggcggcagcgcaaaagatg

SEQ ID NO: 239046 - DNA, 103 bp, Artificial Sequence
  Synthetic Polynucleotide
taatacgactcactatagggtggtaaaataagaacacatagctgggggttaacagaggagaaaccccatgctatgtgttaacctggcggcagcgcaaaagatg

SEQ ID NO: 239047 - DNA, 103 bp, Artificial Sequence
  Synthetic Polynucleotide
taatacgactcactatagggcaaaggtctttggtaaaataagaacacataaacagaggagatatgtgatgttattttacaacctggcggcagcgcaaaagatg

SEQ ID NO: 239048 - DNA, 103 bp, Artificial Sequence
  Synthetic Polynucleotide
taatacgactcactatagggttgctctggccaaaggtctttggtaaaataaacagaggagatattttatgaaagaccttaacctggcggcagcgcaaaagatg

SEQ ID NO: 239049 - DNA, 103 bp, Artificial Sequence
  Synthetic Polynucleotide
taatacgactcactatagggcttttatgtcttgctctggccaaaggtcttaacagaggagaaagaccatgggccagagcaacctggcggcagcgcaaaagatg

SEQ ID NO: 239050 - DNA, 103 bp, Artificial Sequence
  Synthetic Polynucleotide
taatacgactcactatagggtgaaaagaatcttttatgtcttgctctggcaacagaggagagccagaatgagacataaaaacctggcggcagcgcaaaagatg

SEQ ID NO: 239051 - DNA, 103 bp, Artificial Sequence
  Synthetic Polynucleotide
taatacgactcactatagggtattacttgttgaaaagaatcttttatgtcaacagaggagagacataatggattcttttaacctggcggcagcgcaaaagatg

SEQ ID NO: 239052 - DNA, 103 bp, Artificial Sequence
  Synthetic Polynucleotide
taatacgactcactatagggatcttctcagtattacttgttgaaaagaataacagaggagaattcttatgaacaagtaaaacctggcggcagcgcaaaagatg

SEQ ID NO: 239053 - DNA, 103 bp, Artificial Sequence
  Synthetic Polynucleotide
taatacgactcactatagggcatttgccatatcttctcagtattacttgtaacagaggagaacaagtatgactgagaagaacctggcggcagcgcaaaagatg

SEQ ID NO: 239054 - DNA, 103 bp, Artificial Sequence
  Synthetic Polynucleotide
taatacgactcactatagggagccccagggcatccacttgcttccttgagaacagaggagactcaagatggcaagtggaaacctggcggcagcgcaaaagatg

SEQ ID NO: 239055 - DNA, 103 bp, Artificial Sequence
  Synthetic Polynucleotide
taatacgactcactatagggctcatgttcacatttgccatatcttctcagaacagaggagactgagaatgtatggcaaaaacctggcggcagcgcaaaagatg

SEQ ID NO: 239056 - DNA, 103 bp, Artificial Sequence
  Synthetic Polynucleotide
taatacgactcactatagggactgtaaattctcatgttcacatttgccataacagaggagaatggcaatggtgaacatgaacctggcggcagcgcaaaagatg

SEQ ID NO: 239057 - DNA, 103 bp, Artificial Sequence
  Synthetic Polynucleotide
taatacgactcactatagggccttttcttaactgtaaattctcatgttcaaacagaggagatgaacaatggaatttacaaacctggcggcagcgcaaaagatg

SEQ ID NO: 239058 - DNA, 103 bp, Artificial Sequence
  Synthetic Polynucleotide
taatacgactcactatagggacttgcggagccttttcttaactgtaaattaacagaggagaaatttaatgttaagaaaaaacctggcggcagcgcaaaagatg

SEQ ID NO: 239059 - DNA, 103 bp, Artificial Sequence
  Synthetic Polynucleotide
taatacgactcactatagggactcatctacacttgcggagccttttcttaaacagaggagataagaaatggctccgcaaaacctggcggcagcgcaaaagatg

SEQ ID NO: 239060 - DNA, 103 bp, Artificial Sequence
  Synthetic Polynucleotide
taatacgactcactatagggtgcaccttatactcatctacacttgcggagaacagaggagactccgcatgtgtagatgaaacctggcggcagcgcaaaagatg

SEQ ID NO: 239061 - DNA, 103 bp, Artificial Sequence
  Synthetic Polynucleotide
taatacgactcactatagggaccttctttgtgcaccttatactcatctacaacagaggagagtagatatgtataaggtgaacctggcggcagcgcaaaagatg

SEQ ID NO: 239062 - DNA, 103 bp, Artificial Sequence
  Synthetic Polynucleotide
taatacgactcactataggggctcattataaccttctttgtgcaccttataacagaggagaataaggatgacaaagaagaacctggcggcagcgcaaaagatg

SEQ ID NO: 239063 - DNA, 103 bp, Artificial Sequence
  Synthetic Polynucleotide
taatacgactcactatagggcactggtttagctcattataaccttctttgaacagaggagacaaagaatgttataatgaaacctggcggcagcgcaaaagatg

SEQ ID NO: 239064 - DNA, 103 bp, Artificial Sequence
  Synthetic Polynucleotide
taatacgactcactatagggagttgtcaaacactggtttagctcattataaacagaggagatataatatgctaaaccagaacctggcggcagcgcaaaagatg

SEQ ID NO: 239065 - DNA, 103 bp, Artificial Sequence
  Synthetic Polynucleotide
taatacgactcactataggggattcctctcagccccagggcatccacttgaacagaggagacaagtgatggccctggggaacctggcggcagcgcaaaagatg

SEQ ID NO: 239066 - DNA, 103 bp, Artificial Sequence
  Synthetic Polynucleotide
taatacgactcactatagggtgctctgggtagttgtcaaacactggtttaaacagaggagataaaccatggtttgacaaaacctggcggcagcgcaaaagatg

SEQ ID NO: 239067 - DNA, 103 bp, Artificial Sequence
  Synthetic Polynucleotide
taatacgactcactatagggggaaatattttgctctgggtagttgtcaaaaacagaggagatttgacatgtacccagagaacctggcggcagcgcaaaagatg

SEQ ID NO: 239068 - DNA, 103 bp, Artificial Sequence
  Synthetic Polynucleotide
taatacgactcactatagggtttatcacatggaaatattttgctctgggtaacagaggagaacccagatgaaaatatttaacctggcggcagcgcaaaagatg

SEQ ID NO: 239069 - DNA, 103 bp, Artificial Sequence
  Synthetic Polynucleotide
taatacgactcactatagggctttcacatatttatcacatggaaatatttaacagaggagaaaatatatgcatgtgataaacctggcggcagcgcaaaagatg

SEQ ID NO: 239070 - DNA, 103 bp, Artificial Sequence
  Synthetic Polynucleotide
taatacgactcactatagggttatgaaagactttcacatatttatcacataacagaggagaatgtgaatgatatgtgaaaacctggcggcagcgcaaaagatg

SEQ ID NO: 239071 - DNA, 103 bp, Artificial Sequence
  Synthetic Polynucleotide
taatacgactcactatagggatttaaaaatttatgaaagactttcacataaacagaggagatatgtgatggtctttcataacctggcggcagcgcaaaagatg

SEQ ID NO: 239072 - DNA, 103 bp, Artificial Sequence
  Synthetic Polynucleotide
taatacgactcactataggggtctatttgcatttaaaaatttatgaaagaaacagaggagatctttcatgaatttttaaaacctggcggcagcgcaaaagatg

SEQ ID NO: 239073 - DNA, 103 bp, Artificial Sequence
  Synthetic Polynucleotide
taatacgactcactatagggcttgtcttatgtctatttgcatttaaaaataacagaggagaatttttatgtgcaaatagaacctggcggcagcgcaaaagatg

SEQ ID NO: 239074 - DNA, 103 bp, Artificial Sequence
  Synthetic Polynucleotide
taatacgactcactatagggtccagtatgtcttgtcttatgtctatttgcaacagaggagagcaaatatgcataagacaaacctggcggcagcgcaaaagatg

SEQ ID NO: 239075 - DNA, 103 bp, Artificial Sequence
  Synthetic Polynucleotide
taatacgactcactatagggaaggtttctttccagtatgtcttgtcttataacagaggagaataagaatggacatactgaacctggcggcagcgcaaaagatg

SEQ ID NO: 239076 - DNA, 103 bp, Artificial Sequence
  Synthetic Polynucleotide
taatacgactcactatagggtaaactagaagattcctctcagccccagggaacagaggagaccctggatgtgagaggaaaacctggcggcagcgcaaaagatg

SEQ ID NO: 239077 - DNA, 103 bp, Artificial Sequence
  Synthetic Polynucleotide
taatacgactcactatagggttacatttgaaaggtttctttccagtatgtaacagaggagaacatacatgaaagaaaccaacctggcggcagcgcaaaagatg

SEQ ID NO: 239078 - DNA, 103 bp, Artificial Sequence
  Synthetic Polynucleotide
taatacgactcactataggggccacattttttacatttgaaaggtttcttaacagaggagaaagaaaatgttcaaatgtaacctggcggcagcgcaaaagatg

SEQ ID NO: 239079 - DNA, 103 bp, Artificial Sequence
  Synthetic Polynucleotide
taatacgactcactatagggaaaatgatttgccacattttttacatttgaaacagaggagatcaaatatgaaaaatgtgaacctggcggcagcgcaaaagatg

SEQ ID NO: 239080 - DNA, 103 bp, Artificial Sequence
  Synthetic Polynucleotide
taatacgactcactatagggaaaagcatgcaaaatgatttgccacattttaacagaggagaaaaatgatgcaaatcattaacctggcggcagcgcaaaagatg

SEQ ID NO: 239081 - DNA, 103 bp, Artificial Sequence
  Synthetic Polynucleotide
taatacgactcactatagggacttaggtgtaaaagcatgcaaaatgatttaacagaggagaaaatcaatgtgcatgcttaacctggcggcagcgcaaaagatg

SEQ ID NO: 239082 - DNA, 103 bp, Artificial Sequence
  Synthetic Polynucleotide
taatacgactcactatagggttttatgttgacttaggtgtaaaagcatgcaacagaggagagcatgcatgtacacctaaaacctggcggcagcgcaaaagatg

SEQ ID NO: 239083 - DNA, 103 bp, Artificial Sequence
  Synthetic Polynucleotide
taatacgactcactatagggatatgaattcttttatgttgacttaggtgtaacagaggagaacacctatgtcaacataaaacctggcggcagcgcaaaagatg

SEQ ID NO: 239084 - DNA, 103 bp, Artificial Sequence
  Synthetic Polynucleotide
taatacgactcactatagggattctctctaatatgaattcttttatgttgaacagaggagacaacatatgagaattcataacctggcggcagcgcaaaagatg

SEQ ID NO: 239085 - DNA, 103 bp, Artificial Sequence
  Synthetic Polynucleotide
taatacgactcactatagggattggtaagaattctctctaatatgaattcaacagaggagagaattcatgttagagagaaacctggcggcagcgcaaaagatg

SEQ ID NO: 239086 - DNA, 103 bp, Artificial Sequence
  Synthetic Polynucleotide
taatacgactcactatagggcattcttcacattggtaagaattctctctaaacagaggagatagagaatgttcttaccaaacctggcggcagcgcaaaagatg

SEQ ID NO: 239087 - DNA, 103 bp, Artificial Sequence
  Synthetic Polynucleotide
taatacgactcactatagggaaaataagagtaaactagaagattcctctcaacagaggagagagaggatgcttctagttaacctggcggcagcgcaaaagatg

SEQ ID NO: 239088 - DNA, 103 bp, Artificial Sequence
  Synthetic Polynucleotide
taatacgactcactatagggagctttgccacattcttcacattggtaagaaacagaggagatcttacatgtgtgaagaaaacctggcggcagcgcaaaagatg

SEQ ID NO: 239089 - DNA, 103 bp, Artificial Sequence
  Synthetic Polynucleotide
taatacgactcactatagggaccatttaaaagctttgccacattcttcacaacagaggagagtgaagatggtggcaaagaacctggcggcagcgcaaaagatg

SEQ ID NO: 239090 - DNA, 103 bp, Artificial Sequence
  Synthetic Polynucleotide
taatacgactcactatagggagggttgagaaccatttaaaagctttgccaaacagaggagatggcaaatgttttaaatgaacctggcggcagcgcaaaagatg

SEQ ID NO: 239091 - DNA, 103 bp, Artificial Sequence
  Synthetic Polynucleotide
taatacgactcactataggggtgtctagtaagggttgagaaccatttaaaaacagaggagatttaaaatgttctcaaccaacctggcggcagcgcaaaagatg

SEQ ID NO: 239092 - DNA, 103 bp, Artificial Sequence
  Synthetic Polynucleotide
taatacgactcactataggggaattctcttgtgtctagtaagggttgagaaacagaggagatctcaaatgttactagacaacctggcggcagcgcaaaagatg

SEQ ID NO: 239093 - DNA, 103 bp, Artificial Sequence
  Synthetic Polynucleotide
taatacgactcactatagggtctccagtatgaattctcttgtgtctagtaaacagaggagatactagatgcaagagaataacctggcggcagcgcaaaagatg

SEQ ID NO: 239094 - DNA, 103 bp, Artificial Sequence
  Synthetic Polynucleotide
taatacgactcactataggggaagggtttctctccagtatgaattctcttaacagaggagaaagagaatgcatactggaaacctggcggcagcgcaaaagatg

SEQ ID NO: 239095 - DNA, 103 bp, Artificial Sequence
  Synthetic Polynucleotide
taatacgactcactatagggcttcacatttgaagggtttctctccagtataacagaggagaatactgatgagaaaccctaacctggcggcagcgcaaaagatg

SEQ ID NO: 239096 - DNA, 103 bp, Artificial Sequence
  Synthetic Polynucleotide
taatacgactcactatagggttgccacattcttcacatttgaagggtttcaacagaggagagaaaccatgcaaatgtgaaacctggcggcagcgcaaaagatg

SEQ ID NO: 239097 - DNA, 103 bp, Artificial Sequence
  Synthetic Polynucleotide
taatacgactcactatagggcttaaaagctttgccacattcttcacatttaacagaggagaaaatgtatggaatgtggcaacctggcggcagcgcaaaagatg

SEQ ID NO: 239098 - DNA, 103 bp, Artificial Sequence
  Synthetic Polynucleotide
taatacgactcactatagggtctccttttcaaaataagagtaaactagaaaacagaggagattctagatgactcttattaacctggcggcagcgcaaaagatg

SEQ ID NO: 239099 - DNA, 103 bp, Artificial Sequence
  Synthetic Polynucleotide
taatacgactcactatagggttgaggactgcttaaaagctttgccacattaacagaggagaaatgtgatgaagcttttaaacctggcggcagcgcaaaagatg

SEQ ID NO: 239100 - DNA, 103 bp, Artificial Sequence
  Synthetic Polynucleotide
taatacgactcactataggggtagtaagggttgaggactgcttaaaagctaacagaggagaagctttatggcagtcctcaacctggcggcagcgcaaaagatg

SEQ ID NO: 239101 - DNA, 103 bp, Artificial Sequence
  Synthetic Polynucleotide
taatacgactcactatagggtatcttatgtgtagtaagggttgaggactgaacagaggagacagtccatgacccttactaacctggcggcagcgcaaaagatg

SEQ ID NO: 239102 - DNA, 103 bp, Artificial Sequence
  Synthetic Polynucleotide
taatacgactcactatagggcagtatgaattatcttatgtgtagtaagggaacagaggagacccttaatgcacataagaaacctggcggcagcgcaaaagatg

SEQ ID NO: 239103 - DNA, 103 bp, Artificial Sequence
  Synthetic Polynucleotide
taatacgactcactatagggggtttctccccagtatgaattatcttatgtaacagaggagaacataaatgaattcatacaacctggcggcagcgcaaaagatg

SEQ ID NO: 239104 - DNA, 103 bp, Artificial Sequence
  Synthetic Polynucleotide
taatacgactcactatagggacatctatatggtttctccccagtatgaataacagaggagaattcatatgggggagaaaaacctggcggcagcgcaaaagatg

SEQ ID NO: 239105 - DNA, 103 bp, Artificial Sequence
  Synthetic Polynucleotide
taatacgactcactatagggcacattcttcacatctatatggtttctcccaacagaggagagggagaatgcatatagataacctggcggcagcgcaaaagatg

SEQ ID NO: 239106 - DNA, 103 bp, Artificial Sequence
  Synthetic Polynucleotide
taatacgactcactatagggaaggctttgccacattcttcacatctatataacagaggagaatatagatgtgaagaatgaacctggcggcagcgcaaaagatg

SEQ ID NO: 239107 - DNA, 103 bp, Artificial Sequence
  Synthetic Polynucleotide
taatacgactcactatagggggaccggttgaaggctttgccacattcttcaacagaggagagaagaaatgggcaaagccaacctggcggcagcgcaaaagatg

SEQ ID NO: 239108 - DNA, 103 bp, Artificial Sequence
  Synthetic Polynucleotide
taatacgactcactatagggtaaggtgtgaggaccggttgaaggctttgcaacagaggagagcaaagatgtcaaccggtaacctggcggcagcgcaaaagatg

SEQ ID NO: 239109 - DNA, 103 bp, Artificial Sequence
  Synthetic Polynucleotide
taatacgactcactatagggaatgtcaatgtctccttttcaaaataagagaacagaggagactcttaatgtgaaaaggaaacctggcggcagcgcaaaagatg

SEQ ID NO: 239110 - DNA, 103 bp, Artificial Sequence
  Synthetic Polynucleotide
taatacgactcactatagggttatgtgtagtaaggtgtgaggaccggttgaacagaggagacaaccgatgctcacacctaacctggcggcagcgcaaaagatg

SEQ ID NO: 239111 - DNA, 103 bp, Artificial Sequence
  Synthetic Polynucleotide
taatacgactcactatagggatgaattatcttatgtgtagtaaggtgtgaaacagaggagatcacacatgactacacataacctggcggcagcgcaaaagatg

SEQ ID NO: 239112 - DNA, 103 bp, Artificial Sequence
  Synthetic Polynucleotide
taatacgactcactatagggtctctccagtatgaattatcttatgtgtagaacagaggagactacacatgagataattcaacctggcggcagcgcaaaagatg

SEQ ID NO: 239113 - DNA, 103 bp, Artificial Sequence
  Synthetic Polynucleotide
taatacgactcactatagggttgtagggcttctctccagtatgaattatcaacagaggagagataatatgtactggagaaacctggcggcagcgcaaaagatg

SEQ ID NO: 239114 - DNA, 103 bp, Artificial Sequence
  Synthetic Polynucleotide
taatacgactcactatagggttcttcacatttgtagggcttctctccagtaacagaggagaactggaatgaagccctacaacctggcggcagcgcaaaagatg

SEQ ID NO: 239115 - DNA, 103 bp, Artificial Sequence
  Synthetic Polynucleotide
taatacgactcactatagggctttgccacattcttcacatttgtagggctaacagaggagaagccctatgaatgtgaagaacctggcggcagcgcaaaagatg

SEQ ID NO: 239116 - DNA, 103 bp, Artificial Sequence
  Synthetic Polynucleotide
taatacgactcactatagggtggttaaaagctttgccacattcttcacataacagaggagaatgtgaatgatgtggcaaaacctggcggcagcgcaaaagatg

SEQ ID NO: 239117 - DNA, 103 bp, Artificial Sequence
  Synthetic Polynucleotide
taatacgactcactatagggggttgaagactggttaaaagctttgccacaaacagaggagatgtggcatggcttttaacaacctggcggcagcgcaaaagatg

SEQ ID NO: 239118 - DNA, 103 bp, Artificial Sequence
  Synthetic Polynucleotide
taatacgactcactataggggtgtactaagggttgaagactggttaaaagaacagaggagacttttaatgagtcttcaaaacctggcggcagcgcaaaagatg

SEQ ID NO: 239119 - DNA, 103 bp, Artificial Sequence
  Synthetic Polynucleotide
taatacgactcactatagggatgaacttatgtgtactaagggttgaagacaacagaggagagtcttcatgccttagtacaacctggcggcagcgcaaaagatg

SEQ ID NO: 239120 - DNA, 103 bp, Artificial Sequence
  Synthetic Polynucleotide
taatacgactcactatagggctgcagggtccaccctcttggggactccataacagaggagaatggagatgccaagagggaacctggcggcagcgcaaaagatg

SEQ ID NO: 239121 - DNA, 103 bp, Artificial Sequence
  Synthetic Polynucleotide
taatacgactcactatagggggccccccagcctccagacacagccccctcaacagaggagagaggggatggtgtctggaaacctggcggcagcgcaaaagatg

SEQ ID NO: 239122 - DNA, 103 bp, Artificial Sequence
  Synthetic Polynucleotide
taatacgactcactataggggacgaaagcctggccgcactcggcgcactcaacagaggagagagtgcatggagtgcggcaacctggcggcagcgcaaaagatg

SEQ ID NO: 239123 - DNA, 103 bp, Artificial Sequence
  Synthetic Polynucleotide
taatacgactcactatagggaggagcccatgacgaaagcctggccgcactaacagaggagaagtgcgatgaggctttcgaacctggcggcagcgcaaaagatg

SEQ ID NO: 239124 - DNA, 103 bp, Artificial Sequence
  Synthetic Polynucleotide
taatacgactcactatagggtccgccaggtaggagcccatgacgaaagccaacagaggagaggctttatgcatgggctcaacctggcggcagcgcaaaagatg

SEQ ID NO: 239125 - DNA, 103 bp, Artificial Sequence
  Synthetic Polynucleotide
taatacgactcactataggggcgccggtgctccgccaggtaggagcccataacagaggagaatgggcatgtacctggcgaacctggcggcagcgcaaaagatg

SEQ ID NO: 239126 - DNA, 103 bp, Artificial Sequence
  Synthetic Polynucleotide
taatacgactcactatagggccgtgtgcacgcgccggtgctccgccaggtaacagaggagaacctggatgagcaccggcaacctggcggcagcgcaaaagatg

SEQ ID NO: 239127 - DNA, 103 bp, Artificial Sequence
  Synthetic Polynucleotide
taatacgactcactatagggggcttctcgcccgtgtgcacgcgccggtgcaacagaggagagcaccgatgcgtgcacacaacctggcggcagcgcaaaagatg

SEQ ID NO: 239128 - DNA, 103 bp, Artificial Sequence
  Synthetic Polynucleotide
taatacgactcactataggggcacgcatgaggcttctcgcccgtgtgcacaacagaggagagtgcacatgggcgagaagaacctggcggcagcgcaaaagatg

SEQ ID NO: 239129 - DNA, 103 bp, Artificial Sequence
  Synthetic Polynucleotide
taatacgactcactatagggcgcactgggcgcacgcatgaggcttctcgcaacagaggagagcgagaatgctcatgcgtaacctggcggcagcgcaaaagatg

SEQ ID NO: 239130 - DNA, 103 bp, Artificial Sequence
  Synthetic Polynucleotide
taatacgactcactatagggaaggccttgccgcactgggcgcacgcatgaaacagaggagatcatgcatgcgcccagtgaacctggcggcagcgcaaaagatg

SEQ ID NO: 239131 - DNA, 103 bp, Artificial Sequence
  Synthetic Polynucleotide
taatacgactcactataggggcgctggctgaaggccttgccgcactgggcaacagaggagagcccagatgggcaaggccaacctggcggcagcgcaaaagatg

SEQ ID NO: 239132 - DNA, 103 bp, Artificial Sequence
  Synthetic Polynucleotide
taatacgactcactatagggagttttcccaggccccccagcctccagacaaacagaggagatgtctgatggctggggggaacctggcggcagcgcaaaagatg

SEQ ID NO: 239133 - DNA, 103 bp, Artificial Sequence
  Synthetic Polynucleotide
taatacgactcactataggggtaggttggagcgctggctgaaggccttgcaacagaggagagcaaggatgtcagccagcaacctggcggcagcgcaaaagatg

SEQ ID NO: 239134 - DNA, 103 bp, Artificial Sequence
  Synthetic Polynucleotide
taatacgactcactatagggcggtggctcagtaggttggagcgctggctgaacagaggagacagccaatgctccaacctaacctggcggcagcgcaaaagatg

SEQ ID NO: 239135 - DNA, 103 bp, Artificial Sequence
  Synthetic Polynucleotide
taatacgactcactataggggtgcgtgcgccggtggctcagtaggttggaaacagaggagatccaacatgctgagccacaacctggcggcagcgcaaaagatg

SEQ ID NO: 239136 - DNA, 103 bp, Artificial Sequence
  Synthetic Polynucleotide
taatacgactcactatagggtggcgcccgagtgcgtgcgccggtggctcaaacagaggagatgagccatgggcgcacgcaacctggcggcagcgcaaaagatg

SEQ ID NO: 239137 - DNA, 103 bp, Artificial Sequence
  Synthetic Polynucleotide
taatacgactcactataggggcgaagggcttggcgcccgagtgcgtgcgcaacagaggagagcgcacatgctcgggcgcaacctggcggcagcgcaaaagatg

SEQ ID NO: 239138 - DNA, 103 bp, Artificial Sequence
  Synthetic Polynucleotide
taatacgactcactataggggtcggcgcaggcgaagggcttggcgcccgaaacagaggagatcgggcatgaagcccttcaacctggcggcagcgcaaaagatg

SEQ ID NO: 239139 - DNA, 103 bp, Artificial Sequence
  Synthetic Polynucleotide
taatacgactcactatagggccttgccgcagtcggcgcaggcgaagggctaacagaggagaagccctatgcctgcgccgaacctggcggcagcgcaaaagatg

SEQ ID NO: 239140 - DNA, 103 bp, Artificial Sequence
  Synthetic Polynucleotide
taatacgactcactatagggccgcggaaggccttgccgcagtcggcgcagaacagaggagactgcgcatgctgcggcaaaacctggcggcagcgcaaaagatg

SEQ ID NO: 239141 - DNA, 103 bp, Artificial Sequence
  Synthetic Polynucleotide
taatacgactcactataggggccggaactgccgcggaaggccttgccgcaaacagaggagatgcggcatggccttccgcaacctggcggcagcgcaaaagatg

SEQ ID NO: 239142 - DNA, 103 bp, Artificial Sequence
  Synthetic Polynucleotide
taatacgactcactatagggggtgcgccaggccggaactgccgcggaaggaacagaggagaccttccatggcagttccgaacctggcggcagcgcaaaagatg

SEQ ID NO: 239143 - DNA, 103 bp, Artificial Sequence
  Synthetic Polynucleotide
taatacgactcactatagggacctccgtggagttttcccaggccccccagaacagaggagactggggatgctgggaaaaaacctggcggcagcgcaaaagatg

SEQ ID NO: 239144 - DNA, 103 bp, Artificial Sequence
  Synthetic Polynucleotide
taatacgactcactataggggaaagccggtggtgcgccaggccggaactgaacagaggagacagttcatgcctggcgcaaacctggcggcagcgcaaaagatg

SEQ ID NO: 239145 - DNA, 103 bp, Artificial Sequence
  Synthetic Polynucleotide
taatacgactcactatagggtcccgtgtgcgaaagccggtggtgcgccagaacagaggagactggcgatgcaccggcttaacctggcggcagcgcaaaagatg

SEQ ID NO: 239146 - DNA, 103 bp, Artificial Sequence
  Synthetic Polynucleotide
taatacgactcactatagggagggtcgctctcccgtgtgcgaaagccggtaacagaggagaaccggcatgcgcacacggaacctggcggcagcgcaaaagatg

SEQ ID NO: 239147 - DNA, 103 bp, Artificial Sequence
  Synthetic Polynucleotide
taatacgactcactataggggcgcaggcgaagggtcgctctcccgtgtgcaacagaggagagcacacatgagagcgaccaacctggcggcagcgcaaaagatg

SEQ ID NO: 239148 - DNA, 103 bp, Artificial Sequence
  Synthetic Polynucleotide
taatacgactcactataggggccgcattctgcgcaggcgaagggtcgctcaacagaggagagagcgaatgttcgcctgcaacctggcggcagcgcaaaagatg

SEQ ID NO: 239149 - DNA, 103 bp, Artificial Sequence
  Synthetic Polynucleotide
taatacgactcactatagggggaaggccttgccgcattctgcgcaggcgaaacagaggagatcgcctatgcagaatgcgaacctggcggcagcgcaaaagatg

SEQ ID NO: 239150 - DNA, 103 bp, Artificial Sequence
  Synthetic Polynucleotide
taatacgactcactataggggagctgccgcggaaggccttgccgcattctaacagaggagaagaatgatgcaaggccttaacctggcggcagcgcaaaagatg

SEQ ID NO: 239151 - DNA, 103 bp, Artificial Sequence
  Synthetic Polynucleotide
taatacgactcactataggggcgcagctcggagctgccgcggaaggccttaacagaggagaaaggccatgcgcggcagcaacctggcggcagcgcaaaagatg

SEQ ID NO: 239152 - DNA, 103 bp, Artificial Sequence
  Synthetic Polynucleotide
taatacgactcactataggggctggtgctggcgcagctcggagctgccgcaacagaggagagcggcaatgccgagctgcaacctggcggcagcgcaaaagatg

SEQ ID NO: 239153 - DNA, 103 bp, Artificial Sequence
  Synthetic Polynucleotide
taatacgactcactataggggagtgcaggcgctggtgctggcgcagctcgaacagaggagacgagctatgccagcaccaaacctggcggcagcgcaaaagatg

SEQ ID NO: 239154 - DNA, 103 bp, Artificial Sequence
  Synthetic Polynucleotide
taatacgactcactatagggctccctcggaacctccgtggagttttcccaaacagaggagatgggaaatgtccacggagaacctggcggcagcgcaaaagatg

SEQ ID NO: 239155 - DNA, 103 bp, Artificial Sequence
  Synthetic Polynucleotide
taatacgactcactatagggcctctcgccagagtgcaggcgctggtgctgaacagaggagacagcacatgcgcctgcacaacctggcggcagcgcaaaagatg

SEQ ID NO: 239156 - DNA, 103 bp, Artificial Sequence
  Synthetic Polynucleotide
taatacgactcactatagggagacgaacggcctctcgccagagtgcaggcaacagaggagagcctgcatgctggcgagaaacctggcggcagcgcaaaagatg

SEQ ID NO: 239157 - DNA, 103 bp, Artificial Sequence
  Synthetic Polynucleotide
taatacgactcactatagggcagtgggcgcagacgaacggcctctcgccaaacagaggagatggcgaatggccgttcgtaacctggcggcagcgcaaaagatg

SEQ ID NO: 239158 - DNA, 103 bp, Artificial Sequence
  Synthetic Polynucleotide
taatacgactcactatagggggccttgctgcagtgggcgcagacgaacggaacagaggagaccgttcatgtgcgcccacaacctggcggcagcgcaaaagatg

SEQ ID NO: 239159 - DNA, 103 bp, Artificial Sequence
  Synthetic Polynucleotide
taatacgactcactatagggtgcgcacgaaggccttgctgcagtgggcgcaacagaggagagcgcccatggcagcaaggaacctggcggcagcgcaaaagatg

SEQ ID NO: 239160 - DNA, 103 bp, Artificial Sequence
  Synthetic Polynucleotide
taatacgactcactatagggagctccgacttgcgcacgaaggccttgctgaacagaggagacagcaaatgcttcgtgcgaacctggcggcagcgcaaaagatg

SEQ ID NO: 239161 - DNA, 103 bp, Artificial Sequence
  Synthetic Polynucleotide
taatacgactcactataggggtggcttaagagctccgacttgcgcacgaaaacagaggagattcgtgatgaagtcggagaacctggcggcagcgcaaaagatg

SEQ ID NO: 239162 - DNA, 103 bp, Artificial Sequence
  Synthetic Polynucleotide
taatacgactcactataggggcgtgcgccggtggcttaagagctccgactaacagaggagaagtcggatgtcttaagccaacctggcggcagcgcaaaagatg

SEQ ID NO: 239163 - DNA, 103 bp, Artificial Sequence
  Synthetic Polynucleotide
taatacgactcactatagggtcgcccgtgtgcgtgcgccggtggcttaagaacagaggagacttaagatgccggcgcacaacctggcggcagcgcaaaagatg

SEQ ID NO: 239164 - DNA, 103 bp, Artificial Sequence
  Synthetic Polynucleotide
taatacgactcactataggggtagggcctctcgcccgtgtgcgtgcgccgaacagaggagacggcgcatgcacacgggcaacctggcggcagcgcaaaagatg

SEQ ID NO: 239165 - DNA, 103 bp, Artificial Sequence
  Synthetic Polynucleotide
taatacgactcactatagggcgtcccctgcctccctcggaacctccgtggaacagaggagaccacggatgttccgagggaacctggcggcagcgcaaaagatg

SEQ ID NO: 239166 - DNA, 103 bp, Artificial Sequence
  Synthetic Polynucleotide
taatacgactcactatagggcgccgcaagcgtagggcctctcgcccgtgtaacagaggagaacacggatgagaggccctaacctggcggcagcgcaaaagatg

SEQ ID NO: 239167 - DNA, 103 bp, Artificial Sequence
  Synthetic Polynucleotide
taatacgactcactatagggttcccgcactcgccgcaagcgtagggcctcaacagaggagagaggccatgcgcttgcggaacctggcggcagcgcaaaagatg

SEQ ID NO: 239168 - DNA, 103 bp, Artificial Sequence
  Synthetic Polynucleotide
taatacgactcactataggggctgaaaggcttcccgcactcgccgcaagcaacagaggagagcttgcatggagtgcgggaacctggcggcagcgcaaaagatg

SEQ ID NO: 239169 - DNA, 103 bp, Artificial Sequence
  Synthetic Polynucleotide
taatacgactcactatagggtgcaacggtggctgaaaggcttcccgcactaacagaggagaagtgcgatgagcctttcaaacctggcggcagcgcaaaagatg

SEQ ID NO: 239170 - DNA, 103 bp, Artificial Sequence
  Synthetic Polynucleotide
taatacgactcactatagggtcgttgaggttgcaacggtggctgaaaggcaacagaggagagcctttatgccaccgttgaacctggcggcagcgcaaaagatg

SEQ ID NO: 239171 - DNA, 103 bp, Artificial Sequence
  Synthetic Polynucleotide
taatacgactcactatagggcttctggtgctcgttgaggttgcaacggtgaacagaggagacaccgtatgaacctcaacaacctggcggcagcgcaaaagatg

SEQ ID NO: 239172 - DNA, 103 bp, Artificial Sequence
  Synthetic Polynucleotide
taatacgactcactatagggccccgtgccgcttctggtgctcgttgaggtaacagaggagaacctcaatgagcaccagaaacctggcggcagcgcaaaagatg

SEQ ID NO: 239173 - DNA, 103 bp, Artificial Sequence
  Synthetic Polynucleotide
taatacgactcactataggggcagcgcggcccccgtgccgcttctggtgcaacagaggagagcaccaatggcggcacggaacctggcggcagcgcaaaagatg

SEQ ID NO: 239174 - DNA, 103 bp, Artificial Sequence
  Synthetic Polynucleotide
taatacgactcactatagggtgccgctggccgtcccctgcctccctcggaaacagaggagatccgagatgggcaggggaaacctggcggcagcgcaaaagatg

SEQ ID NO: 239175 - DNA, 103 bp, Artificial Sequence
  Synthetic Polynucleotide
taatacgactcactatagggtgtggcttgctgccgctggccgtcccctgcaacagaggagagcagggatgggccagcggaacctggcggcagcgcaaaagatg

SEQ ID NO: 239176 - DNA, 103 bp, Artificial Sequence
  Synthetic Polynucleotide
taatacgactcactatagggccgcccccagtgtggcttgctgccgctggcaacagaggagagccagcatgagcaagccaaacctggcggcagcgcaaaagatg

SEQ ID NO: 239177 - DNA, 103 bp, Artificial Sequence
  Synthetic Polynucleotide
taatacgactcactatagggtgttcgtccgccgcccccagtgtggcttgcaacagaggagagcaagcatgactgggggcaacctggcggcagcgcaaaagatg

SEQ ID NO: 239178 - DNA, 103 bp, Artificial Sequence
  Synthetic Polynucleotide
taatacgactcactatagggggggcctccctgttcgtccgccgcccccagaacagaggagactggggatggcggacgaaaacctggcggcagcgcaaaagatg

SEQ ID NO: 239179 - DNA, 103 bp, Artificial Sequence
  Synthetic Polynucleotide
taatacgactcactatagggctggggccacctgcagggtccaccctcttgaacagaggagacaagagatgggaccctgcaacctggcggcagcgcaaaagatg

SEQ ID NO: 239180 - DNA, 103 bp, Artificial Sequence
  Synthetic Polynucleotide
taatacgactcactataggggctccctgccggggcctccctgttcgtccgaacagaggagacggacgatgagggaggccaacctggcggcagcgcaaaagatg

SEQ ID NO: 239181 - DNA, 103 bp, Artificial Sequence
  Synthetic Polynucleotide
taatacgactcactataggggcggggcccagctccctgccggggcctcccaacagaggagagggaggatgcggcagggaaacctggcggcagcgcaaaagatg

SEQ ID NO: 239182 - DNA, 103 bp, Artificial Sequence
  Synthetic Polynucleotide
taatacgactcactatagggcccaccgtctgcggggcccagctccctgccaacagaggagaggcaggatgctgggccccaacctggcggcagcgcaaaagatg

SEQ ID NO: 239183 - DNA, 103 bp, Artificial Sequence
  Synthetic Polynucleotide
taatacgactcactatagggccccgtcccgcccaccgtctgcggggcccaaacagaggagatgggccatgcagacggtgaacctggcggcagcgcaaaagatg

SEQ ID NO: 239184 - DNA, 103 bp, Artificial Sequence
  Synthetic Polynucleotide
taatacgactcactatagggctgggcccagccccgtcccgcccaccgtctaacagaggagaagacggatggcgggacggaacctggcggcagcgcaaaagatg

SEQ ID NO: 239185 - DNA, 103 bp, Artificial Sequence
  Synthetic Polynucleotide
taatacgactcactatagggaggctcgctcctgggcccagccccgtcccgaacagaggagacgggacatggctgggcccaacctggcggcagcgcaaaagatg

SEQ ID NO: 239186 - DNA, 103 bp, Artificial Sequence
  Synthetic Polynucleotide
taatacgactcactatagggcccggtctgcaggctcgctcctgggcccagaacagaggagactgggcatgggagcgagcaacctggcggcagcgcaaaagatg

SEQ ID NO: 239187 - DNA, 103 bp, Artificial Sequence
  Synthetic Polynucleotide
taatacgactcactataggggggcgcaacgcccggtctgcaggctcgctcaacagaggagagagcgaatgtgcagaccgaacctggcggcagcgcaaaagatg

SEQ ID NO: 239188 - DNA, 103 bp, Artificial Sequence
  Synthetic Polynucleotide
taatacgactcactataggggagaggcgaagggcgcaacgcccggtctgcaacagaggagagcagacatggcgttgcgcaacctggcggcagcgcaaaagatg

SEQ ID NO: 239189 - DNA, 103 bp, Artificial Sequence
  Synthetic Polynucleotide
taatacgactcactataggggctcctctgggagaggcgaagggcgcaacgaacagaggagacgttgcatgcttcgcctcaacctggcggcagcgcaaaagatg

SEQ ID NO: 239190 - DNA, 103 bp, Artificial Sequence
  Synthetic Polynucleotide
taatacgactcactatagggtggccttcctctggggccacctgcagggtcaacagaggagagaccctatgggtggccccaacctggcggcagcgcaaaagatg

SEQ ID NO: 239191 - DNA, 103 bp, Artificial Sequence
  Synthetic Polynucleotide
taatacgactcactatagggcggcagcccggctcctctgggagaggcgaaaacagaggagattcgccatgcccagaggaaacctggcggcagcgcaaaagatg

SEQ ID NO: 239192 - DNA, 103 bp, Artificial Sequence
  Synthetic Polynucleotide
taatacgactcactatagggctccccgcaccggcagcccggctcctctggaacagaggagaccagagatgccgggctgcaacctggcggcagcgcaaaagatg

SEQ ID NO: 239193 - DNA, 103 bp, Artificial Sequence
  Synthetic Polynucleotide
taatacgactcactatagggccttgccgcactccccgcaccggcagcccgaacagaggagacgggctatgggtgcggggaacctggcggcagcgcaaaagatg

SEQ ID NO: 239194 - DNA, 103 bp, Artificial Sequence
  Synthetic Polynucleotide
taatacgactcactatagggtggctgaacgccttgccgcactccccgcacaacagaggagagtgcggatggtgcggcaaaacctggcggcagcgcaaaagatg

SEQ ID NO: 239195 - DNA, 103 bp, Artificial Sequence
  Synthetic Polynucleotide
taatacgactcactataggggtaagagccctggctgaacgccttgccgcaaacagaggagatgcggcatggcgttcagcaacctggcggcagcgcaaaagatg

SEQ ID NO: 239196 - DNA, 103 bp, Artificial Sequence
  Synthetic Polynucleotide
taatacgactcactataggggctgcagcaagtaagagccctggctgaacgaacagaggagacgttcaatgagggctcttaacctggcggcagcgcaaaagatg

SEQ ID NO: 239197 - DNA, 103 bp, Artificial Sequence
  Synthetic Polynucleotide
taatacgactcactatagggacgcgccgatgctgcagcaagtaagagcccaacagaggagagggctcatgcttgctgcaaacctggcggcagcgcaaaagatg

SEQ ID NO: 239198 - DNA, 103 bp, Artificial Sequence
  Synthetic Polynucleotide
taatacgactcactataggggcctgtgtgcacgcgccgatgctgcagcaaaacagaggagattgctgatgcatcggcgcaacctggcggcagcgcaaaagatg

SEQ ID NO: 239199 - DNA, 103 bp, Artificial Sequence
  Synthetic Polynucleotide
taatacgactcactatagggacggcttctcgcctgtgtgcacgcgccgataacagaggagaatcggcatgtgcacacagaacctggcggcagcgcaaaagatg

SEQ ID NO: 239200 - DNA, 103 bp, Artificial Sequence
  Synthetic Polynucleotide
taatacgactcactataggggggcacgtgtacggcttctcgcctgtgtgcaacagaggagagcacacatgcgagaagccaacctggcggcagcgcaaaagatg

SEQ ID NO: 239201 - DNA, 103 bp, Artificial Sequence
  Synthetic Polynucleotide
taatacgactcactataggggcagaggacctggccttcctctggggccacaacagaggagagtggccatggaggaaggcaacctggcggcagcgcaaaagatg

SEQ ID NO: 239202 - DNA, 103 bp, Artificial Sequence
  Synthetic Polynucleotide
taatacgactcactataggggccgcactcggggcacgtgtacggcttctcaacagaggagagagaagatgtacacgtgcaacctggcggcagcgcaaaagatg

SEQ ID NO: 239203 - DNA, 103 bp, Artificial Sequence
  Synthetic Polynucleotide
taatacgactcactatagggcgaaggccttgccgcactcggggcacgtgtaacagaggagaacacgtatgccgagtgcgaacctggcggcagcgcaaaagatg

SEQ ID NO: 239204 - DNA, 103 bp, Artificial Sequence
  Synthetic Polynucleotide
taatacgactcactataggggagctccaggcgaaggccttgccgcactcgaacagaggagacgagtgatgcaaggccttaacctggcggcagcgcaaaagatg

SEQ ID NO: 239205 - DNA, 103 bp, Artificial Sequence
  Synthetic Polynucleotide
taatacgactcactataggggctgaggttggagctccaggcgaaggccttaacagaggagaaaggccatggcctggagcaacctggcggcagcgcaaaagatg

SEQ ID NO: 239206 - DNA, 103 bp, Artificial Sequence
  Synthetic Polynucleotide
taatacgactcactataggggctggtgctggctgaggttggagctccaggaacagaggagacctggaatgccaacctcaaacctggcggcagcgcaaaagatg

SEQ ID NO: 239207 - DNA, 103 bp, Artificial Sequence
  Synthetic Polynucleotide
taatacgactcactatagggctgtggatgcgctggtgctggctgaggttgaacagaggagacaacctatgccagcaccaaacctggcggcagcgcaaaagatg

SEQ ID NO: 239208 - DNA, 103 bp, Artificial Sequence
  Synthetic Polynucleotide
taatacgactcactatagggcttctcgccgctgtggatgcgctggtgctgaacagaggagacagcacatgcgcatccacaacctggcggcagcgcaaaagatg

SEQ ID NO: 239209 - DNA, 103 bp, Artificial Sequence
  Synthetic Polynucleotide
taatacgactcactatagggaagcgtagggcttctcgccgctgtggatgcaacagaggagagcatccatggcggcgagaaacctggcggcagcgcaaaagatg

SEQ ID NO: 239210 - DNA, 103 bp, Artificial Sequence
  Synthetic Polynucleotide
taatacgactcactatagggcactccctgcaagcgtagggcttctcgccgaacagaggagacggcgaatggccctacgcaacctggcggcagcgcaaaagatg

SEQ ID NO: 239211 - DNA, 103 bp, Artificial Sequence
  Synthetic Polynucleotide
taatacgactcactatagggggccttgccgcactccctgcaagcgtagggaacagaggagaccctacatgtgcagggagaacctggcggcagcgcaaaagatg

SEQ ID NO: 239212 - DNA, 103 bp, Artificial Sequence
  Synthetic Polynucleotide
taatacgactcactatagggtcttcacattgcagaggacctggccttcctaacagaggagaaggaagatgaggtcctctaacctggcggcagcgcaaaagatg

SEQ ID NO: 239213 - DNA, 103 bp, Artificial Sequence
  Synthetic Polynucleotide
taatacgactcactataggggcgcgcggaaggccttgccgcactccctgcaacagaggagagcagggatggcggcaaggaacctggcggcagcgcaaaagatg

SEQ ID NO: 239214 - DNA, 103 bp, Artificial Sequence
  Synthetic Polynucleotide
taatacgactcactatagggagctgcgagtgcgcgcggaaggccttgccgaacagaggagacggcaaatgcttccgcgcaacctggcggcagcgcaaaagatg

SEQ ID NO: 239215 - DNA, 103 bp, Artificial Sequence
  Synthetic Polynucleotide
taatacgactcactataggggtggtggatgagctgcgagtgcgcgcggaaaacagaggagattccgcatgcactcgcagaacctggcggcagcgcaaaagatg

SEQ ID NO: 239216 - DNA, 103 bp, Artificial Sequence
  Synthetic Polynucleotide
taatacgactcactataggggtgtctcctggtggtggatgagctgcgagtaacagaggagaactcgcatgtcatccaccaacctggcggcagcgcaaaagatg

SEQ ID NO: 239217 - DNA, 103 bp, Artificial Sequence
  Synthetic Polynucleotide
taatacgactcactatagggaggccgctgtgtgtctcctggtggtggatgaacagaggagacatccaatgccaggagacaacctggcggcagcgcaaaagatg

SEQ ID NO: 239218 - DNA, 103 bp, Artificial Sequence
  Synthetic Polynucleotide
taatacgactcactataggggaagggcttcaggccgctgtgtgtctcctgaacagaggagacaggagatgcacagcggcaacctggcggcagcgcaaaagatg

SEQ ID NO: 239219 - DNA, 103 bp, Artificial Sequence
  Synthetic Polynucleotide
taatacgactcactatagggccgggcagcggaagggcttcaggccgctgtaacagaggagaacagcgatgtgaagccctaacctggcggcagcgcaaaagatg

SEQ ID NO: 239220 - DNA, 103 bp, Artificial Sequence
  Synthetic Polynucleotide
taatacgactcactatagggttgccgcagtccgggcagcggaagggcttcaacagaggagagaagccatgccgctgcccaacctggcggcagcgcaaaagatg

SEQ ID NO: 239221 - DNA, 103 bp, Artificial Sequence
  Synthetic Polynucleotide
taatacgactcactataggggccgaaggacttgccgcagtccgggcagcgaacagaggagacgctgcatggactgcggcaacctggcggcagcgcaaaagatg

SEQ ID NO: 239222 - DNA, 103 bp, Artificial Sequence
  Synthetic Polynucleotide
taatacgactcactatagggtggtgcttcggccgaaggacttgccgcagtaacagaggagaactgcgatgagtccttcgaacctggcggcagcgcaaaagatg

SEQ ID NO: 239223 - DNA, 103 bp, Artificial Sequence
  Synthetic Polynucleotide
taatacgactcactatagggctcgtggcagtcttcacattgcagaggaccaacagaggagaggtcctatgcaatgtgaaaacctggcggcagcgcaaaagatg

SEQ ID NO: 239224 - DNA, 103 bp, Artificial Sequence
  Synthetic Polynucleotide
taatacgactcactatagggtgcaccagcgtggtgcttcggccgaaggacaacagaggagagtccttatgccgaagcacaacctggcggcagcgcaaaagatg

SEQ ID NO: 239225 - DNA, 103 bp, Artificial Sequence
  Synthetic Polynucleotide
taatacgactcactataggggcgtcggtgctgcaccagcgtggtgcttcgaacagaggagacgaagcatgacgctggtgaacctggcggcagcgcaaaagatg

SEQ ID NO: 239226 - DNA, 103 bp, Artificial Sequence
  Synthetic Polynucleotide
taatacgactcactatagggccgtgtgcgtgcgtcggtgctgcaccagcgaacagaggagacgctggatgagcaccgacaacctggcggcagcgcaaaagatg

SEQ ID NO: 239227 - DNA, 103 bp, Artificial Sequence
  Synthetic Polynucleotide
taatacgactcactatagggggcttctcgcccgtgtgcgtgcgtcggtgcaacagaggagagcaccgatgcacgcacacaacctggcggcagcgcaaaagatg

SEQ ID NO: 239228 - DNA, 103 bp, Artificial Sequence
  Synthetic Polynucleotide
taatacgactcactataggggcactcgtagggcttctcgcccgtgtgcgtaacagaggagaacgcacatgggcgagaagaacctggcggcagcgcaaaagatg

SEQ ID NO: 239229 - DNA, 103 bp, Artificial Sequence
  Synthetic Polynucleotide
taatacgactcactatagggcgcactccgggcactcgtagggcttctcgcaacagaggagagcgagaatgcctacgagtaacctggcggcagcgcaaaagatg

SEQ ID NO: 239230 - DNA, 103 bp, Artificial Sequence
  Synthetic Polynucleotide
taatacgactcactatagggaaggccttgccgcactccgggcactcgtagaacagaggagactacgaatgcccggagtgaacctggcggcagcgcaaaagatg

SEQ ID NO: 239231 - DNA, 103 bp, Artificial Sequence
  Synthetic Polynucleotide
taatacgactcactataggggttccagctgaaggccttgccgcactccggaacagaggagaccggagatgggcaaggccaacctggcggcagcgcaaaagatg

SEQ ID NO: 239232 - DNA, 103 bp, Artificial Sequence
  Synthetic Polynucleotide
taatacgactcactatagggggaaattggagttccagctgaaggccttgcaacagaggagagcaaggatgtcagctggaaacctggcggcagcgcaaaagatg

SEQ ID NO: 239233 - DNA, 103 bp, Artificial Sequence
  Synthetic Polynucleotide
taatacgactcactatagggcggtgctccaggaaattggagttccagctgaacagaggagacagctgatgctccaatttaacctggcggcagcgcaaaagatg

SEQ ID NO: 239234 - DNA, 103 bp, Artificial Sequence
  Synthetic Polynucleotide
taatacgactcactatagggagagaggcccctcgtggcagtcttcacattaacagaggagaaatgtgatgactgccacgaacctggcggcagcgcaaaagatg

SEQ ID NO: 239235 - DNA, 103 bp, Artificial Sequence
  Synthetic Polynucleotide
taatacgactcactataggggtgcacgcgccggtgctccaggaaattggaaacagaggagatccaatatgctggagcacaacctggcggcagcgcaaaagatg

SEQ ID NO: 239236 - DNA, 103 bp, Artificial Sequence
  Synthetic Polynucleotide
taatacgactcactataggggcgcgcccgtgtgcacgcgccggtgctccaaacagaggagatggagcatgggcgcgtgcaacctggcggcagcgcaaaagatg

SEQ ID NO: 239237 - DNA, 103 bp, Artificial Sequence
  Synthetic Polynucleotide
taatacgactcactataggggcgtgcggccgcgcgcccgtgtgcacgcgcaacagaggagagcgcgtatgcacgggcgcaacctggcggcagcgcaaaagatg

SEQ ID NO: 239238 - DNA, 103 bp, Artificial Sequence
  Synthetic Polynucleotide
taatacgactcactataggggtcccggcaggcgtgcggccgcgcgcccgtaacagaggagaacgggcatgcggccgcacaacctggcggcagcgcaaaagatg

SEQ ID NO: 239239 - DNA, 103 bp, Artificial Sequence
  Synthetic Polynucleotide
taatacgactcactatagggccttgccacagtcccggcaggcgtgcggccaacagaggagaggccgcatgcctgccgggaacctggcggcagcgcaaaagatg

SEQ ID NO: 239240 - DNA, 103 bp, Artificial Sequence
  Synthetic Polynucleotide
taatacgactcactatagggtggctgaaggccttgccacagtcccggcagaacagaggagactgccgatgctgtggcaaaacctggcggcagcgcaaaagatg

SEQ ID NO: 239241 - DNA, 103 bp, Artificial Sequence
  Synthetic Polynucleotide
taatacgactcactataggggttggagctctggctgaaggccttgccacaaacagaggagatgtggcatggccttcagcaacctggcggcagcgcaaaagatg

SEQ ID NO: 239242 - DNA, 103 bp, Artificial Sequence
  Synthetic Polynucleotide
taatacgactcactataggggctcggccaggttggagctctggctgaaggaacagaggagaccttcaatgagagctccaaacctggcggcagcgcaaaagatg

SEQ ID NO: 239243 - DNA, 103 bp, Artificial Sequence
  Synthetic Polynucleotide
taatacgactcactatagggatcttcaggtgctcggccaggttggagctcaacagaggagagagctcatgcctggccgaaacctggcggcagcgcaaaagatg

SEQ ID NO: 239244 - DNA, 103 bp, Artificial Sequence
  Synthetic Polynucleotide
taatacgactcactataggggcccgcgtggatcttcaggtgctcggccagaacagaggagactggccatgcacctgaagaacctggcggcagcgcaaaagatg

SEQ ID NO: 239245 - DNA, 103 bp, Artificial Sequence
  Synthetic Polynucleotide
taatacgactcactatagggcagccccctcagagaggcccctcgtggcagaacagaggagactgccaatgggggcctctaacctggcggcagcgcaaaagatg

SEQ ID NO: 239246 - DNA, 103 bp, Artificial Sequence
  Synthetic Polynucleotide
taatacgactcactataggggtggccgtgcgcccgcgtggatcttcaggtaacagaggagaacctgaatgtccacgcggaacctggcggcagcgcaaaagatg

SEQ ID NO: 239247 - DNA, 103 bp, Artificial Sequence
  Synthetic Polynucleotide
taatacgactcactatagggggacaggcgtgtggccgtgcgcccgcgtggaacagaggagaccacgcatgcgcacggccaacctggcggcagcgcaaaagatg

SEQ ID NO: 239248 - DNA, 103 bp, Artificial Sequence
  Synthetic Polynucleotide
taatacgactcactataggggccgcagtcgggacaggcgtgtggccgtgcaacagaggagagcacggatgcacgcctgtaacctggcggcagcgcaaaagatg

SEQ ID NO: 239249 - DNA, 103 bp, Artificial Sequence
  Synthetic Polynucleotide
taatacgactcactatagggcgaaggccttgccgcagtcgggacaggcgtaacagaggagaacgcctatgccgactgcgaacctggcggcagcgcaaaagatg

SEQ ID NO: 239250 - DNA, 103 bp, Artificial Sequence
  Synthetic Polynucleotide
taatacgactcactataggggccacacgcacgaaggccttgccgcagtcgaacagaggagacgactgatgcaaggccttaacctggcggcagcgcaaaagatg

SEQ ID NO: 239251 - DNA, 103 bp, Artificial Sequence
  Synthetic Polynucleotide
taatacgactcactatagggccgcagccccgccacacgcacgaaggccttaacagaggagaaaggccatggtgcgtgtgaacctggcggcagcgcaaaagatg

SEQ ID NO: 239252 - DNA, 103 bp, Artificial Sequence
  Synthetic Polynucleotide
taatacgactcactataggggccggtgctgccgcagccccgccacacgcaaacagaggagatgcgtgatgcggggctgcaacctggcggcagcgcaaaagatg

SEQ ID NO: 239253 - DNA, 103 bp, Artificial Sequence
  Synthetic Polynucleotide
taatacgactcactatagggctgtgcgtgcgccggtgctgccgcagccccaacagaggagaggggctatggcagcaccgaacctggcggcagcgcaaaagatg

SEQ ID NO: 239254 - DNA, 103 bp, Artificial Sequence
  Synthetic Polynucleotide
taatacgactcactatagggcttctcgctgctgtgcgtgcgccggtgctgaacagaggagacagcacatgcgcacgcacaacctggcggcagcgcaaaagatg

SEQ ID NO: 239255 - DNA, 103 bp, Artificial Sequence
  Synthetic Polynucleotide
taatacgactcactatagggaggggaagggcttctcgctgctgtgcgtgcaacagaggagagcacgcatggcagcgagaaacctggcggcagcgcaaaagatg

SEQ ID NO: 239256 - DNA, 103 bp, Artificial Sequence
  Synthetic Polynucleotide
taatacgactcactatagggcctccagacacagccccctcagagaggcccaacagaggagagggcctatgtgagggggcaacctggcggcagcgcaaaagatg

SEQ ID NO: 239257 - DNA, 103 bp, Artificial Sequence
  Synthetic Polynucleotide
taatacgactcactatagggcactcggcgcaggggaagggcttctcgctgaacagaggagacagcgaatggcccttcccaacctggcggcagcgcaaaagatg

SEQ ID NO: 239258 - DNA, 103 bp, Artificial Sequence
  Synthetic Polynucleotide
taatacgactcactatagggagcctttccgcactcggcgcaggggaagggaacagaggagacccttcatgtgcgccgagaacctggcggcagcgcaaaagatg

SEQ ID NO: 239259 - DNA, 103 bp, Artificial Sequence
  Synthetic Polynucleotide
taatacgactcactatagggtctcgcggaaagcctttccgcactcggcgcaacagaggagagcgccgatggcggaaaggaacctggcggcagcgcaaaagatg

SEQ ID NO: 239260 - DNA, 103 bp, Artificial Sequence
  Synthetic Polynucleotide
taatacgactcactatagggagctgcgagctctcgcggaaagcctttccgaacagaggagacggaaaatgtttccgcgaaacctggcggcagcgcaaaagatg

SEQ ID NO: 239261 - DNA, 103 bp, Artificial Sequence
  Synthetic Polynucleotide
taatacgactcactataggggtgctgcaggagctgcgagctctcgcggaaaacagaggagattccgcatgagctcgcagaacctggcggcagcgcaaaagatg

SEQ ID NO: 239262 - DNA, 103 bp, Artificial Sequence
  Synthetic Polynucleotide
taatacgactcactataggggcgtgcgctggtgctgcaggagctgcgagcaacagaggagagctcgcatgtcctgcagcaacctggcggcagcgcaaaagatg

SEQ ID NO: 239263 - DNA, 103 bp, Artificial Sequence
  Synthetic Polynucleotide
taatacgactcactatagggtcaccagtgtgcgtgcgctggtgctgcaggaacagaggagacctgcaatgccagcgcacaacctggcggcagcgcaaaagatg

SEQ ID NO: 239264 - DNA, 103 bp, Artificial Sequence
  Synthetic Polynucleotide
taatacgactcactataggggaagggccgctcaccagtgtgcgtgcgctgaacagaggagacagcgcatgcacactggtaacctggcggcagcgcaaaagatg

SEQ ID NO: 239265 - DNA, 103 bp, Artificial Sequence
  Synthetic Polynucleotide
taatacgactcactatagggcggcgcactcgaagggccgctcaccagtgtaacagaggagaacactgatgagcggccctaacctggcggcagcgcaaaagatg

SEQ ID NO: 239266 - DNA, 103 bp, Artificial Sequence
  Synthetic Polynucleotide
taatacgactcactatagggtggccgcactcggcgcactcgaagggccgcaacagaggagagcggccatgcgagtgcgcaacctggcggcagcgcaaaagatg

SEQ ID NO: 239267 - DNA, 103 bp, Artificial Sequence
  Synthetic Polynucleotide
taatacgactcactatagggcattctgagtgatatttggctggaattcataacagaggagaatgaatatgagccaaataaacctggcggcagcgcaaaagatg

SEQ ID NO: 239268 - DNA, 103 bp, Artificial Sequence
  Synthetic Polynucleotide
taatacgactcactataggggtgctgggtaagagatgatctctgagtaaaaacagaggagatttactatgagatcatctaacctggcggcagcgcaaaagatg

SEQ ID NO: 239269 - DNA, 103 bp, Artificial Sequence
  Synthetic Polynucleotide
taatacgactcactataggggaatcctctggtgctgggtaagagatgatcaacagaggagagatcatatgttacccagcaacctggcggcagcgcaaaagatg

SEQ ID NO: 239270 - DNA, 103 bp, Artificial Sequence
  Synthetic Polynucleotide
taatacgactcactatagggtctcctctgtgaatcctctggtgctgggtaaacagaggagatacccaatgccagaggataacctggcggcagcgcaaaagatg

SEQ ID NO: 239271 - DNA, 103 bp, Artificial Sequence
  Synthetic Polynucleotide
taatacgactcactatagggatagggcttctctcctctgtgaatcctctgaacagaggagacagaggatgcacagaggaaacctggcggcagcgcaaaagatg

SEQ ID NO: 239272 - DNA, 103 bp, Artificial Sequence
  Synthetic Polynucleotide
taatacgactcactatagggcactgcacacatagggcttctctcctctgtaacagaggagaacagagatgagaagccctaacctggcggcagcgcaaaagatg

SEQ ID NO: 239273 - DNA, 103 bp, Artificial Sequence
  Synthetic Polynucleotide
taatacgactcactatagggcttccacattcactgcacacatagggcttcaacagaggagagaagccatgtgtgtgcagaacctggcggcagcgcaaaagatg

SEQ ID NO: 239274 - DNA, 103 bp, Artificial Sequence
  Synthetic Polynucleotide
taatacgactcactatagggacggaaacaacttccacattcactgcacacaacagaggagagtgtgcatggaatgtggaaacctggcggcagcgcaaaagatg

SEQ ID NO: 239275 - DNA, 103 bp, Artificial Sequence
  Synthetic Polynucleotide
taatacgactcactatagggttgactgtttacggaaacaacttccacattaacagaggagaaatgtgatggttgtttccaacctggcggcagcgcaaaagatg

SEQ ID NO: 239276 - DNA, 103 bp, Artificial Sequence
  Synthetic Polynucleotide
taatacgactcactatagggtgagtaagatttgactgtttacggaaacaaaacagaggagattgtttatgtaaacagtcaacctggcggcagcgcaaaagatg

SEQ ID NO: 239277 - DNA, 103 bp, Artificial Sequence
  Synthetic Polynucleotide
taatacgactcactatagggtctcagatgttgagtaagatttgactgtttaacagaggagaaaacagatgaatcttactaacctggcggcagcgcaaaagatg

SEQ ID NO: 239278 - DNA, 103 bp, Artificial Sequence
  Synthetic Polynucleotide
taatacgactcactatagggtcccatgtttcattctgagtgatatttggcaacagaggagagccaaaatgcactcagaaaacctggcggcagcgcaaaagatg

SEQ ID NO: 239279 - DNA, 103 bp, Artificial Sequence
  Synthetic Polynucleotide
taatacgactcactatagggcggtatgaattctcagatgttgagtaagataacagaggagaatcttaatgaacatctgaaacctggcggcagcgcaaaagatg

SEQ ID NO: 239280 - DNA, 103 bp, Artificial Sequence
  Synthetic Polynucleotide
taatacgactcactatagggggtttctctccggtatgaattctcagatgtaacagaggagaacatctatgaattcatacaacctggcggcagcgcaaaagatg

SEQ ID NO: 239281 - DNA, 103 bp, Artificial Sequence
  Synthetic Polynucleotide
taatacgactcactatagggacatttataaggtttctctccggtatgaataacagaggagaattcatatgggagagaaaaacctggcggcagcgcaaaagatg

SEQ ID NO: 239282 - DNA, 103 bp, Artificial Sequence
  Synthetic Polynucleotide
taatacgactcactatagggcacattcattacatttataaggtttctctcaacagaggagagagagaatgcttataaataacctggcggcagcgcaaaagatg

SEQ ID NO: 239283 - DNA, 103 bp, Artificial Sequence
  Synthetic Polynucleotide
taatacgactcactatagggaaggctttctcacattcattacatttataaaacagaggagattataaatgtaatgaatgaacctggcggcagcgcaaaagatg

SEQ ID NO: 239284 - DNA, 103 bp, Artificial Sequence
  Synthetic Polynucleotide
taatacgactcactatagggttttgtttgaaaggctttctcacattcattaacagaggagaaatgaaatggagaaagccaacctggcggcagcgcaaaagatg

SEQ ID NO: 239285 - DNA, 103 bp, Artificial Sequence
  Synthetic Polynucleotide
taatacgactcactatagggcaagaattgcttttgtttgaaaggctttctaacagaggagaagaaagatgttcaaacaaaacctggcggcagcgcaaaagatg

SEQ ID NO: 239286 - DNA, 103 bp, Artificial Sequence
  Synthetic Polynucleotide
taatacgactcactatagggagatgctgaacaagaattgcttttgtttgaaacagaggagatcaaacatgagcaattctaacctggcggcagcgcaaaagatg

SEQ ID NO: 239287 - DNA, 103 bp, Artificial Sequence
  Synthetic Polynucleotide
taatacgactcactatagggatgaattctcagatgctgaacaagaattgcaacagaggagagcaattatggttcagcataacctggcggcagcgcaaaagatg

SEQ ID NO: 239288 - DNA, 103 bp, Artificial Sequence
  Synthetic Polynucleotide
taatacgactcactatagggtctctccagtatgaattctcagatgctgaaaacagaggagattcagcatgtgagaattcaacctggcggcagcgcaaaagatg

SEQ ID NO: 239289 - DNA, 103 bp, Artificial Sequence
  Synthetic Polynucleotide
taatacgactcactatagggatgttaactctcccatgtttcattctgagtaacagaggagaactcagatggaaacatggaacctggcggcagcgcaaaagatg

SEQ ID NO: 239290 - DNA, 103 bp, Artificial Sequence
  Synthetic Polynucleotide
taatacgactcactatagggttatagggtttctctccagtatgaattctcaacagaggagagagaatatgtactggagaaacctggcggcagcgcaaaagatg

SEQ ID NO: 239291 - DNA, 103 bp, Artificial Sequence
  Synthetic Polynucleotide
taatacgactcactatagggttcattgcatttatagggtttctctccagtaacagaggagaactggaatgaaaccctataacctggcggcagcgcaaaagatg

SEQ ID NO: 239292 - DNA, 103 bp, Artificial Sequence
  Synthetic Polynucleotide
taatacgactcactatagggcttttccacattcattgcatttatagggttaacagaggagaaaccctatgaatgcaatgaacctggcggcagcgcaaaagatg

SEQ ID NO: 239293 - DNA, 103 bp, Artificial Sequence
  Synthetic Polynucleotide
taatacgactcactatagggtgacaaaaggcttttccacattcattgcataacagaggagaatgcaaatgatgtggaaaaacctggcggcagcgcaaaagatg

SEQ ID NO: 239294 - DNA, 103 bp, Artificial Sequence
  Synthetic Polynucleotide
taatacgactcactatagggggatgggctctgacaaaaggcttttccacaaacagaggagatgtggaatggccttttgtaacctggcggcagcgcaaaagatg

SEQ ID NO: 239295 - DNA, 103 bp, Artificial Sequence
  Synthetic Polynucleotide
taatacgactcactataggggtttaataagggatgggctctgacaaaaggaacagaggagaccttttatgagagcccataacctggcggcagcgcaaaagatg

SEQ ID NO: 239296 - DNA, 103 bp, Artificial Sequence
  Synthetic Polynucleotide
taatacgactcactatagggattcgctggtgtttaataagggatgggctcaacagaggagagagcccatgccttattaaaacctggcggcagcgcaaaagatg

SEQ ID NO: 239297 - DNA, 103 bp, Artificial Sequence
  Synthetic Polynucleotide
taatacgactcactatagggtccagtatgaattcgctggtgtttaataagaacagaggagacttattatgcaccagcgaaacctggcggcagcgcaaaagatg

SEQ ID NO: 239298 - DNA, 103 bp, Artificial Sequence
  Synthetic Polynucleotide
taatacgactcactatagggatggtttctctccagtatgaattcgctggtaacagaggagaaccagcatgttcatactgaacctggcggcagcgcaaaagatg

SEQ ID NO: 239299 - DNA, 103 bp, Artificial Sequence
  Synthetic Polynucleotide
taatacgactcactataggggtacatttatatggtttctctccagtatgaaacagaggagatcatacatgagagaaaccaacctggcggcagcgcaaaagatg

SEQ ID NO: 239300 - DNA, 103 bp, Artificial Sequence
  Synthetic Polynucleotide
taatacgactcactatagggtttcttctgcatgttaactctcccatgtttaacagaggagaaaacatatgagagttaacaacctggcggcagcgcaaaagatg

SEQ ID NO: 239301 - DNA, 103 bp, Artificial Sequence
  Synthetic Polynucleotide
taatacgactcactataggggccacattctgtacatttatatggtttctcaacagaggagagagaaaatgtataaatgtaacctggcggcagcgcaaaagatg

SEQ ID NO: 239302 - DNA, 103 bp, Artificial Sequence
  Synthetic Polynucleotide
taatacgactcactatagggtgaaggctttgccacattctgtacatttataacagaggagaataaatatgcagaatgtgaacctggcggcagcgcaaaagatg

SEQ ID NO: 239303 - DNA, 103 bp, Artificial Sequence
  Synthetic Polynucleotide
taatacgactcactatagggatgctctgactgaaggctttgccacattctaacagaggagaagaatgatgcaaagccttaacctggcggcagcgcaaaagatg

SEQ ID NO: 239304 - DNA, 103 bp, Artificial Sequence
  Synthetic Polynucleotide
taatacgactcactatagggagtaaggcatatgctctgactgaaggctttaacagaggagaaaagccatgagtcagagcaacctggcggcagcgcaaaagatg

SEQ ID NO: 239305 - DNA, 103 bp, Artificial Sequence
  Synthetic Polynucleotide
taatacgactcactatagggtctgatgacgagtaaggcatatgctctgacaacagaggagagtcagaatgtatgccttaaacctggcggcagcgcaaaagatg

SEQ ID NO: 239306 - DNA, 103 bp, Artificial Sequence
  Synthetic Polynucleotide
taatacgactcactataggggaatgacttctctgatgacgagtaaggcataacagaggagaatgcctatgtcgtcatcaaacctggcggcagcgcaaaagatg

SEQ ID NO: 239307 - DNA, 103 bp, Artificial Sequence
  Synthetic Polynucleotide
taatacgactcactatagggtttatctccagaatgacttctctgatgacgaacagaggagacgtcatatgagaagtcataacctggcggcagcgcaaaagatg

SEQ ID NO: 239308 - DNA, 103 bp, Artificial Sequence
  Synthetic Polynucleotide
taatacgactcactatagggacttaaaaggtttatctccagaatgacttcaacagaggagagaagtcatgctggagataaacctggcggcagcgcaaaagatg

SEQ ID NO: 239309 - DNA, 103 bp, Artificial Sequence
  Synthetic Polynucleotide
taatacgactcactatagggcattcattacacttaaaaggtttatctccaaacagaggagatggagaatgaccttttaaaacctggcggcagcgcaaaagatg

SEQ ID NO: 239310 - DNA, 103 bp, Artificial Sequence
  Synthetic Polynucleotide
taatacgactcactatagggggctttcccacattcattacacttaaaaggaacagaggagaccttttatgtgtaatgaaaacctggcggcagcgcaaaagatg

SEQ ID NO: 239311 - DNA, 103 bp, Artificial Sequence
  Synthetic Polynucleotide
taatacgactcactatagggactttgaaggtttcttctgcatgttaactcaacagaggagagagttaatgtgcagaagaaacctggcggcagcgcaaaagatg

SEQ ID NO: 239312 - DNA, 103 bp, Artificial Sequence
  Synthetic Polynucleotide
taatacgactcactatagggtctgattaaaggctttcccacattcattacaacagaggagagtaatgatggtgggaaagaacctggcggcagcgcaaaagatg

SEQ ID NO: 239313 - DNA, 103 bp, Artificial Sequence
  Synthetic Polynucleotide
taatacgactcactatagggagacatgcactctgattaaaggctttcccaaacagaggagatgggaaatgctttaatcaaacctggcggcagcgcaaaagatg

SEQ ID NO: 239314 - DNA, 103 bp, Artificial Sequence
  Synthetic Polynucleotide
taatacgactcactatagggatgctgcatgagacatgcactctgattaaaaacagaggagatttaatatgagtgcatgtaacctggcggcagcgcaaaagatg

SEQ ID NO: 239315 - DNA, 103 bp, Artificial Sequence
  Synthetic Polynucleotide
taatacgactcactataggggaattctctgatgctgcatgagacatgcacaacagaggagagtgcatatgtcatgcagcaacctggcggcagcgcaaaagatg

SEQ ID NO: 239316 - DNA, 103 bp, Artificial Sequence
  Synthetic Polynucleotide
taatacgactcactatagggtctcctgaatgaattctctgatgctgcatgaacagaggagacatgcaatgtcagagaataacctggcggcagcgcaaaagatg

SEQ ID NO: 239317 - DNA, 103 bp, Artificial Sequence
  Synthetic Polynucleotide
taatacgactcactataggggtagggcttctctcctgaatgaattctctgaacagaggagacagagaatgcattcaggaaacctggcggcagcgcaaaagatg

SEQ ID NO: 239318 - DNA, 103 bp, Artificial Sequence
  Synthetic Polynucleotide
taatacgactcactatagggcagtgcatgtgtagggcttctctcctgaataacagaggagaattcagatgagaagccctaacctggcggcagcgcaaaagatg

SEQ ID NO: 239319 - DNA, 103 bp, Artificial Sequence
  Synthetic Polynucleotide
taatacgactcactatagggttaccacattcagtgcatgtgtagggcttcaacagaggagagaagccatgcacatgcacaacctggcggcagcgcaaaagatg

SEQ ID NO: 239320 - DNA, 103 bp, Artificial Sequence
  Synthetic Polynucleotide
taatacgactcactatagggagtgaaggctttaccacattcagtgcatgtaacagaggagaacatgcatggaatgtggtaacctggcggcagcgcaaaagatg

SEQ ID NO: 239321 - DNA, 103 bp, Artificial Sequence
  Synthetic Polynucleotide
taatacgactcactatagggaagagttctgagtgaaggctttaccacattaacagaggagaaatgtgatgaagccttcaaacctggcggcagcgcaaaagatg

SEQ ID NO: 239322 - DNA, 103 bp, Artificial Sequence
  Synthetic Polynucleotide
taatacgactcactatagggcattcactacactttgaaggtttcttctgcaacagaggagagcagaaatgaccttcaaaaacctggcggcagcgcaaaagatg

SEQ ID NO: 239323 - DNA, 103 bp, Artificial Sequence
  Synthetic Polynucleotide
taatacgactcactatagggtcaacaagggaagagttctgagtgaaggctaacagaggagaagccttatgtcagaactcaacctggcggcagcgcaaaagatg

SEQ ID NO: 239324 - DNA, 103 bp, Artificial Sequence
  Synthetic Polynucleotide
taatacgactcactatagggcctttcatgttcaacaagggaagagttctgaacagaggagacagaacatgtcccttgttaacctggcggcagcgcaaaagatg

SEQ ID NO: 239325 - DNA, 103 bp, Artificial Sequence
  Synthetic Polynucleotide
taatacgactcactatagggcagtgtgagtcctttcatgttcaacaagggaacagaggagacccttgatgaacatgaaaaacctggcggcagcgcaaaagatg

SEQ ID NO: 239326 - DNA, 103 bp, Artificial Sequence
  Synthetic Polynucleotide
taatacgactcactatagggagtttctctccagtgtgagtcctttcatgtaacagaggagaacatgaatggactcacacaacctggcggcagcgcaaaagatg

SEQ ID NO: 239327 - DNA, 103 bp, Artificial Sequence
  Synthetic Polynucleotide
taatacgactcactatagggacacttataaagtttctctccagtgtgagtaacagaggagaactcacatgggagagaaaaacctggcggcagcgcaaaagatg

SEQ ID NO: 239328 - DNA, 103 bp, Artificial Sequence
  Synthetic Polynucleotide
taatacgactcactatagggcacactcactacacttataaagtttctctcaacagaggagagagagaatgtttataagtaacctggcggcagcgcaaaagatg

SEQ ID NO: 239329 - DNA, 103 bp, Artificial Sequence
  Synthetic Polynucleotide
taatacgactcactatagggaaagttttttcacactcactacacttataaaacagaggagattataaatgtagtgagtgaacctggcggcagcgcaaaagatg

SEQ ID NO: 239330 - DNA, 103 bp, Artificial Sequence
  Synthetic Polynucleotide
taatacgactcactatagggttgtttgcggaaagttttttcacactcactaacagaggagaagtgagatggaaaaaactaacctggcggcagcgcaaaagatg

SEQ ID NO: 239331 - DNA, 103 bp, Artificial Sequence
  Synthetic Polynucleotide
taatacgactcactatagggtaaggtgtgcttgtttgcggaaagttttttaacagaggagaaaaaaaatgtccgcaaacaacctggcggcagcgcaaaagatg

SEQ ID NO: 239332 - DNA, 103 bp, Artificial Sequence
  Synthetic Polynucleotide
taatacgactcactatagggtaatgctcactaaggtgtgcttgtttgcggaacagaggagaccgcaaatgagcacacctaacctggcggcagcgcaaaagatg

SEQ ID NO: 239333 - DNA, 103 bp, Artificial Sequence
  Synthetic Polynucleotide
taatacgactcactataggggaacttcccacattcactacactttgaaggaacagaggagaccttcaatgtgtagtgaaaacctggcggcagcgcaaaagatg

SEQ ID NO: 239334 - DNA, 103 bp, Artificial Sequence
  Synthetic Polynucleotide
taatacgactcactatagggatgaattctgtaatgctcactaaggtgtgcaacagaggagagcacacatgagtgagcataacctggcggcagcgcaaaagatg

SEQ ID NO: 239335 - DNA, 103 bp, Artificial Sequence
  Synthetic Polynucleotide
taatacgactcactatagggtttctccagtatgaattctgtaatgctcacaacagaggagagtgagcatgacagaattcaacctggcggcagcgcaaaagatg

SEQ ID NO: 239336 - DNA, 103 bp, Artificial Sequence
  Synthetic Polynucleotide
taatacgactcactatagggtcataaggtttttctccagtatgaattctgaacagaggagacagaatatgtactggagaaacctggcggcagcgcaaaagatg

SEQ ID NO: 239337 - DNA, 103 bp, Artificial Sequence
  Synthetic Polynucleotide
taatacgactcactatagggtccaacacactcataaggtttttctccagtaacagaggagaactggaatgaaaccttataacctggcggcagcgcaaaagatg

SEQ ID NO: 239338 - DNA, 103 bp, Artificial Sequence
  Synthetic Polynucleotide
taatacgactcactatagggatttcccacatccaacacactcataaggttaacagaggagaaaccttatgagtgtgttgaacctggcggcagcgcaaaagatg

SEQ ID NO: 239339 - DNA, 103 bp, Artificial Sequence
  Synthetic Polynucleotide
taatacgactcactatagggtgcctaaaggatttcccacatccaacacacaacagaggagagtgtgtatgatgtgggaaaacctggcggcagcgcaaaagatg

SEQ ID NO: 239340 - DNA, 103 bp, Artificial Sequence
  Synthetic Polynucleotide
taatacgactcactatagggtgctgaactgtgcctaaaggatttcccacaaacagaggagatgtgggatgtcctttaggaacctggcggcagcgcaaaagatg

SEQ ID NO: 239341 - DNA, 103 bp, Artificial Sequence
  Synthetic Polynucleotide
taatacgactcactataggggtcgaagaagtgctgaactgtgcctaaaggaacagaggagacctttaatgacagttcagaacctggcggcagcgcaaaagatg

SEQ ID NO: 239342 - DNA, 103 bp, Artificial Sequence
  Synthetic Polynucleotide
taatacgactcactatagggagcctctgatgtcgaagaagtgctgaactgaacagaggagacagttcatgacttcttcgaacctggcggcagcgcaaaagatg

SEQ ID NO: 239343 - DNA, 103 bp, Artificial Sequence
  Synthetic Polynucleotide
taatacgactcactatagggtccagcatgaagcctctgatgtcgaagaagaacagaggagacttcttatgcatcagaggaacctggcggcagcgcaaaagatg

SEQ ID NO: 239344 - DNA, 103 bp, Artificial Sequence
  Synthetic Polynucleotide
taatacgactcactatagggtctgagtaaagaacttcccacattcactacaacagaggagagtagtgatggtgggaagtaacctggcggcagcgcaaaagatg

SEQ ID NO: 239345 - DNA, 103 bp, Artificial Sequence
  Synthetic Polynucleotide
taatacgactcactatagggagagatgatctctgagtaaagaacttcccaaacagaggagatgggaaatgctttactcaaacctggcggcagcgcaaaagatg

SEQ ID NO: 239346 - DNA, 103 bp, Artificial Sequence
  Synthetic Polynucleotide
taatacgactcactatagggctgcgggtggctttgcttccttcggggcataacagaggagaatgcccatgaggaagcaaaacctggcggcagcgcaaaagatg

SEQ ID NO: 239347 - DNA, 103 bp, Artificial Sequence
  Synthetic Polynucleotide
taatacgactcactatagggtagtagcaaatcactctccaataccagggcaacagaggagagccctgatgttggagagtaacctggcggcagcgcaaaagatg

SEQ ID NO: 239348 - DNA, 103 bp, Artificial Sequence
  Synthetic Polynucleotide
taatacgactcactatagggcatgcagcgcccacacatggcagctcccagaacagaggagactgggaatggccatgtgtaacctggcggcagcgcaaaagatg

SEQ ID NO: 239349 - DNA, 103 bp, Artificial Sequence
  Synthetic Polynucleotide
taatacgactcactatagggcctctcctcgcatgcagcgcccacacatggaacagaggagaccatgtatgggcgctgcaaacctggcggcagcgcaaaagatg

SEQ ID NO: 239350 - DNA, 103 bp, Artificial Sequence
  Synthetic Polynucleotide
taatacgactcactatagggccccctccagcctctcctcgcatgcagcgcaacagaggagagcgctgatggcgaggagaaacctggcggcagcgcaaaagatg

SEQ ID NO: 239351 - DNA, 103 bp, Artificial Sequence
  Synthetic Polynucleotide
taatacgactcactatagggcccactggcaccccctccagcctctcctcgaacagaggagacgaggaatggctggagggaacctggcggcagcgcaaaagatg

SEQ ID NO: 239352 - DNA, 103 bp, Artificial Sequence
  Synthetic Polynucleotide
taatacgactcactatagggcctggggccccccactggcaccccctccagaacagaggagactggagatggtgccagtgaacctggcggcagcgcaaaagatg

SEQ ID NO: 239353 - DNA, 103 bp, Artificial Sequence
  Synthetic Polynucleotide
taatacgactcactatagggtcactggggccctggggccccccactggcaaacagaggagatgccagatgggggccccaaacctggcggcagcgcaaaagatg

SEQ ID NO: 239354 - DNA, 103 bp, Artificial Sequence
  Synthetic Polynucleotide
taatacgactcactatagggaaagcctttgtcactggggccctggggcccaacagaggagagggcccatgggccccagtaacctggcggcagcgcaaaagatg

SEQ ID NO: 239355 - DNA, 103 bp, Artificial Sequence
  Synthetic Polynucleotide
taatacgactcactatagggggctacaggcaaagcctttgtcactggggcaacagaggagagccccaatgacaaaggctaacctggcggcagcgcaaaagatg

SEQ ID NO: 239356 - DNA, 103 bp, Artificial Sequence
  Synthetic Polynucleotide
taatacgactcactatagggaaggggcagaggctacaggcaaagcctttgaacagaggagacaaaggatgtgcctgtagaacctggcggcagcgcaaaagatg

SEQ ID NO: 239357 - DNA, 103 bp, Artificial Sequence
  Synthetic Polynucleotide
taatacgactcactataggggtgagtggcaaaggggcagaggctacaggcaacagaggagagcctgtatgctctgccccaacctggcggcagcgcaaaagatg

SEQ ID NO: 239358 - DNA, 103 bp, Artificial Sequence
  Synthetic Polynucleotide
taatacgactcactataggggatcctggcctagtagcaaatcactctccaaacagaggagatggagaatgatttgctacaacctggcggcagcgcaaaagatg

SEQ ID NO: 239359 - DNA, 103 bp, Artificial Sequence
  Synthetic Polynucleotide
taatacgactcactatagggggttgggatagtgagtggcaaaggggcagaaacagaggagatctgccatgttgccactcaacctggcggcagcgcaaaagatg

SEQ ID NO: 239360 - DNA, 103 bp, Artificial Sequence
  Synthetic Polynucleotide
taatacgactcactatagggcgggccaggtggttgggatagtgagtggcaaacagaggagatgccacatgctatcccaaaacctggcggcagcgcaaaagatg

SEQ ID NO: 239361 - DNA, 103 bp, Artificial Sequence
  Synthetic Polynucleotide
taatacgactcactatagggcttcatgtgccgggccaggtggttgggataaacagaggagatatcccatgcacctggccaacctggcggcagcgcaaaagatg

SEQ ID NO: 239362 - DNA, 103 bp, Artificial Sequence
  Synthetic Polynucleotide
taatacgactcactatagggcactgtgtgtcttcatgtgccgggccaggtaacagaggagaacctggatgggcacatgaaacctggcggcagcgcaaaagatg

SEQ ID NO: 239363 - DNA, 103 bp, Artificial Sequence
  Synthetic Polynucleotide
taatacgactcactatagggggcttctcaccactgtgtgtcttcatgtgcaacagaggagagcacatatggacacacagaacctggcggcagcgcaaaagatg

SEQ ID NO: 239364 - DNA, 103 bp, Artificial Sequence
  Synthetic Polynucleotide
taatacgactcactataggggcagcggaagggcttctcaccactgtgtgtaacagaggagaacacacatgggtgagaagaacctggcggcagcgcaaaagatg

SEQ ID NO: 239365 - DNA, 103 bp, Artificial Sequence
  Synthetic Polynucleotide
taatacgactcactataggggacagcgggcgcagcggaagggcttctcacaacagaggagagtgagaatgccttccgctaacctggcggcagcgcaaaagatg

SEQ ID NO: 239366 - DNA, 103 bp, Artificial Sequence
  Synthetic Polynucleotide
taatacgactcactataggggaggcataaggacagcgggcgcagcggaagaacagaggagacttccgatgcgcccgctgaacctggcggcagcgcaaaagatg

SEQ ID NO: 239367 - DNA, 103 bp, Artificial Sequence
  Synthetic Polynucleotide
taatacgactcactatagggcagatgagcagaggcataaggacagcgggcaacagaggagagcccgcatgccttatgccaacctggcggcagcgcaaaagatg

SEQ ID NO: 239368 - DNA, 103 bp, Artificial Sequence
  Synthetic Polynucleotide
taatacgactcactatagggtcaggttatccagatgagcagaggcataagaacagaggagacttatgatgctgctcatcaacctggcggcagcgcaaaagatg

SEQ ID NO: 239369 - DNA, 103 bp, Artificial Sequence
  Synthetic Polynucleotide
taatacgactcactatagggtcaaactccagatcctggcctagtagcaaaaacagaggagatttgctatgaggccaggaaacctggcggcagcgcaaaagatg

SEQ ID NO: 239370 - DNA, 103 bp, Artificial Sequence
  Synthetic Polynucleotide
taatacgactcactatagggtggtgccgtttcaggttatccagatgagcaaacagaggagatgctcaatgggataacctaacctggcggcagcgcaaaagatg

SEQ ID NO: 239371 - DNA, 103 bp, Artificial Sequence
  Synthetic Polynucleotide
taatacgactcactatagggatggacgcgctggtgccgtttcaggttatcaacagaggagagataacatgaaacggcacaacctggcggcagcgcaaaagatg

SEQ ID NO: 239372 - DNA, 103 bp, Artificial Sequence
  Synthetic Polynucleotide
taatacgactcactatagggtctctcctgtatggacgcgctggtgccgttaacagaggagaaacggcatgagcgcgtccaacctggcggcagcgcaaaagatg

SEQ ID NO: 239373 - DNA, 103 bp, Artificial Sequence
  Synthetic Polynucleotide
taatacgactcactatagggttgtagggcttctctcctgtatggacgcgcaacagaggagagcgcgtatgtacaggagaaacctggcggcagcgcaaaagatg

SEQ ID NO: 239374 - DNA, 103 bp, Artificial Sequence
  Synthetic Polynucleotide
taatacgactcactataggggagggggcacttgtagggcttctctcctgtaacagaggagaacaggaatgaagccctacaacctggcggcagcgcaaaagatg

SEQ ID NO: 239375 - DNA, 103 bp, Artificial Sequence
  Synthetic Polynucleotide
taatacgactcactatagggcataagggcagagggggcacttgtagggctaacagaggagaagccctatgagtgcccccaacctggcggcagcgcaaaagatg

SEQ ID NO: 239376 - DNA, 103 bp, Artificial Sequence
  Synthetic Polynucleotide
taatacgactcactatagggttgccacaggcataagggcagagggggcacaacagaggagagtgcccatgctgcccttaaacctggcggcagcgcaaaagatg

SEQ ID NO: 239377 - DNA, 103 bp, Artificial Sequence
  Synthetic Polynucleotide
taatacgactcactataggggttggccagattgccacaggcataagggcaaacagaggagatgccctatggcctgtggcaacctggcggcagcgcaaaagatg

SEQ ID NO: 239378 - DNA, 103 bp, Artificial Sequence
  Synthetic Polynucleotide
taatacgactcactataggggacgcttgaggttggccagattgccacaggaacagaggagacctgtgatgatctggccaaacctggcggcagcgcaaaagatg

SEQ ID NO: 239379 - DNA, 103 bp, Artificial Sequence
  Synthetic Polynucleotide
taatacgactcactatagggatgcgaccatgacgcttgaggttggccagaaacagaggagatctggcatgcctcaagcgaacctggcggcagcgcaaaagatg

SEQ ID NO: 239380 - DNA, 103 bp, Artificial Sequence
  Synthetic Polynucleotide
taatacgactcactatagggctcttcctcctcaaactccagatcctggccaacagaggagaggccagatgctggagtttaacctggcggcagcgcaaaagatg

SEQ ID NO: 239381 - DNA, 103 bp, Artificial Sequence
  Synthetic Polynucleotide
taatacgactcactatagggaccagagtggatgcgaccatgacgcttgagaacagaggagactcaagatgcatggtcgcaacctggcggcagcgcaaaagatg

SEQ ID NO: 239382 - DNA, 103 bp, Artificial Sequence
  Synthetic Polynucleotide
taatacgactcactatagggaaggtttgtcaccagagtggatgcgaccataacagaggagaatggtcatgtccactctgaacctggcggcagcgcaaaagatg

SEQ ID NO: 239383 - DNA, 103 bp, Artificial Sequence
  Synthetic Polynucleotide
taatacgactcactatagggctacaccgaaaaggtttgtcaccagagtggaacagaggagaccactcatgtgacaaaccaacctggcggcagcgcaaaagatg

SEQ ID NO: 239384 - DNA, 103 bp, Artificial Sequence
  Synthetic Polynucleotide
taatacgactcactataggggttgcaaaggctacaccgaaaaggtttgtcaacagaggagagacaaaatgtttcggtgtaacctggcggcagcgcaaaagatg

SEQ ID NO: 239385 - DNA, 103 bp, Artificial Sequence
  Synthetic Polynucleotide
taatacgactcactatagggtgcagctgtagttgcaaaggctacaccgaaaacagaggagattcggtatggcctttgcaaacctggcggcagcgcaaaagatg

SEQ ID NO: 239386 - DNA, 103 bp, Artificial Sequence
  Synthetic Polynucleotide
taatacgactcactatagggatgctctggttgcagctgtagttgcaaaggaacagaggagacctttgatgctacagctgaacctggcggcagcgcaaaagatg

SEQ ID NO: 239387 - DNA, 103 bp, Artificial Sequence
  Synthetic Polynucleotide
taatacgactcactatagggtttgaggttcatgctctggttgcagctgtaaacagaggagatacagcatgaaccagagcaacctggcggcagcgcaaaagatg

SEQ ID NO: 239388 - DNA, 103 bp, Artificial Sequence
  Synthetic Polynucleotide
taatacgactcactataggggcatgtgacgtttgaggttcatgctctggtaacagaggagaaccagaatgtgaacctcaaacctggcggcagcgcaaaagatg

SEQ ID NO: 239389 - DNA, 103 bp, Artificial Sequence
  Synthetic Polynucleotide
taatacgactcactataggggtgtgccgcagcatgtgacgtttgaggttcaacagaggagagaacctatgacgtcacataacctggcggcagcgcaaaagatg

SEQ ID NO: 239390 - DNA, 103 bp, Artificial Sequence
  Synthetic Polynucleotide
taatacgactcactatagggcttctcgcctgtgtgccgcagcatgtgacgaacagaggagacgtcacatgctgcggcacaacctggcggcagcgcaaaagatg

SEQ ID NO: 239391 - DNA, 103 bp, Artificial Sequence
  Synthetic Polynucleotide
taatacgactcactatagggcctcctcttcctcttcctcctcaaactccaaacagaggagatggagtatgaggaggaagaacctggcggcagcgcaaaagatg

SEQ ID NO: 239392 - DNA, 103 bp, Artificial Sequence
  Synthetic Polynucleotide
taatacgactcactatagggagcggaagggcttctcgcctgtgtgccgcaaacagaggagatgcggcatgcaggcgagaaacctggcggcagcgcaaaagatg

SEQ ID NO: 239393 - DNA, 103 bp, Artificial Sequence
  Synthetic Polynucleotide
taatacgactcactatagggcaggtggcacagcggaagggcttctcgcctaacagaggagaaggcgaatggcccttccgaacctggcggcagcgcaaaagatg

SEQ ID NO: 239394 - DNA, 103 bp, Artificial Sequence
  Synthetic Polynucleotide
taatacgactcactatagggggtataggcgcaggtggcacagcggaagggaacagaggagacccttcatgtgtgccaccaacctggcggcagcgcaaaagatg

SEQ ID NO: 239395 - DNA, 103 bp, Artificial Sequence
  Synthetic Polynucleotide
taatacgactcactatagggagtggcccgtggtataggcgcaggtggcacaacagaggagagtgccaatggcgcctataaacctggcggcagcgcaaaagatg

SEQ ID NO: 239396 - DNA, 103 bp, Artificial Sequence
  Synthetic Polynucleotide
taatacgactcactatagggtagttgtcccagtggcccgtggtataggcgaacagaggagacgcctaatgcacgggccaaacctggcggcagcgcaaaagatg

SEQ ID NO: 239397 - DNA, 103 bp, Artificial Sequence
  Synthetic Polynucleotide
taatacgactcactataggggtggcgcttgtagttgtcccagtggcccgtaacagaggagaacgggcatgtgggacaacaacctggcggcagcgcaaaagatg

SEQ ID NO: 239398 - DNA, 103 bp, Artificial Sequence
  Synthetic Polynucleotide
taatacgactcactataggggcaccttctggtggcgcttgtagttgtcccaacagaggagagggacaatgacaagcgccaacctggcggcagcgcaaaagatg

SEQ ID NO: 239399 - DNA, 103 bp, Artificial Sequence
  Synthetic Polynucleotide
taatacgactcactatagggccgtggccatgcaccttctggtggcgcttgaacagaggagacaagcgatgccagaaggtaacctggcggcagcgcaaaagatg

SEQ ID NO: 239400 - DNA, 103 bp, Artificial Sequence
  Synthetic Polynucleotide
taatacgactcactatagggtcctgccccaccgtggccatgcaccttctgaacagaggagacagaagatgcatggccacaacctggcggcagcgcaaaagatg

SEQ ID NO: 239401 - DNA, 103 bp, Artificial Sequence
  Synthetic Polynucleotide
taatacgactcactataggggaccaggccctcctgccccaccgtggccataacagaggagaatggccatggtggggcagaacctggcggcagcgcaaaagatg

SEQ ID NO: 239402 - DNA, 103 bp, Artificial Sequence
  Synthetic Polynucleotide
taatacgactcactatagggccgtcgccttcctcctcttcctcttcctccaacagaggagaggaggaatgggaagaggaaacctggcggcagcgcaaaagatg

SEQ ID NO: 239403 - DNA, 103 bp, Artificial Sequence
  Synthetic Polynucleotide
taatacgactcactataggggaggcagagagaccaggccctcctgccccaaacagaggagatggggcatgagggcctggaacctggcggcagcgcaaaagatg

SEQ ID NO: 239404 - DNA, 103 bp, Artificial Sequence
  Synthetic Polynucleotide
taatacgactcactatagggccagccctcagaggcagagagaccaggcccaacagaggagagggcctatgctctctgccaacctggcggcagcgcaaaagatg

SEQ ID NO: 239405 - DNA, 103 bp, Artificial Sequence
  Synthetic Polynucleotide
taatacgactcactataggggaggtggggcccagccctcagaggcagagaaacagaggagatctctgatgctgagggctaacctggcggcagcgcaaaagatg

SEQ ID NO: 239406 - DNA, 103 bp, Artificial Sequence
  Synthetic Polynucleotide
taatacgactcactatagggggtgggctatgaggtggggcccagccctcaaacagaggagatgagggatgggccccaccaacctggcggcagcgcaaaagatg

SEQ ID NO: 239407 - DNA, 103 bp, Artificial Sequence
  Synthetic Polynucleotide
taatacgactcactatagggcaaaacagagggtgggctatgaggtggggcaacagaggagagccccaatgcatagcccaaacctggcggcagcgcaaaagatg

SEQ ID NO: 239408 - DNA, 103 bp, Artificial Sequence
  Synthetic Polynucleotide
taatacgactcactatagggcccgagagctcaaaacagagggtgggctataacagaggagaatagccatgcctctgtttaacctggcggcagcgcaaaagatg

SEQ ID NO: 239409 - DNA, 103 bp, Artificial Sequence
  Synthetic Polynucleotide
taatacgactcactataggggctggtgggccccgagagctcaaaacagagaacagaggagactctgtatggagctctcgaacctggcggcagcgcaaaagatg

SEQ ID NO: 239410 - DNA, 103 bp, Artificial Sequence
  Synthetic Polynucleotide
taatacgactcactatagggagtccccagggctggtgggccccgagagctaacagaggagaagctctatgggcccaccaaacctggcggcagcgcaaaagatg

SEQ ID NO: 239411 - DNA, 103 bp, Artificial Sequence
  Synthetic Polynucleotide
taatacgactcactatagggggctgccagcagtccccagggctggtgggcaacagaggagagcccacatgccctggggaaacctggcggcagcgcaaaagatg

SEQ ID NO: 239412 - DNA, 103 bp, Artificial Sequence
  Synthetic Polynucleotide
taatacgactcactatagggtggacagcccggctgccagcagtccccaggaacagaggagacctgggatgtgctggcagaacctggcggcagcgcaaaagatg

SEQ ID NO: 239413 - DNA, 103 bp, Artificial Sequence
  Synthetic Polynucleotide
taatacgactcactataggggtcactgttgccgtcgccttcctcctcttcaacagaggagagaagagatggaaggcgacaacctggcggcagcgcaaaagatg

SEQ ID NO: 239414 - DNA, 103 bp, Artificial Sequence
  Synthetic Polynucleotide
taatacgactcactatagggtgagtctgtgtggacagcccggctgccagcaacagaggagagctggcatgcgggctgtcaacctggcggcagcgcaaaagatg

SEQ ID NO: 239415 - DNA, 103 bp, Artificial Sequence
  Synthetic Polynucleotide
taatacgactcactatagggccatgagctggtcactgttgccgtcgccttaacagaggagaaaggcgatggcaacagtgaacctggcggcagcgcaaaagatg

SEQ ID NO: 239416 - DNA, 103 bp, Artificial Sequence
  Synthetic Polynucleotide
taatacgactcactatagggctctcgaagcccatgagctggtcactgttgaacagaggagacaacagatgccagctcataacctggcggcagcgcaaaagatg

SEQ ID NO: 239417 - DNA, 103 bp, Artificial Sequence
  Synthetic Polynucleotide
taatacgactcactatagggttccgagtctctctcgaagcccatgagctgaacagaggagacagctcatgggcttcgagaacctggcggcagcgcaaaagatg

SEQ ID NO: 239418 - DNA, 103 bp, Artificial Sequence
  Synthetic Polynucleotide
taatacgactcactatagggatttcacgggctgcgggtggctttgcttccaacagaggagaggaagcatggccacccgcaacctggcggcagcgcaaaagatg

SEQ ID NO: 239419 - DNA, 103 bp, Artificial Sequence
  Synthetic Polynucleotide
taatacgactcactataggggagagtctccttccgagtctctctcgaagcaacagaggagagcttcgatggagactcggaacctggcggcagcgcaaaagatg

SEQ ID NO: 239420 - DNA, 103 bp, Artificial Sequence
  Synthetic Polynucleotide
taatacgactcactatagggctggcccccagagagtctccttccgagtctaacagaggagaagactcatgaggagactcaacctggcggcagcgcaaaagatg

SEQ ID NO: 239421 - DNA, 103 bp, Artificial Sequence
  Synthetic Polynucleotide
taatacgactcactatagggaagcccaggcctggcccccagagagtctccaacagaggagaggagacatgctgggggccaacctggcggcagcgcaaaagatg

SEQ ID NO: 239422 - DNA, 103 bp, Artificial Sequence
  Synthetic Polynucleotide
taatacgactcactataggggcccatagggaagcccaggcctggcccccaaacagaggagatgggggatgggcctgggcaacctggcggcagcgcaaaagatg

SEQ ID NO: 239423 - DNA, 103 bp, Artificial Sequence
  Synthetic Polynucleotide
taatacgactcactatagggtcgtcgctcagcccatagggaagcccaggcaacagaggagagcctggatgtccctatggaacctggcggcagcgcaaaagatg

SEQ ID NO: 239424 - DNA, 103 bp, Artificial Sequence
  Synthetic Polynucleotide
taatacgactcactatagggcccagactcatcgtcgctcagcccatagggaacagaggagaccctatatgctgagcgacaacctggcggcagcgcaaaagatg

SEQ ID NO: 239425 - DNA, 103 bp, Artificial Sequence
  Synthetic Polynucleotide
taatacgactcactatagggcccggccgcccccagactcatcgtcgctcaaacagaggagatgagcgatgatgagtctgaacctggcggcagcgcaaaagatg

SEQ ID NO: 239426 - DNA, 103 bp, Artificial Sequence
  Synthetic Polynucleotide
taatacgactcactataggggcacttagtgcccggccgcccccagactcaaacagaggagatgagtcatggggcggccgaacctggcggcagcgcaaaagatg

SEQ ID NO: 239427 - DNA, 103 bp, Artificial Sequence
  Synthetic Polynucleotide
taatacgactcactatagggttcactctccgcacttagtgcccggccgccaacagaggagaggcggcatggcactaagtaacctggcggcagcgcaaaagatg

SEQ ID NO: 239428 - DNA, 103 bp, Artificial Sequence
  Synthetic Polynucleotide
taatacgactcactataggggctcctcaacttcactctccgcacttagtgaacagaggagacactaaatgcggagagtgaacctggcggcagcgcaaaagatg

SEQ ID NO: 239429 - DNA, 103 bp, Artificial Sequence
  Synthetic Polynucleotide
taatacgactcactatagggaccccctcgcatttcacgggctgcgggtggaacagaggagaccacccatggcccgtgaaaacctggcggcagcgcaaaagatg

SEQ ID NO: 239430 - DNA, 103 bp, Artificial Sequence
  Synthetic Polynucleotide
taatacgactcactatagggcccctggctggctcctcaacttcactctccaacagaggagaggagagatgagttgaggaaacctggcggcagcgcaaaagatg

SEQ ID NO: 239431 - DNA, 103 bp, Artificial Sequence
  Synthetic Polynucleotide
taatacgactcactatagggctcccctggacccctggctggctcctcaacaacagaggagagttgagatgccagccaggaacctggcggcagcgcaaaagatg

SEQ ID NO: 239432 - DNA, 103 bp, Artificial Sequence
  Synthetic Polynucleotide
taatacgactcactatagggcacccctggcctcccctggacccctggctgaacagaggagacagccaatggtccaggggaacctggcggcagcgcaaaagatg

SEQ ID NO: 239433 - DNA, 103 bp, Artificial Sequence
  Synthetic Polynucleotide
taatacgactcactatagggcctggcctctcacccctggcctcccctggaaacagaggagatccaggatgggccaggggaacctggcggcagcgcaaaagatg

SEQ ID NO: 239434 - DNA, 103 bp, Artificial Sequence
  Synthetic Polynucleotide
taatacgactcactataggggcaggctgggcctggcctctcacccctggcaacagaggagagccaggatggagaggccaaacctggcggcagcgcaaaagatg

SEQ ID NO: 239435 - DNA, 103 bp, Artificial Sequence
  Synthetic Polynucleotide
taatacgactcactatagggcacacagctggcaggctgggcctggcctctaacagaggagaagaggcatggcccagcctaacctggcggcagcgcaaaagatg

SEQ ID NO: 239436 - DNA, 103 bp, Artificial Sequence
  Synthetic Polynucleotide
taatacgactcactataggggtcggccccccacacagctggcaggctgggaacagaggagacccagcatgccagctgtgaacctggcggcagcgcaaaagatg

SEQ ID NO: 239437 - DNA, 103 bp, Artificial Sequence
  Synthetic Polynucleotide
taatacgactcactatagggcccctcacctgtcggccccccacacagctgaacagaggagacagctgatgggggggccgaacctggcggcagcgcaaaagatg

SEQ ID NO: 239438 - DNA, 103 bp, Artificial Sequence
  Synthetic Polynucleotide
taatacgactcactatagggcacaacacggcccctcacctgtcggcccccaacagaggagagggggcatgcaggtgaggaacctggcggcagcgcaaaagatg

SEQ ID NO: 239439 - DNA, 103 bp, Artificial Sequence
  Synthetic Polynucleotide
taatacgactcactatagggcctcctgccccacaacacggcccctcacctaacagaggagaaggtgaatggccgtgttgaacctggcggcagcgcaaaagatg

SEQ ID NO: 239440 - DNA, 103 bp, Artificial Sequence
  Synthetic Polynucleotide
taatacgactcactatagggatccactttgaccccctcgcatttcacgggaacagaggagacccgtgatgtgcgaggggaacctggcggcagcgcaaaagatg

SEQ ID NO: 239441 - DNA, 103 bp, Artificial Sequence
  Synthetic Polynucleotide
taatacgactcactatagggcccacccggccctcctgccccacaacacggaacagaggagaccgtgtatgggggcaggaaacctggcggcagcgcaaaagatg

SEQ ID NO: 239442 - DNA, 103 bp, Artificial Sequence
  Synthetic Polynucleotide
taatacgactcactataggggcaggggccccccacccggccctcctgcccaacagaggagagggcagatgggccgggtgaacctggcggcagcgcaaaagatg

SEQ ID NO: 239443 - DNA, 103 bp, Artificial Sequence
  Synthetic Polynucleotide
taatacgactcactatagggcgtgggggcagcaggggccccccacccggcaacagaggagagccgggatgggggcccctaacctggcggcagcgcaaaagatg

SEQ ID NO: 239444 - DNA, 103 bp, Artificial Sequence
  Synthetic Polynucleotide
taatacgactcactataggggtacagtagccgtgggggcagcaggggcccaacagaggagagggcccatgctgcccccaaacctggcggcagcgcaaaagatg

SEQ ID NO: 239445 - DNA, 103 bp, Artificial Sequence
  Synthetic Polynucleotide
taatacgactcactatagggggcggcatgagtacagtagccgtgggggcaaacagaggagatgccccatgggctactgtaacctggcggcagcgcaaaagatg

SEQ ID NO: 239446 - DNA, 103 bp, Artificial Sequence
  Synthetic Polynucleotide
taatacgactcactatagggaaggtgcagaggcggcatgagtacagtagcaacagaggagagctactatgctcatgccgaacctggcggcagcgcaaaagatg

SEQ ID NO: 239447 - DNA, 103 bp, Artificial Sequence
  Synthetic Polynucleotide
taatacgactcactataggggtgggacacgaaggtgcagaggcggcatgaaacagaggagatcatgcatgctctgcaccaacctggcggcagcgcaaaagatg

SEQ ID NO: 239448 - DNA, 103 bp, Artificial Sequence
  Synthetic Polynucleotide
taatacgactcactatagggggctcgagtagtgggacacgaaggtgcagaaacagaggagatctgcaatgtcgtgtcccaacctggcggcagcgcaaaagatg

SEQ ID NO: 239449 - DNA, 103 bp, Artificial Sequence
  Synthetic Polynucleotide
taatacgactcactatagggcgcttcaggtggctcgagtagtgggacacgaacagaggagacgtgtcatgctactcgagaacctggcggcagcgcaaaagatg

SEQ ID NO: 239450 - DNA, 103 bp, Artificial Sequence
  Synthetic Polynucleotide
taatacgactcactatagggctgcatgtgccgcttcaggtggctcgagtaaacagaggagatactcgatgcacctgaagaacctggcggcagcgcaaaagatg

SEQ ID NO: 239451 - DNA, 103 bp, Artificial Sequence
  Synthetic Polynucleotide
taatacgactcactatagggagtcttcagtatccactttgaccccctcgcaacagaggagagcgaggatgtcaaagtggaacctggcggcagcgcaaaagatg

SEQ ID NO: 239452 - DNA, 103 bp, Artificial Sequence
  Synthetic Polynucleotide
taatacgactcactatagggcgctgtgtgtctgcatgtgccgcttcaggtaacagaggagaacctgaatgggcacatgcaacctggcggcagcgcaaaagatg

SEQ ID NO: 239453 - DNA, 103 bp, Artificial Sequence
  Synthetic Polynucleotide
taatacgactcactatagggggcttctctccgctgtgtgtctgcatgtgcaacagaggagagcacatatggacacacagaacctggcggcagcgcaaaagatg

SEQ ID NO: 239454 - DNA, 103 bp, Artificial Sequence
  Synthetic Polynucleotide
taatacgactcactatagggacagcggaacggcttctctccgctgtgtgtaacagaggagaacacacatgggagagaagaacctggcggcagcgcaaaagatg

SEQ ID NO: 239455 - DNA, 103 bp, Artificial Sequence
  Synthetic Polynucleotide
taatacgactcactatagggggcagcggccacagcggaacggcttctctcaacagaggagagagagaatgcgttccgctaacctggcggcagcgcaaaagatg

SEQ ID NO: 239456 - DNA, 103 bp, Artificial Sequence
  Synthetic Polynucleotide
taatacgactcactataggggaggcgtaggggcagcggccacagcggaacaacagaggagagttccgatgtggccgctgaacctggcggcagcgcaaaagatg

SEQ ID NO: 239457 - DNA, 103 bp, Artificial Sequence
  Synthetic Polynucleotide
taatacgactcactataggggagctgggctgaggcgtaggggcagcggccaacagaggagaggccgcatgccctacgccaacctggcggcagcgcaaaagatg

SEQ ID NO: 239458 - DNA, 103 bp, Artificial Sequence
  Synthetic Polynucleotide
taatacgactcactatagggtcaggttgacgagctgggctgaggcgtaggaacagaggagacctacgatgcagcccagcaacctggcggcagcgcaaaagatg

SEQ ID NO: 239459 - DNA, 103 bp, Artificial Sequence
  Synthetic Polynucleotide
taatacgactcactataggggtatgtcgtgtcaggttgacgagctgggctaacagaggagaagcccaatgcgtcaacctaacctggcggcagcgcaaaagatg

SEQ ID NO: 239460 - DNA, 103 bp, Artificial Sequence
  Synthetic Polynucleotide
taatacgactcactataggggtgggtgcgggtatgtcgtgtcaggttgacaacagaggagagtcaacatgacacgacataacctggcggcagcgcaaaagatg

SEQ ID NO: 239461 - DNA, 103 bp, Artificial Sequence
  Synthetic Polynucleotide
taatacgactcactatagggtctcgccagtgtgggtgcgggtatgtcgtgaacagaggagacacgacatgcccgcacccaacctggcggcagcgcaaaagatg

SEQ ID NO: 239462 - DNA, 103 bp, Artificial Sequence
  Synthetic Polynucleotide
taatacgactcactatagggtcgtcgagggagtcttcagtatccactttgaacagaggagacaaagtatgtactgaagaaacctggcggcagcgcaaaagatg

SEQ ID NO: 239463 - DNA, 103 bp, Artificial Sequence
  Synthetic Polynucleotide
taatacgactcactatagggcggtagggcttctcgccagtgtgggtgcggaacagaggagaccgcacatgcactggcgaaacctggcggcagcgcaaaagatg

SEQ ID NO: 239464 - DNA, 103 bp, Artificial Sequence
  Synthetic Polynucleotide
taatacgactcactataggggtggggacagcggtagggcttctcgccagtaacagaggagaactggcatgaagccctacaacctggcggcagcgcaaaagatg

SEQ ID NO: 239465 - DNA, 103 bp, Artificial Sequence
  Synthetic Polynucleotide
taatacgactcactatagggcaaaggggcagtggggacagcggtagggctaacagaggagaagccctatggctgtccccaacctggcggcagcgcaaaagatg

SEQ ID NO: 239466 - DNA, 103 bp, Artificial Sequence
  Synthetic Polynucleotide
taatacgactcactatagggctgctgcaggcaaaggggcagtggggacagaacagaggagactgtccatgctgccccttaacctggcggcagcgcaaaagatg

SEQ ID NO: 239467 - DNA, 103 bp, Artificial Sequence
  Synthetic Polynucleotide
taatacgactcactataggggttgcccaggctgctgcaggcaaaggggcaaacagaggagatgccccatggcctgcagcaacctggcggcagcgcaaaagatg

SEQ ID NO: 239468 - DNA, 103 bp, Artificial Sequence
  Synthetic Polynucleotide
taatacgactcactataggggccgcctcaggttgcccaggctgctgcaggaacagaggagacctgcaatggcctgggcaaacctggcggcagcgcaaaagatg

SEQ ID NO: 239469 - DNA, 103 bp, Artificial Sequence
  Synthetic Polynucleotide
taatacgactcactataggggtacgctgatgccgcctcaggttgcccaggaacagaggagacctgggatgcctgaggcgaacctggcggcagcgcaaaagatg

SEQ ID NO: 239470 - DNA, 103 bp, Artificial Sequence
  Synthetic Polynucleotide
taatacgactcactatagggccctgcgtgggtacgctgatgccgcctcagaacagaggagactgaggatgcatcagcgtaacctggcggcagcgcaaaagatg

SEQ ID NO: 239471 - DNA, 103 bp, Artificial Sequence
  Synthetic Polynucleotide
taatacgactcactataggggagtggggggccctgcgtgggtacgctgataacagaggagaatcagcatgcccacgcagaacctggcggcagcgcaaaagatg

SEQ ID NO: 239472 - DNA, 103 bp, Artificial Sequence
  Synthetic Polynucleotide
taatacgactcactataggggggcagggaggagtggggggccctgcgtggaacagaggagaccacgcatggccccccacaacctggcggcagcgcaaaagatg

SEQ ID NO: 239473 - DNA, 103 bp, Artificial Sequence
  Synthetic Polynucleotide
taatacgactcactatagggcccgggtccttcgtcgagggagtcttcagtaacagaggagaactgaaatgtccctcgacaacctggcggcagcgcaaaagatg

SEQ ID NO: 239474 - DNA, 103 bp, Artificial Sequence
  Synthetic Polynucleotide
taatacgactcactataggggccacaggtcgggcagggaggagtggggggaacagaggagaccccccatgcctccctgcaacctggcggcagcgcaaaagatg

SEQ ID NO: 239475 - DNA, 103 bp, Artificial Sequence
  Synthetic Polynucleotide
taatacgactcactatagggagcagcggaagccacaggtcgggcagggagaacagaggagactccctatgcgacctgtgaacctggcggcagcgcaaaagatg

SEQ ID NO: 239476 - DNA, 103 bp, Artificial Sequence
  Synthetic Polynucleotide
taatacgactcactatagggcgtggagtacagcagcggaagccacaggtcaacagaggagagacctgatgcttccgctgaacctggcggcagcgcaaaagatg

SEQ ID NO: 239477 - DNA, 103 bp, Artificial Sequence
  Synthetic Polynucleotide
taatacgactcactatagggccgggctggtcgtggagtacagcagcggaaaacagaggagattccgcatgtgtactccaaacctggcggcagcgcaaaagatg

SEQ ID NO: 239478 - DNA, 103 bp, Artificial Sequence
  Synthetic Polynucleotide
taatacgactcactataggggactgggaggccgggctggtcgtggagtacaacagaggagagtactcatggaccagcccaacctggcggcagcgcaaaagatg

SEQ ID NO: 239479 - DNA, 103 bp, Artificial Sequence
  Synthetic Polynucleotide
taatacgactcactatagggtgctctgtgggactgggaggccgggctggtaacagaggagaaccagcatggcctcccagaacctggcggcagcgcaaaagatg

SEQ ID NO: 239480 - DNA, 103 bp, Artificial Sequence
  Synthetic Polynucleotide
taatacgactcactatagggcgccccctcctgctctgtgggactgggaggaacagaggagacctcccatgcccacagagaacctggcggcagcgcaaaagatg

SEQ ID NO: 239481 - DNA, 103 bp, Artificial Sequence
  Synthetic Polynucleotide
taatacgactcactataggggccggggcaccgccccctcctgctctgtggaacagaggagaccacagatgaggagggggaacctggcggcagcgcaaaagatg

SEQ ID NO: 239482 - DNA, 103 bp, Artificial Sequence
  Synthetic Polynucleotide
taatacgactcactatagggtcttcaggtcgccggggcaccgccccctccaacagaggagaggagggatgggtgccccgaacctggcggcagcgcaaaagatg

SEQ ID NO: 239483 - DNA, 103 bp, Artificial Sequence
  Synthetic Polynucleotide
taatacgactcactataggggagcagagcatcttcaggtcgccggggcacaacagaggagagtgcccatgcgacctgaaaacctggcggcagcgcaaaagatg

SEQ ID NO: 239484 - DNA, 103 bp, Artificial Sequence
  Synthetic Polynucleotide
taatacgactcactatagggataccagggccccgggtccttcgtcgagggaacagaggagaccctcgatgaaggacccgaacctggcggcagcgcaaaagatg

SEQ ID NO: 239485 - DNA, 103 bp, Artificial Sequence
  Synthetic Polynucleotide
taatacgactcactatagggaatctggaaggagcagagcatcttcaggtcaacagaggagagacctgatgatgctctgcaacctggcggcagcgcaaaagatg

SEQ ID NO: 239486 - DNA, 103 bp, Artificial Sequence
  Synthetic Polynucleotide
taatacgactcactatagggtggaggctcaaatctggaaggagcagagcaaacagaggagatgctctatgccttccagaaacctggcggcagcgcaaaagatg

SEQ ID NO: 239487 - DNA, 103 bp, Artificial Sequence
  Synthetic Polynucleotide
taatacgactcactatagggtggtggcacatggaggctcaaatctggaagaacagaggagacttccaatgttgagcctcaacctggcggcagcgcaaaagatg

SEQ ID NO: 239488 - DNA, 103 bp, Artificial Sequence
  Synthetic Polynucleotide
taatacgactcactatagggtggcaccacctggtggcacatggaggctcaaacagaggagatgagccatgatgtgccacaacctggcggcagcgcaaaagatg

SEQ ID NO: 239489 - DNA, 103 bp, Artificial Sequence
  Synthetic Polynucleotide
taatacgactcactatagggggcaggaaactggcaccacctggtggcacaaacagaggagatgtgccatgaggtggtgcaacctggcggcagcgcaaaagatg

SEQ ID NO: 239490 - DNA, 103 bp, Artificial Sequence
  Synthetic Polynucleotide
taatacgactcactatagggcccacagtctggcaggaaactggcaccaccaacagaggagaggtggtatgagtttcctgaacctggcggcagcgcaaaagatg

SEQ ID NO: 239491 - DNA, 103 bp, Artificial Sequence
  Synthetic Polynucleotide
taatacgactcactatagggcccgcagctgcccacagtctggcaggaaacaacagaggagagtttccatgcagactgtgaacctggcggcagcgcaaaagatg

SEQ ID NO: 239492 - DNA, 103 bp, Artificial Sequence
  Synthetic Polynucleotide
taatacgactcactatagggtccccttcaccccgcagctgcccacagtctaacagaggagaagactgatggcagctgcgaacctggcggcagcgcaaaagatg

SEQ ID NO: 239493 - DNA, 103 bp, Artificial Sequence
  Synthetic Polynucleotide
taatacgactcactataggggcagaggccctccccttcaccccgcagctgaacagaggagacagctgatgggtgaagggaacctggcggcagcgcaaaagatg

SEQ ID NO: 239494 - DNA, 103 bp, Artificial Sequence
  Synthetic Polynucleotide
taatacgactcactatagggatccagtcccgcagaggccctccccttcacaacagaggagagtgaagatgagggcctctaacctggcggcagcgcaaaagatg

SEQ ID NO: 239495 - DNA, 103 bp, Artificial Sequence
  Synthetic Polynucleotide
taatacgactcactatagggtcactctccaataccagggccccgggtcctaacagaggagaaggaccatgggccctggtaacctggcggcagcgcaaaagatg

SEQ ID NO: 239496 - DNA, 103 bp, Artificial Sequence
  Synthetic Polynucleotide
taatacgactcactatagggagtggttctgatccagtcccgcagaggcccaacagaggagagggcctatgcgggactggaacctggcggcagcgcaaaagatg

SEQ ID NO: 239497 - DNA, 103 bp, Artificial Sequence
  Synthetic Polynucleotide
taatacgactcactatagggcagctctggcagtggttctgatccagtcccaacagaggagagggactatgtcagaaccaaacctggcggcagcgcaaaagatg

SEQ ID NO: 239498 - DNA, 103 bp, Artificial Sequence
  Synthetic Polynucleotide
taatacgactcactatagggaagggaatagcagctctggcagtggttctgaacagaggagacagaacatgtgccagagcaacctggcggcagcgcaaaagatg

SEQ ID NO: 239499 - DNA, 103 bp, Artificial Sequence
  Synthetic Polynucleotide
taatacgactcactatagggcggcaggtccaagggaatagcagctctggcaacagaggagagccagaatggctattcccaacctggcggcagcgcaaaagatg

SEQ ID NO: 239500 - DNA, 103 bp, Artificial Sequence
  Synthetic Polynucleotide
taatacgactcactatagggtccacagccccggcaggtccaagggaatagaacagaggagactattcatgtggacctgcaacctggcggcagcgcaaaagatg

SEQ ID NO: 239501 - DNA, 103 bp, Artificial Sequence
  Synthetic Polynucleotide
taatacgactcactatagggccagctcttgtccacagccccggcaggtccaacagaggagaggacctatgggggctgtgaacctggcggcagcgcaaaagatg

SEQ ID NO: 239502 - DNA, 103 bp, Artificial Sequence
  Synthetic Polynucleotide
taatacgactcactatagggtcaccctcctccagctcttgtccacagcccaacagaggagagggctgatgacaagagctaacctggcggcagcgcaaaagatg

SEQ ID NO: 239503 - DNA, 103 bp, Artificial Sequence
  Synthetic Polynucleotide
taatacgactcactatagggccgactaccctcaccctcctccagctcttgaacagaggagacaagagatggaggagggtaacctggcggcagcgcaaaagatg

SEQ ID NO: 239504 - DNA, 103 bp, Artificial Sequence
  Synthetic Polynucleotide
taatacgactcactatagggcagctcccagccgactaccctcaccctcctaacagaggagaaggaggatgagggtagtcaacctggcggcagcgcaaaagatg

SEQ ID NO: 239505 - DNA, 103 bp, Artificial Sequence
  Synthetic Polynucleotide
taatacgactcactatagggccacacatggcagctcccagccgactacccaacagaggagagggtagatggctgggagcaacctggcggcagcgcaaaagatg

SEQ ID NO: 239506 - DNA, 103 bp, Artificial Sequence
  Synthetic Polynucleotide
taatacgactcactatagggctccatctcggcctctctgttgcgatccataacagaggagaatggatatgaacagagagaacctggcggcagcgcaaaagatg

SEQ ID NO: 239507 - DNA, 103 bp, Artificial Sequence
  Synthetic Polynucleotide
taatacgactcactataggggccgcagatgcagcaggtgtggcaggtagcaacagaggagagctaccatgcacacctgcaacctggcggcagcgcaaaagatg

SEQ ID NO: 239508 - DNA, 103 bp, Artificial Sequence
  Synthetic Polynucleotide
taatacgactcactataggggcacttggcgcagacctcgtagaggctcagaacagaggagactgagcatgtacgaggtcaacctggcggcagcgcaaaagatg

SEQ ID NO: 239509 - DNA, 103 bp, Artificial Sequence
  Synthetic Polynucleotide
taatacgactcactatagggacaggttcccgcacttggcgcagacctcgtaacagaggagaacgaggatggcgccaagtaacctggcggcagcgcaaaagatg

SEQ ID NO: 239510 - DNA, 103 bp, Artificial Sequence
  Synthetic Polynucleotide
taatacgactcactatagggaggtttgtaaacaggttcccgcacttggcgaacagaggagacgccaaatgcgggaacctaacctggcggcagcgcaaaagatg

SEQ ID NO: 239511 - DNA, 103 bp, Artificial Sequence
  Synthetic Polynucleotide
taatacgactcactatagggcaagctgtccaggtttgtaaacaggttcccaacagaggagagggaacatgtttacaaacaacctggcggcagcgcaaaagatg

SEQ ID NO: 239512 - DNA, 103 bp, Artificial Sequence
  Synthetic Polynucleotide
taatacgactcactatagggtgtgggcgttcaagctgtccaggtttgtaaaacagaggagattacaaatgtggacagctaacctggcggcagcgcaaaagatg

SEQ ID NO: 239513 - DNA, 103 bp, Artificial Sequence
  Synthetic Polynucleotide
taatacgactcactatagggtggatggcattgtgggcgttcaagctgtccaacagaggagaggacagatggaacgcccaaacctggcggcagcgcaaaagatg

SEQ ID NO: 239514 - DNA, 103 bp, Artificial Sequence
  Synthetic Polynucleotide
taatacgactcactataggggactctgcggtggatggcattgtgggcgttaacagaggagaaacgccatgaatgccatcaacctggcggcagcgcaaaagatg

SEQ ID NO: 239515 - DNA, 103 bp, Artificial Sequence
  Synthetic Polynucleotide
taatacgactcactatagggggctggcctcgactctgcggtggatggcataacagaggagaatgccaatgaccgcagagaacctggcggcagcgcaaaagatg

SEQ ID NO: 239516 - DNA, 103 bp, Artificial Sequence
  Synthetic Polynucleotide
taatacgactcactataggggcgcgcgtgcggctggcctcgactctgcggaacagaggagaccgcagatgcgaggccagaacctggcggcagcgcaaaagatg

SEQ ID NO: 239517 - DNA, 103 bp, Artificial Sequence
  Synthetic Polynucleotide
taatacgactcactatagggctcggccggggcgcgcgtgcggctggcctcaacagaggagagaggccatgcgcacgcgcaacctggcggcagcgcaaaagatg

SEQ ID NO: 239518 - DNA, 103 bp, Artificial Sequence
  Synthetic Polynucleotide
taatacgactcactatagggggaagctcttgccgcagatgcagcaggtgtaacagaggagaacacctatggcatctgcgaacctggcggcagcgcaaaagatg

SEQ ID NO: 239519 - DNA, 103 bp, Artificial Sequence
  Synthetic Polynucleotide
taatacgactcactatagggccgccccctcctcggccggggcgcgcgtgcaacagaggagagcacgcatgccccggccgaacctggcggcagcgcaaaagatg

SEQ ID NO: 239520 - DNA, 103 bp, Artificial Sequence
  Synthetic Polynucleotide
taatacgactcactataggggagggcccctccgccccctcctcggccgggaacagaggagacccggcatgggagggggcaacctggcggcagcgcaaaagatg

SEQ ID NO: 239521 - DNA, 103 bp, Artificial Sequence
  Synthetic Polynucleotide
taatacgactcactatagggcttggtgtccgagggcccctccgccccctcaacagaggagagaggggatggaggggcccaacctggcggcagcgcaaaagatg

SEQ ID NO: 239522 - DNA, 103 bp, Artificial Sequence
  Synthetic Polynucleotide
taatacgactcactatagggggaagaactgcttggtgtccgagggcccctaacagaggagaaggggcatgcggacaccaaacctggcggcagcgcaaaagatg

SEQ ID NO: 239523 - DNA, 103 bp, Artificial Sequence
  Synthetic Polynucleotide
taatacgactcactatagggaggcactggaggaagaactgcttggtgtccaacagaggagaggacacatggcagttcttaacctggcggcagcgcaaaagatg

SEQ ID NO: 239524 - DNA, 103 bp, Artificial Sequence
  Synthetic Polynucleotide
taatacgactcactatagggcctcaggttcaggcactggaggaagaactgaacagaggagacagttcatgctccagtgcaacctggcggcagcgcaaaagatg

SEQ ID NO: 239525 - DNA, 103 bp, Artificial Sequence
  Synthetic Polynucleotide
taatacgactcactatagggccgccgacggcctcaggttcaggcactggaaacagaggagatccagtatgtgaacctgaaacctggcggcagcgcaaaagatg

SEQ ID NO: 239526 - DNA, 103 bp, Artificial Sequence
  Synthetic Polynucleotide
taatacgactcactataggggagtcgccggccgccgacggcctcaggttcaacagaggagagaacctatggccgtcggcaacctggcggcagcgcaaaagatg

SEQ ID NO: 239527 - DNA, 103 bp, Artificial Sequence
  Synthetic Polynucleotide
taatacgactcactataggggccagggcacgagtcgccggccgccgacggaacagaggagaccgtcgatggccggcgacaacctggcggcagcgcaaaagatg

SEQ ID NO: 239528 - DNA, 103 bp, Artificial Sequence
  Synthetic Polynucleotide
taatacgactcactatagggcggcctgcgtgccagggcacgagtcgccggaacagaggagaccggcgatgcgtgccctgaacctggcggcagcgcaaaagatg

SEQ ID NO: 239529 - DNA, 103 bp, Artificial Sequence
  Synthetic Polynucleotide
taatacgactcactatagggctctggaaggggaagctcttgccgcagatgaacagaggagacatctgatgcaagagcttaacctggcggcagcgcaaaagatg

SEQ ID NO: 239530 - DNA, 103 bp, Artificial Sequence
  Synthetic Polynucleotide
taatacgactcactatagggacccgccgtccggcctgcgtgccagggcacaacagaggagagtgcccatgcacgcaggcaacctggcggcagcgcaaaagatg

SEQ ID NO: 239531 - DNA, 103 bp, Artificial Sequence
  Synthetic Polynucleotide
taatacgactcactatagggcagctcagccacccgccgtccggcctgcgtaacagaggagaacgcagatgggacggcggaacctggcggcagcgcaaaagatg

SEQ ID NO: 239532 - DNA, 103 bp, Artificial Sequence
  Synthetic Polynucleotide
taatacgactcactatagggtgaccgggtccagctcagccacccgccgtcaacagaggagagacggcatgtggctgagcaacctggcggcagcgcaaaagatg

SEQ ID NO: 239533 - DNA, 103 bp, Artificial Sequence
  Synthetic Polynucleotide
taatacgactcactatagggtggtagctgttgaccgggtccagctcagccaacagaggagaggctgaatgggacccggtaacctggcggcagcgcaaaagatg

SEQ ID NO: 239534 - DNA, 103 bp, Artificial Sequence
  Synthetic Polynucleotide
taatacgactcactatagggctgccaggcctggtagctgttgaccgggtcaacagaggagagacccgatgaacagctacaacctggcggcagcgcaaaagatg

SEQ ID NO: 239535 - DNA, 103 bp, Artificial Sequence
  Synthetic Polynucleotide
taatacgactcactataggggcgtggccagctgccaggcctggtagctgtaacagaggagaacagctatgaggcctggcaacctggcggcagcgcaaaagatg

SEQ ID NO: 239536 - DNA, 103 bp, Artificial Sequence
  Synthetic Polynucleotide
taatacgactcactatagggaccttaccccgcgtggccagctgccaggccaacagaggagaggcctgatggctggccacaacctggcggcagcgcaaaagatg

SEQ ID NO: 239537 - DNA, 103 bp, Artificial Sequence
  Synthetic Polynucleotide
taatacgactcactatagggcggctcggccaccttaccccgcgtggccagaacagaggagactggccatgcggggtaagaacctggcggcagcgcaaaagatg

SEQ ID NO: 239538 - DNA, 103 bp, Artificial Sequence
  Synthetic Polynucleotide
taatacgactcactatagggggtactcggccggctcggccaccttaccccaacagaggagaggggtaatgtggccgagcaacctggcggcagcgcaaaagatg

SEQ ID NO: 239539 - DNA, 103 bp, Artificial Sequence
  Synthetic Polynucleotide
taatacgactcactatagggccgtacttgaggtactcggccggctcggccaacagaggagaggccgaatgggccgagtaaacctggcggcagcgcaaaagatg

SEQ ID NO: 239540 - DNA, 103 bp, Artificial Sequence
  Synthetic Polynucleotide
taatacgactcactatagggcgaaagcgagctctggaaggggaagctcttaacagaggagaaagagcatgcccttccagaacctggcggcagcgcaaaagatg

SEQ ID NO: 239541 - DNA, 103 bp, Artificial Sequence
  Synthetic Polynucleotide
taatacgactcactataggggtcccaggccccgtacttgaggtactcggcaacagaggagagccgagatgctcaagtacaacctggcggcagcgcaaaagatg

SEQ ID NO: 239542 - DNA, 103 bp, Artificial Sequence
  Synthetic Polynucleotide
taatacgactcactatagggccagcgcctcgtcccaggccccgtacttgaaacagaggagatcaagtatggggcctgggaacctggcggcagcgcaaaagatg

SEQ ID NO: 239543 - DNA, 103 bp, Artificial Sequence
  Synthetic Polynucleotide
taatacgactcactatagggacgtccccggccagcgcctcgtcccaggccaacagaggagaggcctgatgcgaggcgctaacctggcggcagcgcaaaagatg

SEQ ID NO: 239544 - DNA, 103 bp, Artificial Sequence
  Synthetic Polynucleotide
taatacgactcactataggggtcgaaggccacgtccccggccagcgcctcaacagaggagagaggcgatggccggggacaacctggcggcagcgcaaaagatg

SEQ ID NO: 239545 - DNA, 103 bp, Artificial Sequence
  Synthetic Polynucleotide
taatacgactcactataggggcctgtccttgtcgaaggccacgtccccggaacagaggagaccggggatgtggccttcgaacctggcggcagcgcaaaagatg

SEQ ID NO: 239546 - DNA, 103 bp, Artificial Sequence
  Synthetic Polynucleotide
taatacgactcactatagggacgtactcgcgcctgtccttgtcgaaggccaacagaggagaggccttatgcaaggacagaacctggcggcagcgcaaaagatg

SEQ ID NO: 239547 - DNA, 103 bp, Artificial Sequence
  Synthetic Polynucleotide
taatacgactcactataggggctcaccaggacgtactcgcgcctgtccttaacagaggagaaaggacatgcgcgagtacaacctggcggcagcgcaaaagatg

SEQ ID NO: 239548 - DNA, 103 bp, Artificial Sequence
  Synthetic Polynucleotide
taatacgactcactataggggcttctcctggctcaccaggacgtactcgcaacagaggagagcgagtatgtcctggtgaaacctggcggcagcgcaaaagatg

SEQ ID NO: 239549 - DNA, 103 bp, Artificial Sequence
  Synthetic Polynucleotide
taatacgactcactatagggtcacgcttgcgcttctcctggctcaccaggaacagaggagacctggtatgccaggagaaaacctggcggcagcgcaaaagatg

SEQ ID NO: 239550 - DNA, 103 bp, Artificial Sequence
  Synthetic Polynucleotide
taatacgactcactatagggtgcatcctgctcacgcttgcgcttctcctgaacagaggagacaggagatgcgcaagcgtaacctggcggcagcgcaaaagatg

SEQ ID NO: 239551 - DNA, 103 bp, Artificial Sequence
  Synthetic Polynucleotide
taatacgactcactataggggcatgtgctgcgaaagcgagctctggaaggaacagaggagaccttccatggctcgctttaacctggcggcagcgcaaaagatg

SEQ ID NO: 239552 - DNA, 103 bp, Artificial Sequence
  Synthetic Polynucleotide
taatacgactcactataggggcgcggctggtgcatcctgctcacgcttgcaacagaggagagcaagcatgagcaggatgaacctggcggcagcgcaaaagatg

SEQ ID NO: 239553 - DNA, 103 bp, Artificial Sequence
  Synthetic Polynucleotide
taatacgactcactataggggggggcccctgcgcggctggtgcatcctgcaacagaggagagcaggaatgaccagccgcaacctggcggcagcgcaaaagatg

SEQ ID NO: 239554 - DNA, 103 bp, Artificial Sequence
  Synthetic Polynucleotide
taatacgactcactataggggcgcttccgcgggggcccctgcgcggctggaacagaggagaccagccatgcaggggcccaacctggcggcagcgcaaaagatg

SEQ ID NO: 239555 - DNA, 103 bp, Artificial Sequence
  Synthetic Polynucleotide
taatacgactcactataggggcccgctcgcgcgcttccgcgggggcccctaacagaggagaaggggcatgcgcggaagcaacctggcggcagcgcaaaagatg

SEQ ID NO: 239556 - DNA, 103 bp, Artificial Sequence
  Synthetic Polynucleotide
taatacgactcactataggggggtccccaggcccgctcgcgcgcttccgcaacagaggagagcggaaatgcgcgagcggaacctggcggcagcgcaaaagatg

SEQ ID NO: 239557 - DNA, 103 bp, Artificial Sequence
  Synthetic Polynucleotide
taatacgactcactatagggggcgggcgcggggtccccaggcccgctcgcaacagaggagagcgagcatgcctggggacaacctggcggcagcgcaaaagatg

SEQ ID NO: 239558 - DNA, 103 bp, Artificial Sequence
  Synthetic Polynucleotide
taatacgactcactatagggcgaggtggccggcgggcgcggggtccccagaacagaggagactggggatgccgcgcccgaacctggcggcagcgcaaaagatg

SEQ ID NO: 239559 - DNA, 103 bp, Artificial Sequence
  Synthetic Polynucleotide
taatacgactcactataggggagcggggatcgaggtggccggcgggcgcgaacagaggagacgcgccatgcggccacctaacctggcggcagcgcaaaagatg

SEQ ID NO: 239560 - DNA, 103 bp, Artificial Sequence
  Synthetic Polynucleotide
taatacgactcactataggggcgcgcggccgagcggggatcgaggtggccaacagaggagaggccacatggatccccgcaacctggcggcagcgcaaaagatg

SEQ ID NO: 239561 - DNA, 103 bp, Artificial Sequence
  Synthetic Polynucleotide
taatacgactcactatagggtgcggttggggcgcgcggccgagcggggataacagaggagaatccccatgcggccgcgcaacctggcggcagcgcaaaagatg

SEQ ID NO: 239562 - DNA, 103 bp, Artificial Sequence
  Synthetic Polynucleotide
taatacgactcactataggggtgtgcttgcgcatgtgctgcgaaagcgagaacagaggagactcgctatggcagcacataacctggcggcagcgcaaaagatg

SEQ ID NO: 239563 - DNA, 103 bp, Artificial Sequence
  Synthetic Polynucleotide
taatacgactcactataggggctgcggccctgcggttggggcgcgcggccaacagaggagaggccgcatgccccaaccgaacctggcggcagcgcaaaagatg

SEQ ID NO: 239564 - DNA, 103 bp, Artificial Sequence
  Synthetic Polynucleotide
taatacgactcactataggggccggtggtggctgcggccctgcggttgggaacagaggagacccaacatgagggccgcaaacctggcggcagcgcaaaagatg

SEQ ID NO: 239565 - DNA, 103 bp, Artificial Sequence
  Synthetic Polynucleotide
taatacgactcactatagggacttgccctggccggtggtggctgcggcccaacagaggagagggccgatgccaccaccgaacctggcggcagcgcaaaagatg

SEQ ID NO: 239566 - DNA, 103 bp, Artificial Sequence
  Synthetic Polynucleotide
taatacgactcactatagggcactcggaggacttgccctggccggtggtgaacagaggagacaccacatgccagggcaaaacctggcggcagcgcaaaagatg

SEQ ID NO: 239567 - DNA, 103 bp, Artificial Sequence
  Synthetic Polynucleotide
taatacgactcactataggggcactcgaagcactcggaggacttgccctgaacagaggagacagggcatgtcctccgagaacctggcggcagcgcaaaagatg

SEQ ID NO: 239568 - DNA, 103 bp, Artificial Sequence
  Synthetic Polynucleotide
taatacgactcactatagggagatcttgccgcactcgaagcactcggaggaacagaggagacctccgatggcttcgagtaacctggcggcagcgcaaaagatg

SEQ ID NO: 239569 - DNA, 103 bp, Artificial Sequence
  Synthetic Polynucleotide
taatacgactcactatagggtaggtgcggaagatcttgccgcactcgaagaacagaggagacttcgaatgcggcaagataacctggcggcagcgcaaaagatg

SEQ ID NO: 239570 - DNA, 103 bp, Artificial Sequence
  Synthetic Polynucleotide
taatacgactcactatagggcatctgatgataggtgcggaagatcttgccaacagaggagaggcaagatgttccgcaccaacctggcggcagcgcaaaagatg

SEQ ID NO: 239571 - DNA, 103 bp, Artificial Sequence
  Synthetic Polynucleotide
taatacgactcactatagggagtgcagcaccatctgatgataggtgcggaaacagaggagatccgcaatgatcatcagaaacctggcggcagcgcaaaagatg

SEQ ID NO: 239572 - DNA, 103 bp, Artificial Sequence
  Synthetic Polynucleotide
taatacgactcactatagggtgcacgcgtgagtgcagcaccatctgatgaaacagaggagatcatcaatgggtgctgcaaacctggcggcagcgcaaaagatg

SEQ ID NO: 239573 - DNA, 103 bp, Artificial Sequence
  Synthetic Polynucleotide
taatacgactcactatagggcttctcgcccgtgtgcttgcgcatgtgctgaacagaggagacagcacatgcgcaagcacaacctggcggcagcgcaaaagatg

SEQ ID NO: 239574 - DNA, 103 bp, Artificial Sequence
  Synthetic Polynucleotide
taatacgactcactatagggcgcgcggcgatgcacgcgtgagtgcagcacaacagaggagagtgctgatgtcacgcgtgaacctggcggcagcgcaaaagatg

SEQ ID NO: 239575 - DNA, 103 bp, Artificial Sequence
  Synthetic Polynucleotide
taatacgactcactatagggtctcgcggcgcgcgcggcgatgcacgcgtgaacagaggagacacgcgatgatcgccgcgaacctggcggcagcgcaaaagatg

SEQ ID NO: 239576 - DNA, 103 bp, Artificial Sequence
  Synthetic Polynucleotide
taatacgactcactatagggtcactgtccctctcgcggcgcgcgcggcgaaacagaggagatcgccgatggcgccgcgaaacctggcggcagcgcaaaagatg

SEQ ID NO: 239577 - DNA, 103 bp, Artificial Sequence
  Synthetic Polynucleotide
taatacgactcactatagggcctgtccccgtcactgtccctctcgcggcgaacagaggagacgccgcatgagggacagtaacctggcggcagcgcaaaagatg

SEQ ID NO: 239578 - DNA, 103 bp, Artificial Sequence
  Synthetic Polynucleotide
taatacgactcactatagggcccgcgccgccctgtccccgtcactgtcccaacagaggagagggacaatgacggggacaaacctggcggcagcgcaaaagatg

SEQ ID NO: 239579 - DNA, 103 bp, Artificial Sequence
  Synthetic Polynucleotide
taatacgactcactatagggccgcagcgggcccgcgccgccctgtccccgaacagaggagacggggaatgggcggcgcgaacctggcggcagcgcaaaagatg

SEQ ID NO: 239580 - DNA, 103 bp, Artificial Sequence
  Synthetic Polynucleotide
taatacgactcactatagggactgagtgatccgcagcgggcccgcgccgcaacagaggagagcggcgatggcccgctgcaacctggcggcagcgcaaaagatg

SEQ ID NO: 239581 - DNA, 103 bp, Artificial Sequence
  Synthetic Polynucleotide
taatacgactcactatagggagtcaccctcactgagtgatccgcagcgggaacagaggagacccgctatggatcactcaaacctggcggcagcgcaaaagatg

SEQ ID NO: 239582 - DNA, 103 bp, Artificial Sequence
  Synthetic Polynucleotide
taatacgactcactatagggtgggaggccgagtcaccctcactgagtgataacagaggagaatcactatgtgagggtgaaacctggcggcagcgcaaaagatg

SEQ ID NO: 239583 - DNA, 103 bp, Artificial Sequence
  Synthetic Polynucleotide
taatacgactcactataggggctgctgggctgggaggccgagtcaccctcaacagaggagagagggtatgtcggcctccaacctggcggcagcgcaaaagatg

SEQ ID NO: 239584 - DNA, 103 bp, Artificial Sequence
  Synthetic Polynucleotide
taatacgactcactatagggacttgtagggcttctcgcccgtgtgcttgcaacagaggagagcaagcatgcgggcgagaaacctggcggcagcgcaaaagatg

SEQ ID NO: 239585 - DNA, 103 bp, Artificial Sequence
  Synthetic Polynucleotide
taatacgactcactatagggcggagccagggctgctgggctgggaggccgaacagaggagacggcctatgagcccagcaaacctggcggcagcgcaaaagatg

SEQ ID NO: 239586 - DNA, 103 bp, Artificial Sequence
  Synthetic Polynucleotide
taatacgactcactataggggcggcacaggcggagccagggctgctgggcaacagaggagagcccagatgccctggctcaacctggcggcagcgcaaaagatg

SEQ ID NO: 239587 - DNA, 103 bp, Artificial Sequence
  Synthetic Polynucleotide
taatacgactcactatagggggagtcagcagcggcacaggcggagccaggaacagaggagacctggcatggcctgtgccaacctggcggcagcgcaaaagatg

SEQ ID NO: 239588 - DNA, 103 bp, Artificial Sequence
  Synthetic Polynucleotide
taatacgactcactatagggcagagcccggggagtcagcagcggcacaggaacagaggagacctgtgatgctgctgactaacctggcggcagcgcaaaagatg

SEQ ID NO: 239589 - DNA, 103 bp, Artificial Sequence
  Synthetic Polynucleotide
taatacgactcactatagggtcggccaggccagagcccggggagtcagcaaacagaggagatgctgaatgcccgggctcaacctggcggcagcgcaaaagatg

SEQ ID NO: 239590 - DNA, 103 bp, Artificial Sequence
  Synthetic Polynucleotide
taatacgactcactatagggggcagcctcgtcggccaggccagagcccggaacagaggagaccgggcatgggcctggccaacctggcggcagcgcaaaagatg

SEQ ID NO: 239591 - DNA, 103 bp, Artificial Sequence
  Synthetic Polynucleotide
taatacgactcactatagggcactgtcttcggcagcctcgtcggccaggcaacagaggagagcctggatgacgaggctgaacctggcggcagcgcaaaagatg

SEQ ID NO: 239592 - DNA, 103 bp, Artificial Sequence
  Synthetic Polynucleotide
taatacgactcactatagggccctcctcaccactgtcttcggcagcctcgaacagaggagacgaggcatgcgaagacagaacctggcggcagcgcaaaagatg

SEQ ID NO: 239593 - DNA, 103 bp, Artificial Sequence
  Synthetic Polynucleotide
taatacgactcactatagggttcaggggcgccctcctcaccactgtcttcaacagaggagagaagacatgggtgaggagaacctggcggcagcgcaaaagatg

SEQ ID NO: 239594 - DNA, 103 bp, Artificial Sequence
  Synthetic Polynucleotide
taatacgactcactatagggctggtgcaggttcaggggcgccctcctcacaacagaggagagtgaggatggcgcccctgaacctggcggcagcgcaaaagatg

SEQ ID NO: 239595 - DNA, 103 bp, Artificial Sequence
  Synthetic Polynucleotide
taatacgactcactatagggcagtagggacacttgtagggcttctcgcccaacagaggagagggcgaatggccctacaaaacctggcggcagcgcaaaagatg

SEQ ID NO: 239596 - DNA, 103 bp, Artificial Sequence
  Synthetic Polynucleotide
taatacgactcactatagggggctgtccccctggtgcaggttcaggggcgaacagaggagacgccccatgacctgcaccaacctggcggcagcgcaaaagatg

SEQ ID NO: 239597 - DNA, 103 bp, Artificial Sequence
  Synthetic Polynucleotide
taatacgactcactataggggcagcggcgcggctgtccccctggtgcaggaacagaggagacctgcaatggggggacagaacctggcggcagcgcaaaagatg

SEQ ID NO: 239598 - DNA, 103 bp, Artificial Sequence
  Synthetic Polynucleotide
taatacgactcactatagggcggaaaagcagcagcggcgcggctgtccccaacagaggagaggggacatgcgcgccgctaacctggcggcagcgcaaaagatg

SEQ ID NO: 239599 - DNA, 103 bp, Artificial Sequence
  Synthetic Polynucleotide
taatacgactcactataggggtcacctcttcggaaaagcagcagcggcgcaacagaggagagcgccgatgctgcttttcaacctggcggcagcgcaaaagatg

SEQ ID NO: 239600 - DNA, 103 bp, Artificial Sequence
  Synthetic Polynucleotide
taatacgactcactatagggctcggtcgaagtcacctcttcggaaaagcaaacagaggagatgctttatggaagaggtgaacctggcggcagcgcaaaagatg

SEQ ID NO: 239601 - DNA, 103 bp, Artificial Sequence
  Synthetic Polynucleotide
taatacgactcactatagggcactggagagctcggtcgaagtcacctcttaacagaggagaaagaggatgcttcgaccgaacctggcggcagcgcaaaagatg

SEQ ID NO: 239602 - DNA, 103 bp, Artificial Sequence
  Synthetic Polynucleotide
taatacgactcactatagggctctggtctccactggagagctcggtcgaaaacagaggagattcgacatggctctccagaacctggcggcagcgcaaaagatg

SEQ ID NO: 239603 - DNA, 103 bp, Artificial Sequence
  Synthetic Polynucleotide
taatacgactcactatagggcatcttgtgactctggtctccactggagagaacagaggagactctccatgggagaccagaacctggcggcagcgcaaaagatg

SEQ ID NO: 239604 - DNA, 103 bp, Artificial Sequence
  Synthetic Polynucleotide
taatacgactcactatagggcgttatctcccatcttgtgactctggtctcaacagaggagagagaccatggtcacaagaaacctggcggcagcgcaaaagatg

SEQ ID NO: 239605 - DNA, 103 bp, Artificial Sequence
  Synthetic Polynucleotide
taatacgactcactatagggctttccgaggcgttatctcccatcttgtgaaacagaggagatcacaaatggggagataaaacctggcggcagcgcaaaagatg

SEQ ID NO: 239606 - DNA, 103 bp, Artificial Sequence
  Synthetic Polynucleotide
taatacgactcactatagggccggtggtcgcagtagggacacttgtagggaacagaggagaccctacatgtgtccctacaacctggcggcagcgcaaaagatg

SEQ ID NO: 239607 - DNA, 103 bp, Artificial Sequence
  Synthetic Polynucleotide
taatacgactcactataggggccggtgtctctttccgaggcgttatctccaacagaggagaggagatatggcctcggaaaacctggcggcagcgcaaaagatg

SEQ ID NO: 239608 - DNA, 103 bp, Artificial Sequence
  Synthetic Polynucleotide
taatacgactcactatagggccttggactcgccggtgtctctttccgaggaacagaggagacctcggatggagacaccgaacctggcggcagcgcaaaagatg

SEQ ID NO: 239609 - DNA, 103 bp, Artificial Sequence
  Synthetic Polynucleotide
taatacgactcactataggggcgatccctgccttggactcgccggtgtctaacagaggagaagacacatgcgagtccaaaacctggcggcagcgcaaaagatg

SEQ ID NO: 239610 - DNA, 103 bp, Artificial Sequence
  Synthetic Polynucleotide
taatacgactcactatagggcacagaagctgcgatccctgccttggactcaacagaggagagagtccatggcagggatcaacctggcggcagcgcaaaagatg

SEQ ID NO: 239611 - DNA, 103 bp, Artificial Sequence
  Synthetic Polynucleotide
taatacgactcactatagggcaagtatggacacagaagctgcgatccctgaacagaggagacagggaatgcagcttctgaacctggcggcagcgcaaaagatg

SEQ ID NO: 239612 - DNA, 103 bp, Artificial Sequence
  Synthetic Polynucleotide
taatacgactcactatagggctactgttttcaagtatggacacagaagctaacagaggagaagcttcatggtccatactaacctggcggcagcgcaaaagatg

SEQ ID NO: 239613 - DNA, 103 bp, Artificial Sequence
  Synthetic Polynucleotide
taatacgactcactatagggagtctctctgctactgttttcaagtatggaaacagaggagatccataatggaaaacagtaacctggcggcagcgcaaaagatg

SEQ ID NO: 239614 - DNA, 103 bp, Artificial Sequence
  Synthetic Polynucleotide
taatacgactcactataggggccttctagaagtctctctgctactgttttaacagaggagaaaaacaatggcagagagaaacctggcggcagcgcaaaagatg

SEQ ID NO: 239615 - DNA, 103 bp, Artificial Sequence
  Synthetic Polynucleotide
taatacgactcactatagggtgctgctcttgccttctagaagtctctctgaacagaggagacagagaatgttctagaagaacctggcggcagcgcaaaagatg

SEQ ID NO: 239616 - DNA, 103 bp, Artificial Sequence
  Synthetic Polynucleotide
taatacgactcactatagggagaaaatctgtgctgctcttgccttctagaaacagaggagatctagaatgcaagagcagaacctggcggcagcgcaaaagatg

SEQ ID NO: 239617 - DNA, 103 bp, Artificial Sequence
  Synthetic Polynucleotide
taatacgactcactatagggctcgcctcagctccatctcggcctctctgtaacagaggagaacagagatgccgagatggaacctggcggcagcgcaaaagatg

SEQ ID NO: 239618 - DNA, 103 bp, Artificial Sequence
  Synthetic Polynucleotide
taatacgactcactatagggtctgggaagcccggtggtcgcagtagggacaacagaggagagtccctatggcgaccaccaacctggcggcagcgcaaaagatg

SEQ ID NO: 239619 - DNA, 103 bp, Artificial Sequence
  Synthetic Polynucleotide
taatacgactcactatagggttaagtccatagaaaatctgtgctgctcttaacagaggagaaagagcatgacagattttaacctggcggcagcgcaaaagatg

SEQ ID NO: 239620 - DNA, 103 bp, Artificial Sequence
  Synthetic Polynucleotide
taatacgactcactataggggctggcatctttaagtccatagaaaatctgaacagaggagacagattatgtatggacttaacctggcggcagcgcaaaagatg

SEQ ID NO: 239621 - DNA, 103 bp, Artificial Sequence
  Synthetic Polynucleotide
taatacgactcactatagggggggtgaaatgctggcatctttaagtccataacagaggagaatggacatgaagatgccaaacctggcggcagcgcaaaagatg

SEQ ID NO: 239622 - DNA, 103 bp, Artificial Sequence
  Synthetic Polynucleotide
taatacgactcactatagggcctcctgcttggggtgaaatgctggcatctaacagaggagaagatgcatgcatttcaccaacctggcggcagcgcaaaagatg

SEQ ID NO: 239623 - DNA, 103 bp, Artificial Sequence
  Synthetic Polynucleotide
taatacgactcactataggggggacgggcacctcctgcttggggtgaaataacagaggagaatttcaatgcaagcaggaaacctggcggcagcgcaaaagatg

SEQ ID NO: 239624 - DNA, 103 bp, Artificial Sequence
  Synthetic Polynucleotide
taatacgactcactatagggaccatcaccagggacgggcacctcctgcttaacagaggagaaagcagatggtgcccgtcaacctggcggcagcgcaaaagatg

SEQ ID NO: 239625 - DNA, 103 bp, Artificial Sequence
  Synthetic Polynucleotide
taatacgactcactatagggggaactccacaccatcaccagggacgggcaaacagaggagatgcccgatgctggtgatgaacctggcggcagcgcaaaagatg

SEQ ID NO: 239626 - DNA, 103 bp, Artificial Sequence
  Synthetic Polynucleotide
taatacgactcactataggggtactggaagggaactccacaccatcaccaaacagaggagatggtgaatgtgtggagttaacctggcggcagcgcaaaagatg

SEQ ID NO: 239627 - DNA, 103 bp, Artificial Sequence
  Synthetic Polynucleotide
taatacgactcactatagggctccgctcccgtactggaagggaactccacaacagaggagagtggagatgccttccagtaacctggcggcagcgcaaaagatg

SEQ ID NO: 239628 - DNA, 103 bp, Artificial Sequence
  Synthetic Polynucleotide
taatacgactcactatagggccgtctggccctccgctcccgtactggaagaacagaggagacttccaatgcgggagcggaacctggcggcagcgcaaaagatg

SEQ ID NO: 239629 - DNA, 103 bp, Artificial Sequence
  Synthetic Polynucleotide
taatacgactcactatagggaggttgcccttctgggaagcccggtggtcgaacagaggagacgaccaatgggcttcccaaacctggcggcagcgcaaaagatg

SEQ ID NO: 239630 - DNA, 103 bp, Artificial Sequence
  Synthetic Polynucleotide
taatacgactcactataggggcagggtgacccgtctggccctccgctcccaacagaggagagggagcatggggccagacaacctggcggcagcgcaaaagatg

SEQ ID NO: 239631 - DNA, 103 bp, Artificial Sequence
  Synthetic Polynucleotide
taatacgactcactatagggcagcttttctgcagggtgacccgtctggccaacagaggagaggccagatgggtcaccctaacctggcggcagcgcaaaagatg

SEQ ID NO: 239632 - DNA, 103 bp, Artificial Sequence
  Synthetic Polynucleotide
taatacgactcactataggggcaaatcggacagcttttctgcagggtgacaacagaggagagtcaccatgcagaaaagcaacctggcggcagcgcaaaagatg

SEQ ID NO: 239633 - DNA, 103 bp, Artificial Sequence
  Synthetic Polynucleotide
taatacgactcactatagggtccttgttgtgcaaatcggacagcttttctaacagaggagaagaaaaatggtccgatttaacctggcggcagcgcaaaagatg

SEQ ID NO: 239634 - DNA, 103 bp, Artificial Sequence
  Synthetic Polynucleotide
taatacgactcactatagggcccagagtgttccttgttgtgcaaatcggaaacagaggagatccgatatgcacaacaagaacctggcggcagcgcaaaagatg

SEQ ID NO: 239635 - DNA, 103 bp, Artificial Sequence
  Synthetic Polynucleotide
taatacgactcactataggggcttccctcccccagagtgttccttgttgtaacagaggagaacaacaatgaacactctgaacctggcggcagcgcaaaagatg

SEQ ID NO: 239636 - DNA, 103 bp, Artificial Sequence
  Synthetic Polynucleotide
taatacgactcactataggggccagcgcccgcttccctcccccagagtgtaacagaggagaacactcatggggagggaaaacctggcggcagcgcaaaagatg

SEQ ID NO: 239637 - DNA, 103 bp, Artificial Sequence
  Synthetic Polynucleotide
taatacgactcactataggggaggtctggggccagcgcccgcttccctccaacagaggagaggagggatgcgggcgctgaacctggcggcagcgcaaaagatg

SEQ ID NO: 239638 - DNA, 103 bp, Artificial Sequence
  Synthetic Polynucleotide
taatacgactcactatagggctagcggcatgaggtctggggccagcgcccaacagaggagagggcgcatgccccagaccaacctggcggcagcgcaaaagatg

SEQ ID NO: 239639 - DNA, 103 bp, Artificial Sequence
  Synthetic Polynucleotide
taatacgactcactataggggcacttaaatctagcggcatgaggtctgggaacagaggagacccagaatgcatgccgctaacctggcggcagcgcaaaagatg

SEQ ID NO: 239640 - DNA, 103 bp, Artificial Sequence
  Synthetic Polynucleotide
taatacgactcactataggggtgaatcttcaggttgcccttctgggaagcaacagaggagagcttccatgaagggcaacaacctggcggcagcgcaaaagatg

SEQ ID NO: 239641 - DNA, 103 bp, Artificial Sequence
  Synthetic Polynucleotide
taatacgactcactatagggcgtcgacctcgcacttaaatctagcggcataacagaggagaatgccgatggatttaagtaacctggcggcagcgcaaaagatg

SEQ ID NO: 239642 - DNA, 103 bp, Artificial Sequence
  Synthetic Polynucleotide
taatacgactcactatagggggtcatcccgcgtcgacctcgcacttaaataacagaggagaatttaaatgcgaggtcgaaacctggcggcagcgcaaaagatg

SEQ ID NO: 239643 - DNA, 103 bp, Artificial Sequence
  Synthetic Polynucleotide
taatacgactcactatagggttattgctggggtcatcccgcgtcgacctcaacagaggagagaggtcatggcgggatgaaacctggcggcagcgcaaaagatg

SEQ ID NO: 239644 - DNA, 103 bp, Artificial Sequence
  Synthetic Polynucleotide
taatacgactcactatagggggccgtctccttattgctggggtcatcccgaacagaggagacgggatatgcccagcaataacctggcggcagcgcaaaagatg

SEQ ID NO: 239645 - DNA, 103 bp, Artificial Sequence
  Synthetic Polynucleotide
taatacgactcactataggggcagggaggaggccgtctccttattgctggaacagaggagaccagcaatgaggagacggaacctggcggcagcgcaaaagatg

SEQ ID NO: 239646 - DNA, 103 bp, Artificial Sequence
  Synthetic Polynucleotide
taatacgactcactatagggaaagccgcctgcagggaggaggccgtctccaacagaggagaggagacatgctcctccctaacctggcggcagcgcaaaagatg

SEQ ID NO: 239647 - DNA, 103 bp, Artificial Sequence
  Synthetic Polynucleotide
taatacgactcactataggggtgaacgactaaagccgcctgcagggaggaaacagaggagatcctccatgcaggcggctaacctggcggcagcgcaaaagatg

SEQ ID NO: 239648 - DNA, 103 bp, Artificial Sequence
  Synthetic Polynucleotide
taatacgactcactatagggaaggacacgggtgaacgactaaagccgcctaacagaggagaaggcggatgtagtcgttcaacctggcggcagcgcaaaagatg

SEQ ID NO: 239649 - DNA, 103 bp, Artificial Sequence
  Synthetic Polynucleotide
taatacgactcactatagggtggctgcagtaaggacacgggtgaacgactaacagaggagaagtcgtatgcccgtgtccaacctggcggcagcgcaaaagatg

SEQ ID NO: 239650 - DNA, 103 bp, Artificial Sequence
  Synthetic Polynucleotide
taatacgactcactataggggtaggtcttgtggctgcagtaaggacacggaacagaggagaccgtgtatgtactgcagcaacctggcggcagcgcaaaagatg

SEQ ID NO: 239651 - DNA, 103 bp, Artificial Sequence
  Synthetic Polynucleotide
taatacgactcactatagggggctccggatgtgaatcttcaggttgccctaacagaggagaagggcaatgtgaagattcaacctggcggcagcgcaaaagatg

SEQ ID NO: 239652 - DNA, 103 bp, Artificial Sequence
  Synthetic Polynucleotide
taatacgactcactatagggcctcggggtagtaggtcttgtggctgcagtaacagaggagaactgcaatgacaagacctaacctggcggcagcgcaaaagatg

SEQ ID NO: 239653 - DNA, 103 bp, Artificial Sequence
  Synthetic Polynucleotide
taatacgactcactatagggatccacaggacctcggggtagtaggtcttgaacagaggagacaagacatgctaccccgaaacctggcggcagcgcaaaagatg

SEQ ID NO: 239654 - DNA, 103 bp, Artificial Sequence
  Synthetic Polynucleotide
taatacgactcactataggggcgtttgtgcatccacaggacctcggggtaaacagaggagataccccatggtcctgtggaacctggcggcagcgcaaaagatg

SEQ ID NO: 239655 - DNA, 103 bp, Artificial Sequence
  Synthetic Polynucleotide
taatacgactcactatagggggtgccagatgcgtttgtgcatccacaggaaacagaggagatcctgtatgtgcacaaacaacctggcggcagcgcaaaagatg

SEQ ID NO: 239656 - DNA, 103 bp, Artificial Sequence
  Synthetic Polynucleotide
taatacgactcactatagggcagctgacgcggtgccagatgcgtttgtgcaacagaggagagcacaaatgcatctggcaaacctggcggcagcgcaaaagatg

SEQ ID NO: 239657 - DNA, 103 bp, Artificial Sequence
  Synthetic Polynucleotide
taatacgactcactatagggcacggagttgcagctgacgcggtgccagataacagaggagaatctggatgcgcgtcagcaacctggcggcagcgcaaaagatg

SEQ ID NO: 239658 - DNA, 103 bp, Artificial Sequence
  Synthetic Polynucleotide
taatacgactcactatagggacgggggagccacggagttgcagctgacgcaacagaggagagcgtcaatggcaactccgaacctggcggcagcgcaaaagatg

SEQ ID NO: 239659 - DNA, 103 bp, Artificial Sequence
  Synthetic Polynucleotide
taatacgactcactatagggggctgaatccacgggggagccacggagttgaacagaggagacaactcatgggctcccccaacctggcggcagcgcaaaagatg

SEQ ID NO: 239660 - DNA, 103 bp, Artificial Sequence
  Synthetic Polynucleotide
taatacgactcactataggggtaaccattgggctgaatccacgggggagcaacagaggagagctcccatgtggattcagaacctggcggcagcgcaaaagatg

SEQ ID NO: 239661 - DNA, 103 bp, Artificial Sequence
  Synthetic Polynucleotide
taatacgactcactatagggtgatgcttttgtaaccattgggctgaatccaacagaggagaggattcatgccaatggttaacctggcggcagcgcaaaagatg

SEQ ID NO: 239662 - DNA, 103 bp, Artificial Sequence
  Synthetic Polynucleotide
taatacgactcactatagggcccgtgcggtggctccggatgtgaatcttcaacagaggagagaagatatgcatccggagaacctggcggcagcgcaaaagatg

SEQ ID NO: 239663 - DNA, 103 bp, Artificial Sequence
  Synthetic Polynucleotide
taatacgactcactatagggaaattgcttctgatgcttttgtaaccattgaacagaggagacaatggatgcaaaagcataacctggcggcagcgcaaaagatg

SEQ ID NO: 239664 - DNA, 103 bp, Artificial Sequence
  Synthetic Polynucleotide
taatacgactcactatagggaaggaaaaccaaattgcttctgatgcttttaacagaggagaaaaagcatgagaagcaataacctggcggcagcgcaaaagatg

SEQ ID NO: 239665 - DNA, 103 bp, Artificial Sequence
  Synthetic Polynucleotide
taatacgactcactatagggcgctccgggaaaggaaaaccaaattgcttcaacagaggagagaagcaatgtggttttccaacctggcggcagcgcaaaagatg

SEQ ID NO: 239666 - DNA, 103 bp, Artificial Sequence
  Synthetic Polynucleotide
taatacgactcactatagggcccgtgcgtccgctccgggaaaggaaaaccaacagaggagaggttttatgttcccggagaacctggcggcagcgcaaaagatg

SEQ ID NO: 239667 - DNA, 103 bp, Artificial Sequence
  Synthetic Polynucleotide
taatacgactcactatagggaggcggggggcccgtgcgtccgctccgggaaacagaggagatcccggatgggacgcacgaacctggcggcagcgcaaaagatg

SEQ ID NO: 239668 - DNA, 103 bp, Artificial Sequence
  Synthetic Polynucleotide
taatacgactcactatagggcaccgagggcaggcggggggcccgtgcgtcaacagaggagagacgcaatggccccccgcaacctggcggcagcgcaaaagatg

SEQ ID NO: 239669 - DNA, 103 bp, Artificial Sequence
  Synthetic Polynucleotide
taatacgactcactatagggcattctttgccaccgagggcaggcggggggaacagaggagaccccccatgtgccctcggaacctggcggcagcgcaaaagatg

SEQ ID NO: 239670 - DNA, 103 bp, Artificial Sequence
  Synthetic Polynucleotide
taatacgactcactatagggcaaaggctggcattctttgccaccgagggcaacagaggagagccctcatgggcaaagaaaacctggcggcagcgcaaaagatg

SEQ ID NO: 239671 - DNA, 103 bp, Artificial Sequence
  Synthetic Polynucleotide
taatacgactcactataggggagcaaggagcaaaggctggcattctttgcaacagaggagagcaaagatggccagccttaacctggcggcagcgcaaaagatg

SEQ ID NO: 239672 - DNA, 103 bp, Artificial Sequence
  Synthetic Polynucleotide
taatacgactcactatagggcgggtgaaccgagcaaggagcaaaggctggaacagaggagaccagccatggctccttgcaacctggcggcagcgcaaaagatg

SEQ ID NO: 239673 - DNA, 103 bp, Artificial Sequence
  Synthetic Polynucleotide
taatacgactcactatagggaatcagagtccccgtgcggtggctccggataacagaggagaatccggatgcaccgcacgaacctggcggcagcgcaaaagatg

SEQ ID NO: 239674 - DNA, 103 bp, Artificial Sequence
  Synthetic Polynucleotide
taatacgactcactatagggcacctgagtgcgggtgaaccgagcaaggagaacagaggagactccttatgcggttcaccaacctggcggcagcgcaaaagatg

SEQ ID NO: 239675 - DNA, 103 bp, Artificial Sequence
  Synthetic Polynucleotide
taatacgactcactatagggtcccccctggcacctgagtgcgggtgaaccaacagaggagaggttcaatggcactcaggaacctggcggcagcgcaaaagatg

SEQ ID NO: 239676 - DNA, 103 bp, Artificial Sequence
  Synthetic Polynucleotide
taatacgactcactataggggaccccggcatcccccctggcacctgagtgaacagaggagacactcaatggccagggggaacctggcggcagcgcaaaagatg

SEQ ID NO: 239677 - DNA, 103 bp, Artificial Sequence
  Synthetic Polynucleotide
taatacgactcactataggggccacttttggaccccggcatcccccctggaacagaggagaccagggatgatgccggggaacctggcggcagcgcaaaagatg

SEQ ID NO: 239678 - DNA, 103 bp, Artificial Sequence
  Synthetic Polynucleotide
taatacgactcactatagggggggagaagagccacttttggaccccggcaaacagaggagatgccggatgccaaaagtgaacctggcggcagcgcaaaagatg

SEQ ID NO: 239679 - DNA, 103 bp, Artificial Sequence
  Synthetic Polynucleotide
taatacgactcactatagggaccactcccaggggagaagagccacttttgaacagaggagacaaaagatgctcttctccaacctggcggcagcgcaaaagatg

SEQ ID NO: 239680 - DNA, 103 bp, Artificial Sequence
  Synthetic Polynucleotide
taatacgactcactatagggggcttttgtgaccactcccaggggagaagaaacagaggagatcttctatgctgggagtgaacctggcggcagcgcaaaagatg

SEQ ID NO: 239681 - DNA, 103 bp, Artificial Sequence
  Synthetic Polynucleotide
taatacgactcactataggggcatgctagcggcttttgtgaccactcccaaacagaggagatgggagatgtcacaaaagaacctggcggcagcgcaaaagatg

SEQ ID NO: 239682 - DNA, 103 bp, Artificial Sequence
  Synthetic Polynucleotide
taatacgactcactatagggttattcttaggcatgctagcggcttttgtgaacagaggagacacaaaatgcgctagcataacctggcggcagcgcaaaagatg

SEQ ID NO: 239683 - DNA, 103 bp, Artificial Sequence
  Synthetic Polynucleotide
taatacgactcactatagggatggctctccttattcttaggcatgctagcaacagaggagagctagcatgcctaagaataacctggcggcagcgcaaaagatg

SEQ ID NO: 239684 - DNA, 103 bp, Artificial Sequence
  Synthetic Polynucleotide
taatacgactcactatagggcgtgtccctgaatcagagtccccgtgcggtaacagaggagaaccgcaatgggactctgaaacctggcggcagcgcaaaagatg

SEQ ID NO: 239685 - DNA, 103 bp, Artificial Sequence
  Synthetic Polynucleotide
taatacgactcactataggggacctccggaatggctctccttattcttagaacagaggagactaagaatgaggagagccaacctggcggcagcgcaaaagatg

SEQ ID NO: 239686 - DNA, 103 bp, Artificial Sequence
  Synthetic Polynucleotide
taatacgactcactatagggagagcgcagggacctccggaatggctctccaacagaggagaggagagatgttccggaggaacctggcggcagcgcaaaagatg

SEQ ID NO: 239687 - DNA, 103 bp, Artificial Sequence
  Synthetic Polynucleotide
taatacgactcactataggggggcgcccacagagcgcagggacctccggaaacagaggagatccggaatgccctgcgctaacctggcggcagcgcaaaagatg

SEQ ID NO: 239688 - DNA, 103 bp, Artificial Sequence
  Synthetic Polynucleotide
taatacgactcactatagggcgtcagggccgggcgcccacagagcgcaggaacagaggagacctgcgatgtgtgggcgcaacctggcggcagcgcaaaagatg

SEQ ID NO: 239689 - DNA, 103 bp, Artificial Sequence
  Synthetic Polynucleotide
taatacgactcactatagggtgtcgatacccgtcagggccgggcgcccacaacagaggagagtgggcatgcggccctgaaacctggcggcagcgcaaaagatg

SEQ ID NO: 239690 - DNA, 103 bp, Artificial Sequence
  Synthetic Polynucleotide
taatacgactcactatagggaggtttggtctgtcgatacccgtcagggccaacagaggagaggccctatggggtatcgaaacctggcggcagcgcaaaagatg

SEQ ID NO: 239691 - DNA, 103 bp, Artificial Sequence
  Synthetic Polynucleotide
taatacgactcactatagggggccgtgacaaggtttggtctgtcgataccaacagaggagaggtatcatgagaccaaacaacctggcggcagcgcaaaagatg

SEQ ID NO: 239692 - DNA, 103 bp, Artificial Sequence
  Synthetic Polynucleotide
taatacgactcactatagggtgtggctcctggccgtgacaaggtttggtcaacagaggagagaccaaatgttgtcacggaacctggcggcagcgcaaaagatg

SEQ ID NO: 239693 - DNA, 103 bp, Artificial Sequence
  Synthetic Polynucleotide
taatacgactcactatagggggccgcgccatgtggctcctggccgtgacaaacagaggagatgtcacatgcaggagccaaacctggcggcagcgcaaaagatg

SEQ ID NO: 239694 - DNA, 103 bp, Artificial Sequence
  Synthetic Polynucleotide
taatacgactcactataggggcccctgtgtggccgcgccatgtggctcctaacagaggagaaggagcatgatggcgcggaacctggcggcagcgcaaaagatg

SEQ ID NO: 239695 - DNA, 103 bp, Artificial Sequence
  Synthetic Polynucleotide
taatacgactcactataggggcctccggctcgtgtccctgaatcagagtcaacagaggagagactctatgtcagggacaaacctggcggcagcgcaaaagatg

SEQ ID NO: 239696 - DNA, 103 bp, Artificial Sequence
  Synthetic Polynucleotide
taatacgactcactatagggttggccaggggcccctgtgtggccgcgccaaacagaggagatggcgcatgcacacagggaacctggcggcagcgcaaaagatg

SEQ ID NO: 239697 - DNA, 103 bp, Artificial Sequence
  Synthetic Polynucleotide
taatacgactcactatagggctgcctgggcttggccaggggcccctgtgtaacagaggagaacacagatgcccctggccaacctggcggcagcgcaaaagatg

SEQ ID NO: 239698 - DNA, 103 bp, Artificial Sequence
  Synthetic Polynucleotide
taatacgactcactatagggagctagcctcctgcctgggcttggccagggaacagaggagaccctggatgagcccaggcaacctggcggcagcgcaaaagatg

SEQ ID NO: 239699 - DNA, 103 bp, Artificial Sequence
  Synthetic Polynucleotide
taatacgactcactatagggaccggtttggagctagcctcctgcctgggcaacagaggagagcccagatgggaggctagaacctggcggcagcgcaaaagatg

SEQ ID NO: 239700 - DNA, 103 bp, Artificial Sequence
  Synthetic Polynucleotide
taatacgactcactatagggcggggcaggcaccggtttggagctagcctcaacagaggagagaggctatgtccaaaccgaacctggcggcagcgcaaaagatg

SEQ ID NO: 239701 - DNA, 103 bp, Artificial Sequence
  Synthetic Polynucleotide
taatacgactcactatagggccccgccacccggggcaggcaccggtttggaacagaggagaccaaacatgtgcctgcccaacctggcggcagcgcaaaagatg

SEQ ID NO: 239702 - DNA, 103 bp, Artificial Sequence
  Synthetic Polynucleotide
taatacgactcactatagggctgctgaagcccccgccacccggggcaggcaacagaggagagcctgcatggggtggcggaacctggcggcagcgcaaaagatg

SEQ ID NO: 239703 - DNA, 103 bp, Artificial Sequence
  Synthetic Polynucleotide
taatacgactcactatagggggtggcgctcctgctgaagcccccgccaccaacagaggagaggtggcatgggcttcagcaacctggcggcagcgcaaaagatg

SEQ ID NO: 239704 - DNA, 103 bp, Artificial Sequence
  Synthetic Polynucleotide
taatacgactcactatagggtgggcgtaggggtggcgctcctgctgaagcaacagaggagagcttcaatgggagcgccaaacctggcggcagcgcaaaagatg

SEQ ID NO: 239705 - DNA, 103 bp, Artificial Sequence
  Synthetic Polynucleotide
taatacgactcactataggggcgatgacggtgggcgtaggggtggcgctcaacagaggagagagcgcatgccctacgccaacctggcggcagcgcaaaagatg

SEQ ID NO: 239706 - DNA, 103 bp, Artificial Sequence
  Synthetic Polynucleotide
taatacgactcactatagggcgcctcgcccgcctccggctcgtgtccctgaacagaggagacagggaatggagccggagaacctggcggcagcgcaaaagatg

SEQ ID NO: 239707 - DNA, 103 bp, Artificial Sequence
  Synthetic Polynucleotide
taatacgactcactataggggccagcccgggcgatgacggtgggcgtaggaacagaggagacctacgatgaccgtcatcaacctggcggcagcgcaaaagatg

SEQ ID NO: 239708 - DNA, 103 bp, Artificial Sequence
  Synthetic Polynucleotide
taatacgactcactatagggagggctgcgcgccagcccgggcgatgacggaacagaggagaccgtcaatgcccgggctgaacctggcggcagcgcaaaagatg

SEQ ID NO: 239709 - DNA, 103 bp, Artificial Sequence
  Synthetic Polynucleotide
taatacgactcactatagggctattggccgagggctgcgcgccagcccggaacagaggagaccgggcatgcgcgcagccaacctggcggcagcgcaaaagatg

SEQ ID NO: 239710 - DNA, 103 bp, Artificial Sequence
  Synthetic Polynucleotide
taatacgactcactatagggcacaggcttgctattggccgagggctgcgcaacagaggagagcgcagatgtcggccaataacctggcggcagcgcaaaagatg

SEQ ID NO: 239711 - DNA, 103 bp, Artificial Sequence
  Synthetic Polynucleotide
taatacgactcactatagggcaaacttctccacaggcttgctattggccgaacagaggagacggccaatggcaagcctgaacctggcggcagcgcaaaagatg

SEQ ID NO: 239712 - DNA, 103 bp, Artificial Sequence
  Synthetic Polynucleotide
taatacgactcactatagggggggggaccccaaacttctccacaggcttgaacagaggagacaagccatgggagaagttaacctggcggcagcgcaaaagatg

SEQ ID NO: 239713 - DNA, 103 bp, Artificial Sequence
  Synthetic Polynucleotide
taatacgactcactatagggagcccccgctggggggaccccaaacttctcaacagaggagagagaagatgggggtccccaacctggcggcagcgcaaaagatg

SEQ ID NO: 239714 - DNA, 103 bp, Artificial Sequence
  Synthetic Polynucleotide
taatacgactcactataggggggcaaagccagcccccgctggggggacccaacagaggagagggtccatgcagcgggggaacctggcggcagcgcaaaagatg

SEQ ID NO: 239715 - DNA, 103 bp, Artificial Sequence
  Synthetic Polynucleotide
taatacgactcactatagggttatttgtgggggcaaagccagcccccgctaacagaggagaagcgggatgtggctttgcaacctggcggcagcgcaaaagatg

SEQ ID NO: 239716 - DNA, 103 bp, Artificial Sequence
  Synthetic Polynucleotide
taatacgactcactatagggggcactgtgcttatttgtgggggcaaagccaacagaggagaggctttatgcccacaaataacctggcggcagcgcaaaagatg

SEQ ID NO: 239717 - DNA, 103 bp, Artificial Sequence
  Synthetic Polynucleotide
taatacgactcactatagggcacccagcggcgcctcgcccgcctccggctaacagaggagaagccggatgcgggcgaggaacctggcggcagcgcaaaagatg

SEQ ID NO: 239718 - DNA, 103 bp, Artificial Sequence
  Synthetic Polynucleotide
taatacgactcactataggggggagtccggggcactgtgcttatttgtggaacagaggagaccacaaatgagcacagtgaacctggcggcagcgcaaaagatg

SEQ ID NO: 239719 - DNA, 103 bp, Artificial Sequence
  Synthetic Polynucleotide
taatacgactcactatagggttggctttcagggagtccggggcactgtgcaacagaggagagcacagatgcccggactcaacctggcggcagcgcaaaagatg

SEQ ID NO: 239720 - DNA, 103 bp, Artificial Sequence
  Synthetic Polynucleotide
taatacgactcactatagggagcactgaatttggctttcagggagtccggaacagaggagaccggacatgctgaaagccaacctggcggcagcgcaaaagatg

SEQ ID NO: 239721 - DNA, 103 bp, Artificial Sequence
  Synthetic Polynucleotide
taatacgactcactatagggcctgaggctgagcactgaatttggctttcaaacagaggagatgaaagatgaattcagtgaacctggcggcagcgcaaaagatg

SEQ ID NO: 239722 - DNA, 103 bp, Artificial Sequence
  Synthetic Polynucleotide
taatacgactcactatagggggaggtggaccctgaggctgagcactgaataacagaggagaattcagatgtcagcctcaaacctggcggcagcgcaaaagatg

SEQ ID NO: 239723 - DNA, 103 bp, Artificial Sequence
  Synthetic Polynucleotide
taatacgactcactataggggccctttgcaggaggtggaccctgaggctgaacagaggagacagcctatgggtccacctaacctggcggcagcgcaaaagatg

SEQ ID NO: 239724 - DNA, 103 bp, Artificial Sequence
  Synthetic Polynucleotide
taatacgactcactatagggcgcccccttcgccctttgcaggaggtggacaacagaggagagtccacatgctgcaaaggaacctggcggcagcgcaaaagatg

SEQ ID NO: 239725 - DNA, 103 bp, Artificial Sequence
  Synthetic Polynucleotide
taatacgactcactatagggagaggaggagcgcccccttcgccctttgcaaacagaggagatgcaaaatgcgaagggggaacctggcggcagcgcaaaagatg

SEQ ID NO: 239726 - DNA, 103 bp, Artificial Sequence
  Synthetic Polynucleotide
taatacgactcactataggggcggggaggtagaggaggagcgcccccttcaacagaggagagaagggatggctcctcctaacctggcggcagcgcaaaagatg

SEQ ID NO: 239727 - DNA, 103 bp, Artificial Sequence
  Synthetic Polynucleotide
taatacgactcactatagggaggggggctcgcggggaggtagaggaggagaacagaggagactcctcatgtacctccccaacctggcggcagcgcaaaagatg

SEQ ID NO: 239728 - DNA, 103 bp, Artificial Sequence
  Synthetic Polynucleotide
taatacgactcactataggggggctggggcctcgcctcagctccatctcgaacagaggagacgagatatggctgaggcgaacctggcggcagcgcaaaagatg

SEQ ID NO: 239729 - DNA, 103 bp, Artificial Sequence
  Synthetic Polynucleotide
taatacgactcactataggggcgcgcatctcacccagcggcgcctcgcccaacagaggagagggcgaatggccgctgggaacctggcggcagcgcaaaagatg

SEQ ID NO: 239730 - DNA, 103 bp, Artificial Sequence
  Synthetic Polynucleotide
taatacgactcactataggggctgccttcgaggggggctcgcggggaggtaacagaggagaacctccatgcgagcccccaacctggcggcagcgcaaaagatg

SEQ ID NO: 239731 - DNA, 103 bp, Artificial Sequence
  Synthetic Polynucleotide
taatacgactcactatagggcagctcctgggctgccttcgaggggggctcaacagaggagagagcccatgtcgaaggcaaacctggcggcagcgcaaaagatg

SEQ ID NO: 239732 - DNA, 103 bp, Artificial Sequence
  Synthetic Polynucleotide
taatacgactcactatagggccagagtcctcagctcctgggctgccttcgaacagaggagacgaaggatgcccaggagcaacctggcggcagcgcaaaagatg

SEQ ID NO: 239733 - DNA, 103 bp, Artificial Sequence
  Synthetic Polynucleotide
taatacgactcactataggggcacaggtggccagagtcctcagctcctggaacagaggagaccaggaatggaggactctaacctggcggcagcgcaaaagatg

SEQ ID NO: 239734 - DNA, 103 bp, Artificial Sequence
  Synthetic Polynucleotide
taatacgactcactatagggggaccccgcagcacaggtggccagagtcctaacagaggagaaggactatggccacctgtaacctggcggcagcgcaaaagatg

SEQ ID NO: 239735 - DNA, 103 bp, Artificial Sequence
  Synthetic Polynucleotide
taatacgactcactatagggcgtcgcccctggaccccgcagcacaggtggaacagaggagaccacctatgctgcggggtaacctggcggcagcgcaaaagatg

SEQ ID NO: 239736 - DNA, 103 bp, Artificial Sequence
  Synthetic Polynucleotide
taatacgactcactatagggtgcaaggccgcgtcgcccctggaccccgcaaacagaggagatgcgggatgcaggggcgaaacctggcggcagcgcaaaagatg

SEQ ID NO: 239737 - DNA, 103 bp, Artificial Sequence
  Synthetic Polynucleotide
taatacgactcactataggggggctgggcctgcaaggccgcgtcgcccctaacagaggagaaggggcatggcggccttgaacctggcggcagcgcaaaagatg

SEQ ID NO: 239738 - DNA, 103 bp, Artificial Sequence
  Synthetic Polynucleotide
taatacgactcactatagggcagccacgccgggctgggcctgcaaggccgaacagaggagacggcctatgaggcccagcaacctggcggcagcgcaaaagatg

SEQ ID NO: 239739 - DNA, 103 bp, Artificial Sequence
  Synthetic Polynucleotide
taatacgactcactataggggggggcgccccagccacgccgggctgggccaacagaggagaggcccaatgcggcgtggcaacctggcggcagcgcaaaagatg

SEQ ID NO: 239740 - DNA, 103 bp, Artificial Sequence
  Synthetic Polynucleotide
taatacgactcactataggggccctcggaggcgcgcatctcacccagcggaacagaggagaccgctgatggagatgcgcaacctggcggcagcgcaaaagatg

SEQ ID NO: 239741 - DNA, 103 bp, Artificial Sequence
  Synthetic Polynucleotide
taatacgactcactataggggtgtaggacggggggcgccccagccacgccaacagaggagaggcgtgatgggggcgcccaacctggcggcagcgcaaaagatg

SEQ ID NO: 239742 - DNA, 103 bp, Artificial Sequence
  Synthetic Polynucleotide
taatacgactcactataggggtttgatggagtgtaggacggggggcgcccaacagaggagagggcgcatgccgtcctacaacctggcggcagcgcaaaagatg

SEQ ID NO: 239743 - DNA, 103 bp, Artificial Sequence
  Synthetic Polynucleotide
taatacgactcactatagggaccggctcctgtttgatggagtgtaggacgaacagaggagacgtcctatgctccatcaaaacctggcggcagcgcaaaagatg

SEQ ID NO: 239744 - DNA, 103 bp, Artificial Sequence
  Synthetic Polynucleotide
taatacgactcactatagggcccctcggccaccggctcctgtttgatggaaacagaggagatccatcatgcaggagccgaacctggcggcagcgcaaaagatg

SEQ ID NO: 239745 - DNA, 103 bp, Artificial Sequence
  Synthetic Polynucleotide
taatacgactcactataggggcttctcatgcccctcggccaccggctcctaacagaggagaaggagcatgtggccgaggaacctggcggcagcgcaaaagatg

SEQ ID NO: 239746 - DNA, 103 bp, Artificial Sequence
  Synthetic Polynucleotide
taatacgactcactatagggatgtccaggcgcttctcatgcccctcggccaacagaggagaggccgaatggcatgagaaaacctggcggcagcgcaaaagatg

SEQ ID NO: 239747 - DNA, 103 bp, Artificial Sequence
  Synthetic Polynucleotide
taatacgactcactataggggatgttgaggatgtccaggcgcttctcatgaacagaggagacatgagatgcgcctggacaacctggcggcagcgcaaaagatg

SEQ ID NO: 239748 - DNA, 103 bp, Artificial Sequence
  Synthetic Polynucleotide
taatacgactcactatagggacgtcttaaagatgttgaggatgtccaggcaacagaggagagcctggatgtcctcaacaaacctggcggcagcgcaaaagatg

SEQ ID NO: 239749 - DNA, 103 bp, Artificial Sequence
  Synthetic Polynucleotide
taatacgactcactatagggtttggaatgtacgtcttaaagatgttgaggaacagaggagacctcaaatgctttaagacaacctggcggcagcgcaaaagatg

SEQ ID NO: 239750 - DNA, 103 bp, Artificial Sequence
  Synthetic Polynucleotide
taatacgactcactatagggcgcaaagtcctttggaatgtacgtcttaaaaacagaggagatttaagatgtacattccaaacctggcggcagcgcaaaagatg

SEQ ID NO: 239751 - DNA, 103 bp, Artificial Sequence
  Synthetic Polynucleotide
taatacgactcactatagggaggcgtccaggccctcggaggcgcgcatctaacagaggagaagatgcatgcctccgaggaacctggcggcagcgcaaaagatg

SEQ ID NO: 239752 - DNA, 103 bp, Artificial Sequence
  Synthetic Polynucleotide
taatacgactcactatagggggtagagggtcgcaaagtcctttggaatgtaacagaggagaacattcatgaggactttgaacctggcggcagcgcaaaagatg

SEQ ID NO: 239753 - DNA, 103 bp, Artificial Sequence
  Synthetic Polynucleotide
taatacgactcactatagggccccatccctggtagagggtcgcaaagtccaacagaggagaggacttatggaccctctaaacctggcggcagcgcaaaagatg

SEQ ID NO: 239754 - DNA, 103 bp, Artificial Sequence
  Synthetic Polynucleotide
taatacgactcactataggggccgctgacaccccatccctggtagagggtaacagaggagaaccctcatgcagggatggaacctggcggcagcgcaaaagatg

SEQ ID NO: 239755 - DNA, 103 bp, Artificial Sequence
  Synthetic Polynucleotide
taatacgactcactatagggccaacccagggccgctgacaccccatccctaacagaggagaagggatatggtgtcagcgaacctggcggcagcgcaaaagatg

SEQ ID NO: 239756 - DNA, 103 bp, Artificial Sequence
  Synthetic Polynucleotide
taatacgactcactatagggcctctgtgctccaacccagggccgctgacaaacagaggagatgtcagatgccctgggttaacctggcggcagcgcaaaagatg

SEQ ID NO: 239757 - DNA, 103 bp, Artificial Sequence
  Synthetic Polynucleotide
taatacgactcactatagggccggagtgtccctctgtgctccaacccaggaacagaggagacctgggatggagcacagaaacctggcggcagcgcaaaagatg

SEQ ID NO: 239758 - DNA, 103 bp, Artificial Sequence
  Synthetic Polynucleotide
taatacgactcactataggggggcctgcgtccggagtgtccctctgtgctaacagaggagaagcacaatgggacactccaacctggcggcagcgcaaaagatg

SEQ ID NO: 239759 - DNA, 103 bp, Artificial Sequence
  Synthetic Polynucleotide
taatacgactcactatagggtctcctggccgggcctgcgtccggagtgtcaacagaggagagacactatggacgcaggcaacctggcggcagcgcaaaagatg

SEQ ID NO: 239760 - DNA, 103 bp, Artificial Sequence
  Synthetic Polynucleotide
taatacgactcactataggggcagacgaactctcctggccgggcctgcgtaacagaggagaacgcagatgcggccaggaaacctggcggcagcgcaaaagatg

SEQ ID NO: 239761 - DNA, 103 bp, Artificial Sequence
  Synthetic Polynucleotide
taatacgactcactatagggcgcactcgatgcagacgaactctcctggccaacagaggagaggccagatgagttcgtctaacctggcggcagcgcaaaagatg

SEQ ID NO: 239762 - DNA, 103 bp, Artificial Sequence
  Synthetic Polynucleotide
taatacgactcactataggggggctggcgcaggcgtccaggccctcggagaacagaggagactccgaatgcctggacgcaacctggcggcagcgcaaaagatg

SEQ ID NO: 239763 - DNA, 103 bp, Artificial Sequence
  Synthetic Polynucleotide
taatacgactcactatagggaagctctttccgcactcgatgcagacgaacaacagaggagagttcgtatgcatcgagtgaacctggcggcagcgcaaaagatg

SEQ ID NO: 239764 - DNA, 103 bp, Artificial Sequence
  Synthetic Polynucleotide
taatacgactcactataggggggctggtggaagctctttccgcactcgataacagaggagaatcgagatgggaaagagcaacctggcggcagcgcaaaagatg

SEQ ID NO: 239765 - DNA, 103 bp, Artificial Sequence
  Synthetic Polynucleotide
taatacgactcactatagggtgaggtggccgggctggtggaagctctttcaacagaggagagaaagaatgtccaccagcaacctggcggcagcgcaaaagatg

SEQ ID NO: 239766 - DNA, 103 bp, Artificial Sequence
  Synthetic Polynucleotide
taatacgactcactatagggatgtgggccctgaggtggccgggctggtggaacagaggagaccaccaatgcggccacctaacctggcggcagcgcaaaagatg

SEQ ID NO: 239767 - DNA, 103 bp, Artificial Sequence
  Synthetic Polynucleotide
taatacgactcactataggggtgtgcccgcatgtgggccctgaggtggccaacagaggagaggccacatgagggcccacaacctggcggcagcgcaaaagatg

SEQ ID NO: 239768 - DNA, 103 bp, Artificial Sequence
  Synthetic Polynucleotide
taatacgactcactatagggacaccactgagtgtgcccgcatgtgggcccaacagaggagagggcccatgtgcgggcacaacctggcggcagcgcaaaagatg

SEQ ID NO: 239769 - DNA, 103 bp, Artificial Sequence
  Synthetic Polynucleotide
taatacgactcactatagggtcggactcaaacaccactgagtgtgcccgcaacagaggagagcgggcatgctcagtggtaacctggcggcagcgcaaaagatg

SEQ ID NO: 239770 - DNA, 103 bp, Artificial Sequence
  Synthetic Polynucleotide
taatacgactcactatagggccgaggcccatcggactcaaacaccactgaaacagaggagatcagtgatgtttgagtccaacctggcggcagcgcaaaagatg

SEQ ID NO: 239771 - DNA, 103 bp, Artificial Sequence
  Synthetic Polynucleotide
taatacgactcactatagggcttcagaaccccgaggcccatcggactcaaaacagaggagattgagtatgatgggcctcaacctggcggcagcgcaaaagatg

SEQ ID NO: 239772 - DNA, 103 bp, Artificial Sequence
  Synthetic Polynucleotide
taatacgactcactataggggtggtatgaacttcagaaccccgaggcccaaacagaggagatgggccatggggttctgaaacctggcggcagcgcaaaagatg

SEQ ID NO: 239773 - DNA, 103 bp, Artificial Sequence
  Synthetic Polynucleotide
taatacgactcactataggggctcttggtggggctggcgcaggcgtccagaacagaggagactggacatgtgcgccagcaacctggcggcagcgcaaaagatg

SEQ ID NO: 239774 - DNA, 103 bp, Artificial Sequence
  Synthetic Polynucleotide
taatacgactcactataggggtctgcggaggtggtatgaacttcagaaccaacagaggagaggttctatggttcataccaacctggcggcagcgcaaaagatg

SEQ ID NO: 239775 - DNA, 103 bp, Artificial Sequence
  Synthetic Polynucleotide
taatacgactcactataggggtttgggggcgtctgcggaggtggtatgaaaacagaggagattcataatgcctccgcagaacctggcggcagcgcaaaagatg

SEQ ID NO: 239776 - DNA, 103 bp, Artificial Sequence
  Synthetic Polynucleotide
taatacgactcactatagggtctctcccttgtttgggggcgtctgcggagaacagaggagactccgcatgcgcccccaaaacctggcggcagcgcaaaagatg

SEQ ID NO: 239777 - DNA, 103 bp, Artificial Sequence
  Synthetic Polynucleotide
taatacgactcactataggggttagaatggtctctcccttgtttgggggcaacagaggagagcccccatgcaagggagaaacctggcggcagcgcaaaagatg

SEQ ID NO: 239778 - DNA, 103 bp, Artificial Sequence
  Synthetic Polynucleotide
taatacgactcactatagggcggtacctgtgttagaatggtctctcccttaacagaggagaaagggaatgaccattctaaacctggcggcagcgcaaaagatg

SEQ ID NO: 239779 - DNA, 103 bp, Artificial Sequence
  Synthetic Polynucleotide
taatacgactcactatagggactgtctggacggtacctgtgttagaatggaacagaggagaccattcatgcacaggtacaacctggcggcagcgcaaaagatg

SEQ ID NO: 239780 - DNA, 103 bp, Artificial Sequence
  Synthetic Polynucleotide
taatacgactcactatagggtctcagaggcactgtctggacggtacctgtaacagaggagaacaggtatggtccagacaaacctggcggcagcgcaaaagatg

SEQ ID NO: 239781 - DNA, 103 bp, Artificial Sequence
  Synthetic Polynucleotide
taatacgactcactatagggaggttccctttctcagaggcactgtctggaaacagaggagatccagaatgtgcctctgaaacctggcggcagcgcaaaagatg

SEQ ID NO: 239782 - DNA, 103 bp, Artificial Sequence
  Synthetic Polynucleotide
taatacgactcactatagggaggccgaggcgctcttggtggggctggcgcaacagaggagagcgccaatgccaccaagaaacctggcggcagcgcaaaagatg

SEQ ID NO: 239783 - DNA, 103 bp, Artificial Sequence
  Synthetic Polynucleotide
taatacgactcactatagggagccggttgcaggccgaggcgctcttggtgaacagaggagacaccaaatgcgcctcggcaacctggcggcagcgcaaaagatg

SEQ ID NO: 239784 - DNA, 103 bp, Artificial Sequence
  Synthetic Polynucleotide
taatacgactcactatagggcccgttcagcagccggttgcaggccgaggcaacagaggagagcctcgatgtgcaaccggaacctggcggcagcgcaaaagatg

SEQ ID NO: 239785 - DNA, 103 bp, Artificial Sequence
  Synthetic Polynucleotide
taatacgactcactatagggcctgcgaggccccgttcagcagccggttgcaacagaggagagcaaccatgtgctgaacgaacctggcggcagcgcaaaagatg

SEQ ID NO: 239786 - DNA, 103 bp, Artificial Sequence
  Synthetic Polynucleotide
taatacgactcactataggggcgccgtcggcctgcgaggccccgttcagcaacagaggagagctgaaatgggcctcgcaaacctggcggcagcgcaaaagatg

SEQ ID NO: 239787 - DNA, 103 bp, Artificial Sequence
  Synthetic Polynucleotide
taatacgactcactatagggggccctggtggggctggggcctcgcctcagaacagaggagactgaggatgggccccagcaacctggcggcagcgcaaaagatg

SEQ ID NO: 239788 - DNA, 103 bp, Artificial Sequence
  Synthetic Polynucleotide
taatacgactcactatagggcaggaccctggcgccgtcggcctgcgaggcaacagaggagagcctcgatggccgacggcaacctggcggcagcgcaaaagatg

SEQ ID NO: 239789 - DNA, 103 bp, Artificial Sequence
  Synthetic Polynucleotide
taatacgactcactatagggaggccccgttcaggaccctggcgccgtcggaacagaggagaccgacgatgccagggtccaacctggcggcagcgcaaaagatg

SEQ ID NO: 239790 - DNA, 103 bp, Artificial Sequence
  Synthetic Polynucleotide
taatacgactcactatagggtcggcctgcgaggccccgttcaggaccctgaacagaggagacagggtatggaacggggcaacctggcggcagcgcaaaagatg

SEQ ID NO: 239791 - DNA, 103 bp, Artificial Sequence
  Synthetic Polynucleotide
taatacgactcactatagggtctgccgctgtcggcctgcgaggccccgttaacagaggagaaacgggatgtcgcaggccaacctggcggcagcgcaaaagatg

SEQ ID NO: 239792 - DNA, 103 bp, Artificial Sequence
  Synthetic Polynucleotide
taatacgactcactataggggcagcaggactctgccgctgtcggcctgcgaacagaggagacgcaggatgacagcggcaaacctggcggcagcgcaaaagatg

SEQ ID NO: 239793 - DNA, 103 bp, Artificial Sequence
  Synthetic Polynucleotide
taatacgactcactatagggttgctgctccgcagcaggactctgccgctgaacagaggagacagcggatgagtcctgctaacctggcggcagcgcaaaagatg
